United States Patent 11,078,247 (RNA ENCODING A THERAPEUTIC PROTEIN) - sequence listing, part 11

SEQ ID NO: 21257 - RNA, 2805 nt, Artificial Sequence
  PCDHGC3__Homo_sapiens__NP_002579
auggugcccgaggccuggagaagcggccuggugagcaccggcagaguggugggcgugcugcugcugcugggcgcccugaacaaggccagcaccgugauccacuacgagauccccgaggagagagagaagggcuucgccgugggcaacgugguggccaaccugggccuggaccugggcagccugagcgccagaagauucagaguggugagcggcgccagcagaagauucuucgaggugaacagagagaccggcgagauguucgugaacgacagacuggacagagaggagcugugcggcacccugcccagcugcaccgugacccuggagcuggugguggagaacccccuggagcuguucagcguggagguggugauccaggacaucaacgacaacaaccccgccuuccccacccaggagaugaagcuggagaucagcgaggccguggcccccggcaccagauucccccuggagagcgcccacgaccccgacgugggcagcaacagccugcagaccuacgagcugagcagaaacgaguacuucgcccugagagugcagaccagagaggacagcaccaaguacgccgagcuggugcuggagagagcccuggacagagagagagagcccagccugcagcuggugcugaccgcccuggacggcggcacccccgcccugagcgccagccugcccauccacaucaaggugcuggacgccaacgacaacgcccccguguucaaccagagccuguacagagccagagugcuggaggacgcccccagcggcaccagaguggugcaggugcuggccaccgaccuggacgagggccccaacggcgagaucaucuacagcuucggcagccacaacagagccggcgugagacagcuguucgcccuggaccuggugaccggcaugcugaccaucaagggcagacuggacuucgaggacaccaagcugcacgagaucuacauccaggccaaggacaagggcgccaaccccgagggcgcccacugcaaggugcugguggaggugguggacgugaacgacaacgcccccgagaucaccgugaccagcguguacagccccgugcccgaggacgccccccugggcaccgugaucgcccugcugagcgugaccgaccuggacgccggcgagaacggccuggugaccugcgaggugccccccggccugcccuucagccugaccagcagccugaagaacuacuucacccugaagaccagcgccgaccuggacagagagaccgugcccgaguacaaccugagcaucaccgccagagacgccggcacccccagccugagcgcccugaccaucgugagagugcaggugagcgacaucaacgacaaccccccccagagcagccagagcagcuacgacguguacaucgaggagaacaaccugcccggcgcccccauccugaaccugagcgugugggaccccgacgccccccagaacgccagacugagcuucuuccugcuggagcagggcgccgagaccggccuggugggcagauacuucaccaucaacagagacaacggcaucgugagcagccuggugccccuggacuacgaggacagaagagaguucgagcugaccgcccacaucagcgacggcggcacccccgugcuggccaccaacaucagcgugaacaucuucgugaccgacagaaacgacaacgccccccaggugcuguaccccagacccggcggcagcagcguggagaugcugcccagaggcaccagcgccggccaccuggugagcagaguggugggcugggacgccgacgccggccacaacgccuggcugagcuacagccugcugggcagccccaaccagagccuguucgccaucggccugcacaccggccagaucagcaccgccagacccgugcaggacaccgacagccccagacagacccugaccgugcugaucaaggacaacggcgagcccagccugagcaccaccgccacccugaccgugagcgugaccgaggacagccccgaggccagagccgaguuccccagcggcagcgcccccagagagcagaagaagaaccugaccuucuaccugcugcugagccugauccuggugagcgugggcuucguggugaccguguucggcgugaucaucuucaagguguacaaguggaagcagagcagagaccuguacagagcccccgugagcagccuguacagaacccccggccccagccugcacgccgacgccgugagaggcggccugaugagcccccaccuguaccaccagguguaccugaccaccgacagcagaagaagcgacccccugcugaagaagcccggcgccgccagcccccuggccagcagacagaacacccugagaagcugcgaccccguguucuacagacaggugcugggcgccgagagcgccccccccggccagcaggccccccccaacaccgacuggagauucagccaggcccagagacccggcaccagcggcagccagaacggcgacgacaccggcaccuggcccaacaaccaguucgacaccgagaugcugcaggccaugauccuggccagcgccagcgaggccgccgacggcagcagcacccugggcggcggcgccggcaccaugggccugagcgccagauacggcccccaguucacccugcagcacgugcccgacuacagacagaacguguacauccccggcagcaacgccacccugaccaacgccgccggcaagagagacggcaaggcccccgccggcggcaacggcaacaagaagaagagcggcaagaaggagaagaaguaa

SEQ ID NO: 21258 - RNA, 1299 nt, Artificial Sequence
  PCED1B__Homo_sapiens__NP_001268358
augauccugcugagagccagcgaggugagacagcugcugcacaacaaguucguggugauccugggcgacagcgugcacagagccguguacaaggaccuggugcugcugcugcagaaggacagacugcugacccccggccagcugagagccagaggcgagcugaacuucgagcaggacgagcugguggacggcggccagagaggccacaugcacaacggccugaacuacagagaggugagagaguucagaagcgaccaccaccuggugagauucuacuuccugaccagaguguacagcgacuaccugcagaccauccugaaggagcugcagagcggcgagcacgcccccgaccuggugaucaugaacagcugccugugggacaucagcagauacggccccaacagcuggagaagcuaccuggagaaccuggagaaccuguuccagugccugggccaggugcugcccgagagcugccugcugguguggaacaccgccaugcccgugggcgaggaggugaccggcggcuuccugccccccaagcugagaagacagaaggccaccuuccugaagaacgagguggugaaggccaacuuccacagcgccaccgaggccagaaagcacaacuucgacgugcuggaccugcacuuccacuucagacacgccagagagaaccugcacugggacggcgugcacuggaacggcagagugcacagaugccugagccagcugcugcuggcccacguggccgacgccuggggcguggagcugccccacagacaccccgugggcgaguggaucaagaagaagaagcccggccccagaguggagggccccccccaggccaacagaaaccaccccgcccugccccugagccccccccugcccagccccaccuacagaccccugcugggcuuccccccccagagacugccccugcugccccugcugagcccccagccccccccccccauccugcaccaccagggcaugcccagauucccccagggcccccccgacgccugcuucagcagcgaccacaccuuccagagcgaccaguucuacugccacagcgacgugcccagcagcgcccacgccggcuucuucguggaggacaacuucauggugggcccccagcugcccaugcccuucuuccccacccccagauaccagagacccgcccccguggugcacagaggcuucggcagauacagacccagaggccccuacacccccuggggccagagacccagacccagcaagagaagagcccccgccaaccccgagcccagaccccaguaa

SEQ ID NO: 21259 - RNA, 4668 nt, Artificial Sequence
  PCF11__Homo_sapiens__NP_056969
augagcgagcagacccccgccgaggccggcgccgccggcgccagagaggacgccugcagagacuaccagagcagccuggaggaccugaccuucaacagcaagccccacaucaacaugcugaccauccuggccgaggagaaccugcccuucgccaaggagaucgugagccugaucgaggcccagaccgccaaggcccccagcagcgagaagcugcccgugauguaccugauggacagcaucgugaagaacgugggcagagaguaccugaccgccuucaccaagaaccugguggccaccuucaucugcguguucgagaagguggacgagaacaccagaaagagccuguucaagcugagaagcaccugggacgagaucuucccccugaagaagcuguacgcccuggacgugagagugaacagccuggaccccgccuggcccaucaagccccugccccccaacgugaacaccagcagcauccacgugaaccccaaguuccugaacaagagccccgaggagcccagcacccccggcaccguggugagcagccccagcaucagcaccccccccaucgugcccgacauccagaagaaccugacccaggagcagcugaucagacagcagcugcuggccaagcagaagcagcugcuggagcugcagcagaagaagcuggagcuggagcuggagcaggccaaggcccagcuggccgugagccugagcgugcagcaggagaccagcaaccugggccccggcagcgcccccagcaagcugcacgugagccagaucccccccauggccgugaaggccccccaccaggugcccgugcagagcgagaagagcagacccggccccagccugcagauccaggaccugaagggcaccaacagagaccccagacugaacagaaucagccagcacagccacggcaaggaccagagccacagaaaggaguuccugaugaacacccugaaccagagcgacaccaagaccagcaagaccauccccagcgagaagcugaacagcagcaagcaggagaagagcaagagcggcgagaagaucaccaagaaggagcuggaccagcuggacagcaagagcaagagcaagagcaagagccccagcccccugaagaacaagcugagccacaccaaggaccugaagaaccaggagagcgagagcaugagacugagcgacaugaacaagagagaccccagacugaagaagcaccugcaggacaagaccgacggcaaggacgacgacgugaaggagaagagaaagaccgccgagaagaaggacaaggacgagcacaugaagagcagcgagcacagacuggccggcagcagaaacaagaucaucaacggcaucgugcagaagcaggacaccaucaccgaggagagcgagaagcagggcaccaagcccggcagaagcagcaccagaaagagaagcagaagcagaagccccaagagcagaagccccaucauccacagccccaagagaagagacagaagaagccccaagagaagacagagaagcaugagccccaccagcacccccaaggccggcaagaucagacagagcggcgccaagcagagccacauggaggaguucaccccccccagcagagaggacagaaacgccaagagaagcaccaagcaggacaucagagaccccagaagaaugaagaagaccgaggaggagagaccccaggagaccaccaaccagcacagcaccaagagcggcaccgagcccaaggagaacguggagaacuggcagagcagcaagagcgccaagagauggaagagcggcugggaggagaacaagagccugcagcagguggacgagcacagcaagcccccccaccugagacacagagagagcuggagcagcaccaagggcauccugagccccagagcccccaagcagcagcagcacagacugagcguggacgccaaccugcagauccccaaggagcugacccuggccagcaagagagagcugcugcagaagaccagcgagagacuggccagcggcgagaucacccaggacgacuuccuggugguggugcaccagaucagacagcuguuccaguaccaggagggcgugagagaggagcagagaagccccuucaacgacagauucccccugaagagacccagauacgaggacagcgacaagcccuucguggacagccccgccagcagauucgccggccuggacaccaaccagagacugaccgcccuggccgaggacagaccccuguucgacggccccagcagacccagcguggccagagacggccccaccaagaugaucuucgagggccccaacaagcugagccccagaaucgacggcccccccacccccgccagccugagauucgacggcagccccggccagaugggcggcggcggcccccugagauucgagggcccccagggccagcugggcggcggcugcccccugagauucgagggcccccccggccccgugggcaccccccugagauucgagggccccaucggccaggccggcggcggcggcuucagauucgagggcagccccggccugagauucgagggcagccccggcggccugagauucgagggccccggcggccagcccgugggcggccugagauucgagggccacagaggccagcccgugggcggccugagauucgagggcccccacggccagcccgugggcggccugagauucgacaaccccagaggccagcccgugggcggccugagauucgagggcggccacggccccagcggcgccgccaucagauucgacggcccccacggccagcccggcggcggcaucagauucgagggcccccugcugcagcagggcgugggcaugagauucgagggcccccacggccagagcguggccggccugagauucgagggccagcacaaccagcugggcggcaaccugagauucgagggcccccacggccagcccggcgugggcaucagauucgagggcccccuggugcagcagggcggcggcaugagauucgagggccccagcgugcccggcggcggccugagaaucgagggcccccugggccagggcggccccagauucgagggcugccacgcccugagauucgacggccagcccggccagcccagccugcugcccagauucgacggccugcacggccagcccggccccagauucgagagaacccccggccagcccggcccccagagauucgacggcccccccggccagcaggugcagcccagauucgacggcgugccccagagauucgacggcccccagcaccagcaggccagcagauucgacaucccccugggccugcagggcaccagauucgacaaccaccccagccagagacuggagagcgugagcuucaaccagaccggccccuacaacgacccccccggcaacgccuucaacgcccccagccagggccugcaguuccagagacacgagcagaucuucgacagcccccagggccccaacuucaacggcccccacggccccggcaaccagagcuucagcaacccccugaacagagccagcggccacuacuucgacgagaagaaccugcagagcagccaguucggcaacuucggcaacauccccgcccccaugaccgugggcaacauccaggccagccagcaggugcugagcggcguggcccagcccguggccuucggccagggccagcaguuccugcccgugcacccccagaaccccggcuucgugcagaaccccagcggcgcccugcccaaggccuaccccgacaaccaccugagccagguggacgugaacgagcuguucagcaagcugcugaagaccggcauccugaagcugagccagaccgacagcgccaccacccaggugagcgaggugaccgcccagcccccccccgaggaggaggaggaccagaacgaggaccaggacgugcccgaccugaccaacuucaccguggaggagcugaagcagagauacgacagcgugaucaacagacuguacaccggcauccagugcuacagcugcggcaugagauucaccaccagccagaccgacguguacgccgaccaccuggacuggcacuacagacagaacagaaccgagaaggacgugagcagaaaggugacccacagaagaugguacuacagccugaccgacuggaucgaguucgaggagaucgccgaccuggaggagagagccaagagccaguucuucgagaaggugcacgaggagguggugcugaagacccaggaggccgccaaggagaaggaguuccagagcgugcccgccggccccgccggcgccguggagagcugcgagaucugccaggagcaguucgagcaguacugggacgaggaggaggaggaguggcaccugaagaacgccaucagaguggacggcaagaucuaccaccccagcugcuacgaggacuaccagaacaccagcagcuucgacugcacccccagccccagcaagacccccguggagaacccccugaacaucaugcugaacaucgugaagaacgagcugcaggagcccugcgacagccccaaggugaaggaggagagaaucgacaccccccccgccugcaccgaggagagcaucgccacccccagcgagaucaagaccgagaacgacaccguggagagcguguaa

SEQ ID NO: 21260 - RNA, 780 nt, Artificial Sequence
  PCGF1__Homo_sapiens__NP_116062
auggccagcccccagggcggccagaucgccaucgccaugagacugagaaaccagcugcagagcguguacaagauggacccccugagaaacgaggaggaggugagagugaagaucaaggaccugaacgagcacaucgugugcugccugugcgccggcuacuucguggacgccaccaccaucaccgagugccugcacaccuucugcaagagcugcaucgugaaguaccugcagaccagcaaguacugccccaugugcaacaucaagauccacgagacccagccccugcugaaccugaagcuggacagagugaugcaggacaucguguacaagcuggugcccggccugcaggacagcgaggagaagagaaucagagaguucuaccagagcagaggccuggacagagugacccagcccaccggcgaggagcccgcccugagcaaccugggccugcccuucagcagcuucgaccacagcaaggcccacuacuacagauacgacgagcagcugaaccugugccuggagagacugagcagcggcaaggacaagaacaagagcgugcugcagaacaaguacgugagaugcagcgugagagccgaggugagacaccugagaagagugcugugccacagacugaugcugaacccccagcacgugcagcugcuguucgacaacgaggugcugcccgaccacaugaccaugaagcagaucuggcugagcagaugguucggcaagcccagcccccugcugcugcaguacagcgugaaggagaagagaagauaa

SEQ ID NO: 21261 - RNA, 1035 nt, Artificial Sequence
  PCGF2__Homo_sapiens__XP_005257698
augcacagaaccaccagaaucaagaucaccgagcugaacccccaccugaugugcgcccugugcggcggcuacuucaucgacgccaccaccaucguggagugccugcacagcuucugcaagaccugcaucgugagauaccuggagaccaacaaguacugccccaugugcgacgugcaggugcacaagaccagaccccugcugagcaucagaagcgacaagacccugcaggacaucguguacaagcuggugcccggccuguucaaggacgagaugaagagaagaagagacuucuacgccgccuacccccugaccgaggugcccaacggcagcaacgaggacagaggcgaggugcuggagcaggagaagggcgcccugagcgacgacgagaucgugagccugagcaucgaguucuacgagggcgccagagacagagacgagaagaagggcccccuggagaacggcgacggcgacaaggagaagaccggcgugagauuccugagaugccccgccgccaugaccgugaugcaccuggccaaguuccugagaaacaagauggacgugcccagcaaguacaagguggaggugcuguacgaggacgagccccugaaggaguacuacacccugauggacaucgccuacaucuaccccuggagaagaaacggcccccugccccugaaguacagagugcagcccgccugcaagagacugacccuggccaccgugcccacccccagcgagggcaccaacaccagcggcgccagcgagugcgagagcgugagcgacaaggcccccagccccgccacccugcccgccaccagcagcagccugcccagccccgccacccccagccacggcagccccagcagccacggcccccccgccacccaccccaccagccccaccccccccagcaccgccagcggcgccaccaccgccgccaacggcggcagccugaacugccugcagacccccagcagcaccagcagaggcagaaagaugaccgugaacggcgcccccgugcccccccugaccuaa

SEQ ID NO: 21262 - RNA, 627 nt, Artificial Sequence
  PCGF3__Homo_sapiens__XP_006713915
augaccgugugcagaagcugccuggugaaguaccuggaggagaacaacaccugccccaccugcagaaucgugauccaccagagccacccccugcaguacaucggccacgacagaaccaugcaggacaucguguacaagcuggugcccggccugcaggaggccgagaugagaaagcagagagaguucuaccacaagcugggcauggaggugcccggcgacaucaagggcgagaccugcagcgccaagcagcaccuggacagccacagaaacggcgagaccaaggccgacgacagcagcaacaaggaggccgccgaggagaagcccgaggaggacaacgacuaccacagaagcgacgagcaggugagcaucugccuggagugcaacagcagcaagcugagaggccugaagagaaaguggaucagaugcagcgcccaggccaccgugcugcaccugaagaaguucaucgccaagaagcugaaccugagcagcuucaacgagcuggacauccugugcaacgaggagauccugggcaaggaccacacccugaaguucgugguggugaccagauggagauucaagaaggccccccugcugcugcacuacagacccaagauggaccugcuguaa

SEQ ID NO: 21263 - RNA, 1053 nt, Artificial Sequence
  PCGF6__Homo_sapiens__NP_001011663
auggagggcguggccguggugaccgccggcagcgugggcgccgccaagaccgagggcgccgccgcccugcccccccccccccccgugagcccccccgcccugacccccgcccccgccgccggcgaggagggccccgccccccugagcgagaccggcgcccccggcugcagcggcagcagaccccccgagcuggagcccgagagaagccugggcagauucagaggcagauucgaggacgaggacgaggagcuggaggaggaggaggagcuggaggaggaggaggaggaggaggaggaggacaugagccacuucagccugagacuggagggcggcagacaggacagcgaggacgaggaggagagacugaucaaccugagcgagcugacccccuacauccugugcagcaucugcaagggcuaccugaucgacgccaccaccaucaccgagugccugcacaccuucugcaagagcugcaucgugagacacuucuacuacagcaacagaugccccaagugcaacaucguggugcaccagacccagccccuguacaacaucagacuggacagacagcugcaggacaucguguacaagcuggugaucaaccuggaggagagagagaagaagcagaugcacgacuucuacaaggagagaggccuggaggugcccaagcccgccgugccccagcccgugcccagcagcaagggcagaagcaagaaggugcuggagagcguguucagaaucccccccgagcuggacaugagccugcugcuggaguucaucggcgccaacgagggcaccggccacuucaagccccuggagaagaaguucgugagagugagcggcgaggccaccaucggccacguggagaaguuccugagaagaaagaugggccuggaccccgccugccagguggacaucaucugcggcgaccaccugcuggagcaguaccagacccugagagagaucagaagagccaucggcgacgccgccaugcaggacggccugcuggugcugcacuacggccugguggugagcccccugaagaucaccuaa

SEQ ID NO: 21264 - RNA, 3537 nt, Artificial Sequence
  PC__Homo_sapiens__XP_011543388
augcugaaguucagaaccgugcacggcggccugagacugcugggcaucagaagaaccagcaccgcccccgccgccagccccaacgugagaagacuggaguacaagcccaucaagaaggugaugguggccaacagaggcgagaucgccaucagaguguucagagccugcaccgagcugggcaucagaaccguggccaucuacagcgagcaggacaccggccagaugcacagacagaaggccgacgaggccuaccugaucggcagaggccuggcccccgugcaggccuaccugcacauccccgacaucaucaagguggccaaggagaacaacguggacgccgugcaccccggcuacggcuuccugagcgagagagccgacuucgcccaggccugccaggacgccggcgugagauucaucggccccagccccgagguggugagaaagaugggcgacaagguggaggccagagccaucgccaucgccgccggcgugcccguggugcccggcaccgacgcccccaucaccagccugcacgaggcccacgaguucagcaacaccuacggcuuccccaucaucuucaaggccgccuacggcggcggcggcagaggcaugagaguggugcacagcuacgaggagcuggaggagaacuacaccagagccuacagcgaggcccuggccgccuucggcaacggcgcccuguucguggagaaguucaucgagaagcccagacacaucgaggugcagauccugggcgaccaguacggcaacauccugcaccuguacgagagagacugcagcauccagagaagacaccagaaggugguggagaucgcccccgccgcccaccuggacccccagcugagaaccagacugaccagcgacagcgugaagcuggccaagcaggugggcuacgagaacgccggcaccguggaguuccugguggacagacacggcaagcacuacuucaucgaggugaacagcagacugcagguggagcacaccgugaccgaggagaucaccgacguggaccuggugcacgcccagauccacguggccgagggcagaagccugcccgaccugggccugagacaggagaacaucagaaucaacggcugcgccauccagugcagagugaccaccgaggaccccgccagaagcuuccagcccgacaccggcagaaucgagguguucagaagcggcgagggcaugggcaucagacuggacaacgccagcgccuuccagggcgccgugaucagcccccacuacgacagccugcuggugaaggugaucgcccacggcaaggaccaccccaccgccgccaccaagaugagcagagcccuggccgaguucagagugagaggcgugaagaccaacaucgccuuccugcagaacgugcugaacaaccagcaguuccuggccggcaccguggacacccaguucaucgacgagaaccccgagcuguuccagcugagacccgcccagaacagagcccagaagcugcugcacuaccugggccacgugauggugaacggccccaccacccccauccccgugaaggccagccccagccccaccgaccccguggugcccgccgugcccaucggccccccccccgccggcuucagagacauccugcugagagagggccccgagggcuucgccagagccgugagaaaccaccccggccugcugcugauggacaccaccuucagagacgcccaccagagccugcuggccaccagagugagaacccacgaccugaagaagaucgcccccuacguggcccacaacuucagcaagcuguucagcauggagaacuggggcggcgccaccuucgacguggccaugagauuccuguacgagugccccuggagaagacugcaggagcugagagagcugauccccaacauccccuuccagaugcugcugagaggcgccaacgccgugggcuacaccaacuaccccgacaacgugguguucaaguucugcgagguggccaaggagaacggcauggacguguucagaguguucgacagccugaacuaccugcccaacaugcugcugggcauggaggccgccggcagcgccggcggcgugguggaggccgccaucagcuacaccggcgacguggccgaccccagcagaaccaaguacagccugcaguacuacaugggccuggccgaggagcuggugagagccggcacccacauccugugcaucaaggacauggccggccugcugaagcccaccgccugcaccaugcuggugagcagccugagagacagauuccccgaccugccccugcacauccacacccacgacaccagcggcgccggcguggccgccaugcuggccugcgcccaggccggcgccgacgugguggacguggccgccgacagcaugagcggcaugaccagccagcccagcaugggcgcccugguggccugcaccagaggcaccccccuggacaccgaggugcccauggagagaguguucgacuacagcgaguacugggagggcgccagaggccuguacgccgccuucgacugcaccgccaccaugaagagcggcaacagcgacguguacgagaacgagauccccggcggccaguacaccaaccugcacuuccaggcccacagcaugggccugggcagcaaguucaaggaggugaagaaggccuacguggaggccaaccagaugcugggcgaccugaucaaggugacccccagcagcaagaucgugggcgaccuggcccaguucauggugcagaacggccugagcagagccgaggccgaggcccaggccgaggagcugagcuuccccagaagcgugguggaguuccugcagggcuacaucggcgugccccacggcggcuuccccgagcccuucagaagcaaggugcugaaggaccugcccagaguggagggcagacccggcgccagccugcccccccuggaccugcaggcccuggagaaggagcugguggacagacacggcgaggaggugacccccgaggacgugcugagcgccgccauguaccccgacguguucgcccacuucaaggacuucaccgccaccuucggcccccuggacagccugaacaccagacuguuccugcagggccccaagaucgccgaggaguucgagguggagcuggagagaggcaagacccugcacaucaaggcccuggccgugagcgaccugaacagagccggccagagacagguguucuucgagcugaacggccagcugagaagcauccuggugaaggacacccaggccaugaaggagaugcacuuccaccccaaggcccugaaggacgugaagggccagaucggcgcccccaugcccggcaaggugaucgacaucaaggugguggccggcgccaagguggccaagggccagccccugugcgugcugagcgccaugaagauggagaccguggugaccagccccauggagggcaccgugagaaaggugcacgugaccaaggacaugacccuggagggcgacgaccugauccuggagaucgaguaa

SEQ ID NO: 21265 - RNA, 1200 nt, Artificial Sequence
  PCID2__Homo_sapiens__NP_001120675
auggcccacaucaccaucaaccaguaccugcagcagguguacgaggccaucgacagcagagacggcgccagcugcgccgagcuggugagcuucaagcacccccacguggccaaccccagacugcagauggccagccccgaggagaagugccagcaggugcuggagccccccuacgacgagauguucgccgcccaccugagaugcaccuacgccgugggcaaccacgacuucaucgaggccuacaagugccagaccgugaucgugcagagcuuccugagagccuuccaggcccacaaggaggagaacugggcccugcccgugauguacgccguggcccuggaccugagaguguucgccaacaacgccgaccagcagcuggugaagaagggcaagagcaaggugggcgacaugcuggagaaggccgccgagcugcugaugagcugcuucagagugugcgccagcgacaccagagccggcaucgaggacagcaagaaguggggcaugcuguuccuggugaaccagcuguucaagaucuacuucaagaucaacaagcugcaccugugcaagccccugaucagagccaucgacagcagcaaccugaaggacgacuacagcaccgcccagagagugaccuacaaguacuacgugggcagaaaggccauguucgacagcgacuucaagcaggccgaggaguaccugagcuucgccuucgagcacugccacagaagcagccagaagaacaagagaaugauccugaucuaccugcugcccgugaagaugcugcugggccacaugcccaccguggagcugcugaagaaguaccaccugaugcaguucgccgaggugaccagagccgugagcgagggcaaccugcugcugcugcacgaggcccuggccaagcacgaggccuucuucaucagaugcggcaucuuccugauccuggagaagcugaagaucaucaccuacagaaaccuguucaagaagguguaccugcugcugaagacccaccagcugagccuggacgccuuccugguggcccugaaguucaugcagguggaggacguggacaucgacgaggugcagugcauccuggccaaccugaucuacaugggccacgugaagggcuacaucagccaccagcaccagaagcugguggugagcaagcagaaccccuuccccccccugagcaccgugugcuaa

SEQ ID NO: 21266 - RNA, 1869 nt, Artificial Sequence
  PCK1__Homo_sapiens__NP_002582
augcccccccagcugcagaacggccugaaccugagcgccaagguggugcagggcagccuggacagccugccccaggccgugagagaguuccuggagaacaacgccgagcugugccagcccgaccacauccacaucugcgacggcagcgaggaggagaacggcagacugcugggccagauggaggaggagggcauccugagaagacugaagaaguacgacaacugcuggcuggcccugaccgaccccagagacguggccagaaucgagagcaagaccgugaucgugacccaggagcagagagacaccgugcccauccccaagaccggccugagccagcugggcagauggaugagcgaggaggacuucgagaaggccuucaacgccagauuccccggcugcaugaagggcagaaccauguacgugauccccuucagcaugggcccccugggcagcccccugagcaagaucggcaucgagcugaccgacagccccuacgugguggccagcaugagaaucaugaccagaaugggcacccccgugcuggaggccgugggcgacggcgaguucgugaagugccugcacagcgugggcugcccccugccccugcagaagccccuggugaacaacuggcccugcaaccccgagcugacccugaucgcccaccugcccgacagaagagagaucaucagcuucggcagcggcuacggcggcaacagccugcugggcaagaagugcuucgcccugagaauggccagcagacuggccaaggaggagggcuggcuggccgagcacaugcugauccugggcaucaccaaccccgagggcgagaagaaguaccuggccgccgccuuccccagcgccugcggcaagaccaaccuggccaugaugaaccccagccugcccggcuggaagguggagugcgugggcgacgacaucgccuggaugaaguucgacgcccagggccaccugagagccaucaaccccgagaacggcuucuucggcguggcccccggcaccagcgugaagaccaaccccaacgccaucaagaccauccagaagaacaccaucuucaccaacguggccgagaccagcgacggcggcguguacugggagggcaucgacgagccccuggccagcggcgugaccaucaccagcuggaagaacaaggaguggagcagcgaggacggcgagcccugcgcccaccccaacagcagauucugcacccccgccagccagugccccaucaucgacgccgccugggagagccccgagggcgugcccaucgagggcaucaucuucggcggcagaagacccgccggcgugccccugguguacgaggcccugagcuggcagcacggcguguucgugggcgccgccaugagaagcgaggccaccgccgccgccgagcacaagggcaagaucaucaugcacgaccccuucgccaugagacccuucuucggcuacaacuucggcaaguaccuggcccacuggcugagcauggcccagcaccccgccgccaagcugcccaagaucuuccacgugaacugguucagaaaggacaaggagggcaaguuccuguggcccggcuucggcgagaacagcagagugcuggaguggauguucaacagaaucgacggcaaggccagcaccaagcugacccccaucggcuacauccccaaggaggacgcccugaaccugaagggccugggccacaucaacaugauggagcuguucagcaucagcaaggaguucugggagaaggagguggaggacaucgagaaguaccuggaggaccaggugaacgccgaccugcccugcgagaucgagagagagauccuggcccugaagcagagaaucagccagauguaa

SEQ ID NO: 21267 - RNA, 1326 nt, Artificial Sequence
  PCK2__Homo_sapiens__NP_001018083
auggccgcccuguacagacccggccugagacugaacuggcacggccugagcccccugggcuggcccagcugcagaagcauccagacccugagagugcugagcggcgaccugggccagcugcccaccggcaucagagacuucguggagcacagcgccagacugugccagcccgagggcauccacaucugcgacggcaccgaggccgagaacaccgccacccugacccugcuggagcagcagggccugaucagaaagcugcccaaguacaacaacugcuggcuggccagaaccgaccccaaggacguggccagaguggagagcaagaccgugaucgugacccccagccagagagacaccgugccccugccccccggcggcgccagaggccagcugggcaacuggaugagccccgccgacuuccagagagccguggacgagagauuccccggcugcaugcagggcagaaccauguacgugcugcccuucagcaugggccccgugggcagcccccugagcagaaucggcgugcagcugaccgacagcgccuacgugguggccagcaugagaaucaugaccagacugggcacccccgugcugcaggcccugggcgacggcgacuucgugaagugccugcacagcgugggccagccccugaccggccagggcgagcccgugagccaguggcccugcaaccccgagaagacccugaucggccacgugcccgaccagagagagaucaucagcuucggcagcggcuacggcggcaacagccugcugggcaagaagugcuucgcccugagaaucgccagcagacuggccagagacgagggcuggcuggccgagcacaugcugauccugggcaucaccagccccgccggcaagaagagauacguggccgccgccuuccccagcgccugcggcaagaccaaccuggccaugaugagacccgcccugcccggcuggaagguggagugcgugggcgacgacaucgccuggaugagauucgacagcgagggcagacugagagccaucaaccccgagaacggcuucuucggcguggcccccggcaccagcgccaccaccaaccccaacgccauggccaccauccagagcaacaccaucuucaccaacguggccgagaccagcgacggcggcguguacugggagggcaucgaccagccccugccccccggcgugaccgugaccagcuggcugggcaagcccuggaagcccggcaugugcggcggcgagggcguggcccagccccccggccugagcacccugaugguggagaagcugagcccccagccccccaccaucuucuaa

SEQ ID NO: 21268 - RNA, 14808 nt, Artificial Sequence
  PCLO__Homo_sapiens__NP_055325
augggcaacgaggccagccuggagggcgagggccugcccgagggccuggccgccgccgccgccgccggcggcggcgccagcggcgccggcagccccagccacaccgccauccccgccggcauggaggccgaccugagccagcugagcgaggaggagagaagacagaucgccgccgugaugagcagagcccagggccugcccaagggcagcgugccccccgccgccgccgagagccccagcaugcacagaaagcaggagcuggacagcagccacccccccaagcagagcggcagaccccccgaccccggcagacccgcccagcccggccugagcaagagcagaaccaccgacaccuucagaagcgagcagaagcugcccggcagaagccccagcaccaucagccugaaggagagcaagagcagaaccgaccugaaggaggagcacaagagcagcaugaugcccggcuuccugagcgaggugaacgcccugagcgccgugagcagcguggugaacaaguucaaccccuucgaccugaucagcgacagcgaggccagccaggaggagaccaccaagaagcagaagguggugcagaaggagcagggcaagcccgagggcaucaucaagcccccccugcagcagcagccccccaagcccauccccaagcagcagggccccggcagagacccccugcagcaggacggcacccccaagagcaucagcagccagcagcccgagaagaucaagagccagccccccggcaccggcaagcccauccagggccccacccagaccccccagaccgaccacgccaagcugccccugcagagagacgccagcagaccccagaccaagcaggccgacaucgugagaggcgagagcgugaagcccagccugcccagccccagcaagccccccauccagcagcccacccccggcaagccccccgcccagcagcccggccacgagaagagccagcccggccccgccaagccccccgcccagcccagcggccugaccaagccccuggcccagcagcccggcaccgugaagccccccgugcagccccccggcaccaccaagccccccgcccagccccugggccccgccaagccccccgcccagcagaccggcagcgagaagcccagcagcgagcagcccggccccaaggcccuggcccagccccccggcgugggcaagacccccgcccagcagcccggccccgccaagccccccacccagcaggugggcacccccaagccccuggcccagcagcccggccugcagagccccgccaaggcccccggccccaccaagacccccgugcagcagcccggccccggcaagauccccgcccagcaggccggccccggcaagaccagcgcccagcagaccggccccaccaagccccccagccagcugcccggccccgccaagccccccccccagcagcccggccccgccaagccccccccccagcagcccggcagcgccaagccccccagccagcagcccggcagcaccaagccccccccccagcagcccggccccgccaagcccagcccccagcagcccggcagcaccaagccccccagccagcagcccggcagcgccaagcccagcgcccagcagcccagccccgccaagcccagcgcccagcagagcaccaagcccgugagccagaccggcagcggcaagccccugcagccccccaccgugagccccagcgccaagcagccccccagccagggccugcccaagaccaucugcccccugugcaacaccaccgagcugcugcugcacgugcccgagaaggccaacuucaacaccugcaccgagugccagaccaccgugugcagccugugcggcuucaaccccaacccccaccugaccgaggugaaggaguggcugugccugaacugccagaugaagagagcccugggcggcgaccuggcccccgugcccagcagcccccagcccaagcugaagaccgcccccgugaccaccaccagcgccgugagcaagagcagcccccagccccagcagaccagccccaagaaggacgccgcccccaagcaggaccugagcaaggcccccgagcccaagaagccccccccccuggugaagcagcccacccugcacggcagccccagcgccaaggccaagcagccccccgaggccgacagccugagcaagcccgccccccccaaggagcccagcgugcccagcgagcaggacaaggcccccguggccgacgacaagcccaagcagcccaagauggugaagcccaccaccgaccuggugagcagcagcagcgccaccaccaagcccgacauccccagcagcaaggugcagagccaggccgaggagaagaccacccccccccugaagaccgacagcgccaagcccagccagagcuucccccccaccggcgagaaggugagccccuucgacagcaaggccauccccagacccgccagcgacagcaagaucaucagccaccccggccccagcagcgagagcaagggccagaagcagguggaccccgugcagaagaaggaggagcccaagaaggcccagaccaagaugagccccaagcccgacgccaagcccaugcccaagggcagccccaccccccccggccccagacccaccgccggccagaccgugcccaccccccagcagagccccaagccccaggagcagagcagaagauucagccugaaccugggcagcaucaccgacgcccccaagagccagcccaccaccccccaggagaccgugaccggcaagcuguucggcuucggcgccagcaucuucagccaggccagcaaccugaucagcaccgccggccagcccggcccccacagccagagcggccccggcgcccccaugaagcaggcccccgcccccagccagccccccaccagccagggcccccccaagagcaccggccaggccccccccgcccccgccaagagcauccccgugaagaaggagaccaaggcccccgccgccgagaagcuggagcccaaggccgagcaggcccccaccgugaagagaaccgagaccgagaagaagcccccccccaucaaggacagcaagagccugaccgccgagccccagaaggccgugcugcccaccaagcuggagaagagccccaagcccgagagcaccugcccccugugcaagaccgagcugaacaucggcagcaaggacccccccaacuucaacaccugcaccgagugcaagaaccaggugugcaaccugugcggcuucaaccccaccccccaccugaccgagauccaggaguggcugugccugaacugccagacccagagagccaucagcggccagcugggcgacaucagaaagaugccccccgcccccagcggccccaaggccagccccaugcccgugcccaccgagagcagcagccagaagaccgccgugcccccccaggugaagcuggugaagaagcaggagcaggaggugaagaccgaggccgagaaggugauccuggagaaggugaaggagacccugagcauggagaagaucccccccauggugaccaccgaccagaagcaggaggagagcaagcuggagaaggacaaggccagcgcccugcaggagaagaagccccugcccgaggagaagaagcugauccccgaggaggagaagaucagaagcgaggagaagaagccccugcuggaggagaagaagcccacccccgaggacaagaagcugcugcccgaggccaagaccagcgcccccgaggagcagaagcacgaccugcugaagagccaggugcagaucgccgaggagaagcuggagggcagaguggcccccaagaccgugcaggagggcaagcagccccagaccaagauggagggccugcccagcggcaccccccagagccugcccaaggaggacgacaagaccaccaagaccaucaaggagcagccccagccccccugcaccgccaagcccgaccagguggagcccggcaaggagaagaccgagaaggaggacgacaagagcgacaccagcagcagccagcagcccaagagcccccagggccugagcgacaccggcuacagcagcgacggcaucagcagcagccugggcgagauccccagccugauccccaccgacgagaaggacauccugaagggccugaagaaggacagcuucagccaggagagcagccccagcagccccagcgaccuggccaagcuggagagcaccgugcugagcauccuggaggcccaggccagcacccuggccgacgagaagagcgagaagaagacccagccccacgaggugagccccgagcagcccaaggaccaggagaagacccagagccugagcgagacccuggagaucaccaucagcgaggaggagaucaaggagagccaggaggagagaaaggacaccuucaagaaggacagccagcaggacauccccagcagcaaggaccacaaggagaagagcgaguucguggacgacaucaccaccagaagagagcccuacgacagcguggaggagagcagcgagagcgagaacagccccgugccccagagaaagagaagaaccagcgugggcagcagcagcagcgacgaguacaagcaggaggacagccagggcagcggcgaggaggaggacuucaucagaaagcagaucaucgagaugagcgccgacgaggacgccagcggcagcgaggacgacgaguucaucagaaaccagcugaaggagaucagcagcagcaccgagagccagaagaaggaggagaccaagggcaagggcaagaucaccgccggcaagcacagaagacugaccagaaagagcagcaccagcaucgacgaggacgccggcagaagacacagcuggcacgacgaggacgacgaggccuucgacgagagccccgagcugaaguacagagagaccaagagccaggagagcgaggagcugguggugaccggcggcggcggccugagaagauucaagaccaucgagcugaacagcaccaucgccgacaaguacagcgccgagagcagccagaagaagaccagccuguacuucgacgaggagcccgagcuggagauggagagccugaccgacagccccgaggacagaagcagaggcgagggcagcagcagccugcacgccagcagcuucacccccggcaccagccccaccagcgugagcagccuggacgaggacagcgacagcagccccagccacaagaagggcgagagcaagcagcagagaaaggccagacacagaccccacggcccccugcugcccaccaucgaggacagcagcgaggaggaggagcugagagaggaggaggagcugcugaaggagcaggagaagcagagagagaucgagcagcagcagagaaagagcagcagcaagaagagcaagaaggacaaggacgagcugagagcccagagaagaagagagagacccaagaccccccccagcaaccugagccccaucgaggacgccagccccaccgaggagcugagacaggccgccgagauggaggagcugcacagaagcagcugcagcgaguacagccccagcaucgagagcgaccccgagggcuucgagaucagccccgagaagaucaucgaggugcagaagguguacaagcugcccaccgccgugagccuguacagccccaccgacgagcagagcaucaugcagaaggagggcagccagaaggcccugaagagcgccgaggagauguacgaggagaugaugcacaagacccacaaguacaaggccuuccccgccgccaacgagagagacgagguguucgagaaggagccccuguacggcggcaugcugaucgaggacuacaucuacgagagccugguggaggacaccuacaacggcagcguggacggcagccugcugaccagacaggaggaggagaacggcuucaugcagcagaagggcagagagcagaagaucagacugagcgagcagaucuacgaggaccccaugcagaagaucaccgaccugcagaaggaguucuacgagcuggagagccugcacagcguggugccccaggaggacaucgugagcagcagcuucaucauccccgagagccacgagaucguggaccugggcaccauggugaccagcaccgaggaggagagaaagcugcuggacgccgacgccgccuacgaggagcugaugaagagacagcagaugcagcugacccccggcagcagccccacccaggcccccaucggcgaggacaugaccgagagcaccauggacuucgacagaaugcccgacgccagccugaccagcagcgugcugagcggcgccagccugaccgacagcaccagcagcgccacccugagcauccccgacgugaagaucacccagcacuucagcaccgaggagaucgaggacgaguacgugaccgacuacaccagagagauccaggagaucaucgcccacgagagccugauccugaccuacagcgagcccagcgagagcgccaccagcgugccccccagcgacacccccagccugaccagcagcgugagcagcgugugcaccaccgacagcagcagccccaucaccacccuggacagcaucaccaccguguacaccgagcccguggacaugaucaccaaguucgaggacagcgaggagaucagcagcagcaccuacuuccccggcagcaucaucgacuaccccgaggagaucagcgugagccuggacagaaccgccccccccgacggcagagccagcgccgaccacaucgugaucagccugagcgacauggccagcagcaucaucgagagcguggugcccaagcccgagggccccguggccgacaccgugagcaccgaccugcugaucagcgagaaggaccccgugaagaaggccaagaaggagaccggcaacggcaucauccuggaggugcuggaggccuacagagacaagaaggagcuggaggccgagagaaccaagagcagccugagcgagaccguguucgaccacccccccagcagcgugaucgcccugcccaugaaggagcagcugagcaccaccuacuucaccagcggcgagaccuucggccaggagaagcccgccagccagcugcccagcggcagccccagcgugagcagccugcccgccaagcccagacccuucuucagaagcagcagccuggacaucagcgcccagcccccccccccccccccccccccccccccccccccccccccccccccccccccccccccccccccccugcccccccccaccagccccaagcccaccauccugcccaagaagaagcugaccguggccagccccgugaccaccgccaccccccuguucgacgccgugaccacccuggagaccaccgccgugcugagaagcaacggccugcccgugaccagaaucugcaccaccgcccccccccccgugccccccaagcccagcagcauccccagcggccugguguucacccacagacccgagcccagcaagccccccaucgcccccaagcccgugaucccccagcugcccaccaccacccagaagcccaccgacauccaccccaagcccaccggccugagccugaccagcagcaugacccugaaccuggugaccagcgccgacuacaagcugcccagccccaccagcccccugagcccccacagcaacaagagcagccccagauucagcaagagccugaccgagaccuacguggugaucacccugcccagcgagcccggcacccccaccgacagcagcgccagccaggccaucaccagcuggccccugggcagccccagcaaggaccuggugagcguggagcccguguucagcguggugccccccgugaccgccguggagauccccaucagcagcgagcagaccuucuacaucagcggcgcccugcagaccuucagcgccacccccgugaccgcccccagcagcuuccaggccgcccccaccagcgugacccaguuccugaccaccgaggugagcaagaccgaggugagcgccaccagaagcaccgcccccagcgugggccugagcagcaucagcaucaccaucccccccgagccccuggcccuggacaacauccaccuggagaagccccaguacaaggaggacggcaagcugcagcuggugggcgacgugaucgaccugagaaccgugcccaagguggaggugaagaccaccgacaagugcaucgaccugagcgccagcaccauggacgugaagagacagaucaccgccaacgagguguacggcaagcagaucagcgccgugcagcccagcaucaucaaccugagcgugaccagcagcaucgugacccccgugagccuggccaccgagaccgugaccuucgugaccugcaccgccagcgccagcuacaccaccggcaccgagagccuggugggcgccgagcacgccaugaccaccccccugcagcugaccaccagcaagcacgccgagccccccuacagaauccccagcgaccagguguuccccaucgccagagaggaggcccccaucaaccugagccugggcacccccgcccacgccgugacccuggccaucaccaagcccgugaccgugccccccgugggcgugaccaacggcuggaccgacagcaccgugagccagggcaucaccgacggcgaggugguggaccugagcaccaccaagagccacagaaccguggugaccauggacgagagcaccagcagcgugaugaccaagaucaucgaggacgagaagcccguggaccugaccgccggcagaagagccgugugcugcgacgugguguacaagcugcccuucggcagaagcugcaccgcccagcagcccgccaccacccugcccgaggacagauucggcuacagagacgaccacuaccaguacgacagaagcggccccuacggcuacagaggcaucggcggcaugaagcccagcaugagcgacaccaaccuggccgaggccggccacuucuucuacaagagcaagaacgccuucgacuacagcgagggcaccgacaccgccguggaccugaccagcggcagagugaccaccggcgaggugauggacuacagcagcaagaccaccggccccuaccccgagaccagacaggugaucagcggcgccggcaucagcaccccccaguacagcaccgccagaaugacccccccccccggcccccaguacugcgugggcagcgugcugagaagcagcaacggcgugguguacagcagcguggccacccccacccccagcaccuucgccaucaccacccagcccggcagcaucuucagcaccaccgugagagaccugagcggcauccacaccgccgacgccgugaccagccugcccgccaugcaccacagccagcccaugcccagaagcuacuucaucaccaccggcgccagcgagaccgacaucgccgugaccggcaucgacaucagcgccagccugcagaccaucaccauggagagccugaccgccgagaccaucgacagcgugcccacccugaccaccgccagcgagguguuccccgagguggugggcgacgagagcgcccugcugaucgugcccgaggaggacaagcagcagcagcagcuggaccuggagagagagcugcuggagcuggagaagaucaagcagcagagauucgccgaggagcuggagugggagagacaggagauccagagauucagagagcaggagaagaucauggugcagaagaagcuggaggagcugcagagcaugaagcagcaccugcuguuccagcaggaggaggagagacaggcccaguucaugaugagacaggagacccuggcccagcagcagcugcagcuggagcagauccagcagcugcagcagcagcugcaccagcagcuggaggagcagaagaucagacagaucuaccaguacaacuacgaccccagcggcaccgccagcccccagaccaccaccgagcaggccauccuggagggccaguacgccgcccuggagggcagccaguucugggccaccgaggacgccaccaccaccgccagcgccgugguggccaucgagaucccccagagccagggcugguacaccgugcagagcgacggcgugacccaguacaucgccccccccggcauccugagcaccgugagcgagaucccccugaccgacgugguggugaaggaggagaagcagcccaagaagagaagcagcggcgccaaggugagaggccaguacgacgacaugggcgagaacaugaccgacgaccccagaagcuucaagaagaucguggacagcggcgugcagaccgacgacgaggacgccaccgacagaagcuacgugagcagaagaagaagaaccaagaagagcguggacaccagcgugcagaccgacgacgaggaccaggacgagugggacaugcccaccagaagcagaagaaaggccagagugggcaaguacggcgacagcaugaccgaggccgacaagaccaagccccugagcaaggugagcagcaucgccgugcagaccguggccgagaucagcgugcagaccgagcccgugggcaccaucagaacccccagcaucagagccagaguggacgccaagguggagaucaucaagcacaucagcgcccccgagaagaccuacaagggcggcagccugggcugccagaccgaggccgacagcgacacccagagcccccaguaccugagcgccaccagcccccccaaggacaagaagagacccaccccccuggagaucggcuacagcagccaccugagagccgacagcaccgugcagcuggcccccagcccccccaagagccccaaggugcuguacagccccaucagcccccugagccccggcaaggcccuggagagcgccuucgugcccuacgagaagccccugcccgacgacaucagcccccagaaggugcugcaccccgacauggccaaggugccccccgccagccccaagaccgccaagaugaugcagagaagcaugagcgaccccaagccccugagccccaccgccgacgagagcagcagagcccccuuccaguacaccgagggcuacaccaccaagggcagccagaccaugaccagcagcggcgcccagaagaaggugaagagaacccugcccaaccccccccccgaggagaucagcaccggcacccagagcaccuucagcaccaugggcaccgugagcagaagaagaaucugcagaaccaacaccauggccagagccaagauccugcaggacaucgacagagagcuggaccugguggagagagagagcgccaagcugagaaagaagcaggccgagcuggacgaggaggagaaggagaucgacgccaagcugagauaccuggagaugggcaucaacagaagaaaggaggcccugcugaaggagagagagaagagagagagagccuaccugcagggcguggccgaggacagagacuacaugagcgacagcgaggugagcagcaccagacccaccagaaucgagagccagcacggcaucgagagacccagaaccgccccccagaccgaguucagccaguucauccccccccagacccagaccgagagccagcuggugccccccaccagccccuacacccaguaccaguacagcagccccgcccugcccacccaggcccccaccagcuacacccagcagagccacuucgagcagcagacccuguaccaccagcaggugagccccuaccagacccagcccaccuuccaggccguggccaccaugagcuucaccccccaggugcagcccacccccaccccccagcccagcuaccagcugcccagccagaugauggugauccagcagaagcccagacagaccacccuguaccuggagcccaagaucaccagcaacuacgaggugaucagaaaccagccccugaugaucgcccccgugagcaccgacaacaccuucgccgugagccaccugggcagcaaguacaacagccuggaccugagaaucggccuggaggagagaagcagcauggccagcagccccaucagcagcaucagcgccgacagcuucuacgccgacaucgaccaccacacccccagaaacuacgugcugaucgacgacaucggcgagaucaccaagggcaccgccgcccugagcaccgccuucagccugcacgagaaggaccugagcaagaccgacagacugcugagaaccaccgagaccagaagaagccaggaggugaccgacuuccuggccccccugcagagcagcagcagacugcacagcuacgugaaggccgaggaggaccccauggaggaccccuacgagcugaagcugcugaagcaccagaucaagcaggaguucagaagaggcaccgagagccuggaccaccuggccggccugagccacuacuaccacgccgacaccagcuacagacacuuccccaagagcgagaaguacagcaucagcagacugacccuggagaagcaggccgccaagcagcugcccgccgccauccuguaccagaagcagagcaagcacaagaagagccugaucgaccccaagaugagcaaguucagccccauccaggagagcagagaccuggagcccgacuacagcagcuacaugaccagcagcaccagcagcaucggcggcaucagcagcagagccagacugcugcaggacgacaucaccuucggccugagaaagaacaucaccgaccagcagaaguucaugggcagcagccugggcaccggccugggcacccugggcaacaccaucagaagcgcccugcaggacgaggccgacaagcccuacagcagcggcagcagaagcagacccagcagcagacccagcagcguguacggccuggaccugagcaucaagagagacagcagcagcagcagccugagacugaaggcccaggaggccgaggcccuggacgugagcuucagccacgccagcagcagcgccagaaccaagcccaccagccugcccaucagccagagcagaggcagaauccccaucguggcccagaacagcgaggaggagagcccccugagccccgugggccagcccaugggcauggccagagccgccgccggcccccugccccccaucagcgccgacaccagagaccaguucggcagcagccacagccugcccgaggugcagcagcacaugagagaggagagcagaaccagaggcuacgacagagacaucgccuucaucauggacgacuuccagcacgccaugagcgacagcgaggccuaccaccugagaagagaggagaccgacugguucgacaagcccagagagagcagacuggagaacggccacggccuggacagaaagcugcccgagagacuggugcacagcagaccccugagccagcaccaggagcagaucauccagaugaacggcaagaccaugcacuacaucuucccccacgccagaaucaagaucaccagagacagcaaggaccacaccgugagcggcaacggccugggcaucagaaucgugggcggcaaggagauccccggccacagcggcgagaucggcgccuacaucgccaagauccugcccggcggcagcgccgagcagaccggcaagcugauggagggcaugcaggugcuggaguggaacggcaucccccugaccagcaagaccuacgaggaggugcagagcaucaucagccagcagagcggcgaggccgagaucugcgugagacuggaccugaacaugcugagcgacagcgagaacagccagcaccuggagcugcacgagccccccaaggccguggacaaggccaagagccccggcguggaccccaagcagcuggccgccgagcugcagaaggugagccugcagcagagcccccuggugcugagcagcgugguggagaagggcagccacgugcacagcggccccaccagcgccggcagcagcagcgugcccagccccggccagcccggcagccccagcgugagcaagaagaagcacggcagcagcaagcccaccgacggcaccaagguggugagccaccccaucaccggcgagauccagcugcagaucaacuacgaccugggcaaccugaucauccacauccugcaggccagaaaccuggugcccagagacaacaacggcuacagcgaccccuucgugaagguguaccugcugcccggcagaggccaggugaugguggugcagaacgccagcgccgaguacaagagaagaaccaagcacgugcagaagagccugaaccccgaguggaaccagaccgugaucuacaagagcaucagcauggagcagcugaagaagaagacccuggaggugaccgugugggacuacgacagauucagcagcaacgacuuccugggcgaggugcugaucgaccugagcagcaccagccaccuggacaacacccccagaugguacccccugaaggagcagaccgagagcaucgaccacggcaagagccacagcagccagagcagccagcagagccccaagcccagcgugaucaagagcagaagccacggcaucuuccccgaccccagcaaggacaugcaggugcccaccaucgagaagagccacagcagccccggcagcagcaagagcagcagcgagggccaccugagaagccacggccccagcagaagccagagcaagaccagcgugacccagacccaccuggaggacgccggcgccgccaucgccgccgccgaggccgccgugcagcagcugagaauccagcccagcaagagaagaaaguaa

SEQ ID NO: 21269 - RNA, 6075 nt, Artificial Sequence
  PCM1__Homo_sapiens__NP_006188
auggccaccggcggcggccccuucgaggacggcaugaacgaccaggaccugcccaacuggagcaacgagaacguggacgacagacugaacaacauggacuggggcgcccagcagaagaaggccaacagaagcagcgagaagaacaagaagaaguucggcguggagagcgacaagagagugaccaacgacaucagccccgagagcagccccggcgugggcagaagaagaaccaagaccccccacaccuucccccacagcagauacaugagccagaugagcgugcccgagcaggccgagcuggagaagcugaagcagagaaucaacuucagcgaccuggaccagagaagcaucggcagcgacagccagggcagagccaccgccgccaacaacaagagacagcugagcgagaacagaaagcccuucaacuuccugcccaugcagaucaacaccaacaagagcaaggacgccagcaccagcccccccaacagagagaccaucggcagcgcccagugcaaggagcuguucgccagcgcccugagcaacgaccugcugcagaacugccaggugagcgaggaggacggcagaggcgagcccgccauggagagcagccagaucgugagcagacuggugcagaucagagacuacaucaccaaggccagcagcaugagagaggaccugguggagaagaacgagagaagcgccaacguggagagacugacccaccugaucgaccaccugaaggagcaggagaagagcuacaugaaguuccugaagaagauccuggccagagacccccagcaggagcccauggaggagaucgagaaccugaagaagcagcacgaccugcugaagagaaugcugcagcagcaggagcagcugagagcccugcagggcagacaggccgcccugcuggcccugcagcacaaggccgagcaggccaucgccgugauggacgacagcgugguggccgagaccgccggcagccugagcggcgugagcaucaccagcgagcugaacgaggagcugaacgaccugauccagagauuccacaaccagcugagagacagccagccccccgccgugcccgacaacagaagacaggccgagagccugagccugaccagagaggugagccagagcagaaagcccagcgccagcgagagacugcccgacgagaagguggagcuguucagcaagaugagagugcugcaggagaagaagcagaagauggacaagcugcugggcgagcugcacacccugagagaccagcaccugaacaacagcagcagcagcccccagagaagcguggaccagagaagcaccagcgcccccagcgccagcgugggccuggcccccguggugaacggcgagagcaacagccugaccagcagcgugcccuaccccaccgccagccuggugagccagaacgagagcgagaacgagggccaccugaaccccagcgagaagcugcagaagcugaacgaggugagaaagagacugaacgagcugagagagcuggugcacuacuacgagcagaccagcgacaugaugaccgacgccgugaacgagaacagaaaggacgaggagaccgaggagagcgaguacgacagcgagcacgagaacagcgagcccgugaccaacaucagaaacccccagguggccagcaccuggaacgaggugaacagccacagcaacgcccagugcgugagcaacaacagagacggcagaaccgugaacagcaacugcgagaucaacaacagaagcgccgccaacaucagagcccugaacaugccccccagccuggacugcagauacaacagagagggcgagcaggagauccacguggcccagggcgaggacgacgaggaggaggaggaggaggccgaggaggagggcgugagcggcgccagccugagcagccacagaagcagccugguggacgagcaccccgaggacgccgaguucgagcagaagaucaacagacugauggccgccaagcagaagcugagacagcugcaggaccugguggccauggugcaggacgacgacgccgcccagggcgugaucagcgccagcgccagcaaccuggacgacuucuaccccgccgaggaggacaccaagcagaacagcaacaacaccagaggcaacgccaacaagacccagaaggacaccggcgugaacgagaaggccagagagaaguucuacgaggccaagcugcagcagcagcagagagagcugaagcagcugcaggaggagagaaagaagcugaucgacauccaggagaagauccaggcccugcagaccgccugccccgaccugcagcugagcgccgccagcgugggcaacugccccaccaagaaguacaugcccgccgugaccagcacccccaccgugaaccagcacgagaccagcaccagcaagagcguguucgagcccgaggacagcagcaucguggacaacgagcuguggagcgagaugagaagacacgagaugcugagagaggagcugagacagagaagaaagcagcuggaggcccugauggccgagcaccagagaagacagggccuggccgagaccgccagccccguggccgugagccugagaagcgacggcagcgagaaccugugcaccccccagcagagcagaaccgagaagaccauggccaccuggggcggcagcacccagugcgcccuggacgaggagggcgacgaggacggcuaccugagcgagggcaucgugagaaccgacgaggaggaggaggaggagcaggacgccagcagcaacgacaacuucagcgugugccccagcaacagcgugaaccacaacagcuacaacggcaaggagaccaagaacagauggaagaacaacugccccuucagcgccgacgagaacuacagaccccuggccaagaccagacagcagaacaucagcaugcagagacaggagaaccugagaugggugagcgagcugagcuacguggaggagaaggagcaguggcaggagcagaucaaccagcugaagaagcagcuggacuucagcgugagcaucugccagacccugaugcaggaccagcagacccugagcugccugcugcagacccugcugaccggccccuacagcgugaugcccagcaacguggccagcccccaggugcacuucaucaugcaccagcugaaccagugcuacacccagcugaccuggcagcagaacaacgugcagagacugaagcagaugcugaacgagcugaugagacagcagaaccagcaccccgagaagcccggcggcaaggagagaggcagcagcgccagccacccccccagccccagccuguucugccccuucagcuuccccacccagcccgugaaccuguucaacauccccggcuucaccaacuucagcagcuucgcccccggcaugaacuucagcccccuguuccccagcaacuucggcgacuucagccagaacaucagcacccccagcgagcagcagcagccccuggcccagaacagcagcggcaagaccgaguacauggccuuccccaagcccuucgagagcagcagcagcaucggcgccgagaagcccagaaacaagaagcugcccgaggaggagguggagagcagcagaacccccuggcuguacgagcaggagggcgagguggagaagcccuucaucaagaccggcuucagcgugagcguggagaagagcaccagcagcaacagaaagaaccagcuggacaccaacggcagaagaagacaguucgacgaggagagccuggagagcuucagcagcaugcccgaccccguggaccccaccaccgugaccaagaccuucaagaccagaaaggccagcgcccaggccagccuggccagcaaggacaagacccccaagagcaagagcaagaagagaaacagcacccagcugaagagcagagugaagaacaucagauacgagagcgccagcaugagcagcaccugcgagcccugcaagagcagaaacagacacagcgcccagaccgaggagcccgugcaggccaagguguucagcagaaagaaccacgagcagcuggagaagaucaucaagugcaacagaagcaccgagaucagcagcgagaccggcagcgacuucagcauguucgaggcccugagagacaccaucuacagcgagguggccacccugaucagccagaacgagagcagaccccacuuccugaucgagcuguuccacgagcugcagcugcugaacaccgacuaccugagacagagagcccuguacgcccugcaggacaucgugagcagacacaucagcgagagccacgagaagggcgagaacgugaagagcgugaacagcggcaccuggaucgccagcaacagcgagcugacccccagcgagagccuggccaccaccgacgacgagaccuucgagaagaacuucgagagagagacccacaagaucagcgagcagaacgacgccgacaacgccagcgugcugagcgugagcagcaacuucgagcccuucgccaccgacgaccugggcaacaccgugauccaccuggaccaggcccuggccagaaugagagaguacgagagaaugaagaccgaggccgagagcaacagcaacaugagaugcaccugcagaaucaucgaggacggcgacggcgccggcgccggcaccaccgugaacaaccuggaggagacccccgugaucgagaacagaagcagccagcagcccgugagcgaggugagcaccauccccugccccagaaucgacacccagcagcuggacagacagaucaaggccaucaugaaggaggugauccccuuccugaaggagcacauggacgaggugugcagcagccagcugcugaccagcgugagaagaauggugcugacccugacccagcagaacgacgagagcaaggaguucgugaaguucuuccacaagcagcugggcagcauccugcaggacagccuggccaaguucgccggcagaaagcugaaggacugcggcgaggaccugcugguggagaucagcgaggugcuguucaacgagcuggccuucuucaagcugaugcaggaccuggacaacaacagcaucaccgugaagcagagaugcaagagaaagaucgaggccaccggcgugauccagagcugcgccaaggaggccaagagaauccuggaggaccacggcagccccgccggcgagaucgacgacgaggacaaggacaaggacgagaccgagaccgugaagcagacccagaccagcgagguguacgacggccccaagaacgugagaagcgacaucagcgaccaggaggaggacgaggagagcgagggcugccccgugagcaucaaccugagcaaggccgagacccaggcccugaccaacuacggcagcggcgaggacgagaacgaggacgaggagauggaggaguucgaggagggccccguggacgugcagaccagccugcaggccaacaccgaggccaccgaggagaacgagcacgacgagcaggugcugcagagagacuucaagaagaccgccgagagcaagaacgugccccuggagagagaggccaccagcaagaacgaccagaacaacugccccgugaagcccugcuaccugaacauccuggaggacgagcagccccugaacagcgccgcccacaaggagagcccccccaccguggacagcacccagcagcccaacccccugccccugagacugcccgagauggagccccuggugcccagagugaaggaggugaagagcgcccaggagacccccgagagcagccuggccggcagccccgacaccgagagccccgugcuggugaacgacuacgaggccgagagcggcaacaucagccagaagagcgacgaggaggacuucgugaagguggaggaccugccccugaagcugaccaucuacagcgaggccgaccugagaaagaagaugguggaggaggagcagaagaaccaccugagcggcgagaucugcgagaugcagaccgaggagcuggccggcaacagcgagacccugaaggagcccgagaccgugggcgcccagagcaucuaa

SEQ ID NO: 21270 - RNA, 861 nt, Artificial Sequence
  PCMT1__Homo_sapiens__NP_001238978
augcccggcgccagaagcggcggcagcggcggcgacggcagcaacagcggcagcuacagcggcgacgccagcggcgccgugaccgugugggagguggugagccugcugggcaagcugcugggcaccgugguggcccugaagguggugcuguaccugcugagagugugccuggccauggccuggaagagcggcggcgccagccacagcgagcugauccacaaccugagaaagaacggcaucaucaagaccgacaagguguucgaggugaugcuggccaccgacagaagccacuacgccaagugcaaccccuacauggacagcccccagagcaucggcuuccaggccaccaucagcgccccccacaugcacgccuacgcccuggagcugcuguucgaccagcugcacgagggcgccaaggcccuggacgugggcagcggcagcggcauccugaccgccugcuucgccagaauggugggcugcaccggcaaggugaucggcaucgaccacaucaaggagcugguggacgacagcgugaacaacgugagaaaggacgaccccacccugcugagcagcggcagagugcagcugguggugggcgacggcagaaugggcuacgccgaggaggcccccuacgacgccauccacgugggcgccgccgcccccguggugccccaggcccugaucgaccagcugaagcccggcggcagacugauccugcccgugggccccgccggcggcaaccagaugcuggagcaguacgacaagcugcaggacggcagcaucaagaugaagccccugaugggcgugaucuacgugccccugaccgacaaggagaagcaguggagcagagacgagcuguaa

SEQ ID NO: 21271 - RNA, 846 nt, Artificial Sequence
  PCMTD1__Homo_sapiens__NP_001273711
augcccggccccagaagacugagaagccccggcggcagcggcugcagcagcagaggcagcggccccagacugagcaccagaagauggagacccugcugcuacugcggcggcagcggcguguggcugcugagaaccccccccagccccagcgccuggcccgccagaagaugccccagacacagauucgaguucugcgagcccgccuucguggugggcaacugccugcagaucgccagcgacagccaccaguacgacagaaucuacugcggcgccggcgugcagaaggaccacgagaacuacaugaagauccugcugaaggugggcggcauccuggugaugcccaucgaggaccagcugacccagaucaugagaaccggccagaacaccugggagagcaagaacauccuggccgugagcuucgccccccuggugcagcccagcaagaacgacaacggcaagcccgacagcgugggccugccccccugcgccgugagaaaccugcaggaccuggccagaaucuacaucagaagaacccugagaaacuucaucaacgacgagaugcaggccaagggcaucccccagagagccccccccaagagaaagagaaagagagugaagcagagaaucaacaccuacguguucgugggcaaccagcugaucccccagccccuggacagcgaggaggacgagaagauggaggaggacaacaaggaggaggaggagaaggaccacaacgaggccaugaagcccgaggagcccccccagaaccugcugagagagaagaucaugaagcugccccugcccgagagccugaaggccuaccugaccuacuucagagacaaguaa

SEQ ID NO: 21272 - RNA, 786 nt, Artificial Sequence
  PCNA__Homo_sapiens__NP_872590
auguucgaggccagacuggugcagggcagcauccugaagaaggugcuggaggcccugaaggaccugaucaacgaggccugcugggacaucagcagcagcggcgugaaccugcagagcauggacagcagccacgugagccuggugcagcugacccugagaagcgagggcuucgacaccuacagaugcgacagaaaccuggccaugggcgugaaccugaccagcaugagcaagauccugaagugcgccggcaacgaggacaucaucacccugagagccgaggacaacgccgacacccuggcccugguguucgaggcccccaaccaggagaaggugagcgacuacgagaugaagcugauggaccuggacguggagcagcugggcauccccgagcaggaguacagcugcguggugaagaugcccagcggcgaguucgccagaaucugcagagaccugagccacaucggcgacgccguggugaucagcugcgccaaggacggcgugaaguucagcgccagcggcgagcugggcaacggcaacaucaagcugagccagaccagcaacguggacaaggaggaggaggccgugaccaucgagaugaacgagcccgugcagcugaccuucgcccugagauaccugaacuucuucaccaaggccaccccccugagcagcaccgugacccugagcaugagcgccgacgugccccuggugguggaguacaagaucgccgacaugggccaccugaaguacuaccuggcccccaagaucgaggacgaggagggcagcuaa

SEQ ID NO: 21273 - RNA, 10011 nt, Artificial Sequence
  PCNT__Homo_sapiens__NP_006022
auggagguggagcaggagcagagaagaagaaagguggaggccggcagaaccaagcuggcccacuucagacagagaaagaccaagggcgacagcagccacagcgagaagaagaccgccaagagaaagggcagcgccguggacgccagcgugcaggaggagagccccgugaccaaggaggacagcgcccugugcggcggcggcgacaucugcaagagcaccagcugcgacgacacccccgacggcgccggcggcgccuucgccgcccagcccgaggacugcgacggcgagaagagagaggaccuggagcagcugcagcagaagcaggugaacgaccacccccccgagcagugcggcauguucaccgugagcgaccacccccccgagcagcacggcauguucaccgugggcgaccacccccccgagcagagaggcauguucaccgugagcgaccacccccccgagcagcacggcauguucaccgugagcgaccacccccccgagcagagaggcauguucaccaucagcgaccaccagcccgagcagagaggcauguucaccgugagcgaccacacccccgagcagagaggcaucuucaccaucagcgaccaccccgccgagcagagaggcauguucaccaaggagugcgagcaggagugcgagcuggccaucaccgaccuggagagcggcagagaggacgaggccggccugcaccagagccaggccgugcacggccuggagcuggaggcccugagacugagccugagcaacaugcacaccgcccagcuggagcugacccaggccaaccugcagaaggagaaggagaccgcccugaccgagcugagagagaugcugaacagcagaagagcccaggagcuggcccugcugcagagcagacagcagcacgagcuggagcugcugagagagcagcacgccagagagaaggaggagguggugcugagaugcggccaggaggccgccgagcugaaggagaagcugcagagcgagauggagaagaacgcccagaucgugaagacccugaaggaggacugggagagcgagaaggaccugugccuggagaaccugagaaaggagcugagcgccaagcaccagagcgagauggaggaccugcagaaccaguuccagaaggagcuggccgagcagagagccgagcuggagaagaucuuccaggacaagaaccaggccgagagagcccugagaaaccuggagagccaccaccaggccgccaucgagaagcugagagaggaccugcagagcgagcacggcagaugccuggaggaccuggaguucaaguucaaggagagcgagaaggagaagcagcuggagcuggagaaccugcaggccagcuacgaggaccugaaggcccagagccaggaggagaucagaagacuguggagccagcuggacagcgccagaaccagcagacaggagcugagcgagcugcacgagcagcugcuggccagaaccagcagaguggaggaccuggagcagcugaagcagagagagaagacccagcacgagagcgagcuggagcagcugagaaucuacuucgagaagaagcugagagacgccgagaagaccuaccaggaggaccugacccugcugcagcagagacugcagggcgccagagaggacgcccugcuggacagcguggaggugggccugagcugcgugggccuggaggagaagcccgagaagggcagaaaggaccacguggacgagcuggagcccgagagacacaaggagagccugcccagauuccaggccgagcuggaggagagccacagacaccagcuggaggcccuggagagcccccugugcauccagcacgagggccacgugagcgacagaugcugcguggagaccagcgcccugggccacgaguggagacuggagcccagcgagggccacagccaggagcugcccugggugcaccugcagggcgugcaggacggcgaccuggaggccgacaccgagagagccgccagagugcugggccuggagaccgagcacaaggugcagcugagccugcugcagaccgagcugaaggaggagaucgagcugcugaagaucgagaacagaaaccuguacggcaagcugcagcacgagaccagacugaaggacgaccuggagaaggugaagcacaaccugaucgaggaccaccagaaggagcugaacaacgccaagcagaagaccgagcugaugaagcaggaguuccagagaaaggagaccgacuggaaggugaugaaggaggagcugcagagagaggccgaggagaagcugacccugaugcugcuggagcugagagagaaggccgagagcgagaagcagaccaucaucaacaaguucgagcugagagaggccgagaugagacagcugcaggaccagcaggccgcccagauccuggaccuggagagaagccugaccgagcagcagggcagacugcagcagcuggagcaggaccugaccagcgacgacgcccugcacugcagccagugcggcagagagccccccaccgcccaggacggcgagcuggccgcccugcacgugaaggaggacugcgcccugcagcugaugcuggccagaagcagauuccuggaggagagaaaggagaucaccgagaaguucagcgccgagcaggacgccuuccugcaggaggcccaggagcagcacgccagagagcugcagcugcugcaggagagacaccagcagcagcugcugagcgugaccgccgagcuggaggccagacaccaggccgcccugggcgagcugaccgccagccuggagagcaagcagggcgcccugcuggccgccagaguggccgagcugcagaccaagcacgccgccgaccugggcgcccuggagaccagacaccugagcagccuggacagccuggagagcugcuaccugagcgaguuccagaccaucagagaggagcacagacaggcccuggagcugcugagagccgacuucgaggagcagcuguggaagaaggacagccugcaccagaccauccugacccaggagcuggagaagcugaagagaaagcacgagggcgagcugcagagcgugagagaccaccugagaaccgaggugagcaccgagcuggccggcaccguggcccacgagcugcagggcgugcaccagggcgaguucggcagcgagaagaagaccgcccugcacgagaaggaggagacccugagacugcagagcgcccaggcccagcccuuccaccaggaggagaaggagagccugagccugcagcugcagaagaagaaccaccaggugcagcagcugaaggaccaggugcugagccugagccacgagaucgaggagugcagaagcgagcuggaggugcugcagcagagaagagagagagagaacagagagggcgccaaccugcugagcaugcugaaggccgacgugaaccugagccacagcgagagaggcgcccugcaggacgcccugagaagacugcugggccuguucggcgagacccugagagccgccgugacccugagaagcagaaucggcgagagagugggccugugccuggacgacgccggcgccggccuggcccugagcaccgcccccgcccuggaggagaccuggagcgacguggcccugcccgagcuggacagaacccugagcgagugcgccgagaugagcagcguggccgagaucagcagccacaugagagagagcuuccugaugagccccgagagcgugagagagugcgagcagcccaucagaagaguguuccagagccugagccuggccguggacggccugauggagauggcccuggacagcagcagacagcuggaggaggccagacagauccacagcagauucgagaaggaguucagcuucaagaacgaggagaccgcccagguggugagaaagcaccaggagcugcuggagugccugaaggaggagagcgccgccaaggccgagcuggcccuggagcugcacaagacccagggcacccuggagggcuucaagguggagaccgccgaccugaaggaggugcuggccggcaaggaggacagcgagcacagacuggugcuggagcuggagagccugagaagacagcugcagcaggccgcccaggagcaggccgcccugagagaggagugcaccagacuguggagcagaggcgaggccaccgccaccgacgccgaggccagagaggccgcccugagaaaggagguggaggaccugaccaaggagcagagcgagaccagaaagcaggccgagaaggacagaagcgcccugcugagccagaugaagauccuggagagcgagcuggaggagcagcugagccagcacagaggcugcgccaagcaggccgaggccgugaccgcccuggagcagcagguggccagccuggacaagcaccugagaaaccagagacaguucauggacgagcaggccgccgagagagagcacgagagagaggaguuccagcaggagauccagagacuggagggccagcugagacaggccgccaagccccagcccuggggccccagagacagccagcaggccccccuggacggcgagguggagcugcugcagcagaagcugagagagaagcuggacgaguucaacgagcuggccauccagaaggagagcgccgacagacaggugcugaugcaggaggaggagaucaagagacuggaggagaugaacaucaacaucagaaagaagguggcccagcugcaggaggagguggagaagcagaagaacaucgugaagggccuggagcaggacaaggaggugcugaagaagcagcagaugagcagccugcugcuggccagcacccugcagagcacccuggacgccggcagaugccccgagccccccagcggcagcccccccgagggccccgagauccagcuggaggugacccagagagcccugcugagaagagagagcgaggugcuggaccugaaggagcagcuggagaagaugaagggcgaccuggagagcaagaacgaggagauccugcaccugaaccugaagcuggacaugcagaacagccagaccgccgugagccugagagagcuggaggaggagaacaccagccugaaggugaucuacaccagaagcagcgagaucgaggagcugaaggccaccaucgagaaccugcaggagaaccagaagagacugcagaaggagaaggccgaggagaucgagcagcugcacgaggugaucgagaagcugcagcacgagcugagccugaugggccccguggugcacgaggugagcgacagccaggccggcagccugcagagcgagcugcugugcagccaggccggcggccccagaggccaggcccugcagggcgagcuggaggccgcccuggaggccaaggaggcccugagcagacugcuggccgaccaggagagaagacacagccaggcccuggaggcccugcagcagagacugcagggcgccgaggaggccgccgagcugcagcuggccgagcuggagagaaacguggcccugagagaggccgagguggaggacauggccagcagaauccaggaguucgaggccgcccugaaggccaaggaggccaccaucgccgagagaaaccuggagaucgacgcccugaaccagagaaaggccgcccacagcgccgagcuggaggccgugcugcuggcccuggccagaaucagaagagcccuggagcagcagccccuggccgccggcgccgccccccccgagcugcaguggcugagagcccagugcgccagacugagcagacagcugcaggugcugcaccagagauuccugagaugccagguggagcuggacagaagacaggccagaagagccaccgcccacaccagagugcccggcgcccacccccagcccagaauggacggcggcgccaaggcccaggugaccggcgacguggaggccagccacgacgccgcccuggagcccguggugcccgacccccagggcgaccugcagcccgugcuggugacccugaaggacgccccccugugcaagcaggagggcgugaugagcgugcugaccgugugccagagacagcugcagagcgagcugcugcuggugaagaacgagaugagacugagccuggaggacggcggcaagggcaaggagaaggugcuggaggacugccagcugcccaagguggaccugguggcccaggugaagcagcugcaggagaagcugaacagacugcuguacagcaugaccuuccagaacguggacgccgccgacaccaagagccuguggcccauggccagcgcccaccugcuggagagcagcuggagcgacgacagcugcgacggcgaggagcccgacaucagcccccacaucgacaccugcgacgccaacaccgccaccggcggcgugaccgacgugaucaagaaccaggccaucgacgccugcgacgccaacaccacccccggcggcgugaccgacgugaucaagaacugggacagccugauccccgacgagaugcccgacagccccauccaggagaagagcgagugccaggacaugagccugagcagccccaccagcgugcugggcggcagcagacaccagagccacaccgccgaggccggccccagaaagagccccgugggcaugcuggaccugagcagcuggagcagccccgaggugcugagaaaggacuggacccuggagcccuggcccagccugcccgugaccccccacagcggcgcccugagccugugcagcgccgacaccagccugggcgacagagccgacaccagccugccccagacccagggccccggccugcugugcagccccggcgugagcgccgccgcccuggcccugcagugggccgagagcccccccgccgacgaccaccacgugcagagaaccgccguggagaaggacguggaggacuucaucaccaccagcuucgacagccaggagacccugagcagccccccccccggccuggagggcaaggccgacagaagcgagaagagcgacggcagcggcuucggcgccagacugagccccggcagcggcggccccgaggcccagaccgccggccccgugacccccgccagcaucagcggcagauuccagccccugcccgaggccaugaaggagaaggaggugagacccaagcacgugaaggcccugcugcagauggugagagacgagagccaccagauccuggcccugagcgagggccuggccccccccagcggcgagccccacccccccagaaaggaggacgagauccaggacaucagccugcacggcggcaagacccaggaggugcccaccgccugccccgacuggagaggcgaccugcugcagguggugcaggaggccuucgagaaggagcaggagaugcagggcguggagcugcagcccagacugagcggcagcgaccugggcggccacagcagccugcuggagagacuggagaagaucaucagagagcagggcgaccugcaggagaagagccuggagcaccugagacugcccgacagaagcagccugcugagcgagauccaggcccugagagcccagcugagaaugacccaccugcagaaccaggagaagcugcagcaccugagaaccgcccugaccagcgccgaggccagaggcagccagcaggagcaccagcugagaagacagguggagcugcuggccuacaagguggagcaggagaagugcaucgccggcgaccugcagaagacccugagcgaggagcaggagaaggccaacagcgugcagaagcugcuggccgccgagcagaccguggugagagaccugaagagcgaccugugcgagagcagacagaagagcgagcagcugagcagaagccugugcgaggugcagcaggaggugcugcagcugagaagcaugcugagcagcaaggagaacgagcugaaggccgcccugcaggagcuggagagcgagcagggcaagggcagagcccugcagagccagcuggaggaggagcagcugagacaccugcagagagagagccagagcgccaaggcccuggaggagcugagagccagccuggagacccagagagcccagagcagcagacugugcguggcccugaagcacgagcagaccgccaaggacaaccugcagaaggagcugagaaucgagcacagcagaugcgaggcccugcuggcccaggagagaagccagcugagcgagcugcagaaggaccuggccgccgagaagagcagaacccuggagcugagcgaggcccugagacacgagagacugcugaccgagcagcugagccagagaacccaggaggccugcgugcaccaggacacccaggcccaccacgcccugcugcagaagcugaaggaggagaagagcagagugguggaccugcaggccaugcuggagaaggugcagcagcaggcccugcacagccagcagcagcuggaggccgaggcccagaagcacugcgaggcccugagaagagagaaggaggugagcgccacccugaagagcaccguggaggcccugcacacccagaagagagagcugagaugcagccuggagagagagagagagaagcccgccuggcugcaggccgagcuggagcagagccaccccagacugaaggagcaggagggcagaaaggccgccagaagaagcgccgaggccagacagagccccgccgccgccgagcaguggagaaaguggcagagagacaaggagaagcugagagagcuggagcugcagagacagagagaccugcacaagaucaagcagcugcagcagaccgugagagaccuggagagcaaggacgaggugcccggcagcagacugcaccugggcagcgccagaagagccgccggcagcgacgccgaccaccugagagagcagcagagagagcuggaggccaugagacagagacugcugagcgccgccagacugcugaccagcuucaccagccaggccguggacagaaccgugaacgacuggaccagcagcaacgagaaggccgugaugagccugcugcacacccuggaggagcugaagagcgaccugagcagacccaccagcagccagaagaagauggccgccgagcugcaguuccaguucguggacgugcugcugaaggacaacgugagccugaccaaggcccugagcaccgugacccaggagaagcuggagcugagcagagccgugagcaagcuggagaagcugcugaagcaccaccugcagaagggcugcagccccagcagaagcgagagaagcgccuggaagcccgacgagaccgccccccagagcagccugagaagacccgaccccggcagacugccccccgccgccagcgaggaggcccacaccagcaacgugaagauggagaagcuguaccugcacuaccugagagccgagagcuucagaaaggcccugaucuaccagaagaaguaccugcugcugcugaucggcggcuuccaggacagcgagcaggagacccugagcaugaucgcccaccugggcguguuccccagcaaggccgagagaaagaucaccagcagacccuucaccagauucagaaccgccgugagaguggugaucgccauccugagacugagauuccuggugaagaaguggcaggagguggacagaaagggcgcccuggcccagggcaaggcccccagacccggccccagagccagacagccccagagcccccccagaaccagagagagcccccccaccagagacgugcccagcggccacaccagagaccccgccagaggcagaagacuggccgccgccgccagcccccacagcggcggcagagccacccccagccccaacagcagacuggagagaagccugaccgccagccaggaccccgagcacagccugaccgaguacauccaccaccuggaggugauccagcagagacugggcggcgugcugcccgacagcaccagcaagaagagcugccaccccaugaucaagcaguaa

SEQ ID NO: 21274 - RNA, 6414 nt, Artificial Sequence
  PCNXL2__Homo_sapiens__NP_055616
auggugagccaggugcugcagcugcugagacagggcgugugggccgcccugaccggcggcugguaccacgaccccgagcagagcaaguucaccaacagcugccaccuguaccuguggcuguuccugcugcugcugccccuggcccugcaccuggccuucccccccaacgccaucaucguguucuucuacugcagcgccgugaccaucuucuucaccaucaucaagcuggugagcuacagacugcaccugauguucgacaagggcgaggugauccagcagaagcccagcagaaaggaggagaagcccaacaaggacaaggaggccaagggcgagcacaucaccaaccacagaaaccccagcaacaacagacagauccacaacggcaagaaggaggaggccagcagaaaccugagcacccccccccugagaugcagcagcagaggccagagcaucaccagccaccacagcagcggcccccuggagcugagcgcccaggagaccguggaggaccugaagggcgugauccugcuggaggaccaccccaucgcccccgugagcagcaccagccccggcaucaagguggagagccugcccgccagccaggcccacaugcuggagaccaccaccaagagcgugauccccgugaagcccguggccaccgagacccugaucaacggcaagggcaaggagagaggcggcaagggccagcccccccugagacacagaagcgagggcggccugguggacaagggcccccugaagaagcugccccaccugagccugagccaguacgaccugcuggagaccgacgugagcuuccagcccuggggcagcgagaacagcgugcugauccccgagcccgugagcugccccagaggcagcaucagagagagagugcagagcaagagcccccaggacagccugagcagcagcugcccccagugcgacaccaucguggccaagcccguggaggagcccgccgacaccagcugccagguggacaccagcugccagggcgaccugccccugcaccaggagguggacagcagcgacagcgagguggccgugacccugaucgacaccagccagcccggcgacccccugagccugcacgagcccaucaagaucgugaucaccaugagcagcacccccaacagcaugaccgaccuggagagcagccugcaccugagaguggugggcaccgagaagaccagcgugaagagcgacgccgagcccaccaaccccggcgccgccggcagccccaacgccgagcagaucagcauccccgugaucacccuggaccugcccgagggcggcggcggcggcgugcccugccccgagggcaacggcagcgagagaacccccgagagacugaagaccagagugagcaccaaccagugcagcggcuacggcagcggcgagggcggcaacgccaucaaggaccacagcagcagcagcagagagcccugggagagcgugagcagacugacccccgacaccggcagcgagagcaaggugggcaaggagggccagaccaaccuggaccccagcagcugcaagagcagccacgagaagagacacgccagagugcugagcguggacagcggcaccgacguguuccugagcaagagcagcgccgagaucgugaacgacaccgagaagaccaugcccaccagcaagagcgaccuggaggccaaggagggccagaugcccaacgagagcaacuuccuggaguucgugagccugcuggagagcaucaacaccagcaagaugaccgccagcagccagcugaacggcagcgccgagcagaacgaggagagcggccugcugagagacaacugcagccaggagaagaaggaggagauccuggagaacgagaagcccagcggccacagcagcaagcagggcaagcccgaccugcagagccaggaccacaccagcaccggccccgccugcacccagcccgccaagaccaccgccuucuuccagggcaacagacagagacagaucaucuacagagugaccagccagcaggacagcagcgugcugcaggugaucagcggccccgagaccagcgugcaggaggagaucagcguggacgccaugcacguguucaucgacgagcacggcgagaucagaagcugcuaccugaagagcggcaaccagaaggagggcccccugcagccccugcccagcaacaacgacugccugagccaggccagagagaugcaggugagcagcagcagcaccaccaccagcgagagccaggaccccagcagcggcgaccccgccgugagcgcccugcagcagcagcugcugcugaugguggccagaagaacccagagcgagacccccagacacgugagccaggaccuggaggccagcagcugcagcagcacccagggcaaguucaacagagagcaguucuacaaguucaucaucuuccccggcaaguggaucaaggugugguacgacagacugacccugcuggcccugcuggacagaaccgaggacaucaaggagaacgugcuggccauccugcugaucgugcuggugagccugcugggcuuccugacccugagccagggcuucugcaaggacaugugggugcugcuguucugccuggugauggccagcugccaguacagccugcugaagagcgugcagcccgaccccgccagccccauccacggccacaaccagaucaucaccuacagcagacccaucuacuucugcgugcugugcggccugauccugcugcuggacaccggcgccaaggccagacacccccccagcuacgugguguacggccugaagcuguucagccccguguuccugcagagcgccagagacuaccugaucguguuccuguacugcuuccccgccaucagccugcugggccuguucccccagaucaacaccuucugcaccuaccugcuggagcagaucgacaugcuguucuucggcggcagcgccgugagcggcaucaccagcgccguguacagcguggccagaagcgugcuggccgccgcccugcugcacgccgugugcuucagcgccgugaaggagcccuggagcaugcagcacauccccgcccuguucagcgccuucugcggccugcugguggcccugagcuaccaccugagcagacagagcagcgaccccagcgugcugaugagcuucauccagugcagacuguuccccaaguuccugcaccagaaccuggccgagagcgccgccgacccccugcccaagaagaugaaggacagcgugaccgacgugcugaagugggaccugaucgugugcgccgugguggccgugcugagcuucgccgugagcgccagcaccguguuccugagccugagacccuuccugagcaucgugcuguucgcccuggccggcgccgugggcuucgugacccacuacgugcugccccagcugagaaagcaccaccccuggauguggaucagccaccccauccugaagaacaaggaguaccaccagagagaggugagagacguggcccaccugaugugguucgagagacuguacguguggcugcagugcuucgagaaguacauccuguaccccgcccugauccugaacgcccugaccaucgacgccuuccugaucagcaaccacagaagacugggcacccacugggacaucuuccugaugaucaucgccggcaugaagcugcugagaaccagcuucugcaaccccguguaccaguucaucaaccugagcuucaccgugaucuucuuccacuucgacuacaaggacaucagcgagagcuuccugcuggacuucuucauggugagcauccuguucagcaagcugggcgaccugcugcacaagcugcaguucgugcugaccuacguggcccccuggcagauggccuggggcagcagcuuccacguguucgcccagcuguucgccaucccccacagcgccaugcuguucuuccagaccaucgccaccagcaucuucagcaccccccugagccccuuccugggcagcgugaucuucaucaccagcuacgugagacccgugaaguucugggagaagaacuacaacaccagaagaguggacaacagcaacaccagacuggccgugcagaucgagagagaccccggcaacgacgacaacaaccugaacagcaucuucuacgagcaccugaccagaacccugcaggagagccugugcggcgaccuggugcugggcagauggggcaacuacagcagcggcgacugcuucauccuggccagcgacgaccugaacgccuucgugcaccugaucgagaucggcaacggccuggugaccuuccagcugagaggccuggaguucagaggcaccuacugccagcagagagagguggaggccaucauggagggcgacgaggaggacagaggcugcugcugcugcaagcccggccaccugccccaccugcugagcugcaacgccgccuuccaccugagauggcugaccugggagaucacccagacccaguacauccuggagggcuacagcauccuggacaacaacgccgccaccaugcugcagguguucgaccugagaagaauccugaucagauacuacaucaagagcaucaucuacuacauggugaccagccccaagcugcugagcuggaucaagaacgagagccugcugaagagccugcagcccuucgccaaguggcacuacaucgagagagaccuggccauguucaacaucaacaucgacgacgacuacgugcccugccugcagggcaucaccagagccagcuucugcaacguguaccuggaguggauccagcacugcgccagaaagagacaggagcccagcaccacccuggacagcgacgaggacagcccccuggugacccugagcuucgcccugugcacccugggcagaagagcccugggcaccgccgcccacaacauggccaucagccuggacagcuuccuguacggccugcacgugcuguucaagggcgacuucagaaucaccgccagagacgaguggguguucgccgacauggaccugcugcacaaggugguggcccccgccaucagaaugagccugaagcugcaccaggaccaguucaccugccccgacgaguacgaggaccccgccgugcuguacgaggccauccagagcuucgagaagaagguggugaucugccacgagggcgaccccgccuggagaggcgccgugcugagcaacaaggaggagcugcugacccugagacacgugguggacgagggcgccgacgaguacaaggugaucaugcugcacagaagcuuccugagcuucaaggugaucaaggugaacaaggagugcgugagaggccugugggccggccagcagcaggagcugaucuuccugagaaacagaaaccccgagagaggcagcauccagaacaacaagcaggugcugagaaaccugaucaacagcagcugcgaccagccccugggcuaccccauguacgugagcccccugaccaccagcuaccugggcacccacagacagcugaagaacaucuggggcggccccaucacccuggacagaaucagaaccugguucuggaccaagugggugagaaugagaaaggacugcaacgccagacagcacagcggcggcaacaucgaggacguggacggcggcggcgcccccaccaccggcggcaacaacgcccccagcggcggcagccaggagagcagcgccgagcagcccagaaagggcggcgcccagcacggcgugagcagcugcgagggcacccagagaaccggcagaagaaagggcagaagccagagcgugcaggcccacagcgcccugagccagagaccccccaugcugagcagcagcggccccauccuggagagcagacagaccuuccugcagaccagcaccagcgugcacgagcuggcccagagacugagcggcagcagacugagccugcacgccagcgccaccagccugcacagccagcccccccccgugaccaccaccggccaccugagcgugagagagagagccgaggcccugaucagaagcagccugggcagcagcaccagcagcacccugagcuuccuguucggcaagagaagcuucagcagcgcccuggugaucagcggccugagcgccgccgagggcggcaacaccagcgacacccagagcagcagcagcgugaacaucgugaugggccccagcgccagagccgccagccaggccaccagacaccugagcgagcccugcgagccccccgacgccaccgagcagggccagcugcacgacagaugccuggccgaggccguggccgacacccugggcguggugugcagaagagccagccaggaggacaugggccuggacgacaccgccagccagcagagcgugagcgacgagcaguaa

SEQ ID NO: 21275 - RNA, 2817 nt, Artificial Sequence
  PCNXL4__Homo_sapiens__NP_071940
augcccgcccuggagcacaugaaccagauccugcacauccuguucguguuccugcccuuccugugggcccugggcacccugcccccccccgacgcccugcugcugugggccauggagcaggugcuggaguucggccugggcggcagcagcaugagcacccaccugagacugcuggugauguucaucaugagcgccggcaccgccaucgccagcuacuucauccccagcaccgugggcguggugcuguucaugaccggcuucggcuuccugcugagccugaaccugagcgacaugggccacaagaucggcaccaagagcaaggaccugcccagcggccccgagaagcacuucagcuggaaggagugccuguucuacaucaucauccuggugcuggcccugcuggagaccagccugcugcaccacuucgccggcuucagccagaucagcaagagcaacagccaggccaucgugggcuacggccugaugauccugcugaucauccuguggauccugagagagauccagagcguguacaucaucggcaucuucagaaaccccuucuaccccaaggacgugcagaccgugaccguguucuucgagaagcagaccagacugaugaagaucggcaucgugagaagaauccugcugacccuggugagccccuucgccaugaucgccuuccugagccuggacagcagccugcagggccugcacagcgugagcgugugcaucggcuucaccagagccuucagaaugguguggcagaacaccgagaacgcccugcuggagaccgugaucgugagcaccgugcaccugaucagcagcaccgacaucugguggaacagaagccuggacaccggccugagacugcugcuggugggcaucaucagagacagacugauccaguucaucagcaagcugcaguucgccgugaccgugcugcugaccagcuggaccgagaagaagcagagaagaaagaccaccgccacccugugcauccugaacaucguguucagccccuucgugcuggugaucaucguguucagcacccugcugagcagcccccugcugccccuguucacccugcccguguuccuggugggcuuccccagacccauccagagcuggcccggcgccgccggcaccaccgccugcgugugcgccgacaccguguacuacuaccagauggugcccagacugaccgccgugcugcagaccgccauggccgccggcagccugggccugcugcugcccggcagccacuaccugggcagauuccaggacagacugauguggaucaugauccuggagugcggcuacaccuacugcagcaucaacaucaagggccuggagcugcaggagaccagcugccacaccgccgaggccagaagaguggacgagguguucgaggacgccuucgagcaggaguacaccagagugugcagccugaacgagcacuucggcaacgugcugacccccugcaccgugcugcccgugaagcuguacagcgacgccagaaacgugcugagcggcaucaucgacagccacgagaaccugaaggaguucaagggcgaccugaucaaggugcugguguggauccuggugcaguacugcagcaagagacccggcaugaaggagaacgugcacaacaccgagaacaagggcaaggccccccugaugcugcccgcccugaacacccugcccccccccaagagccccgaggacaucgacagccugaacagcgagaccuucaacgacuggagcgacgacaacaucuucgacgacgagcccaccaucaagaaggugaucgaggagaagcaccagcugaaggaccugcccggcaccaaccuguucauccccggcagcguggagagccagagagugggcgaccacagcaccggcaccgugcccgagaacgaccuguacaaggccgugcugcugggcuaccccgccguggacaagggcaagcaggaggacaugcccuacaucccccugauggaguucagcugcagccacagccaccuggugugccugcccgccgaguggagaaccagcugcaugcccagcagcaagaugaaggagaugagcagccuguuccccgaggacugguaccaguucgugcugagacagcuggagugcuaccacagcgaggagaaggccagcaacgugcuggaggagaucgccaaggacaaggugcugaaggacuucuacgugcacaccgugaugaccugcuacuucagccuguucggcaucgacaacauggcccccagccccggccacauccugagaguguacggcggcgugcugcccuggagcguggcccuggacuggcugaccgagaagcccgagcuguuccagcuggcccugaaggccuucagauacacccugaagcugaugaucgacaaggccagccugggccccaucgaggacuucagagagcugaucaaguaccuggaggaguacgagagagacugguacaucggccuggugagcgacgagaaguggaaggaggccauccugcaggagaagcccuaccuguucagccugggcuacgacagcaacaugggcaucuacaccggcagagugcugagccugcaggagcugcugauccaggugggcaagcugaaccccgaggccgugagaggccagugggccaaccugagcugggagcugcuguacgccaccaacgacgacgaggagagauacagcauccaggcccacccccugcugcugagaaaccugaccgugcaggccgccgagcccccccugggcuaccccaucuacagcagcaagccccugcacauccaccuguacuaa

SEQ ID NO: 21276 - RNA, 1248 nt, Artificial Sequence
  PCOLCE2__Homo_sapiens__NP_037495
augagaggcgccaacgccugggccccccugugccugcugcuggccgccgccacccagcugagcagacagcagagccccgagagacccguguucaccugcggcggcauccugaccggcgagagcggcuucaucggcagcgagggcuuccccggcguguacccccccaacagcaagugcaccuggaagaucaccgugcccgagggcaaggugguggugcugaacuucagauucaucgaccuggagagcgacaaccugugcagauacgacuucguggacguguacaacggccacgccaacggccagagaaucggcagauucugcggcaccuucagacccggcgcccuggugagcagcggcaacaagaugauggugcagaugaucagcgacgccaacaccgccggcaacggcuucauggccauguucagcgccgccgagcccaacgagagaggcgaccaguacugcggcggccugcuggacagacccagcggcagcuucaagacccccaacuggcccgacagagacuaccccgccggcgugaccugcguguggcacaucguggcccccaagaaccagcugaucgagcugaaguucgagaaguucgacguggagagagacaacuacugcagauacgacuacguggccguguucaacggcggcgaggugaacgacgccagaagaaucggcaaguacugcggcgacagcccccccgcccccaucgugagcgagagaaacgagcugcugauccaguuccugagcgaccugagccugaccgccgacggcuucaucggccacuacaucuucagacccaagaagcugcccaccaccaccgagcagcccgugaccaccaccuuccccgugaccaccggccugaagcccaccguggcccugugccagcagaagugcagaagaaccggcacccuggagggcaacuacugcagcagcgacuucgugcuggccggcaccgugaucaccaccaucaccagagacggcagccugcacgccaccgugagcaucaucaacaucuacaaggagggcaaccuggccauccagcaggccggcaagaacaugagcgccagacugaccguggugugcaagcagugcccccugcugagaagaggccugaacuacaucaucaugggccaggugggcgaggacggcagaggcaagaucaugcccaacagcuucaucaugauguucaagaccaagaaccagaagcugcuggacgcccugaagaacaagcagugcuaa

SEQ ID NO: 21277 - RNA, 1350 nt, Artificial Sequence
  PCOLCE__Homo_sapiens__NP_002584
augcugcccgccgccaccgccagccugcugggcccccugcugaccgccugcgcccugcugcccuucgcccagggccagacccccaacuacaccagacccguguuccugugcggcggcgacgugaagggcgagagcggcuacguggccagcgagggcuuccccaaccuguacccccccaacaaggagugcaucuggaccaucaccgugcccgagggccagaccgugagccugagcuucagaguguucgaccuggagcugcaccccgccugcagauacgacgcccuggagguguucgccggcagcggcaccagcggccagagacugggcagauucugcggcaccuucagacccgccccccugguggcccccggcaaccaggugacccugagaaugaccaccgacgagggcaccggcggcagaggcuuccugcugugguacagcggcagagccaccagcggcaccgagcaccaguucugcggcggcagacuggagaaggcccagggcacccugaccacccccaacuggcccgagagcgacuacccccccggcaucagcugcagcuggcacaucaucgccccccccgaccaggugaucgcccugaccuucgagaaguucgaccuggagcccgacaccuacugcagauacgacagcgugagcguguucaacggcgccgugagcgacgacagcagaagacugggcaaguucugcggcgacgccgugcccggcagcaucagcagcgagggcaacgagcugcuggugcaguucgugagcgaccugagcgugaccgccgacggcuucagcgccagcuacaagacccugcccagaggcaccgccaaggagggccagggccccggccccaagagaggcaccgagcccaaggugaagcugccccccaagagccagccccccgagaagaccgaggagagccccagcgcccccgacgcccccaccugccccaagcagugcagaagaaccggcacccugcagagcaacuucugcgccagcagccugguggugaccgccaccgugaagagcauggugagagagcccggcgagggccuggccgugaccgugagccugaucggcgccuacaagaccggcggccuggaccugcccagcccccccaccggcgccagccugaaguucuacgugcccugcaagcagugcccccccaugaagaagggcgugagcuaccugcugaugggccagguggaggagaacagaggccccgugcugccccccgagagcuucguggugcugcacagacccaaccaggaccagauccugaccaaccugagcaagagaaagugccccagccagcccgugagagccgccgccagccaggacuaa

SEQ ID NO: 21278 - RNA, 411 nt, Artificial Sequence
  PCP2__Homo_sapiens__NP_777555
augauggaccaggaggagaagaccgaggagggcagcggccccugcgccgaggccggcagccccgaccaggagggcuucuucaaccugcugagccacgugcagggcgacagaauggagggccagagaugcagccugcaggccggccccggccagaccaccaagagccagagcgaccccacccccgagauggacagccugauggacaugcuggccagcacccagggcagaagaauggacgaccagagagugaccgugagcagccugcccggcuuccagcccgugggcagcaaggacggcgcccagaagagagccggcacccugagcccccagccccugcugaccccccaggaccccaccgcccugggcuucagaagaaacagcagcccccagccccccacccaggcccccuaa

SEQ ID NO: 21279 - RNA, 189 nt, Artificial Sequence
  PCP4__Homo_sapiens__NP_006189
augagcgagagacagggcgccggcgccaccaacggcaaggacaagaccagcggcgagaacgacggccagaagaaggugcaggaggaguucgacaucgacauggacgcccccgagaccgagagagccgccguggccauccagagccaguucagaaaguuccagaagaagaaggccggcagccagagcuaa

SEQ ID NO: 21280 - RNA, 2262 nt, Artificial Sequence
  PCSK1__Homo_sapiens__NP_000430
auggagagaagagccuggagccugcagugcaccgccuucgugcuguucugcgccuggugcgcccugaacagcgccaaggccaagagacaguucgugaacgagugggccgccgagauccccggcggccccgaggccgccagcgccaucgccgaggagcugggcuacgaccugcugggccagaucggcagccuggagaaccacuaccuguucaagcacaagaaccaccccagaagaagcagaagaagcgccuuccacaucaccaagagacugagcgacgacgacagagugaucugggccgagcagcaguacgagaaggagagaagcaagagaagcgcccugagagacagcgcccugaaccuguucaacgaccccauguggaaccagcagugguaccugcaggacaccagaaugaccgccgcccugcccaagcuggaccugcacgugauccccguguggcagaagggcaucaccggcaagggcguggugaucaccgugcuggacgacggccuggaguggaaccacaccgacaucuacgccaacuacgaccccgaggccagcuacgacuucaacgacaacgaccacgaccccuuccccagauacgaccccaccaacgagaacaagcacggcaccagaugcgccggcgagaucgccaugcaggccaacaaccacaagugcggcgugggcguggccuacaacagcaaggugggcggcaucagaaugcuggacggcaucgugaccgacgccaucgaggccagcagcaucggcuucaaccccggccacguggacaucuacagcgccagcuggggccccaacgacgacggcaagaccguggagggccccggcagacuggcccagaaggccuucgaguacggcgugaagcagggcagacagggcaagggcagcaucuucgugugggccagcggcaacggcggcagacagggcgacaacugcgacugcgacggcuacaccgacagcaucuacaccaucagcaucagcagcgccagccagcagggccugagccccugguacgccgagaagugcagcagcacccuggccaccagcuacagcagcggcgacuacaccgaccagagaaucaccagcgccgaccugcacaacgacugcaccgagacccacaccggcaccagcgccagcgccccccuggccgccggcaucuucgcccuggcccuggaggccaaccccaaccugaccuggagagacaugcagcaccuggugguguggaccagcgaguacgacccccuggccaacaaccccggcuggaagaagaacggcgccggccugauggugaacagcagauucggcuucggccugcugaacgccaaggcccugguggaccuggccgaccccagaaccuggagaagcgugcccgagaagaaggagugcguggugaaggacaacgacuucgagcccagagcccugaaggccaacggcgaggugaucaucgagauccccaccagagccugcgagggccaggagaacgccaucaagagccuggagcacgugcaguucgaggccaccaucgaguacagcagaagaggcgaccugcacgugacccugaccagcgccgccggcaccagcaccgugcugcuggccgagagagagagagacaccagccccaacggcuucaagaacugggacuucaugagcgugcacaccuggggcgagaaccccaucggcaccuggacccugagaaucaccgacaugagcggcagaauccagaacgagggcagaaucgugaacuggaagcugauccugcacggcaccagcagccagcccgagcacaugaagcagcccagaguguacaccagcuacaacaccgugcagaacgacagaagaggcguggagaagaugguggaccccggcgaggagcagcccacccaggagaaccccaaggagaacacccuggugagcaagagccccagcagcagcagcgugggcggcagaagagacgagcuggaggagggcgcccccagccaggccaugcugagacugcugcagagcgccuucagcaagaacagcccccccaagcagagccccaagaagagccccagcgccaagcugaacauccccuacgagaacuucuacgaggcccuggagaagcugaacaagcccagccagcugaaggacagcgaggacagccuguacaacgacuacguggacguguucuacaacaccaagcccuacaagcacagagacgacagacugcugcaggcccugguggacauccugaacgaggagaacuaa

SEQ ID NO: 21281 - RNA, 783 nt, Artificial Sequence
  PCSK1N__Homo_sapiens__NP_037403
auggccggcagcccccugcuguggggccccagagccggcggcgugggccugcuggugcugcugcugcugggccuguucagacccccccccgcccugugcgccagacccgugaaggagcccagaggccugagcgccgccagccccccccuggccgagaccggcgcccccagaagauucagaagaagcgugcccagaggcgaggccgccggcgccgugcaggagcuggccagagcccuggcccaccugcuggaggccgagagacaggagagagccagagccgaggcccaggaggccgaggaccagcaggccagagugcuggcccagcugcugagaguguggggcgcccccagaaacagcgaccccgcccugggccuggacgacgaccccgacgcccccgccgcccagcuggccagagcccugcugagagccagacuggaccccgccgcccuggccgcccagcuggugcccgcccccgugcccgccgccgcccugagacccagaccccccguguacgacgacggccccgccggccccgacgccgaggaggccggcgacgagacccccgacguggaccccgagcugcugagauaccugcugggcagaauccuggccggcagcgccgacagcgagggcguggccgcccccagaagacugagaagagccgccgaccacgacgugggcagcgagcugccccccgagggcgugcugggcgcccugcugagagugaagagacuggagacccccgccccccaggugcccgccagaagacugcugccccccuaa

SEQ ID NO: 21282 - RNA, 1860 nt, Artificial Sequence
  PCSK2__Homo_sapiens__NP_001188457
augguguucgccagcgccgagagacccguguucaccaaccacuuccugguggagcugcacaagggcggcgaggacaaggccagacagguggccgccgagcacggcuucggcgugagaaagcugcccuucgccgagggccuguaccacuucuaccacaacggccuggccaaggccaagagaagaagaagccugcaccacaagcagcagcuggagagagaccccagagugaagauggcccugcagcaggagggcuucgacagaaagaagagaggcuacagagacaucaacgagaucgacaucaacaugaacgacccccuguucaccaagcagugguaccugaucaacaccggccaggccgacggcacccccggccuggaccugaacguggccgaggccugggagcugggcuacaccggcaagggcgugaccaucggcaucauggacgacggcaucgacuaccugcaccccgaccuggccagcaacuacaacgccgaggccagcuacgacuucagcagcaacgaccccuaccccuaccccagauacaccgacgacugguucaacagccacggcaccagaugcgccggcgaggugagcgccgccgccaacaacaacaucugcggcgugggcguggccuacaacagcaagguggccggcaucagaaugcuggaccagcccuucaugaccgacaucaucgaggccagcagcaucagccacaugccccagcugaucgacaucuacagcgccagcuggggccccaccgacaacggcaagaccguggacggccccagagagcugacccugcaggccauggccgacggcgugaacaagggcagaggcggcaagggcagcaucuacgugugggccagcggcgacggcggcagcuacgacgacugcaacugcgacggcuacgccagcagcauguggaccaucagcaucaacagcgccaucaacgacggcagaaccgcccuguacgacgagagcugcagcagcacccuggccagcaccuucagcaacggcagaaagagaaaccccgaggccggcguggccaccaccgaccuguacggcaacugcacccugagacacagcggcaccagcgccgccgcccccgaggccgccggcguguucgcccuggcccuggaggccaaccugggccugaccuggagagacaugcagcaccugaccgugcugaccagcaagagaaaccagcugcacgacgaggugcaccaguggagaagaaacggcgugggccuggaguucaaccaccuguucggcuacggcgugcuggacgccggcgccauggugaagauggccaaggacuggaagaccgugcccgagagauuccacugcgugggcggcagcgugcaggaccccgagaagauccccagcaccggcaagcuggugcugacccugaccaccgacgccugcgagggcaaggagaacuucgugagauaccuggagcacgugcaggccgugaucaccgugaacgccaccagaagaggcgaccugaacaucaacaugaccagccccaugggcaccaagagcauccugcugagcagaagacccagagacgacgacagcaaggugggcuucgacaaguggcccuucaugaccacccacaccuggggcgaggacgccagaggcaccuggacccuggagcugggcuucgugggcagcgccccccagaagggcgugcugaaggaguggacccugaugcugcacggcacccagagcgcccccuacaucgaccagguggugagagacuaccagagcaagcuggccaugagcaagaaggaggagcuggaggaggagcuggacgaggccguggagagaagccugaagagcauccugaacaagaacuaa

SEQ ID NO: 21283 - RNA, 2268 nt, Artificial Sequence
  PCSK4__Homo_sapiens__NP_060043
augagacccgcccccaucgcccuguggcugagacuggugcuggcccuggcccuggugagacccagagccgugggcugggcccccgugagagcccccaucuacgugagcagcugggccgugcaggugagccagggcaacagagagguggagagacuggccagaaaguucggcuucgugaaccugggccccaucuuccccgacggccaguacuuccaccugagacacagaggcguggugcagcagagccugaccccccacuggggccacagacugcaccugaagaagaaccccaaggugcagugguuccagcagcagacccugcagagaagagugaagagaagcgugguggugcccaccgaccccugguucagcaagcagugguacaugaacagcgaggcccagcccgaccugagcauccugcaggccuggagccagggccugagcggccagggcaucguggugagcgugcuggacgacggcaucgagaaggaccaccccgaccugugggccaacuacgacccccuggccagcuacgacuucaacgacuacgaccccgacccccagcccagauacacccccagcaaggagaacagacacggcaccagaugcgccggcgagguggccgccauggccaacaacggcuucugcggcgugggcguggccuucaacgccagaaucggcggcgugagaaugcuggacggcaccaucaccgacgugaucgaggcccagagccugagccugcagccccagcacauccacaucuacagcgccagcuggggccccgaggacgacggcagaaccguggacggccccggcauccugaccagagaggccuucagaagaggcgugaccaagggcagaggcggccugggcacccuguucaucugggccagcggcaacggcggccugcacuacgacaacugcaacugcgacggcuacaccaacagcauccacacccugagcgugggcagcaccacccagcagggcagagugcccugguacagcgaggccugcgccagcacccugaccaccaccuacagcagcggcguggccaccgacccccagaucgugaccaccgaccugcaccacggcugcaccgaccagcacaccggcaccagcgccagcgccccccuggccgccggcaugaucgcccuggcccuggaggccaaccccuuccugaccuggagagacaugcagcaccugguggugagagccagcaagcccgcccaccugcaggccgaggacuggagaaccaacggcgugggcagacaggugagccaccacuacggcuacggccugcuggacgccggccugcugguggacaccgccagaaccuggcugcccacccagccccagagaaagugcgccgugagagugcagagcagacccacccccauccugccccugaucuacaucagagagaacgugagcgccugcgccggccugcacaacagcaucagaagccuggagcacgugcaggcccagcugacccugagcuacagcagaagaggcgaccuggagaucagccugaccagccccaugggcaccagaagcacccugguggccaucagaccccuggacgugagcaccgagggcuacaacaacuggguguucaugagcacccacuucugggacgagaacccccagggcguguggacccugggccuggagaacaagggcuacuacuucaacaccggcacccuguacagauacacccugcugcuguacggcaccgccgaggacaugaccgccagacccaccggcccccaggugaccagcagcgccugcgugcagagagacaccgagggccugugccaggccugcgacggccccgccuacauccugggccagcugugccuggccuacugcccccccagauucuucaaccacaccagacuggugaccgccggccccggccacaccgccgcccccgcccugagagugugcagcagcugccacgccagcugcuacaccugcagaggcggcagccccagagacugcaccagcugcccccccagcagcacccuggaccagcagcagggcagcugcaugggccccaccacccccgacagcagacccagacugagagccgccgccugcccccaccacagaugccccgccagcgccauggugcugagccugcuggccgugacccugggcggccccgugcugugcggcaugagcauggaccugccccuguacgccuggcugagcagagccagagccacccccaccaagccccagguguggcugcccgccggcaccuaa

SEQ ID NO: 21284 - RNA, 5583 nt, Artificial Sequence
  PCSK5__Homo_sapiens__NP_001177411
augggcuggggcagcagaugcugcugccccggcagacuggaccugcugugcgugcuggcccugcugggcggcugccugcugcccgugugcagaaccagaguguacaccaaccacugggccgugaagaucgccggcggcuuccccgaggccaacagaaucgccagcaaguacggcuucaucaacaucggccagaucggcgcccugaaggacuacuaccacuucuaccacagcagaaccaucaagagaagcgugaucagcagcagaggcacccacagcuucaucagcauggagcccaagguggaguggauccagcagcagguggugaagaagagaaccaagagagacuacgacuucagcagagcccagagcaccuacuucaacgaccccaaguggcccagcaugugguacaugcacugcagcgacaacacccaccccugccagagcgacaugaacaucgagggcgccuggaagagaggcuacaccggcaagaacaucguggugaccauccuggacgacggcaucgagagaacccaccccgaccugaugcagaacuacgacgcccuggccagcugcgacgugaacggcaacgaccuggaccccaugcccagauacgacgccagcaacgagaacaagcacggcaccagaugcgccggcgagguggccgccgccgccaacaacagccacugcaccgugggcaucgccuucaacgccaagaucggcggcgugagaaugcuggacggcgacgugaccgacaugguggaggccaagagcgugagcuucaacccccagcacgugcacaucuacagcgccagcuggggccccgacgacgacggcaagaccguggacggccccgccccccugaccagacaggccuucgagaacggcgugagaaugggcagaagaggccugggcagcguguucgugugggccagcggcaacggcggcagaagcaaggaccacugcagcugcgacggcuacaccaacagcaucuacaccaucagcaucagcagcaccgccgagagcggcaagaagcccugguaccuggaggagugcagcagcacccuggccaccaccuacagcagcggcgagagcuacgacaagaagaucaucaccaccgaccugagacagagaugcaccgacaaccacaccggcaccagcgccagcgcccccauggccgccggcaucaucgcccuggcccuggaggccaaccccuuccugaccuggagagacgugcagcacgugaucgugagaaccagcagagccggccaccugaacgccaacgacuggaagaccaacgccgccggcuucaaggugagccaccuguacggcuucggccugauggacgccgaggccauggugauggaggccgagaaguggaccaccgugcccagacagcacgugugcguggagagcaccgacagacagaucaagaccaucagacccaacagcgccgugagaagcaucuacaaggccagcggcugcagcgacaaccccaacagacacgugaacuaccuggagcacgugguggugagaaucaccaucacccaccccagaagaggcgaccuggccaucuaccugaccagccccagcggcaccagaagccagcugcuggccaacagacuguucgaccacagcauggagggcuucaagaacugggaguucaugaccauccacugcuggggcgagagagccgccggcgacugggugcuggagguguacgacacccccagccagcugagaaacuucaagacccccggcaagcugaaggaguggagccuggugcuguacggcaccagcgugcagcccuacagccccaccaacgaguuccccaagguggagagauucagauacagcagaguggaggaccccaccgacgacuacggcaccgaggacuacgccggccccugcgaccccgagugcagcgaggugggcugcgacggccccggccccgaccacugcaacgacugccugcacuacuacuacaagcugaagaacaacaccagaaucugcgugagcagcugcccccccggccacuaccacgccgacaagaagagaugcagaaagugcgcccccaacugcgagagcugcuucggcagccacggcgaccagugcaugagcugcaaguacggcuacuuccugaacgaggagaccaacagcugcgugacccacugccccgacggcagcuaccaggacaccaagaagaaccugugcagaaagugcagcgagaacugcaagaccugcaccgaguuccacaacugcaccgagugcagagacggccugagccugcagggcagcagaugcagcgugagcugcgaggacggcagauacuucaacggccaggacugccagcccugccacagauucugcgccaccugcgccggcgccggcgccgacggcugcaucaacugcaccgagggcuacuucauggaggacggcagaugcgugcagagcugcagcaucagcuacuacuucgaccacagcagcgagaacggcuacaagagcugcaagaagugcgacaucagcugccugaccugcaacggccccggcuucaagaacugcaccagcugccccagcggcuaccugcuggaccugggcaugugccagaugggcgccaucugcaaggacggcgaguacguggacgagcacggccacugccagaccugcgaggccagcugcgccaagugccagggccccacccaggaggacugcaccaccugccccaugaccagaaucuucgacgacggcagaugcgugagcaacugccccagcuggaaguucgaguucgagaaccagugccaccccugccaccacaccugccagagaugccagggcagcggccccacccacugcaccagcugcggcgccgacaacuacggcagagagcacuuccuguaccagggcgagugcggcgacagcugccccgagggccacuacgccaccgagggcaacaccugccugcccugccccgacaacugcgagcugugccacagcgugcacgugugcaccagaugcaugaagggcuacuucaucgcccccaccaaccacaccugccagaagcuggagugcggccagggcgaggugcaggaccccgacuacgaggagugcgugcccugcgaggagggcugccugggcugcagccuggacgaccccggcaccugcaccagcugcgccaugggcuacuacagauucgaccaccacugcuacaagaccugccccgagaagaccuacagcgaggagguggagugcaaggccugcgacagcaacugcggcagcugcgaccagaacggcugcuacuggugcgaggagggcuucuuccugcugggcggcagcugcgugagaaagugcggccccggcuucuacggcgaccaggagaugggcgagugcgagagcugccacagagccugcgagaccugcaccggccccggccacgacgagugcagcagcugccaggagggccugcagcugcugagaggcaugugcgugcacgccaccaagacccaggaggagggcaaguucuggaacgacauccugagaaagcugcagcccugccacagcagcugcaagaccugcaacggcagcgccacccugugcaccagcugccccaagggcgccuaccugcuggcccaggccugcgugagcagcugcccccagggcaccuggcccagcgugagaagcggcagcugcgagaacugcaccgaggccugcgccaucugcagcggcgccgaccugugcaagaagugccagaugcagcccggccacccccuguuccugcacgagggcagaugcuacagcaagugccccgagggcagcuacgccgaggacggcaucugcgagagaugcagcagccccugcagaaccugcgagggcaacgccaccaacugccacagcugcgagggcggccacgugcugcaccacggcgugugccaggagaacugccccgagagacacguggccgugaagggcgugugcaagcacugccccgagaugugccaggacugcauccacgagaagaccugcaaggagugcacccccgaguucuuccugcacgacgacaugugccaccagagcugccccagaggcuucuacgccgacagcagacacugcgugcccugccacaaggacugccuggagugcagcggccccaaggccgacgacugcgagcugugccuggagagcagcugggugcuguacgacggccugugccuggaggagugccccgccggcaccuacuacgagaaggagaccaaggagugcagagacugccacaagagcugccugaccugcagcagcagcggcaccugcaccaccugccagaagggccugaucaugaaccccagaggcagcugcauggccaacgagaagugcagccccagcgaguacugggacgaggacgcccccggcugcaagcccugccacgugaagugcuuccacugcaugggccccgccgaggaccagugccagaccugccccaugaacagccugcugcugaacaccaccugcgugaaggacugccccgagggcuacuacgccgacgaggacagcaacagaugcgcccacugccacagcagcugcagaaccugcgagggcagacacagcagacagugccacagcugcagacccggcugguuccagcugggcaaggagugccugcugcagugcagagagggcuacuacgccgacaacagcaccggcagaugcgagagaugcaacagaagcugcaagggcugccagggccccagacccaccgacugccugagcugcgacagauucuucuuccugcugagaagcaagggcgagugccacagaagcugccccgaccacuacuacguggagcagagcacccagaccugcgagagaugccaccccaccugcgaccagugcaagggcaagggcgcccugaacugccugagcugcguguggagcuaccaccugaugggcggcaucugcaccagcgacugccuggugggcgaguacagagugggcgagggcgagaaguucaacugcgagaagugccacgagagcugcauggagugcaagggccccggcgccaagaacugcacccugugccccgccaaccuggugcugcacauggacgacagccacugccugcacugcugcaacaccagcgacccccccagcgcccaggagugcugcgacugccaggacaccaccgacgagugcauccugagaaccagcaaggugagacccgccaccgagcacuucaagaccgcccuguucaucaccagcagcaugaugcuggugcugcugcugggcgccgccguggugguguggaagaagagcagaggcagagugcagcccgccgccaaggccggcuacgagaagcuggccgaccccaacaagagcuacagcagcuacaagagcagcuacagagagagcaccagcuucgaggaggaccaggugaucgaguacagagacagagacuacgacgaggacgacgacgacgacaucguguacaugggccaggacggcaccguguacagaaaguucaaguacggccugcuggacgacgacgacaucgacgagcuggaguacgacgacgagagcuacagcuacuaccaguaa

SEQ ID NO: 21285 - RNA, 2910 nt, Artificial Sequence
  PCSK6__Homo_sapiens__NP_002561
augccccccagagccccccccgcccccggccccagacccccccccagagccgccgccgccaccgacaccgccgccggcgccggcggcgccggcggcgccggcggcgccggcggccccggcuucagaccccuggcccccagacccuggagauggcugcugcugcuggcccugcccgccgccugcagcgcccccccccccagacccguguacaccaaccacugggccgugcaggugcugggcggccccgccgaggccgacagaguggccgccgcccacggcuaccugaaccugggccagaucggcaaccuggaggacuacuaccacuucuaccacagcaagaccuucaagagaagcacccugagcagcagaggcccccacaccuuccugagaauggacccccaggugaaguggcugcagcagcaggaggugaagagaagagugaagagacaggugagaagcgacccccaggcccuguacuucaacgaccccaucuggagcaacaugugguaccugcacugcggcgacaagaacagcagaugcagaagcgagaugaacgugcaggccgccuggaagagaggcuacaccggcaagaacgugguggugaccauccuggacgacggcaucgagagaaaccaccccgaccuggcccccaacuacgacagcuacgccagcuacgacgugaacggcaacgacuacgaccccagccccagauacgacgccagcaacgagaacaagcacggcaccagaugcgccggcgagguggccgccagcgccaacaacagcuacugcaucgugggcaucgccuacaacgccaagaucggcggcaucagaaugcuggacggcgacgugaccgacgugguggaggccaagagccugggcaucagacccaacuacaucgacaucuacagcgccagcuggggccccgacgacgacggcaagaccguggacggccccggcagacuggccaagcaggccuucgaguacggcaucaagaagggcagacagggccugggcagcaucuucgugugggccagcggcaacggcggcagagagggcgacuacugcagcugcgacggcuacaccaacagcaucuacaccaucagcgugagcagcgccaccgagaacggcuacaagcccugguaccuggaggagugcgccagcacccuggccaccaccuacagcagcggcgccuucuacgagagaaagaucgugaccaccgaccugagacagagaugcaccgacggccacaccggcaccagcgugagcgcccccaugguggccggcaucaucgcccuggcccuggaggccaacagccagcugaccuggagagacgugcagcaccugcuggugaagaccagcagacccgcccaccugaaggccagcgacuggaaggugaacggcgccggccacaaggugagccacuucuacggcuucggccugguggacgccgaggcccuggugguggaggccaagaaguggaccgccgugcccagccagcacaugugcguggccgccagcgacaagagacccagaagcaucccccuggugcaggugcugagaaccaccgcccugaccagcgccugcgccgagcacagcgaccagagagugguguaccuggagcacgugguggugagaaccagcaucagccaccccagaagaggcgaccugcagaucuaccuggugagccccagcggcaccaagagccagcugcuggccaagagacugcuggaccugagcaacgagggcuucaccaacugggaguucaugaccgugcacugcuggggcgagaaggccgagggccaguggacccuggagauccaggaccugcccagccaggugagaaaccccgagaagcagggcaagcugaaggaguggagccugauccuguacggcaccgccgagcaccccuaccacaccuucagcgcccaccagagcagaagcagaaugcuggagcugagcgcccccgagcuggagccccccaaggccgcccugagccccagccagguggaggugcccgaggacgaggaggacuacaccgcccagagcacccccggcagcgccaacauccugcagaccagcgugugccaccccgagugcggcgacaagggcugcgacggccccaacgccgaccagugccugaacugcgugcacuucagccugggcagcgugaagaccagcagaaagugcgugagcgugugcccccugggcuacuucggcgacaccgccgccagaagaugcagaagaugccacaagggcugcgagaccugcagcagcagagccgccacccagugccugagcugcagaagaggcuucuaccaccaccaggagaugaacaccugcgugacccugugccccgccggcuucuacgccgacgagagccagaagaacugccugaagugccaccccagcugcaagaagugcguggacgagcccgagaagugcaccgugugcaaggagggcuucagccuggccagaggcagcugcauccccgacugcgagcccggcaccuacuucgacagcgagcugaucagaugcggcgagugccaccacaccugcggcaccugcgugggccccggcagagaggagugcauccacugcgccaagaacuuccacuuccacgacuggaagugcgugcccgccugcggcgagggcuucuaccccgaggagaugcccggccugccccacaaggugugcagaagaugcgacgagaacugccugagcugcgccggcagcagcagaaacugcagcagaugcaagaccggcuucacccagcugggcaccagcugcaucaccaaccacaccugcagcaacgccgacgagaccuucugcgagauggugaagagcaacagacugugcgagagaaagcuguucauccaguucugcugcagaaccugccugcuggccggcuaa

SEQ ID NO: 21286 - RNA, 2358 nt, Artificial Sequence
  PCSK7__Homo_sapiens__NP_004707
augcccaagggcagacagaaggugccccaccuggacgccccccugggccugcccaccugccuguggcuggagcuggccggccuguuccugcuggugcccugggugaugggccuggccggcaccggcggccccgacggccagggcaccggcggccccagcugggccgugcaccuggagagccuggagggcgacggcgaggaggagacccuggagcagcaggccgacgcccuggcccaggccgccggccuggugaacgccggcagaaucggcgagcugcagggccacuaccuguucgugcagcccgccggccacagacccgcccuggagguggaggccaucagacagcagguggaggccgugcuggccggccacgaggccgugagauggcacagcgagcagagacugcugagaagagccaagagaagcgugcacuucaacgaccccaaguacccccagcaguggcaccugaacaacagaagaagccccggcagagacaucaacgugaccggcgugugggagagaaacgugaccggcagaggcgugaccgugguggugguggacgacggcguggagcacaccauccaggacaucgcccccaacuacagccccgagggcagcuacgaccugaacagcaacgaccccgaccccaugccccaccccgacguggagaacggcaaccaccacggcaccagaugcgccggcgagaucgccgccgugcccaacaacagcuucugcgccgugggcguggccuacggcagcagaaucgccggcaucagagugcuggacggcccccugaccgacagcauggaggccguggccuucaacaagcacuaccagaucaacgacaucuacagcugcagcuggggccccgacgacgacggcaagaccguggacggcccccaccagcugggcaaggccgcccugcagcacggcgugaucgccggcagacagggcuucggcagcaucuucgugguggccagcggcaacggcggccagcacaacgacaacugcaacuacgacggcuacgccaacagcaucuacaccgugaccaucggcgccguggacgaggagggcagaaugcccuucuacgccgaggagugcgccagcaugcuggccgugaccuucagcggcggcgacaagaugcugagaagcaucgugaccaccgacugggaccugcagaagggcaccggcugcaccgagggccacaccggcaccagcgccgccgccccccuggccgccggcaugaucgcccugaugcugcaggugagacccugccugaccuggagagacgugcagcacaucaucguguucaccgccaccagauacgaggacagaagagccgagugggugaccaacgaggccggcuucagccacagccaccagcacggcuucggccugcugaacgccuggagacuggugaacgccgccaagaucuggaccagcgugcccuaccuggccagcuacgugagccccgugcugaaggagaacaaggccaucccccagagccccagaagccuggaggugcuguggaacgugagcagaauggaccuggagaugagcggccugaagacccuggagcacguggccgugaccgugagcaucacccaccccagaagaggcagccuggagcugaagcuguucugccccagcggcaugaugagccugaucggcgcccccagaagcauggacagcgaccccaacggcuucaacgacuggaccuucagcaccgugagaugcuggggcgagagagccagaggcaccuacagacuggugaucagagacgugggcgacgagagcuuccaggugggcauccugagacaguggcagcugacccuguacggcagcguguggagcgccguggacaucagagacagacagagacugcuggagagcgccaugagcggcaaguaccugcacgacgacuucgcccugcccugcccccccggccugaagauccccgaggaggacggcuacaccaucacccccaacacccugaagacccuggugcuggugggcugcuucaccguguucuggaccguguacuacaugcuggagguguaccugagccagagaaacguggccagcaaccaggugugcagaagcggccccugccacuggccccacagaagcagaaaggccaaggaggagggcaccgagcuggagagcgugccccugugcagcagcaaggaccccgacgagguggagaccgagagcagaggcccccccaccaccagcgaccugcuggcccccgaccugcuggagcagggcgacuggagccugagccagaacaagagcgcccuggacugcccccaccagcaccuggacgugccccacggcaaggaggagcagaucugcuaa

SEQ ID NO: 21287 - RNA, 429 nt, Artificial Sequence
  PCTP__Homo_sapiens__NP_001095872
auggacagcgacuacagaaagcagugggaccaguacgugaaggagcuguacgagcaggagugcaacggcgagaccgugguguacugggaggugaaguaccccuuccccaugagcaacagagacuacguguaccugagacagagaagagaccuggacauggagggcagaaagauccacgugauccuggccagaagcaccagcaugccccagcugggcgagagaagcggcgugaucagagugaagcaguacaagcagagccuggccaucgagagcgacggcaagaagggcagcaagguguucauguacuacuucgacaaccccggcggccagauccccagcuggcugaucaacugggccgccaagaacggcgugcccaacuuccugaaggacauggccagagccugccagaacuaccugaagaagaccuaa

SEQ ID NO: 21288 - RNA, 1104 nt, Artificial Sequence
  PCYT1A__Homo_sapiens__NP_005008
auggacgcccagugcagcgccaaggugaacgccagaaagagaagaaaggaggcccccggccccaacggcgccaccgaggaggacggcgugcccagcaaggugcagagaugcgccgugggccugagacagcccgcccccuucagcgacgagaucgagguggacuucagcaagcccuacgugagagugaccauggaggaggccagcagaggcacccccugcgagagacccgugagaguguacgccgacggcaucuucgaccuguuccacagcggccacgccagagcccugaugcaggccaagaaccuguuccccaacaccuaccugaucgugggcgugugcagcgacgagcugacccacaacuucaagggcuucaccgugaugaacgagaacgagagauacgacgccgugcagcacugcagauacguggacgagguggugagaaacgcccccuggacccugacccccgaguuccuggccgagcacagaaucgacuucguggcccacgacgacauccccuacagcagcgccggcagcgacgacguguacaagcacaucaaggaggccggcauguucgcccccacccagagaaccgagggcaucagcaccagcgacaucaucaccagaaucgugagagacuacgacguguacgccagaagaaaccugcagagaggcuacaccgccaaggagcugaacgugagcuucaucaacgagaagaaguaccaccugcaggagagaguggacaaggugaagaagaaggugaaggacguggaggagaagagcaaggaguucgugcagaagguggaggagaagagcaucgaccugauccagaagugggaggagaagagcagagaguucaucggcagcuuccuggagauguucggccccgagggcgcccugaagcacaugcugaaggagggcaagggcagaaugcugcaggccaucagccccaagcagagccccagcagcagccccaccagagagagaagccccagccccagcuucagauggcccuucagcggcaagaccagcccccccugcagccccgccaaccugagcagacacaaggccgccgccuacgacaucagcgaggacgaggaggacuaa

SEQ ID NO: 21289 - RNA, 1056 nt, Artificial Sequence
  PCYT1B__Homo_sapiens__NP_001156736
auggugggccaccaggagugcaucauggaggaggacaacagagccccccagcuguggagaaagacccugaccgcccccgcccccuucgccgacgagaccaacugccagugccaggccccccacgagaagcugaccaucgcccaggccagacugggcacccccgccgacagacccgugagaguguacgccgacggcaucuucgaccuguuccacagcggccacgccagagcccugaugcaggccaagacccuguuccccaacagcuaccugcuggugggcgugugcagcgacgaccugacccacaaguucaagggcuucaccgugaugaacgaggccgagagauacgaggcccugagacacugcagauacguggacgaggugaucagagacgcccccuggacccugacccccgaguuccuggagaagcacaagaucgacuucguggcccacgacgacauccccuacagcagcgccggcagcgacgacguguacaagcacaucaaggaggccggcauguucgugcccacccagagaaccgagggcaucagcaccagcgacaucaucaccagaaucgugagagacuacgacguguacgccagaagaaaccugcagagaggcuacaccgccaaggagcugaacgugagcuucaucaacgagaagagauacagauuccagaaccagguggacaagaugaaggagaaggugaagaacguggaggagagaagcaaggaguucgugaacagaguggaggagaagagccacgaccugauccagaagugggaggagaagagcagagaguucaucggcaacuuccuggagcuguucggccccgacggcgccuggaagcagauguuccaggagagaagcagcagaaugcugcaggcccugagccccaagcagagccccgugagcagccccaccagaagcagaagccccagcagaagccccagccccaccuucagcuggcugccccugaagaccagcccccccagcagccccaaggccgccagcgccagcaucagcagcaugagcgagggcgacgaggacgagaaguaa

SEQ ID NO: 21290 - RNA, 546 nt, Artificial Sequence
  PDAP1__Homo_sapiens__NP_055706
augcccaagggcggcagaaagggcggccacaagggcagagccagacaguacaccagccccgaggagaucgacgcccagcugcaggccgagaagcagaaggccagagaggaggaggagcagaaggagggcggcgacggcgccgccggcgaccccaagaaggagaagaagagccuggacagcgacgagagcgaggacgaggaggacgacuaccagcagaagagaaagggcguggagggccugaucgacaucgagaaccccaacagaguggcccagaccaccaagaaggugacccagcuggaccuggacggccccaaggagcugagcagaagagagagagaggagaucgagaagcagaaggccaaggagagauacaugaagaugcaccuggccggcaagaccgagcaggccaaggccgaccuggccagacuggccaucaucagaaagcagagagaggaggccgccagaaagaaggaggaggagagaaaggccaaggacgacgccacccugagcggcaagagaaugcagagccugagccugaacaaguaa

SEQ ID NO: 21291 - RNA, 639 nt, Artificial Sequence
  PDCD10__Homo_sapiens__NP_665859
augagaaugaccauggaggagaugaagaacgaggccgagaccaccagcauggugagcaugccccuguacgccgugauguaccccguguucaacgagcuggagagagugaaccugagcgccgcccagacccugagagccgccuucaucaaggccgagaaggagaaccccggccugacccaggacaucaucaugaagauccuggagaagaagagcguggaggugaacuucaccgagagccugcugagaauggccgccgacgacguggaggaguacaugaucgagagacccgagcccgaguuccaggaccugaacgagaaggccagagcccugaagcagauccugagcaagauccccgacgagaucaacgacagagugagauuccugcagaccaucaaggacaucgccagcgccaucaaggagcugcuggacaccgugaacaacguguucaagaaguaccaguaccagaacagaagagcccuggagcaccagaagaaggaguucgugaaguacagcaagagcuucagcgacacccugaagaccuacuucaaggacggcaaggccaucaacguguucgugagcgccaacagacugauccaccagaccaaccugauccugcagaccuucaagaccguggccuaa

SEQ ID NO: 21292 - RNA, 867 nt, Artificial Sequence
  PDCD1__Homo_sapiens__NP_005009
augcagaucccccaggcccccuggcccguggugugggccgugcugcagcugggcuggagacccggcugguuccuggacagccccgacagacccuggaacccccccaccuucagccccgcccugcugguggugaccgagggcgacaacgccaccuucaccugcagcuucagcaacaccagcgagagcuucgugcugaacugguacagaaugagccccagcaaccagaccgacaagcuggccgccuuccccgaggacagaagccagcccggccaggacugcagauucagagugacccagcugcccaacggcagagacuuccacaugagcguggugagagccagaagaaacgacagcggcaccuaccugugcggcgccaucagccuggcccccaaggcccagaucaaggagagccugagagccgagcugagagugaccgagagaagagccgaggugcccaccgcccaccccagccccagccccagacccgccggccaguuccagacccugguggugggcguggugggcggccugcugggcagccuggugcugcuggugugggugcuggccgugaucugcagcagagccgccagaggcaccaucggcgccagaagaaccggccagccccugaaggaggaccccagcgccgugcccguguucagcguggacuacggcgagcuggacuuccaguggagagagaagacccccgagccccccgugcccugcgugcccgagcagaccgaguacgccaccaucguguuccccagcggcaugggcaccagcagccccgccagaagaggcagcgccgacggccccagaagcgcccagccccugagacccgaggacggccacugcagcuggccccuguaa

SEQ ID NO: 21293 - RNA, 822 nt, Artificial Sequence
  PDCD1LG2__Homo_sapiens__NP_079515
augaucuuccugcugcugaugcugagccuggagcugcagcugcaccagaucgccgcccuguucaccgugaccgugcccaaggagcuguacaucaucgagcacggcagcaacgugacccuggagugcaacuucgacaccggcagccacgugaaccugggcgccaucaccgccagccugcagaagguggagaacgacaccagcccccacagagagagagccacccugcuggaggagcagcugccccugggcaaggccagcuuccacaucccccaggugcaggugagagacgagggccaguaccagugcaucaucaucuacggcguggccugggacuacaaguaccugacccugaaggugaaggccagcuacagaaagaucaacacccacauccugaaggugcccgagaccgacgagguggagcugaccugccaggccaccggcuacccccuggccgaggugagcuggcccaacgugagcgugcccgccaacaccagccacagcagaacccccgagggccuguaccaggugaccagcgugcugagacugaagcccccccccggcagaaacuucagcugcguguucuggaacacccacgugagagagcugacccuggccagcaucgaccugcagagccagauggagcccagaacccaccccaccuggcugcugcacaucuucauccccuucugcaucaucgccuucaucuucaucgccaccgugaucgcccugagaaagcagcugugccagaagcuguacagcagcaaggacaccaccaagagacccgugaccaccaccaagagagaggugaacagcgccaucuaa

SEQ ID NO: 21294 - RNA, 936 nt, Artificial Sequence
  PDCD2__Homo_sapiens__NP_001186391
auggccgccgccggcgccagacccguggagcugggcuucgccgagagcgcccccgccuggagacugagaagcgagcaguuccccagcaagguguacgccccccugcccggcagacccgacgccuuccacagaugcaucuuccuguucugcugcagagagcagcccugcugcgccggccugagaguguucagaaaccagcugcccagaaagaacgacuucuacagcuacgagccccccagcgagaaccccccccccgagaccggcgagagcgugugccugcagcugaagagcggcgcccaccugugcagagugugcggcugccugggccccaagaccugcagcagaugccacaaggccuacuacugcagcaaggagcaccagacccuggacuggagacugggccacaagcaggccugcgcccagcccgaccaccuggaccacaucauccccgaccacaacuuccuguuccccgaguucgagaucgugaucgagaccgaggacgagaucaugcccgaggugguggagaaggaggacuacagcgagaucaucggcagcaugggcgaggcccuggaggaggagcuggacagcauggccaagcacgagagcagagaggacaagaucuuccagaaguucaagacccagaucgcccuggagcccgagcagauccugagauacggcagaggcaucgcccccaucuggaucagcggcgagaacaucccccaggagaaggacauccccgacugccccugcggcgccaagagaauccuggaguuccaggugaugccccagcugcugaacuaccugaaggccgacagacugggcaagagcaucgacuggggcauccuggccguguucaccugcgccgagagcugcagccugggcaccggcuacaccgaggaguucguguggaagcaggacgugaccgacacccccuaa

SEQ ID NO: 21295 - RNA, 1368 nt, Artificial Sequence
  PDCD4__Homo_sapiens__NP_001186421
auggacguggagaacgagcagauccugaacgugaaccccgccgagaacgccggcaccgaggagaucaagaacgagaucaacggcaacuggaucagcgccagcagcaucaacgaggccagaaucaacgccaaggccaagagaagacugagaaagaacagcagcagagacagcggcagaggcgacagcgugagcgacagcggcagcgacgcccugagaagcggccugaccgugcccaccagccccaagggcagacugcuggacagaagaagcagaagcggcaagggcagaggccugcccaagaagggcggcgccggcggcaagggcguguggggcacccccggccagguguacgacguggaggagguggacgugaaggaccccaacuacgacgacgaccaggagaacugcguguacgagaccguggugcugccccuggacgagagagccuucgagaagacccugacccccaucauccaggaguacuucgagcacggcgacaccaacgagguggccgagaugcugagagaccugaaccugggcgagaugaagagcggcgugcccgugcuggccgugagccuggcccuggagggcaaggccagccacagagagaugaccagcaagcugcugagcgaccugugcggcaccgugaugagcaccaccgacguggagaagagcuucgacaagcugcugaaggaccugcccgagcuggcccuggacacccccagagccccccagcuggugggccaguucaucgccagagccgugggcgacggcauccugugcaacaccuacaucgacagcuacaagggcaccguggacugcgugcaggccagagccgcccuggacaaggccaccgugcugcugagcaugagcaagggcggcaagagaaaggacagcguguggggcagcggcggcggccagcagagcgugaaccaccuggugaaggagaucgacaugcugcugaaggaguaccugcugagcggcgacaucagcgaggccgagcacugccugaaggagcuggaggugccccacuuccaccacgagcugguguacgaggccaucaucauggugcuggagagcaccggcgagagcaccuucaagaugauccuggaccugcugaagagccuguggaagagcagcaccaucaccguggaccagaugaagagaggcuacgagagaaucuacaacgagauccccgacaucaaccuggacgugccccacagcuacagcgugcuggagagauucguggaggagugcuuccaggccggcaucaucagcaagcagcugagagaccugugccccagcagaggcagaaagagauucgugagcgagggcgacggcggcagacugaagcccgagagcuacuaa

SEQ ID NO: 21296 - RNA, 378 nt, Artificial Sequence
  PDCD5__Homo_sapiens__NP_004699
auggccgacgaggagcuggaggcccugagaagacagagacuggccgagcugcaggccaagcacggcgaccccggcgacgccgcccagcaggaggccaagcacagagaggccgagaugagaaacagcauccuggcccaggugcuggaccagagcgccagagccagacugagcaaccuggcccuggugaagcccgagaagaccaaggccguggagaacuaccugauccagauggccagauacggccagcugagcgagaaggugagcgagcagggccugaucgagauccugaagaaggugagccagcagaccgagaagaccaccaccgugaaguucaacagaagaaaggugauggacagcgacgaggacgacgacuacuaa

SEQ ID NO: 21297 - RNA, 570 nt, Artificial Sequence
  PDCD6__Homo_sapiens__NP_001254485
auggccgccuacagcuacagacccggccccggcgccggccccggccccgccgccggcgccgcccugcccgaccagagcuuccuguggaacguguuccagagaguggacaaggacagaagcggcgugaucagcgacaccgagcugcagcaggcccugagcaacggcaccuggacccccuucaaccccgugaccgugagaagcaucaucagcauguucgacagagagaacaaggccggcgugaacuucagcgaguucaccggcguguggaaguacaucaccgacuggcagaacguguucagaaccuacgacagagacaacagcggcaugaucgacaagaacgagcugaagcaggcccugagcggcuacagacugagcgaccaguuccacgacauccugaucagaaaguucgacagacagggcagaggccagaucgccuucgacgacuucauccagggcugcaucgugcugcagagacugaccgacaucuucagaagauacgacaccgaccaggacggcuggauccaggugagcuacgagcaguaccugagcaugguguucagcaucguguaa

SEQ ID NO: 21298 - RNA, 2622 nt, Artificial Sequence
  PDCD6IP__Homo_sapiens__NP_001155901
auggccaccuucaucagcgugcagcugaagaagaccagcgagguggaccuggccaagccccuggugaaguucauccagcagaccuaccccagcggcggcgaggagcaggcccaguacugcagagccgccgaggagcugagcaagcugagaagagccgccgugggcagaccccuggacaagcacgagggcgcccuggagacccugcugagauacuacgaccagaucugcagcaucgagcccaaguuccccuucagcgagaaccagaucugccugaccuucaccuggaaggacgccuucgacaagggcagccuguucggcggcagcgugaagcuggcccuggccagccugggcuacgagaagagcugcgugcuguucaacugcgccgcccuggccagccagaucgccgccgagcagaaccuggacaacgacgagggccugaagaucgccgccaagcacuaccaguucgccagcggcgccuuccugcacaucaaggagaccgugcugagcgcccugagcagagagcccaccguggacaucagccccgacaccgugggcacccugagccugaucaugcuggcccaggcccaggagguguucuuccugaaggccaccagagacaagaugaaggacgccaucaucgccaagcuggccaaccaggccgccgacuacuucggcgacgccuucaagcagugccaguacaaggacacccugcccaaguacuucuacuuccaggagguguuccccgugcuggccgccaagcacugcaucaugcaggccaacgccgaguaccaccagagcauccuggccaagcagcagaagaaguucggcgaggagaucgccagacugcagcacgccgccgagcugaucaagaccguggccagcagauacgacgaguacgugaacgugaaggacuucagcgacaagaucaacagagcccuggccgccgccaagaaggacaacgacuucaucuaccacgacagagugcccgaccugaaggaccuggaccccaucggcaaggccacccuggugaagagcacccccgugaacgugcccaucagccagaaguucaccgaccuguucgagaagauggugcccgugagcgugcagcagagccuggccgccuacaaccagagaaaggccgaccuggugaacagaagcaucgcccagaugagagaggccaccacccuggccaacggcgugcuggccagccugaaccugcccgccgccaucgaggacgugagcggcgacaccgugccccagagcauccugaccaagagcagaagcgugaucgagcagggcggcauccagaccguggaccagcugaucaaggagcugcccgagcugcugcagagaaacagagagauccuggacgagagccugagacugcuggacgaggaggaggccaccgacaacgaccugagagccaaguucaaggagagauggcagagaacccccagcaacgagcuguacaagccccugagagccgagggcaccaacuucagaaccgugcuggacaaggccgugcaggccgacggccaggugaaggagugcuaccagagccacagagacaccaucgugcugcugugcaagcccgagcccgagcugaacgccgccauccccagcgccaaccccgccaagaccaugcagggcagcgagguggugaacgugcugaagagccugcugagcaaccuggacgaggugaagaaggagagagagggccuggagaacgaccugaagagcgugaacuucgacaugaccagcaaguuccugaccgcccuggcccaggacggcgugaucaacgaggaggcccugagcgugaccgagcuggacagaguguacggcggccugaccaccaaggugcaggagagccugaagaagcaggagggccugcugaagaacauccaggugagccaccaggaguucagcaagaugaagcagagcaacaacgaggccaaccugagagaggaggugcugaagaaccuggccaccgccuacgacaacuucguggagcugguggccaaccugaaggagggcaccaaguucuacaacgagcugaccgagauccuggugagauuccagaacaagugcagcgacaucguguucgccagaaagaccgagagagacgagcugcugaaggaccugcagcagagcaucgccagagagcccagcgcccccagcauccccacccccgccuaccagagcagccccgccggcggccacgcccccaccccccccacccccgcccccagaaccaugccccccaccaagccccagccccccgccagaccccccccccccgugcugcccgccaacagagcccccagcgccaccgcccccagccccgugggcgccggcaccgccgcccccgcccccagccagacccccggcagcgccccccccccccaggcccagggcccccccuaccccaccuaccccggcuaccccggcuacugccagaugcccaugcccaugggcuacaaccccuacgccuacggccaguacaacaugcccuacccccccguguaccaccagagccccggccaggcccccuaccccggcccccagcagcccagcuaccccuucccccagcccccccagcagagcuacuacccccagcaguaa

SEQ ID NO: 21299 - RNA, 1458 nt, Artificial Sequence
  PDCD7__Homo_sapiens__NP_005698
auggcccugccccccuucuucggccagggcagacccggccccccccccccccagccccccccccccgcccccuucggcugccccccccccccccugcccagccccgccuucccccccccccugccccagagacccggccccuuccccggcgccagcgcccccuuccugcagcccccccuggcccugcagcccagagccagcgccgaggccagcagaggcggcggcggcgccggcgccuucuaccccgugcccccccccccccugccccccccccccccccagugcagacccuuccccggcaccgacgccggcgagagacccagaccccccccccccggccccggcccccccuggagccccagauggcccgaggccccccccccccccgccgacgugcugggcgacgccgcccugcagagacugagagacagacaguggcuggaggccguguucggcacccccagaagagccggcugccccgugccccagagaacccacgccggccccagccugggcgaggugagagccagacugcugagagcccugagacuggugagaagacugagaggccugagccaggcccugagagaggccgaggccgacggcgccgccugggugcugcuguacagccagaccgccccccugagagccgagcuggccgagagacugcagccccugacccaggccgccuacgugggcgaggccagaagaagacuggagagagugagaagaagaagacugagacugagagagagagccagagagagagaggccgagagagaggccgaggccgccagagccguggagagagagcaggagaucgacagauggagagugaagugcgugcaggagguggaggagaagaagagagagcaggagcugaaggccgccgccgacggcgugcugagcgaggugagaaagaagcaggccgacaccaagagaaugguggacauccugagagcccuggagaagcugagaaagcugagaaaggaggccgccgccagaaagggcgugugcccccccgccagcgccgacgagaccuucacccaccaccugcagagacugagaaagcugaucaagaagagaagcgagcuguacgaggccgaggagagagcccugagagugaugcuggagggcgagcaggaggaggagagaaagagagagcuggagaagaagcagagaaaggagaaggagaagauccugcugcagaagagagagaucgagagcaagcuguucggcgaccccgacgaguucccccuggcccaccugcuggagcccuucagacaguacuaccugcaggccgagcacagccugcccgcccugauccagaucagacacgacugggaccaguaccuggugcccagcgaccaccccaagggcaacuucgugccccagggcugggugcugcccccccugcccagcaacgacaucugggccaccgccgugaagcugcacuaa

SEQ ID NO: 21300 - RNA, 585 nt, Artificial Sequence
  PDC__Homo_sapiens__NP_072098
augagcagcccccagagcagaaacggcaaggacagcaaggagagagugagcagaaagaugagcauccaggaguacgagcugauccacaaggagaaggaggacgagaacugccugagaaaguacagaagacagugcaugcaggacaugcaccagaagcugagcuucggccccagauacggcuucguguacgagcuggagaccggcaagcaguuccuggagaccaucgagaaggagcugaagaucaccaccaucguggugcacaucuacgaggacggcaucaagggcugcgacgcccugaacagcagccugaccugccuggccgccgaguaccccaucgugaaguucugcaagaucaaggccagcaacaccggcgccggcgacagauucagccuggacgugcugcccacccugcugaucuacaagggcggcgagcugaucagcaacuucaucagcguggccgagcaguucgccgaggaguucuucgccggcgacguggagagcuuccugaacgaguacggccugcugcccgagagagaggugcacgugcuggagcacaccaagaucgaggaggaggacguggaguaa

SEQ ID NO: 21301 - RNA, 726 nt, Artificial Sequence
  PDCL2__Homo_sapiens__NP_689614
augcaggaccccaacgaggacaccgaguggaacgacauccugagagacuucggcauccugccccccaaggaggagagcaaggacgagaucgaggagauggugcugagacugcagaaggaggccauggugaagcccuucgagaagaugacccuggcccagcugaaggaggccgaggacgaguucgacgaggaggacaugcaggccguggagaccuacagaaagaagagacugcaggaguggaaggcccugaagaagaagcagaaguucggcgagcugagagagaucagcggcaaccaguacgugaacgaggugaccaacgccgaggaggacgugugggugaucauccaccuguacagaagcagcauccccaugugccugcuggugaaccagcaccugagccugcuggccagaaaguuccccgagaccaaguucgugaaggccaucgugaacagcugcauccagcacuaccacgacaacugccugcccaccaucuucguguacaagaacggccagaucgaggccaaguucaucggcaucaucgagugcggcggcaucaaccugaagcuggaggagcuggaguggaagcuggccgaggugggcgccauccagaccgaccuggaggagaaccccagaaaggacaugguggacaugauggugagcagcaucagaaacaccagcauccacgacgacagcgacagcagcaacagcgacaacgacaccaaguaa

SEQ ID NO: 21302 - RNA, 720 nt, Artificial Sequence
  PDCL3__Homo_sapiens__NP_076970
augcaggaccccaacgccgacaccgaguggaacgacauccugagaaagaagggcauccugccccccaaggagagccugaaggagcuggaggaggaggccgaggaggagcagagaauccugcagcagagcguggugaagaccuacgaggacaugacccuggaggagcuggaggaccacgaggacgaguucaacgaggaggacgagagagccaucgagauguacagaagaagaagacuggccgaguggaaggccaccaagcugaagaacaaguucggcgaggugcuggagaucagcggcaaggacuacgugcaggaggugaccaaggccggcgagggccugugggugauccugcaccuguacaagcagggcaucccccugugcgcccugaucaaccagcaccugagcggccuggccagaaaguuccccgacgugaaguucaucaaggccaucagcaccaccugcauccccaacuaccccgacagaaaccugcccaccaucuucguguaccuggagggcgacaucaaggcccaguucaucggcccccugguguucggcggcaugaaccugaccagagacgagcuggaguggaagcugagcgagagcggcgccaucaugaccgaccuggaggagaaccccaagaagcccaucgaggacgugcugcugagcagcgugagaagaagcgugcugaugaagagagacagcgacagcgagggcgacuaa

SEQ ID NO: 21303 - RNA, 2370 nt, Artificial Sequence
  PDE10A__Homo_sapiens__NP_001124162
auggaggacggccccagcaacaacgccagcugcuucagaagacugaccgagugcuuccugagccccagccugaccgacgagaaggugaaggccuaccugagccugcacccccaggugcuggacgaguucgugagcgagagcgugagcgccgagaccguggagaaguggcugaagagaaagaacaacaagagcgaggacgagagcgcccccaaggaggugagcagauaccaggacaccaacaugcagggcgugguguacgagcugaacagcuacaucgagcagagacuggacaccggcggcgacaaccagcugcugcuguacgagcugagcagcaucaucaagaucgccaccaaggccgacggcuucgcccuguacuuccugggcgagugcaacaacagccugugcaucuucaccccccccggcaucaaggagggcaagcccagacugauccccgccggccccaucacccagggcaccaccgugagcgccuacguggccaagagcagaaagacccugcugguggaggacauccugggcgacgagagauuccccagaggcaccggccuggagagcggcaccagaauccagagcgugcugugccugcccaucgugaccgccaucggcgaccugaucggcauccuggagcuguacagacacuggggcaaggaggccuucugccugagccaccaggagguggccaccgccaaccuggccugggccagcguggccauccaccaggugcaggugugcagaggccuggccaagcagaccgagcugaacgacuuccugcuggacgugagcaagaccuacuucgacaacaucguggccaucgacagccugcuggagcacaucaugaucuacgccaagaaccuggugaacgccgacagaugcgcccuguuccagguggaccacaagaacaaggagcuguacagcgaccuguucgacaucggcgaggagaaggagggcaagcccguguucaagaagaccaaggagaucagauucagcaucgagaagggcaucgccggccagguggccagaaccggcgaggugcugaacauccccgacgccuacgccgaccccagauucaacagagagguggaccuguacaccggcuacaccaccagaaacauccugugcaugcccaucgugagcagaggcagcgugaucggcguggugcagauggugaacaagaucagcggcagcgccuucagcaagaccgacgagaacaacuucaagauguucgccguguucugcgcccuggcccugcacugcgccaacauguaccacagaaucagacacagcgagugcaucuacagagugaccauggagaagcugagcuaccacagcaucugcaccagcgaggaguggcagggccugaugcaguucacccugcccgugagacugugcaaggagaucgagcuguuccacuucgacaucggccccuucgagaacauguggcccggcaucuucguguacauggugcacagaagcugcggcaccagcugcuucgagcuggagaagcugugcagauucaucaugagcgugaagaagaacuacagaagagugcccuaccacaacuggaagcacgccgugaccguggcccacugcauguacgccauccugcagaacaaccacacccuguucaccgaccuggagagaaagggccugcugaucgccugccugugccacgaccuggaccacagaggcuucagcaacagcuaccugcagaaguucgaccacccccuggccgcccuguacagcaccagcaccauggagcagcaccacuucagccagaccgugagcauccugcagcuggagggccacaacaucuucagcacccugagcagcagcgaguacgagcaggugcuggagaucaucagaaaggccaucaucgccaccgaccuggcccuguacuucggcaacagaaagcagcuggaggagauguaccagaccggcagccugaaccugaacaaccagagccacagagacagagugaucggccugaugaugaccgccugcgaccugugcagcgugaccaagcuguggcccgugaccaagcugaccgccaacgacaucuacgccgaguucugggccgagggcgacgagaugaagaagcugggcauccagcccauccccaugauggacagagacaagaaggacgaggugccccagggccagcugggcuucuacaacgccguggccauccccugcuacaccacccugacccagauccugccccccaccgagccccugcugaaggccugcagagacaaccugagccagugggagaaggugaucagaggcgaggagaccgccaccuggaucagcagccccagcguggcccagaaggccgccgccagcgaggacuaa

SEQ ID NO: 21304 - RNA, 1470 nt, Artificial Sequence
  PDE11A__Homo_sapiens__NP_001070664
augagccccaagugcagcgccgacgccgagaacagcuucaaggagagcauggagaagagcagcuacagcgacuggcugaucaacaacagcaucgccgagcugguggccagcaccggccugcccgugaacaucagcgacgccuaccaggaccccagauucgacgccgaggccgaccagaucagcggcuuccacaucagaagcgugcugugcgugcccaucuggaacagcaaccaccagaucaucggcguggcccaggugcugaacagacuggacggcaagcccuucgacgacgccgaccagagacuguucgaggccuucgugaucuucugcggccugggcaucaacaacaccaucauguacgaccaggugaagaagagcugggccaagcagagcguggcccuggacgugcugagcuaccacgccaccugcagcaaggccgagguggacaaguucaaggccgccaacaucccccuggugagcgagcuggccaucgacgacauccacuucgacgacuucagccuggacguggacgccaugaucaccgccgcccugagaauguucauggagcugggcauggugcagaaguucaagaucgacuacgagacccugugcagauggcugcugaccgugagaaagaacuacagaauggugcuguaccacaacuggagacacgccuucaacgugugccagcugauguucgccaugcugaccaccgccggcuuccaggacauccugaccgagguggagauccuggccgugaucgugggcugccugugccacgaccuggaccacagaggcaccaacaacgccuuccaggccaagagcggcagcgcccuggcccagcuguacggcaccagcgccacccuggagcaccaccacuucaaccacgccgugaugauccugcagagcgagggccacaacaucuucgccaaccugagcagcaaggaguacagcgaccugaugcagcugcugaagcagagcauccuggccaccgaccugacccuguacuucgagagaagaaccgaguucuucgagcuggugagcaagggcgaguacgacuggaacaucaagaaccacagagacaucuucagaagcaugcugaugaccgccugcgaccugggcgccgugaccaagcccugggagaucagcagacagguggccgagcuggugaccagcgaguucuucgagcagggcgacagagagagacuggagcugaagcugacccccagcgccaucuucgacagaaacagaaaggacgagcugcccagacugcagcuggaguggaucgacagcaucugcaugccccuguaccaggcccuggugaaggugaacgugaagcugaagcccaugcuggacagcguggccaccaacagaagcaagugggaggagcugcaccagaagagacugcuggccagcaccgccagcagcagccccgccagcgugaugguggccaaggaggacagaaacuaa

SEQ ID NO: 21305 - RNA, 1830 nt, Artificial Sequence
  PDE12__Homo_sapiens__NP_808881
auguggagacugcccggcgccagagccgcccugagagugaucagaaccgccguggagaagcugagcagagccgaggccggcagccagaccgccgccggcgccauggagagagccguggugagaugcgugcccagcgagcccaagcugagccugagcuucgcccuggccgacggcagccacaagaacaugcagagagaccagagcgagccccugggcagagugcugagcagaaucgccaccaacgcccugaagggccacgccaaggccgccgccgccaagaagagcagaaagagcagacccaacgccagcggcggcgccgccugcagcggccccggccccgagcccgccguguucugcgagcccguggugaagcuguacuacagagaggaggccguggccgaggacgugcugaacguggacgccuggcaggacggcgccgugcugcagaucggcgacgugaaguacaagguggagagaaacccccccgccuucaccgagcugcagcugcccagauacaucauggccggcuuccccgugugccccaagcugagccuggaguucggcgaccccgccagcagccuguucagaugguacaaggaggccaagcccggcgccgccgagcccgaggugggcgugcccagcagccugagccccagcagccccagcagcagcuggaccgagaccgacguggaggagagaguguacacccccagcaacgccgacaucggccugagacugaagcugcacugcacccccggcgacggccagagauucggccacagcagagagcuggagagcgugugcgugguggaggccggccccggcaccugcaccuucgaccacagacaccuguacaccaagaaggugaccgaggacgcccugaucagaaccgugagcuacaacauccuggccgacaccuacgcccagaccgaguucagcagaaccgugcuguaccccuacugcgcccccuacgcccuggagcuggacuacagacagaaccugauccagaaggagcugaccggcuacaacgccgacgugaucugccugcaggagguggacagagccguguucagcgacagccuggugcccgcccuggaggccuucggccuggagggcguguucagaaucaagcagcacgagggccuggccaccuucuacagaaagagcaaguucagccugcugagccagcacgacaucagcuucuacgaggcccuggagagcgacccccugcacaaggagcugcuggagaagcuggugcuguaccccagcgcccaggagaaggugcugcagagaagcagcgugcugcaggugagcgugcugcagagcaccaaggacagcagcaagagaaucugcguggccaacacccaccuguacuggcaccccaagggcggcuacaucagacugauccagauggccguggcccuggcccacaucagacacgugagcugcgaccuguaccccggcauccccgugaucuucugcggcgacuucaacagcacccccagcaccggcauguaccacuucgugaucaacggcagcauccccgaggaccacgaggacugggccagcaacggcgaggaggagagaugcaacaugagccugacccacuucuucaagcugaagagcgccugcggcgagcccgccuacaccaacuacgugggcggcuuccacggcugccuggacuacaucuucaucgaccugaacgcccuggagguggagcaggugaucccccugcccagccacgaggaggugaccacccaccaggcccugcccagcgugagccaccccagcgaccacaucgcccuggugugcgaccugaaguggaaguaa

SEQ ID NO: 21306 - RNA, 1608 nt, Artificial Sequence
  PDE1A__Homo_sapiens__NP_001003683
augggcagcagcgccaccgagaucgaggagcuggagaacaccaccuucaaguaccugaccggcgagcagaccgagaagauguggcagagacugaagggcauccugagaugccuggugaagcagcuggagagaggcgacgugaacgugguggaccugaagaagaacaucgaguacgccgccagcgugcuggaggccguguacaucgacgagaccagaagacugcuggacaccgaggacgagcugagcgacauccagaccgacagcgugcccagcgaggugagagacuggcuggccagcaccuucaccagaaagaugggcaugaccaagaagaagcccgaggagaagcccaaguucagaagcaucgugcacgccgugcaggccggcaucuucguggagagaauguacagaaagaccuaccacauggugggccuggccuaccccgccgccgugaucgugacccugaaggacguggacaaguggagcuucgacguguucgcccugaacgaggccagcggcgagcacagccugaaguucaugaucuacgagcuguucaccagauacgaccugaucaacagauucaagauccccgugagcugccugaucaccuucgccgaggcccuggaggugggcuacagcaaguacaagaaccccuaccacaaccugauccacgccgccgacgugacccagaccgugcacuacaucaugcugcacaccggcaucaugcacuggcugaccgagcuggagauccuggccaugguguucgccgccgccauccacgacuacgagcacaccggcaccaccaacaacuuccacauccagaccagaagcgacguggccauccuguacaacgacagaagcgugcuggagaaccaccacgugagcgccgccuacagacugaugcaggaggaggagaugaacauccugaucaaccugagcaaggacgacuggagagaccugagaaaccuggugaucgagauggugcugagcaccgacaugagcggccacuuccagcagaucaagaacaucagaaacagccugcagcagcccgagggcaucgacagagccaagaccaugagccugauccugcacgccgccgacaucagccaccccgccaagagcuggaagcugcacuacagauggaccauggcccugauggaggaguucuuccugcagggcgacaaggaggccgagcugggccugcccuucagcccccugugcgacagaaagagcaccaugguggcccagagccagaucggcuucaucgacuucaucguggagcccaccuucagccugcugaccgacagcaccgagaagaucgugaucccccugaucgaggaggccagcaaggccgagaccagcagcuacguggccagcagcagcaccaccaucgugggccugcacaucgccgacgcccugagaagaagcaacaccaagggcagcaugagcgacggcagcuacagccccgacuacagccuggccgccguggaccugaagagcuucaagaacaaccugguggacaucauccagcagaacaaggagagauggaaggagcuggccgcccaggaggccagaaccagcagccagaagugcgaguucauccaccaguaa

SEQ ID NO: 21307 - RNA, 1611 nt, Artificial Sequence
  PDE1B__Homo_sapiens__NP_000915
auggagcugagccccagaagcccccccgagaugcuggaggagagcgacugccccagcccccuggagcugaagagcgcccccagcaagaagauguggaucaagcugagaagccugcugagauacauggugaagcagcuggagaacggcgagaucaacaucgaggagcugaagaagaaccuggaguacaccgccagccugcuggaggccguguacaucgacgagaccagacagauccuggacaccgaggacgagcugcaggagcugagaagcgacgccgugcccagcgaggugagagacuggcuggccagcaccuucacccagcaggccagagccaagggcagaagagccgaggagaagcccaaguucagaagcaucgugcacgccgugcaggccggcaucuucguggagagaauguucagaagaaccuacaccagcgugggccccaccuacagcaccgccgugcugaacugccugaagaaccuggaccuguggugcuucgacguguucagccugaaccaggccgccgacgaccacgcccugagaaccaucguguucgagcugcugaccagacacaaccugaucagcagauucaagauccccaccguguuccugaugagcuuccuggacgcccuggagaccggcuacggcaaguacaagaaccccuaccacaaccagauccacgccgccgacgugacccagaccgugcacugcuuccugcugagaaccggcauggugcacugccugagcgagaucgagcugcuggccaucaucuucgccgccgccauccacgacuacgagcacaccggcaccaccaacagcuuccacauccagaccaagagcgagugcgccaucguguacaacgacagaagcgugcuggagaaccaccacaucagcagcguguucagacugaugcaggacgacgagaugaacaucuucaucaaccugaccaaggacgaguucguggagcugagagcccuggugaucgagauggugcuggccaccgacaugagcugccacuuccagcaggugaagaccaugaagaccgcccugcagcagcuggagagaaucgacaagcccaaggcccugagccugcugcugcacgccgccgacaucagccaccccaccaagcaguggcuggugcacagcagauggaccaaggcccugauggaggaguucuucagacagggcgacaaggaggccgagcugggccugcccuucagcccccugugcgacagaaccagcacccugguggcccagagccagaucggcuucaucgacuucaucguggagcccaccuucagcgugcugaccgacguggccgagaagagcgugcagccccuggccgacgaggacagcaagagcaagaaccagcccagcuuccaguggagacagcccagccuggacguggaggugggcgaccccaaccccgacguggugagcuucagaagcaccugggugaagagaauccaggagaacaagcagaaguggaaggagagagccgccagcggcaucaccaaccagaugagcaucgacgagcugagccccugcgaggaggaggccccccccagccccgccgaggacgagcacaaccagaacggcaaccuggacuaa

SEQ ID NO: 21308 - RNA, 2130 nt, Artificial Sequence
  PDE1C__Homo_sapiens__NP_001177986
auggagagccccaccaaggagaucgaggaguucgagagcaacagccugaaguaccugcagcccgagcagaucgagaagaucuggcugagacugagaggccugagaaaguacaagaagaccagccagagacugagaagccuggugaagcagcuggagagaggcgaggccagcgugguggaccugaagaagaaccuggaguacgccgccaccgugcuggagagcguguacaucgacgagaccagaagacugcuggacaccgaggacgagcugagcgacauccagagcgacgccgugcccagcgaggugagagacuggcuggccagcaccuucaccagacagaugggcaugaugcugagaagaagcgacgagaagcccagauucaagagcaucgugcacgccgugcaggccggcaucuucguggagagaauguacagaagaaccagcaacauggugggccugagcuacccccccgccgugaucgaggcccugaaggacguggacaaguggagcuucgacguguucagccugaacgaggccagcggcgaccacgcccugaaguucaucuucuacgagcugcugaccagauacgaccugaucagcagauucaagauccccaucagcgcccuggugagcuucguggaggcccuggaggugggcuacagcaagcacaagaaccccuaccacaaccugaugcacgccgccgacgugacccagaccgugcacuaccugcuguacaagaccggcguggccaacuggcugaccgagcuggagaucuucgccaucaucuucagcgccgccauccacgacuacgagcacaccggcaccaccaacaacuuccacauccagaccagaagcgaccccgccauccuguacaacgacagaagcgugcuggagaaccaccaccugagcgccgccuacagacugcugcaggacgacgaggagaugaacauccugaucaaccugagcaaggacgacuggagagaguucagaacccuggugaucgagauggugauggccaccgacaugagcugccacuuccagcagaucaaggccaugaagaccgcccugcagcagcccgaggccaucgagaagcccaaggcccugagccugaugcugcacaccgccgacaucagccaccccgccaaggccugggaccugcaccacagauggaccaugagccugcuggaggaguucuucagacagggcgacagagaggccgagcugggccugcccuucagcccccugugcgacagaaagagcaccaugguggcccagagccaggugggcuucaucgacuucaucguggagcccaccuucaccgugcugaccgacaugaccgagaagaucgugagcccccugaucgacgagaccagccagaccggcggcaccggccagagaagaagcagccugaacagcaucagcagcagcgacgccaagagaagcggcgugaagaccagcggcagcgagggcagcgcccccaucaacaacagcgugaucagcguggacuacaagagcuucaaggccaccuggaccgagguggugcacaucaacagagagagauggagagccaaggugcccaaggaggagaaggccaagaaggaggccgaggagaaggccagacuggccgccgaggagcagcagaaggagauggaggccaagagccaggccgaggagggcgccagcggcaaggccgagaagaagaccagcggcgagaccaagaaccaggugaacggcaccagagccaacaagagcgacaaccccagaggcaagaacagcaaggccgagaagagcagcggcgagcagcagcagaacggcgacuucaaggacggcaagaacaagaccgacaagaaggaccacagcaacaucggcaacgacagcaagaagaccgacggcaccaagcagagaagccacggcagccccgcccccagcaccagcagcaccugcagacugacccugcccgugaucaagcccccccugagacacuucaagagacccgccuacgccagcagcagcuacgcccccagcgugagcaagaagaccgacgagcaccccgccagauacaagaugcuggaccagagaaucaagaugaagaagauccagaacaucagccacaacuggaacagaaaguaa

SEQ ID NO: 21309 - RNA, 2805 nt, Artificial Sequence
  PDE2A__Homo_sapiens__NP_001137311
auggugcuggugcugcaccacauccugaucgccguggugcaguuccugagaagaggccagcagguguuccugaagcccgacgagccccccccccccccccagcccugcgccgacagccugcaggacgcccugcugagccugggcagcgugaucgacaucagcggccugcagagagccgugaaggaggcccugagcgccgugcugcccagaguggagaccguguacaccuaccugcuggacggcgagagccagcuggugugcgaggaccccccccacgagcugccccaggagggcaaggugagagaggccaucaucagccagaagagacugggcugcaacggccugggcuucagcgaccugcccggcaagccccuggccagacugguggccccccuggcccccgacacccaggugcuggugaugccccuggccgacaaggaggccggcgccguggccgccgugauccuggugcacugcggccagcugagcgacaacgaggaguggagccugcaggccguggagaagcacacccugguggcccugagaagagugcaggugcugcagcagagaggccccagagaggcccccagagccgugcagaacccccccgagggcaccgccgaggaccagaagggcggcgccgccuacaccgacagagacagaaagauccugcagcugugcggcgagcuguacgaccuggacgccagcagccugcagcugaaggugcugcaguaccugcagcaggagaccagagccagcagaugcugccugcugcuggugagcgaggacaaccugcagcugagcugcaaggugaucggcgacaaggugcugggcgaggaggugagcuucccccugaccggcugccugggccaggugguggaggacaagaagagcauccagcugaaggaccugaccagcgaggacgugcagcagcugcagagcaugcugggcugcgagcugcaggccaugcugugcgugcccgugaucagcagagccaccgaccaggugguggcccuggccugcgccuucaacaagcuggagggcgaccuguucaccgacgaggacgagcacgugauccagcacugcuuccacuacaccagcaccgugcugaccagcacccuggccuuccagaaggagcagaagcugaagugcgagugccaggcccugcugcagguggccaagaaccuguucacccaccuggacgacgugagcgugcugcugcaggagaucaucaccgaggccagaaaccugagcaacgccgagaucugcagcguguuccugcuggaccagaacgagcugguggccaagguguucgacggcggcgugguggacgacgagagcuacgagaucagaauccccgccgaccagggcaucgccggccacguggccaccaccggccagauccugaacauccccgacgccuacgcccacccccuguucuacagaggcguggacgacagcaccggcuucagaaccagaaacauccugugcuuccccaucaagaacgagaaccaggaggugaucggcguggccgagcuggugaacaagaucaacggccccugguucagcaaguucgacgaggaccuggccaccgccuucagcaucuacugcggcaucagcaucgcccacagccugcuguacaagaaggugaacgaggcccaguacagaagccaccuggccaacgagaugaugauguaccacaugaaggugagcgacgacgaguacaccaagcugcugcacgacggcauccagcccguggccgccaucgacagcaacuucgccagcuucaccuacacccccagaagccugcccgaggacgacaccagcauggccauccugagcaugcugcaggacaugaacuucaucaacaacuacaagaucgacugccccacccuggccagauucugccugauggugaagaagggcuacagagacccccccuaccacaacuggaugcacgccuucagcgugagccacuucugcuaccugcuguacaagaaccuggagcugaccaacuaccuggaggacaucgagaucuucgcccuguucaucagcugcaugugccacgaccuggaccacagaggcaccaacaacagcuuccagguggccagcaagagcgugcuggccgcccuguacagcagcgagggcagcgugauggagagacaccacuucgcccaggccaucgccauccugaacacccacggcugcaacaucuucgaccacuucagcagaaaggacuaccagagaaugcuggaccugaugagagacaucauccuggccaccgaccuggcccaccaccugagaaucuucaaggaccugcagaagauggccgaggugggcuacgacagaaacaacaagcagcaccacagacugcugcugugccugcugaugaccagcugcgaccugagcgaccagaccaagggcuggaagaccaccagaaagaucgccgagcugaucuacaaggaguucuucagccagggcgaccuggagaaggccaugggcaacagacccauggagaugauggacagagagaaggccuacauccccgagcugcagaucagcuucauggagcacaucgccaugcccaucuacaagcugcugcaggaccuguuccccaaggccgccgagcuguacgagagaguggccagcaacagagagcacuggaccaaggugagccacaaguucaccaucagaggccugcccagcaacaacagccuggacuuccuggacgaggaguacgaggugcccgaccuggacggcaccagagcccccaucaacggcugcugcagccuggacgccgaguaa

SEQ ID NO: 21310 - RNA, 3426 nt, Artificial Sequence
  PDE3A__Homo_sapiens__NP_000912
auggccgugcccggcgacgccgccagagugagagacaagcccgugcacagcggcgugagccaggcccccaccgccggcagagacugccaccacagagccgaccccgccagccccagagacagcggcugcagaggcugcuggggcgaccuggugcugcagccccugagaagcagcagaaagcugagcagcgcccugugcgccggcagccugagcuuccugcuggcccugcuggugagacuggugagaggcgaggugggcugcgaccuggagcagugcaaggaggccgccgccgccgaggaggaggaggccgcccccggcgccgagggcggcguguuccccggccccagaggcggcgcccccggcggcggcgccagacugagccccuggcugcagcccagcgcccugcuguucagccugcugugcgccuucuucuggaugggccuguaccugcugagagccggcgugagacugccccuggccguggcccugcuggccgccugcugcggcggcgaggcccuggugcagaucggccugggcgugggcgaggaccaccugcugagccugcccgccgccggcguggugcugagcugccuggccgccgccaccuggcuggugcugagacugagacugggcgugcugaugaucgcccugaccagcgccgugagaaccgugagccugaucagccuggagagauucaagguggccuggagacccuaccuggccuaccuggccggcgugcugggcauccugcuggccagauacguggagcagauccugccccagagcgccgaggccgcccccagagagcaccugggcagccagcugaucgccggcaccaaggaggacauccccguguucaagagaagaagaagaagcagcagcguggugagcgccgagaugagcggcugcagcagcaagagccacagaagaaccagccugcccugcauccccagagagcagcugaugggccacagcgagugggaccacaagagaggccccagaggcagccagagcagcggcaccagcaucaccguggacaucgccgugaugggcgaggcccacggccugaucaccgaccugcuggccgaccccagccugccccccaacgugugcaccagccugagagccgugagcaaccugcugagcacccagcugaccuuccaggccauccacaagcccagagugaaccccgugaccagccugagcgagaacuacaccugcagcgacagcgaggagagcagcgagaaggacaagcuggccauccccaagagacugagaagaagccugccccccggccugcugagaagagugagcagcaccuggaccaccaccaccagcgccaccggccugcccacccuggagcccgcccccgugagaagagacagaagcaccagcaucaagcugcaggaggcccccagcagcagccccgacagcuggaacaaccccgugaugaugacccugaccaagagcagaagcuucaccagcagcuacgccaucagcgccgccaaccacgugaaggccaagaagcagagcagacccggcgcccuggccaagaucagcccccugagcagccccugcagcagcccccugcagggcacccccgccagcagccuggugagcaagaucagcgccgugcaguuccccgagagcgccgacaccaccgccaagcagagccugggcagccacagagcccugaccuacacccagagcgcccccgaccugagcccccagauccugaccccccccgugaucugcagcagcugcggcagacccuacagccagggcaaccccgccgacgagccccuggagagaagcggcguggccaccagaacccccagcagaaccgacgacaccgcccaggugaccagcgacuacgagaccaacaacaacagcgacagcagcgacaucgugcagaacgaggacgagaccgagugccugagagagccccugagaaaggccagcgccugcagcaccuacgcccccgagaccaugauguuccuggacaagcccauccuggcccccgagccccuggugauggacaaccuggacagcaucauggagcagcugaacaccuggaacuuccccaucuucgaccugguggagaacaucggcagaaagugcggcagaauccugagccaggugagcuacagacuguucgaggacaugggccuguucgaggccuucaagauccccaucagagaguucaugaacuacuuccacgcccuggagaucggcuacagagacauccccuaccacaacagaauccacgccaccgacgugcugcacgccgugugguaccugaccacccagcccauccccggccugagcaccgugaucaacgaccacggcagcaccagcgacagcgacagcgacagcggcuucacccacggccacaugggcuacguguucagcaagaccuacaacgugaccgacgacaaguacggcugccugagcggcaacauccccgcccuggagcugauggcccuguacguggccgccgccaugcacgacuacgaccaccccggcagaaccaacgccuuccugguggccaccagcgccccccaggccgugcuguacaacgacagaagcgugcuggagaaccaccacgccgccgccgccuggaaccuguucaugagcagacccgaguacaacuuccugaucaaccuggaccacguggaguucaagcacuucagauuccuggugaucgaggccauccuggccaccgaccugaagaagcacuucgacuucguggccaaguucaacggcaaggugaacgacgacgugggcaucgacuggaccaacgagaacgacagacugcuggugugccagaugugcaucaagcuggccgacaucaacggccccgccaagugcaaggagcugcaccugcaguggaccgacggcaucgugaacgaguucuacgagcagggcgacgaggaggccagccugggccugcccaucagccccuucauggacagaagcgccccccagcuggccaaccugcaggagagcuucaucagccacaucgugggcccccugugcaacagcuacgacagcgccggccugaugcccggcaaguggguggaggacagcgacgagagcggcgacaccgacgaccccgaggaggaggaggaggaggcccccgcccccaacgaggaggagaccugcgagaacaacgagagccccaagaagaagaccuucaagagaagaaagaucuacugccagaucacccagcaccugcugcagaaccacaagauguggaagaaggugaucgaggaggagcagagacuggccggcaucgagaaccagagccuggaccagaccccccagagccacagcagcgagcagauccaggccaucaaggaggaggaggaggagaagggcaagcccagaggcgaggagauccccacccagaagcccgaccaguaa

SEQ ID NO: 21311 - RNA, 3339 nt, Artificial Sequence
  PDE3B__Homo_sapiens__NP_000913
augagaagagacgagagagacgccaaggccaugagaagccugcagccccccgacggcgccggcagcccccccgagagccugagaaacggcuacgugaagagcugcgugagcccccugagacaggacccccccagaggcuucuucuuccaccugugcagauucugcaacguggagcugagacccccccccgccagcccccagcagcccagaagaugcagccccuucugcagagccagacugagccugggcgcccuggccgccuucgugcuggcccugcugcugggcgccgagcccgagagcugggccgccggcgccgccuggcugagaacccugcugagcgugugcagccacagccugagcccccuguucagcaucgccugcgccuucuucuuccugaccugcuuccugaccagaaccaagagaggccccggccccggcagaagcugcggcagcugguggcugcuggcccugcccgccugcugcuaccugggcgacuuccugguguggcagugguggagcuggcccuggggcgacggcgacgccggcagcgccgccccccacaccccccccgaggccgccgccggcagacugcugcuggugcugagcugcgugggccugcugcugacccuggcccacccccugagacugagacacugcgugcuggugcugcugcuggccagcuucguguggugggugagcuucaccagccugggcagccugcccagcgcccugagaccccugcugagcggccuggugggcggcgccggcugccugcuggcccugggccuggaccacuucuuccagaucagagaggccccccugcaccccagacugagcagcgccgccgaggagaaggugcccgugaucagacccagaagaagaagcagcugcgugagccugggcgagaccgccgccagcuacuacggcagcugcaagaucuucagaagacccagccugcccugcaucagcagagagcagaugauccugugggacugggaccugaagcagugguacaagccccacuaccagaacagcggcggcggcaacggcguggaccugagcgugcugaacgaggccagaaacauggugagcgaccugcugaccgaccccagccugcccccccaggugaucagcagccugagaagcaucagcagccugaugggcgccuucagcggcagcugcagacccaagaucaacccccugacccccuuccccggcuucuaccccugcagcgagaucgaggaccccgccgagaagggcgacagaaagcugaacaagggccugaacagaaacagccugcccaccccccagcugagaagaagcagcggcaccagcggccugcugcccguggagcagagcagcagaugggacagaaacaacggcaagagaccccaccaggaguucggcaucagcagccagggcugcuaccugaacggccccuucaacagcaaccugcugaccauccccaagcagagaagcagcagcgugagccugacccaccacgugggccugagaagagccggcgugcugagcagccugagccccgugaacagcagcaaccacggccccgugagcaccggcagccugaccaacagaagccccaucgaguuccccgacaccgccgacuuccugaacaagcccagcgugauccugcagagaagccugggcaacgcccccaacacccccgacuucuaccagcagcugagaaacagcgacagcaaccugugcaacagcugcggccaccagaugcugaaguacgugagcaccagcgagagcgacggcaccgacugcugcagcggcaagagcggcgaggaggagaacaucuucagcaaggagagcuucaagcugauggagacccagcaggaggaggagaccgagaagaaggacagcagaaagcuguuccaggagggcgacaaguggcugaccgaggaggcccagagcgagcagcagaccaacaucgagcaggaggugagccuggaccugauccugguggaggaguacgacagccugaucgagaagaugagcaacuggaacuuccccaucuucgagcugguggagaagaugggcgagaagagcggcagaauccugagccaggugauguacacccuguuccaggacaccggccugcuggagaucuucaagauccccacccagcaguucaugaacuacuucagagcccuggagaacggcuacagagacauccccuaccacaacagaauccacgccaccgacgugcugcacgccgugugguaccugaccaccagacccgugcccggccugcagcagauccacaacggcugcggcaccggcaacgagaccgacagcgacggcagaaucaaccacggcagaaucgccuacaucagcagcaagagcugcagcaaccccgacgagagcuacggcugccugagcagcaacauccccgcccuggagcugauggcccuguacguggccgccgccaugcacgacuacgaccaccccggcagaaccaacgccuuccugguggccaccaacgccccccaggccgugcuguacaacgacagaagcgugcuggagaaccaccacgccgccagcgccuggaaccuguaccugagcagacccgaguacaacuuccugcugcaccuggaccacguggaguucaagagauucagauuccuggugaucgaggccauccuggccaccgaccugaagaagcacuucgacuuccuggccgaguucaacgccaaggccaacgacgugaacagcaacggcaucgaguggagcaacgagaacgacagacugcuggugugccaggugugcaucaagcuggccgacaucaacggccccgccaaggugagagaccugcaccugaaguggaccgagggcaucgugaacgaguucuacgagcagggcgacgaggaggccaaccugggccugcccaucagccccuucauggacagaagcagcccccagcuggccaagcugcaggagagcuucaucacccacaucgugggcccccugugcaacagcuacgacgccgccggccugcugcccggccaguggcuggaggccgaggaggacaacgacaccgagagcggcgacgacgaggacggcgaggagcuggacaccgaggacgaggagauggagaacaaccugaaccccaagccccccagaagaaagagcagaagaagaaucuucugccagcugaugcaccaccugaccgagaaccacaagaucuggaaggagaucguggaggaggaggagaagugcaaggccgacggcaacaagcugcagguggagaacagcagccugccccaggccgacgagauccaggugaucgaggaggccgacgaggaggaguaa

SEQ ID NO: 21312 - RNA, 2661 nt, Artificial Sequence
  PDE4A__Homo_sapiens__NP_001104777
auggagccccccaccgugcccagcgagagaagccugagccugagccugcccggccccagagagggccaggccacccugaagccccccccccagcaccuguggagacagcccagaacccccaucagaauccagcagagaggcuacagcgacagcgccgagagagccgagagagagagacagccccacagacccaucgagagagccgacgccauggacaccagcgacagacccggccugagaaccaccagaaugagcuggcccagcagcuuccacggcaccggcaccggcagcggcggcgccggcggcggcagcagcagaagauucgaggccgagaacggccccacccccagccccggcagaagcccccuggacagccaggccagccccggccuggugcugcacgccggcgccgccaccagccagagaagagagagcuuccuguacagaagcgacagcgacuacgacaugagccccaagaccaugagcagaaacagcagcgugaccagcgaggcccacgccgaggaccugaucgugacccccuucgcccaggugcuggccagccugagaagcgugagaagcaacuucagccugcugaccaacgugcccgugcccagcaacaagagaagcccccugggcggccccacccccgugugcaaggccacccugagcgaggagaccugccagcagcuggccagagagacccuggaggagcuggacuggugccuggagcagcuggagaccaugcagaccuacagaagcgugagcgagauggccagccacaaguucaagagaaugcugaacagagagcugacccaccugagcgagaugagcagaagcggcaaccaggugagcgaguacaucagcaccaccuuccuggacaagcagaacgagguggagauccccagccccaccaugaaggagagagagaagcagcaggcccccagacccagacccagccagcccccccccccccccgugccccaccugcagcccaugagccagaucaccggccugaagaagcugaugcacagcaacagccugaacaacagcaacauccccagauucggcgugaagaccgaccaggaggagcugcuggcccaggagcuggagaaccugaacaaguggggccugaacaucuucugcgugagcgacuacgccggcggcagaagccugaccugcaucauguacaugaucuuccaggagagagaccugcugaagaaguucagaauccccguggacaccauggugaccuacaugcugacccuggaggaccacuaccacgccgacguggccuaccacaacagccugcacgccgccgacgugcugcagagcacccacgugcugcuggccacccccgcccuggacgccguguucaccgaccuggagauccuggccgcccuguucgccgccgccauccacgacguggaccaccccggcgugagcaaccaguuccugaucaacaccaacagcgagcuggcccugauguacaacgacgagagcgugcuggagaaccaccaccuggccgugggcuucaagcugcugcaggaggacaacugcgacaucuuccagaaccugagcaagagacagagacagagccugagaaagauggugaucgacauggugcuggccaccgacaugagcaagcacaugacccugcuggccgaccugaagaccaugguggagaccaagaaggugaccagcagcggcgugcugcugcuggacaacuacagcgacagaauccaggugcugagaaacauggugcacugcgccgaccugagcaaccccaccaagccccuggagcuguacagacaguggaccgacagaaucauggccgaguucuuccagcagggcgacagagagagagagagaggcauggagaucagccccaugugcgacaagcacaccgccagcguggagaagagccaggugggcuucaucgacuacaucgugcacccccugugggagaccugggccgaccuggugcaccccgacgcccaggagauccuggacacccuggaggacaacagagacugguacuacagcgccaucagacagagccccagccccccccccgaggaggagagcagaggccccggccaccccccccugcccgacaaguuccaguucgagcugacccuggaggaggaggaggaggaggagaucagcauggcccagauccccugcaccgcccaggaggcccugaccgcccagggccugagcggcguggaggaggcccuggacgccaccaucgccugggaggccagccccgcccaggagagccuggaggugauggcccaggaggccagccuggaggccgagcuggaggccguguaccugacccagcaggcccagagcaccggcagcgcccccguggcccccgacgaguucagcagcagagaggaguucgugguggccgugagccacagcagccccagcgcccuggcccugcagagcccccugcugcccgccuggagaacccugagcgugagcgagcacgcccccggccugcccggccugcccagcaccgccgccgagguggaggcccagagagagcaccaggccgccaagagagccugcagcgccugcgccggcaccuucggcgaggacaccagcgcccugcccgcccccggcggcggcggcagcggcggcgaccccaccuaa

SEQ ID NO: 21313 - RNA, 2430 nt, Artificial Sequence
  PDE4D__Homo_sapiens__NP_001098101
auggaggccgagggcagcagcgcccccgccagagccggcagcggcgagggcagcgacagcgccggcggcgccacccugaaggcccccaagcaccuguggagacacgagcagcaccaccaguacccccugagacagccccaguucagacugcugcacccccaccaccaccugccccccccccccccccccagcccccagccccagccccagugcccccugcagcccccccccccccccccccugcccccccccccccccccccccggcgccgccagaggcagauacgccagcagcggcgccaccggcagagugagacacagaggcuacagcgacaccgagagauaccuguacugcagagccauggacagaaccagcuacgccguggagaccggccacagacccggccugaagaagagcagaaugagcuggcccagcagcuuccagggccugagaagauucgacguggacaacggcaccagcgccggcagaagcccccuggaccccaugaccagccccggcagcggccugauccugcaggccaacuucgugcacagccagagaagagagagcuuccuguacagaagcgacagcgacuacgaccugagccccaagagcaugagcagaaacagcagcaucgccagcgacauccacggcgacgaccugaucgugacccccuucgcccaggugcuggccagccugagaaccgugagaaacaacuucgccgcccugaccaaccugcaggacagagcccccagcaagagaagccccaugugcaaccagcccagcaucaacaaggccaccaucaccgaggaggccuaccagaagcuggccagcgagacccuggaggagcuggacuggugccuggaccagcuggagacccugcagaccagacacagcgugagcgagauggccagcaacaaguucaagagaaugcugaacagagagcugacccaccugagcgagaugagcagaagcggcaaccaggugagcgaguucaucagcaacaccuuccuggacaagcagcacgagguggagauccccagccccacccagaaggagaaggagaagaagaagagacccaugagccagaucagcggcgugaagaagcugaugcacagcagcagccugaccaacagcagcauccccagauucggcgugaagaccgagcaggaggacgugcuggccaaggagcuggaggacgugaacaaguggggccugcacguguucagaaucgccgagcugagcggcaacagaccccugaccgugaucaugcacaccaucuuccaggagagagaccugcugaagaccuucaagauccccguggacacccugaucaccuaccugaugacccuggaggaccacuaccacgccgacguggccuaccacaacaacauccacgccgccgacguggugcagagcacccacgugcugcugagcacccccgcccuggaggccguguucaccgaccuggagauccuggccgccaucuucgccagcgccauccacgacguggaccaccccggcgugagcaaccaguuccugaucaacaccaacagcgagcuggcccugauguacaacgacagcagcgugcuggagaaccaccaccuggccgugggcuucaagcugcugcaggaggagaacugcgacaucuuccagaaccugaccaagaagcagagacagagccugagaaagauggugaucgacaucgugcuggccaccgacaugagcaagcacaugaaccugcuggccgaccugaagaccaugguggagaccaagaaggugaccagcagcggcgugcugcugcuggacaacuacagcgacagaauccaggugcugcagaacauggugcacugcgccgaccugagcaaccccaccaagccccugcagcuguacagacaguggaccgacagaaucauggaggaguucuucagacagggcgacagagagagagagagaggcauggagaucagccccaugugcgacaagcacaacgccagcguggagaagagccaggugggcuucaucgacuacaucgugcacccccugugggagaccugggccgaccuggugcaccccgacgcccaggacauccuggacacccuggaggacaacagagagugguaccagagcaccaucccccagagccccagccccgcccccgacgaccccgaggagggcagacagggccagaccgagaaguuccaguucgagcugacccuggaggaggacggcgagagcgacaccgagaaggacagcggcagccagguggaggaggacaccagcugcagcgacagcaagacccugugcacccaggacagcgagagcaccgagaucccccuggacgagcagguggaggaggaggccgugggcgaggaggaggagagccagcccgaggccugcgugaucgacgacagaagccccgacaccuaa

SEQ ID NO: 21314 - RNA, 2628 nt, Artificial Sequence
  PDE5A__Homo_sapiens__NP_001074
auggagagagccggccccagcuucggccagcagagacagcagcagcagccccagcagcagaagcagcagcagagagaccaggacagcguggaggccuggcuggacgaccacugggacuucaccuucagcuacuucgugagaaaggccaccagagagauggugaacgccugguucgccgagagagugcacaccauccccgugugcaaggagggcaucagaggccacaccgagagcugcagcugcccccugcagcagagccccagagccgacaacagcgcccccggcacccccaccagaaagaucagcgccagcgaguucgacagaccccugagacccaucguggugaaggacagcgagggcaccgugagcuuccugagcgacagcgagaagaaggagcagaugccccugaccccccccagauucgaccacgacgagggcgaccagugcagcagacugcuggagcuggugaaggacaucagcagccaccuggacgugaccgcccugugccacaagaucuuccugcacauccacggccugaucagcgccgacagauacagccuguuccuggugugcgaggacagcagcaacgacaaguuccugaucagcagacuguucgacguggccgagggcagcacccuggaggaggugagcaacaacugcaucagacuggaguggaacaagggcaucgugggccacguggccgcccugggcgagccccugaacaucaaggacgccuacgaggaccccagauucaacgccgagguggaccagaucaccggcuacaagacccagagcauccugugcaugcccaucaagaaccacagagaggagguggugggcguggcccaggccaucaacaagaagagcggcaacggcggcaccuucaccgagaaggacgagaaggacuucgccgccuaccuggccuucugcggcaucgugcugcacaacgcccagcuguacgagaccagccugcuggagaacaagagaaaccaggugcugcuggaccuggccagccugaucuucgaggagcagcagagccuggaggugauccugaagaagaucgccgccaccaucaucagcuucaugcaggugcagaagugcaccaucuucaucguggacgaggacugcagcgacagcuucagcagcguguuccacauggagugcgaggagcuggagaagagcagcgacacccugaccagagagcacgacgccaacaagaucaacuacauguacgcccaguacgugaagaacaccauggagccccugaacauccccgacgugagcaaggacaagagauuccccuggaccaccgagaacaccggcaacgugaaccagcagugcaucagaagccugcugugcacccccaucaagaacggcaagaagaacaaggugaucggcgugugccagcuggugaacaagauggaggagaacaccggcaaggugaagcccuucaacagaaacgacgagcaguuccuggaggccuucgugaucuucugcggccugggcauccagaacacccagauguacgaggccguggagagagccauggccaagcagauggugacccuggaggugcugagcuaccacgccagcgccgccgaggaggagaccagagagcugcagagccuggccgccgccguggugcccagcgcccagacccugaagaucaccgacuucagcuucagcgacuucgagcugagcgaccuggagaccgcccugugcaccaucagaauguucaccgaccugaaccuggugcagaacuuccagaugaagcacgaggugcugugcagauggauccugagcgugaagaagaacuacagaaagaacguggccuaccacaacuggagacacgccuucaacaccgcccagugcauguucgccgcccugaaggccggcaagauccagaacaagcugaccgaccuggagauccuggcccugcugaucgccgcccugagccacgaccuggaccacagaggcgugaacaacagcuacauccagagaagcgagcacccccuggcccagcuguacugccacagcaucauggagcaccaccacuucgaccagugccugaugauccugaacagccccggcaaccagauccugagcggccugagcaucgaggaguacaagaccacccugaagaucaucaagcaggccauccuggccaccgaccuggcccuguacaucaagagaagaggcgaguucuucgagcugaucagaaagaaccaguucaaccuggaggacccccaccagaaggagcuguuccuggccaugcugaugaccgccugcgaccugagcgccaucaccaagcccuggcccauccagcagagaaucgccgagcugguggccaccgaguucuucgaccagggcgacagagagagaaaggagcugaacaucgagcccaccgaccugaugaacagagagaagaagaacaagauccccagcaugcaggugggcuucaucgacgccaucugccugcagcuguacgaggcccugacccacgugagcgaggacugcuucccccugcuggacggcugcagaaagaacagacagaaguggcaggcccuggccgagcagcaggagaagaugcugaucaacggcgagagcggccaggccaagagaaacuaa

SEQ ID NO: 21315 - RNA, 2583 nt, Artificial Sequence
  PDE6A__Homo_sapiens__NP_000431
augggcgaggugaccgccgaggagguggagaaguuccuggacagcaacaucggcuucgccaagcaguacuacaaccugcacuacagagccaagcugaucagcgaccugcugggcgccaaggaggccgccguggacuucagcaacuaccacagccccagcagcauggaggagagcgagaucaucuucgaccugcugagagacuuccaggagaaccugcagaccgagaagugcaucuucaacgugaugaagaagcugugcuuccugcugcaggccgacagaaugagccuguucauguacagaaccagaaacggcaucgccgagcuggccaccagacuguucaacgugcacaaggacgccgugcuggaggacugccuggugaugcccgaccaggagaucguguucccccuggacaugggcaucgugggccacguggcccacagcaagaagaucgccaacgugcccaacaccgaggaggacgagcacuucugcgacuucguggacauccugaccgaguacaagaccaagaacauccuggccagccccaucaugaacggcaaggacgugguggccaucaucauggccgugaacaagguggacggcagccacuucaccaagagagacgaggagauccugcugaaguaccugaacuucgccaaccugaucaugaagguguaccaccugagcuaccugcacaacugcgagaccagaagaggccagauccugcuguggagcggcagcaagguguucgaggagcugaccgacaucgagagacaguuccacaaggcccuguacaccgugagagccuuccugaacugcgacagauacagcgugggccugcuggacaugaccaagcagaaggaguucuucgacguguggcccgugcugaugggcgaggugccccccuacagcggccccagaacccccgacggcagagagaucaacuucuacaaggugaucgacuacauccugcacggcaaggaggacaucaaggugauccccaaccccccccccgaccacugggcccuggugagcggccugcccgccuacguggcccagaacggccugaucugcaacaucaugaacgcccccgccgaggacuucuucgccuuccagaaggagccccuggacgagagcggcuggaugaucaagaacgugcugagcaugcccaucgugaacaagaaggaggagaucgugggcguggccaccuucuacaacagaaaggacggcaagcccuucgacgagauggacgagacccugauggagagccugacccaguuccugggcuggagcgugcugaaccccgacaccuacgagagcaugaacaagcuggagaacagaaaggacaucuuccaggacaucgugaaguaccacgugaagugcgacaacgaggagauccagaagauccugaagaccagagagguguacggcaaggagcccugggagugcgaggaggaggagcuggccgagauccugcaggccgagcugcccgacgccgacaaguacgagaucaacaaguuccacuucagcgaccugccccugaccgagcuggagcuggugaagugcggcauccagauguacuacgagcugaaggugguggacaaguuccacaucccccaggaggcccuggugagauucauguacagccugagcaagggcuacagaaagaucaccuaccacaacuggagacacggcuucaacgugggccagaccauguucagccugcuggugaccggcaagcugaagagauacuucaccgaccuggaggcccuggccauggugaccgccgccuucugccacgacaucgaccacagaggcaccaacaaccuguaccagaugaagagccagaacccccuggccaagcugcacggcagcagcauccuggagagacaccaccuggaguucggcaagacccugcugagagacgagagccugaacaucuuccagaaccugaacagaagacagcacgagcacgccauccacaugauggacaucgccaucaucgccaccgaccuggcccuguacuucaagaagagaaccauguuccagaagaucguggaccagagcaagaccuacgagagcgagcaggaguggacccaguacaugaugcuggagcagaccagaaaggagaucgugauggccaugaugaugaccgccugcgaccugagcgccaucaccaagcccugggaggugcagagccagguggcccugcugguggccgccgaguucugggagcagggcgaccuggagagaaccgugcugcagcagaaccccauccccaugauggacagaaacaaggccgacgagcugcccaagcugcaggugggcuucaucgacuucgugugcaccuucguguacaaggaguucagcagauuccacgaggagaucacccccaugcuggacggcaucaccaacaacagaaaggaguggaaggcccuggccgacgaguacgacgccaagaugaaggugcaggaggagaagaagcagaagcagcagagcgccaagagcgccgccgccggcaaccagcccggcggcaaccccagccccggcggcgccaccaccagcaagagcugcugcauccaguaa

SEQ ID NO: 21316 - RNA, 2565 nt, Artificial Sequence
  PDE6B__Homo_sapiens__NP_000274
augagccugagcgaggagcaggccagaagcuuccuggaccagaaccccgacuucgccagacaguacuucggcaagaagcugagccccgagaacguggccgccgccugcgaggacggcugcccccccgacugcgacagccugagagaccugugccagguggaggagagcaccgcccugcuggagcuggugcaggacaugcaggagagcaucaacauggagagagugguguucaaggugcugagaagacugugcacccugcugcaggccgacagaugcagccuguucauguacagacagagaaacggcguggccgagcuggccaccagacuguucagcgugcagcccgacagcgugcuggaggacugccuggugccccccgacagcgagaucguguucccccuggacaucggcguggugggccacguggcccagaccaagaagauggugaacguggaggacguggccgagugcccccacuucagcagcuucgccgacgagcugaccgacuacaagaccaagaacaugcuggccacccccaucaugaacggcaaggacgugguggccgugaucauggccgugaacaagcugaacggccccuucuucaccagcgaggacgaggacguguuccugaaguaccugaacuucgccacccuguaccugaagaucuaccaccugagcuaccugcacaacugcgagaccagaagaggccaggugcugcuguggagcgccaacaagguguucgaggagcugaccgacaucgagagacaguuccacaaggccuucuacaccgugagagccuaccugaacugcgagagauacagcgugggccugcuggacaugaccaaggagaaggaguucuucgacguguggagcgugcugaugggcgagagccagcccuacagcggccccagaacccccgacggcagagagaucguguucuacaaggugaucgacuacauccugcacggcaaggaggagaucaaggugauccccacccccagcgccgaccacugggcccuggccagcggccugcccagcuacguggccgagagcggcuucaucugcaacaucaugaacgccagcgccgacgagauguucaaguuccaggagggcgcccuggacgacagcggcuggcugaucaagaacgugcugagcaugcccaucgugaacaagaaggaggagaucgugggcguggccaccuucuacaacagaaaggacggcaagcccuucgacgagcaggacgaggugcugauggagagccugacccaguuccugggcuggagcgugaugaacaccgacaccuacgacaagaugaacaagcuggagaacagaaaggacaucgcccaggacauggugcuguaccacgugaagugcgacagagacgagauccagcugauccugcccaccagagccagacugggcaaggagcccgccgacugcgacgaggacgagcugggcgagauccugaaggaggagcugcccggccccaccaccuucgacaucuacgaguuccacuucagcgaccuggagugcaccgagcuggaccuggugaagugcggcauccagauguacuacgagcugggcguggugagaaaguuccagaucccccaggaggugcuggugagauuccuguucagcaucagcaagggcuacagaagaaucaccuaccacaacuggagacacggcuucaacguggcccagaccauguucacccugcugaugaccggcaagcugaagagcuacuacaccgaccuggaggccuucgccauggugaccgccggccugugccacgacaucgaccacagaggcaccaacaaccuguaccagaugaagagccagaacccccuggccaagcugcacggcagcagcauccuggagagacaccaccuggaguucggcaaguuccugcugagcgaggagacccugaacaucuaccagaaccugaacagaagacagcacgagcacgugauccaccugauggacaucgccaucaucgccaccgaccuggcccuguacuucaagaagagagccauguuccagaagaucguggacgagagcaagaacuaccaggacaagaagagcuggguggaguaccugagccuggagaccaccagaaaggagaucgugauggccaugaugaugaccgccugcgaccugagcgccaucaccaagcccugggaggugcagagcaagguggcccugcugguggccgccgaguucugggagcagggcgaccuggagagaaccgugcuggaccagcagcccauccccaugauggacagaaacaaggccgccgagcugcccaagcugcaggugggcuucaucgacuucgugugcaccuucguguacaaggaguucagcagauuccacgaggagauccugcccauguucgacagacugcagaacaacagaaaggaguggaaggcccuggccgacgaguacgaggccaaggugaaggcccuggaggagaaggaggaggaggagagaguggccgccaagaaggugggcaccgagaucugcaacggcggccccgcccccaagagcagcaccugcugcauccuguaa

SEQ ID NO: 21317 - RNA, 2577 nt, Artificial Sequence
  PDE6C__Homo_sapiens__NP_006195
augggcgagaucaaccagguggccguggagaaguaccuggaggagaacccccaguucgccaaggaguacuucgacagaaagcugagaguggaggugcugggcgagaucuucaagaacagccaggugcccgugcagagcagcaugagcuucagcgagcugacccagguggaggagagcgcccugugccuggagcugcuguggaccgugcaggaggagggcggcacccccgagcagggcgugcacagagcccugcagagacuggcccaccugcugcaggccgacagaugcagcauguuccugugcagaagcagaaacggcauccccgagguggccagcagacugcuggacgugacccccaccagcaaguucgaggacaaccuggugggccccgacaaggaggugguguucccccuggacaucggcaucgugggcugggccgcccacaccaagaagacccacaacgugcccgacgugaagaagaacagccacuucagcgacuucauggacaagcagaccggcuacgugaccaagaaccugcuggccacccccaucguggugggcaaggaggugcuggccgugaucauggccgugaacaaggugaacgccagcgaguucagcaagcaggacgaggagguguucagcaaguaccugaacuucgugagcaucauccugagacugcaccacaccagcuacauguacaacaucgagagcagaagaagccagauccugauguggagcgccaacaagguguucgaggagcugaccgacguggagagacaguuccacaaggcccuguacaccgugagaagcuaccugaacugcgagagauacagcaucggccugcuggacaugaccaaggagaaggaguucuacgacgaguggcccaucaagcugggcgagguggagcccuacaagggccccaagacccccgacggcagagaggugaacuucuacaagaucaucgacuacauccugcacggcaaggaggagaucaaggugauccccaccccccccgccgaccacuggacccugaucagcggccugcccaccuacguggccgagaacggcuucaucugcaacaugaugaacgcccccgccgacgaguacuucaccuuccagaagggccccguggacgagaccggcugggugaucaagaacgugcugagccugcccaucgugaacaagaaggaggacaucgugggcguggccaccuucuacaacagaaaggacggcaagcccuucgacgagcacgacgaguacaucaccgagacccugacccaguuccugggcuggagccugcugaacaccgacaccuacgacaagaugaacaagcuggagaacagaaaggacaucgcccaggagaugcugaugaaccagaccaaggccacccccgaggagaucaagagcauccugaaguuccaggagaagcugaacguggacgugaucgacgacugcgaggagaagcagcugguggccauccugaaggaggaccugcccgaccccagaagcgccgagcuguacgaguucagauucagcgacuucccccugaccgagcacggccugaucaagugcggcaucagacuguucuucgagaucaacgugguggagaaguucaaggugcccguggaggugcugaccagauggauguacaccgugagaaagggcuacagagccgugaccuaccacaacuggagacacggcuucaacgugggccagaccauguucacccugcugaugaccggcagacugaagaaguacuacaccgaccuggaggccuucgccaugcuggccgccgccuucugccacgacaucgaccacagaggcaccaacaaccuguaccagaugaagagcaccagcccccuggccagacugcacggcagcagcauccuggagagacaccaccuggaguacagcaagacccugcugcaggacgagagccugaacaucuuccagaaccugaacaagagacaguucgagaccgugauccaccuguucgagguggccaucaucgccaccgaccuggcccuguacuucaagaagagaaccauguuccagaagaucguggacgccugcgagcagaugcagaccgaggaggaggccaucaaguacgugaccguggaccccaccaagaaggagaucaucauggccaugaugaugaccgccugcgaccugagcgccaucaccaagcccugggaggugcagagccagguggcccugaugguggccaacgaguucugggagcagggcgaccuggagagaaccgugcugcagcagcagcccauccccaugauggacagaaacaagagagacgagcugcccaagcugcaggugggcuucaucgacuucgugugcaccuucguguacaaggaguucagcagauuccacaaggagaucacccccaugcugagcggccugcagaacaacagaguggaguggaagagccuggccgacgaguacgacgccaagaugaaggugaucgaggaggaggccaagaagcaggagggcggcgccgagaaggccgccgaggacagcggcggcggcgacgacaagaagagcaagaccugccugaugcuguaa

SEQ ID NO: 21318 - RNA, 453 nt, Artificial Sequence
  PDE6D__Homo_sapiens__NP_002592
augagcgccaaggacgagagagccagagagauccugagaggcuucaagcugaacuggaugaaccugagagacgccgagaccggcaagauccuguggcagggcaccgaggaccugagcgugcccggcguggagcacgaggccagagugcccaagaagauccugaagugcaaggccgugagcagagagcugaacuucagcagcaccgagcagauggagaaguucagacuggagcagaagguguacuucaagggccagugccuggaggagugguucuucgaguucggcuucgugauccccaacagcaccaacaccuggcagagccugaucgaggccgcccccgagagccagaugaugcccgccagcgugcugaccggcaacgugaucaucgagaccaaguucuucgacgacgaccugcuggugagcaccagcagagugagacuguucuacguguaa

SEQ ID NO: 21319 - RNA, 264 nt, Artificial Sequence
  PDE6G__Homo_sapiens__NP_002593
augaaccuggagccccccaaggccgaguucagaagcgccaccagaguggccggcggccccgugacccccagaaagggcccccccaaguucaagcagagacagaccagacaguucaagagcaagccccccaagaagggcgugcagggcuucggcgacgacauccccggcauggagggccugggcaccgacaucaccgugaucugccccugggaggccuucaaccaccuggagcugcacgagcuggcccaguacggcaucaucuaa

SEQ ID NO: 21320 - RNA, 252 nt, Artificial Sequence
  PDE6H__Homo_sapiens__NP_006196
augagcgacaacaccacccugcccgcccccgccagcaaccagggccccaccacccccagaaagggcccccccaaguucaagcagagacagaccagacaguucaagagcaagccccccaagaagggcgugaagggcuucggcgacgacauccccggcauggagggccugggcaccgacaucaccgugaucugccccugggaggccuucagccaccuggagcugcacgagcuggcccaguucggcaucaucuaa

SEQ ID NO: 21321 - RNA, 1449 nt, Artificial Sequence
  PDE7A__Homo_sapiens__NP_001229247
auggaggugugcuaccagcugcccgugcugccccuggacagacccgugccccagcacgugcugagcagaagaggcgccaucagcuucagcagcagcagcgcccuguucggcugccccaaccccagacagcugagccagagaagaggcgccaucagcuacgacagcagcgaccagaccgcccuguacaucagaaugcugggcgacgugagagugagaagcagagccggcuucgagagcgagagaagaggcagccaccccuacaucgacuucagaaucuuccacagccagagcgagaucgaggugagcgugagcgccagaaacaucagaagacugcugagcuuccagagauaccugagaagcagcagauucuucagaggcaccgccgugagcaacagccugaacauccuggacgacgacuacaacggccaggccaagugcaugcuggagaaggugggcaacuggaacuucgacaucuuccuguucgacagacugaccaacggcaacagccuggugagccugaccuuccaccuguucagccugcacggccugaucgaguacuuccaccuggacaugaugaagcugagaagauuccuggugaugauccaggaggacuaccacagccagaaccccuaccacaacgccgugcacgccgccgacgugacccaggccaugcacugcuaccugaaggagcccaagcuggccaacagcgugacccccugggacauccugcugagccugaucgccgccgccacccacgaccuggaccaccccggcgugaaccagcccuuccugaucaagaccaaccacuaccuggccacccuguacaagaacaccagcgugcuggagaaccaccacuggagaagcgccgugggccugcugagagagagcggccuguucagccaccugccccuggagagcagacagcagauggagacccagaucggcgcccugauccuggccaccgacaucagcagacagaacgaguaccugagccuguucagaagccaccuggacagaggcgaccugugccuggaggacaccagacacagacaccuggugcugcagauggcccugaagugcgccgacaucugcaaccccugcagaaccugggagcugagcaagcaguggagcgagaaggugaccgaggaguucuuccaccagggcgacaucgagaagaaguaccaccugggcgugagcccccugugcgacagacacaccgagagcaucgccaacauccagaucggcuucaugaccuaccugguggagccccuguucaccgagugggccagauucagcaacaccagacugagccagaccaugcugggccacgugggccugaacaaggccagcuggaagggccugcagagagagcagagcagcagcgaggacaccgacgccgccuucgagcugaacagccagcugcugccccaggagaacagacugagcuaa

SEQ ID NO: 21322 - RNA, 1353 nt, Artificial Sequence
  PDE7B__Homo_sapiens__NP_061818
augagcugccugaugguggagagaugcggcgagauccuguucgagaaccccgaccagaacgccaagugcgugugcaugcugggcgacaucagacugagaggccagaccggcgugagagccgagagaagaggcagcuaccccuucaucgacuucagacugcugaacagcaccaccuacagcggcgagaucggcaccaagaagaaggugaagagacugcugagcuuccagagauacuuccacgccagcagacugcugagaggcaucaucccccaggccccccugcaccugcuggacgaggacuaccugggccaggccagacacaugcugagcaaggugggcaugugggacuucgacaucuuccuguucgacagacugaccaacggcaacagccuggugacccugcugugccaccuguucaacacccacggccugauccaccacuucaagcuggacauggugacccugcacagauuccuggugauggugcaggaggacuaccacagccagaaccccuaccacaacgccgugcacgccgccgacgugacccaggccaugcacugcuaccugaaggagcccaagcuggccagcuuccugaccccccuggacaucaugcugggccugcuggccgccgccgcccacgacguggaccaccccggcgugaaccagcccuuccugaucaagaccaaccaccaccuggccaaccuguaccagaacaugagcgugcuggagaaccaccacuggagaagcaccaucggcaugcugagagagagcagacugcuggcccaccugcccaaggagaugacccaggacaucgagcagcagcugggcagccugauccuggccaccgacaucaacagacagaacgaguuccugaccagacugaaggcccaccugcacaacaaggaccugagacuggaggacgcccaggacagacacuucaugcugcagaucgcccugaagugcgccgacaucugcaaccccugcagaaucugggagaugagcaagcaguggagcgagagagugugcgaggaguucuacagacagggcgagcuggagcagaaguucgagcuggagaucagcccccugugcaaccagcagaaggacagcauccccagcauccagaucggcuucaugagcuacaucguggagccccuguucagagagugggcccacuucaccggcaacagcacccugagcgagaacaugcugggccaccuggcccacaacaaggcccaguggaagagccugcugcccagacagcacagaagcagaggcagcagcggcagcggccccgaccacgaccacgccggccagggcaccgagagcgaggagcaggagggcgacagccccuaa

SEQ ID NO: 21323 - RNA, 2490 nt, Artificial Sequence
  PDE8A__Homo_sapiens__NP_002596
augggcugcgcccccagcauccacaucagcgagagacugguggccgaggacgcccccagccccgccgcccccccccugagcagcggcggccccagacugccccagggccagaagaccgccgcccugcccagaaccagaggcgccggccugcuggagagcgagcugagagacggcagcggcaagaagguggccguggccgacgugcaguucggccccaugagauuccaccaggaccagcugcaggugcugcugguguucaccaaggaggacaaccagugcaacggcuucugcagagccugcgagaaggccggcuucaagugcaccgugaccaaggaggcccaggccgugcuggccugcuuccuggacaagcaccacgacaucaucaucaucgaccacagaaaccccagacagcuggacgccgaggcccugugcagaagcaucagaagcagcaagcugagcgagaacaccgugaucgugggcguggugagaagaguggacagagaggagcugagcgugaugcccuucaucagcgccggcuucaccagaagauacguggagaaccccaacaucauggccugcuacaacgagcugcugcagcuggaguucggcgaggugagaagccagcugaagcugagagccugcaacagcguguucaccgcccuggagaacagcgaggacgccaucgagaucaccagcgaggacagauucauccaguacgccaaccccgccuucgagaccaccaugggcuaccagagcggcgagcugaucggcaaggagcugggcgaggugcccaucaacgagaagaaggccgaccugcuggacaccaucaacagcugcaucagaaucggcaaggaguggcagggcaucuacuacgccaagaagaagaacggcgacaacauccagcagaacgugaagaucauccccgugaucggccagggcggcaagaucagacacuacgugagcaucaucagagugugcaacggcaacaacaaggccgagaagaucagcgagugcgugcagagcgacacccacaccgacaaccagaccggcaagcacaaggacagaagaaagggcagccuggacgugaaggccguggccagcagagccaccgaggugagcagccagagaagacacagcagcauggccagaauccacagcaugaccaucgaggcccccaucaccaaggugaucaacaucaucaacgccgcccaggagagcagccccaugcccgugaccgaggcccuggacagagugcuggagauccugagaaccaccgagcuguacagcccccaguucggcgccaaggacgacgacccccacgccaacgaccuggugggcggccugaugagcgacggccugagaagacugagcggcaacgaguacgugcugagcaccaagaacacccagauggugagcagcaacaucaucacccccaucagccuggacgacgugccccccagaaucgccagagccauggagaacgaggaguacugggacuucgacaucuucgagcuggaggccgccacccacaacagaccccugaucuaccugggccugaagauguucgccagauucggcaucugcgaguuccugcacugcagcgagagcacccugagaagcuggcugcagaucaucgaggccaacuaccacagcagcaaccccuaccacaacagcacccacagcgccgacgugcugcacgccaccgccuacuuccugagcaaggagagaaucaaggagacccuggaccccaucgacgagguggccgcccugaucgccgccaccauccacgacguggaccaccccggcagaaccaacagcuuccugugcaacgccggcagcgagcuggccauccuguacaacgacaccgccgugcuggagagccaccacgccgcccuggccuuccagcugaccaccggcgacgacaagugcaacaucuucaagaacauggagagaaacgacuacagaacccugagacagggcaucaucgacauggugcuggccaccgagaugaccaagcacuucgagcacgugaacaaguucgugaacagcaucaacaagccccuggccacccuggaggagaacggcgagaccgacaagaaccaggaggugaucaacaccaugcugagaacccccgagaacagaacccugaucaagagaaugcugaucaagugcgccgacgugagcaaccccugcagaccccugcaguacugcaucgagugggccgccagaaucagcgaggaguacuucagccagaccgacgaggagaagcagcagggccugcccguggugaugcccguguucgacagaaacaccugcagcauccccaagagccagaucagcuucaucgacuacuucaucaccgacauguucgacgccugggacgccuucguggaccugcccgaccugaugcagcaccuggacaacaacuucaaguacuggaagggccuggacgagaugaagcugagaaaccugagacccccccccgaguaa

SEQ ID NO: 21324 - RNA, 2367 nt, Artificial Sequence
  PDE8B__Homo_sapiens__NP_001025022
augggcugcgcccccagcauccacgugagccagagcggcgugaucuacugcagagacagcgacgagagcagcagccccagacagaccaccagcgugagccagggccccgccgccccccugcccggccuguucgugcagaccgacgccgccgacgccaucccccccagcagagccagcggcccccccagcguggccagagugagaagagccagaaccgagcugggcagcggcagcagcgccggcagcgccgcccccgccgccaccaccagcagaggcagaagaagacacugcugcagcagcgccgaggccgagacccagaccugcuacaccagcgugaagcaggugagcagcgccgaggugagaaucggccccaugagacugacccaggaccccauccaggugcugcugaucuucgccaaggaggacagccagagcgacggcuucuggugggccugcgacagagccggcuacagaugcaacaucgccagaacccccgagagcgcccuggagugcuuccuggacaagcaccacgagaucaucgugaucgaccacagacagacccagaacuucgacgccgaggccgugugcagaagcaucagagccaccaaccccagcgagcacaccgugauccuggccguggugagcagagugagcgacgaccacgaggaggccagcgugcugccccugcugcacgccggcuucaacagaagauucauggagaacagcagcaucaucgccugcuacaacgagcugauccagaucgagcacggcgaggugagaagccaguucaagcugagagccugcaacagcguguucaccgcccuggaccacugccacgaggccaucgagaucaccagcgacgaccacgugauccagauccacaagauccacagagacagcggcgacaacagccagaccgagccccacagcuucagauacaagaacagaagaaaggagagcaucgacgugaagagcaucagcagcagaggcagcgacgcccccagccugcagaacagaagauaccccagcauggccagaauccacagcaugaccaucgaggcccccaucaccaaggugaucaacaucaucaacgccgcccaggagaacagccccgugaccguggccgaggcccuggacagagugcuggagauccugagaaccaccgagcuguacagcccccagcugggcaccaaggacgaggacccccacaccagcgaccuggugggcggccugaugaccgacggccugagaagacugagcggcaacgaguacguguucaccaagaacgugcaccagagccacagccaccuggccaugcccaucaccaucaacgacgugccccccugcaucagccagcugcuggacaacgaggagagcugggacuucaacaucuucgagcuggaggccaucacccacaagagaccccugguguaccugggccugaagguguucagcagauucggcgugugcgaguuccugaacugcagcgagaccacccugagagccugguuccaggugaucgaggccaacuaccacagcagcaacgccuaccacaacagcacccacgccgccgacgugcugcacgccaccgccuucuuccugggcaaggagagagugaagggcagccuggaccagcuggacgagguggccgcccugaucgccgccaccgugcacgacguggaccaccccggcagaaccaacagcuuccugugcaacgccggcagcgagcuggccgugcuguacaacgacaccgccgugcuggagagccaccacaccgcccuggccuuccagcugaccgugaaggacaccaagugcaacaucuucaagaacaucgacagaaaccacuacagaacccugagacaggccaucaucgacauggugcuggccaccgagaugaccaagcacuucgagcacgugaacaaguucgugaacagcaucaacaagcccauggccgccgagaucgagggcagcgacugcgagugcaaccccgccggcaagaacuuccccgagaaccagauccugaucaagagaaugaugaucaagugcgccgacguggccaaccccugcagaccccuggaccugugcaucgagugggccggcagaaucagcgaggaguacuucgcccagaccgacgaggagaagagacagggccugcccguggugaugcccguguucgacagaaacaccugcagcauccccaagagccagaucagcuucaucgacuacuucaucaccgacauguucgacgccugggacgccuucgcccaccugcccgcccugaugcagcaccuggccgacaacuacaagcacuggaagacccuggacgaccugaagugcaagagccugagacugcccagcgacagcuaa

SEQ ID NO: 21325 - RNA, 1602 nt, Artificial Sequence
  PDE9A__Homo_sapiens__NP_001001567
augggcagcggcagcagcagcuacagacccaaggccaucuaccuggacaucgacggcagaauccagaaggugaucuucagcaaguacugcaacagcagcgacaucauggaccuguucugcaucgccaccggccugcccagaaacaccaccaucagccugcugaccaccgacgacgccauggugagcaucgaccccaccaugcccgccaacagcgagagaacccccuacaaggugagacccguggccaucaagcagcugagcgagagagaggagcugauccagagcgugcuggcccagguggccgagcaguucagcagagccuucaagaucaacgagcugaaggccgagguggccaaccaccuggccgugcuggagaagagaguggagcuggagggccugaaggugguggagaucgagaagugcaagagcgacaucaagaagaugagagaggagcuggccgccagaagcagcagaaccaacugccccugcaaguacagcuuccuggacaaccacaagaagcugacccccagaagagacgugcccaccuaccccaaguaccugcugagccccgagaccaucgaggcccugagaaagcccaccuucgacguguggcugugggagcccaacgagaugcugagcugccuggagcacauguaccacgaccugggccuggugagagacuucagcaucaaccccgugacccugagaagauggcuguucugcgugcacgacaacuacagaaacaaccccuuccacaacuucagacacugcuucugcguggcccagaugauguacagcaugguguggcugugcagccugcaggagaaguucagccagaccgacauccugauccugaugaccgccgccaucugccacgaccuggaccaccccggcuacaacaacaccuaccagaucaacgccagaaccgagcuggccgugagauacaacgacaucagcccccuggagaaccaccacugcgccguggccuuccagauccuggccgagcccgagugcaacaucuucagcaacaucccccccgacggcuucaagcagaucagacagggcaugaucacccugauccuggccaccgacauggccagacacgccgagaucauggacagcuucaaggagaagauggagaacuucgacuacagcaacgaggagcacaugacccugcugaagaugauccugaucaagugcugcgacaucagcaacgaggugagacccauggagguggccgagcccuggguggacugccugcuggaggaguacuucaugcagagcgacagagagaagagcgagggccugcccguggcccccuucauggacagagacaaggugaccaaggccaccgcccagaucggcuucaucaaguucgugcugauccccauguucgagaccgugaccaagcuguuccccaugguggaggagaucaugcugcagccccugugggagagcagagacagauacgaggagcugaagagaaucgacgacgccaugaaggagcugcagaagaagaccgacagccugaccagcggcgccaccgagaagagcagagagagaagcagagacgugaagaacagcgagggcgacugcgccuaa

SEQ ID NO: 21326 - RNA, 732 nt, Artificial Sequence
  PDF__Homo_sapiens__NP_071736
auggccagacuguggggcgcccugagccuguggccccugugggccgccgugcccuggggcggcgccgccgccgugggcgugagagccugcagcagcaccgccgcccccgacggcguggagggccccgcccugagaagaagcuacuggagacaccugagaagacuggugcugggcccccccgagccccccuucagccacgugugccaggugggcgaccccgugcugagaggcguggccgcccccguggagagagcccagcugggcggccccgagcugcagagacugacccagagacuggugcaggugaugagaagaagaagaugcgugggccugagcgccccccagcugggcgugcccagacaggugcuggcccuggagcugcccgaggcccugugcagagagugcccccccagacagagagcccugagacagauggagcccuucccccugagaguguucgugaaccccagccugagagugcuggacagcagacuggugaccuuccccgagggcugcgagagcguggccggcuuccuggccugcgugcccagauuccaggccgugcagaucagcggccuggaccccaacggcgagcaggugguguggcaggccagcggcugggccgccagaaucauccagcacgagauggaccaccugcagggcugccuguucaucgacaagauggacagcagaaccuucaccaacguguacuggaugaaggugaacgacuaa

SEQ ID NO: 21327 - RNA, 636 nt, Artificial Sequence
  PDGFA__Homo_sapiens__NP_002598
augagaacccuggccugccugcugcugcugggcugcggcuaccuggcccacgugcuggccgaggaggccgagauccccagagaggugaucgagagacuggccagaagccagauccacagcaucagagaccugcagagacugcuggagaucgacagcgugggcagcgaggacagccuggacaccagccugagagcccacggcgugcacgccaccaagcacgugcccgagaagagaccccugcccaucagaagaaagagaagcaucgaggaggccgugcccgccgugugcaagaccagaaccgugaucuacgagauccccagaagccagguggaccccaccagcgccaacuuccugaucuggccccccugcguggaggugaagagaugcaccggcugcugcaacaccagcagcgugaagugccagcccagcagagugcaccacagaagcgugaagguggccaagguggaguacgugagaaagaagcccaagcugaaggaggugcaggugagacuggaggagcaccuggagugcgccugcgccaccaccagccugaaccccgacuacagagaggaggacaccggcagacccagagagagcggcaagaagagaaagagaaagagacugaagcccaccuaa

SEQ ID NO: 21328 - RNA, 726 nt, Artificial Sequence
  PDGFB__Homo_sapiens__NP_002599
augaacagaugcugggcccuguuccugagccugugcugcuaccugagacuggugagcgccgagggcgaccccauccccgaggagcuguacgagaugcugagcgaccacagcaucagaagcuucgacgaccugcagagacugcugcacggcgaccccggcgaggaggacggcgccgagcuggaccugaacaugaccagaagccacagcggcggcgagcuggagagccuggccagaggcagaagaagccugggcagccugaccaucgccgagcccgccaugaucgccgagugcaagaccagaaccgagguguucgagaucagcagaagacugaucgacagaaccaacgccaacuuccugguguggccccccugcguggaggugcagagaugcagcggcugcugcaacaacagaaacgugcagugcagacccacccaggugcagcugagacccgugcaggugagaaagaucgagaucgugagaaagaagcccaucuucaagaaggccaccgugacccuggaggaccaccuggccugcaagugcgagaccguggccgccgccagacccgugaccagaagccccggcggcagccaggagcagagagccaagaccccccagaccagagugaccaucagaaccgugagagugagaagaccccccaagggcaagcacagaaaguucaagcacacccacgacaagaccgcccugaaggagacccugggcgccuaa

SEQ ID NO: 21329 - RNA, 1038 nt, Artificial Sequence
  PDGFC__Homo_sapiens__NP_057289
augagccuguucggccugcugcugcugaccagcgcccuggccggccagagacagggcacccaggccgagagcaaccugagcagcaaguuccaguucagcagcaacaaggagcagaacggcgugcaggacccccagcacgagagaaucaucaccgugagcaccaacggcagcauccacagccccagauucccccacaccuaccccagaaacaccgugcugguguggagacugguggccguggaggagaacguguggauccagcugaccuucgacgagagauucggccuggaggaccccgaggacgacaucugcaaguacgacuucguggagguggaggagcccagcgacggcaccauccugggcagauggugcggcagcggcaccgugcccggcaagcagaucagcaagggcaaccagaucagaaucagauucgugagcgacgaguacuuccccagcgagcccggcuucugcauccacuacaacaucgugaugccccaguucaccgaggccgugagccccagcgugcugccccccagcgcccugccccuggaccugcugaacaacgccaucaccgccuucagcacccuggaggaccugaucagauaccuggagcccgagagauggcagcuggaccuggaggaccuguacagacccaccuggcagcugcugggcaaggccuucguguucggcagaaagagcagagugguggaccugaaccugcugaccgaggaggugagacuguacagcugcacccccagaaacuucagcgugagcaucagagaggagcugaagagaaccgacaccaucuucuggcccggcugccugcuggugaagagaugcggcggcaacugcgccugcugccugcacaacugcaacgagugccagugcgugcccagcaaggugaccaagaaguaccacgaggugcugcagcugagacccaagaccggcgugagaggccugcacaagagccugaccgacguggcccuggagcaccacgaggagugcgacugcgugugcagaggcagcaccggcggcuaa

SEQ ID NO: 21330 - RNA, 1113 nt, Artificial Sequence
  PDGFD__Homo_sapiens__NP_079484
augcacagacugaucuucguguacacccugaucugcgccaacuucugcagcugcagagacaccagcgccaccccccagagcgccagcaucaaggcccugagaaacgccaaccugagaagagacgagagcaaccaccugaccgaccuguacagaagagacgagaccauccaggugaagggcaacggcuacgugcagagccccagauuccccaacagcuaccccagaaaccugcugcugaccuggagacugcacagccaggagaacaccagaauccagcugguguucgacaaccaguucggccuggaggaggccgagaacgacaucugcagauacgacuucguggagguggaggacaucagcgagaccagcaccaucaucagaggcagauggugcggccacaaggaggugccccccagaaucaagagcagaaccaaccagaucaagaucaccuucaagagcgacgacuacuucguggccaagcccggcuucaagaucuacuacagccugcuggaggacuuccagcccgccgccgccagcgagaccaacugggagagcgugaccagcagcaucagcggcgugagcuacaacagccccagcgugaccgaccccacccugaucgccgacgcccuggacaagaagaucgccgaguucgacaccguggaggaccugcugaaguacuucaaccccgagagcuggcaggaggaccuggagaacauguaccuggacacccccagauacagaggcagaagcuaccacgacagaaagagcaagguggaccuggacagacugaacgacgacgccaagagauacagcugcacccccagaaacuacagcgugaacaucagagaggagcugaagcuggccaacgugguguucuuccccagaugccugcuggugcagagaugcggcggcaacugcggcugcggcaccgugaacuggagaagcugcaccugcaacagcggcaagaccgugaagaaguaccacgaggugcugcaguucgagcccggccacaucaagagaagaggcagagccaagaccauggcccugguggacauccagcuggaccaccacgagagaugcgacugcaucugcagcagcagaccccccagauaa

SEQ ID NO: 21331 - RNA, 3345 nt, Artificial Sequence
  PDGFRA__Homo_sapiens__XP_006714102
augcugcccagacuggugcugaacagcugggcccagaugaucugccugccccagcugcccaaguuccccagagccaugggcaccagccaccccgccuuccuggugcugggcugccugcugaccggccugagccugauccugugccagcugagccugcccagcauccugcccaacgagaacgagaagguggugcagcugaacagcagcuucagccugagaugcuucggcgagagcgaggugagcuggcaguaccccaugagcgaggaggagagcagcgacguggagaucagaaacgaggagaacaacagcggccuguucgugaccgugcuggaggugagcagcgccagcgccgcccacaccggccuguacaccugcuacuacaaccacacccagaccgaggagaacgagcuggagggcagacacaucuacaucuacgugcccgaccccgacguggccuucgugccccugggcaugaccgacuaccuggugaucguggaggacgacgacagcgccaucauccccugcagaaccaccgaccccgagacccccgugacccugcacaacagcgagggcguggugcccgccagcuacgacagcagacagggcuucaacggcaccuucaccgugggccccuacaucugcgaggccaccgugaagggcaagaaguuccagaccauccccuucaacguguacgcccugaaggccaccagcgagcuggaccuggagauggaggcccugaagaccguguacaagagcggcgagaccaucguggugaccugcgccguguucaacaacgaggugguggaccugcaguggaccuaccccggcgaggugaagggcaagggcaucaccaugcuggaggagaucaaggugcccagcaucaagcugguguacacccugaccgugcccgaggccaccgugaaggacagcggcgacuacgagugcgccgccagacaggccaccagagaggugaaggagaugaagaaggugaccaucagcgugcacgagaagggcuucaucgagaucaagcccaccuucagccagcuggaggccgugaaccugcacgaggugaagcacuucgugguggaggugagagccuaccccccccccagaaucagcuggcugaagaacaaccugacccugaucgagaaccugaccgagaucaccaccgacguggagaagauccaggagaucagauacagaagcaagcugaagcugaucagagccaaggaggaggacagcggccacuacaccaucguggcccagaacgaggacgccgugaagagcuacaccuucgagcugcugacccaggugcccagcagcauccuggaccugguggacgaccaccacggcagcaccggcggccagaccgugagaugcaccgccgagggcaccccccugcccgacaucgaguggaugaucugcaaggacaucaagaagugcaacaacgagaccagcuggaccauccuggccaacaacgugagcaacaucaucaccgagauccacagcagagacagaagcaccguggagggcagagugaccuucgccaagguggaggagaccaucgccgugagaugccuggccaagaaccugcugggcgccgagaacagagagcugaagcugguggcccccacccugagaagcgagcugaccguggccgccgccgugcuggugcugcuggugaucgugaucaucagccugaucgugcugguggugaucuggaagcagaagcccagauacgagaucagauggagagugaucgagagcaucagccccgacggccacgaguacaucuacguggaccccaugcagcugcccuacgacagcagaugggaguuccccagagacggccuggugcugggcagagugcugggcagcggcgccuucggcaaggugguggagggcaccgccuacggccugagcagaagccagcccgugaugaagguggccgugaagaugcugaagcccaccgccagaagcagcgagaagcaggcccugaugagcgagcugaagaucaugacccaccugggcccccaccugaacaucgugaaccugcugggcgccugcaccaagagcggccccaucuacaucaucaccgaguacugcuucuacggcgaccuggugaacuaccugcacaagaacagagacagcuuccugagccaccaccccgagaagcccaagaaggagcuggacaucuucggccugaaccccgccgacgagagcaccagaagcuacgugauccugagcuucgagaacaacggcgacuacauggacaugaagcaggccgacaccacccaguacgugcccaugcuggagagaaaggaggugagcaaguacagcgacauccagagaagccuguacgacagacccgccagcuacaagaagaagagcaugcuggacagcgaggugaagaaccugcugagcgacgacaacagcgagggccugacccugcuggaccugcugagcuucaccuaccagguggccagaggcauggaguuccuggccagcaagaacugcgugcacagagaccuggccgccagaaacgugcugcuggcccagggcaagaucgugaagaucugcgacuucggccuggccagagacaucaugcacgacagcaacuacgugagcaagggcagcaccuuccugcccgugaaguggauggcccccgagagcaucuucgacaaccuguacaccacccugagcgacguguggagcuacggcauccugcugugggagaucuucagccugggcggcacccccuaccccggcaugaugguggacagcaccuucuacaacaagaucaagagcggcuacagaauggccaagcccgaccacgccaccagcgagguguacgagaucauggugaagugcuggaacagcgagcccgagaagagacccagcuucuaccaccugagcgagaucguggagaaccugcugcccggccaguacaagaagagcuacgagaagauccaccuggacuuccugaagagcgaccaccccgccguggccagaaugagaguggacagcgacaacgccuacaucggcgugaccuacaagaacgaggaggacaagcugaaggacugggagggcggccuggacgagcagagacugagcgccgacagcggcuacaucaucccccugcccgacaucgaccccgugcccgaggaggaggaccugggcaagagaaacagacacagcagccagaccagcgaggagagcgccaucgagaccggcagcagcagcagcaccuucaucaagagagaggacgagaccaucgaggacaucgacaugauggacgacaucggcaucgacagcagcgaccugguggaggacagcuuccuguaa

SEQ ID NO: 21332 - RNA, 3321 nt, Artificial Sequence
  PDGFRB__Homo_sapiens__NP_002600
augagacugcccggcgccaugcccgcccuggcccugaagggcgagcugcugcugcugagccugcugcugcugcuggagccccagaucagccagggccugguggugaccccccccggccccgagcuggugcugaacgugagcagcaccuucgugcugaccugcagcggcagcgcccccguggugugggagagaaugagccaggagcccccccaggagauggccaaggcccaggacggcaccuucagcagcgugcugacccugaccaaccugaccggccuggacaccggcgaguacuucugcacccacaacgacagcagaggccuggagaccgacgagagaaagagacuguacaucuucgugcccgaccccaccgugggcuuccugcccaacgacgccgaggagcuguucaucuuccugaccgagaucaccgagaucaccauccccugcagagugaccgacccccagcugguggugacccugcacgagaagaagggcgacguggcccugcccgugcccuacgaccaccagagaggcuucagcggcaucuucgaggacagaagcuacaucugcaagaccaccaucggcgacagagagguggacagcgacgccuacuacguguacagacugcaggugagcagcaucaacgugagcgugaacgccgugcagaccguggugagacagggcgagaacaucacccugaugugcaucgugaucggcaacgagguggugaacuucgaguggaccuaccccagaaaggagagcggcagacugguggagcccgugaccgacuuccugcuggacaugcccuaccacaucagaagcauccugcacauccccagcgccgagcuggaggacagcggcaccuacaccugcaacgugaccgagagcgugaacgaccaccaggacgagaaggccaucaacaucaccgugguggagagcggcuacgugagacugcugggcgaggugggcacccugcaguucgccgagcugcacagaagcagaacccugcaggugguguucgaggccuaccccccccccaccgugcugugguucaaggacaacagaacccugggcgacagcagcgccggcgagaucgcccugagcaccagaaacgugagcgagaccagauacgugagcgagcugacccuggugagagugaagguggccgaggccggccacuacaccaugagagccuuccacgaggacgccgaggugcagcugagcuuccagcugcagaucaacgugcccgugagagugcuggagcugagcgagagccaccccgacagcggcgagcagaccgugagaugcagaggcagaggcaugccccagcccaacaucaucuggagcgccugcagagaccugaagagaugccccagagagcugccccccacccugcugggcaacagcagcgaggaggagagccagcuggagaccaacgugaccuacugggaggaggagcaggaguucgagguggugagcacccugagacugcagcacguggacagaccccugagcgugagaugcacccugagaaacgccgugggccaggacacccaggaggugaucguggugccccacagccugcccuucaaggugguggugaucagcgccauccuggcccugguggugcugaccaucaucagccugaucauccugaucaugcuguggcagaagaagcccagauacgagaucagauggaaggugaucgagagcgugagcagcgacggccacgaguacaucuacguggaccccaugcagcugcccuacgacagcaccugggagcugcccagagaccagcuggugcugggcagaacccugggcagcggcgccuucggccaggugguggaggccaccgcccacggccugagccacagccaggccaccaugaagguggccgugaagaugcugaagagcaccgccagaagcagcgagaagcaggcccugaugagcgagcugaagaucaugagccaccugggcccccaccugaacguggugaaccugcugggcgccugcaccaagggcggccccaucuacaucaucaccgaguacugcagauacggcgaccugguggacuaccugcacagaaacaagcacaccuuccugcagcaccacagcgacaagagaagaccccccagcgccgagcuguacagcaacgcccugcccgugggccugccccugcccagccacgugagccugaccggcgagagcgacggcggcuacauggacaugagcaaggacgagagcguggacuacgugcccaugcuggacaugaagggcgacgugaaguacgccgacaucgagagcagcaacuacauggcccccuacgacaacuacgugcccagcgcccccgagagaaccugcagagccacccugaucaacgagagccccgugcugagcuacauggaccuggugggcuucagcuaccagguggccaacggcauggaguuccuggccagcaagaacugcgugcacagagaccuggccgccagaaacgugcugaucugcgagggcaagcuggugaagaucugcgacuucggccuggccagagacaucaugagagacagcaacuacaucagcaagggcagcaccuuccugccccugaaguggauggcccccgagagcaucuucaacagccuguacaccacccugagcgacguguggagcuucggcauccugcugugggagaucuucacccugggcggcacccccuaccccgagcugcccaugaacgagcaguucuacaacgccaucaagagaggcuacagaauggcccagcccgcccacgccagcgacgagaucuacgagaucaugcagaagugcugggaggagaaguucgagaucagaccccccuucagccagcuggugcugcugcuggagagacugcugggcgagggcuacaagaagaaguaccagcagguggacgaggaguuccugagaagcgaccaccccgccauccugagaagccaggccagacugcccggcuuccacggccugagaagcccccuggacaccagcagcgugcuguacaccgccgugcagcccaacgagggcgacaacgacuacaucaucccccugcccgaccccaagcccgagguggccgacgagggcccccuggagggcagccccagccuggccagcagcacccugaacgaggugaacaccagcagcaccaucagcugcgacagcccccuggagccccaggacgagcccgagcccgagccccagcuggagcugcagguggagcccgagcccgagcuggagcagcugcccgacagcggcugccccgcccccagagccgaggccgaggacagcuuccuguaa

SEQ ID NO: 21333 - RNA, 1128 nt, Artificial Sequence
  PDGFRL__Homo_sapiens__XP_011542860
augaagguguggcugcugcugggccugcugcuggugcacgaggcccuggaggacgugaccggccagcaccugcccaagaacaagagacccaaggagcccggcgagaacagaaucaagcccaccaacaagaaggugaagcccaagauccccaagaugaaggacagagacagcgccaacagcgcccccaagacccagagcaucaugaugcaggugcuggacaagggcagauuccagaagcccgccgccacccugagccugcuggccggccagaccguggagcugagaugcaagggcagcagaaucggcuggagcuaccccgccuaccuggacaccuucaaggacagcagacugagcgugaagcagaacgagagauacggccagcugacccuggugaacagcaccagcgccgacaccggcgaguucagcugcugggugcagcugugcagcggcuacaucugcagaaaggacgaggccaagaccggcagcaccuacaucuucuucaccgagaagggcgagcuguucgugcccagccccagcuacuucgacgugguguaccugaaccccgacagacaggccguggugcccugcagagugaccgugcugagcgccaaggugacccugcacagagaguuccccgccaaggagauccccgccaacggcaccgacaucguguacgacaugaagagaggcuucguguaccugcagccccacagcgagcaccagggcgugguguacugcagagccgaggccggcggcagaagccagaucagcgugaaguaccagcugcuguacguggccgugcccagcggcccccccagcaccaccauccuggccagcagcaacaaggugaagagcggcgacgacaucagcgugcugugcaccgugcugggcgagcccgacguggagguggaguucaccuggaucuuccccggccagaaggacgagagacccgugaccauccaggacaccuggagacugauccacagaggccugggccacaccaccagaaucagccagagcgugaucaccguggaggacuucgagaccaucgacgccggcuacuacaucugcaccgcccagaaccugcagggccagaccaccguggccaccaccguggaguucagcuaa

SEQ ID NO: 21334 - RNA, 1173 nt, Artificial Sequence
  PDHA1__Homo_sapiens__NP_000275
augagaaagaugcuggccgccgugagcagagugcugagcggcgccagccagaagcccgccagcagagugcugguggccagcagaaacuucgccaacgacgccaccuucgagaucaagaagugcgaccugcacagacuggaggagggcccccccgugaccaccgugcugaccagagaggacggccugaaguacuacagaaugaugcagaccgugagaagaauggagcugaaggccgaccagcuguacaagcagaagaucaucagaggcuucugccaccugugcgacggccaggaggccugcugcgugggccuggaggccggcaucaaccccaccgaccaccugaucaccgccuacagagcccacggcuucaccuucaccagaggccugagcgugagagagauccuggccgagcugaccggcagaaagggcggcugcgccaagggcaagggcggcagcaugcacauguacgccaagaacuucuacggcggcaacggcaucgugggcgcccaggugccccugggcgccggcaucgcccuggccugcaaguacaacggcaaggacgaggugugccugacccuguacggcgacggcgccgccaaccagggccagaucuucgaggccuacaacauggccgcccuguggaagcugcccugcaucuucaucugcgagaacaacagauacggcaugggcaccagcguggagagagccgccgccagcaccgacuacuacaagagaggcgacuucauccccggccugagaguggacggcauggacauccugugcgugagagaggccaccagauucgccgccgccuacugcagaagcggcaagggccccauccugauggagcugcagaccuacagauaccacggccacagcaugagcgaccccggcgugagcuacagaaccagagaggagauccaggaggugagaagcaagagcgaccccaucaugcugcugaaggacagaauggugaacagcaaccuggccagcguggaggagcugaaggagaucgacguggaggugagaaaggagaucgaggacgccgcccaguucgccaccgccgaccccgagcccccccuggaggagcugggcuaccacaucuacagcagcgacccccccuucgaggugagaggcgccaaccaguggaucaaguucaagagcgugagcuaa

SEQ ID NO: 21335 - RNA, 1080 nt, Artificial Sequence
  PDHB__Homo_sapiens__NP_000916
auggccgccgugagcggccuggugagaagaccccugagagaggugagcggccugcugaagagaagauuccacuggaccgcccccgccgcccugcaggugaccgugagagacgccaucaaccagggcauggacgaggagcuggagagagacgagaagguguuccugcugggcgaggagguggcccaguacgacggcgccuacaaggugagcagaggccuguggaagaaguacggcgacaagagaaucaucgacacccccaucagcgagaugggcuucgccggcaucgccgugggcgccgccauggccggccugagacccaucugcgaguucaugaccuucaacuucagcaugcaggccaucgaccaggugaucaacagcgccgccaagaccuacuacaugagcggcggccugcagcccgugcccaucguguucagaggccccaacggcgccagcgccggcguggccgcccagcacagccagugcuucgccgccugguacggccacugccccggccugaagguggugagccccuggaacagcgaggacgccaagggccugaucaagagcgccaucagagacaacaaccccgugguggugcuggagaacgagcugauguacggcgugcccuucgaguucccccccgaggcccagagcaaggacuuccugauccccaucggcaaggccaagaucgagagacagggcacccacaucaccguggugagccacagcagacccgugggccacugccuggaggccgccgccgugcugagcaaggagggcguggagugcgaggugaucaacaugagaaccaucagacccauggacauggagaccaucgaggccagcgugaugaagaccaaccaccuggugaccguggagggcggcuggccccaguucggcgugggcgccgagaucugcgccagaaucauggagggccccgccuucaacuuccuggacgcccccgccgugagagugaccggcgccgacgugcccaugcccuacgccaagauccuggaggacaacagcaucccccaggugaaggacaucaucuucgccaucaagaagacccugaacaucuaa

SEQ ID NO: 21336 - RNA, 1461 nt, Artificial Sequence
  PDHX__Homo_sapiens__NP_001128496
augcagagcggcggcgccgagggcagccccggcgccggcagaaccggcagaggccccggcagcggcaaggccccccccgccgagaucagcagcggcgcccccgacuuccccggcggcgaccccaucaagauccugaugcccagccugagccccaccauggaggagggcaacaucgugaaguggcugaagaaggagggcgaggccgugagcgccggcgacgcccugugcgagaucgagaccgacaaggccguggugacccuggacgccagcgacgacggcauccuggccaagaucgugguggaggagggcagcaagaacaucagacugggcagccugaucggccugaucguggaggagggcgaggacuggaagcacguggagauccccaaggacgugggcccccccccccccgugagcaagcccagcgagcccagacccagccccgagccccagaucagcauccccgugaagaaggagcacauccccggcacccugagauucagacugagccccgccgccagaaacauccuggagaagcacagccuggacgccagccagggcaccgccaccggccccagaggcaucuucaccaaggaggacgcccugaagcuggugcagcugaagcagaccggcaagaucaccgagagcagacccacccccgcccccaccgccacccccaccgcccccagcccccugcaggccaccgccggccccagcuaccccagacccgugaucccccccgugagcacccccggccagcccaacgccgugggcaccuucaccgagauccccgccagcaacaucagaagagugaucgccaagagacugaccgagagcaagagcaccgugccccacgccuacgccaccgccgacugcgaccugggcgccgugcugaaggugagacaggaccuggugaaggacgacaucaaggugagcgugaacgacuucaucaucaaggccgccgccgugacccugaagcagaugcccgacgugaacgugagcugggacggcgagggccccaagcagcugcccuucaucgacaucagcguggccguggccaccgacaagggccugcugacccccaucaucaaggacgccgccgccaagggcauccaggagaucgccgacagcgugaaggcccugagcaagaaggccagagacggcaagcugcugcccgaggaguaccagggcggcagcuucagcaucagcaaccugggcauguucggcaucgacgaguucaccgccgugaucaaccccccccaggccugcauccuggccgugggcagauucagacccgugcugaagcugaccgaggacgaggagggcaacgccaagcugcagcagagacagcugaucaccgugaccaugagcagcgacagcagagugguggacgacgagcuggccaccagauuccugaagagcuucaaggccaaccuggagaaccccaucagacuggccuaa

SEQ ID NO: 21337 - RNA, 1578 nt, Artificial Sequence
  PDIA2__Homo_sapiens__NP_006840
augagcagacagcugcugcccgugcugcugcugcugcugcugagagccagcugccccuggggccaggagcagggcgccagaagccccagcgaggagccccccgaggaggagauccccaaggaggacggcauccuggugcugagcagacacacccugggccuggcccugagagagcaccccgcccugcugguggaguucuacgcccccuggugcggccacugccaggcccuggcccccgaguacagcaaggccgccgccgugcuggccgccgagagcaugguggugacccuggccaagguggacggccccgcccagagagagcuggccgaggaguucggcgugaccgaguaccccacccugaaguucuucagaaacggcaacagaacccaccccgaggaguacaccggccccagagacgccgagggcaucgccgaguggcugagaagaagagugggccccagcgccaugagacuggaggacgaggccgccgcccaggcccugaucggcggcagagaccugguggugaucggcuucuuccaggaccugcaggacgaggacguggccaccuuccuggcccuggcccaggacgcccuggacaugaccuucggccugaccgacagacccagacuguuccagcaguucggccugaccaaggacaccguggugcuguucaagaaguucgacgagggcagagccgacuuccccguggacgaggagcugggccuggaccugggcgaccugagcagauuccuggugacccacagcaugagacuggugaccgaguucaacagccagaccagcgccaagaucuucgccgccagaauccugaaccaccugcugcuguucgugaaccagacccuggccgcccacagagagcugcuggccggcuucggcgaggccgcccccagauucagaggccaggugcuguucguggugguggacguggccgccgacaacgagcacgugcugcaguacuucggccugaaggccgaggccgcccccacccugagacuggugaaccuggagaccaccaagaaguacgcccccguggacggcggccccgugaccgccgccagcaucaccgccuucugccacgccgugcugaacggccaggugaagcccuaccugcugagccaggagaucccccccgacugggaccagagacccgugaagacccuggugggcaagaacuucgagcagguggccuucgacgagaccaagaacguguucgugaaguucuacgcccccuggugcacccacugcaaggagauggcccccgccugggaggcccuggccgagaaguaccaggaccacgaggacaucaucaucgccgagcuggacgccaccgccaacgagcuggacgccuucgccgugcacggcuuccccacccugaaguacuuccccgccggccccggcagaaaggugaucgaguacaagagcaccagagaccuggagaccuucagcaaguuccuggacaacggcggcgugcugcccaccgaggagccccccgaggagcccgccgcccccuuccccgagccccccgccaacagcaccaugggcagcaaggaggagcuguaa

SEQ ID NO: 21338 - RNA, 1518 nt, Artificial Sequence
  PDIA3__Homo_sapiens__NP_005304
augagacugagaagacuggcccuguuccccggcguggcccugcugcuggccgccgccagacuggccgccgccagcgacgugcuggagcugaccgacgacaacuucgagagcagaaucagcgacaccggcagcgccggccugaugcugguggaguucuucgcccccuggugcggccacugcaagagacuggcccccgaguacgaggccgccgccaccagacugaagggcaucgugccccuggccaagguggacugcaccgccaacaccaacaccugcaacaaguacggcgugagcggcuaccccacccugaagaucuucagagacggcgaggaggccggcgccuacgacggccccagaaccgccgacggcaucgugagccaccugaagaagcaggccggccccgccagcgugccccugagaaccgaggaggaguucaagaaguucaucagcgacaaggacgccagcaucgugggcuucuucgacgacagcuucagcgaggcccacagcgaguuccugaaggccgccagcaaccugagagacaacuacagauucgcccacaccaacguggagagccuggugaacgaguacgacgacaacggcgagggcaucauccuguucagacccagccaccugaccaacaaguucgaggacaagaccguggccuacaccgagcagaagaugaccagcggcaagaucaagaaguucauccaggagaacaucuucggcaucugcccccacaugaccgaggacaacaaggaccugauccagggcaaggaccugcugaucgccuacuacgacguggacuacgagaagaacgccaagggcagcaacuacuggagaaacagagugaugaugguggccaagaaguuccuggacgccggccacaagcugaacuucgccguggccagcagaaagaccuucagccacgagcugagcgacuucggccuggagagcaccgccggcgagauccccgugguggccaucagaaccgccaagggcgagaaguucgugaugcaggaggaguucagcagagacggcaaggcccuggagagauuccugcaggacuacuucgacggcaaccugaagagauaccugaagagcgagcccauccccgagagcaacgacggccccgugaagguggugguggccgagaacuucgacgagaucgugaacaacgagaacaaggacgugcugaucgaguucuacgcccccuggugcggccacugcaagaaccuggagcccaaguacaaggagcugggcgagaagcugagcaaggaccccaacaucgugaucgccaagauggacgccaccgccaacgacgugcccagccccuacgaggugagaggcuuccccaccaucuacuucagccccgccaacaagaagcugaaccccaagaaguacgagggcggcagagagcugagcgacuucaucagcuaccugcagagagaggccaccaacccccccgugauccaggaggagaagcccaagaagaagaagaaggcccaggaggaccuguaa

SEQ ID NO: 21339 - RNA, 1938 nt, Artificial Sequence
  PDIA4__Homo_sapiens__NP_004902
augagacccagaaaggccuuccugcugcugcugcugcugggccuggugcagcugcuggccguggccggcgccgagggccccgacgaggacagcagcaacagagagaacgccaucgaggacgaggaggaggaggaggaggaggacgacgacgaggaggaggacgaccuggaggugaaggaggagaacggcgugcuggugcugaacgacgccaacuucgacaacuucguggccgacaaggacaccgugcugcuggaguucuacgcccccuggugcggccacugcaagcaguucgcccccgaguacgagaagaucgccaacauccugaaggacaaggacccccccauccccguggccaagaucgacgccaccagcgccagcgugcuggccagcagauucgacgugagcggcuaccccaccaucaagauccugaagaagggccaggccguggacuacgagggcagcagaacccaggaggagaucguggccaaggugagagaggugagccagcccgacuggacccccccccccgaggugacccuggugcugaccaaggagaacuucgacgagguggugaacgacgccgacaucauccugguggaguucuacgcccccuggugcggccacugcaagaagcuggcccccgaguacgagaaggccgccaaggagcugagcaagagaagcccccccaucccccuggccaagguggacgccaccgccgagaccgaccuggccaagagauucgacgugagcggcuaccccacccugaagaucuucagaaagggcagacccuacgacuacaacggccccagagagaaguacggcaucguggacuacaugaucgagcagagcggcccccccagcaaggagauccugacccugaagcaggugcaggaguuccugaaggacggcgacgacgugaucaucaucggcguguucaagggcgagagcgaccccgccuaccagcaguaccaggacgccgccaacaaccugagagaggacuacaaguuccaccacaccuucagcaccgagaucgccaaguuccugaaggugagccagggccagcugguggugaugcagcccgagaaguuccagagcaaguacgagcccagaagccacaugauggacgugcagggcagcacccaggacagcgccaucaaggacuucgugcugaaguacgcccugccccuggugggccacagaaaggugagcaacgacgccaagagauacaccagaagaccccugguggugguguacuacagcguggacuucagcuucgacuacagagccgccacccaguucuggagaagcaaggugcuggagguggccaaggacuuccccgaguacaccuucgccaucgccgacgaggaggacuacgccggcgaggugaaggaccugggccugagcgagagcggcgaggacgugaacgccgccauccuggacgagagcggcaagaaguucgccauggagcccgaggaguucgacagcgacacccugagagaguucgugaccgccuucaagaagggcaagcugaagcccgugaucaagagccagcccgugcccaagaacaacaagggccccgugaaggugguggugggcaagaccuucgacagcaucgugauggaccccaagaaggacgugcugaucgaguucuacgcccccuggugcggccacugcaagcagcuggagcccguguacaacagccuggccaagaaguacaagggccagaagggccuggugaucgccaagauggacgccaccgccaacgacgugcccagcgacagauacaagguggagggcuuccccaccaucuacuucgcccccagcggcgacaagaagaaccccgugaaguucgagggcggcgacagagaccuggagcaccugagcaaguucaucgaggagcacgccaccaagcugagcagaaccaaggaggagcuguaa

SEQ ID NO: 21340 - RNA, 1560 nt, Artificial Sequence
  PDIA5__Homo_sapiens__NP_006801
auggccagagccggccccgccuggcugcugcuggccaucuggguggugcugcccagcuggcugagcagcgccaaggugagcagccugaucgagagaaucagcgaccccaaggaccugaagaagcugcugagaaccagaaacaacgugcuggugcuguacagcaagagcgagguggccgccgagaaccaccugagacugcugagcaccguggcccaggccgugaagggccagggcaccaucugcuggguggacugcggcgacgccgagagcagaaagcugugcaagaagaugaagguggaccugagccccaaggacaagaagguggagcuguuccacuaccaggacggcgccuuccacaccgaguacaacagagccgugaccuucaagagcaucguggccuuccugaaggaccccaagggccccccccugugggaggaggaccccggcgccaaggacguggugcaccuggacagcgagaaggacuucagaagacugcugaagaaggaggagaagccccugcugaucauguucuacgcccccuggugcagcaugugcaagagaaugaugccccacuuccagaaggccgccacccagcugagaggccacgccgugcuggccggcaugaacguguacagcagcgaguucgagaacaucaaggaggaguacagcgugagaggcuuccccaccaucugcuacuucgagaagggcagauuccuguuccaguacgacaacuacggcagcaccgccgaggacaucguggaguggcugaagaacccccagcccccccagccccaggugcccgagacccccugggccgacgagggcggcagcguguaccaccugaccgacgaggacuucgaccaguucgugaaggagcacagcagcgugcuggugauguuccacgcccccuggugcggccacugcaagaagaugaagcccgaguucgagaaggccgccgaggcccugcacggcgaggccgacagcagcggcgugcuggccgccguggacgccaccgugaacaaggcccuggccgagagauuccacaucagcgaguuccccacccugaaguacuucaagaacggcgagaaguacgccgugcccgugcugagaaccaagaagaaguuccuggaguggaugcagaaccccgaggccccccccccccccgagcccaccugggaggagcagcagaccagcgugcugcaccuggugggcgacaacuucagagagacccugaagaagaagaagcacacccuggugauguucuacgcccccuggugcccccacugcaagaaggugaucccccacuucaccgccaccgccgacgccuucaaggacgacagaaagaucgccugcgccgccguggacugcgugaaggacaagaaccaggaccugugccagcaggaggccgugaagggcuaccccaccuuccacuacuaccacuacggcaaguucgccgagaaguacgacagcgacagaaccgagcugggcuucaccaacuacaucagagcccugagagagggcgaccacgagagacugggcaagaagaaggaggagcuguaa

SEQ ID NO: 21341 - RNA, 1479 nt, Artificial Sequence
  PDIA6__Homo_sapiens__NP_001269633
augagaagagaccugagagagaagcuggugugggugugcagaccccuggcccccguggaggugcccgccaacaucagcagcgacuuccagcccugcagccccaccagccccgcccacagccugagcagaaagagccccaucauguaccccagcaccaccauggccaacgcccccggccuggugagcugcaccuucuuccuggccgugaacggccuguacagcagcagcgacgacgugaucgagcugacccccagcaacuucaacagagaggugauccagagcgacagccuguggcugguggaguucuacgcccccuggugcggccacugccagagacugacccccgaguggaagaaggccgccaccgcccugaaggacguggugaaggugggcgccguggacgccgacaagcaccacagccugggcggccaguacggcgugcagggcuuccccaccaucaagaucuucggcagcaacaagaacagacccgaggacuaccagggcggcagaaccggcgaggccaucguggacgccgcccugagcgcccugagacagcuggugaaggacagacugggcggcagaagcggcggcuacagcagcggcaagcagggcagaagcgacagcagcagcaagaaggacgugaucgagcugaccgacgacagcuucgacaagaacgugcuggacagcgaggacguguggaugguggaguucuacgcccccuggugcggccacugcaagaaccuggagcccgagugggccgccgccgccagcgaggugaaggagcagaccaagggcaaggugaagcuggccgccguggacgccaccgugaaccaggugcuggccagcagauacggcaucagaggcuuccccaccaucaagaucuuccagaagggcgagagccccguggacuacgacggcggcagaaccagaagcgacaucgugagcagagcccuggaccuguucagcgacaacgcccccccccccgagcugcuggagaucaucaacgaggacaucgccaagagaaccugcgaggagcaccagcugugcgugguggccgugcugccccacauccuggacaccggcgccgccggcagaaacagcuaccuggaggugcugcugaagcuggccgacaaguacaagaagaagauguggggcuggcuguggaccgaggccggcgcccagagcgagcuggagaccgcccugggcaucggcggcuucggcuaccccgccauggccgccaucaacgccagaaagaugaaguucgcccugcugaagggcagcuucagcgagcagggcaucaacgaguuccugagagagcugagcuucggcagaggcagcaccgcccccgugggcggcggcgccuuccccaccaucguggagagagagcccugggacggcagagacggcgagcugcccguggaggacgacaucgaccugagcgacguggagcuggacgaccugggcaaggacgagcuguaa

SEQ ID NO: 21342 - RNA, 1371 nt, Artificial Sequence
  PDK1__Homo_sapiens__NP_001265478
augagacuggccagacugcugagaggcgccgcccuggccggccccggccccggccugagagccgccggcuucagcagaagcuucagcagcgacagcggcagcagccccgccagcgagagaggcgugcccggccagguggacuucuacgccagauucagccccagcccccugagcaugaagcaguuccuggacuucggcagcgugaacgccugcgagaagaccagcuucauguuccugagacaggagcugcccgugagacuggccaacaucaugaaggagaucagccugcugcccgacaaccugcugagaacccccagcgugcagcuggugcagagcugguacauccagagccugcaggagcugcuggacuucaaggacaagagcgccgaggacgccaaggccaucuacgagagacccagaagaaccuggcugcaggugagcagccugugcugcauggccugcaagaugaucuucaccgacaccgugaucagaaucagaaacagacacaacgacgugauccccaccauggcccagggcgugaucgaguacaaggagagcuucggcguggaccccgugaccagccagaacgugcaguacuuccuggacagauucuacaugagcagaaucagcaucagaaugcugcugaaccagcacagccugcuguucggcggcaagggcaagggcagccccagccacagaaagcacaucggcagcaucaaccccaacugcaacgugcuggaggugaucaaggacggcuacgagaacgccagaagacugugcgaccuguacuacaucaacagccccgagcuggagcuggaggagcugaacgccaagagccccggccagcccauccaggugguguacgugcccagccaccuguaccacaugguguucgagcuguucaagaacgccaugagagccaccauggagcaccacgccaacagaggcguguacccccccauccaggugcacgugacccugggcaacgaggaccugaccgugaagaugagcgacagaggcggcggcgugccccugagaaagaucgacagacuguucaacuacauguacagcaccgcccccagacccagaguggagaccagcagagccgugccccuggccggcuucggcuacggccugcccaucagcagacuguacgcccaguacuuccagggcgaccugaagcuguacagccuggagggcuacggcaccgacgccgugaucuacaucaaggcccugagcaccgacagcaucgagagacugcccguguacaacaaggccgccuggaagcacuacaacaccaaccacgaggccgacgacuggugcgugcccagcagagagcccaaggacaugaccaccuucagaagcgccuaa

SEQ ID NO: 21343 - RNA, 1032 nt, Artificial Sequence
  PDK2__Homo_sapiens__NP_001186828
augaaggagaucaaccugcugcccgacagagugcugagcacccccagcgugcagcuggugcagagcugguacgugcagagccugcuggacaucauggaguuccuggacaaggaccccgaggaccacagaacccugagccaguucaccgacgcccuggugaccaucagaaacagacacaacgacguggugcccaccauggcccagggcgugcuggaguacaaggacaccuacggcgacgaccccgugagcaaccagaacauccaguacuuccuggacagauucuaccugagcagaaucagcaucagaaugcugaucaaccagcacacccugaucuucgacggcagcaccaaccccgcccaccccaagcacaucggcagcaucgaccccaacugcaacgugagcgagguggugaaggacgccuacgacauggccaagcugcugugcgacaaguacuacauggccagccccgaccuggagauccaggagaucaacgccgccaacagcaagcagcccauccacaugguguacgugcccagccaccuguaccacaugcuguucgagcuguucaagaacgccaugagagccaccguggagagccacgagagcagccugauccugccccccaucaaggugaugguggcccugggcgaggaggaccugagcaucaagaugagcgacagaggcggcggcgugccccugagaaagaucgagagacuguucagcuacauguacagcaccgcccccaccccccagcccggcaccggcggcaccccccuggccggcuucggcuacggccugcccaucagcagacuguacgccaaguacuuccagggcgaccugcagcuguucagcauggagggcuucggcaccgacgccgugaucuaccugaaggcccugagcaccgacagcguggagagacugcccguguacaacaagagcgccuggagacacuaccagaccauccaggaggccggcgacuggugcgugcccagcaccgagcccaagaacaccagcaccuacagagugagcuaa

SEQ ID NO: 21344 - RNA, 1248 nt, Artificial Sequence
  PDK3__Homo_sapiens__NP_001135858
augagacuguucagauggcugcugaagcagcccgugcccaagcagaucgagagauacagcagauucagccccagcccccugagcaucaagcaguuccuggacuucggcagagacaacgccugcgagaagaccagcuacauguuccugagaaaggagcugcccgugagacuggccaacaccaugagagaggugaaccugcugcccgacaaccugcugaacagacccagcgugggccuggugcagagcugguacaugcagagcuuccuggagcugcuggaguacgagaacaagagccccgaggacccccaggugcuggacaacuuccugcaggugcugaucaaggugagaaacagacacaacgacguggugcccaccauggcccagggcgugaucgaguacaaggagaaguucggcuucgaccccuucaucagcaccaacauccaguacuuccuggacagauucuacaccaacagaaucagcuucagaaugcugaucaaccagcacacccugcuguucggcggcgacaccaaccccgugcaccccaagcacaucggcagcaucgaccccaccugcaacguggccgacguggugaaggacgccuacgagaccgccaagaugcugugcgagcaguacuaccugguggcccccgagcuggagguggaggaguucaacgccaaggcccccgacaagcccauccaggugguguacgugcccagccaccuguuccacaugcuguucgagcuguucaagaacagcaugagagccaccguggagcuguacgaggacagaaaggagggcuaccccgccgugaagacccuggugacccugggcaaggaggaccugagcaucaagaucagcgaccugggcggcggcgugccccugagaaagaucgacagacuguucaacuacauguacagcaccgcccccagacccagccuggagcccaccagagccgccccccuggccggcuucggcuacggccugcccaucagcagacuguacgccagauacuuccagggcgaccugaagcuguacagcauggagggcgugggcaccgacgccgugaucuaccugaaggcccugagcagcgagagcuucgagagacugcccguguucaacaagagcgccuggagacacuacaagaccacccccgaggccgacgacuggagcaaccccagcagcgagcccagagacgccagcaaguacaaggccaagcaggacaagaucaagaccaacagaaccuucuaa

SEQ ID NO: 21345 - RNA, 1236 nt, Artificial Sequence
  PDK4__Homo_sapiens__NP_002603
augaaggccgccagauucgugcugagaagcgccggcagccugaacggcgccggccuggugcccagagagguggagcacuucagcagauacagccccagcccccugagcaugaagcagcugcuggacuucggcagcgagaacgccugcgagagaaccagcuucgccuuccugagacaggagcugcccgugagacuggccaacauccugaaggagaucgacauccugcccacccagcuggugaacaccagcagcgugcagcuggugaagagcugguacauccagagccugauggaccugguggaguuccacgagaagagccccgacgaccagaaggcccugagcgacuucguggacacccugaucaaggugagaaacagacaccacaacguggugcccaccauggcccagggcaucaucgaguacaaggacgccugcaccguggaccccgugaccaaccagaaccugcaguacuuccuggacagauucuacaugaacagaaucagcaccagaaugcugaugaaccagcacauccugaucuucagcgacagccagaccggcaaccccagccacaucggcagcaucgaccccaacugcgacgugguggccguggugcaggacgccuucgagugcagcagaaugcugugcgaccaguacuaccugagcagccccgagcugaagcugacccaggugaacggcaaguuccccgaccagcccauccacaucguguacgugcccagccaccugcaccacaugcuguucgagcuguucaagaacgccaugagagccaccguggagcaccaggagaaccagcccagccugacccccaucgaggugaucguggugcugggcaaggaggaccugaccaucaagaucagcgacagaggcggcggcgugccccugagaaucaucgacagacuguucagcuacaccuacagcaccgcccccacccccgugauggacaacagcagaaacgccccccuggccggcuucggcuacggccugcccaucagcagacuguacgccaaguacuuccagggcgaccugaaccuguacagccugagcggcuacggcaccgacgccaucaucuaccugaaggcccugagcagcgagagcaucgagaagcugcccguguucaacaagagcgccuucaagcacuaccagaugagcagcgaggccgacgacuggugcauccccagcagagagcccaagaaccuggccaaggagguggccauguaa

SEQ ID NO: 21346 - RNA, 990 nt, Artificial Sequence
  PDLIM1__Homo_sapiens__NP_066272
augaccacccagcagaucgaccugcagggccccggccccuggggcuucagacuggugggcggcaaggacuucgagcagccccuggccaucagcagagugacccccggcagcaaggccgcccuggccaaccugugcaucggcgacgugaucaccgccaucgacggcgagaacaccagcaacaugacccaccuggaggcccagaacagaaucaagggcugcaccgacaaccugacccugaccguggccagaagcgagcacaagguguggagcccccuggugaccgaggagggcaagagacaccccuacaagaugaaccuggccagcgagccccaggaggugcugcacaucggcagcgcccacaacagaagcgccaugcccuucaccgccagccccgccagcagcaccaccgccagagugaucaccaaccaguacaacaaccccgccggccuguacagcagcgagaacaucagcaacuucaacaacgcccuggagagcaagaccgccgccagcggcguggaggccaacagcagaccccuggaccacgcccagccccccagcagccuggugaucgacaaggagagcgagguguacaagaugcugcaggagaagcaggagcugaacgagccccccaagcagagcaccagcuuccuggugcugcaggagauccuggagagcgaggagaagggcgaccccaacaagcccagcggcuucagaagcgugaaggcccccgugaccaagguggccgccagcaucggcaacgcccagaagcugcccaugugcgacaagugcggcaccggcaucgugggcguguucgugaagcugagagacagacacagacaccccgagugcuacgugugcaccgacugcggcaccaaccugaagcagaagggccacuucuucguggaggaccagaucuacugcgagaagcacgccagagagagagugaccccccccgagggcuacgagguggugaccguguuccccaaguaa

SEQ ID NO: 21347 - RNA, 1809 nt, Artificial Sequence
  PDLIM2__Homo_sapiens__NP_067643
augagaggcggcagagccagacccgccugggagagcuucaugggccugccccccagaagcagcgccaaguggggcgccggccagagccuggacagacugugcugcgcccccggcagcagaggccuggccggcgcccccggcagaaugagagccccccccgccggcagaagccagcccgccggcggccccggcgacagccugccccacccccccggcggccugggccccggcggcagcgccugggccagaagagccgaggccgccgccagcagagccagaggcggcggcagaggcggccccggcaucaccugggccgaggccggccccggcgcccccggcggccugagccccgagagcggcagaagacagagagagagauggagacugcccgccuucccccccagcagagccugggcccccagcagaaccggcgagagacagcccggcgagagagcccaccugagacugagcgccagacccgcccugcccggcgccggccugcugagcgccccccugagcgccagaaaccccggccuggugagaggccccgcccccuggagccuggccagcgccggcgccccccccagagccgcccugagccccgccggcgcccugcugcugcagccccccgccagaagagugcugugccccagaagcgagggcggcagcagaaccggcagagccggccccagcggcugggccccccccagaggcgccagaagcgccgagagcaccgacagacugaagggcauggcccugaccguggacguggccggccccgcccccuggggcuucagaaucaccggcggcagagacuuccacacccccaucauggugaccaagguggccgagagaggcaaggccaaggacgccgaccugagacccggcgacaucaucguggccaucaacggcgagagcgccgagggcaugcugcacgccgaggcccagagcaagaucagacagagccccagcccccugagacugcagcuggacagaagccaggccaccagccccggccagaccaacggcgacagcagccuggaggugcuggccaccagauuccagggcagcgugagaaccuacaccgagagccagagcagccugagaagcagcuacagcagccccaccagccugagccccagagccggcagccccuucagccccccccccagcagcagcagccugaccggcgaggccgccaucagcagaagcuuccagagccuggccugcagccccggccugcccgccgccgacagacugagcuacagcggcagacccggcagcagacaggccggccugggcagagccggcgacagcgccgugcuggugcugccccccagccccggccccagaagcagcagacccagcauggacagcgagggcggcagccugcugcuggacgaggacagcgagguguucaagaugcugcaggagaacagagagggcagagccgcccccagacagagcagcagcuucagacugcugcaggaggcccuggaggccgaggagagaggcggcacccccgccuuccugcccagcagccugagcccccagagcagccugcccgccagcagagcccuggccaccccccccaagcugcacaccugcgagaagugcagcaccagcaucgccaaccaggccgugagaauccaggagggcagauacagacaccccggcugcuacaccugcgccgacugcggccugaaccugaagaugagaggccacuucugggugggcgacgagcuguacugcgagaagcacgccagacagagauacagcgcccccgccacccugagcagcagagccuaa

SEQ ID NO: 21348 - RNA, 951 nt, Artificial Sequence
  PDLIM3__Homo_sapiens__NP_001107579
augccccagaccgugauccugcccggccccgcccccuggggcuucagacugagcggcggcaucgacuucaaccagccccuggugaucaccagaaucacccccggcagcaaggccgccgccgccaaccugugccccggcgacgugauccuggccaucgacggcuucggcaccgagagcaugacccacgccgacgcccaggacagaaucaaggccgccgcccaccagcugugccugaagaucgacagaggcgagacccaccuguggagcccccaggugagcgaggacggcaaggcccaccccuucaagaucaaccuggagagcgagccccaggaguucaagcccaucggcaccgcccacaacagaagagcccagcccuucguggccgccgccaacaucgacgacaagagacagguggugagcgccagcuacaacagccccaucggccuguacagcaccagcaacauccaggacgcccugcacggccagcugagaggccugauccccagcagcccccagaacgagcccaccgccagcgugccccccgagagcgacguguacagaaugcugcacgacaacagaaacgagcccacccagcccagacagagcggcagcuucagagugcugcagggcaugguggacgacggcagcgacgacagacccgccggcaccagaagcgugagagcccccgugaccaaggugcacggcggcagcggcggcgcccagagaaugccccugugcgacaagugcggcagcggcaucgugggcgccguggugaaggccagagacaaguacagacaccccgagugcuucgugugcgccgacugcaaccugaaccugaagcagaagggcuacuucuucaucgagggcgagcuguacugcgagacccacgccagagccagaaccaagccccccgagggcuacgacaccgugacccuguaccccaaggccuaa

SEQ ID NO: 21349 - RNA, 741 nt, Artificial Sequence
  PDLIM4__Homo_sapiens__NP_001124499
augccccacagcgugacccugagaggccccagccccuggggcuucagacuggugggcggcagagacuucagcgccccccugaccaucagcagagugcacgccggcagcaaggccgcccuggccgcccugugccccggcgaccugauccaggccaucaacggcgagagcaccgagcugaugacccaccuggaggcccagaacagaaucaagggcugccacgaccaccugacccugagcgugagcagacccgagggcagaagcuggcccagcgcccccgacgacagcaaggcccaggcccacagaauccacaucgaccccgagauccaggacggcagccccaccaccagcagaagacccagcggcaccggcaccggccccgaggacggcagacccagccugggcagccccuacggccagccccccagauuccccgugccccacaacggcagcagcgaggccacccugcccgcccagaugagcacccugcacgugagccccccccccagcgccgaccccgccagaggccugcccagaagcagagacugcagaguggaccugggcagcgagguguacagaaugcugagagagcccgccgagcccguggccgccgagcccaagcagagcggcagcuucagauaccugcagggcaugcuggaggccggcgagggcggcgcccccagcagcagacacggcaccagcagcaccauccccagcgccagcugcgccgugaccgccgccuaa

SEQ ID NO: 21350 - RNA, 1464 nt, Artificial Sequence
  PDLIM5__Homo_sapiens__NP_001011513
augagcaacuacagcgugagccuggugggccccgcccccuggggcuucagacugcagggcggcaaggacuucaacaugccccugaccaucagcagccugaaggacggcggcaaggccgcccaggccaacgugagaaucggcgacguggugcugagcaucgacggcaucaacgcccagggcaugacccaccuggaggcccagaacaagaucaagggcugcaccggcagccugaacaugacccugcagagagccagcgccgcccccaagcccgagcccgugcccgugcagaagcccaccgugaccagcgugugcagcgagaccagccaggagcuggccgagggccagagaagaggcagccagggcgacagcaagcagcagaacggcccccccagaaagcacaucguggagagauacaccgaguucuaccacgugcccacccacagcgacgccagcaagaagagacugaucgaggacaccgaggacuggagacccagaaccggcaccacccagagcagaagcuucagaauccuggcccagaucaccggcaccgagcaccugaaggagagcgaggccgacaacaccaagaaggccaacaacagccaggagcccagcccccagcuggccagcagcguggccagcaccagaagcaugcccgagagccuggacagccccaccagcggcagacccggcgugaccagccugaccaccgccgccgccuucaagcccgugggcagcaccggcgugaucaagagccccagcuggcagagacccaaccagggcgugcccagcaccggcagaaucagcaacagcgccaccuacagcggcagcguggcccccgccaacagcgcccugggccagacccagcccagcgaccaggacacccuggugcagagagccgagcacauccccgccggcaagagaacccccaugugcgcccacugcaaccaggugaucagaggccccuuccugguggcccugggcaagagcuggcaccccgaggaguucaacugcgcccacugcaagaacaccauggccuacaucggcuucguggaggagaagggcgcccuguacugcgagcugugcuacgagaaguucuucgcccccgagugcggcagaugccagagaaagauccugggcgaggugaucagcgcccugaagcagaccuggcacgugagcugcuucgugugcguggccugcggcaagcccaucagaaacaacguguuccaccuggaggacggcgagcccuacugcgagaccgacuacuacgcccuguucggcaccaucugccacggcugcgaguuccccaucgaggccggcgacauguuccuggaggcccugggcuacaccuggcacgacaccugcuucgugugcagcgugugcugcgagagccuggagggccagaccuucuucagcaagaaggacaagccccugugcaagaagcacgcccacagcgugaacuucuaa

SEQ ID NO: 21351 - RNA, 1374 nt, Artificial Sequence
  PDLIM7__Homo_sapiens__NP_005442
auggacagcuucaagguggugcuggagggccccgcccccuggggcuucagacugcagggcggcaaggacuucaacgugccccugagcaucagcagacugacccccggcggcaaggccgcccaggccggcguggccgugggcgacugggugcugagcaucgacggcgagaacgccggcagccugacccacaucgaggcccagaacaagaucagagccugcggcgagagacugagccugggccugagcagagcccagcccgugcagagcaagccccagaaggccagcgcccccgccgccgacccccccagauacaccuucgcccccagcgugagccugaacaagaccgccagacccuucggcgcccccccccccgccgacagcgccccccagcagaacggccagccccugagaccccuggugcccgacgccagcaagcagagacugauggagaacaccgaggacuggagacccagacccggcaccggccagagcagaagcuucagaauccuggcccaccugaccggcaccgaguucaugcaggaccccgacgaggagcaccugaagaagagcagccaggugcccagaaccgaggcccccgcccccgccagcagcaccccccaggagcccuggcccggccccaccgcccccagccccaccagcagaccccccugggccguggaccccgccuucgccgagagauacgcccccgacaagaccagcaccgugcugaccagacacagccagcccgccacccccaccccccugcagagcagaaccagcaucgugcaggccgccgccggcggcgugcccggcggcggcagcaacaacggcaagacccccgugugccaccagugccacaaggugaucagaggcagauaccugguggcccugggccacgccuaccaccccgaggaguucgugugcagccagugcggcaaggugcuggaggagggcggcuucuucgaggagaagggcgccaucuucugcccccccugcuacgacgugagauacgcccccagcugcgccaagugcaagaagaagaucaccggcgagaucaugcacgcccugaagaugaccuggcacgugcacugcuucaccugcgccgccugcaagacccccaucagaaacagagccuucuacauggaggagggcgugcccuacugcgagagagacuacgagaagauguucggcaccaagugccacggcugcgacuucaagaucgacgccggcgacagauuccuggaggcccugggcuucagcuggcacgacaccugcuucgugugcgccaucugccagaucaaccuggagggcaagaccuucuacagcaagaaggacagaccccugugcaagagccacgccuucagccacguguaa

SEQ ID NO: 21352 - RNA, 1689 nt, Artificial Sequence
  PDP1__Homo_sapiens__NP_001155251
augugcgugugccccggccccagaagaaucggcauccccgugagaagcagcagccugccccuguucagcgacgccaugcccgcccccacccagcuguucuucccccugaucagaaacugcgagcugagcagaaucuacggcaccgccugcuacugccaccacaagcaccugugcugcagcagcagcuacaucccccagagcagacugagauacaccccccaccccgccuacgccaccuucugcagacccaaggagaacugguggcaguacacccagggcagaagauacgccagcaccccccagaaguucuaccugacccccccccaggugaacagcauccugaaggccaacgaguacagcuucaaggugcccgaguucgacggcaagaacgugagcagcauccugggcuucgacagcaaccagcugcccgccaacgcccccaucgaggacagaagaagcgccgccaccugccugcagaccagaggcaugcugcugggcguguucgacggccacgccggcugcgccugcagccaggccgugagcgagagacuguucuacuacaucgccgugagccugcugccccacgagacccugcuggagaucgagaacgccguggagagcggcagagcccugcugcccauccugcaguggcacaagcaccccaacgacuacuucagcaaggaggccagcaagcuguacuucaacagccugagaaccuacuggcaggagcugaucgaccugaacaccggcgagagcaccgacaucgacgugaaggaggcccugaucaacgccuucaagagacuggacaacgacaucagccuggaggcccaggugggcgaccccaacagcuuccugaacuaccuggugcugagaguggccuucagcggcgccaccgccugcguggcccacguggacggcguggaccugcacguggccaacaccggcgacagcagagccaugcugggcgugcaggaggaggacggcagcuggagcgccgugacccugagcaacgaccacaacgcccagaacgagagagagcuggagagacugaagcuggagcaccccaagagcgaggccaagagcguggugaagcaggacagacugcugggccugcugaugcccuucagagccuucggcgacgugaaguucaaguggagcaucgaccugcagaagagagugaucgagagcggccccgaccagcugaacgacaacgaguacaccaaguucaucccccccaacuaccacaccccccccuaccugaccgccgagcccgaggugaccuaccacagacugagaccccaggacaaguuccuggugcuggccaccgacggccugugggagaccaugcacagacaggacguggugagaaucgugggcgaguaccugaccggcaugcaccaccagcagcccaucgccgugggcggcuacaaggugacccugggccagaugcacggccugcugaccgagagaagaaccaagaugagcagcguguucgaggaccagaacgccgccacccaccugaucagacacgccgugggcaacaacgaguucggcaccguggaccacgagagacugagcaagaugcugagccugcccgaggagcuggccagaauguacagagacgacaucaccaucaucguggugcaguucaacagccacguggugggcgccuaccagaaccaggaguaa

SEQ ID NO: 21353 - RNA, 1590 nt, Artificial Sequence
  PDP2__Homo_sapiens__NP_065837
augagcagcaccgugagcuacuggauccugaacagcaccagaaacagcaucgccacccugcagggcggcagaagacuguacagcagauacgugagcaacagaaacaagcugaaguggagacuguucagcagagugccccccacccugaacagcagccccugcggcggcuucacccugugcaaggccuacagacacaccagcaccgaggaggacgacuuccaccugcagcugagccccgagcagaucaacgaggugcugagagccggcgagaccacccacaagauccuggaccuggagagcagagugcccaacagcgugcugagauucgagagcaaccagcuggccgccaacagccccguggaggacagaagaggcguggccagcugccugcagaccaacggccugauguucggcaucuucgacggccacggcggccacgccugcgcccaggccgugagcgagagacuguucuacuacguggccgugagccugaugagccaccagacccuggagcacauggagggcgccauggagagcaugaagccccugcugcccauccugcacuggcugaagcaccccggcgacagcaucuacaaggacgugaccagcgugcaccuggaccaccugagaguguacuggcaggagcugcuggaccugcacauggagaugggccugagcaucgaggaggcccugauguacagcuuccagagacuggacagcgacaucagccuggagauccaggccccccuggaggacgaggugaccagaaaccugagccugcagguggccuucagcggcgccaccgccugcauggcccacguggacggcauccaccugcacguggccaacgccggcgacugcagagccauccugggcgugcaggaggacaacggcauguggagcugccugccccugaccagagaccacaacgccuggaaccaggccgagcugagcagacugaagagagagcaccccgagagcgaggacagaaccaucaucauggaggacagacugcugggcgugcugauccccugcagagccuucggcgacgugcagcugaaguggagcaaggagcugcagagaagcauccuggagagaggcuucaacaccgaggcccugaacaucuaccaguucacccccccccacuacuacaccccccccuaccugaccgccgagcccgaggugaccuaccacagacugagaccccaggacaaguuccuggugcuggccagcgacggccugugggacaugcugagcaacgaggacguggugagacugguggugggccaccuggccgaggccgacuggcacaagaccgaccuggcccagagacccgccaaccugggccugaugcagagccugcugcugcagagaaaggccagcggccugcacgaggccgaccagaacgccgccaccagacugaucagacacgccaucggcaacaacgaguacggcgagauggaggccgagagacuggccgccaugcugacccugcccgaggaccuggccagaauguacagagacgacaucaccgugaccgugguguacuucaacagcgagagcaucggcgccuacuacaagggcggcuaa

SEQ ID NO: 21354 - RNA, 1365 nt, Artificial Sequence
  PDPK1__Homo_sapiens__NP_001248745
auggccagaaccaccagccagcuguacgacgccgugcccauccagagcagcguggugcugugcagcugccccagccccagcauggugagaacccagaccgagagcagcaccccccccggcauccccggcggcagcagacagggccccgccauggacggcaccgccgccgagcccagacccggcgccggcagccugcagcacgcccagccccccccccagcccagaaagaagagacccgaggacuucaaguucggcaagauccugggcgagggcagcuucagcaccguggugcuggccagagagcuggccaccagcagagaguacgccaucaagauccuggagaagagacacaucaucaaggagaacaaggugcccuacgugaccagagagagagacgugaugagcagacuggaccaccccuucuucgugaagcuguacuucaccuuccaggacgacgagaagcuguacuucggccugagcuacgccaagaacggcgagcugcugaaguacaucagaaagaucggcagcuucgacgagaccugcaccagauucuacaccgccgagaucgugagcgcccuggaguaccugcacggcaagggcaucauccacagagaccugaagcccgagaacauccugcugaacgaggacaugcacauccagaucaccgacuucggcaccgccaaggugcugagccccgagagcaagcaggccagagccaacagcuucgugggcaccgcccaguacgugagccccgagcugcugaccgagaagagcgccugcaagagcagcgaccugugggcccugggcugcaucaucuaccagcugguggccggccugccccccuucagagccggcaacgaguaccugaucuuccagaagaucaucaagcuggaguacgacuuccccgagaaguucuuccccaaggccagagaccugguggagaagcugcuggugcuggacgccaccaagagacugggcugcgaggagauggagggcuacggcccccugaaggcccaccccuucuucgagagcgugaccugggagaaccugcaccagcagaccccccccaagcugaccgccuaccugcccgccaugagcgaggacgacgaggacugcuacggcaacuacgacaaccugcugagccaguucggcugcaugcaggugagcagcagcagcagcagccacagccugagcgccagcgacaccggccugccccagagaagcggcagcaacaucgagcaguacauccacgaccuggacagcaacagcuucgagcuggaccugcaguucagcgaggacgagaagagacugcugcuggagaagcaggccggcggcaaccccugccugaccggcagaaucaucuaa

SEQ ID NO: 21355 - RNA, 2640 nt, Artificial Sequence
  PDPR__Homo_sapiens__NP_060460
augauguucuacagacugcugagcaucgugggcagacagagagccagccccggcuggcagaacuggagcagcgccagaaacagcaccagcgccgccgaggccagaagcauggcccugcccacccaggcccagguggugaucugcggcggcggcaucaccggcaccagcguggccuaccaccugagcaagaugggcuggaaggacaucgugcugcuggagcagggcagacuggccgccggcagcaccagauucugcgccggcauccugagcaccgccagacaccugaccaucgagcagaagauggccgacuacagcaacaagcuguacuaccagcuggagcaggagaccggcauccagaccggcuacaccagaaccggcagcaucuuccuggcccagacccaggacagacugaucagccugaagagaaucaacgccggccugaacgugaucggcauccccagcgagaucaucagccccaagaagguggccgagcugcaccaccugcugaacgugcacgaccuggugggcgccaugcacgugcccgaggacgccguggugagcagcgccgacguggcccuggcccuggccagcgccgccagccagaacggcgugcagaucuacgacagaaccagcgugcugcacgugauggugaagaagggccaggugaccggcguggagaccgacaagggccagaucgagugccaguacuucgugaacugcgccggccagugggccuacgagcugggccugagcaacgaggagcccgugagcaucccccugcacgccugcgagcacuucuaccugcugaccagaccccuggagaccccccugcagagcagcacccccaccaucguggacgccgacggcagaaucuacaucagaaacuggcagggcggcauccugagcggcggcuucgagaagaaccccaagcccaucuucaccgagggcaagaaccagcuggagauccagaaccugcaggaggacugggaccacuucgagccccugcugagcagccugcugagaagaaugcccgagcuggagacccuggagaucaugaagcuggugaacugccccgagaccuucacccccgacaugagaugcaucaugggcgagagccccgccgugcagggcuacuucgugcuggccggcaugaacagcgccggccugagcuucggcggcggcgccggcaaguaccuggccgaguggauggugcacggcuaccccagcgagaacgugugggagcuggaccugaagagauucggcgcccugcagagcagcagaaccuuccugagacacagagugauggaggugaugccccugauguacgaccugaaggugcccagaugggacuuccagaccggcagacagcugagaaccagcccccuguacgacagacuggacgcccagggcgccagauggauggagaagcacggcuucgagagacccaaguacuucgugccccccgacaaggaccugcuggcccuggagcagagcaagaccuucuacaagcccgacugguucgacaucguggagagcgaggugaagugcugcaaggaggccgugugcgugaucgacaugagcagcuucaccaaguucgagaucaccagcaccggcgaccaggcccuggaggugcugcaguaccuguucagcaacgaccuggacgugcccgugggccacaucgugcacaccggcaugcugaacgagggcggcggcuacgagaacgacugcagcaucgccagacugaacaagagaagcuucuucaugaucagccccaccgaccagcaggugcacugcugggccuggcugaagaagcacaugcccaaggacagcaaccugcugcuggaggacgugaccuggaaguacaccgcccugaaccugaucggccccagagccguggacgugcugagcgagcugagcuacgcccccaugacccccgaccacuuccccagccuguucugcaaggagaugagcgugggcuacgccaacggcaucagagugaugagcaugacccacaccggcgagcccggcuucaugcuguacauccccaucgaguacgcccugcacguguacaacgaggugaugagcgugggccagaaguacggcaucagaaacgccggcuacuacgcccugagaagccugagaaucgagaaguucuucgccuucuggggccaggacaucaacaaccugaccaccccccuggagugcggcagagagagcagagugaagcuggagaagggcauggacuucaucggcagagacgcccugcugcagcagaagcagaacggcguguacaagagacugaccauguucauccuggacgaccacgacagcgaccuggaccuguggcccugguggggcgagcccaucuacagaaacggccaguacgugggcaagaccaccagcagcgccuacagcuacagccuggagagacacgugugccugggcuucgugcacaacuucagcgaggacaccggcgaggagcagguggugaccgccgacuucaucaacagaggcgaguacgagaucgacaucgccggcuacagauuccaggccaaggccaagcuguaccccguggccagccuguucacccagaagagaagaaaggacgacauggagcugagcgaccugcacggcaaguaa

SEQ ID NO: 21356 - RNA, 402 nt, Artificial Sequence
  PDRG1__Homo_sapiens__NP_110442
augcugagccccgaggccgagagagugcugagauaccugguggagguggaggagcuggccgaggaggugcuggccgacaagagacagaucguggaccuggacaccaagagaaaccagaacagagagggccugagagcccugcagaaggaccugagccugagcgaggacgugauggugugcuucggcaacauguucaucaagaugccccaccccgagaccaaggagaugaucgagaaggaccaggaccaccuggacaaggagaucgagaagcugagaaagcagcugaaggugaaggugaacagacuguucgaggcccagggcaagcccgagcugaagggcuucaaccugaacccccugaaccaggacgagcugaaggcccugaaggugauccugaagggcuaa

SEQ ID NO: 21357 - RNA, 4014 nt, Artificial Sequence
  PDS5A__Homo_sapiens__NP_001093869
auggacuucaccgcccagcccaagcccgccaccgcccugugcggcguggugagcgccgacggcaagaucgccuacccccccggcgugaaggagaucaccgacaagaucaccaccgacgagaugaucaagagacugaagaugguggugaagaccuucauggacauggaccaggacagcgaggacgagaagcagcaguaccugccccuggcccugcaccuggccagcgaguucuuccugagaaaccccaacaaggacgugagacugcugguggccugcugccuggccgacaucuucagaaucuacgcccccgaggcccccuacaccagccacgacaagcugaaggacaucuuccuguucaucaccagacagcugaagggccuggaggacaccaagagcccccaguucaacagauacuucuaccugcuggagaaccuggccugggugaagagcuacaacaucugcuucgagcuggaggacugcaacgagaucuucauccagcuguucagaacccuguucagcgugaucaacaacagccacaacaagaaggugcagaugcacaugcuggaccugaugagcagcaucaucauggagggcgacggcgugacccaggagcugcuggacagcauccugaucaaccugauccccgcccacaagaaccugaacaagcagagcuucgaccuggccaaggugcugcugaagagaaccgugcagaccaucgaggccugcaucgccaacuucuucaaccaggugcuggugcugggcagaagcagcgugagcgaccugagcgagcacguguucgaccugauccaggagcuguucgccaucgacccccaccugcugcugagcgugaugccccagcuggaguucaagcugaagagcaacgacggcgaggagagacuggccguggugagacugcuggccaagcuguucggcagcaaggacagcgaccuggccacccagaacagaccccuguggcagugcuuccugggcagauucaacgacauccacgugcccgugagacuggagagcgugaaguucgccagccacugccugaugaaccaccccgaccuggccaaggaccugaccgaguaccugaaggugagaagccacgaccccgaggaggccaucagacacgacgugaucgugaccaucaucaccgccgccaagagagaccuggcccuggugaacgaccagcugcugggcuucgugagagagagaacccuggacaagagauggagagugagaaaggaggccaugaugggccuggcccagcuguacaagaaguacugccugcacggcgaggccggcaaggaggccgccgagaaggugagcuggaucaaggacaagcugcugcacaucuacuaccagaacagcaucgacgacaagcugcugguggagaagaucuucgcccaguaccuggugccccacaaccuggagaccgaggagagaaugaagugccuguacuaccuguacgccagccuggaccccaacgccgugaaggcccugaacgagauguggaagugccagaacaugcugagaagccacgugagagagcugcuggaccugcacaagcagcccaccagcgaggccaacugcagcgccauguucggcaagcugaugaccaucgccaagaaccugcccgaccccggcaaggcccaggacuucgugaagaaguucaaccaggugcugggcgacgacgagaagcugagaagccagcuggagcugcugaucagccccaccugcagcugcaagcaggccgacaucugcgugagagagaucgccagaaagcuggccaaccccaagcagcccaccaaccccuuccuggagauggugaaguuccugcuggagagaaucgcccccgugcacaucgacagcgaggccaucagcgcccuggugaagcugaugaacaagagcaucgagggcaccgccgacgacgaggaggagggcgugagccccgacaccgccaucagaagcggccuggagcugcugaaggugcugagcuucacccaccccaccagcuuccacagcgccgagaccuacgagagccugcugcagugccugagaauggaggacgacaagguggccgaggccgccauccagaucuucagaaacaccggccacaagaucgagaccgaccugccccagaucagaagcacccugauccccauccugcaccagaaggccaagagaggcaccccccaccaggccaagcaggccgugcacugcauccacgccaucuucaccaacaaggaggugcagcuggcccagaucuucgagccccugagcagaagccugaacgccgacgugcccgagcagcugaucaccccccuggugagccugggccacaucagcaugcuggcccccgaccaguucgccagccccaugaagagcgugguggccaacuucaucgugaaggaccugcugaugaacgacagaagcaccggcgagaagaacggcaagcuguggagccccgacgaggaggugagccccgaggugcuggccaaggugcaggccaucaagcugcuggugagauggcugcugggcaugaagaacaaccagagcaagagcgccaacagcacccugagacugcugagcgccaugcuggugagcgagggcgaccugaccgagcagaagagaaucagcaagagcgacaugagcagacugagacuggccgccggcagcgccaucaugaagcuggcccaggagcccugcuaccacgagaucaucacccccgagcaguuccagcugugcgcccuggugaucaacgacgagugcuaccaggugagacagaucuucgcccagaagcugcacaaggcccuggugaagcugcugcugccccuggaguacauggccaucuucgcccugugcgccaaggaccccgugaaggagagaagagcccacgccagacagugccugcugaagaacaucagcaucagaagagaguacaucaagcagaaccccauggccaccgagaagcugcugagccugcugcccgaguacguggugcccuacaugauccaccugcuggcccacgaccccgacuucaccagaagccaggacguggaccagcugagagacaucaaggagugccugugguucaugcuggaggugcugaugaccaagaacgagaacaacagccacgccuucaugaagaagauggccgagaacaucaagcugaccagagacgcccagagccccgacgagagcaagaccaacgagaagcuguacaccgugugcgacguggcccugugcgugaucaacagcaagagcgcccugugcaacgccgacagccccaaggaccccgugcugcccaugaaguucuucacccagcccgagaaggacuucugcaacgacaagagcuacaucagcgaggagaccagagugcugcugcugaccggcaagcccaagcccgccggcgugcugggcgccgugaacaagccccugagcgccaccggcagaaagcccuacgugagaagcaccggcaccgagaccggcagcaacaucaacgugaacagcgagcugaaccccagcaccggcaacagaagcagagagcagagcagcgaggccgccgagaccggcgugagcgagaacgaggagaaccccgugagaaucaucagcgugacccccgugaagaacaucgaccccgugaagaacaaggagaucaacagcgaccaggccacccagggcaacaucagcagcgacagaggcaagaagagaaccgugaccgccgccggcgccgagaacauccagcagaagaccgacgagaagguggacgagagcggcccccccgcccccagcaagcccagaagaggcagaagacccaagagcgagagccagggcaacgccaccaagaacgacgaccugaacaagcccaucaacaagggcagaaagagagccgccgugggccaggagagccccggcggccuggaggccggcaacgccaaggcccccaagcugcaggaccuggccaagaaggccgcccccgccgagagacagaucgaccugcagagauaa

SEQ ID NO: 21358 - RNA, 4344 nt, Artificial Sequence
  PDS5B__Homo_sapiens__NP_055847
auggcccacagcaagaccagaaccaacgacggcaagaucaccuacccccccggcgugaaggagaucagcgacaagaucagcaaggaggagauggugagaagacugaagaugguggugaagaccuucauggacauggaccaggacagcgaggaggagaaggagcuguaccugaaccuggcccugcaccuggccagcgacuucuuccugaagcaccccgacaaggacgugagacugcugguggccugcugccuggccgacaucuucagaaucuacgcccccgaggcccccuacaccagccccgacaagcugaaggacaucuucauguucaucaccagacagcugaagggccuggaggacaccaagagcccccaguucaacagauacuucuaccugcuggagaacaucgccugggugaagagcuacaacaucugcuucgagcuggaggacagcaacgagaucuucacccagcuguacagaacccuguucagcgugaucaacaacggccacaaccagaaggugcacaugcacaugguggaccugaugagcagcaucaucugcgagggcgacaccgugagccaggagcugcuggacaccgugcuggugaaccuggugcccgcccacaagaaccugaacaagcaggccuacgaccuggccaaggcccugcugaagagaaccgcccaggccaucgagcccuacaucaccaacuucuucaaccaggugcugaugcugggcaagaccagcaucagcgaccugagcgagcacguguucgaccugauccuggagcuguacaacaucgacagccaccugcugcugagcgugcugccccagcuggaguucaagcugaagagcaacgacaacgaggagagacugcagguggugaagcugcuggccaagauguucggcgccaaggacagcgagcuggccagccagaacaagccccuguggcagugcuaccugggcagauucaacgacauccacgugcccaucagacuggagugcgugaaguucgccagccacugccugaugaaccaccccgaccuggccaaggaccugaccgaguaccugaaggugagaagccacgaccccgaggaggccaucagacacgacgugaucgugagcaucgugaccgccgccaagaaggacauccugcuggugaacgaccaccugcugaacuucgugagagagagaacccuggacaagagauggagagugagaaaggaggccaugaugggccuggcccagaucuacaagaaguacgcccugcagagcgccgccggcaaggacgccgccaagcagaucgccuggaucaaggacaagcugcugcacaucuacuaccagaacagcaucgacgacagacugcugguggagagaaucuucgcccaguacauggugccccacaaccuggagaccaccgagagaaugaagugccuguacuaccuguacgccacccuggaccugaacgccgugaaggcccugaacgagauguggaagugccagaaccugcugagacaccaggugaaggaccugcuggaccugaucaagcagcccaagaccgacgccagcgugaaggccaucuucagcaaggugauggugaucaccagaaaccugcccgaccccggcaaggcccaggacuucaugaagaaguucacccaggugcuggaggacgacgagaagaucagaaagcagcuggaggugcuggugagccccaccugcagcugcaagcaggccgagggcugcgugagagagaucaccaagaagcugggcaaccccaagcagcccaccaaccccuuccuggagaugaucaaguuccugcuggagagaaucgcccccgugcacaucgacaccgagagcaucagcgcccugaucaagcaggugaacaagagcaucgacggcaccgccgacgacgaggacgagggcgugcccaccgaccaggccaucagagccggccuggagcugcugaaggugcugagcuucacccaccccaucagcuuccacagcgccgagaccuucgagagccugcuggccugccugaagauggacgacgagaagguggccgaggccgcccugcagaucuucaagaacaccggcagcaagaucgaggaggacuucccccacaucagaagcgcccugcugcccgugcugcaccacaagagcaagaagggcccccccagacaggccaaguacgccauccacugcauccacgccaucuucagcagcaaggagacccaguucgcccagaucuucgagccccugcacaagagccuggaccccagcaaccuggagcaccugaucaccccccuggugaccaucggccacaucgcccugcuggcccccgaccaguucgccgccccccugaagagccugguggccaccuucaucgugaaggaccugcugaugaacgacagacugcccggcaagaagaccaccaagcugugggugcccgacgaggaggugagccccgagaccauggugaagauccaggccaucaagaugauggugagauggcugcugggcaugaagaacaaccacagcaagagcggcaccagcacccugagacugcugaccaccauccugcacagcgacggcgaccugaccgagcagggcaagaucagcaagcccgacaugagcagacugagacuggccgccggcagcgccaucgugaagcuggcccaggagcccugcuaccacgagaucaucacccuggagcaguaccagcugugcgcccuggccaucaacgacgagugcuaccaggugagacagguguucgcccagaagcugcacaagggccugagcagacugagacugccccuggaguacauggccaucugcgcccugugcgccaaggaccccgugaaggagagaagagcccacgccagacagugccuggugaagaacaucaacgugagaagagaguaccugaagcagcacgccgccgugagcgagaagcugcugagccugcugcccgaguacguggugcccuacaccauccaccugcuggcccacgaccccgacuacgugaaggugcaggacaucgagcagcugaaggacgugaaggagugccugugguucgugcuggagauccugauggccaagaacgagaacaacagccacgccuucaucagaaagaugguggagaacaucaagcagaccaaggacgcccagggccccgacgacgccaagaugaacgagaagcuguacaccgugugcgacguggccaugaacaucaucaugagcaagagcaccaccuacagccuggagagccccaaggaccccgugcugcccgccagauucuucacccagcccgacaagaacuucagcaacaccaagaacuaccugccccccgagaugaagagcuucuucacccccggcaagcccaagaccaccaacgugcugggcgccgugaacaagccccugagcagcgccggcaagcagagccagaccaagagcagcagaauggagaccgugagcaacgccagcagcagcagcaaccccagcagccccggcagaaucaagggcagacuggacagcagcgagauggaccacagcgagaacgaggacuacaccaugagcagcccccugcccggcaagaagagcgacaagagagacgacagcgaccuggugagaagcgagcuggagaagcccagaggcagaaagaagacccccgugaccgagcaggaggagaagcugggcauggacgaccugaccaagcuggugcaggagcagaagcccaagggcagccagagaagcagaaagagaggccacaccgccagcgagagcgacgagcagcaguggcccgaggagaagagacugaaggaggacauccuggagaacgaggacgagcagaacagcccccccaagaagggcaagagaggcagaccccccaagccccugggcggcggcacccccaaggaggagcccaccaugaagaccagcaagaagggcagcaagaagaagagcggcccccccgcccccgaggaggaggaggaggaggagagacagagcggcaacaccgagcagaagagcaagagcaagcagcacagagugagcagaagagcccagcagagagccgagagccccgagagcagcgccaucgagagcacccagagcaccccccagaagggcagaggcagacccagcaagacccccagccccagccagcccaagaagaacgugagagugggcagaagcaagcaggccgccaccaaggagaacgacagcagcgaggagguggacguguuccagggcagcagccccguggacgacaucccccaggaggagaccgaggaggaggaggugagcaccgugaacgugagaagaagaagcgccaagagagagagaagauaa

SEQ ID NO: 21359 - RNA, 1248 nt, Artificial Sequence
  PDSS1__Homo_sapiens__NP_055132
auggccagcagaugguggagauggagaagaggcugcagcuggaagcccgccgccagaagccccggccccggcagccccggcagagccggcccccugggccccagcgccgccgccgaggugagagcccaggugcacagaagaaagggccuggaccugagccagauccccuacaucaaccuggugaagcaccugaccagcgccugccccaacgugugcagaaucagcagauuccaccacaccacccccgacagcaagacccacagcggcgagaaguacaccgaccccuucaagcugggcuggagagaccugaagggccuguacgaggacaucagaaaggagcugcugaucagcaccagcgagcugaaggagaugagcgaguacuacuucgacggcaagggcaaggccuucagacccaucaucguggcccugauggccagagccugcaacauccaccacaacaacagcagacacgugcaggccagccagagagccaucgcccugaucgccgagaugauccacaccgccagccuggugcacgacgacgugaucgacgacgccagcagcagaagaggcaagcacaccgugaacaagaucuggggcgagaagaaggccgugcuggccggcgaccugauccugagcgccgccagcaucgcccuggccagaaucggcaacaccaccgugaucagcauccugacccaggugaucgaggaccuggugagaggcgaguuccugcagcugggcagcaaggagaacgagaacgagagauucgcccacuaccuggagaagaccuucaagaagaccgccagccugaucgccaacagcugcaaggccgugagcgugcugggcugccccgaccccguggugcacgagaucgccuaccaguacggcaagaacgugggcaucgccuuccagcugaucgacgacgugcuggacuucaccagcugcagcgaccagaugggcaagcccaccagcgccgaccugaagcugggccuggccaccggccccgugcuguucgccugccagcaguuccccgagaugaacgccaugaucaugagaagauucagccugcccggcgacguggacagagccagacaguacgugcugcagagcgacggcgugcagcagaccaccuaccuggcccagcaguacugccacgaggccaucagagagaucagcaagcugagacccagccccgagagagacgcccugauccagcugagcgagaucgugcugaccagagacaaguaa

SEQ ID NO: 21360 - RNA, 1200 nt, Artificial Sequence
  PDSS2__Homo_sapiens__NP_065114
augaacuucagacagcugcugcugcaccugcccagauaccugggcgccagcggcagccccagaagacugugguggagccccagccuggacaccaucagcagcgugggcagcuggagaggcagaagcagcaagagccccgcccacuggaaccagguggugagcgaggccgagaagaucgugggcuaccccaccagcuucaugagccugagaugccugcugagcgacgagcugagcaacaucgccaugcaggugagaaagcuggugggcacccagcacccccugcugaccaccgccagaggccuggugcacgacagcuggaacagccugcagcugagaggccugguggugcugcugaucagcaaggccgccggccccagcagcgugaacaccagcugccagaacuacgacauggugagcggcaucuacagcugccagagaagccuggccgagaucaccgagcugauccacaucgcccugcuggugcacagaggcaucgugaaccugaacgagcugcagagcagcgacggcccccugaaggacaugcaguucggcaacaagaucgccauccugagcggcgacuuccugcuggccaacgccugcaacggccuggcccugcugcagaacaccaaggugguggagcugcuggccagcgcccugauggaccuggugcagggcguguaccacgagaacagcaccagcaaggagagcuacaucaccgacgacaucggcaucagcaccuggaaggagcagaccuuccugagccacggcgcccugcuggccaagagcugccaggccgccauggagcuggccaagcacgacgccgaggugcagaacauggccuuccaguacggcaagcacauggccaugagccacaagaucaacagcgacgugcagcccuucaucaaggagaagaccagcgacagcaugaccuucaaccugaacagcgcccccguggugcugcaccaggaguuccugggcagagaccuguggaucaagcagaucggcgaggcccaggagaagggcagacuggacuacgccaagcugagagagagaaucaaggccggcaagggcgugaccagcgccaucgaccugugcagauaccacggcaacaaggcccuggaggcccuggagagcuucccccccagcgaggccagaagcgcccuggagaacaucguguucgccgugaccagauucagcuaa

SEQ ID NO: 21361 - RNA, 852 nt, Artificial Sequence
  PDX1__Homo_sapiens__NP_000200
augaacggcgaggagcaguacuacgccgccacccagcuguacaaggaccccugcgccuuccagagaggccccgcccccgaguucagcgccagcccccccgccugccuguacaugggcagacagcccccccccccccccccccaccccuuccccggcgcccugggcgcccuggagcagggcagcccccccgacaucagccccuacgaggugcccccccuggccgacgaccccgccguggcccaccugcaccaccaccugcccgcccagcuggcccugccccacccccccgccggccccuuccccgagggcgccgagcccggcgugcuggaggagcccaacagagugcagcugcccuuccccuggaugaagagcaccaaggcccacgccuggaagggccagugggccggcggcgccuacgccgccgagcccgaggagaacaagagaaccagaaccgccuacaccagagcccagcugcuggagcuggagaaggaguuccuguucaacaaguacaucagcagacccagaagaguggagcuggccgugaugcugaaccugaccgagagacacaucaagaucugguuccagaacagaagaaugaaguggaagaaggaggaggacaagaagagaggcggcggcaccgccgugggcggcggcggcguggccgagcccgagcaggacugcgccgugaccagcggcgaggagcugcuggcccugccccccccccccccccccggcggcgccgugccccccgccgcccccguggccgccagagagggcagacugccccccggccugagcgccagcccccagcccagcagcguggcccccagaagaccccaggagcccagauaa

SEQ ID NO: 21362 - RNA, 2283 nt, Artificial Sequence
  PDXDC1__Homo_sapiens__NP_001272374
auggacgccagccuggagaagaucgccgaccccacccuggccgagaugggcaagaaccugaaggaggccgugaagaugcuggaggacagccagagaaccgaggaggagaacggcaagaagcugaucagcggcgacauccccggcccccugcagggcagaauccagaacaucggcgagcagggccacauggcccugcugggccacagccugggcgccuacaucagcacccuggacaaggagaagcugagaaagcugaccaccagaauccugagcgacaccacccuguggcugugcagaaucuucagauacgagaacggcugcgccuacuuccacgaggaggagagagagggccuggccaagaucugcagacuggccauccacagcagauacgaggacuucgugguggacggcuucaacgugcuguacaacaagaagcccgugaucuaccugagcgccgccgccagacccggccugggccaguaccugugcaaccagcugggccugcccuuccccugccugugcagagugcccugcaacaccguguucggcagccagcaccagauggacguggccuuccuggagaagcugaucaaggacgacaucgagagaggcagacugccccugcugcugguggccaacgccggcaccgccgccgugggccacaccgacaagaucggcagacugaaggagcugugcgagcaguacggcaucuggcugcacguggagggcgugaaccuggccacccuggcccugggcuacgugagcagcagcgugcuggccgccgccaagugcgacagcaugaccaugacccccggccccuggcugggccugcccgccgugcccgccgugacccuguacaagcacgacgaccccgcccugacccugguggccggccugaccagcaacaagcccaccgacaagcugagagcccugccccuguggcugagccugcaguaccugggccuggacggcuucguggagagaaucaagcacgccugccagcugagccagagacugcaggagagccugaagaaggugaacuacaucaagauccugguggaggacgagcugagcagccccguggugguguucagauucuuccaggagcugcccggcagcgaccccguguucaaggccgugcccgugcccaacaugacccccagcggcgugggcagagagagacacagcugcgacgcccugaacagauggcugggcgagcagcugaagcagcuggugcccgccagcggccugaccgugauggaccuggaggccgagggcaccugccugagauucagcccccugaugaccgccgccgugcugggcaccagaggcgaggacguggaccagcugguggccugcaucgagagcaagcugcccgugcugugcugcacccugcagcugagagaggaguucaagcaggagguggaggccaccgccggccugcuguacguggacgaccccaacuggagcggcaucggcguggugagauacgagcacgccaacgacgacaagagcagccugaagagcgaccccgagggcgagaacauccacgccggccugcugaagaagcugaacgagcuggagagcgaccugaccuucaagaucggccccgaguacaagagcaugaagagcugccuguacgugggcauggccagcgacaacguggacgccgccgagcugguggagaccaucgccgccaccgccagagagaucgaggagaacagcagacugcuggagaacaugaccgagguggugagaaagggcauccaggaggcccagguggagcugcagaaggccagcgaggagagacugcuggaggagggcgugcugagacagauccccguggugggcagcgugcugaacugguucagccccgugcaggcccugcagaagggcagaaccuucaaccugaccgccggcagccuggagagcaccgagcccaucuacguguacaaggcccagggcgccggcgugacccugccccccacccccagcggcagcagaaccaagcagagacugcccggccagaagcccuucaagagaagccugagaggcagcgacgcccugagcgagaccagcagcgugagccacaucgaggaccuggagaagguggagagacugagcagcggccccgagcagaucacccuggaggccagcagcaccgagggccaccccggcgcccccagcccccagcacaccgaccagaccgaggccuuccagaagggcgugccccaccccgaggacgaccacagccagguggagggccccgagagccugagauaa

SEQ ID NO: 21363 - RNA, 939 nt, Artificial Sequence
  PDXK__Homo_sapiens__NP_003672
auggaggaggagugcagagugcugagcauccagagccacgugaucagaggcuacgugggcaacagagccgccaccuucccccugcaggugcugggcuucgagaucgacgccgugaacagcgugcaguucagcaaccacaccggcuacgcccacuggaagggccaggugcugaacagcgacgagcugcaggagcuguacgagggccugagacugaacaacaugaacaaguacgacuacgugcugaccggcuacaccagagacaagagcuuccuggccauggugguggacaucgugcaggagcugaagcagcagaaccccagacugguguacgugugcgaccccgugcugggcgacaagugggacggcgagggcagcauguacgugcccgaggaccugcugcccguguacaaggagaagguggugccccuggccgacaucaucacccccaaccaguucgaggccgagcugcugagcggcagaaagauccacagccaggaggaggcccugagagugauggacaugcugcacagcaugggccccgacaccguggugaucaccagcagcgaccugcccagcccccagggcagcaacuaccugaucgugcugggcagccagagaagaagaaaccccgccggcagcguggugauggagagaaucagaauggacaucagaaagguggacgccguguucgugggcaccggcgaccuguucgccgccaugcugcuggccuggacccacaagcaccccaacaaccugaagguggccugcgagaagaccgugagcacccugcaccacgugcugcagagaaccauccagugcgccaaggcccaggccggcgagggcgugagacccagccccaugcagcuggagcugagaauggugcagagcaagagagacaucgaggaccccgagaucguggugcaggccaccgugcuguaa

SEQ ID NO: 21364 - RNA, 891 nt, Artificial Sequence
  PDXP__Homo_sapiens__NP_064711
auggccagaugcgagagacugagaggcgccgcccugagagacgugcugggcagagcccagggcgugcuguucgacugcgacggcgugcuguggaacggcgagagagccgugcccggcgcccccgagcugcuggagagacuggccagagccggcaaggccgcccuguucgugagcaacaacagcagaagagccagacccgagcuggcccugagauucgccagacugggcuucggcggccugagagccgagcagcuguucagcagcgcccugugcgccgccagacugcugagacagagacugcccggcccccccgacgcccccggcgccguguucgugcugggcggcgagggccugagagccgagcugagagccgccggccugagacuggccggcgaccccagcgccggcgacggcgccgcccccagagugagagccgugcuggugggcuacgacgagcacuucagcuucgccaagcugagagaggccugcgcccaccugagagaccccgagugccugcugguggccaccgacagagaccccuggcacccccugagcgacggcagcagaacccccggcaccggcagccuggccgccgccguggagaccgccagcggcagacaggcccugguggugggcaagcccagccccuacauguucgagugcaucaccgagaacuucagcaucgaccccgccagaacccugauggugggcgacagacuggagaccgacauccuguucggccacagaugcggcaugaccaccgugcugacccugaccggcgugagcagacuggaggaggcccaggccuaccuggccgccggccagcacgaccuggugccccacuacuacguggagagcaucgccgaccugaccgagggccuggaggacuaa

SEQ ID NO: 21365 - RNA, 765 nt, Artificial Sequence
  PDYN__Homo_sapiens__XP_011527552
auggccuggcagggccuggugcuggccgccugccugcugauguuccccagcaccaccgccgacugccugagcagaugcagccugugcgccgugaagacccaggacggccccaagcccaucaacccccugaucugcagccugcagugccaggccgcccugcugcccagcgaggagugggagagaugccagagcuuccugagcuucuucacccccagcacccugggccugaacgacaaggaggaccugggcagcaagagcgugggcgagggccccuacagcgagcuggccaagcugagcggcagcuuccugaaggagcuggagaagagcaaguuccugcccagcaucagcaccaaggagaacacccugagcaagagccuggaggagaagcugagaggccugagcgacggcuucagagagggcgccgagagcgagcugaugagagacgcccagcugaacgacggcgccauggagaccggcacccuguaccuggccgaggaggaccccaaggagcaggugaagagauacggcggcuuccugagaaaguaccccaagagaagcagcgagguggccggcgagggcgacggcgacagcaugggccacgaggaccuguacaagagauacggcggcuuccugagaagaaucagacccaagcugaagugggacaaccagaagagauacggcggcuuccugagaagacaguucaagguggugaccagaagccaggaggaccccaacgccuacagcggcgagcuguucgacgccuaa

SEQ ID NO: 21366 - RNA, 8520 nt, Artificial Sequence
  PDZD2__Homo_sapiens__NP_835260
augcccaucacccaggacaacgccgugcugcaccugccccugcuguaccaguggcugcagaacagccugcaggagggcggcgacggccccgagcagagacugugccaggccgccauccagaagcugcaggaguacauccagcugaacuucgccguggacgagagcaccgugccccccgaccacagcccccccgagauggagaucugcaccguguaccugaccaaggagcugggcgacaccgagaccgugggccugagcuucggcaacauccccguguucggcgacuacggcgagaagagaagaggcggcaagaagagaaagacccaccagggccccgugcuggacgugggcugcaucugggugaccgagcugagaaagaacagccccgccggcaagagcggcaaggugagacugagagacgagauccugagccugaacggccagcugauggugggcguggacgugagcggcgccagcuaccuggccgagcagugcuggaacggcggcuucaucuaccugaucaugcugagaagauucaagcacaaggcccacagcaccuacaacggcaacagcagcaacagcagcgagcccggcgagacccccacccuggagcugggcgacagaaccgccaagaagggcaagagaaccagaaaguucggcgugaucagcagaccccccgccaacaaggcccccgaggagagcaagggcagcgccggcugcgaggugagcagcgaccccagcaccgagcuggagaacggccccgaccccgagcugggcaacggccacguguuccagcuggagaacggccccgacagccugaaggagguggccggcccccaccuggagagaagcgagguggacagaggcaccgagcacagaauccccaagaccgacgccccccugaccaccagcaacgacaagagaagauucagcaagggcggcaagaccgacuuccagagcagcgacugccuggccagagaggaggugggcagaaucuggaagauggagcugcugaaggagagcgacggccugggcauccaggugagcggcggcagaggcagcaagagaagcccccacgccaucguggugacccaggugaaggagggcggcgccgcccacagagacggcagacugagccugggcgacgagcugcuggugaucaacggccaccugcuggugggccugagccacgaggaggccguggccauccugagaagcgccaccggcauggugcagcuggugguggccagcaaggagaacagcgccgaggaccugcugagacugaccagcaagagccugcccgaccugaccagcagcguggaggacgugagcagcuggaccgacaacgaggaccaggaggccgacggcgaggaggacgagggcaccagcagcagcgugcagagagccaugcccggcaccgacgagccccaggacgugugcggcgccgaggagagcaagggcaaccuggagagccccaagcagggcagcaacaagaucaagcugaagagcagacugagcggcggcgugcacagacuggagagcguggaggaguacaacgagcugauggugagaaacggcgaccccagaaucagaaugcuggaggugagcagagacggcagaaagcacagccugccccagcugcuggacagcagcagcgccagccaggaguaccacaucgugaagaagagcaccagaagccugagcaccacccagguggagagccccuggagacugaucagacccagcgugaucagcaucaucggccuguacaaggagaagggcaagggccugggcuucagcaucgccggcggcagagacugcaucagaggccagaugggcaucuucgugaagaccaucuuccccaacggcagcgccgccgaggacggcagacugaaggagggcgacgagauccuggacgugaacggcauccccaucaagggccugaccuuccaggaggccauccacaccuucaagcagaucagaagcggccuguucgugcugaccgugagaaccaagcuggugagccccagccugacccccugcagcacccccacccacaugagcagaagcgccagccccaacuucaacaccagcggcggcgccagcgccggcggcagcgacgagggcagcagcagcagccugggcagaaagacccccggccccaaggacagaaucgugauggaggugacccugaacaaggagcccagagugggccugggcaucggcgccugcugccuggcccuggagaacagcccccccggcaucuacauccacagccuggcccccggcagcguggccaagauggagagcaaccugagcagaggcgaccagauccuggaggugaacagcgugaacgugagacacgccgcccugagcaaggugcacgccauccugagcaagugcccccccggccccgugagacuggugaucggcagacaccccaaccccaaggugagcgagcaggagauggacgaggugaucgccagaagcaccuaccaggagagcaaggaggccaacagcagccccggccugggcaccccccugaagagccccagccuggccaagaaggacagccugaucagcgagagcgagcugagccaguacuucgcccacgacgugcccggcccccugagcgacuucaugguggccggcagcgaggacgaggaccaccccggcagcggcugcagcaccagcgaggagggcagccugccccccagcaccagcacccacaaggagcccggcaagcccagagccaacagccuggugacccugggcagccacagagccagcggccuguuccacaagcaggugaccguggccagacaggccagccugcccggcagcccccaggcccugagaaacccccugcugagacagagaaaggugggcugcuacgacgccaacgacgccagcgacgaggaggaguucgacagagagggcgacugcaucagccugcccggcgcccugcccggccccaucagaccccugagcgaggacgaccccagaagagugagcaucagcagcagcaagggcauggacgugcacaaccaggaggagagacccagaaagacccuggugagcaaggccaucagcgccccccugcugggcagcagcguggaccuggaggagagcauccccgagggcaugguggacgccgccagcuacgccgccaaccugaccgacagcgccgaggcccccaagggcagccccggcagcugguggaagaaggagcugagcggcagcagcagcgcccccaagcuggaguacaccgugagaaccgacacccagagccccaccaacaccggcagccccagcagcccccagcagaagagcgagggccugggcagcagacacagacccguggccagagugagcccccacugcaagagaagcgaggccgaggccaagcccagcggcagccagaccgugaaccugaccggcagagccaacgaccccugcgaccuggacagcagagugcaggccaccagcgugaaggugaccguggccggcuuccagcccggcggcgccguggagaaggagagccugggcaagcugaccaccggcgacgccugcgugagcaccagcugcgagcuggccagcgcccugagccaccuggacgccagccaccugaccgagaaccugcccaaggccgccagcgagcugggccagcagcccaugaccgagcuggacagcagcagcgaccugaucagcagccccggcaagaagggcgccgcccaccccgaccccagcaagaccagcguggacaccggccaggugagcagacccgagaaccccagccagcccgccagccccagagugaccaagugcaaggccagaagccccgugagacugccccacgagggcagccccagccccggcgagaaggccgccgccccccccgacuacagcaagaccagaagcgccagcgagaccagcaccccccacaacaccagaagaguggccgcccugagaggcgccggccccggcgccgagggcaugacccccgccggcgccgugcugcccggcgacccccugaccagccaggagcagagacagggcgcccccggcaaccacagcaaggcccuggagaugaccggcauccacgcccccgagagcagccaggagcccagccugcuggagggcgccgacagcgugagcagcagagccccccaggccagccugagcaugcugcccagcaccgacaacaccaaggaggccugcggccacgugagcggccacugcugccccggcggcagcagagagagccccgugaccgacaucgacagcuucaucaaggagcuggacgccagcgccgccagaagccccagcagccagaccggcgacagcggcagccaggagggcagcgcccagggccacccccccgccggcgccggcggcggcagcagcugcagagccgagcccgugcccggcggccagaccagcagccccagaagagccugggccgccggcgcccccgccuacccccagugggccagccagcccagcgugcuggacagcaucaaccccgacaagcacuucaccgugaacaagaacuuccugagcaacuacagcagaaacuucagcagcuuccacgaggacagcaccagccugagcggccugggcgacagcaccgagcccagccugagcagcauguacggcgacgccgaggacagcagcagcgaccccgagagccugaccgaggcccccagagccagcgccagagacggcuggagcccccccagaagcagagugagccugcacaaggaggaccccagcgagagcgaggaggagcagaucgagaucugcagcaccagaggcugccccaacccccccagcagccccgcccaccugcccacccaggccgccaucugccccgccagcgccaaggugcugagccugaaguacagcacccccagagagagcguggccagccccagagagaaggccgccugccugcccggcagcuacaccagcggccccgacagcagccagcccagcagccugcuggagaugagcagccaggagcacgagacccacgccgacaucagcaccagccagaaccacagacccagcugcgccgaggagaccaccgaggugaccagcgccagcagcgccauggagaacagcccccugagcaagguggccagacacuuccacagcccccccaucauccugagcagccccaacauggugaacggccuggagcacgaccugcuggacgacgagacccugaaccaguacgagaccagcaucaacgccgccgccagccugagcagcuucagcguggacgugcccaagaacggcgagagcgugcuggagaaccugcacaucagcgagagccaggaccuggacgaccugcugcagaagcccaagaugaucgccagaagacccaucauggccugguucaaggagaucaacaagcacaaccagggcacccaccugagaagcaagaccgagaaggagcagccccugaugcccgccagaagccccgacagcaagauccagauggugagcagcagccagaagaagggcgugaccgugccccacagccccccccagcccaagaccaaccuggagaacaaggaccugagcaagaagagccccgccgagaugcugcugaccaacggccagaaggccaagugcggccccaagcugaagagacugagccugaagggcaaggccaaggugaacagcgaggcccccgccgccaacgccgugaaggccggcggcaccgaccacagaaagccccugaucagcccccagaccagccacaagacccugagcaaggccgugagccagagacugcacguggccgaccacgaggaccccgacagaaacaccaccgccgcccccagaagcccccagugcgugcuggagagcaagcccccccuggccaccagcggcccccugaagcccagcgugagcgacaccagcaucagaaccuucgugagcccccugaccagccccaagcccgugcccgagcagggcauguggagcagauuccacauggccgugcugagcgagcccgacagaggcugccccaccacccccaagagccccaagugcagagccgagggcagagcccccagagccgacagcggccccgugagccccgccgccagcagaaacggcaugagcguggccggcaacagacagagcgagcccagacuggccagccacguggccgccgacaccgcccagcccagacccaccggcgagaagggcggcaacaucauggccagcgacagacuggagagaaccaaccagcugaagaucguggagaucagcgccgaggccgugagcgagaccgugugcggcaacaagcccgccgagagcgacagaagaggcggcugccuggcccagggcaacugccaggagaagagcgagaucagacuguacagacagguggccgagagcagcaccagccaccccagcagccugcccagccacgccagccaggccgagcaggagaugagcagaagcuucagcauggccaagcuggccagcagcagcagcagccugcagaccgccaucagaaaggccgaguacagccagggcaagagcagccugaugagcgacagcagaggcgugcccagaaacagcauccccggcggccccagcggcgaggaccaccuguacuucacccccagacccgccaccagaaccuacagcaugcccgcccaguucagcagccacuucggcagagagggccaccccccccacagccugggcagaagcagagacagccaggugcccgugaccagcagcguggugcccgaggccaaggccagcagaggcggccugcccagccuggccaacggccagggcaucuacagcgugaagccccugcuggacaccagcagaaaccugcccgccaccgacgagggcgacaucaucagcgugcaggagaccagcugccuggugaccgacaagaucaaggugaccagaagacacuacugcuacgagcagaacuggccccacgagagcaccagcuucuucagcgugaagcagagaaucaagagcuucgagaaccuggccaacgccgacagacccguggccaagagcggcgccagccccuuccugagcgugagcagcaagccccccaucggcagaagaagcagcggcagcaucgugagcggcagccugggccaccccggcgacgccgccgccagacugcugagaagaagccugagcagcugcagcgagaaccagagcgaggccggcacccugcugccccagauggccaagagccccagcaucaugacccugaccaucagcagacagaacccccccgagaccagcagcaagggcagcgacagcgagcugaagaagagccugggcccccugggcauccccacccccaccaugacccuggccagccccgugaagagaaacaagagcagcgugagacacacccagcccagccccgugagcagaagcaagcugcaggagcugagagcccugagcaugcccgaccuggacaagcugugcagcgaggacuacagcgccggccccagcgccgugcuguucaagaccgagcuggagaucacccccagaagaagccccggcccccccgccggcggcgugagcugccccgagaagggcggcaacagagccugccccggcggcagcggccccaagaccagcgccgccgagacccccagcagcgccagcgacaccggcgaggccgcccaggaccugcccuucagaagaagcuggagcgugaaccuggaccagcugcuggugagcgccggcgaccagcagagacugcagagcgugcugagcagcgugggcagcaagagcaccauccugacccugauccaggaggccaaggcccagagcgagaacgaggaggacgugugcuucaucgugcugaacagaaaggagggcagcggccugggcuucagcguggccggcggcaccgacguggagcccaagagcaucaccgugcacagaguguucagccagggcgccgccagccaggagggcaccaugaacagaggcgacuuccugcugagcgugaacggcgccagccuggccggccuggcccacggcaacgugcugaaggugcugcaccaggcccagcugcacaaggacgcccugguggugaucaagaagggcauggaccagcccagacccagcgccagacaggagccccccaccgccaacggcaagggccugcugagcagaaagaccaucccccuggagcccggcaucggcagaagcguggccgugcacgacgcccugugcguggaggugcugaagaccagcgccggccugggccugagccuggacggcggcaagagcagcgugaccggcgacggcccccuggugaucaagagaguguacaagggcggcgccgccgagcaggccggcaucaucgaggccggcgacgagauccuggccaucaacggcaagccccuggugggccugaugcacuucgacgccuggaacaucaugaagagcgugcccgagggccccgugcagcugcugaucagaaagcacagaaacagcagcuaa

SEQ ID NO: 21367 - RNA, 2328 nt, Artificial Sequence
  PDZD4__Homo_sapiens__NP_001290441
augggcugcaacaugugcguggugcagaagcccgaggagcaguacaaggugaugcugcaggugaacggcaaggagcugagcaagcugagccaggagcagacccugcaggcccugagaagcagcaaggagccccuggugauccaggugcugagaagaagccccagacugagaggcgacagcagcugccacgaccugcagcugguggacagcggcacccagaccgacaucaccuucgagcacaucauggcccugggcaagcugagaccccccaccccccccauggugauccuggagcccuacgugcugagcgagcugccccccaucagccacgaguacuacgaccccgccgaguucauggagggcggcccccaggaggccgacagacuggacgagcuggaguacgaggagguggagcuguacaagagcagccacagagacaagcugggccugauggugugcuacagaaccgacgacgaggaggaccugggcaucuacgugggcgaggugaaccccaacagcaucgccgccaaggacggcagaaucagagagggcgacagaaucauccagaucaacggcguggacgugcagaacagagaggaggccguggccauccugagccaggaggagaacaccaacaucagccugcugguggccagacccgagagccagcuggccaagagauggaaggacagcgacagagacgacuuccuggacgacuucggcagcgagaacgagggcgagcugagagccagaaagcugaagagcccccccgcccagcagcccggcaacgaggaggagaagggcgcccccgacgccggccccggccugagcaacagccaggagcuggacagcggcgugggcagaaccgacgagagcaccagaaacgaggagagcagcgagcacgaccugcugggcgacgagccccccagcagcaccaacacccccggcagccugagaaaguucggccugcagggcgacgcccugcagagcagagacuuccacuucagcauggacagccugcuggccgagggcgccggccugggcggcggcgacgugcccggccugaccgacgaggaguacgagagauacagagagcugcuggagaucaagugccaccuggagaacggcaaccagcugggccugcuguuccccagagccagcggcggcaacagcgcccuggacgugaacagaaacgagagccugggccacgagauggccaugcuggaggaggagcugagacaccuggaguucaagugcagaaacauccugagagcccagaagaugcagcagcugagagagagaugcaugaaggccuggcugcuggaggaggagagccuguacgaccuggccgccagcgagcccaagaagcacgagcugagcgacaucagcgagcugcccgagaagagcgacaaggacagcaccagcgccuacaacaccggcgagagcugcagaagcaccccccugcugguggagccccugcccgagagcccccugagaagagccauggccggcaacagcaaccugaacagaaccccccccggccccgccguggccacccccgccaaggccgcccccccccccggcagccccgccaaguucagaagccugagcagagaccccgaggccggcagaagacagcacgccgaggagagaggcagaagaaaccccaagaccggccugacccuggagagagugggccccgagagcagccccuaccugagcagaagacacagaggccagggccaggagggcgagcacuaccacagcugcgugcagcuggcccccaccagaggccuggaggagcugggccacggcccccugagccuggccggcggccccagagugggcggcguggccgccgccgccaccgaggcccccagaauggaguggaaggugaaggugagaagcgacggcaccagauacguggccaagagacccgugagagacagacugcugaaggccagagcccugaagaucagagaggagagaagcggcaugaccaccgacgacgacgccgugagcgagaugaagaugggcagauacuggagcaaggaggagagaaagcagcaccugaucagagccagagagcagagaaagagaagagaguucaugaugcagagcagacuggagugccugagagagcagcagaacggcgacagcaagcccgagcugaacaucaucgcccugagccacagaaagaccaugaagaagagaaacaagaagauccuggacaacuggaucaccauccaggagaugcuggcccacggcgccagaagcgccgacggcaagagaguguacaacccccugcugagcgugaccaccguguaa

SEQ ID NO: 21368 - RNA, 3102 nt, Artificial Sequence
  PDZD7__Homo_sapiens__NP_001182192
auggcccagggcuucgccgugggcuucgacccccugggccugggcgaccugagcagcggcagccugagcagccugagcagcagaggccaccugggcagcgacagcggcagcaccgccaccagauaccugcugagaaagcagcagagacugcugaacggcccccccagaggcaucagagccagcagccccaugggcagagugauccugaucaacagccccaucgaggccaacagcgacgagagcgacaucauccacagcgugagaguggagaagagccccgccggcagacugggcuucagcgugagaggcggcagcgagcacggccugggcaucuucgugagcaagguggaggagggcagcagcgccgagagagccggccugugcgugggcgacaagaucaccgaggugaacggccugagccuggagagcaccaccaugggcagcgccgugaaggugcugaccagcagcagcagacugcacaugauggugagaagaaugggcagagugcccggcaucaaguucagcaaggagaagaccaccuggguggacguggugaacagaagacuggugguggagaagugcggcagcacccccagcgacaccagcagcgaggacggcgugagaagaaucgugcaccuguacaccaccagcgacgacuucugccugggcuucaacaucagaggcggcaaggaguucggccugggcaucuacgugagcaagguggaccacggcggccuggccgaggagaacggcaucaaggugggcgaccaggugcuggccgccaacggcgugagauucgacgacaucagccacagccaggccguggaggugcugaagggccagacccacaucaugcugaccaucaaggagaccggcagauaccccgccuacaaggagauggugagcgaguacugcuggcuggacagacugagcaacggcgugcugcagcagcugagccccgccagcgagagcagcagcagcgugagcagcugcgccagcagcgcccccuacagcagcggcagccugcccagcgacagaauggacaucugccugggccaggaggagcccggcagcagaggccccggcuggggcagagccgacaccgccaugcagaccgagcccgacgccggcggcagaguggagaccuggugcagcgugagacccaccgugauccugagagacaccgccaucagaagcgacggcccccaccccggcagaagacuggacagcgcccugagcgagagccccaagaccgcccugcugcuggcccugagcagacccagaccccccaucaccagaagccagagcuaccugacccugugggaggagaagcagcagagaaagaaggagaagagcggcagccccggcgagaagggcgcccugcagagaagcaagacccugaugaaccuguucuucaagggcggcagacagggcagacuggccagagacggcagaagagaggccuggacccuggacagcggcagccuggccaagaccuaccccagacuggacaucgagaaggccggcggcgugggccccgugcagaaguucgugaccuggagacugagaagagaccaggagagaggcagagcccugcugagcgccagaagcggcagccccagcagccagcugcccaacguggacgagcaggugcaggccugggagagcagaagaccccugauccaggaccuggcccagagacugcugaccgacgacgaggugcuggccgugaccagacacugcagcagauacgugcacgagggcggcaucgaggaccuggugagaccccugcuggccauccuggacagacccgagaagcugcugcugcugcaggacaucagaagcgugguggcccccaccgaccugggcagauucgacagcauggugaugcugguggagcuggaggccuucgaggcccugaagagcagagccgugagaccccccgcccugagacccgccagacaggacaccccccccaagagacaccugaucacccccgugcccgacagcagaggcggcuucuaccugcugcccgugaacggcuuccccgaggaggaggacaacggcgagcugagagagagacugggcgcccugaaggugagccccagcgccagcgcccccagacacccccacaagggcauccccccccugcaggacgugcccguggacgccuucaccccccugagaaucgccugcaccccccccccccagcugccccccguggcccccagaccccugagacccaacuggcugcugaccgagccccugagcagagagcaccccccccagagccagaucagaggcagagcccagagcagaagcagaagcagaagcagaagcagaagcagaagcagcagaggccagggcaagagccccggcagaagaagccccagccccgugcccacccccgcccccagcaugaccaacggcagauaccacaagcccagaaaggccagacccccccugcccagaccccuggacggcgaggccgccaaggugggcgccaagcagggccccagcgagagcggcaccgagggcaccgccaaggaggccgccaugaagaaccccagcggcgagcugaagaccgugacccugagcaagaugaagcagagccugggcaucagcaucagcggcggcaucgagagcaaggugcagcccauggugaagaucgagaagaucuuccccggcggcgccgccuuccugagcggcgcccugcaggccggcuucgagcugguggccguggacggcgagaaccuggagcaggugacccaccagagagccguggacaccaucagaagagccuacagaaacaaggccagagagcccauggagcugguggugagagugcccggccccagccccagacccagccccagcgacagcagcgcccugaccgacggcggccugcccgccgaccaccugcccgcccaccagccccuggacgccgcccccgugcccgcccacuggcugcccgagccccccaccaacccccagaccccccccaccgacgccagacugcugcagcccacccccagccccgcccccagccccgcccugcagacccccgacagcaagcccgcccccagccccagaauccccuaa

SEQ ID NO: 21369 - RNA, 3465 nt, Artificial Sequence
  PDZD8__Homo_sapiens__NP_776152
augggccugcugcugaugauccuggccagcgccgugcugggcagcuuccugacccugcuggcccaguucuuccugcuguacagaagacagcccgagccccccgccgacgaggccgccagagccggcgagggcuucagauacaucaagcccgugcccggccugcugcugagagaguaccuguacggcggcggcagagacgaggagcccagcggcgccgcccccgagggcggcgccacccccaccgccgcccccgagacccccgccccccccaccagagagaccugcuacuuccugaacgccaccauccuguuccuguucagagagcugagagacaccgcccugaccagaagaugggugaccaagaagaucaagguggaguucgaggagcugcugcagaccaagaccgccggcagacugcuggagggccugagccugagagacguguuccugggcgagaccgugcccuucaucaagaccaucagacuggugagacccguggugcccagcgccaccggcgagcccgacggccccgagggcgaggcccugcccgccgccugccccgaggagcuggccuucgaggccgagguggaguacaacggcggcuuccaccuggccaucgacguggaccugguguucggcaagagcgccuaccuguucgugaagcugagcagaguggugggcagacugagacugguguucaccagagugcccuucacccacugguucuucagcuucguggaggacccccugaucgacuucgaggugagaagccaguucgagggcagacccaugccccagcugaccagcaucaucgugaaccagcugaagaagaucaucaagagaaagcacacccugcccaacuacaagaucagauucaagcccuucuuccccuaccagacccugcagggcuucgaggaggacgaggagcacauccacauccagcagugggcccugaccgagggcagacugaaggugacccugcuggagugcagcagacugcugaucuucggcagcuacgacagagaggccaacgugcacugcacccuggagcugagcagcagcgugugggaggagaagcagagaagcagcaucaagaccguggagcugaucaagggcaaccugcagagcgugggccugacccugagacuggugcagagcaccgacggcuacgccggccacgugaucaucgagaccguggcccccaacagccccgccgccaucgccgaccugcagagaggcgacagacugaucgccaucggcggcgugaagaucaccagcacccugcaggugcugaagcugaucaagcaggccggcgacagagugcugguguacuacgagagacccgugggccagagcaaccagggcgccgugcugcaggacaacuucggccagcuggaggagaacuuccugagcagcagcugccagagcggcuacgaggaggaggccgccggccugaccguggacaccgagagcagagagcuggacagcgaguucgaggaccuggccagcgacgugagagcccagaacgaguucaaggacgaggcccagagccugagccacagccccaagagagugcccaccacccugagcaucaagccccugggcgccaucagccccgugcugaacagaaagcuggccgugggcagccacccccugccccccaagauccagagcaaggacggcaacaagccccccccccugaagaccagcgagaucaccgaccccgcccaggugagcaagcccacccagggcagcgccuucaagccccccgugccccccagaccccaggccaaggugccccugcccagcgccgacgcccccaaccaggccgagcccgacgugcugguggagaagcccgagaagguggugccccccccccugguggacaagagcgccgagaagcaggccaagaacguggacgccaucgacgacgccgccgcccccaagcaguuccuggccaagcaggagguggccaaggacgugaccagcgagaccagcugccccaccaaggacagcagcgacgacagacagaccugggagagcagcgagauccuguacagaaacaagcugggcaaguggaccagaaccagagccagcugccuguucgacaucgaggccugccacagauaccugaacaucgcccuguggugcagagaccccuucaagcugggcggccugaucugccugggccacgugagccugaagcuggaggacguggcccugggcugccuggccaccagcaacaccgaguaccugagcaagcugagacuggaggcccccagccccaaggccaucgugaccagaaccgcccugagaaaccugagcaugcagaagggcuucaacgacaaguucugcuacggcgacaucaccauccacuucaaguaccugaaggagggcgagagcgaccaccacguggugaccaacguggagaaggagaaggagccccaccugguggaggaggugagcgugcugcccaaggaggagcaguucgugggccagaugggccugaccgagaacaagcacagcuuccaggacacccaguuccagaaccccaccuggugcgacuacugcaagaagaagguguggaccaaggccgccagccagugcauguucugcgccuacgugugccacaagaagugccaggagaagugccuggccgagaccagcgugugcggcgccaccgacagaagaaucgacagaacccugaagaaccugagacuggagggccaggagacccugcugggccugccccccagaguggacgccgaggccagcaagagcgugaacaagaccaccggccugaccagacacaucaucaacaccagcagcagacugcugaaccugagacaggugagcaagaccagacugagcgagcccggcaccgaccugguggagcccagccccaagcacacccccaacaccagcgacaacgagggcagcgacaccgaggugugcggccccaacagccccagcaagagaggcaacagcaccggcaucaagcuggugagaaaggagggcggccuggacgacagcguguucaucgccgugaaggagaucggcagagaccuguacagaggccugcccaccgaggagagaauccagaagcuggaguucaugcuggacaagcugcagaacgagaucgaccaggagcuggagcacaacaacagccuggugagagaggagaaggagaccaccgacaccagaaagaagagccugcugagcgccgcccuggccaagagcggcgagagacugcaggcccugacccugcugaugauccacuacagagccggcaucgaggacaucgagacccuggagagccugagccuggaccagcacagcaagaagaucagcaaguacaccgacgacaccgaggaggaccuggacaacgagaucagccagcugaucgacagccagcccuucagcagcaucagcgacgaccuguucggccccagcgagagcguguaa

SEQ ID NO: 21370 - RNA, 1539 nt, Artificial Sequence
  PDZK1__Homo_sapiens__XP_011507918
augaccagcaccuucaaccccagagagugcaagcugagcaagcaggagggccagaacuacggcuucuuccugagaaucgagaaggacaccgagggccaccuggugagagugguggagaagugcagccccgccgagaaggccggccugcaggacggcgacagagugcugagaaucaacggcguguucguggacaaggaggagcacaugcaggugguggaccuggugagaaagagcggcaacagcgugacccugcuggugcuggacggcgacagcuacgagaaggccgugaagaccagaguggaccugaaggagcugggccagagccagaaggagcagggccugagcgacaacauccugagccccgugaugaacggcggcgugcagaccuggacccagcccagacugugcuaccuggugaaggagggcggcagcuacggcuucagccugaagaccgugcagggcaagaagggcguguacaugaccgacaucaccccccagggcguggccaugagagccggcgugcuggccgacgaccaccugaucgaggugaacggcgagaacguggaggacgccagccacgaggaggugguggagaaggugaagaagagcggcagcagagugauguuccugcugguggacaaggagaccgacaagagacacguggagcagaagauccaguucaagagagagaccgccagccugaagcugcugccccaccagcccagaaucguggagaugaagaagggcagcaacggcuacggcuucuaccugagagccggcagcgagcagaagggccagaucaucaaggacaucgacagcggcagccccgccgaggaggccggccugaagaacaacgaccuggugguggccgugaacggcgagagcguggagacccuggaccacgacagcgugguggagaugaucagaaagggcggcgaccagaccagccugcuggugguggacaaggagaccgacaacauguacagacuggcccacuucagccccuuccuguacuaccagagccaggagcugcccaacggcagcgugaaggaggcccccgcccccacccccaccagccuggaggugagcagcccccccgacaccaccgaggagguggaccacaagcccaagcugugcagacuggccaagggcgagaacggcuacggcuuccaccugaacgccaucagaggccugcccggcagcuucaucaaggaggugcagaagggcggccccgccgaccuggccggccuggaggacgaggacgugaucaucgaggugaacggcgugaacgugcuggacgagcccuacgagaaggugguggacagaauccagagcagcggcaagaacgugacccugcuggugugcggcaagaaggccuacgacuacuuccaggccaagaagauccccaucgugagcagccuggccgacccccuggacaccccccccgacagcaaggagggcaucgugguggagagcaaccacgacagccacauggccaaggagagacuguacaccaucgccgugaacugcaugcuguaa

SEQ ID NO: 21371 - RNA, 2367 nt, Artificial Sequence
  PDZRN3__Homo_sapiens__NP_001290070
augaagauggagcacaagagaaugauccugcuguucagcaaguucacccugauccacaagccccacggcggcagaugguaccuggugaacggcagagaccugagcagagccacccacgaccaggccguggaggccuucaagaccgccaaggagcccaucguggugcaggugcugagaagaacccccagaaccaagauguucaccccccccagcgagagccagcugguggacaccggcacccagaccgacaucaccuucgagcacaucauggcccugaccaagaugagcagccccagcccccccgugcuggaccccuaccugcugcccgaggagcaccccagcgcccacgaguacuacgaccccaacgacuacaucggcgacauccaccaggagauggacagagaggagcuggagcuggaggagguggaccuguacagaaugaacagccaggacaagcugggccugaccgugugcuacagaaccgacgacgaggacgacaucggcaucuacaucagcgagaucgaccccaacagcaucgccgccaaggacggcagaaucagagagggcgacagaaucauccagaucaacggcaucgaggugcagaacagagaggaggccguggcccugcugaccagcgaggagaacaagaacuucagccugcugaucgccagacccgagcugcagcuggacgagggcuggauggacgacgacagaaacgacuuccuggacgaccugcacauggacaugcuggaggagcagcaccaccaggccaugcaguucaccgccagcgugcugcagcagaagaagcacgacgaggacggcggcaccaccgacaccgccaccauccugagcaaccagcacgagaaggacagcggcgugggcagaaccgacgagagcaccagaaacgacgagagcagcgagcaggagaacaacggcgacgacgccaccgccagcagcaacccccuggccggccagagaaagcugaccugcagccaggacacccugggcagcggcgaccugcccuucagcaacgagagcuucaucagcgccgacugcaccgacgccgacuaccugggcauccccguggacgagugcgagagauucagagagcugcuggagcugaagugccaggugaagagcgccacccccuacggccuguacuaccccagcggcccccuggacgccggcaagagcgaccccgagagcguggacaaggagcuggagcugcugaacgaggagcugagaagcaucgagcuggagugccugagcaucgugagagcccacaagaugcagcagcugaaggagcaguacagagagagcuggaugcugcacaacagcggcuucagaaacuacaacaccagcaucgacgugagaagacacgagcugagcgacaucaccgagcugcccgagaagagcgacaaggacagcagcagcgccuacaacaccggcgagagcugcagaagcaccccccugacccuggagaucagccccgacaacagccugagaagagccgccgagggcaucagcugccccagcagcgagggcgccgugggcaccaccgaggccuacggccccgccagcaagaaccugcugagcaucaccgaggaccccgaggugggcacccccaccuacagccccagccugaaggagcuggaccccaaccagccccuggagagcaaggagagaagagccagcgacggcagcagaagccccacccccagccagaagcugggcagcgccuaccugcccagcuaccaccacagccccuacaagcacgcccacauccccgcccacgcccagcacuaccagagcuacaugcagcugauccagcagaagagcgccguggaguacgcccagagccagaugagccuggugagcaugugcaaggaccugagcagccccacccccagcgagcccagaauggaguggaaggugaagaucagaagcgacggcaccagauacaucaccaagagacccgugagagacagacugcugagagagagagcccugaagaucagagaggagagaagcggcaugaccaccgacgacgacgccgugagcgagaugaagaugggcagauacuggagcaaggaggagagaaagcagcaccuggugaaggccaaggagcagagaagaagaagagaguucaugaugcagagcagacuggacugccugaaggagcagcaggccgccgacgacagaaaggagaugaacauccuggagcugagccacaagaagaugaugaagaagagaaacaagaagaucuucgacaacuggaugaccauccaggagcugcugacccacggcaccaagagccccgacggcaccagaguguacaacagcuuccugagcgugaccaccguguaa

SEQ ID NO: 21372 - RNA, 3111 nt, Artificial Sequence
  PDZRN4__Homo_sapiens__NP_001158067
augggcuucgcccuggagagauucgccgaggccguggaccccgcccuggagugcaagcugugcggccaggugcuggaggagccccugugcacccccugcggccacguguucugcgccagcugccugcugcccugggccgugagaagaagaagaugcccccugcagugccagccccuggcccccggcgagcuguacagagugcugccccugagaagccugauccagaagcugagagugcagugcgacuacagagccagaggcugcggccacagcgugagacugcacgagcuggaggcccacguggagcacugcgacuucggccccgccagaagacugagaagcagaggcggcugcgccagcggccugggcggcggcgaggugcccgccagaggcggcugcggccccacccccagagccggcagaggcggcggcgccagaggcggcccccccggcggcagauggggcagaggcagaggccccggccccagagugcuggccuggagaagaagagagaaggcccugcuggcccagcugugggcccugcagggcgaggugcagcugaccgccagaagauaccaggagaaguucacccaguacauggcccacgugagaaacuucgugggcgaccugggcggcggccacagaagagacggcgagcacaagcccuucaccaucgugcuggagagagagaacgacacccugggcuucaacaucaucggcggcagacccaaccagaacaaccaggagggcaccagcaccgagggcaucuacgugagcaagauccuggagaacggccccgccgacagagccgacggccuggagauccacgacaagaucauggaggugaacggcaaggaccugagcaaggccacccacgaggaggccguggaggccuucagaaacgccaaggagcccaucguggugcaggugcugagaagaaccccccugagcagacccgccuacggcauggccagcgaggugcagcugaugaacgccagcacccagaccgacaucaccuucgagcacaucauggcccuggccaagcugagaccccccaccccccccgugcccgacaucugccccuuccugcugagcgacagcugccacagccugcaccccauggagcacgaguucuacgaggacaacgaguacaucagcagccugcccgccgacgccgacagaaccgaggacuucgaguacgaggagguggagcugugcagagugagcagccaggagaagcugggccugaccgugugcuacagaaccgacgacgaggaggacaccggcaucuacgugagcgagguggaccccaacagcaucgccgccaaggacggcagaaucagagagggcgacagaauccugcagaucaacggcgaggacgugcagaacagagaggaggccguggcccugcugagcaacgacgagugcaagagaaucgugcugcugguggccagacccgagauccagcuggacgagggcuggcuggaggacgagagaaacgaguuccuggaggagcugaaccuggagaugcuggaggaggagcacaacgaggccaugcagcccaccgccaacgagguggagcagcccaagaagcaggaggaggaggagggcaccaccgacaccgccaccagcagcagcaacaaccacgagaaggacagcggcgugggcagaaccgacgagagccugagaaacgacgagagcagcgagcaggagaacgccgccgaggaccccaacagcaccagccugaagagcaagagagaccugggccagagccaggacacccugggcagcguggagcugcaguacaacgagagccuggugagcggcgaguacaucgacagcgacugcaucggcaaccccgacgaggacugcgagagauucagacagcugcuggagcugaagugcaagaucagaaaccacggcgaguacgaccuguacuacagcagcagcaccaucgagugcaaccagggcgagcaggagggcguggagcacgagcugcagcugcugaacgaggagcugagaaacaucgagcuggagugccagaacaucaugcaggcccacagacugcagaaggugaccgaccaguacggcgacaucuggacccugcacgacggcggcuucagaaacuacaacaccagcaucgacaugcagagaggcaagcuggacgacaucauggagcaccccgagaagagcgacaaggacagcagcagcgccuacaacaccgccgagagcugcagaagcaccccccugaccguggacagaagccccgacagcagccugcccagagugaucaaccugaccaacaagaagaaccugagaagcaccauggccgccacccagagcagcagcggccagagcagcaaggagagcaccagcaccaaggccaagaccaccgagcagggcugcagcgccgagagcaaggagaaggugcuggagggcagcaagcugcccgaccaggagaaggccgugagcgagcacauccccuaccugagccccuaccacagcagcagcuacagauacgccaacauccccgcccacgccagacacuaccagagcuacaugcagcugauccagcagaagagcgccguggaguacgcccagagccagcugagccuggugagcaugugcaaggagagccagaagugcagcgagcccaagauggaguggaaggugaagaucagaagcgacggcaccagauacaucaccaagagacccgugagagacagaauccugaaggagagagcccugaagaucaaggaggagagaagcggcaugaccaccgacgacgacaccaugagcgagaugaagaugggcagauacuggagcaaggaggagagaaagcagcaccuggugagagccaaggagcagagaagaagaagagaguucaugaugagaagcagacuggagugccugaaggagagcccccagagcggcagcgagggcaagaaggagaucaacaucaucgagcugagccacaagaagaugaugaagaagagaaacaagaagauccuggacaacuggaugaccauccaggagcugaugacccacggcgccaagagccccgacggcaccagagugcacaacgccuuccugagcgugaccaccguguaa

SEQ ID NO: 21373 - RNA, 456 nt, Artificial Sequence
  PEA15__Homo_sapiens__NP_001284505
auggaggacgagggcaacaagcugugccaggccccccccuggcccggccagaccagccccgugauggccgaguacggcacccugcugcaggaccugaccaacaacaucacccuggaggaccuggagcagcugaagagcgccugcaaggaggacauccccagcgagaagagcgaggagaucaccaccggcagcgccugguucagcuuccuggagagccacaacaagcuggacaaggacaaccugagcuacaucgagcacaucuucgagaucagcagaagacccgaccugcugaccauggugguggacuacagaaccagagugcugaagaucagcgaggaggacgagcuggacaccaagcugaccagaauccccagcgccaagaaguacaaggacaucaucagacagcccagcgaggaggagaucaucaagcuggcccccccccccaagaaggccuaa

SEQ ID NO: 21374 - RNA, 5241 nt, Artificial Sequence
  PEAK1__Homo_sapiens__NP_079052
augagcgccugcaacaccuucaccgagcacguguggaagcccggcgagugcaagaacugcuucaagcccaagagccugcaccagcugccccccgaccccgagaaggcccccaucacccacggcaacgugaagaccaacgccaaccacagcaacaaccacagaaucagaaacaccggcaacuucagaccccccguggccaagaagcccaccaucgccgugaagcccaccaugaucguggccgacggccagagcaucugcggcgagcugagcauccaggagcacugcgagaacaagcccgugaucaucggcuggaacagaaacagagccgcccugagccagaagccccugaacaacaacaacgaggacgacgagggcaucagccacgugcccaagcccuacggcaacaacgacagcgccaagaagaugagcgacaacaacaacggccugaccgaggugcugaaggagaucgccggccuggacaccgccccccagaucagaggcaacgagaccaacagcagagagaccuuccugggcagaaucaacgacugcuacaagagaagccuggagagaaagcugccccccagcugcaugaucggcggcaucaaggagacccagggcaagcacgugauccugagcggcagcaccgaggugaucagcaacgagggcggcagauucugcuaccccgaguucagcagcggcgaggagagcgaggaggacgugcuguucagcaacauggaggaggagcacgagagcugggacgagagcgacgaggagcugcuggccauggagaucagaaugagaggccagcccagauucgccaacuucagagccaacacccugagccccgugagauucuucguggacaagaaguggaacaccaucccccugagaaacaagagccugcagagaaucugcgccguggacuacgacgacagcuacgacgagauccugaacggcuacgaggagaacagcguggugagcuacggccagggcagcauccagagcauggugagcagcgacagcaccagccccgacagcagccugaccgaggagagcagaagcgagaccgccagcagccugagccagaagaucugcaacggcggccugagccccggcaaccccggcgacagcaaggacaugaaggagaucgagcccaacuacgagagccccagcagcaacaaccaggacaaggacagcagccaggccagcaagagcagcaucaaggugcccgagacccacaaggccgugcuggcccugagacuggaggagaaggacggcaagaucgccgugcagaccgagaaggaggagagcaaggccagcaccgacguggccggccaggccgugaccaucaaccuggugcccaccgaggagcaggccaagcccuacagaguggugaaccuggagcagccccugugcaagcccuacaccgugguggacgugagcgccgccauggccagcgagcaccuggagggccccgugaacagccccaagaccaagagcagcagcagcacccccaacagccccgugaccagcagcagccugacccccggccagaucagcgcccacuuccagaagagcagcgccaucagauaccaggagguguggaccagcagcaccagccccagacagaagauccccaagguggagcugaucaccagcggcaccggccccaacgugccccccagaaagaacugccacaagagcgcccccaccagccccaccgccaccaacaucagcagcaagaccauccccgugaagagccccaaccugagcgagaucaaguucaacagcuacaacaacgccggcaugccccccuuccccaucaucauccacgacgagcccaccuacgccagaagcagcaagaacgccaucaaggugcccaucgugaucaaccccaacgccuacgacaaccuggccaucuacaagagcuuccugggcaccagcggcgagcugagcgugaaggagaagaccaccagcgugaucagccacaccuacgaggagaucgagaccgagagcaaggugcccgacaacaccaccagcaagaccaccgacugccugcagaccaagggcuucagcaacagcaccgagcacaagagaggcagcguggcccagaaggugcaggaguucaacaacugccugaacagaggccagagcagcccccagagaagcuacagcagcagccacagcagccccgccaagauccagagagccacccaggagcccguggccaagaucgagggcacccaggagagccagauggugggcagcagcagcaccagagagaaggccagcaccgugcugagccagaucguggccagcauccagcccccccagagcccccccgagaccccccagagcggccccaaggccugcagcguggaggagcuguacgccaucccccccgacgccgacguggccaagagcacccccaagagcacccccgugagacccaagagccuguucaccagccagcccagcggcgaggccgaggccccccagaccaccgacagccccaccaccaaggugcagaaggaccccagcaucaagcccgugacccccagccccagcaagcuggugaccagcccccagagcgagccccccgcccccuuccccccccccagaagcaccagcagccccuaccacgccggcaaccugcugcagagacacuucaccaacuggaccaagcccaccagccccaccagaagcaccgaggccgagagcgugcugcacagcgagggcagcagaagagccgccgacgccaagcccaagagauggaucagcuucaagagcuucuucagaagaagaaagaccgacgaggaggacgacaaggagaaggagagagagaagggcaagcuggugggccuggacggcaccgugauccacaugcugccccccccccccgugcagagacaccacugguucaccgaggccaagggcgagagcagcgagaagcccgccaucguguucauguacagaugcgaccccgcccagggccagcugagcguggaccagagcaaggccagaaccgaccaggccgccgugauggagaagggcagagccgagaacgcccugcugcaggacagcgagaagaagagaagccacagcagccccagccagauccccaagaagauccugagccacaugacccacgaggugaccgaggacuucagccccagagaccccagaaccguggugggcaagcaggacggcagaggcugcaccagcgugaccaccgcccugagccugcccgagcuggagagagaggacggcaaggaggacaucagcgaccccauggaccccaaccccugcagcgccaccuacagcaaccugggccagagcagagccgccaugaucccccccaagcagcccagacagcccaagggcgccguggacgacgccaucgccuucggcggcaagaccgaccaggaggcccccaacgccagccagcccaccccccccccccugcccaagaagaugaucaucagagccaacaccgagcccaucagcaaggaccugcagaagagcauggagagcagccugugcgugauggccaaccccaccuacgacaucgaccccaacugggacgccagcagcgccggcagcagcaucagcuacgagcugaagggccuggacaucgagagcuacgacagccuggagagaccccugagaaaggagagacccgugcccagcgccgccaacagcaucagcagccugaccacccugagcaucaaggacagauucagcaacagcauggagagccugagcagcagaagaggccccagcugcagacagggcagaggcauccagaagccccagagacaggcccuguacagaggccuggagaacagagaggagguggugggcaagaucagaagccugcacaccgacgcccugaagaagcuggccgugaagugcgaggaccuguucauggccggccagaaggaccagcugagauucggcguggacagcuggagcgacuucagacugaccagcgacaagcccugcugcgaggccggcgacgccguguacuacaccgccagcuacgccaaggacccccugaacaacuacgccgugaagaucugcaagagcaaggccaaggagagccagcaguacuaccacagccuggccgugagacagagccuggccgugcacuucaacauccagcaggacugcggccacuuccuggccgaggugcccaacagacugcugcccugggaggaccccgacgaccccgagaaggacgaggacgacauggaggagaccgaggaggacgccaagggcgagaccgacggcaagaaccccaagcccugcagcgaggccgccagcagccagaaggagaaccagggcgugaugagcaagaagcagagaagccacgugguggugaucaccagagaggugcccugccugaccguggccgacuucgugagagacagccuggcccagcacggcaagagccccgaccuguacgagagacaggugugccugcugcugcugcagcugugcagcggccuggagcaccugaagcccuaccacgugacccacugcgaccugagacuggagaaccugcugcuggugcacuaccagcccggcggcaccgcccagggcuucggccccgccgagcccagccccaccagcagcuaccccaccagacugaucgugagcaacuucagccaggccaagcagaagagccaccugguggaccccgagauccugagagaccagagcagacuggcccccgagaucaucaccgccacccaguacaagaagugcgacgaguuccagaccggcauccugaucuacgagaugcugcaccugcccaaccccuucgacgagaaccccgagcugaaggagagagaguacaccagagccgaccugcccagaauccccuucagaagccccuacagcagaggccugcagcagcuggccagcugccugcugaaccccaaccccagcgagagaauccugaucagcgacgccaagggcauccugcagugccugcuguggggccccagagaggaccuguuccagaccuucaccgccugccccagccuggugcagagaaacacccugcugcagaacuggcuggacaucaagagaacccugcugaugaucaaguucgccgagaagagccuggacagagagggcggcaucagccuggaggacuggcugugcgcccaguaccuggccuucgccaccaccgacagccugagcugcaucgugaagauccugcagcacagauaa

SEQ ID NO: 21375 - RNA, 3114 nt, Artificial Sequence
  PEAR1__Homo_sapiens__NP_001073940
augagccccccccugugcccccugcugcugcuggccgugggccugagacuggccggcacccugaaccccagcgaccccaacaccugcagcuucugggagagcuucaccaccaccaccaaggagagccacagcagacccuucagccugcugcccagcgagcccugcgagagacccugggagggcccccacaccugcccccagcccaccgugguguacagaaccguguacagacagguggugaagaccgaccacagacagagacugcagugcugccacggcuucuacgagagcagaggcuucugcgugccccugugcgcccaggagugcgugcacggcagaugcguggcccccaaccagugccagugcgugcccggcuggagaggcgacgacugcagcagcgagugcgcccccggcauguggggcccccagugcgacaagcccugcagcugcggcaacaacagcagcugcgaccccaagagcggcgugugcagcugccccagcggccugcagccccccaacugccugcagcccugcacccccggcuacuacggccccgccugccaguucagaugccagugccacggcgcccccugcgacccccagaccggcgccugcuucugccccgccgagagaaccggccccagcugcgacgugagcugcagccagggcaccagcggcuucuucugccccagcacccacagcugccagaacggcggcguguuccagaccccccagggcagcugcagcugcccccccggcuggaugggcaccaucugcagccugcccugccccgagggcuuccacggccccaacugcagccaggagugcagaugccacaacggcggccugugcgacagauucaccggccagugcagaugcgcccccggcuacaccggcgacagaugcagagaggagugccccgugggcagauucggccaggacugcgccgagaccugcgacugcgcccccgacgccagaugcuuccccgccaacggcgccugccugugcgagcacggcuucaccggcgacagaugcaccgacagacugugccccgacggcuucuacggccugagcugccaggcccccugcaccugcgacagagagcacagccugagcugccaccccaugaacggcgagugcagcugccugcccggcugggccggccugcacugcaacgagagcugcccccaggacacccacggccccggcugccaggagcacugccugugccugcacggcggcgugugccaggccaccagcggccugugccagugcgcccccggcuacaccggcccccacugcgccagccugugcccccccgacaccuacggcgugaacugcagcgccagaugcagcugcgagaacgccaucgccugcagccccaucgacggcgagugcgugugcaaggagggcuggcagagaggcaacugcagcgugcccugcccccccggcaccuggggcuucagcugcaacgccagcugccagugcgcccacgaggccgugugcagcccccagaccggcgccugcaccugcacccccggcuggcacggcgcccacugccagcugcccugccccaagggccaguucggcgagggcugcgccagcagaugcgacugcgaccacagcgacggcugcgaccccgugcacggcagaugccagugccaggccggcuggaugggcgccagaugccaccugagcugccccgagggccuguggggcgugaacugcagcaacaccugcaccugcaagaacggcggcaccugccugcccgagaacggcaacugcgugugcgcccccggcuucagaggccccagcugccagagaagcugccagcccggcagauacggcaagagaugcgugcccugcaagugcgccaaccacagcuucugccaccccagcaacggcaccugcuacugccuggccggcuggaccggccccgacugcagccagcccugcccccccggccacuggggcgagaacugcgcccagaccugccagugccaccacggcggcaccugccacccccaggacggcagcugcaucugcccccugggcuggaccggccaccacugccuggagggcugcccccugggcaccuucggcgccaacugcagccagcccugccagugcggccccggcgagaagugccaccccgagaccggcgccugcgugugcccccccggccacagcggcgcccccugcagaaucggcauccaggagcccuucaccgugaugcccaccacccccguggccuacaacagccugggcgccgugaucggcaucgccgugcugggcagccuggugguggcccugguggcccuguucaucggcuacagacacuggcagaagggcaaggagcaccaccaccuggccguggccuacagcagcggcagacuggacggcagcgaguacgugaugcccgacgugccccccagcuacagccacuacuacagcaaccccagcuaccacacccugagccagugcagccccaacccccccccccccaacaaggugcccggcccccuguucgccagccugcagaaccccgagagacccggcggcgcccagggccacgacaaccacaccacccugcccgccgacuggaagcacagaagagagcccccccccggcccccuggacagaggcagcagcagacuggacagaagcuacagcuacagcuacagcaacggccccggccccuucuacaacaagggccugaucagcgaggaggagcugggcgccagcguggccagccugagcagcgagaaccccuacgccaccaucagagaccugcccagccugcccggcggccccagagagagcagcuacauggagaugaagggcccccccagcggcagcccccccagacagcccccccaguucugggacagccagagaagaagacagccccagccccagagagacagcggcaccuacgagcagcccagcccccugauccacgacagagacagcgugggcagccagcccccccugccccccggccugccccccggccacuacgacagccccaagaacagccacauccccggccacuacgaccugccccccgugagacacccccccagccccccccugagaagacaggacagauaa

SEQ ID NO: 21376 - RNA, 564 nt, Artificial Sequence
  PEBP1__Homo_sapiens__NP_002558
augcccguggaccugagcaaguggagcggcccccugagccugcaggagguggacgagcagccccagcacccccugcacgugaccuacgccggcgccgccguggacgagcugggcaaggugcugacccccacccaggugaagaacagacccaccagcaucagcugggacggccuggacagcggcaagcuguacacccuggugcugaccgaccccgacgcccccagcagaaaggaccccaaguacagagaguggcaccacuuccugguggugaacaugaagggcaacgacaucagcagcggcaccgugcugagcgacuacgugggcagcggcccccccaagggcaccggccugcacagauacguguggcugguguacgagcaggacagaccccugaagugcgacgagcccauccugagcaacagaagcggcgaccacagaggcaaguucaagguggccagcuucagaaagaaguacgagcugagagcccccguggccggcaccugcuaccaggccgagugggacgacuacgugcccaagcuguacgagcagcugagcggcaaguaa

SEQ ID NO: 21377 - RNA, 684 nt, Artificial Sequence
  PEBP4__Homo_sapiens__NP_659399
augggcuggaccaugagacuggugaccgccgcccugcugcugggccugaugaugguggugaccggcgacgaggacgagaacagccccugcgcccacgaggcccugcuggacgaggacacccuguucugccagggccuggagguguucuaccccgagcugggcaacaucggcugcaagguggugcccgacugcaacaacuacagacagaagaucaccagcuggauggagcccaucgugaaguuccccggcgccguggacggcgccaccuacauccuggugaugguggaccccgacgcccccagcagagccgagcccagacagagauucuggagacacuggcuggugaccgacaucaagggcgccgaccugaagaagggcaagauccagggccaggagcugagcgccuaccaggcccccagcccccccgcccacagcggcuuccacagauaccaguucuucguguaccugcaggagggcaaggugaucagccugcugcccaaggagaacaagaccagaggcagcuggaagauggacagauuccugaacagauuccaccugggcgagcccgaggccagcacccaguucaugacccagaacuaccaggacagccccacccugcaggcccccagagagagagccagcgagcccaagcacaagaaccaggccgagaucgccgccugcuaa

SEQ ID NO: 21378 - RNA, 2160 nt, Artificial Sequence
  PECAM1__Homo_sapiens__XP_005276938
augcagcccagaugggcccagggcgccaccauguggcugggcgugcugcugacccugcugcugugcagcagccuggagggccaggagaacagcuucaccaucaacagcguggacaugaagagccugcccgacuggaccgugcagaacggcaagaaccugacccugcagugcuucgccgacgugagcaccaccagccacgugaagccccagcaccagaugcuguucuacaaggacgacgugcuguucuacaacaucagcagcaugaagagcaccgagagcuacuucauccccgaggugagaaucuacgacagcggcaccuacaagugcaccgugaucgugaacaacaaggagaagaccaccgccgaguaccaggugcugguggagggcgugcccagccccagagugacccuggacaagaaggaggccauccagggcggcaucgugagagugaacugcagcgugcccgaggagaaggcccccauccacuucaccaucgagaagcuggagcugaacgagaagauggugaagcugaagagagagaagaacagcagagaccagaacuucgugauccuggaguuccccguggaggagcaggacagagugcugagcuucagaugccaggccagaaucaucagcggcauccacaugcagaccagcgagagcaccaagagcgagcuggugaccgugaccgagagcuucagcacccccaaguuccacaucagccccaccggcaugaucauggagggcgcccagcugcacaucaagugcaccauccaggugacccaccuggcccaggaguuccccgagaucaucauccagaaggacaaggccaucguggcccacaacagacacggcaacaaggccguguacagcgugauggccaugguggagcacagcggcaacuacaccugcaagguggagagcagcagaaucagcaaggugagcagcaucguggugaacaucaccgagcuguucagcaagcccgagcuggagagcagcuucacccaccuggaccagggcgagagacugaaccugagcugcagcauccccggcgccccccccgccaacuucaccauccagaaggaggacaccaucgugagccagacccaggacuucaccaagaucgccagcaagagcgacagcggcaccuacaucugcaccgccggcaucgacaagguggugaagaagagcaacaccgugcagaucguggugugcgagaugcugagccagcccagaaucagcuacgacgcccaguucgaggugaucaagggccagaccaucgaggugagaugcgagagcaucagcggcacccugcccaucagcuaccagcugcugaagaccagcaaggugcuggagaacagcaccaagaacagcaacgaccccgccguguucaaggacaaccccaccgaggacguggaguaccagugcguggccgacaacugccacagccacgccaagaugcugagcgaggugcugagagugaaggugaucgcccccguggacgaggugcagaucagcauccugagcagcaaggugguggagagcggcgaggacaucgugcugcagugcgccgugaacgagggcagcggccccaucaccuacaaguucuacagagagaaggagggcaagcccuucuaccagaugaccagcaacgccacccaggccuucuggaccaagcagaaggccagcaaggagcaggagggcgaguacuacugcaccgccuucaacagagccaaccacgccagcagcgugcccagaagcaagauccugaccgugagagugauccuggcccccuggaagaagggccugaucgccguggugaucaucggcgugaucaucgcccugcugaucaucgccgccaagugcuacuuccugagaaaggccaaggccaagcagaugcccguggagaugagcagacccgccgugccccugcugaacagcaacaacgagaagaugagcgaccccaacauggaggccaacagccacuacggccacaacgacgacgugagaaaccacgccaugaagcccaucaacgacaacaaggagccccugaacagcgacgugcaguacaccgaggugcaggugagcagcgccgagagccacaaggacgccguggagagcagauacagcagaaccgagggcagccuggacggcaccuaa

SEQ ID NO: 21379 - RNA, 912 nt, Artificial Sequence
  PECR__Homo_sapiens__NP_060911
auggccagcugggccaagggcagaagcuaccuggcccccggccugcugcagggccagguggccaucgugaccggcggcgccaccggcaucggcaaggccaucgugaaggagcugcuggagcugggcagcaacguggugaucgccagcagaaagcuggagagacugaagagcgccgccgacgagcugcaggccaaccugccccccaccaagcaggccagagugauccccauccagugcaacaucagaaacgaggaggaggugaacaaccuggugaagagcacccuggacaccuucggcaagaucaacuuccuggugaacaacggcggcggccaguuccugagccccgccgagcacaucagcagcaagggcuggcacgccgugcuggagaccaaccugaccggcaccuucuacaugugcaaggccguguacagcagcuggaugaaggagcacggcggcagcaucgugaacaucaucgugcccaccaaggccggcuucccccuggccgugcacagcggcgccgccagagccggcguguacaaccugaccaagagccuggcccuggagugggccugcagcggcaucagaaucaacugcguggcccccggcgugaucuacagccagaccgccguggagaacuacggcagcuggggccagagcuucuucgagggcagcuuccagaagauccccgccaagagaaucggcgugcccgaggaggugagcagcguggugugcuuccugcugagccccgccgccagcuucaucaccggccagagcguggacguggacggcggcagaagccuguacacccacagcuacgaggugcccgaccacgacaacuggcccaagggcgccggcgaccugagcguggugaagaagaugaaggagaccuucaaggagaaggccaagcuguaa

SEQ ID NO: 21380 - RNA, 978 nt, Artificial Sequence
  PEG10__Homo_sapiens__NP_001035242
augaccgagagaagaagagacgagcugagcgaggagaucaacaaccugagagagaaggugaugaagcagagcgaggagaacaacaaccugcagagccaggugcagaagcugaccgaggagaacaccacccugagagagcagguggagcccacccccgaggacgaggacgacgacaucgagcugagaggcgccgccgccgccgccgccccccccccccccaucgaggaggagugccccgaggaccugcccgagaaguucgacggcaaccccgacaugcuggcccccuucauggcccagugccagaucuucauggagaagagcaccagagacuucagcguggacagagugagagugugcuucgugaccagcaugaugaccggcagagccgccagaugggccagcgccaagcuggagagaagccacuaccugaugcacaacuaccccgccuucaugauggagaugaagcacguguucgaggacccccagagaagagagguggccaagagaaagaucagaagacugagacagggcaugggcagcgugaucgacuacagcaacgccuuccagaugaucgcccaggaccuggacuggaacgagcccgcccugaucgaccaguaccacgagggccugagcgaccacauccaggaggagcugagccaccuggagguggccaagagccugagcgcccugaucggccagugcauccacaucgagagaagacuggccagagccgccgccgccagaaagcccagaagcccccccagagcccuggugcugccccacaucgccagccaccaccagguggaccccaccgagcccgugggcggcgccagaaugagacugacccaggaggagaaggagagaagaagaaagcugaaccugugccuguacugcggcaccggcggccacuacgccgacaacugccccgccaaggccagcaagagcagccccgccggcaacagccccgccccccuguaa

SEQ ID NO: 21381 - RNA, 4389 nt, Artificial Sequence
  PEG3__Homo_sapiens__NP_001139657
auguaccagcccgaggacgacaacaacagcgacgugaccagcgacgacgacaugaccagaaacagaagagagagcagccccccccacagcgugcacagcuucagcgacagagacugggacagaagaggcagaagcagagacauggagcccagagacagauggagccacaccagaaaccccagaagcagaaugccccccagagaccugagccugcccgugguggccaagaccagcuucgagauggacagagaggacgacagagacagcagagccuacgagagcagaagccaggacgccgagagcuaccagaacgugguggaccuggccgaggacagaaagccccacaacaccauccaggacaacauggagaacuacagaaagcugcugagccuggugcagcuggccgaggacgacggccacagccacaugacccagggccacagcagcagaagcaagagaagcgccuaccccagcaccagcagaggccugaagaccaugcccgaggccaagaagagcacccacagaagaggcaucugcgaggacgagagcagccacggcgugaucauggagaaguucaucaaggacgugagcagaagcagcaagagcggcagagccagagagagcagcgacagaagccagagauuccccagaaugagcgacgacaacuggaaggacaucagccugaacaagagagagagcgugauccagcagagaguguacgagggcaacgccuucagaggcggcuucagauucaacagcacccuggugagcagaaagagagugcuggagagaaagagaagauaccacuucgacaccgacggcaagggcagcauccacgaccagaagggcugccccagaaagaagcccuucgagugcggcagcgagaugagaaaggccaugagcgugagcagccugagcagccugagcagccccagcuucaccgagagccagcccaucgacuucggcgccaugcccuacgugugcgacgagugcggcagaagcuucagcgugaucagcgaguucguggagcaccagaucaugcacaccagagagaaccuguacgaguacggcgagagcuucauccacagcguggccgugagcgaggugcagaagagccaggugggcggcaagagauucgagugcaaggacugcggcgagaccuucaacaagagcgccgcccuggccgagcacagaaagauccacgccagaggcuaccugguggagugcaagaaccaggagugcgaggaggccuucaugcccagccccaccuucagcgagcugcagaagaucuacggcaaggacaaguucuacgagugcagagugugcaaggagaccuuccugcacagcagcgcccugaucgagcaccagaagauccacuucggcgacgacaaggacaacgagagagagcacgagagagagagagagagagagagaggcgagaccuucagacccagccccgcccugaacgaguuccagaagauguacggcaaggagaagauguacgagugcaaggugugcggcgagaccuuccugcacagcagcagccugaaggagcaccagaagauccacaccagaggcaaccccuucgagaacaagggcaaggugugcgaggagaccuucauccccggccagagccugaagagaagacagaagaccuacaacaaggagaagcugugcgacuucaccgacggcagagacgccuucaugcagagcagcgagcugagcgagcaccagaagauccacagcagaaagaaccuguucgagggcagaggcuacgagaagagcgugauccacagcggccccuucaccgagagccagaagagccacaccaucaccagaccccuggagagcgacgaggacgagaaggccuucaccaucagcagcaaccccuacgagaaccagaagauccccaccaaggagaacguguacgaggccaagagcuacgagagaagcgugauccacagccuggccagcguggaggcccagaagagccacagcguggccggccccagcaagcccaaggugauggccgagagcaccauccagagcuucgacgccaucaaccaccagagagugagagccggcggcaacaccagcgagggcagagaguacagcagaagcgugauccacagccugguggccagcaagccccccagaagccacaacggcaacgagcugguggagagcaacgagaagggcgagagcagcaucuacaucagcgaccugaacgacaagagacagaagauccccgccagagagaaccccugcgagggcggcagcaagaacagaaacuacgaggacagcgugauccagagcguguucagagccaagccccagaagagcgugcccggcgagggcagcggcgaguucaagaaggacggcgaguucagcgugcccagcagcaacgugagagaguaccagaaggccagagccaagaagaaguacaucgagcacagaagcaacgagaccagcgugauccacagccugcccuucggcgagcagaccuucagacccagaggcaugcuguacgagugccaggagugcggcgagugcuucgcccacagcagcgaccugaccgagcaccagaagauccacgacagagagaagcccagcggcagcagaaacuacgaguggagcgugaucagaagccuggcccccaccgacccccagaccagcuacgcccaggagcaguacgccaaggagcaggccagaaacaagugcaaggacuucagacaguucuucgccaccagcgaggaccugaacaccaaccagaagaucuacgaccaggagaagagccacggcgaggagagccagggcgagaacaccgacggcgaggagacccacagcgaggagacccacggccaggagaccaucgaggaccccgugauccagggcagcgacauggaggacccccagaaggacgaccccgacgacaagaucuacgagugcgaggacugcggccugggcuucguggaccugaccgaccugaccgaccaccagaaggugcacagcagaaagugccugguggacagcagagaguacacccacagcgugauccacacccacagcaucagcgaguaccagagagacuacaccggcgagcagcuguacgagugccccaagugcggcgagagcuucauccacagcagcuuccuguucgagcaccagagaauccacgagcaggaccagcuguacagcaugaagggcugcgacgacggcuucaucgcccugcugcccaugaagcccagaagaaacagagccgccgagagaaaccccgcccuggccggcagcgccaucagaugccugcugugcggccagggcuucauccacagcagcgcccugaacgagcacaugagacugcacagagaggacgaccugcuggagcagagccagauggccgaggaggccaucauccccggccuggcccugaccgaguuccagagaagccagaccgaggagagacuguucgagugcgccgugugcggcgagagcuucgugaaccccgccgagcuggccgaccacgugaccgugcacaagaacgagcccuacgaguacggcagcagcuacacccacaccagcuuccugaccgagccccugaagggcgccauccccuucuacgagugcaaggacugcggcaagagcuucauccacagcaccgugcugaccaagcacaaggagcugcaccuggaggaggaggaggaggacgaggccgccgccgccgccgccgccgccgcccaggagguggaggccaacgugcacgugccccagguggugcugagaauccagggccugaacguggaggccgccgagcccgagguggaggccgccgagcccgagguggaggccgccgagcccgagguggaggccgccgagcccaacggcgaggccgagggccccgacggcgaggccgccgagcccaucggcgaggccggccagcccaacggcgaggccgagcagcccaacggcgacgccgacgagcccgacggcgccggcaucgaggaccccgaggagagagccgaggagcccgagggcaaggccgaggagcccgagggcgacgccgacgagcccgacggcgugggcaucgaggaccccgaggagggcgaggaccaggagauccagguggaggagcccuacuacgacugccacgagugcaccgagaccuucaccagcagcaccgccuucagcgagcaccugaagacccacgccagcaugaucaucuucgagcccgccaacgccuucggcgagugcagcggcuacaucgagagagccagcaccagcaccggcggcgccaaccaggccgacgagaaguacuucaagugcgacgugugcggccagcuguucaacgacagacugagccuggccagacaccagaacacccacaccggcuaa

SEQ ID NO: 21382 - RNA, 1257 nt, Artificial Sequence
  PELI1__Homo_sapiens__XP_011531296
auguucagccccgaccaggagaaccaccccagcaaggcccccgugaaguacggcgagcugaucgugcugggcuacaacggcagccugcccaacggcgacagaggcagaagaaagagcagauucgcccuguucaagagacccaaggccaacggcgugaagcccagcaccgugcacaucgccugcaccccccaggccgccaaggccaucagcaacaaggaccagcacagcaucagcuacacccugagcagagcccagaccguggugguggaguacacccacgacagcaacaccgacauguuccagaucggcagaagcaccgagagccccaucgacuucguggugaccgacaccgugcccggcagccagagcaacagcgacacccagagcgugcagagcaccaucagcagauucgccugcagaaucaucugcgagagaaacccccccuucaccgccagaaucuacgccgccggcuucgacagcagcaagaacaucuuccugggcgagaaggccgccaaguggaagaccagcgacggccagauggacggccugaccaccaacggcgugcuggugaugcaccccagaaacggcuucaccgaggacagcaagcccggcaucuggagagagaucagcgugugcggcaacguguucagccugagagagaccagaagcgcccagcagagaggcaagaugguggagaucgagaccaaccagcugcaggacggcagccugaucgaccugugcggcgccacccugcuguggagaaccgccgagggccugagccacacccccaccgugaagcaccuggaggcccugagacaggagaucaacgccgccagaccccagugccccgugggcuucaacacccuggccuuccccagcaugaagagaaaggacgugguggacgagaagcagcccuggguguaccugaacugcggccacgugcacggcuaccacaacuggggcaacaaggaggagagagacggcaaggacagagagugccccaugugcagaagcgugggccccuacgugccccuguggcugggcugcgaggccggcuucuacguggacgccggcccccccacccacgccuucagccccugcggccacgugugcagcgagaagaccaccgccuacuggagccagaucccccugccccacggcacccacaccuuccacgccgccugccccuucugcgcccaccagcuggccggcgagcagggcuacaucagacugaucuuccagggcccccuggacuaa

SEQ ID NO: 21383 - RNA, 1263 nt, Artificial Sequence
  PELI2__Homo_sapiens__NP_067078
auguucagccccggccaggaggagcacugcgcccccaacaaggagcccgugaaguacggcgagcugguggugcugggcuacaacggcgcccugcccaacggcgacagaggcagaagaaagagcagauucgcccuguacaagagacccaaggccaacggcgugaagcccagcaccgugcacgugaucagcaccccccaggccagcaaggccaucagcugcaagggccagcacagcaucagcuacacccugagcagaaaccagaccguggugguggaguacacccacgacaaggacaccgacauguuccaggugggcagaagcaccgagagccccaucgacuucguggugaccgacaccaucagcggcagccagaacaccgacgaggcccagaucacccagagcaccaucagcagauucgccugcagaaucgugugcgacagaaacgagcccuacaccgccagaaucuucgccgccggcuucgacagcagcaagaacaucuuccugggcgagaaggccgccaaguggaagaaccccgacggccacauggacggccugaccaccaacggcgugcuggugaugcaccccagaggcggcuucaccgaggagagccagcccggcguguggagagagaucagcgugugcggcgacguguacacccugagagagaccagaagcgcccagcagagaggcaagcugguggagagcgagaccaacgugcugcaggacggcagccugaucgaccugugcggcgccacccugcuguggagaaccgccgacggccuguuccacacccccacccagaagcacaucgaggcccugagacaggagaucaacgccgccagaccccagugccccgugggccugaacacccuggccuuccccagcaucaacagaaaggaggugguggaggagaagcagcccugggccuaccugagcugcggccacgugcacggcuaccacaacuggggccacagaagcgacaccgaggccaacgagagagagugccccaugugcagaaccgugggccccuacgugccccuguggcugggcugcgaggccggcuucuacguggacgccggcccccccacccacgccuucacccccugcggccacgugugcagcgagaagagcgccaaguacuggagccagaucccccugccccacggcacccacgccuuccacgccgccugccccuucugcgccacccagcuggugggcgagcagaacugcaucaagcugaucuuccagggccccaucgacuaa

SEQ ID NO: 21384 - RNA, 2721 nt, Artificial Sequence
  PELP1__Homo_sapiens__NP_001265170
auggagcuggccguggccgugcugagagaccugcugagauacgccgcccagcugcccgcccuguucagagacaucagcaugaaccaccugcccggccugcugaccagccugcugggccugagacccgagugcgagcagagcgcccuggagggcaugaaggccugcaugaccuacuuccccagagccugcggcagccugaagggcaagcuggccagcuucuuccugagcagaguggacgcccugagcccccagcugcagcagcuggccugcgagugcuacagcagacugcccagccugggcgccggcuucagccagggccugaagcacaccgagagcugggagcaggagcugcacagccugcuggccagccugcacacccugcugggcgcccuguacgagggcgccgagaccgcccccgugcagaacgagggccccggcguggagaugcugcugagcagcgaggacggcgacgcccacgugcugcugcagcugagacagagauucagcggccuggccagaugccugggccugaugcugagcagcgaguucggcgcccccgugagcgugcccgugcaggagauccuggacuucaucugcagaacccugagcgugagcagcaagaacaucagccugcacggcgacggcccccugagacugcugcugcugcccagcauccaccuggaggcccuggaccugcugagcgcccugauccuggccugcggcagcagacugcugagauucggcauccugaucggcagacugcugccccaggugcugaacagcuggagcaucggcagagacagccugagccccggccaggagagacccuacagcaccgugagaaccaagguguacgccauccuggagcugugggugcaggugugcggcgccagcgccggcaugcugcagggcggcgccagcggcgaggcccugcugacccaccugcugagcgacaucagcccccccgccgacgcccugaagcugagaagccccagaggcagccccgacggcagccugcagaccggcaagcccagcgcccccaagaagcugaagcuggacgugggcgaggccauggccccccccagccacagaaagggcgacagcaacgccaacagcgacgugugcgccgccgcccugagaggccugagcagaaccauccugaugugcggcccccugaucaaggaggagacccacagaagacugcacgaccuggugcugccccuggugaugggcgugcagcagggcgaggugcugggcagcagccccuacaccagcagcagaugcagaagagagcuguacugccugcugcuggcccugcugcuggcccccagccccagaugcccccccccccuggccugcgcccugcaggccuucagccugggccagagagaggacagccuggaggugagcagcuucugcagcgaggcccuggugaccugcgccgcccugacccaccccagagugcccccccugcagcccaugggccccaccugccccacccccgcccccgugcccccccccgaggcccccagccccuucagagccccccccuuccacccccccggccccaugcccagcgugggcagcaugcccagcgccggccccaugcccagcgccggccccaugcccagcgccggccccgugcccagcgccagacccggcccccccaccaccgccaaccaccugggccugagcgugcccggccuggugagcgugccccccagacugcugcccggccccgagaaccacagagccggcagcaacgaggaccccauccuggcccccagcggcacccccccccccaccaucccccccgacgagaccuucggcggcagagugcccagacccgccuucgugcacuacgacaaggaggaggccagcgacguggagaucagccuggagagcgacagcgacgacagcguggugaucgugcccgagggccugcccccccugcccccccccccccccagcggcgccacccccccccccaucgcccccaccggcccccccaccgccagcccccccgugcccgccaaggaggagcccgaggagcugcccgccgcccccggcccccugcccccccccccccccccccccccccccgugcccggccccgugacccugccccccccccagcuggugcccgagggcacccccggcggcggcggcccccccgcccuggaggaggaccugaccgugaucaacaucaacagcagcgacgaggaggaggaggaggaggaggaggaggaggaggaggaggaggaggaggaggaggaggaggaggacuucgaggaggaggaggaggacgaggaggaguacuucgaggaggaggaggaggaggaggaggaguucgaggaggaguucgaggaggaggagggcgagcuggaggaggaggaggaggaggaggacgaggaggaggaggaggagcuggaggagguggagagagagggcgagagccccgccgccggcccccccccccaggagcugguggaggaggagcccagcgccccccccacccugcuggaggaggagaccgaggacggcagcgacaaggugcagcccccccccgagacccccgccgaggaggagauggagaccgagaccgaggccgaggcccugcaggagaaggagcaggacgacaccgccgccaugcuggccgacuucaucgacugcccccccgacgacgagaagccccccccccccaccgagcccgacagcuaa

SEQ ID NO: 21385 - RNA, 645 nt, Artificial Sequence
  PEMT__Homo_sapiens__NP_001254480
augaagagaagcggcaaccccggcgccgaggccgacuucugcgugaugaccagacugcugggcuacguggacccccuggaccccagcuucguggccgccgugaucaccaucaccuucaacccccuguacuggaacgugguggccagaugggagcacaagaccagaaagcugagcagagccuucggcagccccuaccuggccugcuacagccugagcgugaccauccugcugcugaacuuccugagaagccacugcuucacccaggccaugcugagccagcccagaauggagagccuggacacccccgccgccuacagccugggccuggcccugcugggccugggcguggugcuggugcugagcagcuucuucgcccugggcuucgccggcaccuuccugggcgacuacuucggcauccugaaggaggccagagugaccguguuccccuucaacauccuggacaaccccauguacuggggcagcaccgccaacuaccugggcugggccaucaugcacgccagccccaccggccugcugcugaccgugcugguggcccugaccuacaucguggcccugcuguacgaggagcccuucaccgccgagaucuacagacagaaggccagcggcagccacaagagaagcuaa

SEQ ID NO: 21386 - RNA, 804 nt, Artificial Sequence
  PENK__Homo_sapiens__NP_001129162
auggccagauuccugacccugugcaccuggcugcugcugcugggccccggccugcuggccaccgugagagccgagugcagccaggacugcgccaccugcagcuacagacuggugagacccgccgacaucaacuuccuggccugcgugauggagugcgagggcaagcugcccagccugaagaucugggagaccugcaaggagcugcugcagcugagcaagcccgagcugccccaggacggcaccagcacccugagagagaacagcaagcccgaggagagccaccugcuggccaagagauacggcggcuucaugaagagauacggcggcuucaugaagaagauggacgagcuguaccccauggagcccgaggaggaggccaacggcagcgagauccuggccaagagauacggcggcuucaugaagaaggacgccgaggaggacgacagccuggccaacagcagcgaccugcugaaggagcugcuggagaccggcgacaacagagagagaagccaccaccaggacggcagcgacaacgaggaggaggugagcaagagauacggcggcuucaugagaggccugaagagaagcccccagcuggaggacgaggccaaggagcugcagaagagauacggcggcuucaugagaagagugggcagacccgagugguggauggacuaccagaagagauacggcggcuuccugaagagauucgccgaggcccugcccagcgacgaggagggcgagagcuacagcaaggaggugcccgagauggagaagagauacggcggcuucaugagauucuaa

SEQ ID NO: 21387 - RNA, 1482 nt, Artificial Sequence
  PEPD__Homo_sapiens__NP_000276
auggccgccgccaccggccccagcuucuggcugggcaacgagacccugaaggugccccuggcccuguucgcccugaacagacagagacugugcgagagacugagaaagaaccccgccgugcaggccggcagcaucguggugcugcagggcggcgaggagacccagagauacugcaccgacaccggcgugcuguucagacaggagagcuucuuccacugggccuucggcgugaccgagcccggcugcuacggcgugaucgacguggacaccggcaagagcacccuguucgugcccagacugcccgccagccacgccaccuggaugggcaagauccacagcaaggagcacuucaaggagaaguacgccguggacgacgugcaguacguggacgagaucgccagcgugcugaccagccagaagcccagcgugcugcugacccugagaggcgugaacaccgacagcggcagcgugugcagagaggccagcuucgacggcaucagcaaguucgaggugaacaacaccauccugcaccccgagaucguggagugcagaguguucaagaccgacauggagcuggaggugcugagauacaccaacaagaucagcagcgaggcccacagagaggugaugaaggccgugaaggugggcaugaaggaguacgagcuggagagccuguucgagcacuacugcuacagcagaggcggcaugagacacagcagcuacaccugcaucugcggcagcggcgagaacagcgccgugcugcacuacggccacgccggcgcccccaacgacagaaccauccagaacggcgacaugugccuguucgacaugggcggcgaguacuacugcuucgccagcgacaucaccugcagcuuccccgccaacggcaaguucaccgccgaccagaaggccguguacgaggccgugcugagaagcagcagagccgugaugggcgccaugaagcccggcgugugguggcccgacaugcacagacuggccgacagaauccaccuggaggagcuggcccacaugggcauccugagcggcagcguggacgccauggugcaggcccaccugggcgccguguucaugccccacggccugggccacuuccugggcaucgacgugcacgacgugggcggcuaccccgagggcguggagagaaucgacgagcccggccugagaagccugagaaccgccagacaccugcagcccggcauggugcugaccguggagcccggcaucuacuucaucgaccaccugcuggacgaggcccuggccgaccccgccagagccagcuuccugaacagagaggugcugcagagauucagaggcuucggcggcgugagaaucgaggaggacgugguggugaccgacagcggcaucgagcugcugaccugcgugcccagaaccguggaggagaucgaggccugcauggccggcugcgacaaggccuucacccccuucagcggccccaaguaa

SEQ ID NO: 21388 - RNA, 3873 nt, Artificial Sequence
  PER1__Homo_sapiens__NP_002607
augagcggcccccuggagggcgccgacggcggcggcgaccccagacccggcgagagcuucugccccggcggcgugcccagccccggccccccccagcacagacccugccccggccccagccuggccgacgacaccgacgccaacagcaacggcagcagcggcaacgagagcaacggccacgagagcagaggcgccagccagagaagcagccacagcagcagcagcggcaacggcaaggacagcgcccugcuggagaccaccgagagcagcaagagcaccaacagccagagccccagcccccccagcagcagcaucgccuacagccugcugagcgccagcagcgagcaggacaaccccagcaccagcggcugcagcagcgagcagagcgccagagccagaacccagaaggagcugaugaccgcccugagagagcugaagcugagacugccccccgagagaagaggcaagggcagaagcggcacccuggccacccugcaguacgcccuggccugcgugaagcaggugcaggccaaccaggaguacuaccagcaguggagccuggaggagggcgagcccugcagcauggacaugagcaccuacacccuggaggagcuggagcacaucaccagcgaguacacccugcagaaccaggacaccuucagcguggccgugagcuuccugaccggcagaaucguguacaucagcgagcaggccgccgugcugcugagaugcaagagagacguguucagaggcaccagauucagcgagcugcuggccccccaggacgugggcguguucuacggcagcaccgcccccagcagacugcccaccuggggcaccggcgccagcgccggcagcggccugagagacuucacccaggagaagagcguguucugcagaaucagaggcggccccgacagagaccccggccccagauaccagcccuucagacugacccccuacgugaccaagaucagagugagcgacggcgcccccgcccagcccugcugccugcugaucgccgagagaauccacagcggcuacgaggcccccagaaucccccccgacaagagaaucuucaccaccagacacacccccagcugccuguuccaggacguggacgagagagccgccccccugcugggcuaccugccccaggaccugcugggcgcccccgugcugcuguuccugcaccccgaggacagaccccugaugcuggccauccacaagaagauccugcagcuggccggccagcccuucgaccacagccccaucagauucugcgccagaaacggcgaguacgugaccauggacaccagcugggccggcuucgugcaccccuggagcagaaagguggccuucgugcugggcagacacaaggugagaaccgccccccugaacgaggacguguucaccccccccgcccccagccccgcccccagccuggacaccgacauccaggagcugagcgagcagauccacagacugcugcugcagcccgugcacagccccagccccaccggccugugcggcgugggcgccgugaccagccccggcccccugcacagccccggcagcagcagcgacagcaacggcggcgacgccgagggccccggcccccccgcccccgugaccuuccagcagaucugcaaggacgugcaccuggugaagcaccagggccagcagcuguucaucgagagcagagccagaccccagagcagacccagacugcccgccaccggcaccuucaaggccaaggcccugcccugccagagccccgaccccgagcuggaggccggcagcgcccccgugcaggccccccuggcccuggugcccgaggaggccgagagaaaggaggccagcagcugcagcuaccagcagaucaacugccuggacagcauccugagauaccuggagagcugcaaccugcccagcaccaccaagagaaagugcgccagcagcagcagcuacaccaccagcagcgccagcgacgacgacagacagagaaccggccccgugagcgugggcaccaagaaggacccccccagcgccgcccugagcggcgagggcgccacccccagaaaggagcccguggugggcggcacccugagcccccuggcccuggccaacaaggccgagagcguggugagcgugaccagccagugcagcuucagcagcaccaucgugcacgugggcgacaagaagccccccgagagcgacaucaucaugauggaggaccugcccggccuggcccccggccccgcccccagccccgcccccagccccaccguggcccccgaccccgcccccgacgccuacagacccgugggccugaccaaggccgugcugagccugcacacccagaaggaggagcaggccuuccugagcagauucagagaccugggcagacugagaggccuggacagcagcagcaccgcccccagcgcccugggcgagagaggcugccaccacggccccgccccccccagcagaagacaccacugcagaagcaaggccaagagaagcagacaccaccagaaccccagagccgaggcccccugcuacgugagccaccccagccccgugccccccagcacccccuggcccaccccccccgccaccacccccuuccccgccguggugcagcccuacccccugcccguguucagccccagaggcggcccccagccccugccccccgcccccaccagcgugccccccgccgccuuccccgccccccuggugacccccaugguggcccuggugcugcccaacuaccuguuccccacccccagcagcuaccccuacggcgcccugcagacccccgccgagggcccccccacccccgccagccacagccccagccccagccugcccgcccuggcccccagccccccccacagacccgacagcccccuguucaacagcagaugcagcagcccccugcagcugaaccugcugcagcuggaggagcugcccagagccgagggcgccgccguggccggcggccccggcagcagcgccggcccccccccccccagcgccgaggccgccgagcccgaggccagacuggccgaggugaccgagagcagcaaccaggacgcccugagcggcagcagcgaccugcuggagcugcugcugcaggaggacagcagaagcggcaccggcagcgccgccagcggcagccugggcagcggccugggcagcggcagcggcagcggcagccacgagggcggcagcaccagcgccagcaucaccagaagcagccagagcagccacaccagcaaguacuucggcagcaucgacagcagcgaggccgaggccggcgccgccagaggcggcgccgagcccggcgaccaggugaucaaguacgugcugcaggaccccaucuggcugcugauggccaacgccgaccagagagugaugaugaccuaccaggugcccagcagagacaugaccagcgugcugaagcaggacagagagagacugagagccaugcagaagcagcagcccagauucagcgaggaccagagaagagagcugggcgccgugcacagcugggugagaaagggccagcugcccagagcccuggacgugauggccugcguggacugcggcagcagcacccaggaccccggccaccccgacgacccccuguucagcgagcuggacggccugggccuggagcccauggaggagggcggcggcgagcagggcagcagcggcggcggcagcggcgagggcgagggcugcgaggaggcccagggcggcgccaaggccagcagcagccaggaccuggccauggaggaggaggaggagggcagaagcagcagcagccccgcccugcccaccgccggcaacugcaccagcuaa

SEQ ID NO: 21389 - RNA, 3768 nt, Artificial Sequence
  PER2__Homo_sapiens__NP_073728
augaacggcuacgccgaguucccccccagccccagcaaccccaccaaggagcccguggagccccagcccagccaggugccccugcaggaggacguggacaugagcagcggcagcagcggccacgagaccaacgagaacugcagcaccggcagagacagccagggcagcgacugcgacgacagcggcaaggagcugggcaugcugguggagccccccgacgccagacagagccccgacaccuucagccugaugauggccaagagcgagcacaaccccagcaccagcggcugcagcagcgaccagagcagcaagguggacacccacaaggagcugaucaagacccugaaggagcugaaggugcaccugcccgccgacaagaaggccaagggcaaggccagcacccuggccacccugaaguacgcccugagaagcgugaagcaggugaaggccaacgaggaguacuaccagcugcugaugagcagcgagggccaccccugcggcgccgacgugcccagcuacaccguggaggagauggagagcgugaccagcgagcacaucgugaagaacgccgacauguucgccguggccgugagccuggugagcggcaagauccuguacaucagcgaccagguggccagcaucuuccacugcaagagagacgccuucagcgacgccaaguucguggaguuccuggccccccacgacgugggcguguuccacagcuucaccagccccuacaagcugccccuguggagcaugugcagcggcgccgacagcuucacccaggagugcauggaggagaagagcuucuucugcagagugagcgugagaaagagccacgagaacgagaucagauaccaccccuucagaaugacccccuaccuggugaaggugagagaccagcagggcgccgagagccagcugugcugccugcugcuggccgagagagugcacagcggcuacgaggcccccagaaucccccccgagaagagaaucuucaccaccacccacacccccaacugccuguuccaggacguggacgagagagccgugccccugcugggcuaccugccccaggaccugaucgagacccccgugcuggugcagcugcaccccagcgacagaccccugaugcuggccauccacaagaagauccugcagagcggcggccagcccuucgacuacagccccaucagauucagagccagaaacggcgaguacaucacccuggacaccagcuggagcagcuucaucaaccccuggagcagaaagaucagcuucaucaucggcagacacaaggugagagugggcccccugaacgaggacguguucgccgcccaccccugcaccgaggagaaggcccugcaccccagcauccaggagcugaccgagcagauccacagacugcugcugcagcccgugccccacagcggcagcagcggcuacggcagccugggcagcaacggcagccacgagcaccugaugagccagaccagcagcagcgacagcaacggccacgaggacagcagaagaagaagagccgagaucugcaagaacggcaacaagaccaagaacagaagccacuacagccacgagagcggcgagcagaagaagaagagcgugaccgagaugcagaccaacccccccgccgagaagaaggccgugcccgccauggagaaggacagccugggcgugagcuuccccgaggagcuggccugcaagaaccagcccaccugcagcuaccagcagaucagcugccuggacagcgugaucagauaccuggagagcugcaacgaggccgccacccugaagagaaagugcgaguuccccgccaacgugcccgcccugagaagcagcgacaagagaaaggccaccgugagccccggcccccacgccggcgaggccgagccccccagcagagugaacagcagaaccggcgugggcacccaccugaccagccuggcccugcccggcaaggccgagagcguggccagccugaccagccagugcagcuacagcagcaccaucgugcacgugggcgacaagaagccccagcccgagcuggagaugguggaggacgccgccagcggccccgagagccuggacugccuggccggccccgcccuggccugcggccugagccaggagaaggagcccuucaagaagcugggccugaccaaggaggugcuggccgcccacacccagaaggaggagcagagcuuccugcagaaguucaaggagaucagaaagcugagcaucuuccagagccacugccacuacuaccugcaggagagaagcaagggccagcccagcgagagaaccgcccccggccugagaaacaccagcggcaucgacagccccuggaagaagaccggcaagaacagaaagcugaagagcaagagagugaagcccagagacagcagcgagagcaccggcagcggcggccccgugagcgccagacccccccuggugggccugaacgccaccgccuggagccccagcgacaccagccagagcagcugccccgccgugcccuuccccgcccccgugcccgccgccuacagccugcccguguuccccgcccccggcaccguggccgccccccccgcccccccccacgccagcuucaccgugcccgccgugcccguggaccugcagcaccaguucgccgugcagcccccccccuuccccgccccccuggcccccgugauggccuucaugcugcccagcuacagcuuccccagcggcacccccaaccugccccaggccuucuuccccagccagccccaguuccccagccaccccacccugaccagcgagauggccagcgccagccagcccgaguuccccagcagaaccagcauccccagacagcccugcgccugccccgccaccagagccaccccccccagcgccaugggcagagccagccccccccuguuccagagcagaagcagcagcccccugcagcugaaccugcugcagcuggaggaggcccccgagggcggcaccggcgccaugggcaccaccggcgccaccgagaccgccgccgugggcgccgacugcaagcccggcaccagcagagaccagcagcccaaggccccccugaccagagacgagcccagcgacacccagaacagcgacgcccugagcaccagcagcggccugcugaaccugcugcugaacgaggaccugugcagcgccagcggcagcgccgccagcgagagccugggcagcggcagccugggcugcgacgccagccccagcggcgccggcagcagcgacaccagccacaccagcaaguacuucggcagcaucgacagcagcgagaacaaccacaaggccaagaugaacaccggcauggaggagagcgagcacuucaucaagugcgugcugcaggaccccaucuggcugcugauggccgacgccgacagcagcgugaugaugaccuaccagcugcccagcagaaaccuggaggccgugcugaaggaggacagagagaagcugaagcugcugcagaagcugcagcccagauucaccgagagccagaagcaggagcugagagaggugcaccaguggaugcagaccggcggccugcccgccgccaucgacguggccgagugcguguacugcgagaacaaggagaagggcaacaucugcauccccuacgaggaggacauccccagccugggccugagcgaggugagcgacaccaaggaggacgagaacggcagcccccugaaccacagaaucgaggagcagaccuaa

SEQ ID NO: 21390 - RNA, 3576 nt, Artificial Sequence
  PER3__Homo_sapiens__NP_001276790
augcccagaggcgaggcccccggccccggcagaagaggcgccaaggacgaggcccugggcgaggagagcggcgagagauggagccccgaguuccaccugcagagaaagcuggccgacagcagccacagcgagcagcaggacagaaacagagugagcgaggagcugaucaugguggugcaggagaugaagaaguacuuccccagcgagagaagaaacaagcccagcacccuggacgcccugaacuacgcccugagaugcgugcacagcgugcaggccaacagcgaguucuuccagauccugagccagaacggcgccccccaggccgacgugagcauguacagccuggaggagcuggccaccaucgccagcgagcacaccagcaagaacaccgacaccuucguggccguguucagcuuccugagcggcagacuggugcacaucagcgagcaggccgcccugauccugaacagaaagaaggacgugcuggccagcagccacuucguggaccugcuggccccccaggacaugagaguguucuacgcccacaccgccagagcccagcugcccuucuggaacaacuggacccagagagccgccgccagauacgagugcgcccccgugaagcccuucuucugcagaaucagaggcggcgaggacagaaagcaggagaagugccacagccccuucagaaucauccccuaccugauccacgugcaccaccccgcccagcccgagcuggagagcgagcccugcugccugaccgugguggagaagauccacagcggcuacgaggcccccagaauccccgugaacaagagaaucuucaccaccacccacacccccggcugcguguuccuggagguggacgagaaggccgugccccugcugggcuaccugccccaggaccugaucggcaccagcauccugagcuaccugcaccccgaggacagaagccugaugguggccauccaccagaaggugcugaaguacgccggccacccccccuucgagcacagccccaucagauucugcacccagaacggcgacuacaucauccuggacagcagcuggagcagcuucgugaaccccuggagcagaaagaucagcuucaucaucggcagacacaaggugagaaccagcccccugaacgaggacguguucgccaccaagaucaagaagaugaacgacaacgacaaggacaucaccgagcugcaggagcagaucuacaagcugcugcugcagcccgugcacgugagcgugagcagcggcuacggcagccugggcagcagcggcagccaggagcagcuggugagcaucgccagcagcagcgaggccagcggccacagaguggaggagaccaaggccgagcagaugacccugcagcagguguacgccagcgugaacaagaucaagaaccugggccagcagcuguacaucgagagcaugaccaagagcagcuucaagcccgugaccggcaccagaaccgagcccaacggcggcggcgagagcgccaacggcggcggcgagugcaagaccuucaccagcuuccaccagacccugaagaacaacagcguguacaccgagcccugcgaggaccugagaaacgacgagcacagccccagcuaccagcagaucaacugcaucgacagcgugaucagauaccugaagagcuacaacauccccgcccugaagagaaagugcaucagcugcaccaacaccaccagcagcagcagcgaggaggacaagcagaaccacaaggccgacgacgugcaggcccugcaggccggccugcagauccccgccauccccaagagcgagaugcccaccaacggcagaagcaucgacaccggcggcggcgccccccagauccugagcaccgccaugcugagccugggcagcggcaucagccagugcggcuacagcagcaccaucgugcacgugcccccccccgagaccgccagagacgccacccuguucugcgagcccuggacccugaacaugcagcccgccccccugaccagcgaggaguucaagcacgugggccugaccgccgccgugcugagcgcccacacccagaaggaggagcagaacuacguggacaaguucagagagaagauccugagcagccccuacagcagcuaccugcagcaggagagcagaagcaaggccaaguacagcuacuuccagggcgacagcaccagcaagcagaccagaagcgccggcugcagaaagggcaagcacaagagaaagaagcugcccgagccccccgacagcagcagcagcaacaccggcagcggccccagaagaggcgcccaccagaacgcccagcccugcugccccagcgccgccagcagcccccacaccagcagccccaccuucccccccgccgccauggugcccagccaggcccccuaccuggugcccgccuucccccugcccgccgccaccagccccggcagagaguacgccgcccccggcaccgcccccgagggccugcacggccugccccugagcgagggccugcagcccuaccccgccuuccccuuccccuaccuggacaccuucaugaccguguuccugcccgacccccccgugugcccccugcugagccccagcuuccugcccugccccuuccugggcgccaccgccagcagcgccaucagccccagcaugagcagcgccaugagccccacccuggaccccccccccagcgugaccagccagagaagagaggaggagaagugggaggcccagagcgagggccaccccuucaucaccagcagaagcagcagcccccugcagcugaaccugcugcaggaggagaugcccagacccagcgagagccccgaccagaugagaagaaacaccugcccccagaccgaguacugcgugaccggcaacaacggcagcgagagcagccccgccaccaccggcgcccugagcaccggcagcccccccagagagaaccccagccaccccaccgccagcgcccugagcaccggcagcccccccaugaagaaccccagccaccccaccgccagcacccugagcaugggccugccccccagcagaacccccagccaccccaccgccaccgugcugagcaccggcagcccccccagcgagagccccagcagaaccggcagcgccgccagcggcagcagcgacagcagcaucuaccugaccagcagcguguacagcagcaagaucagccagaacggccagcagagccaggacgugcagaagaaggagaccuuccccaacguggccgaggagcccaucuggagaaugaucagacagacccccgagagaauccugaugaccuaccaggugcccgagagagugaaggagguggugcugaaggaggaccuggagaagcuggagagcaugagacagcagcagccccaguucagccacggccagaaggaggagcuggccaagguguacaacuggauccagagccagaccgugacccaggagaucgacauccaggccugcgugaccugcgagaacgaggacagcgccgacggcgccgccaccagcugcggccaggugcugguggaggacagcugcuaa

SEQ ID NO: 21391 - RNA, 2091 nt, Artificial Sequence
  PERM1__Homo_sapiens__NP_001278296
augcccacccaggacggccagcugagaagacccgccagaccccccggccccagagccuggauggagcccagaggcggcggcagcagccaguucagcagcugccccggccccgccagcagcggcgaccagaugcagagacugcugcagggccccgcccccagaccccccggcgagccccccggcagccccaagagccccggccacagcaccggcagccagagaccccccgacagccccggcgccccccccagaagccccagcagaaagaagagaagagccgugggcgccaagggcggcggccacaccggcgccagcgccagcgcccagaccggcagcccccugcugcccgccgccagccccgagaccgccaagcugauggccaaggccggccaggaggagcugggccccggccccgccggcgcccccgagcccggccccagaagccccgugcaggaggacagacccggccccggccugggccugagcacccccgugcccgugaccgagcagggcaccgaccagaucagaacccccagaagagccaagcugcacaccgugagcaccaccgugugggaggcccugcccgacgugagcagagccaagagcgacauggccgugagcacccccgccagcgagccccagcccgacagagacauggccgugagcacccccgccagcgagccccagagcgacagagacauggccgugagcacccccgccagcgagccccagcccgacaccgacauggccgugagcacccccgccagcgagccccagcccgacagagacauggccgugagcauccccgccagcaagccccagagcgacaccgccgugagcacccccgccagcgagccccagagcagcguggcccugagcacccccaucagcaagccccagcuggacaccgacguggccgugagcacccccgccagcaagcacggccuggacguggcccugcccaccgccggccccguggccaagcuggagguggccagcagcccccccgugagcgaggccgugcccagaaugaccgagagcagcggccuggugagcacccccgugcccagagccgacgccgccggccuggccuggccccccaccagaagagccggccccgacgugguggagauggaggccguggugagcgagcccagcgccggcgcccccggcugcugcagcggcgcccccgcccugggccugacccaggugcccagaaagaagaaggugagauucagcguggccggccccagccccaacaagcccggcagcggccaggccagcgccagacccagcgccccccagaccgccaccggcgcccacggcggccccggcgccugggaggccguggccgugggccccagaccccaccagcccagaauccugaagcaccugcccagacccccccccagcgccgugaccagagugggccccggcagcagcuucgccgugacccugcccgaggccuacgaguucuucuucugcgacaccaucgaggagaacgaggaggccgaggccgccgccgccggccaggaccccgccggcgugcaguggcccgacaugugcgaguucuucuuccccgacgugggcgcccagagaagcagaagaagaggcagccccgagccccugcccagagccgaccccgugcccgcccccauccccggcgaccccgugcccaucagcauccccgagguguacgagcacuucuucuucggcgaggacagacuggagggcgugcugggccccgccgugccccugccccugcaggcccuggagccccccagaagcgccagcgagggcgccggccccggcaccccccugaagcccgccgugguggagagacugcaccuggcccugagaagagccggcgagcugagaggccccgugcccagcuucgccuucagccagaacgacaugugccugguguucguggccuucgccaccugggccgugagaaccagcgacccccacacccccgacgccuggaagaccgcccugcuggccaacgugggcaccaucagcgccaucagauacuucagaagacaggugggccagggcagaagaagccacagccccagccccagcagcuaa

SEQ ID NO: 21392 - RNA, 582 nt, Artificial Sequence
  PERP__Homo_sapiens__NP_071404
augaucagaugcggccuggccugcgagagaugcagauggauccugccccugcugcugcugagcgccaucgccuucgacaucaucgcccuggccggcagaggcuggcugcagagcagcgaccacggccagaccagcagccugugguggaagugcagccaggagggcggcggcagcggcagcuacgaggagggcugccagagccugauggaguacgccuggggcagagccgccgccgccaugcuguucugcggcuucaucauccuggugaucugcuucauccugagcuucuucgcccugugcggcccccagaugcugguguuccugagagugaucggcggccugcuggcccuggccgccguguuccagaucaucagccuggugaucuaccccgugaaguacacccagaccuucacccugcacgccaaccccgccgugaccuacaucuacaacugggccuacggcuucggcugggccgccaccaucauccugaucggcugcgccuucuucuucugcugccugcccaacuacgaggacgaccugcugggcaacgccaagcccagauacuucuacaccagcgccuaa

SEQ ID NO: 21393 - RNA, 1752 nt, Artificial Sequence
  PES1__Homo_sapiens__NP_001230154
augggcggccuggagaagaagaaguacgagagaggcagcgccaccaacuacaucaccagaaacaaggccagaaagaagcugcagcugagccuggccgacuucagaagacugugcauccugaagggcaucuacccccacgagcccaagcacaagaagaaggugaacaagggcagcaccgccgccagaaccuucuaccugaucaaggacaucagauuccugcugcacgagcccaucgugaacaaguucagagaguacaagguguucgugagaaagcugagaaaggccuacggcaagagcgaguggaacaccguggagagacugaaggacaacaagcccaacuacaagcuggaccacaucaucaaggagagauaccccaccuucaucgacgcccugagagaccuggacgacgcccugagcaugugcuuccuguucagcaccuuccccagaaccggcaagugccacgugcagaccauccagcugugcagaagacugaccguggaguucaugcacuacaucaucgccgccagagcccugagaaagguguuccugagcaucaagggcaucuacuaccaggccgaggugcugggccagcccaucguguggaucacccccuacgccuucagccacgaccaccccaccgacguggacuacagagugauggccaccuucaccgaguucuacaccacccugcugggcuucgugaacuucagacuguaccagcugcugaaccugcacuacccccccaagcuggagggccaggcccaggccgaggccaaggccggcgagggcaccuacgcccuggacagcgagagcugcauggagaagcuggccgcccugagcgccagccuggccagagugguggugcccgccaccgaggaggaggccgagguggacgaguuccccaccgacggcgaggaggacagaagaaaggagcuggaggcccaggagaagcacaagaagcuguucgagggccugaaguucuuccugaacagagaggugcccagagaggcccuggccuucaucaucagaagcuucggcggcgaggugagcugggacaagagccugugcaucggcgccaccuacgacgugaccgacagcagaaucacccaccagaucguggacagacccggccagcagaccagcgugaucggcagaugcuacgugcagccccaguggguguucgacagcgugaacgccagacugcugcugcccguggccgaguacuucagcggcgugcagcugcccccccaccugagccccuucgugaccgagaaggagggcgacuacgugccccccgagaagcugaagcugcuggcccugcagagaggcgaggaccccggcaaccugaacgagagcgaggaggaggaggaggaggacgacaacaacgagggcgacggcgacgaggagggcgagaacgaggaggaggaggaggacgccgaggccggcagcgagaaggaggaggaggccagacuggccgcccuggaggagcagagaauggagggcaagaagcccagagugauggccggcacccugaagcuggaggacaagcagagacuggcccaggaggaggagagcgaggccaagagacuggccaucaugaugaugaagaagagagagaaguaccuguaccagaagaucauguucggcaagagaagaaagaucagagaggccaacaagcuggccgagaagagaaaggcccacgacgaggccgugagaagcgagaagaaggccaagaaggccagacccgaguaa

SEQ ID NO: 21394 - RNA, 222 nt, Artificial Sequence
  PET100__Homo_sapiens__NP_001164626
augggcgugaagcuggagaucuucagaaugaucaucuaccugaccuuccccguggccauguucugggugagcaaccaggccgagugguucgaggacgacgugauccagagaaagagagagcuguggccccccgagaagcugcaggagaucgaggaguucaaggagagacugagaaagagaagagaggagaagcugcugagagacgcccagcagaacagcuaa

SEQ ID NO: 21395 - RNA, 246 nt, Artificial Sequence
  PET117__Homo_sapiens__NP_001158283
augagcagaagcagcaagguggugcugggccugagcgugcugcugaccgccgccaccguggccggcgugcacgugaagcagcagugggaccagcagagacugagagacggcgugaucagagacaucgagagacagaucagaaagaaggagaacaucagacugcugggcgagcagaucauccugaccgagcagcuggaggccgagagagagaagaugcugcuggccaagggcagccagaagagcuaa

SEQ ID NO: 21396 - RNA, 744 nt, Artificial Sequence
  PEX11A__Homo_sapiens__NP_003838
auggacgccuucaccagauucaccaaccagacccagggcagagacagacuguucagagccacccaguacaccugcaugcugcugagauaccugcuggagcccaaggccggcaaggagaagguggugaugaagcugaagaagcuggagagcagcgugagcaccggcagaaagugguucagacugggcaacguggugcacgccauccaggccaccgagcagagcauccacgccaccgaccuggugcccagacugugccugacccuggccaaccugaacagagugaucuacuucaucugcgacaccauccugugggugagaagcgugggccugaccagcggcaucaacaaggagaaguggagaaccagagccgcccaccacuacuacuacagccugcugcugagccuggugagagaccuguacgagaucagccugcagaugaagagagugaccugcgacagagccaagaaggagaagagcgccagccaggacccccugugguucagcguggccgaggaggagaccgaguggcugcagagcuuccugcugcugcuguucagaagccugaagcagcaccccccccugcugcuggacaccgugaagaaccugugcgacauccugaacccccuggaccagcugggcaucuacaagagcaaccccggcaucaucggccugggcggccuggugagcagcaucgccggcaugaucaccguggccuacccccagaugaagcugaagaccagauaa

SEQ ID NO: 21397 - RNA, 1080 nt, Artificial Sequence
  PEX12__Homo_sapiens__NP_000277
auggccgagcacggcgcccacuucaccgccgccagcguggccgacgaccagcccagcaucuucgaggugguggcccaggacagccugaugaccgccgugagacccgcccugcagcacguggugaaggugcuggccgagagcaaccccacccacuacggcuuccuguggagaugguucgacgagaucuucacccugcuggaccugcugcugcagcagcacuaccugagcagaaccagcgccagcuucagcgagaacuucuacggccugaagagaaucgugaugggcgacacccacaagagccagagacuggccagcgccggccugcccaagcagcagcuguggaagagcaucauguuccuggugcugcugcccuaccugaaggugaagcuggagaagcuggugagcagccugagagaggaggacgaguacagcauccacccccccagcagcagauggaagagauucuacagagccuuccuggccgccuaccccuucgugaacauggccugggagggcugguuccuggugcagcagcugagauacauccugggcaaggcccagcaccacagcccccugcugagacuggccggcgugcagcugggcagacugaccgugcaggacauccaggcccuggagcacaagcccgccaaggccagcaugaugcagcagcccgccagaagcgugagcgagaagaucaacagcgcccugaagaaggccgugggcggcguggcccugagccugagcaccggccugagcgugggcguguucuuccugcaguuccuggacuggugguacagcagcgagaaccaggagaccaucaagagccugaccgcccugcccaccccccccccccccgugcaccuggacuacaacagcgacagcccccugcugcccaagaugaagaccgugugcccccugugcagaaagaccagagugaacgacaccgugcuggccaccagcggcuacguguucugcuacagaugcguguuccacuacgugagaagccaccaggccugccccaucaccggcuaccccaccgaggugcagcaccugaucaagcuguacagccccgagaacuaa

SEQ ID NO: 21398 - RNA, 1212 nt, Artificial Sequence
  PEX13__Homo_sapiens__NP_002609
auggccagccagcccccccccccccccaagcccugggagaccagaagaauccccggcgccggccccggccccggccccggccccaccuuccagagcgccgaccugggccccacccugaugaccagacccggccagcccgcccugaccagagugcccccccccauccugcccagacccagccagcagaccggcagcagcagcgugaacaccuucagacccgccuacagcagcuucagcagcggcuacggcgccuacggcaacagcuucuacggcggcuacagccccuacagcuacggcuacaacggccugggcuacaacagacugagaguggacgaccugccccccagcagauucgugcagcaggccgaggagagcagcagaggcgccuuccagagcaucgagagcaucgugcacgccuucgccagcgugagcaugaugauggacgccaccuucagcgccguguacaacagcuucagagccgugcuggacguggccaaccacuucagcagacugaagauccacuucaccaagguguucagcgccuucgcccuggugagaaccaucagauaccuguacagaagacugcagagaaugcugggccugagaagaggcagcgagaacgaggaccugugggccgagagcgagggcaccguggccugccugggcgccgaggacagagccgccaccagcgccaagagcuggcccaucuuccuguucuucgccgugauccugggcggccccuaccugaucuggaagcugcugagcacccacagcgacgaggugaccgacagcaucaacugggccagcggcgaggacgaccacgugguggccagagccgaguacgacuucgccgccgugagcgaggaggagaucagcuucagagccggcgacaugcugaaccuggcccugaaggagcagcagcccaaggugagaggcuggcugcuggccagccuggacggccagaccaccggccugauccccgccaacuacgugaagauccugggcaagagaaagggcagaaagaccguggagagcagcaaggugagcaagcagcagcagagcuucaccaaccccacccugaccaagggcgccaccguggccgacagccuggacgagcaggaggccgccuucgagagcguguucguggagaccaacaaggugcccguggcccccgacagcaucggcaaggacggcgagaagcaggaccuguaa

SEQ ID NO: 21399 - RNA, 1077 nt, Artificial Sequence
  PEX14__Homo_sapiens__XP_011539880
augcugaacaagcugaucugccugaugaucgccaccgccgugaaguuccugcagaacagcagagugagacagagcccccuggccaccagaagagccuuccugaagaagaagggccugaccgacgaggagaucgacauggccuuccagcagagcggcaccgccgccgacgagcccagcagccugggccccgccacccagguggugcccgugcagcccccccaccugaucagccagcccuacagccccgccggcagcagauggagagacuacggcgcccuggccaucaucauggccggcaucgccuucggcuuccaccagcuguacaagaaguaccugcugccccugauccugggcggcagagaggacagaaagcagcuggagagaauggaggccggccugagcgagcugagcggcagcguggcccagaccgugacccagcugcagaccacccuggccagcgugcaggagcugcugauccagcagcagcagaagauccaggagcuggcccacgagcuggccgccgccaaggccaccaccagcaccaacuggauccuggagagccagaacaucaacgagcugaagagcgagaucaacagccugaagggccugcugcugaacagaagacaguucccccccagccccagcgcccccaagauccccagcuggcagauccccgugaagagccccagccccagcagccccgccgccgugaaccaccacagcagcagcgacaucagccccgugagcaacgagagcaccagcagcagccccggcaaggagggccacagccccgagggcagcaccgugaccuaccaccugcugggcccccaggaggagggcgagggcgugguggacgugaagggccaggugagaauggaggugcagggcgaggaggagaagagagaggacaaggaggacgaggaggacgaggaggacgacgacgugagccacguggacgaggaggacugccugggcgugcagagagaggacagaagaggcggcgacggccagaucaacgagcagguggagaagcugagaagacccgagggcgccagcaacgagagcgagagagacuaa

SEQ ID NO: 21400 - RNA, 1011 nt, Artificial Sequence
  PEX16__Homo_sapiens__NP_004804
auggagaagcugagacugcugggccugagauaccaggaguacgugaccagacaccccgccgccaccgcccagcuggagaccgccgugagaggcuucagcuaccugcuggccggcagauucgccgacagccacgagcugagcgagcugguguacagcgccagcaaccugcuggugcugcugaacgacggcauccugagaaaggagcugagaaagaagcugcccgugagccugagccagcagaagcugcugaccuggcugagcgugcuggagugcguggagguguucauggagaugggcgccgccaagguguggggcgaggugggcagauggcuggugaucgcccugauccagcuggccaaggccgugcugagaaugcugcugcugcugugguucaaggccggccugcagaccagcccccccaucgugccccuggacagagagacccaggcccagccccccgacggcgaccacagccccggcaaccacgagcagagcuacgugggcaagagaagcaacagaguggugagaacccugcagaacacccccagccugcacagcagacacuggggcgccccccagcagagagagggcagacagcagcagcaccacgaggagcugagcgccacccccaccccccugggccugcaggagaccaucgccgaguuccuguacaucgccagaccccugcugcaccugcugagccugggccuguggggccagagaagcuggaagcccuggcugcuggccggcgugguggacgugaccagccugagccugcugagcgacagaaagggccugaccagaagagagagaagagagcugagaagaagaaccauccugcugcuguacuaccugcugagaagccccuucuacgacagauucagcgaggccagaauccuguuccugcugcagcugcuggccgaccacgugcccggcgugggccuggugaccagaccccugauggacuaccugcccaccuggcagaagaucuacuucuacagcuggggcuaa

SEQ ID NO: 21401 - RNA, 840 nt, Artificial Sequence
  PEX19__Homo_sapiens__NP_001180573
auggccgccgccgaggagggcugcagcgugggcgccgaggccgacagagagcuggaggagcugcuggagagcgcccuggacgacuucgacaaggccaagcccagccccgccccccccagcaccaccaccgcccccgacgccagcggcccccagaagagaagccccggcgacaccgccaaggacgcccuguucgccagccaggagaaguucuuccaggagcuguucgacagcgagcuggccagccaggccaccgccgaguucgagaaggccaugaaggagcuggccgaggaggagccccaccugguggagcaguuccagaagcugagcgaggccgccggcagagugggcagcgacaugaccagccagcaggaguucaccagcugccugaaggagacccugagcggccuggccaagaacgccaccgaccugcagaacagcagcaugagcgaggaggagcugaccaaggccauggagggccugggcauggacgagggcgacggcgagggcaacauccugcccaucaugcagagcaucaugcagaaccugcugagcaaggacgugcuguaccccagccugaaggagaucaccgagaaguaccccgaguggcugcagagccacagagagagccugccccccgagcaguucgagaaguaccaggagcagcacagcgugaugugcaagaucugcgagcaguucgaggccgagacccccaccgacagcgagaccacccagaaggccagauucgagauggugcuggaccugaugcagcagcugcaggaccugggccacccccccaaggagcuggccggcgagauggugcccguggugaacagcguguaa

SEQ ID NO: 21402 - RNA, 3852 nt, Artificial Sequence
  PEX1__Homo_sapiens__NP_000457
auguggggcagcgacagacuggccggcgccggcggcggcggcgccgccgugaccguggccuucaccaacgccagagacugcuuccugcaccugcccagaagacugguggcccagcugcaccugcugcagaaccaggccaucgaggugguguggagccaccagcccgccuuccugagcuggguggagggcagacacuucagcgaccagggcgagaacguggccgagaucaacagacaggugggccagaagcugggccugagcaacggcggccagguguuccugaagcccugcagccacguggugagcugccagcagguggagguggagccccugagcgccgacgacugggagauccuggagcugcacgccgugagccuggagcagcaccugcuggaccagaucagaaucguguuccccaaggccaucuuccccguguggguggaccagcagaccuacaucuucauccagaucguggcccugauccccgccgccagcuacggcagacuggagaccgacaccaagcugcugauccagcccaagaccagaagagccaaggagaacaccuucagcaaggccgacgccgaguacaagaagcugcacagcuacggcagagaccagaagggcaugaugaaggagcugcagaccaagcagcugcagagcaacaccgugggcaucaccgagagcaacgagaacgagagcgagauccccguggacagcagcagcguggccagccuguggaccaugaucggcagcaucuucagcuuccagagcgagaagaagcaggagaccagcuggggccugaccgagaucaacgccuucaagaacaugcagagcaagguggugccccuggacaacaucuucagagugugcaagagccagccccccagcaucuacaacgccagcgccaccagcguguuccacaagcacugcgccauccacguguuccccugggaccaggaguacuucgacguggagcccagcuucaccgugaccuacggcaagcuggugaagcugcugagccccaagcagcagcagagcaagaccaagcagaacgugcugagccccgagaaggagaagcagaugagcgagccccuggaccagaagaagaucagaagcgaccacaacgaggaggacgagaaggccugcgugcugcaggugguguggaacggccuggaggagcugaacaacgccaucaaguacaccaagaacguggaggugcugcaccugggcaagguguggauccccgacgaccugagaaagagacugaacaucgagaugcacgccguggugagaaucacccccguggaggugacccccaagauccccagaagccugaagcugcagcccagagagaaccugcccaaggacaucagcgaggaggacaucaagaccguguucuacagcuggcugcagcagagcaccaccaccaugcugccccuggugaucagcgaggaggaguucaucaagcuggagaccaaggacggccugaaggaguucagccugagcaucgugcacagcugggagaaggagaaggacaagaacaucuuccugcugagccccaaccugcugcagaagaccaccauccaggugcugcuggaccccauggugaaggaggagaacagcgaggagaucgacuucauccugcccuuccugaagcugagcagccugggcggcgugaacagccugggcgugagcagccuggagcacaucacccacagccugcugggcagaccccugagcagacagcugaugagccugguggccggccugagaaacggcgcccugcugcugaccggcggcaagggcagcggcaagagcacccuggccaaggccaucugcaaggaggccuucgacaagcuggacgcccacguggagagaguggacugcaaggcccugagaggcaagagacuggagaacauccagaagacccuggagguggccuucagcgaggccguguggaugcagcccagcguggugcugcuggacgaccuggaccugaucgccggccugcccgccgugcccgagcacgagcacagccccgacgccgugcagagccagagacuggcccacgcccugaacgacaugaucaaggaguucaucagcaugggcagccugguggcccugaucgccaccagccagagccagcagagccugcacccccugcuggugagcgcccagggcgugcacaucuuccagugcgugcagcacauccagccccccaaccaggagcagagaugcgagauccugugcaacgugaucaagaacaagcuggacugcgacaucaacaaguucaccgaccuggaccugcagcacguggccaaggagaccggcggcuucguggccagagacuucaccgugcugguggacagagccauccacagcagacugagcagacagagcaucagcaccagagagaagcuggugcugaccacccuggacuuccagaaggcccugagaggcuuccugcccgccagccugagaagcgugaaccugcacaagcccagagaccugggcugggacaagaucggcggccugcacgaggugagacagauccugauggacaccauccagcugcccgccaaguaccccgagcuguucgccaaccugcccaucagacagagaaccggcauccugcuguacggcccccccggcaccggcaagacccugcuggccggcgugaucgccagagagagcagaaugaacuucaucagcgugaagggccccgagcugcugagcaaguacaucggcgccagcgagcaggccgugagagacaucuucaucagagcccaggccgccaagcccugcauccuguucuucgacgaguucgagagcaucgcccccagaagaggccacgacaacaccggcgugaccgacagaguggugaaccagcugcugacccagcuggacggcguggagggccugcagggcguguacgugcuggccgccaccagcagacccgaccugaucgaccccgcccugcugagacccggcagacuggacaagugcguguacugccccccccccgaccaggugagcagacuggagauccugaacgugcugagcgacagccugccccuggccgacgacguggaccugcagcacguggccagcgugaccgacagcuucaccggcgccgaccugaaggcccugcuguacaacgcccagcuggaggcccugcacggcaugcugcugagcagcggccugcaggacggcagcagcagcagcgacagcgaccugagccugagcagcaugguguuccugaaccacagcagcggcagcgacgacagcgccggcgacggcgagugcggccuggaccagagccuggugagccuggagaugagcgagauccugcccgacgagagcaaguucaacauguacagacuguacuucggcagcagcuacgagagcgagcugggcaacggcaccagcagcgaccugagcagccagugccugagcgcccccagcagcaugacccaggaccugcccggcgugcccggcaaggaccagcuguucagccagccccccgugcugagaaccgccagccaggagggcugccaggagcugacccaggagcagagagaccagcugagagccgacaucagcaucaucaagggcagauacagaagccagagcggcgaggacgagagcaugaaccagcccggccccaucaagaccagacuggccaucagccagagccaccugaugaccgcccugggccacaccagacccagcaucagcgaggacgacuggaagaacuucgccgagcuguacgagagcuuccagaaccccaagagaagaaagaaccagagcggcaccauguucagacccggccagaaggugacccuggccuaa

SEQ ID NO: 21403 - RNA, 918 nt, Artificial Sequence
  PEX26__Homo_sapiens__NP_001121121
augaagagcgacagcagcaccagcgccgccccccugagaggccugggcggcccccugagaagcagcgagcccgugagagccgugcccgccagagcccccgccguggaccugcuggaggaggccgccgaccugcugguggugcaccuggacuucagagccgcccuggagaccugcgagagagccuggcagagccuggccaaccacgccguggccgaggagcccgccggcaccagccuggaggugaagugcagccugugcguggugggcauccaggcccuggccgagauggacagauggcaggaggugcugagcugggugcugcaguacuaccaggugcccgagaagcugccccccaaggugcuggagcugugcauccugcuguacagcaagaugcaggagcccggcgccgugcuggacguggugggcgccuggcugcaggaccccgccaaccagaaccugcccgaguacggcgcccuggccgaguuccacgugcagagagugcugcugccccugggcugccugagcgaggccgaggagcugguggugggcagcgccgccuucggcgaggagagaagacuggacgugcugcaggccauccacaccgccagacagcagcagaagcaggagcacagcggcagcgaggaggcccagaagcccaaccuggagggcagcgugagccacaaguuccugagccugcccaugcuggugagacagcugugggacagcgccgugagccacuucuucagccugcccuucaagaagagccugcuggccgcccugauccugugccugcugguggugagauucgaccccgccagccccagcagccugcacuuccuguacaagcuggcccagcuguucagauggaucagaaaggccgccuucagcagacuguaccagcugagaaucagagacuaa

SEQ ID NO: 21404 - RNA, 918 nt, Artificial Sequence
  PEX2__Homo_sapiens__NP_001165558
auggccagcagaaaggagaacgccaagagcgccaacagagugcugagaaucagccagcuggacgcccuggagcugaacaaggcccuggagcagcugguguggagccaguucacccagugcuuccacggcuucaagcccggccugcuggccagauucgagcccgaggugaaggccugccuguggguguuccuguggagauucaccaucuacagcaagaacgccaccgugggccagagcgugcugaacaucaaguacaagaacgacuucagccccaaccugagauaccagccccccagcaagaaccagaagaucugguacgccgugugcaccaucggcggcagauggcuggaggagagaugcuacgaccuguucagaaaccaccaccuggccagcuucggcaaggugaagcagugcgugaacuucgugaucggccugcugaagcugggcggccugaucaacuuccugaucuuccugcagagaggcaaguucgccacccugaccgagagacugcugggcauccacagcguguucugcaagccccagaacaucagagaggugggcuucgaguacaugaacagagagcugcuguggcacggcuucgccgaguuccugaucuuccugcugccccugaucaacgugcagaagcugaaggccaagcugagcagcuggugcaucccccugaccggcgcccccaacagcgacaacacccuggccaccagcggcaaggagugcgcccugugcggcgaguggcccaccaugccccacaccaucggcugcgagcacaucuucugcuacuucugcgccaagagcagcuuccuguucgacguguacuucaccugccccaagugcggcaccgaggugcacagccugcagccccugaagagcggcaucgagaugagcgaggugaacgcccuguaa

SEQ ID NO: 21405 - RNA, 1122 nt, Artificial Sequence
  PEX3__Homo_sapiens__NP_003621
augcugagaagcguguggaacuuccugaagagacacaagaagaagugcaucuuccugggcaccgugcugggcggcguguacauccugggcaaguacggccagaagaagaucagagagauccaggagagagaggccgccgaguacaucgcccaggccagaagacaguaccacuucgagagcaaccagagaaccugcaacaugaccgugcugagcaugcugcccacccugagagaggcccugaugcagcagcugaacagcgagagccugaccgcccugcugaagaacagacccagcaacaagcuggagaucugggaggaccugaagaucaucagcuucaccagaagcaccguggccguguacagcaccugcaugcugguggugcugcugagagugcagcugaacaucaucggcggcuacaucuaccuggacaacgccgccgugggcaagaacggcaccaccauccuggccccccccgacgugcagcagcaguaccugagcagcauccagcaccugcugggcgacggccugaccgagcugaucaccgugaucaagcaggccgugcagaaggugcugggcagcgugagccugaagcacagccugagccugcuggaccuggagcagaagcugaaggagaucagaaaccugguggagcagcacaagagcagcagcuggaucaacaaggacggcagcaagccccugcugugccacuacaugaugcccgacgaggagaccccccuggccgugcaggccugcggccugagccccagagacaucaccaccaucaagcugcugaacgagaccagagacaugcuggagagccccgacuucagcaccgugcugaacaccugccugaacagaggcuucagcagacugcuggacaacauggccgaguucuucagacccaccgagcaggaccugcagcacggcaacagcaugaacagccugagcagcgugagccugccccuggccaagaucauccccaucgugaacggccagauccacagcgugugcagcgagacccccagccacuucgugcaggaccugcugaccauggagcaggugaaggacuucgccgccaacguguacgaggccuucagcaccccccagcagcuggagaaguaa

SEQ ID NO: 21406 - RNA, 1896 nt, Artificial Sequence
  PEX5__Homo_sapiens__NP_000310
auggccaugagagagcugguggaggccgagugcggcggcgccaacccccugaugaagcuggccggccacuucacccaggacaaggcccugagacaggagggccugagacccggccccuggccccccggcgcccccgccagcgaggccgccagcaagccccugggcguggccagcgaggacgagcugguggccgaguuccugcaggaccagaacgccccccuggugagcagagccccccagaccuucaagauggacgaccugcuggccgagaugcagcagaucgagcagagcaacuucagacaggccccccagagagcccccggcguggccgaccuggcccugagcgagaacugggcccaggaguuccuggccgccggcgacgccguggacgugacccaggacuacaacgagaccgacuggagccaggaguucaucagcgaggugaccgacccccugagcgugagccccgccagaugggccgaggaguaccuggagcagagcgaggagaagcuguggcugggcgagcccgagggcaccgccaccgacagaugguacgacgaguaccaccccgaggaggaccugcagcacaccgccagcgacuucguggccaagguggacgaccccaagcuggccaacagcgaguuccugaaguucgugagacagaucggcgagggccaggugagccuggagagcggcgccggcagcggcagagcccaggccgagcagugggccgccgaguucauccagcagcagggcaccagcgacgccuggguggaccaguucaccagacccgugaacaccagcgcccuggacauggaguucgagagagccaagagcgccaucgagcugcaggccgagcuggaggagauggccaagagagacgccgaggcccaccccuggcugagcgacuacgacgaccugaccagcgccaccuacgacaagggcuaccaguucgaggaggagaacccccugagagaccacccccagcccuucgaggagggccugagaagacugcaggagggcgaccugcccaacgccgugcugcuguucgaggccgccgugcagcaggaccccaagcacauggaggccuggcaguaccugggcaccacccaggccgagaacgagcaggagcugcuggccaucagcgcccugagaagaugccuggagcugaagcccgacaaccagaccgcccugauggcccuggccgugagcuucaccaacgagagccugcagagacaggccugcgagacccugagagacuggcugagauacacccccgccuacgcccaccuggugacccccgccgaggagggcgccggcggcgccggccugggccccagcaagagaauccugggcagccugcugagcgacagccuguuccuggaggugaaggagcuguuccuggccgccgugagacuggaccccaccagcaucgaccccgacgugcagugcggccugggcgugcuguucaaccugagcggcgaguacgacaaggccguggacugcuucaccgccgcccugagcgugagacccaacgacuaccugcuguggaacaagcugggcgccacccuggccaacggcaaccagagcgaggaggccguggccgccuacagaagagcccuggagcugcagcccggcuacaucagaagcagauacaaccugggcaucagcugcaucaaccugggcgcccacagagaggccguggagcacuuccuggaggcccugaacaugcagagaaagagcagaggccccagaggcgagggcggcgccaugagcgagaacaucuggagcacccugagacuggcccugagcaugcugggccagagcgacgccuacggcgccgccgacgccagagaccugagcacccugcugaccauguucggccugccccaguaa

SEQ ID NO: 21407 - RNA, 1875 nt, Artificial Sequence
  PEX5L__Homo_sapiens__NP_001243679
auguaccagggccacaugcagguggugggcgugacccugaagaagaaguggcacugccugcagaagagcgaccugacccuggcccugggcaagggcagcagagccgccgacaaggccguggccauggugaugaaggagauccccagagaggagagcgccgaggagaagccccugcugaccaugaccagccagcuggugaacgagcagcaggagagcagaccccugcugagccccagcaucgacgacuuccugugcgagaccaagagcgaggccaucgccagacccgugaccagcaacaccgccgugcugaccaccggccuggaccugcuggaccugagcgagcccgugagccagacccagaccaaggccaagaagagcgagcccagcagcaagaccagcagccugaagaagaaggccgacggcagcgaccugaucagcaccgacgccgagcagagaggccagccccugagagugcccgagaccagcagccuggaccuggacauccagacccagcuggagaagugggacgacgugaaguuccacggcgacagaaacaccaagggccaccccauggccgagagaaagagcagcagcagcagaaccggcagcaaggagcugcuguggagcagcgagcacagaagccagcccgagcugagcggcggcaagagcgcccugaacagcgagagcgccagcgagcuggagcugguggcccccacccaggccagacugaccaaggagcacagauggggcagcgcccugcugagcagaaaccacagccuggaggaggaguucgagagagccaaggccgccguggagagcgacaccgaguucugggacaagaugcaggccgagugggaggagauggccagaagaaacuggaucagcgagaaccaggaggcccagaaccaggugaccaucagcgccagcgagaagggcuacuacuuccacaccgagaaccccuucaaggacuggcccggcgccuucgaggagggccugaagagacugaaggagggcgaccugcccgugaccauccuguucauggaggccgccauccugcaggaccccggcgacgccgaggccuggcaguuccugggcaucacccaggccgagaacgagaacgagcaggccgccaucguggcccugcagagaugccuggagcugcagcccaacaaccugaaggcccugauggcccuggccgugagcuacaccaacaccggccaccagcaggacgccugcgacgcccugaagaacuggaucaagcagaaccccaaguacaaguaccuggugaagagcaagaagggcagccccggccugaccagaagaaugagcaagagccccguggacagcagcgugcuggagggcgugaaggagcuguaccuggaggccgcccaccagaacggcgacaugaucgaccccgaccugcagaccggccugggcgugcuguuccaccugagcggcgaguucaacagagccaucgacgccuucaacgccgcccugaccgugagacccgaggacuacagccuguggaacagacugggcgccacccuggccaacggcgacagaagcgaggaggccguggaggccuacaccagagcccuggagauccagcccggcuucaucagaagcagauacaaccugggcaucagcugcaucaaccugggcgccuacagagaggccgugagcaacuuccugaccgcccugagccugcagagaaagagcagaaaccagcagcaggugccccaccccgccaucagcggcaacaucugggccgcccugagaaucgcccugagccugauggaccagcccgagcuguuccaggccgccaaccugggcgaccuggacgugcugcugagagccuucaaccuggaccccuaa

SEQ ID NO: 21408 - RNA, 2943 nt, Artificial Sequence
  PEX6__Homo_sapiens__NP_000278
auggcccuggccgugcugagagugcuggagcccuuccccaccgagacccccccccuggccgugcugcugccccccggcggccccuggcccgccgccgagcugggccuggugcuggcccugagacccgccggcgagagccccgccggccccgcccugcugguggccgcccuggagggccccgacgccggcaccgaggagcagggccccggccccccccagcugcuggugagcagagcccugcugagacugcuggcccugggcagcggcgccugggugagagccagagccgugagaagaccccccgcccugggcugggcccugcugggcaccagccugggccccggccugggccccagagugggcccccugcuggugagaagaggcgagacccugcccgugcccggccccagagugcuggagaccagacccgcccugcagggccugcugggccccggcaccagacuggccgugaccgagcugagaggcagagccagacugugccccgagagcggcgacagcagcagacccccccccccccccguggugagcagcuucgccgugagcggcaccgugagaagacugcagggcgugcugggcggcaccggcgacagccugggcgugagcagaagcugccugagaggccugggccuguuccagggcgaguggguguggguggcccaggccagagagagcagcaacaccagccagccccaccuggccagagugcaggugcuggagcccagaugggaccugagcgacagacugggccccggcagcggcccccugggcgagccccuggccgacggccuggcccuggugcccgccacccuggccuucaaccugggcugcgacccccuggagaugggcgagcugagaauccagagauaccuggagggcagcaucgcccccgaggacaagggcagcugcagccugcugcccggcccccccuucgccagagagcugcacaucgagaucgugagcagcccccacuacagcaccaacggcaacuacgacggcgugcuguacagacacuuccagauccccagaguggugcaggagggcgacgugcugugcgugcccaccaucggccagguggagauccuggagggcagccccgagaagcugcccagauggagagagauguucuucaaggugaagaagaccgugggcgaggcccccgacggccccgccagcgccuaccuggccgacaccacccacaccagccuguacauggugggcagcacccugagccccgugcccuggcugcccagcgaggagagcacccuguggagcagccugagcccccccggccuggaggcccuggugagcgagcugugcgccgugcugaagcccagacugcagcccggcggcgcccugcugaccggcaccagcagcgugcugcugagaggcccccccggcugcggcaagaccaccgugguggccgccgccugcagccaccugggccugcaccugcugaaggugcccugcagcagccugugcgccgagagcagcggcgccguggagaccaagcugcaggccaucuucagcagagccagaagaugcagacccgccgugcugcugcugaccgccguggaccugcugggcagagacagagacggccugggcgaggacgccagagugauggccgugcugagacaccugcugcugaacgaggacccccugaacagcugccccccccugauggugguggccaccaccagcagagcccaggaccugcccgccgacgugcagaccgccuucccccacgagcuggaggugcccgcccugagcgagggccagagacugagcauccugagagcccugaccgcccaccugccccugggccaggaggugaaccuggcccagcuggccagaagaugcgccggcuucguggugggcgaccuguacgcccugcugacccacagcagcagagccgccugcaccagaaucaagaacagcggccuggccggcggccugaccgaggaggacgagggcgagcugugcgccgccggcuucccccugcuggccgaggacuucggccaggcccuggagcagcugcagaccgcccacagccaggccgugggcgcccccaagauccccagcgugagcuggcacgacgugggcggccugcaggaggugaagaaggagauccuggagaccauccagcugccccuggagcaccccgagcugcugagccugggccugagaagaagcggccugcugcugcacggcccccccggcaccggcaagacccugcuggccaaggccguggccaccgagugcagccugaccuuccugagcgugaagggccccgagcugaucaacauguacgugggccagagcgaggagaacgugagagagguguucgccagagccagagccgccgcccccugcaucaucuucuucgacgagcuggacagccuggcccccagcagaggcagaagcggcgacagcggcggcgugauggacagaguggugagccagcugcuggccgagcuggacggccugcacagcacccaggacguguucgugaucggcgccaccaacagacccgaccugcuggaccccgcccugcugagacccggcagauucgacaagcugguguucgugggcgccaacgaggacagagccagccagcugagagugcugagcgccaucaccagaaaguucaagcuggagcccagcgugagccuggugaacgugcuggacugcugccccccccagcugaccggcgccgaccuguacagccugugcagcgacgccaugaccgccgcccugaagagaagagugcacgaccuggaggagggccuggagcccggcagcagcgcccugaugcugaccauggaggaccugcugcaggccgccgccagacugcagcccagcgugagcgagcaggagcugcugagauacaagagaauccagagaaaguucgccgccugcuaa

SEQ ID NO: 21409 - RNA, 972 nt, Artificial Sequence
  PEX7__Homo_sapiens__NP_000279
augagcgccgugugcggcggcgccgccagaaugcugagaacccccggcagacacggcuacgccgccgaguucagccccuaccugcccggcagacuggccugcgccaccgcccagcacuacggcaucgccggcugcggcacccugcugauccuggaccccgacgaggccggccugagacuguucagaagcuucgacuggaacgacggccuguucgacgugaccuggagcgagaacaacgagcacgugcugaucaccugcagcggcgacggcagccugcagcugugggacaccgccaaggccgccggcccccugcagguguacaaggagcacgcccaggagguguacagcguggacuggagccagaccagaggcgagcagcugguggugagcggcagcugggaccagaccgugaagcugugggaccccaccgugggcaagagccugugcaccuucagaggccacgagagcaucaucuacagcaccaucuggagcccccacauccccggcugcuucgccagcgccagcggcgaccagacccugagaaucugggacgugaaggccgccggcgugagaaucgugauccccgcccaccaggccgagauccugagcugcgacuggugcaaguacaacgagaaccugcuggugaccggcgccguggacugcagccugagaggcugggaccugagaaacgugagacagcccguguucgagcugcugggccacaccuacgccaucagaagagugaaguucagccccuuccacgccagcgugcuggccagcugcagcuacgacuucaccgugagauucuggaacuucagcaagcccgacagccugcuggagaccguggagcaccacaccgaguucaccugcggccuggacuucagccugcagagccccacccagguggccgacugcagcugggacgagaccaucaagaucuacgaccccgccugccugaccauccccgccuaa

SEQ ID NO: 21410 - RNA, 306 nt, Artificial Sequence
  PF4__Homo_sapiens__NP_002610
augagcagcgccgccggcuucugcgccagcagacccggccugcuguuccugggccugcugcugcugccccuggugguggccuucgccagcgccgaggccgaggaggacggcgaccugcagugccugugcgugaagaccaccagccaggugagacccagacacaucaccagccuggaggugaucaaggccggcccccacugccccaccgcccagcugaucgccacccugaagaacggcagaaagaucugccuggaccugcaggccccccuguacaagaagaucaucaagaagcugcuggagagcuaa

SEQ ID NO: 21411 - RNA, 315 nt, Artificial Sequence
  PF4V1__Homo_sapiens__NP_002611
augagcagcgccgccagaagcagacugaccagagccaccagacaggagaugcuguuccuggcccugcugcugcugcccguggugguggccuucgccagagccgaggccgaggaggacggcgaccugcagugccugugcgugaagaccaccagccaggugagacccagacacaucaccagccuggaggugaucaaggccggcccccacugccccaccgcccagcugaucgccacccugaagaacggcagaaagaucugccuggaccugcaggcccugcuguacaagaagaucaucaaggagcaccuggagagcuaa

SEQ ID NO: 21412 - RNA, 405 nt, Artificial Sequence
  PFDN4__Homo_sapiens__NP_002614
auggccgccaccaugaagaaggccgccgccgaggacgugaacgugaccuucgaggaccagcagaagaucaacaaguucgccagaaacaccagcagaaucaccgagcugaaggaggagaucgaggugaagaagaagcagcugcagaaccuggaggacgccugcgacgacaucaugcuggccgacgacgacugccugaugauccccuaccagaucggcgacguguucaucagccacagccaggaggagacccaggagaugcuggaggaggccaagaagaaccugcaggaggagaucgacgcccuggagagcagaguggagagcauccagagagugcuggccgaccugaaggugcagcuguacgccaaguucggcagcaacaucaaccuggaggccgacgagagcuaa

SEQ ID NO: 21413 - RNA, 465 nt, Artificial Sequence
  PFDN5__Homo_sapiens__NP_002615
auggcccagagcaucaacaucaccgagcugaaccugccccagcuggagaugcugaagaaccagcuggaccaggagguggaguuccugagcaccagcaucgcccagcugaagguggugcagaccaaguacguggaggccaaggacugccugaacgugcugaacaagagcaacgagggcaaggagcugcuggugccccugaccagcagcauguacgugcccggcaagcugcacgacguggagcacgugcugaucgacgugggcaccggcuacuacguggagaagaccgccgaggacgccaaggacuucuucaagagaaagaucgacuuccugaccaagcagauggagaagauccagcccgcccugcaggagaagcacgccaugaagcaggccgugauggagaugaugagccagaagauccagcagcugaccgcccugggcgccgcccaggccaccgccaaggccuaa

SEQ ID NO: 21414 - RNA, 390 nt, Artificial Sequence
  PFDN6__Homo_sapiens__NP_001252525
auggccgagcugauccagaagaagcugcagggcgagguggagaaguaccagcagcugcagaaggaccugagcaagagcaugagcggcagacagaagcuggaggcccagcugaccgagaacaacaucgugaaggaggagcuggcccugcuggacggcagcaacgugguguucaagcugcugggccccgugcuggugaagcaggagcugggcgaggccagagccaccgugggcaagagacuggacuacaucaccgccgagaucaagagauacgagagccagcugagagaccuggagagacagagcgagcagcagagagagacccuggcccagcugcagcaggaguuccagagagcccaggccgccaaggccggcgcccccggcaaggccuaa

SEQ ID NO: 21415 - RNA, 1350 nt, Artificial Sequence
  PFKFB1__Homo_sapiens__NP_001258733
augagccccgagaugggcgagcugacccagaccagacugcagaagaucuggaucccccacagcagcggcagcagcagacugcagagaagaagaggcagcagcaucccccaguucaccaacagccccaccauggugaucauggugggccugcccgccagaggcaagaccuacaucagcaccaagcugaccagauaccugaacuggaucggcacccccaccaaggacaacauggaggcccugcagaucagaaagcagugcgcccuggccgcccugaaggacgugcacaacuaccugagccacgaggagggccacguggccguguucgacgccaccaacaccaccagagagagaagaagccugauccugcaguucgccaaggagcacggcuacaagguguucuucaucgagagcaucugcaacgaccccggcaucaucgccgagaacaucagacaggugaagcugggcagccccgacuacaucgacugcgacagagagaaggugcuggaggacuuccugaagagaaucgagugcuacgaggugaacuaccagccccuggacgaggagcuggacagccaccugagcuacaucaagaucuucgacgugggcaccagauacauggugaacagagugcaggaccacauccagagcagaaccguguacuaccugaugaacauccacgugacccccagaagcaucuaccugugcagacacggcgagagcgagcugaacaucagaggcagaaucggcggcgacagcggccugagcgugagaggcaagcaguacgccuacgcccuggccaacuucauccagagccagggcaucagcagccugaagguguggaccagccacaugaagagaaccauccagaccgccgaggcccugggcgugcccuacgagcaguggaaggcccugaacgagaucgacgccggcgugugcgaggagaugaccuacgaggagauccaggagcacuaccccgaggaguucgcccugagagaccaggacaaguacagauacagauaccccaagggcgagagcuacgaggaccuggugcagagacuggagcccgugaucauggagcuggagagacaggagaacgugcuggugaucugccaccaggccgugaugagaugccugcuggccuacuuccuggacaagagcagcgacgagcugcccuaccugaagugcccccugcacaccgugcugaagcugacccccguggccuacggcugcaagguggagagcaucuaccugaacguggaggccgugaacacccacagagagaagcccgagaacguggacaucaccagagagcccgaggaggcccuggacaccgugcccgcccacuacuaa

SEQ ID NO: 21416 - RNA, 1416 nt, Artificial Sequence
  PFKFB2__Homo_sapiens__NP_001018063
augagcggcgccagcagcagcgagcagaacaacaacagcuacgagaccaagacccccaaccugagaaugagcgagaagaagugcagcugggccagcuacaugaccaacagccccacccugaucgugaugaucggccugcccgccagaggcaagaccuacgugagcaagaagcugaccagauaccugaacuggaucggcgugcccaccaagguguucaaccugggcguguacagaagagaggccgugaagagcuacaagagcuacgacuucuucagacacgacaacgaggaggccaugaagaucagaaagcagugcgcccugguggcccuggaggacgugaaggccuaccugaccgaggagaacggccagaucgccguguucgacgccaccaacaccaccagagagagaagagacaugauccugaacuucgccgagcagaacagcuucaagguguucuucguggagagcgugugcgacgaccccgacgugaucgccgccaacauccuggaggugaaggugagcagccccgacuaccccgagagaaacagagagaacgugauggaggacuuccugaagagaaucgagugcuacaaggugaccuacagaccccuggaccccgacaacuacgacaaggaccugagcuucaucaaggugaucaacgugggccagagauuccuggugaacagagugcaggacuacauccagagcaagaucguguacuaccugaugaacauccacgugcagcccagaaccaucuaccugugcagacacggcgagagcgaguucaaccugcugggcaagaucggcggcgacagcggccugagcgugagaggcaagcaguucgcccaggcccugagaaaguuccuggaggagcaggagaucaccgaccugaagguguggaccagccagcugaagagaaccauccagaccgccgagagccugggcgugcccuacgagcaguggaagauccugaacgagaucgacgccggcgugugcgaggagaugaccuacgccgagaucgagaagagauaccccgaggaguucgcccugagagaccaggagaaguaccuguacagauaccccggcggcgagagcuaccaggaccuggugcagagacuggagcccgugaucauggagcuggagagacagggcaacgugcuggugaucagccaccaggccgugaugagaugccugcuggccuacuuccuggacaagggcgccgacgagcugcccuaccugagaugcccccugcacaccaucuucaagcugacccccguggccuacggcugcaagguggagaccaucaagcugaacguggaggccgugaacacccacagagacaagcccaccgccgccgagaccacccuggccgugagaagaagacccagcgccgccagccugaugcugcccugcuaa

SEQ ID NO: 21417 - RNA, 1503 nt, Artificial Sequence
  PFKFB3__Homo_sapiens__NP_001138915
augcccuucagaaaggccugcggccccaagcugaccaacagccccaccgugaucgugauggugggccugcccgccagaggcaagaccuacaucagcaagaagcugaccagauaccugaacuggaucggcgugcccaccaagguguucaacgugggcgaguacagaagagaggccgugaagcaguacagcagcuacaacuucuucagacccgacaacgaggaggccaugaaggugagaaagcagugcgcccuggccgcccugagagacgugaagagcuaccuggccaaggagggcggccagaucgccguguucgacgccaccaacaccaccagagagagaagacacaugauccugcacuucgccaaggagaacgacuucaaggccuucuucaucgagagcgugugcgacgaccccaccgugguggccagcaacaucauggaggugaagaucagcagccccgacuacaaggacugcaacagcgccgaggccauggacgacuucaugaagagaaucagcugcuacgaggccagcuaccagccccuggaccccgacaagugcgacagagaccugagccugaucaaggugaucgacgugggcagaagauuccuggugaacagagugcaggaccacauccagagcagaaucguguacuaccugaugaacauccacgugcagcccagaaccaucuaccugugcagacacggcgagaacgagcacaaccugcagggcagaaucggcggcgacagcggccugagcagcagaggcaagaaguucgccagcgcccugagcaaguucguggaggagcagaaccugaaggaccugagaguguggaccagccagcugaagagcaccauccagaccgccgaggcccugagacugcccuacgagcaguggaaggcccugaacgagaucgacgccggcgugugcgaggagcugaccuacgaggagaucagagacaccuaccccgaggaguacgcccugagagagcaggacaaguacuacuacagauaccccaccggcgagagcuaccaggaccuggugcagagacuggagcccgugaucauggagcuggagagacaggagaacgugcuggugaucugccaccaggccgugcugagaugccugcuggccuacuuccuggacaagagcgccgaggagaugcccuaccugaagugcccccugcacaccgugcugaagcugacccccguggccuacggcugcagaguggagagcaucuaccugaacguggagagcgugugcacccacagagagagaagcgaggacgccaagaagggccccaacccccugaugagaagaaacagcgugaccccccuggccagccccgagcccaccaagaagcccagaaucaacagcuucgaggagcacguggccagcaccagcgccgcccugcccagcugccugccccccgaggugcccacccagcugcccggccagaacaugaagggcagcagaagcagcgccgacagcagcagaaagcacuaa

SEQ ID NO: 21418 - RNA, 1410 nt, Artificial Sequence
  PFKFB4__Homo_sapiens__NP_004558
auggccagccccagagagcugacccagaacccccugaagaagaucuggaugcccuacagcaacggcagacccgcccugcacgccugccagagaggcgugugcaugaccaacugccccacccugaucgugauggugggccugcccgccagaggcaagaccuacaucagcaagaagcugaccagauaccugaacuggaucggcgugcccaccagagaguucaacgugggccaguacagaagagacguggugaagaccuacaagagcuucgaguucuuccugcccgacaacgaggagggccugaagaucagaaagcagugcgcccuggccgcccugagagacgugagaagauuccugagcgaggagggcggccacguggccguguucgacgccaccaacaccaccagagagagaagagccaccaucuucaacuucggcgagcagaacggcuacaagaccuucuucguggagagcaucugcguggaccccgaggugaucgccgccaacaucgugcaggugaagcugggcagccccgacuacgugaacagagacagcgacgaggccaccgaggacuucaugagaagaaucgagugcuacgagaacagcuacgagagccuggacgaggaccuggacagagaccugagcuacaucaagaucauggacgugggccagagcuacguggugaacagaguggccgaccacauccagagcagaaucguguacuaccugaugaacauccacgugacccccagaagcaucuaccugugcagacacggcgagagcgagcugaaccugaagggcagaaucggcggcgaccccggccugagccccagaggcagagaguucgccaagagccuggcccaguucaucagcgaccagaacaucaaggaccugaagguguggaccagccagaugaagagaaccauccagaccgccgaggcccugggcgugcccuacgagcaguggaaggugcugaacgagaucgacgccggcgugugcgaggagaugaccuacgaggagauccaggacaacuacccccuggaguucgcccugagagaccaggacaaguacagauacagauaccccaagggcgagagcuacgaggaccuggugcagagacuggagcccgugaucauggagcuggagagacaggagaacgugcuggugaucugccaccaggccgugaugagaugccugcuggccuacuuccuggacaaggccgccgagcagcugcccuaccugaagugcccccugcacaccgugcugaagcugacccccguggccuacggcugcaagguggagagcaucuuccugaacguggccgccgugaacacccacagagacagaccccagaacguggacaucagcagaccccccgaggaggcccuggugaccgugcccgcccaccaguaa

SEQ ID NO: 21419 - RNA, 2343 nt, Artificial Sequence
  PFKL__Homo_sapiens__NP_002617
auggccgccguggaccuggagaagcugagagccagcggcgccggcaaggccaucggcgugcugaccagcggcggcgacgcccagggcaugaacgccgccgugagagccgugaccagaaugggcaucuacgugggcgccaagguguuccugaucuacgagggcuacgagggccugguggagggcggcgagaacaucaagcaggccaacuggcugagcgugagcaacaucauccagcugggcggcaccaucaucggcagcgccagaugcaaggccuucaccaccagagagggcagaagagccgccgccuacaaccuggugcagcacggcaucaccaaccugugcgugaucggcggcgacggcagccugaccggcgccaacaucuucagaagcgaguggggcagccugcuggaggagcugguggccgagggcaagaucagcgagaccaccgccagaaccuacagccaccugaacaucgccggccuggugggcagcaucgacaacgacuucugcggcaccgacaugaccaucggcaccgacagcgcccugcacagaaucauggaggugaucgacgccaucaccaccaccgcccagagccaccagagaaccuucgugcuggaggugaugggcagacacugcggcuaccuggcccuggugagcgcccuggccagcggcgccgacuggcuguucauccccgaggccccccccgaggacggcugggagaacuucaugugcgagagacugggcgagaccagaagcagaggcagcagacugaacaucaucaucaucgccgagggcgccaucgacagaaacggcaagcccaucagcagcagcuacgugaaggaccugguggugcagagacugggcuucgacaccagagugaccgugcugggccacgugcagagaggcggcacccccagcgccuucgacagaauccugagcagcaagaugggcauggaggccgugauggcccugcuggaggccacccccgacacccccgccugcguggugacccugagcggcaaccagagcgugagacugccccugauggagugcgugcagaugaccaaggaggugcagaaggccauggacgacaagagauucgacgaggccacccagcugagaggcggcagcuucgagaacaacuggaacaucuacaagcugcuggcccaccagaagccccccaaggagaagagcaacuucagccuggccauccugaacgugggcgcccccgccgccggcaugaacgccgccgugagaagcgccgugagaaccggcaucagccacggccacaccguguacguggugcacgacggcuucgagggccuggccaagggccaggugcaggaggugggcuggcacgacguggccggcuggcugggcagaggcggcagcaugcugggcaccaagagaacccugcccaagggccagcuggagagcaucguggagaacaucagaaucuacggcauccacgcccugcugguggugggcggcuucgaggccuacgagggcgugcugcagcugguggaggccagaggcagauacgaggagcugugcaucgugaugugcgugauccccgccaccaucagcaacaacgugcccggcaccgacuucagccugggcagcgacaccgccgugaacgccgccauggagagcugcgacagaaucaagcagagcgccagcggcaccaagagaagaguguucaucguggagaccaugggcggcuacugcggcuaccuggccaccgugaccggcaucgccgugggcgccgacgccgccuacguguucgaggaccccuucaacauccacgaccugaaggugaacguggagcacaugaccgagaagaugaagaccgacauccagagaggccuggugcugagaaacgagaagugccacgacuacuacaccaccgaguuccuguacaaccuguacagcagcgagggcaagggcguguucgacugcagaaccaacgugcugggccaccugcagcagggcggcgcccccacccccuucgacagaaacuacggcaccaagcugggcgugaaggccaugcuguggcugagcgagaagcugagagagguguacagaaagggcagaguguucgccaacgcccccgacagcgccugcgugaucggccugaagaagaaggccguggccuucagccccgugaccgagcugaagaaggacaccgacuucgagcacagaaugcccagagagcagugguggcugagccugagacugaugcugaagaugcuggcccaguacagaaucagcauggccgccuacgugagcggcgagcuggagcacgugaccagaagaacccugagcauggacaagggcuucuaa

SEQ ID NO: 21420 - RNA, 2556 nt, Artificial Sequence
  PFKM__Homo_sapiens__NP_001160158
augcacaaggacgaguuccaccugaaguucuucaugugcgugauccagagcagacagcuggugagaaccccccagagaaccgccggcgaggccagcaccagcagcaugcugauccccaagcccccccccaagaccgacauccugaagagccuggacaccauggacgaccccgacaccgugggcagcauccccguguucaagaccgaguggaucaugacccacgaggagcaccacgccgccaagacccugggcaucggcaaggccaucgccgugcugaccagcggcggcgacgcccagggcaugaacgccgccgugagagccguggugagagugggcaucuucaccggcgccagaguguucuucgugcacgagggcuaccagggccugguggacggcggcgaccacaucaaggaggccaccugggagagcgugagcaugaugcugcagcugggcggcaccgugaucggcagcgccagaugcaaggacuucagagagagagagggcagacugagagccgccuacaaccuggugaagagaggcaucaccaaccugugcgugaucggcggcgacggcagccugaccggcgccgacaccuucagaagcgaguggagcgaccugcugagcgaccugcagaaggccggcaagaucaccgacgaggaggccaccaagagcagcuaccugaacaucgugggccuggugggcagcaucgacaacgacuucugcggcaccgacaugaccaucggcaccgacagcgcccugcacagaaucauggagaucguggacgccaucaccaccaccgcccagagccaccagagaaccuucgugcuggaggugaugggcagacacugcggcuaccuggcccuggugaccagccugagcugcggcgccgacuggguguucauccccgagugcccccccgacgacgacugggaggagcaccugugcagaagacugagcgagaccagaaccagaggcagcagacugaacaucaucaucguggccgagggcgccaucgacaagaacggcaagcccaucaccagcgaggacaucaagaaccugguggugaagagacugggcuacgacaccagagugaccgugcugggccacgugcagagaggcggcacccccagcgccuucgacagaauccugggcagcagaaugggcguggaggccgugauggcccugcuggagggcacccccgacacccccgccugcguggugagccugagcggcaaccaggccgugagacugccccugauggagugcgugcaggugaccaaggacgugaccaaggccauggacgagaagaaguucgacgaggcccugaagcugagaggcagaagcuucaugaacaacugggagguguacaagcugcuggcccacgugagaccccccgugagcaagagcggcagccacaccguggccgugaugaacgugggcgcccccgccgccggcaugaacgccgccgugagaagcaccgugagaaucggccugauccagggcaacagagugcugguggugcacgacggcuucgagggccuggccaagggccagaucgaggaggccggcuggagcuacgugggcggcuggaccggccagggcggcagcaagcugggcaccaagagaacccugcccaagaagagcuucgagcagaucagcgccaacaucaccaaguucaacauccagggccuggugaucaucggcggcuucgaggccuacaccggcggccuggagcugauggagggcagaaagcaguucgacgagcugugcauccccuucguggugauccccgccaccgugagcaacaacgugcccggcagcgacuucagcgugggcgccgacaccgcccugaacaccaucugcaccaccugcgacagaaucaagcagagcgccgccggcaccaagagaagaguguucaucaucgagaccaugggcggcuacugcggcuaccuggccaccauggccggccuggccgccggcgccgacgccgccuacaucuucgaggagcccuucaccaucagagaccugcaggccaacguggagcaccuggugcagaagaugaagaccaccgugaagagaggccuggugcugagaaacgagaagugcaacgagaacuacaccaccgacuucaucuucaaccuguacagcgaggagggcaagggcaucuucgacagcagaaagaacgugcugggccacaugcagcagggcggcagccccacccccuucgacagaaacuucgccaccaagaugggcgccaaggccaugaacuggaugagcggcaagaucaaggagagcuacagaaacggcagaaucuucgccaacacccccgacagcggcugcgugcugggcaugagaaagagagcccugguguuccagcccguggccgagcugaaggaccagaccgacuucgagcacagaauccccaaggagcagugguggcugaagcugagacccauccugaagauccuggccaaguacgagaucgaccuggacaccagcgaccacgcccaccuggagcacaucaccagaaagagaagcggcgaggccgccguguaa

SEQ ID NO: 21421 - RNA, 2331 nt, Artificial Sequence
  PFKP__Homo_sapiens__NP_001229268
augugcggcuacgagagaugcagacccugcagaggcgcccacggcuaccugagaggcggccagggcgugcugcaccugagaggccugcccggccacggcggcagaagacugaagcacagaagaggcagacugggcgagugccugcagcaccccgccagcggcgccgugagaggcgacuggagagagaagcccggcugcuggagccacagauuccccugccccggcagacacgcccuggugggcggcaccaucaucggcagcgccagaugccaggccuucagaaccagagagggcagacugaaggccgccugcaaccugcugcagagaggcaucaccaaccugugcgugaucggcggcgacggcagccugaccggcgccaaccuguucagaaaggaguggagcggccugcuggaggagcuggccagaaacggccagaucgacaaggaggccgugcagaaguacgccuaccugaacguggugggcauggugggcagcaucgacaacgacuucugcggcaccgacaugaccaucggcaccgacagcgcccugcacagaaucaucgaggugguggacgccaucaugaccaccgcccagagccaccagagaaccuucgugcuggaggugaugggcagacacugcggcuaccuggcccuggugagcgcccuggccugcggcgccgacuggguguuccugcccgagagcccccccgaggagggcugggaggagcagaugugcgugaagcugagcgagaacagagccagaaagaagagacugaacaucaucaucguggccgagggcgccaucgacacccagaacaagcccaucaccagcgagaagaucaaggagcugguggugacccagcugggcuacgacaccagagugaccauccugggccacgugcagagaggcggcacccccagcgccuucgacagaauccuggccagcagaaugggcguggaggccgugaucgcccugcuggaggccacccccgacacccccgccugcguggugagccugaacggcaaccacgccgugagacugccccugauggagugcgugcagaugacccaggacgugcagaaggccauggacgagagaagauuccaggacgccgugagacugagaggcagaagcuucgccggcaaccugaacaccuacaagagacuggccaucaagcugcccgacgaccagauccccaagaccaacugcaacguggccgugaucaacgugggcgcccccgccgccggcaugaacgccgccgugagaagcgccgugagagugggcaucgccgacggccacagaaugcuggccaucuacgacggcuucgacggcuucgccaagggccagaucaaggagaucggcuggaccgacgugggcggcuggaccggccagggcggcagcauccugggcaccaagagagugcugcccggcaaguaccuggaggagaucgccacccagaugagaacccacagcaucaacgcccugcugaucaucggcggcuucgaggccuaccugggccugcuggagcugagcgccgccagagagaagcacgaggaguucugcgugcccauggugauggugcccgccaccgugagcaacaacgugcccggcagcgacuucagcaucggcgccgacaccgcccugaacaccaucaccgacaccugcgacagaaucaagcagagcgccagcggcaccaagagaagaguguucaucaucgagaccaugggcggcuacugcggcuaccuggccaacaugggcggccuggccgccggcgccgacgccgccuacaucuucgaggagcccuucgacaucagagaccugcagagcaacguggagcaccugaccgagaagaugaagaccaccauccagagaggccuggugcugagaaacgagagcugcagcgagaacuacaccaccgacuucaucuaccagcuguacagcgaggagggcaagggcguguucgacugcagaaagaacgugcugggccacaugcagcagggcggcgcccccagccccuucgacagaaacuucggcaccaagaucagcgccagagccauggaguggaucaccgccaagcugaaggaggccagaggcagaggcaagaaguucaccaccgacgacagcaucugcgugcugggcaucagcaagagaaacgugaucuuccagcccguggccgagcugaagaagcagaccgacuucgagcacagaauccccaaggagcagugguggcugaagcugagaccccugaugaagauccuggccaaguacaaggccagcuacgacgugagcgacagcggccagcuggagcacgugcagcccuggagcguguaa

SEQ ID NO: 21422 - RNA, 423 nt, Artificial Sequence
  PFN1__Homo_sapiens__NP_005013
auggccggcuggaacgccuacaucgacaaccugauggccgacggcaccugccaggacgccgccaucgugggcuacaaggacagccccagcgugugggccgccgugcccggcaagaccuucgugaacaucacccccgccgaggugggcgugcuggugggcaaggacagaagcagcuucuacgugaacggccugacccugggcggccagaagugcagcgugaucagagacagccugcugcaggacggcgaguucagcauggaccugagaaccaagagcaccggcggcgcccccaccuucaacgugaccgugaccaagaccgacaagacccuggugcugcugaugggcaaggagggcgugcacggcggccugaucaacaagaagugcuacgagauggccagccaccugagaagaagccaguacuaa

SEQ ID NO: 21423 - RNA, 423 nt, Artificial Sequence
  PFN2__Homo_sapiens__NP_002619
auggccggcuggcagagcuacguggacaaccugaugugcgacggcugcugccaggaggccgccaucgugggcuacugcgacgccaaguacgugugggccgccaccgccggcggcguguuccagagcaucacccccaucgagaucgacaugaucgugggcaaggacagagagggcuucuucaccaacggccugacccugggcgccaagaagugcagcgugaucagagacagccuguacguggacggcgacugcaccauggacaucagaaccaagagccagggcggcgagcccaccuacaacguggccgugggcagagccggcagagcccuggugaucgugaugggcaaggagggcgugcacggcggcacccugaacaagaaggccuacgagcuggcccuguaccugagaagaagcgacguguaa

SEQ ID NO: 21424 - RNA, 1167 nt, Artificial Sequence
  PGA3__Homo_sapiens__NP_001073275
augaaguggcugcugcugcugggccugguggcccugagcgagugcaucauguacaaggugccccugaucagaaagaagagccugagaagaacccugagcgagagaggccugcugaaggacuuccugaagaagcacaaccugaaccccgccagaaaguacuucccccaguggaaggcccccacccugguggacgagcagccccuggagaacuaccuggacauggaguacuucggcaccaucggcaucggcacccccgcccaggacuucaccgugguguucgacaccggcagcagcaaccugugggugcccagcguguacugcagcagccuggccugcaccaaccacaacagauucaaccccgaggacagcagcaccuaccagagcaccagcgagaccgugagcaucaccuacggcaccggcagcaugaccggcauccugggcuacgacaccgugcaggugggcggcaucagcgacaccaaccagaucuucggccugagcgagaccgagcccggcagcuuccuguacuacgcccccuucgacggcauccugggccuggccuaccccagcaucagcagcagcggcgccacccccguguucgacaacaucuggaaccagggccuggugagccaggaccuguucagcguguaccugagcgccgacgaccagagcggcagcguggugaucuucggcggcaucgacagcagcuacuacaccggcagccugaacugggugcccgugaccguggagggcuacuggcagaucaccguggacagcaucaccaugaacggcgaggccaucgccugcgccgagggcugccaggccaucguggacaccggcaccagccugcugaccggccccaccagccccaucgccaacauccagagcgacaucggcgccagcgagaacagcgacggcgacaugguggugagcugcagcgccaucagcagccugcccgacaucguguucaccaucaacggcgugcaguaccccgugccccccagcgccuacauccugcagagcgagggcagcugcaucagcggcuuccagggcaugaaccugcccaccgagagcggcgagcuguggauccugggcgacguguucaucagacaguacuucaccguguucgacagagccaacaaccaggugggccuggcccccguggccuaa

SEQ ID NO: 21425 - RNA, 1167 nt, Artificial Sequence
  PGA4__Homo_sapiens__NP_001073276
augaaguggcugcugcugcugggccugguggcccugagcgagugcaucauguacaaggugccccugaucagaaagaagagccugagaagaacccugagcgagagaggccugcugaaggacuuccugaagaagcacaaccugaaccccgccagaaaguacuucccccagugggaggcccccacccugguggacgagcagccccuggagaacuaccuggacauggaguacuucggcaccaucggcaucggcacccccgcccaggacuucaccgugguguucgacaccggcagcagcaaccugugggugcccagcguguacugcagcagccuggccugcaccaaccacaacagauucaaccccgaggacagcagcaccuaccagagcaccagcgagaccgugagcaucaccuacggcaccggcagcaugaccggcauccugggcuacgacaccgugcaggugggcggcaucagcgacaccaaccagaucuucggccugagcgagaccgagcccggcagcuuccuguacuacgcccccuucgacggcauccugggccuggccuaccccagcaucagcagcagcggcgccacccccguguucgacaacaucuggaaccagggccuggugagccaggaccuguucagcguguaccugagcgccgacgaccagagcggcagcguggugaucuucggcggcaucgacagcagcuacuacaccggcagccugaacugggugcccgugaccguggagggcuacuggcagaucaccguggacagcaucaccaugaacggcgaggccaucgccugcgccgagggcugccaggccaucguggacaccggcaccagccugcugaccggccccaccagccccaucgccaacauccagagcgacaucggcgccagcgagaacagcgacggcgacaugguggugagcugcagcgccaucagcagccugcccgacaucguguucaccaucaacggcgugcaguaccccgugccccccagcgccuacauccugcagagcgagggcagcugcaucagcggcuuccagggcaugaaccugcccaccgagagcggcgagcuguggauccugggcgacguguucaucagacaguacuucaccguguucgacagagccaacaaccaggugggccuggcccccguggccuaa

SEQ ID NO: 21426 - RNA, 1167 nt, Artificial Sequence
  PGA5__Homo_sapiens__NP_055039
augaaguggcugcugcugcugggccugguggcccugagcgagugcaucauguacaaggugccccugaucagaaagaagagccugagaagaacccugagcgagagaggccugcugaaggacuuccugaagaagcacaaccugaaccccgccagaaaguacuucccccagugggaggcccccacccugguggacgagcagccccuggagaacuaccuggacauggaguacuucggcaccaucggcaucggcacccccgcccaggacuucaccgugguguucgacaccggcagcagcaaccugugggugcccagcguguacugcagcagccuggccugcaccaaccacaacagauucaaccccgaggacagcagcaccuaccagagcaccagcgagaccgugagcaucaccuacggcaccggcagcaugaccggcauccugggcuacgacaccgugcaggugggcggcaucagcgacaccaaccagaucuucggccugagcgagaccgagcccggcagcuuccuguacuacgcccccuucgacggcauccugggccuggccuaccccagcaucagcagcagcggcgccacccccguguucgacaacaucuggaaccagggccuggugagccaggaccuguucagcguguaccugagcgccgacgacaagagcggcagcguggugaucuucggcggcaucgacagcagcuacuacaccggcagccugaacugggugcccgugaccguggagggcuacuggcagaucaccguggacagcaucaccaugaacggcgagaccaucgccugcgccgagggcugccaggccaucguggacaccggcaccagccugcugaccggccccaccagccccaucgccaacauccagagcgacaucggcgccagcgagaacagcgacggcgacaugguggugagcugcagcgccaucagcagccugcccgacaucguguucaccaucaacggcgugcaguaccccgugccccccagcgccuacauccugcagagcgagggcagcugcaucagcggcuuccagggcaugaacgugcccaccgagagcggcgagcuguggauccugggcgacguguucaucagacaguacuucaccguguucgacagagccaacaaccaggugggccuggcccccguggccuaa

SEQ ID NO: 21427 - RNA, 765 nt, Artificial Sequence
  PGAM1__Homo_sapiens__NP_002620
auggccgccuacaagcuggugcugaucagacacggcgagagcgccuggaaccuggagaacagauucagcggcugguacgacgccgaccugagccccgccggccacgaggaggccaagagaggcggccaggcccugagagacgccggcuacgaguucgacaucugcuucaccagcgugcagaagagagccaucagaacccuguggaccgugcuggacgccaucgaccagauguggcugcccguggugagaaccuggagacugaacgagagacacuacggcggccugaccggccugaacaaggccgagaccgccgccaagcacggcgaggcccaggugaagaucuggagaagaagcuacgacgugccccccccccccauggagcccgaccaccccuucuacagcaacaucagcaaggacagaagauacgccgaccugaccgaggaccagcugcccagcugcgagagccugaaggacaccaucgccagagcccugcccuucuggaacgaggagaucgugccccagaucaaggagggcaagagagugcugaucgccgcccacggcaacagccugagaggcaucgugaagcaccuggagggccugagcgaggaggccaucauggagcugaaccugcccaccggcauccccaucguguacgagcuggacaagaaccugaagcccaucaagcccaugcaguuccugggcgacgaggagaccgugagaaaggccauggaggccguggccgcccagggcaaggccaagaaguaa

SEQ ID NO: 21428 - RNA, 762 nt, Artificial Sequence
  PGAM2__Homo_sapiens__NP_000281
auggccacccacagacuggugauggugagacacggcgagagcaccuggaaccaggagaacagauucugcggcugguucgacgccgagcugagcgagaagggcaccgaggaggccaagagaggcgccaaggccaucaaggacgccaagauggaguucgacaucugcuacaccagcgugcugaagagagccaucagaacccugugggccauccuggacggcaccgaccagauguggcugcccguggugagaaccuggagacugaacgagagacacuacggcggccugaccggccugaacaaggccgagaccgccgccaagcacggcgaggagcaggugaagaucuggagaagaagcuucgacaucccccccccccccauggacgagaagcaccccuacuacaacagcaucagcaaggagagaagauacgccggccugaagcccggcgagcugcccaccugcgagagccugaaggacaccaucgccagagcccugcccuucuggaacgaggagaucgugccccagaucaaggccggcaagagagugcugaucgccgcccacggcaacagccugagaggcaucgugaagcaccuggagggcaugagcgaccaggccaucauggagcugaaccugcccaccggcauccccaucguguacgagcugaacaaggagcugaagcccaccaagcccaugcaguuccugggcgacgaggagaccgugagaaaggccauggaggccguggccgcccagggcaaggccaaguaa

SEQ ID NO: 21429 - RNA, 765 nt, Artificial Sequence
  PGAM4__Homo_sapiens__NP_001025062
auggccgccuacaagcuggugcugaucagacacggcgagagcaccuggaaccuggagaacagauucagcugcugguacgacgccgaccugagccccgccggccacgaggaggccaagagaggcggccaggcccugagagacgccggcuacgaguucgacaucugccugaccagcgugcagaagagagugaucagaacccuguggaccgugcuggacgccaucgaccagauguggcugcccguggugagaaccuggagacugaacgagagacacuacggcggccugaccggccugaacaaggccgagaccgccgccaagcacggcgaggcccaggugaagaucuggagaagaagcuacgacgugccccccccccccauggagcccgaccaccccuucuacagcaacaucagcaaggacagaagauacgccgaccugaccgaggaccagcugcccagcuacgagagccccaaggacaccaucgccagagcccugcccuucuggaacgaggagaucgugccccagaucaaggagggcaagagagugcugaucgccgcccacggcaacagccugcagggcaucgccaagcacguggagggccugagcgaggaggccaucauggagcugaaccugcccaccggcauccccaucguguacgagcuggacaagaaccugaagcccaucaagcccaugcaguuccugggcgacgaggagaccgugugcaaggccaucgaggccguggccgcccagggcaaggccaagaaguaa

SEQ ID NO: 21430 - RNA, 2769 nt, Artificial Sequence
  PGAP1__Homo_sapiens__NP_079265
auguuccugcacagcgugaaccuguggaaccuggccuucuacguguucaugguguuccuggccacccugggccugugggacguguucuucggcuucgaggagaacaagugcagcaugagcuacauguucgaguaccccgaguaccagaagaucgagcugcccaagaagcuggccaagagauaccccgccuacgagcuguaccuguacggcgagggcagcuacgccgaggagcacaagauccugccccugaccggcauccccgugcuguuccugcccggcaacgccggcagcuacaagcaggugagaagcaucggcagcaucgcccugagaaaggccgaggacaucgacuucaaguaccacuucgacuucuucagcgugaacuucaacgaggagcugguggcccuguacggcggcagccugcagaagcagaccaaguucgugcacgagugcaucaagaccauccugaagcuguacaagggccaggaguucgcccccaagagcguggccaucaucggccacagcaugggcggccugguggccagagcccugcugacccugaagaacuucaagcacgaccugaucaaccugcugaucacccaggccaccccccacguggcccccgugaugccccuggacagauucaucaccgacuucuacaccaccgugaacaacuacuggauccugaacgccagacacaucaaccugaccacccugagcguggccggcggcuucagagacuaccaggugagaagcggccugaccuuccugcccaagcugagccaccacaccagcgcccugagcguggugagcagcgccgugcccaagaccugggugagcaccgaccaccugagcaucguguggugcaagcagcugcagcugaccaccgugagagccuucuucgaccugaucgacgccgacaccaagcagaucacccagaacagcaagaagaagcugagcgugcuguaccaccacuucaucagacaccccagcaagcacuucgaggagaaccccgccaucaucagcgaccugaccggcaccagcaugugggugcuggugaaggugagcaaguggaccuacguggccuacaacgagagcgagaagaucuacuucaccuucccccuggagaaccacagaaagaucuacacccacguguacugccagagcaccaugcuggacaccaacagcuggaucuucgccugcaucaacagcaccagcaugugccugcagggcguggaccugagcuggaaggccgagcugcugcccaccaucaaguaccugacccugagacugcaggacuaccccagccugagccaccuggugguguacgugcccagcgugagaggcagcaaguucgugguggacugcgaguucuucaagaaggagaagagauacauccagcugcccgugacccaccuguucagcuucggccugagcagcagaaagguggugcugaacaccaacggccuguacuacaaccuggagcugcugaacuucggccagaucuaccaggccuucaagaucaacguggugagcaagugcagcgccgugaaggaggagaucaccagcaucuacagacugcacauccccuggagcuacgaggacagccugaccaucgcccaggcccccagcagcaccgagaucagccugaagcugcacaucgcccagcccgagaacaacacccacguggcccuguucaagauguacaccagcagcgacugcagauacgaggugaccgugaagaccagcuucagccagauccugggccagguggugagauuccacggcggcgcccugcccgccuacguggugagcaacauccugcuggccuacagaggccagcuguacagccuguucagcaccggcugcugccuggaguacgccaccaugcuggacaaggaggccaagcccuacaagguggaccccuucgugaucaucaucaaguuccugcugggcuacaagugguucaaggagcugugggacgugcugcugcugcccgagcuggacgccgugauccugaccugccagagcaugugcuucccccugaucagccugauccuguuccuguucggcaccugcaccgccuacuggagcggccugcugagcagcgccagcgugagacugcugagcagccuguggcuggcccugaagagacccagcgagcugcccaaggacaucaagaugaucagccccgaccugcccuuccugaccaucgugcugaucaucgugagcuggaccaccugcggcgcccuggccauccugcugagcuaccuguacuacguguucaagguggugcaccugcaggccagccugaccaccuucaagaacagccagcccgugaaccccaagcacagcagaagaagcgagaagaagagcaaccaccacaaggacagcagcauccaccaccugagacugagcgccaacgacgccgaggacagccugagaaugcacagcaccgugaucaaccugcugaccuggaucgugcugcugagcaugcccagccugaucuacuggcugaagaaccugagauacuacuucaagcugaaccccgaccccugcaagccccuggccuucauccugauccccaccauggccauccugggcaacaccuacaccgugagcaucaagagcagcaagcugcugaagaccaccagccaguucccccugccccuggccgugggcgugaucgccuucggcagcgcccaccuguacagacugcccugcuucguguucaucccccugcugcugcacgcccugugcaacuucauguaa

SEQ ID NO: 21431 - RNA, 924 nt, Artificial Sequence
  PGAP2__Homo_sapiens__NP_001138910
auggccagacugggcagcaccggcggcgugagcggcagaguggugacccagcacagagacagcgcccccuuccugggcgcccccagacugggccugagagagcugggccccaucagaggcaccgcccccgaguggcacggcagauggaacgccgccgagagaagcgacaagauguaccaggugccccugccccuggacagagacggcacccuggugagacugagauucaccaugguggcccuggugaccgugugcugcccccugguggccuuccuguucugcauccuguggagccugcuguuccacuucaaggagaccaccgccacccacugcggcgugcccaacuaccugcccagcgugagcagcgccaucggcggcgaggugccccagagauacguguggagauucugcaucggccugcacagcgcccccagauuccugguggccuucgccuacuggaaccacuaccugagcugcaccagccccugcagcugcuacagaccccugugcagacugaacuucggccugaacgugguggagaaccuggcccugcuggugcugaccuacgugagcagcagcgaggacuucaccauccacgagaacgccuucaucguguucaucgccagcagccugggccacaugcugcugaccugcauccuguggagacugaccaagaagcacaccgacagaaagagcuacagcuggaagcagagacuguucaucaucaacuucaucagcuucuucagcgcccuggccguguacuucagacacaacauguacugcgaggccggcguguacaccaucuucgccauccuggaguacaccguggugcugaccaacauggccuuccacaugaccgccuggugggacuucggcaacaaggagcugcugaucaccagccagcccgaggagaagagauucuaa

SEQ ID NO: 21432 - RNA, 810 nt, Artificial Sequence
  PGAP3__Homo_sapiens__NP_001278655
auggccggccuggccgccagacuggugcugcuggccggcgccgccgcccuggccagcggcagccagggcgacagagagcccguguacagagacugcgugcugcagugcgaggagcagaacugcagcggcggcgcccugaaccacuucagaagcagacagcccaucuacaugagccuggccggcuggaccugcagagacgacugcaaguacgagugcaugugggugaccgugggccuguaccugcaggagggccacaaggugccccaguuccacggcaaggugagccugaacgccugguucuggagcaccguguuccacaccagagacaccgaccugaccgagaagauggacuacuucugcgccagcaccgugauccugcacagcaucuaccugugcugcgugagaaccgugggccugcagcaccccgccguggugagcgccuucagagcccugcugcugcugaugcugaccgugcacgugagcuaccugagccugaucagauucgacuacggcuacaaccugguggccaacguggccaucggccuggugaacguggugugguggcuggccuggugccuguggaaccagagaagacugccccacgugagaaagugcguggugguggugcugcugcugcagggccugagccugcuggagcugcuggacuuccccccccuguucugggugcuggacgcccacgccaucuggcacaucagcaccauccccgugcacgugcuguucuucagcuuccuggaggacgacagccuguaccugcugaaggagagcgaggacaaguucaagcuggacuaa

SEQ ID NO: 21433 - RNA, 2430 nt, Artificial Sequence
  PGBD1__Homo_sapiens__NP_001171672
auguacgaggcccugcccggccccgcccccgagaacgaggacggccuggugaaggugaaggaggaggaccccaccugggagcaggugugcaacagccaggagggcagcagccacacccaggagaucugcagacugagauucagacacuucugcuaccaggaggcccacggcccccaggaggcccuggcccagcugagagagcugugccaccaguggcugagacccgagaugcacaccaaggagcagaucauggagcugcuggugcuggagcaguuccugaccauccugcccaaggagcugcagcccugcgugaagaccuacccccuggagagcggcgaggaggccgugaccgugcuggagaaccuggagaccggcagcggcgacaccggccagcaggccagcguguacauccagggccaggacaugcaccccaugguggccgaguaccagggcgugagccuggagugccagagccugcagcugcugcccggcaucaccacccugaagugcgagcccccccagagaccccagggcaacccccaggaggugagcggccccgugccccacggcagcgcccaccugcaggagaagaaccccagagacaaggccguggugcccguguucaaccccgugagaagccagacccuggugaagaccgaggaggagaccgcccaggccguggccgccgagaaguggagccaccugagccugaccagaagaaaccugugcggcaacagcgcccaggagaccgugaugagccugagccccaugaccgaggagaucgugaccaaggacagacuguucaaggccaagcaggagaccagcgaggagauggagcagagcggcgaggccagcggcaagcccaacagagagugcgccccccagauccccugcagcacccccaucgccaccgagagaaccguggcccaccugaacacccugaaggacagacaccccggcgaccugugggccagaaugcacaucagcagccuggaguacgccgccggcgacaucaccagaaagggcagaaagaaggacaaggccagagugagcgagcugcugcagggccugagcuucagcggcgacagcgacguggagaaggacaacgagcccgagauccagcccgcccagaagaagcugaaggugagcugcuuccccgagaagagcuggaccaagagagacaucaagcccaacuuccccagcuggagcgcccuggacagcggccugcugaaccugaagagcgagaagcugaaccccguggagcuguucgagcuguucuucgacgacgagaccuucaaccugaucgugaacgagaccaacaacuacgccagccagaagaacgugagccuggaggugaccgugcaggagaugagaugcguguucggcgugcugcugcugagcggcuucaugagacaccccagaagagagauguacugggaggugagcgacaccgaccagaaccuggugagagacgccaucagaagagacagauucgagcugaucuucagcaaccugcacuucgccgacaacggccaccuggaccagaaggacaaguucaccaagcugagaccccugaucaagcagaugaacaagaacuuccugcuguacgccccccuggaggaguacuacugcuucgacaagagcaugugcgagugcuucgacagcgaccaguuccugaacggcaagcccaucagaaucggcuacaagaucuggugcggcaccaccacccagggcuaccuggugugguucgagcccuaccaggaggagagcaccaugaagguggacgaggaccccgaccugggccugggcggcaaccuggugaugaacuucgccgacgugcugcuggagagaggccaguaccccuaccaccugugcuucgacagcuucuucaccagcgugaagcugcugagcgcccugaagaagaagggcgugagagccaccggcaccaucagagagaacagaaccgagaagugcccccugaugaacguggagcacaugaagaagaugaagagaggcuacuucgacuucagaaucgaggagaacaacgagaucauccugugcagaugguacggcgacggcaucaucagccugugcagcaacgccgugggcaucgagcccgugaacgaggugagcugcugcgacgccgacaacgaggagaucccccagaucagccagcccagcaucgugaagguguacgacgagugcaaggagggcguggccaagauggaccagaucaucagcaaguacagagugagaaucagaagcaagaagugguacagcauccuggugagcuacaugaucgacguggccaugaacaacgccuggcagcugcacagagccugcaaccccggcgccagccuggacccccuggacuucagaagauucguggcccacuucuaccuggagcacaacgcccaccugagcgacuaa

SEQ ID NO: 21434 - RNA, 1575 nt, Artificial Sequence
  PGBD5__Homo_sapiens__NP_001245240
auggccgagggcggcggcggcgccagaagaagagcccccgcccugcuggaggccgccagagccagauacgagagccugcacaucagcgacgacguguucggcgagagcggccccgacagcggcggcaaccccuucuacagcaccagcgccgccagcagaagcagcagcgccgccagcagcgacgacgagagagagccccccggcccccccggcgccgccccccccccccccagagcccccgacgcccaggagcccgaggaggacgaggccggcgccggcuggagcgccgcccugagagacagacccccccccagauucgaggacaccggcggccccaccagaaagaugccccccagcgccagcgccguggacuucuuccagcuguucgugcccgacaacgugcugaagaacaugguggugcagaccaacauguacgccaagaaguuccaggagagauucggcagcgacggcgccuggguggaggugacccugaccgagaugaaggccuuccugggcuacaugaucagcaccagcaucagccacugcgagagcgugcugagcaucuggagcggcggcuucuacagcaacagaagccuggcccuggugaugagccaggccagauucgagaagauccugaaguacuuccacgugguggccuucagaagcagccagaccacccacggccuguacaaggugcagcccuuccuggacagccugcagaacagcuucgacagcgccuucagacccagccagacccaggugcugcacgagccccugaucgacgaggaccccguguucaucgccaccugcaccgagagagagcugagaaagagaaagaagagaaaguucagccugugggugagacagugcagcagcaccggcuucaucauccagaucuacgugcaccugaaggagggcggcggccccgacggccuggacgcccugaagaacaagccccagcugcacagcaugguggccagaagccugugcagaaacgccgccggcaagaacuacaucaucuucaccggccccagcaucaccagccugacccuguucgaggaguucgagaagcagggcaucuacugcugcggccugcugagagccagaaagagcgacugcaccggccugccccugagcaugcugaccaaccccgccaccccccccgccagaggccaguaccagaucaagaugaagggcaacaugagccugaucugcugguacaacaagggccacuucagauuccugaccaacgccuacagccccgugcagcagggcgugaucaucaagagaaagagcggcgagauccccugcccccuggccguggaggccuucgccgcccaccugagcuacaucugcagauacgacgacaaguacagcaaguacuucaucagccacaagcccaacaagaccuggcagcagguguucugguucgccaucagcaucgccaucaacaacgccuacauccuguacaagaugagcgacgccuaccacgugaagagauacagcagagcccaguucggcgagagacuggugagagagcugcugggccuggaggacgccagccccacccacuaa

SEQ ID NO: 21435 - RNA, 948 nt, Artificial Sequence
  PGC__Homo_sapiens__NP_001159896
augaaguggauggugguggugcuggugugccugcagcugcuggaggccgccguggugaaggugccccugaagaaguucaagagcaucagagagaccaugaaggagaagggccugcugggcgaguuccugagaacccacaaguacgaccccgccuggaaguacagauucggcgaccugagcgugaccuacgagcccauggccuacauggacgccgccuacuucggcgagaucagcaucggcacccccccccagaacuuccuggugcuguucgacaccggcagcagcaaccugugggugcccagcguguacugccagagccaggccugcaccagccacagcagauucaaccccagcgagagcagcaccuacagcaccaacggccagaccuucagccugcaguacggcagcggcagccugaccggcuucuucggcuacgacacccugaccgugcagagcauccaggugcccaaccaggaguucggccugagcgagaacgagcccggcaccaacuucguguacgcccaguucgacggcaucaugggccuggccuaccccgcccugagcguggacgaggccaccaccgccaugcagggcauggugcaggagggcgcccugaccagccccguguucagcguguaccugagcaaccuggugcuggagagcagcggccugggcccccugcugacccccagcagagccgccccccccagcagcacccugcagcugcccgagaagccccuggagcagaccuggaacauccugacccccuucaccaagacccugcccgugagcaaccugagcagaaaggugaccagcugggccggcgugggcauccccgugaccugccugcccgaggccggcagcggcggcgagagaagagccgagugcggccugggcgugcccaccaccagaggcccccccagaagccagcaccacagcggcgccuaa

SEQ ID NO: 21436 - RNA, 1386 nt, Artificial Sequence
  PGD__Homo_sapiens__NP_001291380
auggcccaggccgacaucgcccugaucggccuggccgugaugggccagaaccugauccugaacaugaacgaccacggcuucguggugugcgccuucaacagaaccgugagcaagguggacgacuuccuggccaacgaggccaagggcaccaagguggugggcgcccagagccugaaggagauggugagcaagcugaagaagcccagaagaaucauccugcuggugaaggccggccaggccguggacgacuucaucgagaagcugagaagaugcagagaccugaaggccaagggcauccuguucgugggcagcggcgugagcggcggcgaggagggcgccagauacggccccagccugaugcccggcggcaacaaggaggccuggccccacaucaagaccaucuuccagggcaucgccgccaaggugggcaccggcgagcccugcugcgacugggugggcgacgagggcgccggccacuucgugaagauggugcacaacggcaucgaguacggcgacaugcagcugaucugcgaggccuaccaccugaugaaggacgugcugggcauggcccaggacgagauggcccaggccuucgaggacuggaacaagaccgagcuggacagcuuccugaucgagaucaccgccaacauccugaaguuccaggacaccgacggcaagcaccugcugcccaagaucagagacagcgccggccagaagggcaccggcaaguggaccgccaucagcgcccuggaguacggcgugcccgugacccugaucggcgaggccguguucgccagaugccugagcagccugaaggacgagagaauccaggccagcaagaagcugaagggcccccagaaguuccaguucgacggcgacaagaagagcuuccuggaggacaucagaaaggcccuguacgccagcaagaucaucagcuacgcccagggcuucaugcugcugagacaggccgccaccgaguucggcuggacccugaacuacggcggcaucgcccugauguggagaggcggcugcaucaucagaagcguguuccugggcaagaucaaggacgccuucgacagaaaccccgagcugcagaaccugcugcuggacgacuucuucaagagcgccguggagaacugccaggacagcuggagaagagccgugagcaccggcgugcaggccggcauccccaugcccugcuucaccaccgcccugagcuucuacgacggcuacagacacgagaugcugcccgccagccugauccaggcccagagagacuacuucggcgcccacaccuacgagcugcuggccaagcccggccaguucauccacaccaacuggaccggccacggcggcaccgugagcagcagcagcuacaacgccuaa

SEQ ID NO: 21437 - RNA, 450 nt, Artificial Sequence
  PGF__Homo_sapiens__NP_001193941
augcccgugaugagacuguuccccugcuuccugcagcugcuggccggccuggcccugcccgccgugcccccccagcagugggcccugagcgccggcaacggcagcagcgagguggagguggugcccuuccaggagguguggggcagaagcuacugcagagcccuggagagacugguggacguggugagcgaguaccccagcgagguggagcacauguucagccccagcugcgugagccugcugagaugcaccggcugcugcggcgacgagaaccugcacugcgugcccguggagaccgccaacgugaccaugcagcugcugaagaucagaagcggcgacagacccagcuacguggagcugaccuucagccagcacgugagaugcgagugcagaccccugagagagaagaugaagcccgagagaugcggcgacgccgugcccagaagauaa

SEQ ID NO: 21438 - RNA, 1134 nt, Artificial Sequence
  PGGT1B__Homo_sapiens__NP_005014
auggccgccaccgaggacgagagacuggccggcagcggcgagggcgagagacuggacuuccugagagacagacacgugagauucuuccagagaugccugcaggugcugcccgagagauacagcagccuggagaccagcagacugaccaucgccuucuucgcccugagcggccuggacaugcuggacagccuggacguggugaacaaggacgacaucaucgaguggaucuacagccugcaggugcugcccaccgaggacagaagcaaccugaacagaugcggcuucagaggcagcagcuaccugggcauccccuucaaccccagcaaggcccccggcaccgcccaccccuacgacagcggccacaucgccaugaccuacaccggccugagcugccuggugauccugggcgacgaccugagcagagugaacaaggaggccugccuggccggccugagagcccugcagcuggaggacggcagcuucugcgccgugcccgagggcagcgagaacgacaugagauucguguacugcgccagcugcaucugcuacaugcugaacaacuggagcggcauggacaugaagaaggccaucaccuacaucagaagaagcaugagcuacgacaacggccuggcccagggcgccggccuggagagccacggcggcagcaccuucugcggcaucgccagccugugccugaugggcaagcuggaggagguguucagcgagaaggagcugaacagaaucaagagauggugcaucaugagacagcagaacggcuaccacggcagacccaacaagcccguggacaccugcuacagcuucugggugggcgccacccugaagcugcugaagaucuuccaguacaccaacuucgagaagaacagaaacuacauccugagcacccaggacagacuggugggcggcuucgccaaguggcccgacagccaccccgacgcccugcacgccuacuucggcaucugcggccugagccugauggaggagagcggcaucugcaaggugcaccccgcccugaacgugagcaccagaaccagcgagagacugcuggaccugcaccagagcuggaagaccaaggacagcaagcagugcagcgagaacgugcacaucagcaccuaa

SEQ ID NO: 21439 - RNA, 1254 nt, Artificial Sequence
  PGK1__Homo_sapiens__NP_000282
augagccugagcaacaagcugacccuggacaagcuggacgugaagggcaagagaguggugaugagaguggacuucaacgugcccaugaagaacaaccagaucaccaacaaccagagaaucaaggccgccgugcccagcaucaaguucugccuggacaacggcgccaagagcguggugcugaugagccaccugggcagacccgacggcgugcccaugcccgacaaguacagccuggagcccguggccguggagcugaagagccugcugggcaaggacgugcuguuccugaaggacugcgugggccccgagguggagaaggccugcgccaaccccgccgccggcagcgugauccugcuggagaaccugagauuccacguggaggaggagggcaagggcaaggacgccagcggcaacaaggugaaggccgagcccgccaagaucgaggccuucagagccagccugagcaagcugggcgacguguacgugaacgacgccuucggcaccgcccacagagcccacagcagcauggugggcgugaaccugccccagaaggccggcggcuuccugaugaagaaggagcugaacuacuucgccaaggcccuggagagccccgagagacccuuccuggccauccugggcggcgccaagguggccgacaagauccagcugaucaacaacaugcuggacaaggugaacgagaugaucaucggcggcggcauggccuucaccuuccugaaggugcugaacaacauggagaucggcaccagccuguucgacgaggagggcgccaagaucgugaaggaccugaugagcaaggccgagaagaacggcgugaagaucacccugcccguggacuucgugaccgccgacaaguucgacgagaacgccaagaccggccaggccaccguggccagcggcauccccgccggcuggaugggccuggacugcggccccgagagcagcaagaaguacgccgaggccgugaccagagccaagcagaucguguggaacggccccgugggcguguucgagugggaggccuucgccagaggcaccaaggcccugauggacgagguggugaaggccaccagcagaggcugcaucaccaucaucggcggcggcgacaccgccaccugcugcgccaaguggaacaccgaggacaaggugagccacgugagcaccggcggcggcgccagccuggagcugcuggagggcaaggugcugcccggcguggacgcccugagcaacaucuaa

SEQ ID NO: 21440 - RNA, 1254 nt, Artificial Sequence
  PGK2__Homo_sapiens__NP_620061
augagccugagcaagaagcugacccuggacaagcuggacgugagaggcaagagagugaucaugagaguggacuucaacgugcccaugaagaagaaccagaucaccaacaaccagagaaucaaggccagcauccccagcaucaaguacugccuggacaacggcgccaaggccguggugcugaugagccaccugggcagacccgacggcgugcccaugcccgacaaguacagccuggcccccguggccguggagcugaagagccugcugggcaaggacgugcuguuccugaaggacugcgugggcgccgagguggagaaggccugcgccaaccccgcccccggcagcgugauccugcuggagaaccugagauuccacguggaggaggagggcaagggccaggaccccagcggcaagaagaucaaggccgagcccgacaagaucgaggccuucagagccagccugagcaagcugggcgacguguacgugaacgacgccuucggcaccgcccacagagcccacagcagcauggugggcgugaaccugccccacaaggccagcggcuuccugaugaagaaggagcuggacuacuucgccaaggcccuggagaaccccgugagacccuuccuggccauccugggcggcgccaagguggccgacaagauccagcugaucaagaacaugcuggacaaggugaacgagaugaucaucggcggcggcauggccuacaccuuccugaaggugcugaacaacauggagaucggcgccagccuguucgacgaggagggcgccaagaucgugaaggacaucauggccaaggcccagaagaacggcgugagaaucaccuuccccguggacuucgugaccggcgacaaguucgacgagaacgcccaggugggcaaggccaccguggccagcggcaucagccccggcuggaugggccuggacugcggccccgagagcaacaagaaccacgcccaggugguggcccaggccagacugaucguguggaacggcccccugggcguguucgagugggacgccuucgccaagggcaccaaggcccugauggacgagaucgugaaggccaccagcaagggcugcaucaccgugaucggcggcggcgacaccgccaccugcugcgccaaguggaacaccgaggacaaggugagccacgugagcaccggcggcggcgccagccuggagcugcuggagggcaagauccugcccggcguggaggcccugagcaacauguaa

SEQ ID NO: 21441 - RNA, 777 nt, Artificial Sequence
  PGLS__Homo_sapiens__NP_036220
auggccgcccccgcccccggccugaucagcguguucagcagcagccaggagcugggcgccgcccuggcccagcugguggcccagagagccgccugcugccuggccggcgccagagccagauucgcccugggccugagcggcggcagccuggugagcaugcuggccagagagcugcccgccgccguggcccccgccggccccgccagccuggccagauggacccugggcuucugcgacgagagacuggugcccuucgaccacgccgagagcaccuacggccuguacagaacccaccugcugagcagacugcccauccccgagagccaggugaucaccaucaaccccgagcugcccguggaggaggccgccgaggacuacgccaagaagcugagacaggccuuccagggcgacagcauccccguguucgaccugcugauccugggcgugggccccgacggccacaccugcagccuguuccccgaccacccccugcugcaggagagagagaagaucguggcccccaucagcgacagccccaagccccccccccagagagugacccugacccugcccgugcugaacgccgccagaaccgugaucuucguggccaccggcgagggcaaggccgccgugcugaagagaauccuggaggaccaggaggagaacccccugcccgccgcccuggugcagccccacaccggcaagcugugcugguuccuggacgaggccgccgccagacugcugaccgugcccuucgagaagcacagcacccuguaa

SEQ ID NO: 21442 - RNA, 591 nt, Artificial Sequence
  PGLYRP1__Homo_sapiens__NP_005082
augagcagaagaagcaugcugcuggccugggcccugcccagccugcugagacugggcgccgcccaggagaccgaggaccccgccugcugcagccccaucgugcccagaaacgaguggaaggcccuggccagcgagugcgcccagcaccugagccugccccugagauacgugguggugagccacaccgccggcagcagcugcaacacccccgccagcugccagcagcaggccagaaacgugcagcacuaccacaugaagacccugggcuggugcgacgugggcuacaacuuccugaucggcgaggacggccugguguacgagggcagaggcuggaacuucaccggcgcccacagcggccaccuguggaaccccaugagcaucggcaucagcuucaugggcaacuacauggacagagugcccaccccccaggccaucagagccgcccagggccugcuggccugcggcguggcccagggcgcccugagaagcaacuacgugcugaagggccacagagacgugcagagaacccugagccccggcaaccagcuguaccaccugauccagaacuggccccacuacagaagccccuaa

SEQ ID NO: 21443 - RNA, 1731 nt, Artificial Sequence
  PGLYRP2__Homo_sapiens__NP_443122
auggcccagggcgugcuguggauccugcugggccugcugcuguggagcgaccccggcaccgccagccugccccugcugauggacagcgugauccaggcccuggccgagcuggagcagaaggugcccgccgccaagaccagacacaccgccagcgccuggcugaugagcgcccccaacagcggcccccacaacagacuguaccacuuccugcugggcgccuggagccugaacgccaccgagcuggaccccugcccccugagccccgagcugcugggccugaccaaggagguggccagacacgacgugagagagggcaaggaguacggcguggugcuggcccccgacggcagcaccguggccguggagccccugcuggccggccuggaggccggccugcagggcagaagagugaucaaccugccccuggacagcauggccgcccccugggagaccggcgacaccuuccccgacgugguggccaucgcccccgacgugagagccaccagcagccccggccugagagacggcagccccgacgugaccaccgccgacaucggcgccaacacccccgacgccaccaagggcugccccgacgugcaggccagccugcccgacgccaaggccaagagcccccccaccaugguggacagccugcuggccgugacccuggccggcaaccugggccugaccuuccugagaggcagccagacccagagccaccccgaccugggcaccgagggcugcugggaccagcugagcgcccccagaaccuucacccugcuggaccccaaggccagccugcugaccauggccuuccugaacggcgcccuggacggcgugauccugggcgacuaccugagcagaacccccgagcccagacccagccugagccaccugcugagccaguacuacggcgccggcguggccagagaccccggcuucagaagcaacuucagaagacagaacggcgccgcccugaccagcgccagcauccuggcccagcagguguggggcacccuggugcugcugcagagacuggagcccgugcaccugcagcugcagugcaugagccaggagcagcuggcccagguggccgccaacgccaccaaggaguucaccgaggccuuccugggcugccccgccauccaccccagaugcagauggggcgccgcccccuacagaggcagacccaagcugcugcagcugccccugggcuuccuguacgugcaccacaccuacgugcccgccccccccugcaccgacuucaccagaugcgccgccaacaugagaagcaugcagagauaccaccaggacacccagggcuggggcgacaucggcuacagcuucguggugggcagcgacggcuacguguacgagggcagaggcuggcacugggugggcgcccacacccugggccacaacagcagaggcuucggcguggccaucgugggcaacuacaccgccgcccugcccaccgaggccgcccugagaaccgugagagacacccugcccagcugcgccgugagagccggccugcugagacccgacuacgcccugcugggccacagacagcuggugagaaccgacugccccggcgacgcccuguucgaccugcugagaaccuggccccacuucaccgccaccgugaagcccagacccgccagaagcgugagcaagagaagcagaagagagcccccccccagaacccugcccgccaccgaccugcaguaa

SEQ ID NO: 21444 - RNA, 1026 nt, Artificial Sequence
  PGLYRP3__Homo_sapiens__XP_011507421
augggcacccugcccuggcugcuggccuucuucauccugggccugcaggccugggacacccccaccaucgugagcagaaaggaguggggcgccagaccccuggccugcagagcccugcugacccugcccguggccuacaucaucaccgaccagcugcccggcaugcagugccagcagcagagcgugugcagccagaugcugagaggccugcagagccacagcguguacaccaucggcuggugcgacguggccuacaacuuccuggugggcgacgacggcagaguguacgagggcgugggcuggaacauccagggccugcacacccagggcuacaacaacaucagccugggcaucgccuucuucggcaacaagaucggcagcagccccagccccgccgcccugagcgccgccgagggccugaucagcuacgccauccagaagggccaccugagccccagauacauccagccccugcugcugaaggaggagaccugccuggacccccagcaccccgugaugcccagaaaggugugccccaacaucaucaagagaagcgccugggaggccagagagacccacugccccaagaugaaccugcccgccaaguacgugaucaucauccacaccgccggcaccagcugcaccgugagcaccgacugccagaccguggugagaaacauccagagcuuccacauggacaccagaaacuucugcgacaucggcuaccacuuccuggugggccaggacggcggcguguacgagggcgugggcuggcacauccagggcagccacaccuacggcuucaacgacaucgcccugggcaucgccuucaucggcuacuucguggagaagccccccaacgccgccgcccuggaggccgcccaggaccugauccagugcgccgugguggagggcuaccugacccccaacuaccugcugaugggccacagcgacguggugaacauccugagccccggccaggcccuguacaacaucaucagcaccuggccccacuucaagcacuaa

SEQ ID NO: 21445 - RNA, 1122 nt, Artificial Sequence
  PGLYRP4__Homo_sapiens__NP_065126
augcugcccuggcugcugguguucagcgcccugggcauccaggccuggggcgacagcagcuggaacaagacccaggccaagcaggugagcgagggccugcaguaccuguucgagaacaucagccagcugaccgagaagggccugcccaccgacgugagcaccaccgugagcagaaaggccuggggcgccgaggccgugggcugcagcauccagcugaccacccccgugaacgugcuggugauccaccacgugcccggccuggagugccacgaccagaccgugugcagccagagacugagagagcugcaggcccaccacgugcacaacaacagcggcugcgacguggccuacaacuuccuggugggcgacgacggcagaguguacgagggcgugggcuggaacauccagggcgugcacacccagggcuacaacaacaucagccugggcuucgccuucuucggcaccaagaagggccacagccccagccccgccgcccugagcgccauggagaaccugaucaccuacgccgugcagaagggccaccugagcagcagcuacgugcagccccugcugggcaagggcgagaacugccuggcccccagacagaagaccagccugaagaaggccugccccggcguggugcccagaagcguguggggcgccagagagacccacugccccagaaugacccugcccgccaaguacggcaucaucauccacaccgccggcagaaccugcaacaucagcgacgagugcagacugcuggugagagacauccagagcuucuacaucgacagacugaagagcugcgacaucggcuacaacuuccuggugggccaggacggcgccaucuacgagggcgugggcuggaacgugcagggcagcagcacccccggcuacgacgacaucgcccugggcaucaccuucaugggcaccuucaccggcaucccccccaacgccgccgcccuggaggccgcccaggaccugauccagugcgccauggugaagggcuaccugacccccaacuaccugcuggugggccacagcgacguggccagaacccugagccccggccaggcccuguacaacaucaucagcaccuggccccacuucaagcacuaa

SEQ ID NO: 21446 - RNA, 1701 nt, Artificial Sequence
  PGM3__Homo_sapiens__NP_001186848
auggaccugggcgccaucaccaaguacagcgcccugcacgccaagcccaacggccugauccugcaguacggcaccgccggcuucagaaccaaggccgagcaccuggaccacgugauguucagaaugggccugcuggccgugcugagaagcaagcagaccaagagcaccaucggcgugauggugaccgccagccacaaccccgaggaggacaacggcgugaagcugguggacccccugggcgagaugcuggcccccagcugggaggagcacgccaccugccuggccaacgccgaggagcaggacaugcagagagugcugaucgacaucagcgagaaggaggccgugaaccugcagcaggacgccuucguggugaucggcagagacaccagacccagcagcgagaagcugagccagagcgugaucgacggcgugaccgugcugggcggccaguuccacgacuacggccugcugaccaccccccagcugcacuacaugguguacugcagaaacaccggcggcagauacggcaaggccaccaucgagggcuacuaccagaagcugagcaaggccuucguggagcugaccaagcaggccagcugcagcggcgacgaguacagaagccugaagguggacugcgccaacggcaucggcgcccugaagcugagagagauggagcacuacuucagccagggccugagcgugcagcuguucaacgacggcagcaagggcaagcugaaccaccugugcggcgccgacuucgugaagagccaccagaagcccccccagggcauggagaucaagagcaacgagagaugcugcagcuucgacggcgacgccgacagaaucguguacuacuaccacgacgccgacggccacuuccaccugaucgacggcgacaagaucgccacccugaucagcagcuuccugaaggagcugcugguggagaucggcgagagccugaacaucggcguggugcagaccgccuacgccaacggcagcagcaccagauaccuggaggaggugaugaaggugcccguguacugcaccaagaccggcgugaagcaccugcaccacaaggcccaggaguucgacaucggcguguacuucgaggccaacggccacggcaccgcccuguucagcaccgccguggagaugaagaucaagcagagcgccgagcagcuggaggacaagaagagaaaggccgccaagaugcuggagaacaucaucgaccuguucaaccaggccgccggcgacgccaucagcgacaugcuggugaucgaggccauccuggcccugaagggccugaccgugcagcagugggacgcccuguacaccgaccugcccaacagacagcugaaggugcagguggccgacagaagagugaucagcaccaccgacgccgagagacaggccgugaccccccccggccugcaggaggccaucaacgaccuggugaagaaguacaagcugagcagagccuucgugagacccagcggcaccgaggacguggugagaguguacgccgaggccgacagccaggagagcgccgaccaccuggcccacgaggugagccuggccguguuccagcuggccggcggcaucggcgagagaccccagcccggcuacaaggccgccgagaccacccacaacaucaacaacgccuucggccccggcaccgccaacgagcacaccgugcccuaa

SEQ ID NO: 21447 - RNA, 630 nt, Artificial Sequence
  PGPEP1__Homo_sapiens__NP_060182
auggagcagcccagaaaggccgugguggugaccggcuucggccccuucggcgagcacaccgugaacgccagcuggaucgccgugcaggagcuggagaagcugggccugggcgacagcguggaccugcacguguacgagauccccguggaguaccagaccgugcagagacugauccccgcccugugggagaagcacagcccccagcugguggugcacgugggcgugagcggcauggccaccaccgugacccuggagaagugcggccacaacaagggcuacaagggccuggacaacugcagauucugccccggcagccagugcugcguggaggacggccccgagagcaucgacagcaucaucgacauggacgccgugugcaagagagugaccacccugggccuggacgugagcgugaccaucagccaggacgccggcagauaccugugcgacuucaccuacuacaccagccuguaccagagccacggcagaagcgccuucgugcacgugcccccccugggcaagcccuacaacgccgaccagcugggcagagcccugagagccaucaucgaggagaugcuggaccugcuggagcagagcgagggcaagaucaacuacugccacaagcacuaa

SEQ ID NO: 21448 - RNA, 966 nt, Artificial Sequence
  PGP__Homo_sapiens__NP_001035830
auggccgccgccgaggccggcggcgacgacgccagaugcgugagacugagcgccgagagagcccaggcccugcuggccgacguggacacccugcuguucgacugcgacggcgugcuguggagaggcgagaccgccgugcccggcgcccccgaggcccugagagcccugagagccagaggcaagagacugggcuucaucaccaacaacagcagcaagaccagagccgccuacgccgagaagcugagaagacugggcuucggcggccccgccggccccggcgccagccuggagguguucggcaccgccuacugcaccgcccuguaccugagacagagacuggccggcgcccccgcccccaaggccuacgugcugggcagccccgcccuggccgccgagcuggaggccgugggcguggccagcgugggcgugggccccgagccccugcagggcgagggccccggcgacuggcugcacgccccccuggagcccgacgugagagccgugguggugggcuucgacccccacuucagcuacaugaagcugaccaaggcccugagauaccugcagcagcccggcugccugcuggugggcaccaacauggacaacagacugccccuggagaacggcagauucaucgccggcaccggcugccuggugagagccguggagauggccgcccagagacaggccgacaucaucggcaagcccagcagauucaucuucgacugcgugagccaggaguacggcaucaaccccgagagaaccgugauggugggcgacagacuggacaccgacauccugcugggcgccaccugcggccugaagaccauccugacccugaccggcgugagcacccugggcgacgugaagaacaaccaggagagcgacugcgugagcaagaagaagauggugcccgacuucuacguggacagcaucgccgaccugcugcccgcccugcagggcuaa

SEQ ID NO: 21449 - RNA, 2802 nt, Artificial Sequence
  PGR__Homo_sapiens__NP_000917
augaccgagcugaaggccaagggccccagagccccccacguggccggcggcccccccagccccgaggugggcagcccccugcugugcagacccgccgccggccccuuccccggcagccagaccagcgacacccugcccgaggugagcgccauccccaucagccuggacggccugcuguuccccagacccugccagggccaggaccccagcgacgagaagacccaggaccagcagagccugagcgacguggagggcgccuacagcagagccgaggccaccagaggcgccggcggcagcagcagcagcccccccgagaaggacagcggccugcuggacagcgugcuggacacccugcuggcccccagcggccccggccagagccagcccagcccccccgccugcgaggugaccagcagcuggugccuguucggccccgagcugcccgaggacccccccgccgcccccgccacccagagagugcugagcccccugaugagcagaagcggcugcaaggugggcgacagcagcggcaccgccgccgcccacaaggugcugcccagaggccugagccccgccagacagcugcugcugcccgccagcgagagcccccacuggagcggcgcccccgugaagcccagcccccaggccgccgccguggagguggaggaggaggacggcagcgagagcgaggagagcgccggcccccugcugaagggcaagcccagagcccugggcggcgccgccgccggcggcggcgccgccgccgugccccccggcgccgccgccggcggcguggcccuggugcccaaggaggacagcagauucagcgcccccagaguggcccugguggagcaggacgcccccauggcccccggcagaagcccccuggccaccaccgugauggacuucauccacgugcccauccugccccugaaccacgcccugcuggccgccagaaccagacagcugcuggaggacgagagcuacgacggcggcgccggcgccgccagcgccuucgccccccccagaagcagccccugcgccagcagcacccccguggccgugggcgacuuccccgacugcgccuacccccccgacgccgagcccaaggacgacgccuacccccuguacagcgacuuccagccccccgcccugaagaucaaggaggaggaggagggcgccgaggccagcgccagaagccccagaagcuaccugguggccggcgccaaccccgccgccuuccccgacuucccccugggccccccccccccccugccccccagagccacccccagcagacccggcgaggccgccgugaccgccgcccccgccagcgccagcgugagcagcgccagcagcagcggcagcacccuggagugcauccuguacaaggccgagggcgcccccccccagcagggccccuucgcccccccccccugcaaggcccccggcgccagcggcugccugcugcccagagacggccugcccagcaccagcgccagcgccgccgccgccggcgccgcccccgcccuguaccccgcccugggccugaacggccugccccagcugggcuaccaggccgccgugcugaaggagggccugccccagguguacccccccuaccugaacuaccugagacccgacagcgaggccagccagagcccccaguacagcuucgagagccugccccagaagaucugccugaucugcggcgacgaggccagcggcugccacuacggcgugcugaccugcggcagcugcaagguguucuucaagagagccauggagggccagcacaacuaccugugcgccggcagaaacgacugcaucguggacaagaucagaagaaagaacugccccgccugcagacugagaaagugcugccaggccggcauggugcugggcggcagaaaguucaagaaguucaacaaggugagaguggugagagcccuggacgccguggcccugccccagcccgugggcgugcccaacgagagccaggcccugagccagagauucaccuucagccccggccaggacauccagcugauccccccccugaucaaccugcugaugagcaucgagcccgacgugaucuacgccggccacgacaacaccaagcccgacaccagcagcagccugcugaccagccugaaccagcugggcgagagacagcugcugagcguggugaaguggagcaagagccugcccggcuucagaaaccugcacaucgacgaccagaucacccugauccaguacagcuggaugagccugaugguguucggccugggcuggagaagcuacaagcacgugagcggccagaugcuguacuucgcccccgaccugauccugaacgagcagagaaugaaggagagcagcuucuacagccugugccugaccauguggcagaucccccaggaguucgugaagcugcaggugagccaggaggaguuccugugcaugaaggugcugcugcugcugaacaccaucccccuggagggccugagaagccagacccaguucgaggagaugagaagcagcuacaucagagagcugaucaaggccaucggccugagacagaagggcguggugagcagcagccagagauucuaccagcugaccaagcugcuggacaaccugcacgaccuggugaagcagcugcaccuguacugccugaacaccuucauccagagcagagcccugagcguggaguuccccgagaugaugagcgaggugaucgccgcccagcugcccaagauccuggccggcauggugaagccccugcuguuccacaagaaguaa

SEQ ID NO: 21450 - RNA, 432 nt, Artificial Sequence
  PGRMC1__Homo_sapiens__NP_001269550
auggccgccgaggacgugguggccaccggcgccgaccccagcgaccuggagagcggcggccugcugcacgagaucuucaccagcccccugaaccugcugcugcugggccugugcaucuuccugcuguacaagaucgugagaggcgaccagcccgccgccagcggcgacagcgacgacgacgagccccccccccugcccagacugaagagaagagacuucacccccgccgagcugagaagauucgacggcgugcaggaccccagaauccugauggccaucaacggcaagguguucgacgugaccaagggcagaaaguucuacggccccgugaaguaccaccacgugggcaagcugcugaaggagggcgaggagcccaccguguacagcgacgaggaggagcccaaggacgagagcgccagaaagaacgacuaa

SEQ ID NO: 21451 - RNA, 744 nt, Artificial Sequence
  PGRMC2__Homo_sapiens__NP_006311
augggcggcgccggcagaggcgugggcgagggcagaggcagaggcggcggcggcagaagauggagagccgugauggccgccggcgacggcgacgugaagcugggcacccugggcagcggcagcgagagcagcaacgacggcggcagcgagagccccggcgacgccggcgccgccgccgagggcggcggcugggccgccgccgcccuggcccugcugaccggcggcggcgagaugcugcugaacguggcccugguggcccuggugcugcugggcgccuacagacugugggugagauggggcagaagaggccugggcgccggcgccggcgccggcgaggagagccccgccaccagccugcccagaaugaagaagagagacuucagccuggagcagcugagacaguacgacggcagcagaaaccccagaauccugcuggccgugaacggcaagguguucgacgugaccaagggcagcaaguucuacggccccgccggccccuacggcaucuucgccggcagagacgccagcagaggccuggccaccuucugccuggacaaggacgcccugagagacgaguacgacgaccugagcgaccugaacgccgugcagauggagagcgugagagagugggagaugcaguucaaggagaaguacgacuacgugggcagacugcugaagcccggcgaggagcccagcgaguacaccgacgaggaggacaccaaggaccacaacaagcaggacuaa

SEQ ID NO: 21452 - RNA, 1743 nt, Artificial Sequence
  PHACTR1__Homo_sapiens__NP_001229577
auggacuaccccaagauggacuacuuccuggacguggagagcgcccacagacugcuggacguggagagcgcccagagauucuucuacagccagggcgcccaggccagaagagccacccugcugcugccccccacccugauggccgccagcagcgaggacgacaucgacagaagacccaucagaagagugagaagcaagagcgacacccccuaccuggccgaggccagaaucagcuucaaccugggcgccgccgaggagguggagagacuggccgccaugagaagcgacagccuggugcccggcacccacaccccccccaucagaagaagaagcaaguucgccaaccugggcagaaucuucaagcccuggaaguggagaaagaagaagagcgagaaguucaagcacaccagcgccgcccuggagagaaagaucagcaugagacagagcagagaggagcugaucaagagaggcgugcugaaggagaucuacgacaaggacggcgagcugagcaucagcaacgaggaggacagccuggagaacggccagagccugagcagcagccagcugagccugcccgcccugagcgagauggagcccgugcccaugcccagagaccccugcagcuacgaggugcugcagcccagcgacaucauggacggccccgaccccggcgcccccgugaagcugcccugccugcccgugaagcugagccccccccugccccccaagaaggugaugaucugcaugcccgugggcggccccgaccugagccuggugagcuacaccgcccagaagagcggccagcagggcguggcccagcaccaccacaccgugcugcccagccagauccagcaccagcugcaguacggcagccacggccagcaccugcccagcaccaccggcagccugcccaugcaccccagcggcugcagaaugaucgacgagcugaacaagacccuggccaugaccaugcagagacuggagagcagcgagcagagagugcccugcagcaccagcuaccacagcagcggccugcacagcggcgacggcgugaccaaggccggccccaugggccugcccgagaucagacaggugcccaccguggugaucgagugcgacgacaacaaggagaacgugccccacgagagcgacuacgaggacagcagcugccuguacaccagagaggaggaggaggaggaggaggacgaggacgacgacagcagccuguacaccagcagccuggccaugaaggugugcagaaaggacagccuggccaucaagcugagcaacagacccagcaagagagagcuggaggagaagaacauccugcccagacagaccgacgaggagagacuggagcugagacagcagaucggcaccaagcugaccagaagacugagccagagacccaccgccgaggagcuggagcagagaaacauccugaagcccagaaacgagcaggaggagcaggaggagaagagagagaucaagagaagacugaccagaaagcugagccagagacccaccguggaggagcugagagagagaaagauccugaucagauucagcgacuacguggagguggccgacgcccaggacuacgacagaagagccgacaagcccuggaccagacugaccgccgccgacaaggccgccaucagaaaggagcugaacgaguucaagagcaccgagauggaggugcacgagcugagcagacaccugaccagauuccacagacccuaa

SEQ ID NO: 21453 - RNA, 1938 nt, Artificial Sequence
  PHACTR2__Homo_sapiens__NP_001093634
augggccagaccagcgugagcacccugagcccccagcccggcagcguggacggccuggacaaggccagcaucgccaacagcgacggccccaccgccggcagccagaccccccccuucaagagaaagggcaagcugagcaccaucggcaagaucuucaagcccuggaaguggagaaagaagaagaccagcgacaaguucagagagaccagcgccgugcuggagagaaagaucagcaccagacagagcagagaggagcugaucagaagaggcgugcugaaggagcugcccgaccaggacggcgacgugaccgugaacuucgagaacagcaacggccacaugauccccaucggcgaggagagcaccagagaggagaacguggugaagagcgaggagggcaacggcagcgugagcgagaagacccccccccuggaggagcaggccgaggacaagaaggagaacaccgagaaccacagcgagacccccgccgcccccgcccugccccccagcgccccccccaagcccagacccaagcccaagcccaagaagagccccgugccccccaagggcgccaccgccggcgccagccacaagggcgacgaggugccccccaucaagaagaacaccaaggcccccggcaagcaggcccccgugcccccccccaagcccgccagcagaaacaccaccagagaggccgccggcagcagccacagcaagaagaccaccggcagcaaggccagcgccagccccagcaccagcagcaccagcagcagacccaaggccagcaaggagaccgugagcagcaaggccggcaccgugggcaccaccaagggcaagagaaagaccgacaagcagcccaucaccagccaccugagcagcgacaccaccaccagcggcaccagcgaccugaagggcgagcccgccgagaccagaguggagagcuucaagcuggagcagaccgugcccggcgccgaggagcagaacaccggcaaguucaagagcauggugccccccccccccguggcccccgcccccagcccccuggcccccccccugccccuggaggaccagugcaucaccgccagcgacacccccguggugcuggugagcgugggcgccgaccugcccgugagcgcccuggaccccagccagcugcugugggccgaggagcccaccaacagaaccacccuguacagcggcaccggccugagcgugaacagagagaacgccaagugcuucaccaccaaggaggagcugggcaagaccgugccccagcugcugacccccggccugaugggcgagagcagcgagagcuucagcgccagcgaggacgagggccacagagaguaccaggccaacgacagcgacagcgacggccccauccuguacaccgacgacgaggacgaggacgaggacgaggacggcagcggcgagagcgcccuggccagcaagaucagaagaagagacacccuggccaucaagcugggcaacagacccagcaagaaggagcuggaggacaagaacauccugcagagaaccagcgaggaggagagacaggagaucagacagcagaucggcaccaagcuggugagaagacugagccagagacccaccaccgaggagcuggagcagagaaacauccugaagcagaagaacgaggaggaggagcaggaggccaagauggagcugaagagaagacugagcagaaagcugagccugagacccaccguggccgagcugcaggccagaagaauccugagauucaacgaguacguggaggugaccgacagccccgacuacgacagaagagccgacaagcccugggccagacugacccccgccgacaaggccgccaucagaaaggagcugaacgaguucaagagcaccgagauggaggugcacgaggagagcagacaguucaccagauuccacagacccuaa

SEQ ID NO: 21454 - RNA, 1671 nt, Artificial Sequence
  PHACTR3__Homo_sapiens__NP_001186434
augagaggcagaggcggcggcagagccagaugccccgccccccugagaagccugcugggcgccuucggcgccagagacgccgccgccgccgccagagaccccgcccaggacgagauggaccagaccccccccgccagacccgaguaccuggugagcggcaucagaaccccccccgugagaagaaacagcaagcuggccacccugggcagaaucuucaagcccuggaaguggagaaagaagaagaacgagaagcugaagcagaccaccagcgcccuggagaagaagauggccggcagacagggcagagaggagcugaucaagaagggccugcuggagaugauggagcaggacgccgagagcaagaccugcaaccccgacggcggccccagaagcgugcagagcgagccccccacccccaagagcgagacccugaccagcgaggacgcccagcccggcagcccccuggccaccggcaccgaccaggugagccuggacaagccccugagcagcgccgcccaccuggacgacgccgccaagaugcccagcgccagcagcggcgaggaggccgacgccggcagccugcugcccaccaccaacgagcugagccaggcccuggccggcgccgacagccuggacagcccccccagaccccuggagagaagcgugggccagcugcccagccccccccugcugcccacccccccccccaaggccagcagcaagaccaccaagaacgugaccggccaggccacccuguuccaggccagcagcaugaagagcgccgaccccagccugagaggccagcugagcacccccaccggcagcccccaccugaccaccgugcacagaccccugccccccagcagagugaucgaggagcugcacagagcccuggccaccaagcacagacaggacagcuuccagggcagagagagcaagggcagccccaagaagagacuggacgugagacugagcagaaccagcagcguggagagaggcaaggagagagaggaggccuggagcuucgacggcgcccuggagaacaagagaaccgccgccaaggagagcgaggagaacaaggagaaccugaucaucaacagcgagcugaaggacgaccugcugcuguaccaggacgaggaggcccugaacgacagcaucaucagcggcacccugcccagaaagugcaagaaggagcugcuggccgugaagcugagaaacagacccagcaagcaggagcuggaggacagaaacaucuuccccagaagaaccgacgaggagagacaggagaucagacagcagaucgagaugaagcugagcaagagacugagccagagacccgccguggaggagcuggagagaagaaacauccugaagcagagaaacgaccagaccgagcaggaggagagaagagagaucaagcagagacugaccagaaagcugaaccagagacccaccguggacgagcugagagacagaaagauccugaucagauucagcgacuacguggagguggccaaggcccaggacuacgacagaagagccgacaagcccuggaccagacugagcgccgccgacaaggccgccaucagaaaggagcugaacgaguacaagagcaacgagauggaggugcacgccagcagcaagcaccugaccagauuccacagacccuaa

SEQ ID NO: 21455 - RNA, 900 nt, Artificial Sequence
  PHB2__Homo_sapiens__NP_001138303
auggcccagaaccugaaggaccuggccggcagacugcccgccggccccagaggcaugggcaccgcccugaagcugcugcugggcgccggcgccguggccuacggcgugagagagagcguguucaccguggagggcggccacagagccaucuucuucaacagaaucggcggcgugcagcaggacaccauccuggccgagggccugcacuucagaauccccugguuccaguaccccaucaucuacgacaucagagccagacccagaaagaucagcagccccaccggcagcaaggaccugcagauggugaacaucagccugagagugcugagcagacccaacgcccaggagcugcccagcauguaccagagacugggccuggacuacgaggagagagugcugcccagcaucgugaacgaggugcugaagagcgugguggccaaguucaacgccagccagcugaucacccagagagcccaggugagccugcugaucagaagagagcugaccgagagagccaaggacuucagccugauccuggacgacguggccaucaccgagcugagcuucagcagagaguacaccgccgccguggaggccaagcagguggcccagcaggaggcccagagagcccaguuccugguggagaaggccaagcaggagcagagacagaagaucgugcaggccgagggcgaggccgaggccgccaagaugcugggcgaggcccugagcaagaaccccggcuacaucaagcugagaaagaucagagccgcccagaacaucagcaagaccaucgccaccagccagaacagaaucuaccugaccgccgacaaccuggugcugaaccugcaggacgagagcuucaccagaggcagcgacagccugaucaagggcaagaaguaa

SEQ ID NO: 21456 - RNA, 468 nt, Artificial Sequence
  PHB__Homo_sapiens__NP_001268426
auggccgccaagguguucgagagcaucggcaaguucggccuggcccuggccguggccggcggcguggugaacagcgcccuguacaacguggacgccggccacagagccgugaucuucgacagauucagaggcgugcaggacaucguggugggcgagggcacccacuuccugauccccugggugcagaagcccaucaucuucgacugcagaagcagacccagaaacgugcccgugaucaccggcagcaaggaccugcagaacgugaacaucacccugagaauccuguucagacccguggccagccagcugcccagaaucuucaccagcaucggcgaggacuacgacgagagagugcugcccagcaucaccaccgagauccugaagagcgugguggccagauucgacgccggcgagcugaucaccuaccugcccgccggccagagcgugcugcugcagcugccccaguaa

SEQ ID NO: 21457 - RNA, 3015 nt, Artificial Sequence
  PHC1__Homo_sapiens__NP_004417
auggagaccgagagcgagcagaacagcaacagcaccaacggcagcagcagcagcggcggcagcagcagaccccagaucgcccagaugagccuguacgagagacaggccgugcaggcccugcaggcccugcagagacagcccaacgccgcccaguacuuccaccaguucaugcugcagcagcagcugagcaacgcccagcugcacagccuggccgccgugcagcaggccaccaucgccgccagcagacaggccagcagccccaacaccagcaccacccagcagcagaccaccaccacccaggccagcaucaaccuggccaccaccagcgccgcccagcugaucagcagaagccagagcgugagcagccccagcgccaccacccugacccagagcgugcugcugggcaacaccaccagccccccccugaaccagagccaggcccagauguaccugagaccccagcugggcaaccugcugcaggugaacagaacccugggcagaaacgugccccuggccagccagcugauccugaugcccaacggcgccguggccgccgugcagcaggaggugcccagcgcccagagccccggcgugcacgccgacgccgaccaggugcagaaccuggccgugagaaaccagcaggccagcgcccagggcccccagaugcagggcagcacccagaaggccaucccccccggcgccagccccgugagcagccugagccaggccagcagccaggcccuggccguggcccaggccagcagcggcgccaccaaccagagccugaaccugagccaggccggcggcggcagcggcaacagcauccccggcagcaugggccccggcggcggcggccaggcccacggcggccugggccagcugcccagcagcggcaugggcggcggcagcugccccagaaagggcaccggcguggugcagccccugcccgccgcccagaccgugaccgugagccagggcagccagaccgaggccgagagcgccgccgccaagaaggccgaggccgacggcagcggccagcagaacgugggcaugaaccugaccagaaccgccacccccgcccccagccagacccugaucagcagcgccaccuacacccagauccagccccacagccugauccagcagcagcagcagauccaccugcagcagaagcagguggugauccagcagcagaucgccauccaccaccagcagcaguuccagcacagacagagccagcugcugcacaccgccacccaccugcagcuggcccagcagcagcagcagcagcagcagcagcagcagcagcagcagcagccccaggccaccacccugaccgccccccagcccccccaggugccccccacccagcaggugccccccagccagagccagcagcaggcccagacccugguggugcagcccaugcugcagagcagcccccugagccugccccccgacgccgcccccaagccccccauccccauccagagcaagccccccguggcccccaucaagcccccccagcugggcgccgccaagaugagcgccgcccagcagccccccccccacauccccgugcagguggugggcaccagacagcccggcaccgcccaggcccaggcccugggccuggcccagcuggccgccgccgugcccaccagcagaggcaugcccggcaccgugcagagcggccaggcccaccuggccagcagcccccccagcagccaggcccccggcgcccugcaggagugcccccccacccuggcccccggcaugacccuggcccccgugcagggcaccgcccacguggugaagggcggcgccaccaccagcagccccgugguggcccaggugcccgccgccuucuacaugcagagcgugcaccugcccggcaagccccagacccuggccgugaagagaaaggccgacagcgaggaggagagagacgacgugagcacccugggcagcaugcugcccgccaaggccagccccguggccgagagccccaaggugauggacgagaagagcagccugggcgagaaggccgagagcguggccaacgugaacgccaacacccccagcagcgagcugguggcccugacccccgcccccagcgugcccccccccacccuggccauggugagcagacagaugggcgacagcaagcccccccaggccaucgugaagccccagauccugacccacaucaucgagggcuucgugauccaggagggcgccgagcccuuccccgugggcugcagccagcugcugaaggagagcgagaagccccugcagaccggccugcccaccggccugaccgagaaccagagcggcggcccccugggcguggacagccccagcgccgagcuggacaagaaggccaaccugcugaagugcgaguacugcggcaaguacgcccccgccgagcaguucagaggcagcaagagauucugcagcaugaccugcgccaagagauacaacgugagcugcagccaccaguucagacugaagagaaagaagaugaaggaguuccaggaggccaacuacgccagagugagaagaagaggccccagaagaagcagcagcgacaucgccagagccaagauccagggcaagugccacagaggccaggaggacagcagcagaggcagcgacaacagcagcuacgacgaggcccugagccccaccagccccggcccccugagcgugagagccggccacggcgagagagaccugggcaaccccaacaccgccccccccacccccgagcugcacggcaucaaccccguguuccugagcagcaaccccagcagauggagcguggaggagguguacgaguucaucgccagccugcagggcugccaggagaucgccgaggaguucagaagccaggagaucgacggccaggcccugcugcugcugaaggaggagcaccugaugagcgccaugaacaucaagcugggccccgcccugaagaucugcgccaagaucaacgugcugaaggagaccuaa

SEQ ID NO: 21458 - RNA, 861 nt, Artificial Sequence
  PHC2__Homo_sapiens__XP_011539177
augaccagcggcaacggcaacagcgccagcagcaucgccggcaccgccccccagaacggcgagaacaagcccccccaggccaucgugaagccccagauccugacccacgugaucgagggcuucgugauccaggagggcgccgagcccuuccccgugggcagaagcagccugcuggugggcaaccugaagaagaaguacgcccagggcuuccugcccgagaagcugccccagcaggaccacaccaccaccaccgacagcgagauggaggagcccuaccugcaggagagcaaggaggagggcgccccccugaagcugaagugcgagcugugcggcagaguggacuucgccuacaaguucaagagaagcaagagauucugcagcauggccugcgccaagagauacaacgugggcugcaccaagagagugggccuguuccacagcgacagaagcaagcugcagaaggccggcgccgccacccacaacagaagaagagccagcaaggccagccugcccccccugaccaaggacaccaagaagcagcccaccggcaccgugccccugagcgugaccgccgcccugcagcugacccacagccaggaggacagcagcagaugcagcgacaacagcagcuacgaggagccccugagccccaucagcgccagcagcagcaccagcagaagaagacagggccagagagaccuggagcugcccgacaugcacaugagagaccuggugggcaugggccaccacuuccugcccagcgagcccaccaaguggaacguggaggacguguacgaguucaucagaagccugcccgaguacccccacagacaccagauccccgacagccuggugcccuaa

SEQ ID NO: 21459 - RNA, 2988 nt, Artificial Sequence
  PHC3__Homo_sapiens__NP_079223
auggccgaggccgaguucaaggaccacagcaccgccauggacaccgagcccaaccccggcaccagcagcgugagcaccaccaccagcagcaccaccaccaccaccaucaccaccagcagcagcagaaugcagcagccccagaucagcguguacagcggcagcgacagacacgccgugcaggugauccagcaggcccugcacagaccccccagcagcgccgcccaguaccugcagcagauguacgccgcccagcagcagcaccugaugcugcacaccgccgcccugcagcagcagcaccugagcagcagccagcugcagagccuggccgccgugcaggccagccugagcagcggcagacccagcaccagccccaccggcagcgugacccagcagagcagcaugagccagaccagcaucaaccugagcaccagccccacccccgcccagcugaucagcagaagccaggccagcagcagcaccagcggcagcaucacccagcagaccaugcugcugggcagcaccagccccacccugaccgccagccaggcccagauguaccugagagcccagaugcugaucuucacccccgccaccaccguggccgccgugcagagcgacauccccguggugagcagcagcagcagcagcagcugccagagcgccgccacccaggugcagaaccugacccugagaagccagaagcugggcgugcugagcagcagccagaacggcccccccaagagcaccagccagacccagagccugaccaucugccacaacaagaccaccgugaccagcagcaagaucagccagagagaccccagccccgagagcaacaagaagggcgagagccccagccuggagagcagaagcaccgccgugaccagaaccagcagcauccaccagcugaucgcccccgccagcuacagccccauccagccccacagccugaucaagcaccagcagaucccccugcacagcccccccagcaaggugagccaccaccagcugauccugcagcagcagcagcagcagauccagcccaucacccugcagaacagcacccaggaccccccccccagccagcacugcaucccccugcagaaccacggccugccccccgcccccagcaacgcccagagccagcacugcagccccauccagagccaccccagcccccugaccgugagccccaaccagagccagagcgcccagcagagcgugguggugagccccccccccccccacagccccagccagagccccaccaucaucauccacccccaggcccugauccagccccacccccuggugagcagcgcccugcagcccggccccaaccugcagcagagcaccgccaaccaggugcaggccaccgcccagcugaaccugcccagccaccugccccugcccgccagccccguggugcacaucggccccgugcagcagagcgcccuggugagccccggccagcagaucgugagccccagccaccagcaguacagcagccugcagagcagccccauccccaucgccagccccccccagaugagcaccagcccccccgcccagauccccccccugccccugcagagcaugcagagccugcaggugcagcccgagauccugagccagggccaggugcuggugcagaacgcccuggugagcgaggaggagcugcccgccgccgaggcccuggugcagcugcccuuccagacccugccccccccccagaccguggccgugaaccugcaggugcagccccccgcccccguggacccccccgugguguaccagguggaggacgugugcgaggaggagaugcccgaggagagcgacgagugcgugagaauggacagaaccccccccccccccacccugagccccgccgccaucaccgugggcagaggcgaggaccugaccagcgagcacccccugcuggagcagguggagcugcccgccguggccagcgugagcgccagcgugaucaagagccccagcgaccccagccacgugagcgugcccccccccccccugcugcugcccgccgccaccaccagaagcaacagcaccagcaugcacagcagcauccccagcaucgagaacaagcccccccaggccaucgugaagccccagauccugacccacgugaucgagggcuucgugauccaggagggccuggagcccuuccccgugagcagaagcagccugcugaucgagcagcccgugaagaagagaccccugcuggacaaccaggugaucaacagcgugugcgugcagcccgagcugcagaacaacaccaagcacgccgacaacagcagcgacaccgagauggaggacaugaucgccgaggagacccuggaggagauggacagcgagcugcugaagugcgaguucugcggcaagaugggcuacgccaacgaguuccugagaagcaagagauucugcaccaugagcugcgccaagagauacaacgugagcugcagcaagaaguucgcccugagcagauggaacagaaagcccgacaaccagagccugggccacagaggcagaagacccagcggccccgacggcgccgccagagagcacauccugagacagcugcccaucaccuaccccagcgccgaggaggaccuggccagccacgaggacagcgugcccagcgccaugaccaccagacugagaagacagagcgagagagagagagagagagagcugagagacgugagaaucagaaagaugcccgagaacagcgaccugcugcccguggcccagaccgagcccagcaucuggaccguggacgacgugugggccuucauccacagccugcccggcugccaggacaucgccgacgaguucagagcccaggagaucgacggccaggcccugcugcugcugaaggaggaccaccugaugagcgccaugaacaucaagcugggccccgcccugaagaucugcgccagaaucaacagccugaaggagagcuaa

SEQ ID NO: 21460 - RNA, 2250 nt, Artificial Sequence
  PHEX__Homo_sapiens__NP_000435
auggaggccgagaccggcagcagcguggagaccggcaagaaggccaacagaggcaccagaaucgcccuggugguguucgugggcggcacccuggugcugggcaccauccuguuccuggugagccagggccugcugagccugcaggccaagcaggaguacugccugaagcccgagugcaucgaggccgccgccgccauccugagcaaggugaaccugagcguggaccccugcgacaacuucuucagauucgccugcgacggcuggaucagcaacaaccccauccccgaggacaugcccagcuacggcguguaccccuggcugagacacaacguggaccugaagcugaaggagcugcuggagaagagcaucagcagaagaagagacaccgaggccauccagaaggccaagauccuguacagcagcugcaugaacgagaaggccaucgagaaggccgacgccaagccccugcugcacauccugagacacagccccuucagauggcccgugcuggagagcaacaucggccccgagggcguguggagcgagagaaaguucagccugcugcagacccuggccaccuucagaggccaguacagcaacagcguguucaucagacuguacgugagccccgacgacaaggccagcaacgagcacauccugaagcuggaccaggccacccugagccuggccgugagagaggacuaccuggacaacagcaccgaggccaagagcuacagagacgcccuguacaaguucaugguggacaccgccgugcugcugggcgccaacagcagcagagccgagcacgacaugaagagcgugcugagacuggagaucaagaucgccgagaucaugaucccccacgagaacagaaccagcgaggccauguacaacaagaugaacaucagcgagcugagcgccaugaucccccaguucgacuggcugggcuacaucaagaaggugaucgacaccagacuguacccccaccugaaggacaucagccccagcgagaacgugguggugagagugccccaguacuucaaggaccuguucagaauccugggcagcgagagaaagaagaccaucgccaacuaccugguguggagaaugguguacagcagaauccccaaccugagcagaagauuccaguacagauggcuggaguucagcagagugauccagggcaccaccacccugcugccccagugggacaagugcgugaacuucaucgagagcgcccugcccuacguggugggcaagauguucguggacguguacuuccaggaggacaagaaggagaugauggaggagcugguggagggcgugagaugggccuucaucgacaugcuggagaaggagaacgaguggauggacgccggcaccaagagaaaggccaaggagaaggccagagccgugcuggccaaggugggcuaccccgaguucaucaugaacgacacccacgugaacgaggaccugaaggccaucaaguucagcgaggccgacuacuucggcaacgugcugcagaccagaaaguaccuggcccagagcgacuucuucuggcugagaaaggccgugcccaagaccgagugguucaccaaccccaccaccgugaacgccuucuacagcgccagcaccaaccagaucagauuccccgccggcgagcugcagaagcccuucuucuggggcaccgaguaccccagaagccugagcuacggcgccaucggcgugaucgugggccacgaguucacccacggcuucgacaacaacggcagaaaguacgacaagaacggcaaccuggaccccugguggagcaccgagagcgaggagaaguucaaggagaagaccaagugcaugaucaaccaguacagcaacuacuacuggaagaaggccggccugaacgugaagggcaagagaacccugggcgagaacaucgccgacaacggcggccugagagaggccuucagagccuacagaaaguggaucaacgacagaagacagggccuggaggagccccugcugcccggcaucaccuucaccaacaaccagcuguucuuccugagcuacgcccacgugagaugcaacagcuacagacccgaggccgccagagagcaggugcagaucggcgcccacagccccccccaguucagagugaacggcgccaucagcaacuucgaggaguuccagaaggccuucaacugcccccccaacagcaccaugaacagaggcauggacagcugcagacugugguaa

SEQ ID NO: 21461 - RNA, 1497 nt, Artificial Sequence
  PHF10__Homo_sapiens__NP_060758
auggccgccgccgccggccccggcgccgcccugagccccagacccugcgacagcgaccccgccacccccggcgcccagagccccaaggacgacaacgaggacaacagcaacgacggcacccagcccagcaagagaagaagaaugggcagcggcgacagcagcagaagcugcgagaccagcagccaggaccugggcuucagcuacuaccccgccgagaaccugaucgaguacaaguggccccccgacgagaccggcgaguacuacaugcugcaggagcaggugagcgaguaccugggcgugaccagcuucaagagaaaguaccccgaccuggagagaagagaccugagccacaaggagaagcuguaccugagagagcugaacgugaucaccgagacccagugcacccugggccugaccgcccugagaagcgacgaggugaucgaccugaugaucaaggaguaccccgccaagcacgccgaguacagcgugauccugcaggagaaggagagacagagaaucaccgaccacuacaaggaguacagccagaugcagcagcagaacacccagaagguggaggccagcaaggugcccgaguacaucaagaaggccgccaagaaggccgccgaguucaacagcaaccugaacagagagagaauggaggagagaagagccuacuucgaccugcagacccacgugauccaggugccccagggcaaguacaaggugcugcccaccgagagaaccaaggugagcagcuaccccguggcccugauccccggccaguuccaggaguacuacaagagauacagccccgacgagcugagauaccugccccugaacaccgcccuguacgagcccccccuggaccccgagcugcccgcccuggacagcgacggcgacagcgacgacggcgaggacggcagaggcgacgagaagagaaagaacaagggcaccagcgacagcagcagcggcaacgugagcgagggcgagagcccccccgacagccaggaggacagcuuccagggcagacagaagagcaaggacaaggccgccacccccagaaaggacggccccaagagaagcgugcugagcaagagcgugcccggcuacaagcccaaggugauccccaacgccaucugcggcaucugccugaagggcaaggagagcaacaagaagggcaaggccgagagccugauccacugcagccagugcgagaacagcggccaccccagcugccuggacaugaccauggagcuggugagcaugaucaagaccuaccccuggcagugcauggagugcaagaccugcaucaucugcggccagccccaccacgaggaggagaugauguucugcgacaugugcgacagaggcuaccacaccuucugcgugggccugggcgccauccccagcggcagauggaucugcgacugcugccagagagccccccccacccccagaaaggugggcagaagaggcaagaacagcaaggagggcuaa

SEQ ID NO: 21462 - RNA, 996 nt, Artificial Sequence
  PHF11__Homo_sapiens__NP_001035533
auggcccaggccagcccccccagacccgagagagugcugggcgccagcagccccgaggccagacccgcccaggaggcccugcugcugcccaccggcguguuccagguggccgagaagauggagaagagaaccugcgcccugugccccaaggacguggaguacaacgugcuguacuucgcccagagcgagaacaucgccgcccacgagaacugccugcuguacagcagcggccugguggagugcgaggaccaggacccccugaaccccgacagaagcuucgacguggagagcgugaagaaggagauccagagaggcagaaagcugaagugcaaguucugccacaagagaggcgccaccgugggcugcgaccugaagaacugcaacaagaacuaccacuucuucugcgccaagaaggacgacgccgugccccagagcgacggcgugagaggcaucuacaagcugcugugccagcagcacgcccaguuccccaucaucgcccagagcgccaaguucagcggcgugaagagaaagagaggcagaaagaagccccugagcggcaaccacgugcagccccccgagaccaugaagugcaacaccuucaucagacaggugaaggaggagcacggcagacacaccgacgccaccgugaaggugcccuuccugaagaagugcaaggaggccggccugcugaacuaccugcuggaggagauccuggacaaggugcacagcauccccgagaagcugauggacgagaccaccagcgagagcgacuacgaggagaucggcagcgcccuguucgacugcagacuguucgaggacaccuucgugaacuuccaggccgccaucgagaagaagauccacgccagccagcagagauggcagcagcugaaggaggagaucgagcugcugcaggaccugaagcagacccugugcagcuuccaggagaacagagaccugaugagcagcagcaccagcaucagcagccugagcuacuaa

SEQ ID NO: 21463 - RNA, 3015 nt, Artificial Sequence
  PHF12__Homo_sapiens__NP_001028733
augugggagaagauggagaccaagaccaucguguacgaccuggacaccagcggcggccugauggagcagauccaggcccugcuggccccccccaagaccgacgaggccgagaagagaagcagaaagcccgagaaggagcccagaagaagcggcagagccaccaaccacgacagcugcgacagcugcaaggagggcggcgaccugcugugcugcgaccacugccccgccgccuuccaccugcagugcugcaaccccccccugagcgaggagaugcugccccccggcgaguggaugugccacagaugcaccgugagaagaaagaagagagagcagaagaaggagcugggccacgugaacggccugguggacaagagcggcaagagaaccaccagccccagcagcgacaccgaccugcuggacagaagcgccagcaagaccgagcugaaggccaucgcccacgccagaauccuggagagaagagccagcagacccggcacccccaccagcagcgccagcaccgagacccccaccagcgagcagaacgacguggacgaggacaucaucgacguggacgaggagcccguggccgccgagcccgacuacgugcagccccagcugagaagacccuucgagcugcugaucgccgccgccauggagagaaaccccacccaguuccagcugcccaacgagcugaccugcaccaccgcccugcccggcagcagcaagagaagaagaaaggaggagaccaccggcaagaacgugaagaagacccagcacgagcuggaccacaacggccuggugccccugcccgugaaggugugcuucaccugcaacagaagcugcagaguggccccccugauccagugcgacuacugcccccugcuguuccacauggacugccuggagcccccccugaccgccaugccccugggcagauggaugugccccaaccacaucgagcacguggugcugaaccagaagaacaugacccugagcaacagaugccagguguucgacagauuccaggacaccgugagccagcacguggugaagguggacuuccugaacagaauccacaagaagcacccccccaacagaagagugcugcagagcgugaagagaagaagccugaaggugcccgacgccaucaagagccaguaccaguucccccccccccugaucgcccccgccgccaucagagacggcgagcugaucugcaacggcauccccgaggagagccagaugcaccugcugaacagcgagcaccuggccacccaggccgagcagcaggaguggcugugcagcgugguggcccugcagugcagcauccugaagcaccugagcgccaagcagaugcccagccacugggacagcgagcagaccgagaaggccgacaucaagcccgugaucgugaccgacagcagcgugaccaccagccugcagaccgccgacaagacccccacccccagccacuacccccugagcugccccagcggcaucagcacccagaacagccugagcugcagccccccccaccagagccccgcccuggaggacaucggcugcagcagcugcgccgagaagagcaagaagacccccugcggcaccgccaacggccccgugaacaccgaggugaaggccaacggcccccaccuguacagcagccccaccgacagcaccgaccccagaagacugcccggcgccaacaccccccugcccggccugagccacagacagggcuggcccagaccccugaccccccccgccgccggcggccugcagaaccacaccgugggcaucaucgugaagaccgagaacgccaccggccccagcagcugcccccagagaagccuggugcccgugcccagccugccccccagcauccccagcagcugcgccagcaucgagaacaccagcacccugcagagaaagaccgugcagagccagaucggccccccccugaccgacagcagaccccugggcagcccccccaacgccaccagagugcugacccccccccaggccgccggcgacggcauccuggccaccaccgccaaccagagauucagcagccccgcccccagcagcgacggcaaggugagccccggcacccugagcaucggcagcgcccugaccgugcccagcuuccccgccaacagcaccgccaugguggaccugaccaacagccugagagccuucauggacgugaacggcgagaucgagaucaacaugcuggacgagaagcugaucaaguuccuggcccugcagagaauccaccagcuguuccccagcagagugcagcccagccccggcagcgugggcacccaccagcuggccagcggcggccaccacaucgaggugcagagaaaggaggugcaggccagagccguguucuacccccugcugggccugggcggcgccgugaacaugugcuacagaacccuguacaucggcaccggcgccgacauggacgugugccugaccaacuacggccacugcaacuacgugagcggcaagcacgccugcaucuucuacgacgagaacaccaagcacuacgagcugcugaacuacagcgagcacggcaccaccguggacaacgugcuguacagcugcgacuucagcgagaagaccccccccaccccccccagcagcaucguggccaaggugcagagcgugaucagaagaagaagacaccagaagcaggacgaggagcccagcgaggaggccgccaugaugagcagccaggcccagggcccccagagaagacccugcaacugcaaggccagcagcagcagccugaucggcggcagcggcgccggcugggagggcaccgcccugcugcaccacggcagcuacaucaagcugggcugccugcaguucguguucagcaucaccgaguucgccaccaagcagcccaagggcgacgccagccugcugcaggacggcgugcuggccgagaagcugagccugaagccccaccagggccccgugcugagaagcaacagcgugcccuaa

SEQ ID NO: 21464 - RNA, 624 nt, Artificial Sequence
  PHF19__Homo_sapiens__NP_001009936
auggagaacagagcccuggaccccggcaccagagacagcuacggcgccaccagccaccugcccaacaagggcgcccuggccaaggugaagaacaacuucaaggaccugaugagcaagcugaccgagggccaguacgugcugugcagauggaccgacggccuguacuaccugggcaagaucaagagagugagcagcagcaagcagagcugccuggugaccuucgaggacaacagcaaguacugggugcuguggaaggacauccagcacgccggcgugcccggcgaggagcccaagugcaacaucugccugggcaagaccagcggcccccugaacgagauccugaucugcggcaagugcggccugggcuaccaccagcagugccacauccccaucgccggcagcgccgaccagccccugcugacccccugguucugcagaagaugcaucuucgcccuggccgugagagugagccugcccagcagccccgugcccgccagccccgccagcagcagcggcgccgaccagagacugcccagccagagccugagcagcaagcagaagggccacaccugggcccuggagaccgacagcgccagcgccaccgugcugggccaggaccuguaa

SEQ ID NO: 21465 - RNA, 1374 nt, Artificial Sequence
  PHF1__Homo_sapiens__NP_002627
auggcccagccccccagacugagcagaagcggcgccagcagccugugggaccccgccagccccgcccccaccagcggccccagacccagacugugggagggccaggacgugcuggccagauggaccgacggccugcuguaccugggcaccaucaagaagguggacagcgccagagaggugugccuggugcaguucgaggacgacagccaguuccuggugcuguggaaggacaucagccccgccgcccugcccggcgaggagcugcugugcugcgugugcagaagcgagaccguggugcccggcaacagacuggugagcugcgagaagugcagacacgccuaccaccaggacugccacgugcccagagcccccgcccccggcgagggcgagggcaccagcugggugugcagacagugcguguucgccaucgccaccaagagaggcggcgcccugaagaagggccccuacgccagagccaugcugggcaugaagcugagccugcccuacggccugaagggccuggacugggacgccggccaccugagcaacagacagcagagcuacugcuacugcggcggccccggcgaguggaaccugaagaugcugcagugcagaagcugccugcagugguuccacgaggccugcacccagugccugagcaagccccugcuguacggcgacagauucuacgaguucgagugcugcgugugcagaggcggccccgagaaggugagaagacugcagcugagauggguggacguggcccaccuggugcuguaccaccugagcgugugcugcaagaagaaguacuucgacuucgacagagagauccugcccuucaccagcgagaacugggacagccugcugcugggcgagcugagcgacacccccaagggcgagagaagcagcaagcugcugagcgcccugaacagccacaaggacagauucaucagcggcagagagaucaagaagagaaagugccuguucggccugcacgccagaaugcccccccccguggagccccccaccggcgacggcgcccugaccagagccggccccuggggcagaggccugaccagccccggcgaggcccccgaggccggcgccagagcccccgaggaggaggccgagggcgagagcggcggcgccggcgccacccugagcagcgcccagagcgccagagcccccggcgccgagggcgccggcagcagcgccgagggcaccgccgccgcccccagcggcugccugcugcccagcacccugcugcccgccccccagggcccccugggcaccguggacccccagaccggccaccccuggaacuucacccuggugagcccccagaccagccugaaggugccccccaccagauaa

SEQ ID NO: 21466 - RNA, 3039 nt, Artificial Sequence
  PHF20__Homo_sapiens__NP_057520
augaccaagcacccccccaacagaagaggcaucagcuucgaggugggcgcccagcuggaggccagagacagacugaagaacugguaccccgcccacaucgaggacaucgacuacgaggagggcaaggugcugauccacuucaagagauggaaccacagauacgacgagugguucugcugggacagccccuaccugagaccccuggagaagauccagcugagaaaggagggccugcacgaggaggacggcagcagcgaguuccagaucaacgagcaggugcuggccugcuggagcgacugcagauucuaccccgccaaggugaccgccgugaacaaggacggcaccuacaccgugaaguucuacgacggcguggugcagaccgugaagcacauccacgugaaggccuucagcaaggaccagaacaucgugggcaacgccagacccaaggagaccgaccacaagagccugagcagcagccccgacaagagagagaaguucaaggagcagagaaaggccaccgugaacgugaagaaggacaaggaggacaagccccugaagaccgagaagagacccaagcagcccgacaaggagggcaagcugaucugcagcgagaagggcaaggugagcgagaagagccugcccaagaacgagaaggaggacaaggagaacaucagcgagaacgacagagaguacagcggcgacgcccagguggacaagaagcccgagaacgacaucgugaagagcccccaggagaaccugagagagcccaagagaaagagaggcagaccccccagcaucgcccccaccgccguggacagcaacagccagacccugcagcccaucacccuggagcugagaagaagaaagaucagcaagggcugcgaggugccccugaagagacccagacuggacaagaacagcagccaggagaagagcaagaacuacagcgagaacaccgacaaggaccugagcagaagaagaagcagcagacugagcaccaacggcacccacgagauccuggaccccgaccugguggugagcgaccugguggacaccgacccccugcaggacacccugagcagcaccaaggagagcgaggagggccagcugaagagcgcccuggaggccggccaggugagcagcgcccugaccugccacagcuucggcgacggcagcggcgccgccggccuggagcugaacugccccagcaugggcgagaacaccaugaagaccgagcccaccagcccccugguggagcugcaggagaucagcaccguggaggugaccaacaccuucaagaagaccgacgacuucggcagcagcaacgcccccgccguggaccuggaccacaaguucagaugcaaggugguggacugccugaaguucuucagaaaggccaagcugcugcacuaccacaugaaguacuuccacggcauggagaagagccuggagcccgaggagagccccggcaagagacacgugcagaccagaggccccagcgccagcgacaagcccagccaggagacccugaccagaaagagagugagcgccagcagccccaccaccaaggacaaggagaagaacaaggagaagaaguucaaggaguucgugagagugaagcccaagaagaagaagaagaagaagaagaagaccaagcccgagugccccugcagcgaggagaucagcgacaccagccaggagcccagcccccccaaggccuucgccgugaccagaugcggcagcagccacaagcccggcgugcacaugagcccccagcugcacggccccgagagcggccaccacaagggcaaggugaaggcccuggaggaggacaaccugagcgagagcagcagcgagagcuuccuguggagcgacgacgaguacggccaggacguggacgugaccaccaaccccgacgaggagcuggacggcgacgacagauacgacuucgagguggugagaugcaucugcgaggugcaggaggagaacgacuucaugauccagugcgaggagugccagugcuggcagcacggcgugugcaugggccugcuggaggagaacgugcccgagaaguacaccugcuacgugugccaggacccccccggccagagacccggcuucaaguacugguacgacaaggaguggcugagcagaggccacaugcacggccuggccuuccuggaggagaacuacagccaccagaacgccaagaagaucguggccacccaccagcugcugggcgacgugcagagagugaucgaggugcugcacggccugcagcugaagaugagcauccugcagagcagagagcaccccgaccugccccuguggugccagcccuggaagcagcacagcggcgagggcagaagccacuucagaaacauccccgugaccgacaccagaagcaaggaggaggcccccagcuacagaacccugaacggcgccguggagaagcccagaccccuggcccugccccugcccagaagcguggaggagagcuacaucaccagcgagcacugcuaccagaagcccagagccuacuaccccgccguggagcagaagcuggugguggagaccagaggcagcgcccuggacgacgccgugaacccccugcacgagaacggcgacgacagccugagccccagacugggcuggccccuggaccaggacagaagcaagggcgacagcgaccccaagcccggcagccccaaggugaaggaguacgugagcaagaaggcccugcccgaggaggcccccgccagaaagcugcuggacagaggcggcgagggccugcugagcagccagcaccaguggcaguucaaccugcugacccacguggagagccugcaggacgaggugacccacagaauggacagcaucgagaaggagcuggacgugcuggagagcuggcuggacuacaccggcgagcuggagccccccgagccccuggccagacugccccagcugaagcacugcaucaagcagcugcugauggaccugggcaaggugcagcagaucgcccugugcugcagcaccuaa

SEQ ID NO: 21467 - RNA, 2043 nt, Artificial Sequence
  PHF21A__Homo_sapiens__NP_001095272
auggagcugcagacccugcaggaggcccugaagguggagauccaggugcaccagaagcugguggcccagaugaagcaggacccccagaacgccgaccugaagaagcagcugcacgagcugcaggccaagaucaccgcccugagcgagaagcagaagagagugguggagcagcugagaaagaaccugaucgugaagcaggagcagcccgacaaguuccagauccagccccugccccagagcgagaacaagcugcagaccgcccagcagcagccccugcagcagcugcagcagcagcagcaguaccaccaccaccacgcccagcagagcgccgccgccagccccaaccugaccgccagccagaagaccgugaccaccgccagcaugaucaccaccaagacccugccccuggugcugaaggccgccaccgccaccaugcccgccagcguggugggccagagacccaccaucgccauggugaccgccaucaacagccagaaggccgugcugagcaccgacgugcagaacacccccgugaaccugcagaccagcagcaaggugaccggccccggcgccgaggccgugcagaucguggccaagaacaccgugacccuggugcaggccacccccccccagcccaucaaggugccccaguucauccccccccccagacugacccccagacccaacuuccugccccaggugagacccaagcccguggcccagaacaacauccccaucgcccccgcccccccccccaugcuggccgccccccagcugauccagagacccgugaugcugaccaaguucacccccaccacccugcccaccagccagaacagcauccaccccgugagaguggugaacggccagaccgccaccaucgccaagaccuuccccauggcccagcugaccagcaucgugaucgccacccccggcaccagacuggccggcccccagaccgugcagcugagcaagcccagccuggagaagcagaccgugaagagccacaccgagaccgacgagaagcagaccgagagcagaaccaucaccccccccgccgcccccaagcccaagagagaggagaacccccagaagcuggccuucauggugagccugggccuggugacccacgaccaccuggaggagauccagagcaagagacaggagagaaagagaagaaccaccgccaaccccguguacagcggcgccguguucgagcccgagagaaagaagagcgccgugaccuaccugaacagcaccaugcaccccggcaccagaaagagaggcagaccccccaaguacaacgccgugcugggcuucggcgcccugacccccaccagcccccagagcagccaccccgacagccccgagaacgagaagaccgagaccaccuucaccuuccccgcccccgugcagcccgugagccugcccagccccaccagcaccgacggcgacauccacgaggacuucugcagcgugugcagaaagagcggccagcugcugaugugcgacaccugcagcagaguguaccaccuggacugccuggaccccccccugaagaccauccccaagggcauguggaucugccccagaugccaggaccagaugcugaagaaggaggaggccauccccuggcccggcacccuggccaucgugcacagcuacaucgccuacaaggccgccaaggaggaggagaagcagaagcugcugaaguggagcagcgaccugaagcaggagagagagcagcuggagcagaaggugaagcagcugagcaacagcaucagcaagugcauggagaugaagaacaccauccuggccagacagaaggagaugcacagcagccuggagaaggugaagcagcugaucagacugauccacggcaucgaccugagcaagcccguggacagcgaggccaccgugggcgccaucagcaacggccccgacugcaccccccccgccaacgccgccaccagcacccccgcccccagccccagcagccagagcugcaccgccaacugcaaccagggcgaggagaccaaguaa

SEQ ID NO: 21468 - RNA, 1200 nt, Artificial Sequence
  PHF23__Homo_sapiens__NP_001271447
augcccggcgacugcagaagagaccccccccccacccugaagcccgagacccagccccccgagaagagaagaagaaccaucgaggacuucaacaaguucugcagcuucgugcuggccuacgccggcuacaucccccccagcaaggaggagagcgacuggcccgccagcggcagcagcagcccccugagaggcgagagcgccgccgacagcgacggcugggacagcgcccccagcgaccugagaaccauccagaccuucgugaagaaggccaagagcagcaagagaagagccgcccaggccggccccacccagcccggcccccccagaagcaccuucagcagacugcaggcccccgacagcgccacccugcuggagaagaugaagcugaaggacagccuguucgaccuggacggccccaagguggccagcccccugagccccaccagccugacccacaccagcagaccccccgccgcccugacccccgugccccugagccagggcgaccugagccacccccccagaaagaaggacagaaagaacagaaagcugggccccggcgccggcgccggcuucggcgugcugagaagacccagacccacccccggcgacggcgagaagagaagcagaaucaagaagagcaagaagagaaagcugaagaaggccgagagaggcgacagacugcccccccccggccccccccaggccccccccagcgacaccgacagcgaggaggaggaggaggaggaggaggaggaggaggaggaggagauggccaccguggugggcggcgaggcccccgugcccgugcugcccaccccccccgaggcccccagaccccccgccaccgugcaccccgagggcgugccccccgccgacagcgagagcaaggaggugggcagcaccgagaccagccaggacggcgacgccagcagcagcgagggcgagaugagagugauggacgaggacaucaugguggagagcggcgacgacagcugggaccugaucaccugcuacugcagaaagcccuucgccggcagacccaugaucgagugcagccugugcggcaccuggauccaccugagcugcgccaagaucaagaagaccaacgugcccgacuucuucuacugccagaagugcaaggagcugagacccgaggccagaagacugggcggcccccccaagagcggcgagcccuaa

SEQ ID NO: 21469 - RNA, 3291 nt, Artificial Sequence
  PHF2__Homo_sapiens__NP_005383
auggccaccgugcccguguacugcgugugcagacugcccuacgacgugaccagauucaugaucgagugcgacgccugcaaggacugguuccacggcagcugcgugggcguggaggaggaggaggcccccgacaucgacaucuaccacugccccaacugcgagaagacccacggcaagagcacccugaagaagaagagaaccuggcacaagcacggccccggccaggcccccgacgugaagcccgugcagaacggcagccagcuguucaucaaggagcugagaagcagaaccuuccccagcgccgaggacgugguggccagagugcccggcagccagcugacccugggcuacauggaggagcacggcuucaccgagcccauccuggugcccaagaaggacggccugggccuggccgugcccgcccccaccuucuacgugagcgacguggagaacuacgugggccccgagagaagcguggacgugaccgacgugaccaagcagaaggacugcaagaugaagcugaaggaguucguggacuacuacuacagcaccaacagaaagagagugcugaacgugaccaaccuggaguucagcgacaccagaaugagcagcuucguggagccccccgacaucgugaagaagcugagcuggguggagaacuacuggcccgacgacgcccugcuggccaagcccaaggugaccaaguacugccugaucugcgugaaggacagcuacaccgacuuccacaucgacagcggcggcgccagcgccugguaccacgugcugaagggcgagaagaccuucuaccugaucagacccgccagcgccaacaucagccuguacgagagauggagaagcgccagcaaccacagcgagauguucuucgccgaccagguggacaagugcuacaagugcaucgugaagcagggccagacccuguucauccccagcggcuggaucuacgccacccugacccccguggacugccuggccuucgccggccacuuccugcacagccugagcguggagaugcagaugagagccuacgagguggagagaagacugaagcugggcagccugacccaguuccccaacuucgagaccgccugcugguacaugggcaagcaccugcuggaggccuucaagggcagccacaagagcggcaagcagcugcccccccaccuggugcagggcgccaagauccugaacggcgccuucagaagcuggaccaagaagcaggcccuggccgagcacgaggacgagcugcccgagcacuucaagcccagccagcugaucaaggaccuggccaaggagaucagacugagcgagaacgccagcaaggccgugagacccgaggugaacaccguggccagcagcgacgaggugugcgacggcgacagagagaaggaggagccccccagccccaucgaggccacccccccccagagccugcuggagaaggugagcaagaagaagacccccaagaccgugaagaugcccaagcccagcaagauccccaagccccccaagccccccaagccccccagaccccccaagacccugaagcugaaggacggcggcaagaagaagggcaagaagagcagagagagcgccagccccaccauccccaaccuggaccugcuggaggcccacaccaaggaggcccugaccaagauggagccccccaagaagggcaaggccaccaagagcgugcugagcgugcccaacaaggacguggugcacaugcagaacgacguggagagacuggagaucagagagcagaccaagagcaagagcgaggccaaguggaaguacaagaacagcaagcccgacagccugcugaagauggaggaggagcagaagcuggagaagagcccccuggccggcaacaaggacaacaaguucagcuucagcuucagcaacaagaagcugcugggcagcaaggcccugagaccccccaccagccccggcguguucggcgcccugcagaacuucaaggaggacaagcccaagcccgugagagacgaguacgaguacgugagcgacgacggcgagcugaagaucgacgaguuccccaucagaagaaagaagaacgcccccaagagagaccugagcuuccugcuggacaagaaggccgugcugcccacccccgugaccaagcccaagcuggacagcgccgccuacaagagcgacgacagcagcgacgagggcagccugcacaucgacaccgacaccaagcccggcagaaacgccagagugaagaaggagagcggcagcagcgccgccggcauccuggaccugcugcaggccagcgaggaggugggcgcccuggaguacaaccccagcagccagccccccgccagccccagcacccaggaggccauccagggcaugcugagcauggccaaccugcaggccagcgacagcugccugcagaccaccuggggcgccggccaggccaagggcagcagccuggccgcccacggcgccagaaagaacggcggcggcagcggcaagagcgccggcaagagacugcugaagagagccgccaagaacagcguggaccuggacgacuacgaggaggagcaggaccaccuggacgccugcuucaaggacagcgacuacguguaccccagccuggagagcgacgaggacaaccccaucuucaagagcagaagcaagaagagaaagggcagcgacgacgcccccuacagccccaccgccagagugggccccagcgugcccagacaggacagacccgugagagagggcaccagaguggccagcaucgagaccggccuggccgccgccgccgccaagcugagccagcaggaggagcagaagagcaagaagaagaagagcgccaagagaaagcugacccccaacaccaccagccccagcaccagcaccagcaucagcgccggcaccaccagcaccagcaccacccccgccagcaccacccccgccagcaccacccccgccagcaccagcaccgccagcagccaggccagccaggagggcagcagccccgagcccccccccgagagccacagcagcagccuggccgaccacgaguacaccgccgccggcaccuucaccggcgcccaggccggcagaaccagccagcccauggcccccggcguguuccugacccagagaagacccagcgccagcagccccaacaacaacaccgccgccaagggcaagagaaccaagaagggcauggccaccgccaagcagagacugggcaagauccugaagauccacagaaacggcaagcugcugcuguaa

SEQ ID NO: 21470 - RNA, 2211 nt, Artificial Sequence
  PHF3__Homo_sapiens__NP_001277189
auggacaucguggacaccuucaaccaccugauccccaccgagcaccuggacgacgcccuguuccugggcagcaaccuggagaacgaggugugcgaggacuucagcgccagccagaacgugcuggaggacagccugaagaacaugcugagcgacaaggaccccaugcugggcagcgccagcaaccaguucugccugcccgugcuggacagcaacgaccccaacuuccagaugcccugcagcaccguggugggccuggacgacaucauggacgagggcguggugaaggagagcggcaacgacaccaucgacgaggaggagcugauccugcccaacagaaaccugagagacaagguggaggagaacagcgugagaagccccagaaagagccccagacugauggcccaggagcaggugagaagccugagacagagcaccaucgccaagagaagcaacgccgccccccugagcaacaccaagaaggccagcggcaagaccgugagcaccgccaaggccggcgugaagcagcccgagagaagccaggugaaggaggaggugugcaugagccugaagcccgaguaccacaaggagaacagaagaugcagcagaaacagcggccagaucgagguggugcccgaggugagcgugagcagcagccacagcagcgugagcagcugccuggagaugaaggacgaggacggccuggacagcaagcacaagugcaacaaccccggcgagaucgacgugcccagccacgagcugaacugcagccugcugagcgagaccugcgugaccaucggcgagaagaagaacgaggcccugauggagugcaaggccaagcccgugggcagcccccuguucaaguucagcgacaaggaggagcacgagcagaacgacagcaucagcggcaagaccggcgagaccgugguggaggagaugaucgccaccagaaagguggagcaggacagcaaggagaccgugaagcugagccacgaggacgaccacauccuggaggacgccggcagcagcgacaucagcagcgacgccgccugcaccaaccccaacaagaccgagaacagccuggugggccugcccagcugcguggacgaggugaccgagugcaaccuggagcugaaggacaccaugggcaucgccgacaagaccgagaacacccuggagagaaacaagaucgagccccugggcuacugcgaggacgccgagagcaacagacagcuggagagcaccgaguucaacaagagcaaccuggaggugguggacaccagcaccuucggccccgagagcaacauccuggagaacgccaucugcgacgugcccgaccagaacagcaagcagcugaacgccaucgagagcaccaagaucgagagccacgagaccgccaaccugcaggacgacagaaacagccagagcagcagcgugagcuaccuggagagcaagagcgugaagagcaagcacaccaagcccgugauccacagcaagcagaacaugaccaccgacgcccccaagaagaucguggccgccaaguacgaggugauccacagcaagaccaaggugaacgugaagagcgugaagagaaacaccgacgugcccgagagccagcagaacuuccacagacccgugaaggugagaaagaagcagaucgacaaggagcccaagauccagagcugcaacagcggcgugaagagcgugaagaaccaggcccacagcgugcugaagaagacccugcaggaccagacccuggugcagaucuucaagccccugacccacagccugagcgacaagagccacgcccaccccggcugccugaaggagccccaccaccccgcccagaccggccacgugagccacagcagccagaagcagugccacaagccccagcagcaggcccccgccaugaagaccaacagccacgugaaggaggagcuggagcaccccggcguggagcacuucaaggaggaggacaagcugaagcugaagaagcccgagaagaaccugcagcccagacagagaagaagcagcaagagcuucagccuggacgagcccccccuguucauccccgacaacaucgccaccaucagaagagagggcagcgaccacagcagcagcuucgagagcaaguacauguggacccccagcaagcagugcggcuucugcaagaagccccacggcaacagaugcgugugcaugugcguguaa

SEQ ID NO: 21471 - RNA, 333 nt, Artificial Sequence
  PHF5A__Homo_sapiens__NP_116147
auggccaagcaccaccccgaccugaucuucugcagaaagcaggccggcguggccaucggcagacugugcgagaagugcgacggcaagugcgugaucugcgacagcuacgugagacccugcacccuggugagaaucugcgacgagugcaacuacggcagcuaccagggcagaugcgugaucugcggcggccccggcgugagcgacgccuacuacugcaaggagugcaccauccaggagaaggacagagacggcugccccaagaucgugaaccugggcagcagcaagaccgaccuguucuacgagagaaagaaguacggcuucaagaagagauaa

SEQ ID NO: 21472 - RNA, 939 nt, Artificial Sequence
  PHF6__Homo_sapiens__NP_115711
augagcagcagcguggagcagaagaagggccccaccagacagagaaagugcggcuucugcaagagcaacagagacaaggagugcggccagcugcugaucagcgagaaccagaagguggccgcccaccacaagugcaugcuguucagcagcgcccuggugagcagccacagcgacaacgagagccugggcggcuucagcaucgaggacgugcagaaggagaucaagagaggcaccaagcugaugugcagccugugccacugccccggcgccaccaucggcugcgacgugaagaccugccacagaaccuaccacuaccacugcgcccugcacgacaaggcccagaucagagagaagcccagccagggcaucuacaugguguacugcagaaagcacaagaagaccgcccacaacagcgaggccgccgaccuggaggagagcuucaacgagcacgagcuggagcccagcagccccaagagcaagaagaagagcagaaagggcagacccagaaagaccaacuucaagggccugagcgaggacaccagaagcaccagcagccacggcaccgacgagauggagagcagcagcuacagagacagaagcccccacagaagcagccccagcgacaccagacccaagugcggcuucugccacgugggcgaggaggagaacgaggccagaggcaagcugcacaucuucaacgccaagaaggccgccgcccacuacaagugcaugcuguucagcagcggcaccgugcagcugaccaccaccagcagagccgaguucggcgacuucgacaucaagaccgugcugcaggagaucaagagaggcaagagaauggugugcagcuucuacaucugcuacgccacccugcaccugaucugcugcuucaaguucagagugcaccccaaguucauccagagcagcgagaaccugaaguaa

SEQ ID NO: 21473 - RNA, 3183 nt, Artificial Sequence
  PHF8__Homo_sapiens__NP_001171825
augaacagaagcagagccaucgugcagagaggcagagugcugcccccccccgccccccuggacaccaccaaccuggccggcagaagaacccugcagggcagagccaagauggccagcgugcccguguacugccugugcagacugcccuacgacgugaccagauucaugaucgagugcgacaugugccaggacugguuccacggcagcugcgugggcguggaggaggagaaggccgccgacaucgaccuguaccacugccccaacugcgaggugcugcacggccccagcaucaugaagaagagaagaggcagcagcaagggccacgacacccacaagggcaagcccgugaagaccggcagccccaccuucgugagagagcugagaagcagaaccuucgacagcagcgacgaggugauccugaagcccaccggcaaccagcugaccguggaguuccuggaggagaacagcuucagcgugcccauccuggugcugaagaaggacggccugggcaugacccugcccagccccagcuucaccgugagagacguggagcacuacgugggcagcgacaaggagaucgacgugaucgacgugaccagacaggccgacugcaagaugaagcugggcgacuucgugaaguacuacuacagcggcaagagagagaaggugcugaacgugaucagccuggaguucagcgacaccagacugagcaaccugguggagacccccaagaucgugagaaagcugagcuggguggagaaccuguggcccgaggagugcguguucgagagacccaacgugcagaaguacugccugaugagcgugagagacagcuacaccgacuuccacaucgacuucggcggcaccagcgugugguaccacgugcugaagggcgagaagaucuucuaccugaucagacccaccaacgccaaccugacccuguucgagugcuggagcagcagcagcaaccagaacgagauguucuucggcgaccagguggacaagugcuacaagugcagcgugaagcagggccagacccuguucauccccaccggcuggauccacgccgugcugacccccguggacugccuggccuucggcggcaacuuccugcacagccugaacaucgagaugcagcugaaggccuacgagaucgagaagagacugagcaccgccgaccuguucagauuccccaacuucgagaccaucugcugguacgugggcaagcacauccuggacaucuucagaggccugagagagaacagaagacaccccgccagcuaccuggugcacggcggcaaggcccugaaccuggccuucagagccuggaccagaaaggaggcccugcccgaccacgaggacgagauccccgagaccgugagaaccgugcagcugaucaaggaccuggccagagagaucagacugguggaggacaucuuccagcagaacgugggcaagaccagcaacaucuucggccugcagagaaucuuccccgccggcagcaucccccugaccagacccgcccacagcaccagcgugagcaugagcagacugagccugcccagcaagaacggcagcaagaagaagggccugaagcccaaggagcuguucaagaaggccgagagaaagggcaaggagagcagcgcccugggccccgccggccagcugagcuacaaccugauggacaccuacagccaccaggcccugaagaccggcagcuuccagaaggccaaguucaacaucaccggcgccugccugaacgacagcgacgacgacagccccgaccuggaccuggacggcaacgagagcccccuggcccugcugaugagcaacggcagcaccaagagagugaagagccugagcaagagcagaagaaccaagaucgccaagaagguggacaaggccagacugauggccgagcaggugauggaggacgaguucgaccuggacagcgacgacgagcugcagaucgacgagagacugggcaaggagaaggccacccugaucaucagacccaaguuccccagaaagcugcccagagccaagcccugcagcgaccccaacagagugagagagcccggcgagguggaguucgacaucgaggaggacuacaccaccgacgaggacaugguggagggcguggagggcaagcugggcaacggcagcggcgccggcggcauccuggaccugcugaaggccagcagacaggugggcggccccgacuacgccgcccugaccgaggcccccgccagccccagcacccaggaggccauccagggcaugcugugcauggccaaccugcagagcagcagcagcagccccgccaccagcagccugcaggccugguggaccggcggccaggacagaagcagcggcagcagcagcagcggccugggcaccgugagcaacagccccgccagccagagaacccccggcaagagacccaucaagagacccgccuacuggagaaccgagagcgaggaggaggaggagaacgccagccuggacgagcaggacagccugggcgccugcuucaaggacgccgaguacaucuaccccagccuggagagcgacgacgacgaccccgcccugaagagcagacccaagaagaagaagaacagcgacgacgcccccuggagccccaaggccagagugacccccacccugcccaagcaggacagacccgugagagagggcaccagaguggccagcaucgagaccggccuggccgccgccgccgccaagcuggcccagcaggagcugcagaaggcccagaagaagaaguacaucaagaagaagccccugcugaaggagguggagcagcccagaccccaggacagcaaccugagccugaccgugcccgcccccaccguggccgccaccccccagcuggugaccagcagcagcccccugcccccccccgagcccaagcaggaggcccugagcggcagccuggccgaccacgaguacaccgccagacccaacgccuucggcauggcccaggccaacagaagcaccacccccauggcccccggcguguuccugacccagagaagacccagcgugggcagccagagcaaccaggccggccagggcaagagacccaagaagggccuggccaccgccaagcagagacugggcagaauccugaagauccacagaaacggcaagcugcugcuguaa

SEQ ID NO: 21474 - RNA, 1308 nt, Artificial Sequence
  PHGDH__Homo_sapiens__XP_011539533
augcugugguucaagagaagcagcccccugagcaccgcccaccacgaccugacccaccagagacagaucccccaggccaccgccagcaugaaggacggcaagugggagagaaagaaguucaugggcaccgagcugaacggcaagacccugggcauccugggccugggcagaaucggcagagagguggccaccagaaugcagagcuucggcaugaagaccaucggcuacgaccccaucaucagccccgaggugagcgccagcuucggcgugcagcagcugccccuggaggagaucuggccccugugcgacuucaucaccgugcacaccccccugcugcccagcaccaccggccugcugaacgacaacaccuucgcccagugcaagaagggcgugagaguggugaacugcgccagaggcggcaucguggacgagggcgcccugcugagagcccugcagagcggccagugcgccggcgccgcccuggacguguucaccgaggagccccccagagacagagcccugguggaccacgagaacgugaucagcugcccccaccugggcgccagcaccaaggaggcccagagcagaugcggcgaggagaucgccgugcaguucguggacauggugaagggcaagagccugaccggcguggugaacgcccaggcccugaccagcgccuucagcccccacaccaagcccuggaucggccuggccgaggcccugggcacccugaugagagccugggccggcagccccaagggcaccauccaggugaucacccagggcaccagccugaagaacgccggcaacugccugagccccgccgugaucgugggccugcugaaggaggccagcaagcaggccgacgugaaccuggugaacgccaagcugcuggugaaggaggccggccugaacgugaccaccagccacagccccgccgcccccggcgagcagggcuucggcgagugccugcuggccguggcccuggccggcgcccccuaccaggccgugggccuggugcagggcaccacccccgugcugcagggccugaacggcgccguguucagacccgaggugccccugagaagagaccugccccugcugcuguucagaacccagaccagcgaccccgccaugcugcccaccaugaucggccugcuggccgaggccggcgugagacugcugagcuaccagaccagccuggugagcgacggcgagaccuggcacgugaugggcaucagcagccugcugcccagccuggaggccuggaagcagcacgugaccgaggccuuccaguuccacuucuaa

SEQ ID NO: 21475 - RNA, 5466 nt, Artificial Sequence
  PHIP__Homo_sapiens__NP_060404
augagcugcgagagaaagggccugagcgagcugagaagcgagcuguacuuccugaucgccagauuccuggaggacggccccugccagcaggccgcccaggugcugaucagagagguggccgagaaggagcugcugcccagaagaaccgacuggaccggcaaggagcaccccagaaccuaccagaaccuggugaaguacuacagacaccuggcccccgaccaccugcugcagaucugccacagacugggcccccugcuggagcaggagaucccccagagcgugcccggcgugcagacccugcugggcgccggcagacagagccugcugagaaccaacaagagcugcaagcacgugguguggaagggcagcgcccuggccgcccugcacugcggcagaccccccgagagccccgugaacuacggcagcccccccagcaucgccgacacccuguucagcagaaagcugaacggcaaguacagacuggagagacuggugcccaccgccguguaccagcacaugaagaugcacaagagaauccugggccaccugagcagcguguacugcgugaccuucgacagaaccggcagaagaaucuucaccggcagcgacgacugccuggugaagaucugggccaccgacgacggcagacugcuggccacccugagaggccacgccgccgagaucagcgacauggccgugaacuacgagaacaccaugaucgccgccggcagcugcgacaagaugaucagaguguggugccugagaaccugcgccccccuggccgugcugcagggccacagcgccagcaucaccagccugcaguucagcccccugugcagcggcagcaagagauaccugagcagcaccggcgccgacggcaccaucugcuucuggcugugggacgccggcacccugaagaucaaccccagacccgccaaguucaccgagagacccagacccggcgugcagaugaucugcagcagcuucagcgccggcggcauguuccuggccaccggcagcaccgaccacaucaucagaguguacuucuucggcagcggccagcccgagaagaucagcgagcuggaguuccacaccgacaagguggacagcauccaguucagcaacaccagcaacagauucgugagcggcagcagagacggcaccgccagaaucuggcaguucaagagaagagaguggaagagcauccugcuggacauggccaccagacccgccggccagaaccugcagggcaucgaggacaagaucaccaagaugaaggugaccaugguggccugggacagacacgacaacaccgugaucaccgccgugaacaacaugacccugaagguguggaacagcuacaccggccagcugauccacgugcugaugggccacgaggacgagguguucgugcuggagccccaccccuucgaccccagagugcuguucagcgccggccacgacggcaacgugaucgugugggaccuggccagaggcgugaagaucagaagcuacuucaacaugaucgagggccagggccacggcgccguguucgacugcaagugcagccccgacggccagcacuucgccugcaccgacagccacggccaccugcugaucuucggcuucggcagcagcagcaaguacgacaagaucgccgaccagauguucuuccacagcgacuacagaccccugaucagagacgccaacaacuucgugcuggacgagcagacccagcaggccccccaccugaugcccccccccuuccugguggacguggacggcaacccccaccccagcagauaccagagacuggugcccggcagagagaacugcagagaggagcagcugaucccccagaugggcgugaccagcagcggccugaaccaggugcugagccagcaggccaaccaggagaucagcccccuggacagcaugauccagagacugcagcaggagcaggaccugagaagaagcggcgaggccggcaucagcaacaccagcagacugagcagaggcagcaucagcagcaccagcgaggugcacagcccccccaacgugggccugagaagaagcggccagaucgagggcgugagacagaugcacagcaacgcccccagaagcgagaucgccaccgagagagaccugguggccuggagcagaagagugguggugcccgagcugagcgccggcguggccagcagacaggaggaguggagaaccgccaagggcgaggaggagaucaagaccuacagaagcgaggagaagagaaagcaccugaccgugcccaaggagaacaagauccccaccgugagcaagaaccacgcccacgagcacuuccuggaccugggcgagagcaagaagcagcagaccaaccagcacaacuacagaaccagaagcgcccuggaggagacccccagacccagcgaggagaucgagaacggcagcagcagcagcgacgagggcgaggugguggccgugagcggcggcaccagcgaggaggaggagagagccuggcacagcgacggcagcagcagcgacuacagcagcgacuacagcgacuggaccgccgacgccggcaucaaccugcagccccccaagaaggugcccaagaacaagaccaagaaggccgagagcagcagcgacgaggaggaggagagcgagaagcagaagcagaagcagaucaagaaggagaagaagaaggugaacgaggagaaggacggccccaucagccccaagaagaagaagcccaaggagagaaagcagaagagacuggccgugggcgagcugaccgagaacggccugacccuggaggaguggcugcccagcaccuggaucaccgacaccauccccagaagaugccccuucgugccccagaugggcgacgagguguacuacuucagacagggccacgaggccuacguggagauggccagaaagaacaagaucuacagcaucaaccccaagaagcagcccuggcacaagauggagcugagagagcaggagcugaugaagaucgugggcaucaaguacgaggugggccugcccacccugugcugccugaagcuggccuuccuggaccccgacaccggcaagcugaccggcggcagcuucaccaugaaguaccacgacaugcccgacgugaucgacuuccuggugcugagacagcaguucgacgacgccaaguacagaagauggaacaucggcgacagauucagaagcgugaucgacgacgccuggugguucggcaccaucgagagccaggagccccugcagcuggaguaccccgacagccuguuccagugcuacaacgugugcugggacaacggcgacaccgagaagaugagccccugggacauggagcugauccccaacaacgccguguuccccgaggagcugggcaccagcgugccccugaccgacggcgagugcagaagccugaucuacaagccccuggacggcgaguggggcaccaaccccagagacgaggagugcgagagaaucguggccggcaucaaccagcugaugacccuggacaucgccagcgccuucguggcccccguggaccugcaggccuaccccauguacugcaccgugguggccuaccccaccgaccugagcaccaucaagcagagacuggagaacagauucuacagaagagugagcagccugaugugggaggugagauacaucgagcacaacaccagaaccuucaacgagcccggcagccccaucgugaagagcgccaaguucgugaccgaccugcugcugcacuucaucaaggaccagaccugcuacaacaucaucccccuguacaacagcaugaagaagaaggugcugagcgacagcgaggacgaggagaaggacgccgacgugcccggcaccagcaccagaaagagaaaggaccaccagcccagaagaagacugagaaacagagcccagagcuacgacauccaggccuggaagaagcagugcgaggagcugcugaaccugaucuuccagugcgaggacagcgagcccuucagacagcccguggaccugcuggaguaccccgacuacagagacaucaucgacacccccauggacuucgccaccgugagagagacccuggaggccggcaacuacgagagccccauggagcugugcaaggacgugagacugaucuucagcaacagcaaggccuacacccccagcaagagaagcagaaucuacagcaugagccugagacugagcgccuucuucgaggagcacaucagcagcgugcugagcgacuacaagagcgcccugagauuccacaagagaaacaccaucaccaagagaagaaagaagagaaacagaagcagcagcgugagcagcagcgccgccagcagccccgagagaaagaagagaauccugaagccccagcugaagagcgagagcagcaccagcgccuucagcacccccaccagaagcaucccccccagacacaacgccgcccagaucaacggcaagaccgagagcagcagcguggugagaaccagaagcaacagaguggugguggaccccguggugaccgagcagcccagcaccagcagcgccgccaagaccuucaucaccaaggccaacgccagcgccauccccggcaagaccauccuggagaacagcgugaagcacagcaaggcccugaacacccugagcagccccggccagagcagcuucagccacggcaccagaaacaacagcgccaaggagaacauggagaaggagaagcccgugaagagaaagaugaagagcagcgugcugcccaaggccagcacccugagcaagagcagcgccgugaucgagcagggcgacugcaagaacaacgcccuggugcccggcaccauccaggugaacggccacggcggccagcccagcaagcuggugaagagaggccccggcagaaagcccaagguggaggugaacaccaacagcggcgagaucauccacaagaagagaggcagaaagcccaagaagcugcaguacgccaagcccgaggaccuggagcagaacaacgugcaccccaucagagacgaggugcugcccagcagcaccugcaacuuccugagcgagaccaacaacgugaaggaggaccugcugcagaagaagaacagaggcggcagaaagcccaagagaaagaugaagacccagaagcuggacgccgaccugcuggugcccgccagcgugaaggugcugagaagaagcaacagaaagaagaucgacgaccccaucgacgaggaggaggaguucgaggagcugaagggcagcgagccccacaugagaaccagaaaccagggcagaagaaccgccuucuacaacgaggacgacagcgaggaggagcagagacagcugcuguucgaggacaccagccugaccuucggcaccagcagcagaggcagagugagaaagcugaccgagaaggccaaggccaaccugaucggcugguaa

SEQ ID NO: 21476 - RNA, 3633 nt, Artificial Sequence
  PHKA1__Homo_sapiens__NP_001116142
augagaagcagaagcaacagcggcgugagacuggacggcuacgccagacuggugcagcagaccauccugugccaccagaaccccgugaccggccugcugcccgccagcuacgaccagaaggacgccugggugagagacaacguguacagcauccuggccguguggggccugggccuggccuacagaaagaacgccgacagagacgaggacaaggccaaggccuacgagcuggagcagagcguggugaagcugaugagaggccugcugcacugcaugaucagacagguggacaagguggagagcuucaaguacagccagagcaccaaggacagccugcacgccaaguacaacaccaagaccugcgccaccguggugggcgacgaccaguggggccaccugcagcuggacgccaccagcguguaccugcuguuccuggcccagaugaccgccagcggccugcacaucauccacagccuggacgaggugaacuucauccagaaccugguguucuacaucgaggccgccuacaagaccgccgacuucggcaucugggagagaggcgacaagaccaaccagggcaucagcgagcugaacgccagcagcgugggcauggccaaggccgcccuggaggcccuggacgagcuggaccuguucggcgugaagggcggcccccagagcgugauccacgugcuggccgacgaggugcagcacugccagagcauccugaacagccugcugcccagagccagcaccagcaaggagguggacgccagccugcugagcguggugagcuuccccgccuucgccguggaggacagccagcugguggagcugaccaagcaggagaucaucaccaagcugcagggcagauacggcugcugcagauuccugagagacggcuacaagacccccaaggaggaccccaacagacuguacuacgagcccgccgagcugaagcuguucgagaacaucgagugcgaguggccccuguucuggaccuacuucauccuggacggcguguucagcggcaacgccgagcaggugcaggaguacaaggaggcccuggaggccgugcugaucaagggcaagaacggcgugccccugcugcccgagcuguacagcgugccccccgacagaguggacgaggaguaccagaacccccacaccguggacagagugcccaugggcaagcugccccacauguggggccagagccuguacauccugggcagccugauggccgagggcuuccuggcccccggcgagaucgacccccugaacagaagauucagcaccgugcccaagcccgacgugguggugcaggugagcauccuggccgagaccgaggagaucaagaccauccugaaggacaagggcaucuacguggagaccaucgccgagguguaccccaucagagugcagcccgccagaauccugagccacaucuacagcagccugggcugcaacaacagaaugaagcugagcggcagacccuacagacacaugggcgugcugggcaccagcaagcuguacgacaucagaaagaccaucuucaccuucaccccccaguucaucgaccagcagcaguucuaccuggcccuggacaacaagaugaucguggagaugcugagaaccgaccugagcuaccugugcagcagauggagaaugaccggccagcccaccaucaccuuccccaucagccacagcaugcuggacgaggacggcaccagccugaacagcagcauccuggccgcccugagaaagaugcaggacggcuacuucggcggcgccagagugcagaccggcaagcugagcgaguuccugaccaccagcugcugcacccaccugagcuucauggaccccggccccgagggcaagcuguacagcgaggacuacgacgacaacuacgacuaccuggagagcggcaacuggaugaacgacuacgacagcaccagccacgccagaugcggcgacgagguggccagauaccuggaccaccugcuggcccacaccgccccccaccccaagcuggcccccaccagccagaagggcggccuggacagauuccaggccgccgugcagaccaccugcgaccugaugagccuggugaccaaggccaaggagcugcacgugcagaacgugcacauguaccugcccaccaagcuguuccaggccagcagacccagcuucaaccugcuggacagcccccaccccagacaggagaaccaggugcccagcgugagaguggagauccaccugcccagagaccagagcggcgagguggacuucaaggcccuggugcugcagcugaaggagaccagcagccugcaggagcaggccgacauccuguacaugcuguacaccaugaagggccccgacuggaacaccgagcuguacaacgagagaagcgccaccgugagagagcugcugaccgagcuguacggcaaggugggcgagaucagacacuggggccugaucagauacaucagcggcauccugagaaagaagguggaggcccuggacgaggccugcaccgaccugcugagccaccagaagcaccugaccgugggccugccccccgagcccagagagaagaccaucagcgccccccugcccuacgaggcccugacccagcugaucgacgaggccagcgagggcgacaugagcaucagcauccugacccaggagaucaugguguaccuggccauguacaugagaacccagcccggccuguucgccgagauguucagacugagaaucggccugaucauccaggugauggccaccgagcuggcccacagccugagaugcagcgccgaggaggccaccgagggccugaugaaccugagccccagcgccaugaagaaccugcugcaccacauccugagcggcaaggaguucggcguggagagaagcgugagacccaccgacagcaacgugagccccgccaucagcauccacgagaucggcgccgugggcgccaccaagaccgagagaaccggcaucaugcagcugaagagcgagaucaagcagagccccggcaccagcaugacccccagcagcggcagcuuccccagcgccuacgaccagcagagcagcaaggacagcagacagggccaguggcagagaagaagaagacuggacggcgcccugaacagagugcccgugggcuucuaccagaagguguggaaggugcugcagaagugccacggccugagcguggagggcuucgugcugcccagcagcaccaccagagagaugacccccggcgagaucaaguucagcgugcacguggagagcgugcugaacagagugccccagcccgaguacagacagcugcugguggaggccauccuggugcugaccaugcuggccgacaucgagauccacagcaucggcagcaucaucgccguggagaagaucgugcacaucgccaacgaccuguuccugcaggagcagaagacccugggcgccgacgacaccaugcuggccaaggaccccgccagcggcaucugcacccugcuguacgacagcgcccccagcggcagauucggcaccaugaccuaccugagcaaggccgccgccaccuacgugcaggaguuccugccccacagcaucugcgccaugcaguaa

SEQ ID NO: 21477 - RNA, 3708 nt, Artificial Sequence
  PHKA2__Homo_sapiens__NP_000283
augagaagcagaagcaacagcggcgugagacuggacggcuacgccagacuggugcagcagaccauccugugcuaccagaaccccgugaccggccugcugagcgccagccacgagcagaaggacgccugggugagagacaacaucuacagcauccuggccguguggggccugggcauggccuacagaaagaacgccgacagagacgaggacaaggccaaggccuacgagcuggagcagaacguggugaagcugaugagaggccugcugcagugcaugaugagacagguggccaagguggagaaguucaagcacacccagagcaccaaggacagccugcacgccaaguacaacaccgccaccugcggcaccguggugggcgacgaccaguggggccaccugcagguggacgccaccagccuguuccugcuguuccuggcccagaugaccgccagcggccugagaaucaucuucacccuggacgagguggccuucauccagaaccugguguucuacaucgaggccgccuacaagguggccgacuacggcaugugggagagaggcgacaagaccaaccagggcauccccgagcugaacgccagcagcgugggcauggccaaggccgcccuggaggccaucgacgagcuggaccuguucggcgcccacggcggcagaaagagcgugauccacgugcugcccgacgagguggagcacugccagagcauccuguucagcaugcugcccagagccagcaccagcaaggagaucgacgccggccugcugagcaucaucagcuuccccgccuucgccguggaggacgugaaccuggugaacgugaccaagaacgagaucaucagcaagcugcagggcagauacggcugcugcagauuccugagagacggcuacaagacccccagagaggaccccaacagacugcacuacgaccccgccgagcugaagcuguucgagaacaucgagugcgaguggcccguguucuggaccuacuucaucaucgacggcguguucagcggcgacgccgugcaggugcaggaguacagagaggcccuggagggcauccugaucagaggcaagaacggcaucagacuggugcccgagcuguacgccgugccccccaacaagguggacgaggaguacaagaacccccacaccguggacagagugcccaugggcaaggugccccaccuguggggccagagccuguacauccugagcagccugcuggccgagggcuuccuggccgccggcgagaucgacccccugaacagaagauucagcaccagcgugaagcccgacgugguggugcaggugaccgugcuggccgagaacaaccacaucaaggaccugcugagaaagcacggcgugaacgugcagagcaucgccgacauccaccccauccaggugcagcccggcagaauccugagccacaucuacgccaagcugggcagaaacaagaacaugaaccugagcggcagacccuacagacacaucggcgugcugggcaccagcaagcuguacgugaucagaaaccagaucuucaccuucaccccccaguucaccgaccagcaccacuucuaccuggcccuggacaacgagaugaucguggagaugcugagaaucgagcuggccuaccugugcaccugcuggagaaugaccggcagacccacccugaccuuccccaucagcagaaccaugcugaccaacgacggcagcgacauccacagcgccgugcugagcaccaucagaaagcuggaggacggcuacuucggcggcgccagagugaagcugggcaaccugagcgaguuccugaccaccagcuucuacaccuaccugaccuuccuggaccccgacugcgacgagaagcuguucgacaacgccagcgagggcaccuucagccccgacagcgacagcgaccuggugggcuaccuggaggacaccugcaaccaggagagccaggacgagcuggaccacuacaucaaccaccugcugcagagcaccagccugagaagcuaccugcccccccugugcaagaacaccgaggacagacacguguucagcgccauccacagcaccagagacauccugagcgugauggccaaggccaagggccuggaggugcccuucgugcccaugacccugcccaccaaggugcugagcgcccacagaaagagccugaaccugguggacagcccccagccccugcuggagaaggugcccgagagcgacuuccaguggcccagagacgaccacggcgacguggacugcgagaagcugguggagcagcugaaggacugcagcaaccugcaggaccaggccgacauccuguacauccuguacgugaucaagggccccagcugggacaccaaccugagcggccagcacggcgugaccgugcagaaccugcugggcgagcuguacggcaaggccggccugaaccaggaguggggccugaucagauacaucagcggccugcugagaaagaagguggaggugcuggccgaggccugcaccgaccugcugagccaccagaagcagcugaccgugggccugccccccgagcccagagagaagaucaucagcgccccccugccccccgaggagcugaccaagcugaucuacgaggccagcggccaggacaucagcaucgccgugcugacccaggagaucgugguguaccuggccauguacgugagagcccagcccagccuguucguggagaugcugagacugagaaucggccugaucauccaggugauggccaccgagcuggccagaagccugaacugcagcggcgaggaggccagcgagagccugaugaaccugagccccuucgacaugaagaaccugcugcaccacauccugagcggcaaggaguucggcguggagagaagcgugagacccauccacagcagcaccagcagccccaccaucagcauccacgaggugggccacaccggcgugaccaagaccgagagaagcggcaucaacagacugagaagcgagaugaagcagaugaccagaagauucagcgccgacgagcaguucuucagcgugggccaggccgccagcagcagcgcccacagcagcaagagcgccagaagcagcacccccagcagccccaccggcaccagcagcagcgacagcggcggccaccacaucggcuggggcgagagacagggccaguggcugagaagaagaagacuggacggcgccaucaacagagugcccgugggcuucuaccagagaguguggaagauccugcagaagugccacggccugagcaucgacggcuacgugcugcccagcagcaccaccagagagaugaccccccacgagaucaaguucgccgugcacguggagagcgugcugaacagagugccccagcccgaguacagacagcugcugguggaggccaucauggugcugacccugcugagcgacaccgagaugaccagcaucggcggcaucauccacguggaccagaucgugcagauggccagccagcuguuccugcaggaccaggugagcaucggcgccauggacacccuggagaaggaccaggccaccggcaucugccacuucuucuacgacagcgcccccagcggcgccuacggcaccaugaccuaccugaccagagccguggccagcuaccugcaggagcugcugcccaacagcggcugccagaugcaguaa

SEQ ID NO: 21478 - RNA, 3282 nt, Artificial Sequence
  PHKB__Homo_sapiens__NP_000284
auggccggcgccgccggccugaccgccgaggugagcuggaaggugcuggagagaagagccagaaccaagagaagcggcagcguguacgagccccugaagagcaucaaccugcccagacccgacaacgagacccugugggacaagcuggaccacuacuacagaaucgugaagagcacccugcugcuguaccagagccccaccaccggccuguuccccaccaagaccugcggcggcgaccagaaggccaagauccaggacagccuguacugcgccgccggcgccugggcccuggcccuggccuacagaagaaucgacgacgacaagggcagaacccacgagcuggagcacagcgccaucaagugcaugagaggcauccuguacugcuacaugagacaggccgacaaggugcagcaguucaagcaggaccccagacccaccaccugccugcacagcguguucaacgugcacaccggcgacgagcugcugagcuacgaggaguacggccaccugcagaucaacgccgugagccuguaccugcuguaccugguggagaugaucagcagcggccugcagaucaucuacaacaccgacgaggugagcuucauccagaaccugguguucugcguggagagaguguacagagugcccgacuucggcgugugggagagaggcagcaaguacaacaacggcagcaccgagcugcacagcagcagcgugggccuggccaaggccgcccuggaggccaucaacggcuucaaccuguucggcaaccagggcugcagcuggagcgugaucuucguggaccuggacgcccacaacagaaacagacagacccugugcagccugcugcccagagagagcagaagccacaacaccgacgccgcccugcugcccugcaucagcuaccccgccuucgcccuggacgacgaggugcuguucagccagacccuggacaagguggugagaaagcugaagggcaaguacggcuucaagagauuccugagagacggcuacagaaccagccuggaggaccccaacagaugcuacuacaagcccgccgagaucaagcuguucgacggcaucgagugcgaguuccccaucuucuuccuguacaugaugaucgacggcguguucagaggcaaccccaagcaggugcaggaguaccaggaccugcugacccccgugcugcaccacaccaccgagggcuaccccguggugcccaaguacuacuacgugcccgccgacuucguggaguacgagaagaacaaccccggcagccagaagagauuccccagcaacugcggcagagacggcaagcuguuccuguggggccaggcccuguacaucaucgccaagcugcuggccgacgagcugaucagccccaaggacaucgaccccgugcagagauacgugccccugaaggaccagagaaacgugagcaugagauucagcaaccagggcccccuggagaacgaccugguggugcacguggcccugaucgccgagagccagagacugcagguguuccugaacaccuacggcauccagacccagaccccccagcagguggagcccauccagaucuggccccagcaggagcuggugaaggccuaccugcagcugggcaucaacgagaagcugggccugagcggcagacccgacagacccaucggcugccugggcaccagcaagaucuacagaauccugggcaagaccguggugugcuaccccaucaucuucgaccugagcgacuucuacaugagccaggacguguuccugcugaucgacgacaucaagaacgcccugcaguucaucaagcaguacuggaagaugcacggcagaccccuguuccuggugcugaucagagaggacaacaucagaggcagcagauucaaccccauccuggacaugcuggccgcccugaagaagggcaucaucggcggcgugaaggugcacguggacagacugcagacccugaucagcggcgccgugguggagcagcuggacuuccugagaaucagcgacaccgaggagcugcccgaguucaagagcuucgaggagcuggagccccccaagcacagcaaggugaagagacagagcagcacccccagcgcccccgagcugggccagcagcccgacgugaacaucagcgaguggaaggacaagcccacccacgagauccugcagaagcugaacgacugcagcugccuggccagccaggccauccugcugggcauccugcugaagagagagggccccaacuucaucaccaaggagggcaccgugagcgaccacaucgagagaguguacagaagagccggcagccagaagcuguggcuggccgugagauacggcgccgccuucacccagaaguucagcagcagcaucgccccccacaucaccaccuuccuggugcacggcaagcaggugacccugggcgccuucggccacgaggaggaggugaucagcaacccccugagccccagagugauccagaacaucaucuacuacaagugcaacacccacgacgagagagaggccgugauccagcaggagcuggugauccacaucggcuggaucaucagcaacaaccccgagcuguucagcggcaugcugaagaucagaaucggcuggaucauccacgccauggaguacgagcugcagaucagaggcggcgacaagcccgcccuggaccuguaccagcugagccccagcgaggugaagcagcugcugcuggacauccugcagccccagcagaacggcagaugcuggcugaacagaagacagaucgacggcagccugaacagaacccccaccggcuucuacgacagaguguggcagauccuggagagaacccccaacggcaucaucguggccggcaagcaccugccccagcagcccacccugagcgacaugaccauguacgagaugaacuucagccugcugguggaggacacccugggcaacaucgaccagccccaguacagacagaucgugguggagcugcugaugguggugagcaucgugcuggagagaaaccccgagcuggaguuccaggacaagguggaccuggacagacuggugaaggaggccuucaacgaguuccagaaggaccagagcagacugaaggagaucgagaagcaggacgacaugaccagcuucuacaacacccccccccugggcaagagaggcaccugcagcuaccugaccaaggccgugaugaaccugcugcuggagggcgaggugaagcccaacaacgacgaccccugccugaucagcuaa

SEQ ID NO: 21479 - RNA, 1260 nt, Artificial Sequence
  PHKG1__Homo_sapiens__NP_001245388
augaccagagacgaggcccugcccgacagccacagcgcccaggacuucuacgagaacuacgagcccaaggagauccugggcagaggcgugagcagcguggugagaagaugcauccacaagcccaccagccaggaguacgccgugaaggugaucgacgugaccggcggcggcagcuucagccccgaggaggugagagagcugagagaggccacccugaaggagguggacauccugagaaaggugagcggccaccccaacaucauccagcugaaggacaccuacgagaccaacaccuucuucuuccugguguucgaccugugggaggacaccgacaccauggagauggagcagaaguggugccugggcugggacagccccaagagcaccaacuucagagcccagggcagagccagaaugaagagaggcgagcuguucgacuaccugaccgagaaggugacccugagcgagaaggagaccagaaagaucaugagagcccugcuggaggugaucugcacccugcacaagcugaacaucgugcacagagaccugaagcccgagaacauccugcuggacgacaacaugaacaucaagcugaccgacuucggcuucagcugccagcuggagcccggcgagagacugagagaggugugcggcacccccagcuaccuggcccccgagaucaucgagugcagcaugaacgaggaccaccccggcuacggcaaggagguggacauguggagcaccggcgugaucauguacacccugcuggccggcagcccccccuucuggcacagaaagcagaugcugaugcugagaaugaucaugagcggcaacuaccaguucggcagccccgagugggacgacuacagcgacaccgugaaggaccuggugagcagauuccugguggugcagccccagaacagauacaccgccgaggaggcccuggcccaccccuucuuccagcaguaccugguggaggaggugagacacuucagccccagaggcaaguucaaggugaucgcccugaccgugcuggccagcgugagaaucuacuaccaguacagaagagugaagcccgugaccagagagaucgugaucagagaccccuacgcccugagaccccugagaagacugaucgacgccuacgccuucagaaucuacggccacugggugaagaagggccagcagcagaacagagccgcccuguucgagaacacccccaaggccgugcugcugagccuggccgaggaggacuacuaa

SEQ ID NO: 21480 - RNA, 1221 nt, Artificial Sequence
  PHKG2__Homo_sapiens__NP_000285
augacccuggacgugggccccgaggacgagcugcccgacugggccgccgccaaggaguucuaccagaaguacgaccccaaggacgugaucggcagaggcgugagcagcguggugagaagaugcgugcacagagccaccggccacgaguucgccgugaagaucauggaggugaccgccgagagacugagccccgagcagcuggaggaggugagagaggccaccagaagagagacccacauccugagacagguggccggccacccccacaucaucacccugaucgacagcuacgagagcagcagcuucauguuccugguguucgaccugaugagaaagggcgagcuguucgacuaccugaccgagaagguggcccugagcgagaaggagaccagaagcaucaugagaagccugcuggaggccgugagcuuccugcacgccaacaacaucgugcacagagaccugaagcccgagaacauccugcuggacgacaacaugcagaucagacugagcgacuucggcuucagcugccaccuggagcccggcgagaagcugagagagcugugcggcacccccggcuaccuggcccccgagauccugaagugcagcauggacgagacccaccccggcuacggcaaggagguggaccugugggccugcggcgugauccuguucacccugcuggccggcagcccccccuucuggcacagaagacagauccugaugcugagaaugaucauggagggccaguaccaguucagcagccccgagugggacgacagaagcagcaccgugaaggaccugaucagcagacugcugcagguggaccccgaggccagacugaccgccgagcaggcccugcagcaccccuucuucgagagaugcgagggcagccagcccuggaaccugacccccagacagagauucagaguggccguguggaccgugcuggccgccggcagaguggcccugagcacccacagagugagaccccugaccaagaacgcccugcugagagaccccuacgcccugagaagcgugagacaccugaucgacaacugcgccuucagacuguacggccacugggugaagaagggcgagcagcagaacagagccgcccuguuccagcacagaccccccggccccuuccccaucaugggccccgaggaggagggcgacagcgccgccaucaccgaggacgaggccgugcuggugcugggcuaa

SEQ ID NO: 21481 - RNA, 1206 nt, Artificial Sequence
  PHLDA1__Homo_sapiens__NP_031376
augagaagagcccccgccgccgagagacugcuggagcugggcuucccccccagaugcggcagacaggagccccccuucccccugggcgugaccagaggcuggggcagauggcccauccagaagagaagagagggcgccagacccgugcccuucagcgagagaagccaggaggacggcagaggccccgccgccagaagcagcggcacccuguggagaaucagaaccagacugagccugugcagagaccccgagcccccccccccccugugccugcugagagugagccugcugugcgcccugagagccggcggcagaggcagcagauggggcgaggacggcgccagacugcugcugcugccccccgccagagccgccggcaacggcgaggccgagcccagcggcggccccagcuacgccggcagaaugcuggagagcagcggcugcaaggcccugaaggagggcgugcuggagaagagaagcgacggccugcugcagcuguggaagaagaagugcugcauccugaccgaggagggccugcugcugaucccccccaagcagcugcagcaccagcagcagcagcagcagcagcagcagcagcagcagcagcagcagcccggccagggccccgccgagcccagccagcccagcggccccgccguggccagccuggagccccccgugaagcugaaggagcugcacuucagcaacaugaagaccguggacugcguggagagaaagggcaaguacauguacuucaccguggugauggccgagggcaaggagaucgacuucagaugcccccaggaccagggcuggaacgccgagaucacccugcagauggugcaguacaagaacagacaggccauccuggccgugaagagcaccagacagaagcagcagcaccuggugcagcagcagccccccagccagccccagccccagccccagcugcagccccagccccagccccagccccagccccagccccagccccagagccagccccagccccagccccagcccaagccccagccccagcagcugcaccccuacccccacccccacccccacccccacagccacccccacagccacccccacccccacccccacccccacccccaccagaucccccacccccacccccagccccacagccagccccacggccacagacugcugagaagcaccagcaacagcgccuaa

SEQ ID NO: 21482 - RNA, 459 nt, Artificial Sequence
  PHLDA2__Homo_sapiens__NP_003302
augaagagccccgacgaggugcugagagagggcgagcuggagaagagaagcgacagccuguuccagcuguggaagaagaagagaggcgugcugaccagcgacagacugagccuguuccccgccagccccagagccagacccaaggagcugagauuccacagcauccugaagguggacugcguggagagaaccggcaaguacguguacuucaccaucgugaccaccgaccacaaggagaucgacuucagaugcgccggcgagagcugcuggaacgccgccaucgcccuggcccugaucgacuuccagaacagaagagcccugcaggacuucagaagcagacaggagagaaccgcccccgccgcccccgccgaggacgccguggccgccgccgccgccgcccccagcgagcccagcgagcccagcagacccagcccccagcccaagcccagaacccccuaa

SEQ ID NO: 21483 - RNA, 384 nt, Artificial Sequence
  PHLDA3__Homo_sapiens__NP_036528
augaccgccgccgccaccgccaccgugcugaaggagggcgugcuggagaagagaagcggcggccugcugcagcuguggaagagaaagagaugcgugcugaccgagagaggccugcagcuguucgaggccaagggcaccggcggcagacccaaggagcugagcuucgccagaaucaaggccguggagugcguggagagcaccggcagacacaucuacuucacccuggugaccgagggcggcggcgagaucgacuucagaugcccccuggaggaccccggcuggaacgcccagaucacccugggccuggugaaguucaagaaccagcaggccauccagaccgugagagccagacagagccugggcaccggcacccuggugagcuaa

SEQ ID NO: 21484 - RNA, 3960 nt, Artificial Sequence
  PHLDB1__Homo_sapiens__NP_001138231
auggacgcccugaacagaaaccagaucggccccggcugccagacccagaccauggugcagaagggcccccuggaccugaucgagaccggcaagggccugaaggugcagaccgacaagccccaccuggugagccugggcagcggcagacugagcaccgccaucacccugcugccccuggaggagggcagaaccgugaucggcagcgccgccagagacaucagccugcagggccccggccuggcccccgagcacugcuacaucgagaaccugagaggcacccugacccuguaccccugcggcaacgccugcaccaucgacggccugcccgugagacagcccaccagacugacccagggcugcaugcugugccugggccagagcaccuuccugagauucaaccaccccgccgaggccaaguggaugaagagcaugauccccgccggcggcagagcccccggcccccccuacagccccgugcccgccgagagcgagagccuggugaacggcaaccacaccccccagaccgccaccagaggccccagcgccugcgccagccacagcagccuggugagcagcaucgagaaggaccugcaggagaucauggacagccuggugcuggaggagcccggcgccgccggcaagaagcccgccgccaccagcccccugagccccauggccaacggcggcagauaccugcugagcccccccaccagccccggcgccaugagcgugggcagcagcuacgagaacaccagccccgccuucagcccccugagcagccccgccagcagcggcagcugcgccagccacagccccagcggccaggagcccggccccagcgugcccccccuggugcccgccagaagcagcagcuaccaccuggcccugcagcccccccagagcagacccagcggcgccagaagcgagagccccagacugagcagaaagggcggccacgagagaccccccagccccggccugagaggccugcugaccgacagccccgccgccaccgugcuggccgaggccagaagagccaccgagagccccagacugggcggccagcugcccgugguggccaucagccugagcgaguaccccgccagcggcgcccugagccagcccaccagcauccccggcagccccaaguuccagccccccgugcccgcccccagaaacaagaucggcacccugcaggacagaccccccagccccuucagagagccccccggcagcgagagagugcugaccaccagccccagcagacagcuggugggcagaaccuucagcgacggccuggccaccagaacccugcagccccccgagagccccagacugggcagaagaggccuggacagcaugagagagcugcccccccugagccccagccugagcagaagagcccugagcccccugcccaccagaaccacccccgaccccaagcugaacagagagguggccgagagccccagacccagaagaugggccgcccacggcgccagccccgaggacuucagccugacccugggcgccagaggcagaagaaccagaagccccagccccacccugggcgagagccuggccccccacaagggcagcuucagcggcagacugagccccgccuacagccugggcagccugaccggcgccagccccugccagagccccugcgugcagagaaagcugagcagcggcgaccugagagugcccgugaccagagagagaaagaacagcaucaccgagaucagcgacaacgaggacgaccugcuggaguaccacagaagacagagacaggagagacugagagagcaggagauggagagacuggagagacagagacuggagaccauccugaaccugugcgccgaguacagcagagccgacggcggccccgaggccggcgagcugcccagcaucggcgaggccaccgccgcccuggcccuggccggcagaagacccagcagaggccuggccggcgccagcggcagaagcagcgaggagcccggcguggccacccagagacugugggagagcauggagagaagcgacgaggagaaccugaaggaggagugcagcagcaccgagagcacccagcaggagcacgaggacgcccccagcaccaagcugcagggcgaggugcuggcccuggaggaggagagagcccaggugcugggccacguggagcagcugaaggugagagugaaggagcuggagcagcagcugcaggagagcgccagagaggccgagauggagagagcccugcugcagggcgagagagaggccgagagagcccugcugcagaaggagcagaaggccguggaccagcugcaggagaagcugguggcccuggagaccggcauccagaaggagagagacaaggaggccgaggcccuggagaccgagaccaagcuguucgaggaccuggaguuccagcagcuggagagagagagcagaguggaggaggagagagagcuggccggccagggccugcugagaagcaaggccgagcugcugagaagcaucgccaagagaaaggagagacuggccauccuggacagccaggccggccagaucagagcccaggccgugcaggagagcgagagacuggccagagacaagaacgccagccugcagcugcugcagaaggagaaggagaagcugaccgugcuggagagaagauaccacagccugaccggcggcagacccuuccccaagaccaccagcacccugaaggagguguacagaagcaagauggacggcgaggccaccagcccccugcccagaaccagaagcggcccccugcccagcagcagcggcagcagcagcagcagcagccagcugagcguggccacccugggcagaagccccagccccaagagcgcccugcugacccagaacggcaccggcagccugcccagaaaccuggccgccacccugcaggacaucgagaccaagagacagcuggcccugcagcagaagggccagcaggugaucgaggagcagagaagaagacuggccgagcugaagcagaaggccgccgccgaggcccagugccagugggacgcccugcacggcgccgcccccuuccccgccggccccagcggcuuccccccccugaugcaccacagcauccugcaccaccugcccgccggcagagagagaggcgaggagggcgagcacgccuacgacacccugagccuggagagcagcgacagcauggagaccagcaucagcaccggcggcaacagcgccugcagccccgacaacaugagcagcgccagcggccuggacaugggcaagaucgaggagauggagaagaugcugaaggaggcccacgccgagaagaacagacugauggagagcagagagagagagauggagcugagaagacaggcccuggaggaggagagaagaagaagagagcagguggagagaagacugcagagcgagagcgccagaagacagcagcugguggagaaggaggugaagaugagagagaagcaguucagccaggccagaccccugaccagauaccugcccaucagaaaggaggacuucgaccugaagacccacaucgagagcagcggccacggcguggacaccugccugcacguggugcugagcagcaaggugugcagaggcuaccuggugaagaugggcggcaagaucaagagcuggaagaagagaugguucguguucgacagacugaagagaacccugagcuacuacguggacaagcacgagaccaagcugaagggcgugaucuacuuccaggccaucgaggagguguacuacgaccaccugagaagcgccgccaagagccccaaccccgcccugaccuucugcgugaagacccacgacagacuguacuacaugguggcccccagcgccgaggccaugagaaucuggauggacgugaucgugaccggcgccgagggcuacacccaguucaugaacuaa

SEQ ID NO: 21485 - RNA, 5154 nt, Artificial Sequence
  PHLPP1__Homo_sapiens__NP_919431
auggagcccgccgccgccgccaccgugcagagacugcccgagcugggcagagaggacagagccagcgcccccgccgccgccgccgccgccgccgccgccgccgccgccgccgccgccgcccuggccgccgccgccggcggcggcagaagccccgagcccgcccugacccccgccgcccccagcggcggcaacggcagcggcagcggcgccagagaggaggcccccggcgaggccccccccggcccccugcccggcagagccggcggcgccggcagaagaagaagaagaggcgccccccagcccaucgccggcggcgccgcccccgugcccggcgccggcggcggcgccaacagccugcugcugagaagaggcagacugaagagaaaccugagcgccgccgccgccgccgccagcagcagcagcagcagcagcgccgccgccgccagccacagccccggcgccgccggccugcccgccagcugcagcgccagcgccagccugugcaccagaagccuggacagaaagacccugcugcugaagcacagacagacccugcagcugcagcccagcgacagagacugggugagacaccagcugcagagaggcugcgugcacguguucgacagacacauggccagcaccuaccugagacccgugcugugcacccuggacaccaccgccggcgagguggccgccagacugcugcagcugggccacaagggcggcggcguggugaaggugcugggccagggccccggcgccgccgccgccagagagcccgccgagcccccccccgaggccggccccagacuggccccccccgagcccagagacagcgaggugccccccgccagaagcgcccccggcgccuucggcggcccccccagagccccccccgccgaccugccccugcccgugggcggccccggcggcuggagcagaagagccagccccgcccccagcgacagcagccccggcgagcccuucgugggcggccccgugagcagccccagagcccccagacccguggugagcgacaccgagagcuucagccugagccccagcgccgagagcgugagcgacagacuggaccccuacagcagcggcggcggcagcagcagcagcagcgaggagcuggaggccgacgccgccagcgcccccaccggcgugcccggccagcccagaagacccggccaccccgcccagccccugccccugccccagaccgccagcagcccccagccccagcagaaggcccccagagccaucgacagccccggcggcgccgugagagagggcagcugcgaggagaaggccgccgccgccguggcccccggcggccugcagagcacccccggcagaagcggcgugaccgccgagaaggcccccccccccccccccccccccacccuguacgugcagcugcacggcgagaccaccagaagacuggaggccgaggagaagccccugcagauccagaacgacuaccuguuccagcugggcuucggcgagcuguggagagugcaggaggagggcauggacagcgagaucggcugccugaucagauucuacgccggcaagccccacagcaccggcagcagcgagagaauccagcugagcggcauguacaacgugagaaagggcaagaugcagcugcccgugaacagauggaccagaagacaggugauccugugcggcaccugccugaucgugagcagcgugaaggacagccugaccggcaagaugcacgugcugccccugaucggcggcaagguggaggaggugaagaagcaccagcacugccuggccuucagcagcagcggcccccagagccagaccuacuacaucugcuucgacaccuucaccgaguaccugagauggcugagacaggugagcaagguggccagccagagaaucagcagcguggaccugagcugcugcagccuggagcaccugcccgccaaccuguucuacagccaggaccugacccaccugaaccugaagcagaacuuccugagacagaaccccagccugcccgccgccagaggccugaacgagcugcagagauucaccaagcugaagagccugaaccugagcaacaaccaccugggcgacuucccccuggccgugugcagcauccccacccuggccgagcugaacgugagcugcaacgcccugagaagcgugcccgccgccgugggcgugaugcacaaccugcagaccuuccugcuggacggcaacuuccugcagagccugcccgccgagcuggagaacaugaagcagcugagcuaccugggccugagcuucaacgaguucaccgacauccccgaggugcuggagaagcugaccgccguggacaagcugugcaugagcggcaacugcguggagacccugagacugcaggcccugagaaagaugccccacaucaagcacguggaccugagacugaacgugaucagaaagcugaucgccgacgagguggacuuccugcagcacgugacccagcuggaccugagagacaacaagcugggcgaccuggacgccaugaucuucaacaacaucgaggugcugcacugcgagagaaaccagcuggugacccuggacaucugcggcuacuuccugaaggcccuguacgccagcagcaacgagcuggugcagcuggacguguaccccgugcccaacuaccugagcuacauggacgugagcagaaacagacuggagaacgugcccgagugggugugcgagagcagaaagcuggaggugcuggacaucggccacaaccagaucugcgagcugcccgccagacuguucugcaacagcagccugagaaagcugcuggccggccacaaccagcuggccagacugcccgagagacuggagagaaccagcguggaggugcuggacgugcagcacaaccagcugcuggagcugccccccaaccugcugaugaaggccgacagccugagauuccugaacgccagcgccaacaagcuggagagccugccccccgccacccugagcgaggagaccaacagcauccugcaggagcuguaccugaccaacaacagccugaccgacaagugcgugccccugcugaccggccacccccaccugaagauccugcacauggccuacaacagacugcagagcuuccccgccagcaagauggccaagcuggaggagcuggaggagaucgaccugagcggcaacaagcugaaggccauccccaccaccaucaugaacugcagaagaaugcacaccgugaucgcccacagcaacugcaucgagguguuccccgaggugaugcagcugcccgagaucaagugcguggaccugagcugcaacgagcugagcgaggugacccugcccgagaaccugccccccaagcugcaggagcuggaccugaccggcaaccccagacuggugcuggaccacaagacccuggagcugcugaacaacaucagaugcuucaagaucgaccagcccagcaccggcgacgccagcggcgcccccgccguguggagccacggcuacaccgaggccagcggcgugaagaacaagcugugcguggccgcccugagcgugaacaacuucugcgacaacagagaggcccuguacggcguguucgacggcgacagaaacguggaggugcccuaccugcugcagugcaccaugagcgacauccuggccgaggagcugcagaagaccaagaacgaggaggaguacauggugaacaccuucaucgugaugcagagaaagcugggcaccgccggccagaagcugggcggcgccgccgugcugugccacaucaagcacgaccccguggaccccggcggcagcuucacccugaccagcgccaacgugggcaagugccagaccgugcugugcagaaacggcaagccccugccccugagcagaagcuacaucaugagcugcgaggaggagcugaagagaaucaagcagcacaaggccaucaucaccgaggacggcaaggugaacggcgugaccgagagcaccagaauccugggcuacaccuuccugcaccccagcguggugcccagaccccacgugcagagcgugcugcugaccccccaggacgaguucuucauccugggcagcaagggccugugggacagccugagcguggaggaggccguggaggccgugagaaacgugcccgacgcccuggccgccgccaagaagcugugcacccuggcccagagcuacggcugccacgacagcaucagcgccgugguggugcagcugagcgugaccgaggacagcuucugcugcugcgagcugagcgccggcggcgccgugcccccccccagccccggcaucuucccccccagcgugaacauggugaucaaggacagacccagcgacggccugggcgugcccagcagcagcagcggcauggccagcgagaucagcagcgagcugagcaccagcgagaugagcagcgaggugggcagcaccgccagcgacgagcccccccccggcgcccugagcgagaacagccccgccuaccccagcgagcagagaugcaugcugcaccccaucugccugagcaacagcuuccagagacagcugagcagcgccaccuucagcagcgccuucagcgacaacggccuggacagcgacgacgaggagcccaucgagggcguguucaccaacggcagcagaguggagguggagguggacauccacugcagcagagccaaggagaaggagaagcagcagcaccugcugcaggugcccgccgaggccagcgacgagggcaucgugaucagcgccaacgaggacgagcccggccugcccagaaaggccgacuucagcgccgugggcaccaucggcagaagaagagccaacggcagcguggccccccaggagagaagccacaacgugaucgagguggccaccgacgccccccugagaaagcccggcggcuacuucgccgcccccgcccagcccgaccccgacgaccaguucaucaucccccccgagcuggaggaggaggugaaggagaucaugaagcaccaccaggagcagcagcagcagcagcagccccccccccccccccagcugcagccccagcugcccagacacuaccagcuggaccagcugcccgacuacuacgacaccccccuguaa

SEQ ID NO: 21486 - RNA, 3771 nt, Artificial Sequence
  PHLPP2__Homo_sapiens__NP_001275932
augaagagaaacggcagcagaaacugccugaacagaagaagcagauucggcagcagagagagagacuggcugagagaggacgugaagagaggcugcguguaccuguacggcgccgacaccaccaccgccaccaccaccaccaccaccagcagcagcagcagcagcagcagcagcagcagcgaccugcaccuggugcugugcaccguggagacccccgccagcgagaucugcgccggcgagggcagagagagccuguaccugcagcugcacggcgaccuggugagaagacuggagcccaccgagagaccccugcagaucguguacgacuaccugagcagacugggcuucgacgaccccgugagaauccaggaggaggccaccaaccccgaccugggcugcaugaucagauucuacggcgagaagcccugccacauggacagacuggacagaauccugcugagcggcaucuacaacgugagaaagggcaagacccagcugcacaagugggccgagagacugguggugcugugcggcaccugccugaucgugagcagcgugaaggacugccagaccggcaagaugcacauccugccccuggugggcggcaagaucgaggaggugaagagaagacaguacagccuggccuucagcagcgccggcgcccaggcccagaccuaccacgugagcuucgagacccuggccgaguaccagagauggcagagacaggccagcaagguggugagccagagaaucagcaccguggaccugagcugcuacagccuggaggaggugcccgagcaccuguucuacagccaggacaucaccuaccugaaccugagacacaacuucaugcagcuggagagacccggcggccuggacacccuguacaaguucagccagcugaagggccugaaccugagccacaacaagcugggccuguuccccauccugcugugcgagaucagcacccugaccgagcugaaccugagcugcaacggcuuccacgaccugcccagccagaucggcaaccugcugaaccugcagacccugugccuggacggcaacuuccugaccacccugcccgaggagcugggcaaccugcagcagcugagcagccugggcaucagcuucaacaacuucagccagauccccgagguguacgagaagcugaccaugcuggacagaguggugauggccggcaacugccuggaggugcugaaccugggcgugcugaacagaaugaaccacaucaagcacguggaccugagaaugaaccaccugaagaccauggugaucgagaaccuggagggcaacaagcacaucacccacguggaccugagagacaacagacugaccgaccuggaccugagcagccugugcagccuggagcagcugcacugcggcagaaaccagcugagagagcugacccugagcggcuucagccugagaacccuguacgccagcagcaacagacugaccgccgugaacguguaccccgugcccagccugcugaccuuccuggaccugagcagaaaccugcuggagugcgugcccgacugggccugcgaggccaagaagaucgaggugcuggacgugagcuacaaccugcugaccgaggugcccgugagaauccugagcagccugagccugagaaagcugaugcugggccacaaccacgugcagaaccugcccacccugguggagcacaucccccuggaggugcuggaccugcagcacaacgcccugaccagacugcccgacacccuguucagcaaggcccugaacaagcugaacaagcuggagcagcuggaggagcugaaccugagcggcaacaagcugaagaccauccccaccaccaucgccaacugcaagagacugcacacccugguggcccacagcaacaacaucagcaucuuccccgagauccugcagcugccccagauccaguucguggaccugagcugcaacgaccugaccgagauccugauccccgaggcccugcccgccacccugcaggaccuggaccugaccggcaacaccaaccuggugcuggagcacaagacccuggacaucuucagccacaucaccacccugaagaucgaccagaagccccugcccaccaccgacagcaccgugaccagcaccuucuggagccacggccuggccgagauggccggccagagaaacaagcugugcgugagcgcccuggccauggacagcuucgccgagggcgugggcgccguguacggcauguucgacggcgacagaaacgaggagcugcccagacugcugcagugcaccauggccgacgugcugcuggaggaggugcagcagagcaccaacgacaccguguucauggccaacaccuuccuggugagccacagaaagcugggcauggccggccagaagcugggcagcagcgcccugcugugcuacaucagacccgacaccgccgaccccgccagcagcuucagccugaccguggccaacgugggcaccugccaggccgugcugugcagaggcggcaagcccgugccccugagcaagguguucagccuggagcaggaccccgaggaggcccagagagugaaggaccagaaggccaucaucaccgaggacaacaaggugaacggcgugaccugcugcaccagaaugcugggcugcaccuaccuguaccccuggauccugcccaagccccacaucagcagcaccccccugaccauccaggacgagcugcugauccugggcaacaaggcccugugggagcaccugagcuacaccgaggccgugaacgccgugagacacgugcaggacccccuggccgccgccaagaagcugugcacccuggcccagagcuacggcugccaggacaacgugggcgccauggugguguaccugaacaucggcgaggagggcugcaccugcgagaugaacggccugacccugcccggccccgugggcuucgccagcaccaccaccaucaaggacgcccccaagcccgccacccccagcagcagcagcggcaucgccagcgaguucagcagcgagaugagcaccagcgaggugagcagcgaggugggcagcaccgccagcgacgagcacaacgccggcggccuggacaccgcccugcugcccagacccgagagaagaugcagccugcaccccacccccaccagcggccuguuccagagacagcccagcagcgccaccuucagcagcaaccagagcgacaacggccuggacagcgacgacgaccagcccguggagggcgugaucaccaacggcagcaagguggagguggagguggacauccacugcugcagaggcagagaccuggagaacagccccccccugaucgagagcagccccacccugugcagcgaggagcacgccagaggcagcugcuucggcaucagaagacagaacagcgugaacagcggcaugcugcugcccaugagcaaggacagaauggagcugcagaagagccccagcaccagcugccuguacggcaagaagcugagcaacggcagcaucgugccccuggaggacagccugaaccugaucgagguggccaccgaggugcccaagagaaagaccggcuacuucgccgcccccacccagauggagcccgaggaccaguucguggugccccacgaccuggaggaggaggugaaggagcagaugaagcagcaccaggacagcagacuggagcccgagccccacgaggaggacagaaccgagccccccgaggaguucgacaccgcccuguaa

SEQ ID NO: 21487 - RNA, 855 nt, Artificial Sequence
  PHOX2A__Homo_sapiens__NP_005160
auggacuacagcuaccugaacagcuacgacagcugcguggccgccauggaggccagcgccuacggcgacuucggcgccugcagccagcccggcggcuuccaguacagcccccugagacccgccuuccccgccgccggcccccccugccccgcccugggcagcagcaacugcgcccugggcgcccugagagaccaccagcccgcccccuacagcgccgugcccuacaaguucuuccccgagcccagcggccugcacgagaagagaaagcagagaagaaucagaaccaccuucaccagcgcccagcugaaggagcuggagagaguguucgccgagacccacuaccccgacaucuacaccagagaggagcuggcccugaagaucgaccugaccgaggccagagugcaggugugguuccagaacagaagagccaaguucagaaagcaggagagagccgccagcgccaagggcgccgccggcgccgccggcgccaagaagggcgaggccagaugcagcagcgaggacgacgacagcaaggagagcaccugcagccccacccccgacagcaccgccagccugccccccccccccgcccccggccuggccagccccagacugagccccagcccccugcccguggcccugggcagcggccccggccccggccccggcccccagccccugaagggcgcccugugggccggcguggccggcggcggcggcggcggccccggcgccggcgccgccgagcugcugaaggccuggcagcccgccgagagcggccccggccccuucagcggcgugcugagcagcuuccacagaaagcccggccccgcccugaagaccaaccuguucuaa

SEQ ID NO: 21488 - RNA, 945 nt, Artificial Sequence
  PHOX2B__Homo_sapiens__NP_003915
auguacaagauggaguacagcuaccugaacagcagcgccuacgagagcugcauggccggcauggacaccagcagccuggccagcgccuacgccgacuucagcagcugcagccaggccagcggcuuccaguacaaccccaucagaaccaccuucggcgccaccagcggcugccccagccugacccccggcagcugcagccugggcacccugagagaccaccagagcagccccuacgccgccgugcccuacaagcuguucaccgaccacggcggccugaacgagaagagaaagcagagaagaaucagaaccaccuucaccagcgcccagcugaaggagcuggagagaguguucgccgagacccacuaccccgacaucuacaccagagaggagcuggcccugaagaucgaccugaccgaggccagagugcaggugugguuccagaacagaagagccaaguucagaaagcaggagagagccgccgccgccgccgccgccgccgccaagaacggcagcagcggcaagaagagcgacagcagcagagacgacgagagcaaggaggccaagagcaccgaccccgacagcaccggcggccccggccccaaccccaaccccacccccagcugcggcgccaacggcggcggcggcggcggccccagccccgccggcgcccccggcgccgccggccccggcggccccggcggcgagcccggcaagggcggcgccgccgccgccgccgccgccgccgccgccgccgccgccgccgccgccgccgccgccgccggcggccuggccgccgccggcggccccggccagggcugggcccccggccccggccccaucaccagcauccccgacagccugggcggccccuucgccagcgugcugagcagccugcagagacccaacggcgccaaggccgcccuggugaagagcagcauguucuaa

SEQ ID NO: 21489 - RNA, 375 nt, Artificial Sequence
  PHPT1__Homo_sapiens__NP_001129333
auggccguggccgaccuggcccugauccccgacguggacaucgacagcgacggcguguucaaguacgugcugaucagagugcacagcgcccccagaagcggcgcccccgccgccgagagcaaggagaucgugagaggcuacaagugggccgaguaccacgccgacaucuacgacaaggugagcggcgacaugcagaagcagggcugcgacugcgagugccugggcggcggcagaaucagccaccagagccaggacaagaagauccacguguacggcuacagcaugaugagacccaccugcgugccccugggcgccagcggccccagaauccaccaccagggccuguggagcugccccgccagacacuucaacuaa

SEQ ID NO: 21490 - RNA, 4950 nt, Artificial Sequence
  PHRF1__Homo_sapiens__NP_001273510
auggacgacgacagccuggacgagcugguggccagaagccccggccccgacggccacccccaggugggccccgccgaccccgccggcgacuucgaggagagcagcgugggcagcagcggcgacagcggcgacgacagcgacagcgagcacggcgacggcaccgacggcgaggacgagggcgccagcgaggaggaggaccuggaggacagaagcggcagcgaggacagcgaggacgacggcgagacccugcuggagguggccggcacccagggcaagcuggaggccgccggcagcuucaacagcgacgacgacgccgagagcugccccaucugccugaacgccuucagagaccaggccgugggcacccccgagaacugcgcccacuacuucugccuggacugcaucguggaguggagcaagaacgccaacagcugccccguggacagaacccuguucaagugcaucugcaucagagcccaguucggcggcaagauccugagaaagauccccguggagaacaccaaggccagcgaggaggaggaggaccccaccuucugcgaggugugcggcagaagcgacagagaggacagacugcugcugugcgacggcugcgacgccggcuaccacauggagugccuggaccccccccugcaggaggugcccguggacgagugguucugccccgagugcgccgcccccggcguggugcuggccgccgacgccggccccgugagcgaggaggaggugagccugcugcuggccgacguggugcccaccaccagcagacugagacccagagccggcagaaccagagccaucgccagaaccagacagagcgagagagugagagccaccgugaacagaaacagaaucagcaccgccagaagagugcagcacacccccggcagacugggcagcagccugcuggacgaggccaucgaggccguggccaccggccugagcaccgccguguaccagagaccccugacccccagaacccccgccagaagaaagagaaagaccagaagaagaaagaaggugcccggcagaaagaagacccccagcggccccagcgccaagagcaagagcagcgccaccagaagcaagaagagacagcacagagugaagaagagaagaggcaagaaggugaagagcgaggccaccaccagaagcagaaucgccagaacccugggccugagaagacccgugcacagcagcugcauccccagcgugcugaagcccguggagcccagccugggccugcugagagccgacaucggcgccgccagccugagccuguucggcgaccccuacgagcuggaccccuucgacagcagcgaggagcugagcgccaacccccugagcccccugagcgccaagagaagagcccugagcagaagcgcccugcagagccaccagcccguggccagacccgugagcgugggccugagcagaagaagacugcccgccgccgugcccgagcccgaccuggaggaggagcccgugcccgaccugcugggcagcauccugagcggccagagccugcugaugcugggcagcagcgacgugaucauccacagagacggcagccugagcgccaagagagccgcccccgugagcuuccagagaaacagcggcagccugagcagaggcgaggagggcuucaagggcugccugcagcccagagcccugcccagcggcagccccgcccagggccccagcggcaacagaccccagagcaccggccugagcugccagggcagaagcagaacccccgccagaaccgccggcgcccccgugagacuggaccugcccgccgcccccggcgccgugcaggccagaaaccugagcaacggcagcgugcccggcuucagacagagccacagccccugguucaacggcaccaacaagcacacccugccccuggccagcgccgccagcaagaucagcagcagagacagcaagccccccugcagaagcguggugcccggccccccccugaagcccgcccccagaagaaccgacaucagcgagcugcccagaauccccaagaucagaagagacgacggcggcggcagaagagacgccgcccccgcccacggccagagcaucgagauccccagcgccugcaucagcagacugaccggcagagagggcaccggccagcccggcagaggcaccagagccgagagcgaggccagcagcagagugcccagagagcccggcgugcacaccggcagcagcagaccccccgcccccagcagccacggcagccuggccccccugggccccagcagaggcaagggcgugggcagcaccuucgagagcuucagaaucaacauccccggcaacauggcccacagcagccagcugagcagccccggcuucugcaacaccuucagacccguggacgacaaggagcagagaaaggagaaccccagcccccuguucagcaucaagaagaccaagcagcugagaagcgagguguacgaccccagcgaccccaccggcagcgacagcagcgcccccggcagcagccccgagagaagcggccccggccugcugcccagcgagaucaccagaaccaucagcaucaacagccccaaggcccagaccgugcaggccgugagaugcgugaccagcuacaccguggagagcaucuucggcaccgagcccgagcccccccugggccccagcagcgccaugagcaagcugagaggcgccguggccgccgagggcgccagcgacaccgagagagaggagcccaccgagagccagggccuggccgccagacugagaagacccagcccccccgagcccugggacgaggaggacggcgccagcugcagcaccuucuucggcagcgaggagagaaccgugaccugcgugaccgugguggagcccgaggccccccccagccccgacgugcugcaggccgccacccacagagugguggagcugagaccccccagcagaagcagaagcaccagcagcagcagaagcagaaagaaggccaagagaaagagagugagcagagagcacggcagaaccagaagcggcaccagaagcgagagcagagacagaagcagcagaagcgccagccccagcgugggcgaggagagacccagaagacagagaagcaaggccaagagcagaagaagcagcagcgacagaagcagcagcagagagagagccaagagaaagaaggccaaggacaagagcagagagcacagaagaggccccuggggccacagcagaagaaccagcagaagcagaagcggcagccccggcagcagcagcuacgagcacuacgagagcagaaagaagaagaagagaagaagcgccagcagacccagaggcagagagugcagccccaccagcagccuggagagacugugcagacacaagcaccagagagagagaagccacgagagacccgacagaaaggagagcguggccuggcccagagacagaagaaagagaagaagcagaagccccagcagcgagcacagagccagagagcacagaagacccagaagcagagagaaguggccccagaccagaagccacagccccgagagaaagggcgccgugagagaggccagccccgccccccuggcccagggcgagcccggcagagaggaccugcccaccagacugcccgcccugggcgaggcccacgugagccccgagguggccaccgccgacaaggccccccugcaggccccccccgugcuggagguggccgccgagugcgagcccgacgaccuggaccuggacuacggcgacagcguggaggccggccacguguucgacgacuucagcagcgacgccguguucauccagcuggacgacaugagcagcccccccagccccgagagcaccgacagcagccccgagagagacuucccccugaagcccgcccugccccccgccagccuggccguggccgccauccagagagaggugagccugaugcacgacgaggaccccagccagccccccccccugcccgagggcacccaggagccccaccugcugagacccgacgccgccgagaaggccgaggcccccagcagccccgacguggcccccgccggcaaggaggacagccccagcgccagcggcagagugcaggaggccgccagacccgaggagguggugagccagaccccccugcugagaagcagagcccuggugaagagagugaccuggaaccugcaggagagcgagagcagcgcccccgccgaggacagagcccccagagccccccugcacagaccccagaagcccagagagggcgccugggacauggaggacguggcccccaccggcgugagacagguguucagcgagcugcccuuccccagccacgugcugcccgagcccggcuuccccgacaccgaccccagccagguguacagccccggccugccccccgcccccgcccagcccagcagcaucccccccugcgcccuggugagccagcccaccgugcaguucauccugcagggcagccugccccuggugggcugcggcgccgcccagacccuggcccccgugcccgccgcccugacccccgccagcgagcccgccagccaggccaccgccgccagcaacagcgaggagaagacccccgcccccagacuggccgccgagaagaccaagaaggaggaguacaugaagaagcugcacaugcaggagagagccguggaggaggugaagcuggccaucaagcccuucuaccagaagagagaggugaccaaggaggaguacaaggacauccugagaaaggccgugcagaagaucugccacagcaagagcggcgagaucaaccccgugaagguggccaaccuggugaaggccuacguggacaaguacagacacaugagaagacacaagaagcccgaggccggcgaggagccccccacccagggcgccgagggcuaa

SEQ ID NO: 21491 - RNA, 2289 nt, Artificial Sequence
  PHTF1__Homo_sapiens__XP_011538833
auggccagcaacgagagagacgccaucagcugguaccagaagaagaucggcgccuacgaccagcagaucugggagaagagcaucgagcagacccagaucaagggccugaagaacaagcccaagaagaugggccacaucaagcccgaccugaucgacguggaccugaucagaggcagcaccuucgccaaggccaagcccgagauccccuggaccagccugaccagaaagggccuggugagagugguguucuucccccuguucagcaacugguggauccaggugaccagccugagaaucuucguguggcugcugcugcuguacuucaugcaggugaucgccaucgugcuguaccugaugaugcccaucgugaacaucagcgaggugcugggcccccugugccugaugcugcugaugggcaccgugcacugccagaucgugagcacccagaucaccagacccagcggcaacaacggcaacagaagaagaagaaagcugagaaagaccgugaacggcgacggcagcagagagaacggcaacaacagcagcgacaaggugagaggcaucgagacccuggagagcgugcccaucaucggcggcuucugggagaccaucuucggcaacagaaucaagagagugaagcugaucagcaacaagggcaccgagaccgacaacgaccccagcugcgugcaccccaucaucaagagaagacagugcagacccgagaucagaauguggcagaccagagagaaggccaaguucagcgacggcgagaagugcagaagagaggccuucagaagacugggcaacggcgugagcgacgaccugagcagcgaggaggacggcgaggccagaacccagaugauccugcugagaagaagcguggagggcgccagcagcgacaacggcugcgaggugaagaacagaaagagcauccugagcagacaccugaacagccaggugaagaagaccaccaccagauggugccacaucgugagagacagcgacagccuggccgagagcgaguucgagagcgccgccuucagccagggcagcagaagcggcgugagcggcggcagcagaagccugaacaugagcagaagagacagcgagagcaccagacacgacagcgagaccgaggacaugcugugggacgaccugcugcacggccccgagugcagaagcagcgugaccagcgacagcgagggcgcccacgugaacacccugcacagcggcaccaagagagaccccaaggaggacguguuccagcagaaccaccuguucuggcugcagaacagcagccccagcagcgacagagugagcgccaucaucugggagggcaacgagugcaagaagauggacaugagcgugcuggagaucagcggcaucaucaugagcagagugaacgccuaccagcagggcgugggcuaccagaugcugggcaacguggugaccaucggccuggccuucuuccccuuccugcacagacuguucagagagaagagccuggaccagcugaagagcaucagcgccgaggagauccugacccuguucugcggcgccccccccgugacccccaucaucgugcugagcaucaucaacuucuucgagagacugugccugaccuggauguucuucuucaugaugugcguggccgagagaaccuacaagcagagauuccuguucgccaagcuguucagccacaucaccagcgccagaaaggccagaaaguacgagaucccccacuucagacugaagaagguggagaacaucaagaucuggcugagccugagaagcuaccugaagagaagaggcccccagagaagcguggacgugguggugagcagcguguuccugcugacccugagcaucgccuucaucugcugcgcccaggugcugcagggccacaagaccuuccugaacgacgccuacaacugggaguuccugaucugggagaccgcccugcugcuguuccugcugagacuggccagccugggcagcgagaccaacaagaaguacagcaacgugagcauccugcugaccgagcagaucaaccuguaccugaagauggagaagaagcccaacaagaaggagcagcugacccuggugaacaacgugcugaagcugagcaccaagcugcugaaggagcuggacacccccuucagacuguacggccugaccaugaacccccugaucuacaacaucaccagaguggugauccugagcgccgugagcggcgugaucagcgaccugcugggcuucaacaucagacuguggaagaucaagagcuaa

SEQ ID NO: 21492 - RNA, 2244 nt, Artificial Sequence
  PHTF2__Homo_sapiens__NP_001120830
auggccagcaaggugaccgacgccaucgugugguaccagaagaagaucggcgccuacgaccagcagaucugggagaagagcguggagcagagagagaucaagggccugagaaacaagcccaagaagaccgcccacgugaagcccgaccugaucgacguggaccuggugagaggcagcgccuucgccaaggccaagcccgagagccccuggaccagccugaccagaaagggcaucgugagagugguguucuuccccuucuucuucagaugguggcugcaggugaccagcaaggugaucuucuucuggcugcuggugcuguaccugcugcagguggccgccaucgugcuguucugcagcaccagcagcccccacagcaucccccugaccgaggugaucggccccaucuggcugaugcugcugcugggcaccgugcacugccagaucgugagcaccagaacccccaagcccccccugagcaccggcggcaagagaagaagaaagcugagaaaggccgcccaccuggaggugcacagagagggcgacggcagcagcaccaccgacaacacccaggagggcgccgugcagaaccacggcaccagcaccagccacagcgugggcaccguguucagagaccuguggcacgccgccuucuuccugagcggcagcaagaaggccaagaacagcaucgacaagagcaccgagaccgacaacggcuacgugagccuggacggcaagaagaccgugaagagcggcgaggacggcauccagaaccacgagccccagugcgagaccaucagacccgaggagaccgccuggaacaccggcacccugagaaacggccccagcaaggacacccagagaaccaucaccaacgugagcgacgaggugagcagcgaggagggccccgagaccggcuacagccugagaagacacguggacagaaccagcgagggcgugcugagaaacagaaagagccaccacuacaagaagcacuaccccaacgaggacgcccccaagagcggcaccagcugcagcagcagaugcagcagcagcagacaggacagcgagagcgccagacccgagagcgagaccgaggacgugcugugggaggaccugcugcacugcgccgagugccacagcagcugcaccagcgagaccgacguggagaaccaccagaucaaccccugcgugaagaaggaguacagagacgaccccuuccaccagagccaccugcccuggcugcacagcagccaccccggccuggagaagaucagcgccaucgugugggagggcaacgacugcaagaaggccgacaugagcgugcuggagaucagcggcaugaucaugaacagagugaacagccacauccccggcaucggcuaccagaucuucggcaacgccgugagccugauccugggccugacccccuucguguucagacugagccaggccaccgaccuggagcagcugaccgcccacagcgccagcgagcuguacgugaucgccuucggcagcaacgaggacgugaucgugcugagcauggugaucaucagcuucguggugagagugagccugguguggaucuucuucuuccugcugugcguggccgagagaaccuacaagcagagacugcuguucgccaagcuguucggccaccugaccagcgccagaagagccagaaagagcgaggugccccacuucagacugaagaaggugcagaacaucaagauguggcugagccugagaagcuaccugaagagaagaggcccccagagaagcguggacgugaucgugagcagcgccuuccugcugaccaucagcgugguguucaucugcugcgcccagcugcugcacgugcacgagaucuuccuggacugccacuacaacugggagcuggugaucuggugcaucagccugacccuguuccugcugagauucgugacccugggcagcgagaccagcaagaaguacagcaacaccagcauccugcugaccgagcagaucaaccuguaccugaagauggagaagaagcccaacaagaaggaggagcugacccuggugaacaacgugcugaagcuggccaccaagcugcugaaggagcuggacagccccuucagacuguacggccugaccaugaacccccugcuguacaacaucacccagguggugauccugagcgccgugagcggcgugaucagcgaccugcugggcuucaaccugaagcuguggaagaucaagagcuaa

SEQ ID NO: 21493 - RNA, 717 nt, Artificial Sequence
  PHYH__Homo_sapiens__NP_001032626
augagagacgugaccaucagcaagagcgaguacgcccccagcgagaagaugaucaccaaggugcaggacuuccaggaggacaaggagcuguucagauacugcacccugcccgagauccugaaguacguggagugcuucaccggccccaacaucauggccaugcacaccaugcugaucaacaagccccccgacagcggcaagaagaccagcagacacccccugcaccaggaccugcacuacuuccccuucagacccagcgaccugaucgugugcgccuggaccgccauggagcacaucagcagaaacaacggcugccugguggugcugcccggcacccacaagggcagccugaagccccacgacuaccccaagugggagggcggcgugaacaagauguuccacggcauccaggacuacgaggagaacaaggccagagugcaccuggugauggagaagggcgacaccguguucuuccacccccugcugauccacggcagcggccagaacaagacccagggcuucagaaaggccaucagcugccacuucgccagcgccgacugccacuacaucgacgugaagggcaccagccaggagaacaucgagaaggagguggugggcaucgcccacaaguucuucggcgccgagaacagcgugaaccugaaggacaucuggauguucagagccagacuggugaagggcgagagaaccaaccuguaa

SEQ ID NO: 21494 - RNA, 993 nt, Artificial Sequence
  PHYHIP__Homo_sapiens__NP_001092805
auggagcugcugagcaccccccacagcaucgagaucaacaacaucaccugcgacagcuucagaaucagcugggccauggaggacagcgaccuggagagagugacccacuacuucaucgaccugaacaagaaggagaacaagaacagcaacaaguucaagcacagagacgugcccaccaagcugguggccaaggccgugccccugcccaugaccgugagaggccacugguuccugagccccagaaccgaguacagcguggccgugcagaccgccgugaagcagagcgacggcgaguaccuggugagcggcuggagcgagaccguggaguucugcaccggcgacuacgccaaggagcaccuggcccagcugcaggagaaggccgagcagaucgccggcagaaugcugagauucagcguguucuacagaaaccaccacaaggaguacuuccagcacgccagaacccacugcggcaacaugcugcagcccuaccugaaggacaacagcggcagccacggcagccccaccagcggcaugcugcacggcguguucuucagcugcaacaccgaguucaacaccggccagcccccccaggacagccccuacggcagauggagauuccagauccccgcccagagacuguucaaccccagcaccaaccuguacuucgccgacuucuacugcauguacaccgccuaccacuacgccauccuggugcuggcccccaagggcagccugggcgacagauucugcagagacagacugccccugcuggacaucgccugcaacaaguuccugaccugcagcguggaggacggcgagcugguguucagacacgcccaggaccugauccuggagaucaucuacaccgagcccguggaccugagccugggcacccugggcgagaucagcggccaccagcugaugagccugagcaccgccgacgccaagaaggaccccagcugcaagaccugcaacaucagcgugggcagauaa

SEQ ID NO: 21495 - RNA, 1353 nt, Artificial Sequence
  PHYKPL__Homo_sapiens__NP_699204
auggccgccgaccagagacccaaggccgacacccuggcccugagacagagacugaucagcagcagcugcagacuguucuuccccgaggaccccgugaagaucgugagagcccagggccaguacauguacgacgagcagggcgccgaguacaucgacugcaucagcaacguggcccacgugggccacugccacccccugguggugcaggccgcccacgagcagaaccaggugcugaacaccaacagcagauaccugcacgacaacaucguggacuacgcccagagacugagcgagacccugcccgagcagcugugcguguucuacuuccugaacagcggcagcgaggccaacgaccuggcccugagacuggccagacacuacaccggccaccaggacgugguggugcuggaccacgccuaccacggccaccugagcagccugaucgacaucagccccuacaaguucagaaaccuggacggccagaaggagugggugcacguggccccccugcccgacaccuacagaggccccuacagagaggaccaccccaaccccgccauggccuacgccaacgaggugaagagaguggugagcagcgcccaggagaagggcagaaagaucgccgccuucuucgccgagagccugcccagcgugggcggccagaucaucccccccgccggcuacuucagccagguggccgagcacaucagaaaggccggcggcguguucguggccgacgagauccaggugggcuucggcagagugggcaagcacuucugggccuuccagcugcagggcaaggacuucgugcccgacaucgugaccaugggcaagagcaucggcaacggccaccccguggccugcguggccgccacccagcccguggccagagccuucgaggccaccggcguggaguacuucaacaccuucggcggcagccccgugagcugcgccgugggccuggccgugcugaacgugcuggagaaggagcagcugcaggaccacgccaccagcgugggcagcuuccugaugcagcugcugggccagcagaagaucaagcaccccaucgugggcgacgugagaggcgugggccuguucaucggcguggaccugaucaaggacgaggccaccagaacccccgccaccgaggaggccgccuaccuggugagcagacugaaggagaacuacgugcugcugagcaccgacggccccggcagaaacauccugaaguucaagccccccaugugcuucagccuggacaacgccagacaggugguggccaagcuggacgccauccugaccgacauggaggagaaggugagaagcugcgagacccugagacugcagcccuaa

SEQ ID NO: 21496 - RNA, 777 nt, Artificial Sequence
  PI15__Homo_sapiens__NP_056970
augaucgccaucagcgccgugagcagcgcccugcuguucagccugcugugcgaggccagcaccguggugcugcugaacagcaccgacagcagcccccccaccaacaacuucaccgacaucgaggccgcccugaaggcccagcuggacagcgccgacauccccaaggccagaagaaagagauacaucagccagaacgacaugaucgccauccuggacuaccacaaccaggugagaggcaagguguucccccccgccgccaacauggaguacauggugugggacgagaaccuggccaagagcgccgaggccugggccgccaccugcaucugggaccacggccccagcuaccugcugagauuccugggccagaaccugagcgugagaaccggcagauacagaagcauccugcagcuggugaagcccugguacgacgaggugaaggacuacgccuuccccuacccccaggacugcaaccccagaugccccaugagaugcuucggccccaugugcacccacuacacccagauggugugggccaccagcaacagaaucggcugcgccauccacaccugccagaacaugaacguguggggcagcguguggagaagagccguguaccuggugugcaacuacgcccccaagggcaacuggaucggcgaggcccccuacaaggugggcgugcccugcagcagcugcccccccagcuacggcggcagcugcaccgacaaccugugcuuccccggcgugaccagcaacuaccuguacugguucaaguaa

SEQ ID NO: 21497 - RNA, 1392 nt, Artificial Sequence
  PI16__Homo_sapiens__NP_001186088
augcacggcagcugcagcuuccugaugcugcugcugccccugcugcugcugcugguggccaccaccggccccgugggcgcccugaccgacgaggagaagagacugaugguggagcugcacaaccuguacagagcccaggugagccccaccgccagcgacaugcugcacaugagaugggacgaggagcuggccgccuucgccaaggccuacgccagacagugcguguggggccacaacaaggagagaggcagaagaggcgagaaccuguucgccaucaccgacgagggcauggacgugccccuggccauggaggaguggcaccacgagagagagcacuacaaccugagcgccgccaccugcagccccggccagaugugcggccacuacacccagguggugugggccaagaccgagagaaucggcugcggcagccacuucugcgagaagcugcagggcguggaggagaccaacaucgagcugcuggugugcaacuacgagccccccggcaacgugaagggcaagagacccuaccaggagggcacccccugcagccagugccccagcggcuaccacugcaagaacagccugugcgagcccaucggcagccccgaggacgcccaggaccugcccuaccuggugaccgaggcccccagcuucagagccaccgaggccagcgacagcagaaagaugggcacccccagcagccuggccaccggcauccccgccuuccuggugaccgaggugagcggcagccuggccaccaaggcccugcccgccguggagacccaggcccccaccagccuggccaccaaggacccccccagcauggccaccgaggccccccccugcgugaccaccgaggugcccagcauccuggccgcccacagccugcccagccuggacgaggagcccgugaccuuccccaagagcacccacgugcccauccccaagagcgccgacaaggugaccgacaagaccaaggugcccagcagaagccccgagaacagccuggaccccaagaugagccugaccggcgccagagagcugcugccccacgcccaggaggaggccgaggccgaggccgagcugccccccagcagcgaggugcuggccagcguguuccccgcccaggacaagcccggcgagcugcaggccacccuggaccacaccggccacaccagcagcaagagccugcccaacuuccccaacaccagcgccaccgccaacgccaccggcggcagagcccuggcccugcagagcagccugcccggcgccgagggccccgacaagcccagcguggugagcggccugaacagcggccccggccacguguggggcccccugcugggccugcugcugcugcccccccuggugcuggccggcaucuucuaa

SEQ ID NO: 21498 - RNA, 354 nt, Artificial Sequence
  PI3__Homo_sapiens__NP_002629
augagagccagcagcuuccugaucguggugguguuccugaucgccggcacccuggugcuggaggccgccgugaccggcgugcccgugaagggccaggacaccgugaagggcagagugcccuucaacggccaggaccccgugaagggccaggugagcgugaagggccaggacaaggugaaggcccaggagcccgugaagggccccgugagcaccaagcccggcagcugccccaucauccugaucagaugcgccaugcugaacccccccaacagaugccugaaggacaccgacugccccggcaucaagaagugcugcgagggcagcugcggcauggccugcuucgugccccaguaa

SEQ ID NO: 21499 - RNA, 1440 nt, Artificial Sequence
  PI4K2A__Homo_sapiens__NP_060895
auggacgagaccagcccccuggugagccccgagagagcccagccccccgacuacaccuuccccagcggcagcggcgcccacuucccccaggugcccggcggcgccgugagaguggccgccgccgccggcagcggccccagcccccccggcagccccggccacgacagagagagacagccccugcuggacagagccagaggcgccgccgcccagggccagacccagaccguggccgcccaggcccaggcccuggccgcccaggccgccgccgccgcccacgccgcccaggcccacagagagagaaacgaguuccccgaggaccccgaguucgaggccguggugagacaggccgagcuggccaucgagagaugcaucuuccccgagagaaucuaccagggcagcagcggcagcuacuucgugaaggacccccagggcagaaucaucgccguguucaagcccaagaacgaggagcccuacggccaccugaaccccaaguggaccaaguggcugcagaagcugugcugccccugcugcuucggcagagacugccuggugcugaaccagggcuaccugagcgaggccggcgccagccugguggaccagaagcuggagcugaacaucgugcccagaaccaaggugguguaccuggccagcgagaccuucaacuacagcgccaucgacagagugaagagcagaggcaagagacuggcccuggagaaggugcccaaggugggccagagauucaacagaaucggccugccccccaaggugggcagcuuccagcuguucguggagggcuacaaggacgccgacuacuggcugagaagauucgaggccgagccccugcccgagaacaccaacagacagcugcugcugcaguucgagagacugguggugcuggacuacaucaucagaaacaccgacagaggcaacgacaacuggcugaucaaguacgacugccccauggacagcagcagcagcagagacaccgacugggugguggugaaggagcccgugaucaagguggccgccaucgacaacggccuggccuucccccugaagcaccccgacagcuggagagccuaccccuucuacugggccuggcugccccaggccaaggugcccuucagccaggagaucaaggaccugauccugcccaagaucagcgaccccaacuucgugaaggaccuggaggaggaccuguacgagcuguucaagaaggaccccggcuucgacagaggccaguuccacaagcagaucgccgugaugagaggccagauccugaaccugacccaggcccugaaggacaacaagagcccccugcaccuggugcagaugccccccgugaucguggagaccgccagaagccaccagagaagcagcagcgagagcuacacccagagcuuccagagcagaaagcccuucuucagcuggugguaa

SEQ ID NO: 21500 - RNA, 1446 nt, Artificial Sequence
  PI4K2B__Homo_sapiens__NP_060793
auggaggaccccagcgagcccgacagacuggccagcgccgacggcggcagccccgaggaggaggaggacggcgagagagagccccugcugcccagaaucgccugggcccaccccagaagaggcgcccccggcagcgccgugagacugcuggacgccgccggcgaggagggcgaggccggcgacgaggagcugccccugccccccggcgacgugggcgugagcagaagcagcagcgccgagcuggacagaagcagacccgccgugagcgugaccaucggcaccagcgagaugaacgccuuccuggacgaccccgaguucgccgacaucaugcugagagccgagcaggccaucgaggugggcaucuuccccgagagaaucagccagggcagcagcggcagcuacuucgugaaggaccccaagagaaagaucaucggcguguucaagcccaagagcgaggagcccuacggccagcugaaccccaaguggaccaaguacgugcacaaggugugcugccccugcugcuucggcagaggcugccugauccccaaccagggcuaccugagcgaggccggcgccuaccugguggacaacaagcugcaccugagcaucgugcccaagaccaaggugguguggcuggugagcgagaccuucaacuacaacgccaucgacagagccaagagcagaggcaagaaguacgcccuggagaaggugcccaaggugggcagaaaguuccacagaaucggccugccccccaagaucggcagcuuccagcuguucguggagggcuacaaggaggccgaguacuggcugagaaaguucgaggccgacccccugcccgagaacaucagaaagcaguuccagagccaguucgagagacuggugauccuggacuacaucaucagaaacaccgacagaggcaacgacaacuggcuggugagauacgagaagcagaagugcgagaaggagaucgaccacaaggagagcaaguggaucgacgacgaggaguuccugaucaagaucgccgccaucgacaacggccuggccuuccccuucaagcaccccgacgaguggagagccuaccccuuccacugggccuggcugccccaggccaaggugcccuucagcgaggagaucagaaaccugauccugcccuacaucagcgacaugaacuucgugcaggaccugugcgaggaccuguacgagcuguucaagaccgacaagggcuucgacaaggccaccuucgagagccagaugagcgugaugagaggccagauccugaaccugacccaggcccugagagacggcaagagccccuuccagcuggugcagauccccugcgugaucguggagagaagccagggcggcagccagggcagaaucgugcaccugagcaacagcuucacccagaccgugaacugcagaaagcccuucuucagcagcugguaa

SEQ ID NO: 21501 - RNA, 6309 nt, Artificial Sequence
  PI4KA__Homo_sapiens__NP_477352
auggccgccgcccccgccagaggcggcggcggcggcggcggcggcggcggcggcugcagcggcagcggcagcagcgccagcagaggcuucuacuucaacaccgugcugagccuggccagaagccuggccgugcagagacccgccagccuggagaaggugcagaagcugcugugcaugugccccguggacuuccacggcaucuuccagcuggacgagagaagaagagacgccgugaucgcccugggcaucuuccugaucgagagcgaccugcagcacaaggacugcguggugcccuaccugcugagacugcugaagggccugcccaagguguacuggguggaggagagcaccgccagaaagggcagaggcgcccugcccguggccgagagcuucagcuucugccuggugacccugcugagcgacguggccuacagagaccccagccugagagacgagauccuggaggugcugcugcaggugcugcacgugcugcugggcaugugccaggcccuggagauccaggacaaggaguaccugugcaaguacgccauccccugccugaucggcaucagcagagccuucggcagauacagcaacauggaggagagccugcugagcaagcuguuccccaagauccccccccacagccugagagugcuggaggagcuggagggcgugagaagaagaagcuucaacgacuucagaagcauccugcccagcaaccugcugaccgugugccaggagggcacccugaagagaaagaccagcagcgugagcagcaucagccaggugagccccgagagaggcaugcccccccccagcagccccggcggcagcgccuuccacuacuucgaggccagcugccugcccgacggcaccgcccuggagcccgaguacuacuucagcaccaucagcagcagcuucagcgugagcccccuguucaacggcgugaccuacaaggaguucaacaucccccuggagaugcugagagagcugcugaaccuggugaagaagaucguggaggaggccgugcugaagagccuggacgccaucguggccagcgugauggaggccaaccccagcgccgaccuguacuacaccagcuucagcgacccccuguaccugaccauguucaagaugcugagagacacccuguacuacaugaaggaccugcccaccagcuucgugaaggagauccacgacuucgugcuggagcaguucaacaccagccagggcgagcugcagaagauccugcacgacgccgacagaauccacaacgagcugagcccccugaagcugagaugccaggccaacgccgccugcguggaccugauggugugggccgugaaggacgagcagggcgccgagaaccugugcaucaagcugagcgagaagcugcagagcaagaccagcagcaaggugaucaucgcccaccugccccugcugaucugcugccugcagggccugggcagacugugcgagagauuccccgugguggugcacagcgugacccccagccugagagacuuccuggugauccccagccccgugcuggugaagcuguacaaguaccacagccaguaccacaccguggccggcaacgacaucaagaucagcgugaccaacgagcacagcgagagcacccugaacgugaugagcggcaagaagagccagcccagcauguacgagcagcugagagacaucgccaucgacaacaucugcagaugccugaaggccggccugaccguggaccccgugaucguggaggccuuccuggccagccugagcaacagacuguacaucagccaggagagcgacaaggacgcccaccugauccccgaccacaccaucagagcccugggccacaucgccguggcccugagagacacccccaaggugauggagcccauccugcagauccugcagcagaaguucugccagccccccagcccccuggacgugcugaucaucgaccagcugggcugccuggugaucaccggcaaccaguacaucuaccaggagguguggaaccuguuccagcagaucagcgugaaggccagcagcgugguguacagcgccaccaaggacuacaaggaccacggcuacagacacugcagccuggccgugaucaacgcccuggccaacaucgccgccaacauccaggacgagcaccugguggacgagcugcugaugaaccugcuggagcuguucgugcagcugggccuggagggcaagagagccagcgagagagccagcgagaagggccccgcccugaaggccagcagcagcgccggcaaccugggcgugcugauccccgugaucgccgugcugaccagaagacugccccccaucaaggaggccaagcccagacugcagaagcuguucagagacuucuggcuguacagcgugcugaugggcuucgccguggagggcagcggccuguggcccgaggagugguacgagggcgugugcgagaucgccaccaagagcccccugcugaccuuccccagcaaggagccccugagaagcgugcugcaguacaacagcgccaugaagaacgacaccgugacccccgccgagcugagcgagcugagaagcaccaucaucaaccugcuggaccccccccccgaggugagcgcccugaucaacaagcuggacuucgccaugagcaccuaccugcugagcguguacagacuggaguacaugagagugcugagaagcaccgaccccgacagauuccaggugauguucugcuacuucgaggacaaggccauccagaaggacaagagcggcaugaugcagugcgugaucgccguggccgacaagguguucgacgccuuccugaacaugauggccgacaaggccaagaccaaggagaacgaggaggagcuggagagacacgcccaguuccugcuggugaacuucaaccacauccacaagagaaucagaagaguggccgacaaguaccugagcggccugguggacaaguucccccaccugcuguggagcggcaccgugcugaagaccaugcuggacauccugcagacccugagccugagccugagcgccgacauccacaaggaccagcccuacuacgacauccccgacgcccccuacagaaucaccgugcccgacaccuacgaggccagagagagcaucgugaaggacuucgccgccagaugcggcaugauccugcaggaggccaugaagugggcccccaccgugaccaagagccaccugcaggaguaccugaacaagcaccagaacugggugagcggccugagccagcacaccggccuggccauggccaccgagagcauccugcacuucgccggcuacaacaagcagaacaccacccugggcgccacccagcugagcgagagacccgccugcgugaagaaggacuacagcaacuucauggccagccugaaccugagaaacagauacgccggcgagguguacggcaugaucagauucagcggcaccaccggccagaugagcgaccugaacaagaugauggugcaggaccugcacagcgcccuggacagaagccacccccagcacuacacccaggccauguucaagcugaccgccaugcugaucagcagcaaggacugcgacccccagcugcugcaccaccugugcuggggcccccugagaauguucaacgagcacggcauggagaccgcccuggccugcugggaguggcugcuggccggcaaggacggcguggaggugcccuucaugagagagauggccggcgccuggcacaugaccguggagcagaaguucggccuguucagcgccgagaucaaggaggccgacccccuggccgccagcgaggccagccagcccaagcccugcccccccgaggugaccccccacuacaucuggaucgacuuccuggugcagagauucgagaucgccaaguacugcagcagcgaccagguggagaucuucagcagccugcugcagagaagcaugagccugaacaucggcggcgccaagggcagcaugaacagacacguggccgccaucggccccagauucaagcugcugacccugggccugagccugcugcacgccgacguggugcccaacgccaccaucagaaacgugcugagagagaagaucuacagcaccgccuucgacuacuucagcugcccccccaaguuccccacccagggcgagaagagacugagagaggacaucagcaucaugaucaaguucuggaccgccauguucagcgacaagaaguaccugaccgccagccagcuggugccccccgacaaccaggacaccagaagcaaccuggacaucaccgugggcagcagacagcaggccacccagggcuggaucaacaccuacccccugagcagcggcaugagcaccaucagcaagaagagcggcaugagcaagaagaccaacagaggcagccagcugcacaaguacuacaugaagagaagaacccugcugcugagccugcuggccaccgagaucgagagacugaucaccugguacaacccccugagcgcccccgagcuggagcuggaccaggccggcgagaacagcguggccaacuggagaagcaaguacaucagccugagcgagaagcaguggaaggacaacgugaaccuggccuggagcaucagccccuaccuggccgugcagcugcccgccagauucaagaacaccgaggccaucggcaacgaggugaccagacuggugagacuggaccccggcgccgugagcgacgugcccgaggccaucaaguuccuggugaccuggcacaccaucgacgccgacgcccccgagcugagccacgugcugugcugggcccccaccgacccccccaccggccugagcuacuucagcagcauguaccccccccacccccugaccgcccaguacggcgugaaggugcugagaagcuucccccccgacgccauccuguucuacaucccccagaucgugcaggcccugagauacgacaagaugggcuacgugagagaguacauccugugggccgccagcaagagccagcugcuggcccaccaguucaucuggaacaugaagaccaacaucuaccuggacgaggagggccaccagaaggaccccgacaucggcgaccugcuggaccagcugguggaggagaucaccggcagccugagcggccccgccaaggacuucuaccagagagaguucgacuucuucaacaagaucaccaacgugagcgccaucaucaagcccuaccccaagggcgacgagagaaagaaggccugccugagcgcccugagcgaggugaaggugcagcccggcugcuaccugcccagcaaccccgaggccaucgugcuggacaucgacuacaagagcggcacccccaugcagagcgccgccaaggcccccuaccuggccaaguucaaggugaagagaugcggcgugagcgagcuggagaaggagggccugagaugcagaagcgacagcgaggacgagugcagcacccaggaggccgacggccagaagaucagcuggcaggccgccaucuucaaggugggcgacgacugcagacaggacaugcuggcccugcagaucaucgaccuguucaagaacaucuuccagcuggugggccuggaccuguucguguuccccuacagagugguggccaccgcccccggcugcggcgugaucgagugcauccccgacugcaccagcagagaccagcugggcagacagaccgacuucggcauguacgacuacuucaccagacaguacggcgacgagagcacccuggccuuccagcaggccagauacaacuucaucagaagcauggccgccuacagccugcugcuguuccugcugcagaucaaggacagacacaacggcaacaucaugcuggacaagaagggccacaucauccacaucgacuucggcuucauguucgagagcagccccggcggcaaccugggcugggagcccgacaucaagcugaccgacgagauggugaugaucaugggcggcaagauggaggccacccccuucaagugguucauggagaugugcgugagaggcuaccuggccgugagacccuacauggacgccguggugagccuggugacccugaugcuggacaccggccugcccugcuucagaggccagaccaucaagcugcugaagcacagauucagccccaacaugaccgagagagaggccgccaacuucaucaugaaggugauccagagcugcuuccugagcaacagaagcagaaccuacgacaugauccaguacuaccagaacgacauccccuacuaa

SEQ ID NO: 21502 - RNA, 2406 nt, Artificial Sequence
  PI4KB__Homo_sapiens__NP_001185703
augggcgacaccgugguggagcccgccccccugaagcccaccagcgagcccaccagcggcccccccggcaacaacggcggcagccugcugagcgugaucaccgagggcgugggcgagcugagcgugaucgaccccgagguggcccagaaggccugccaggaggugcuggagaaggugaagcugcugcacggcggcguggccgugagcagcagaggcaccccccuggagcuggugaacggcgacggcguggacagcgagaucagaugccuggacgacccccccgcccagaucagagaggaggaggacgagaugggcgccgccguggccagcggcaccgccaagggcgccagaagaagaagacagaacaacagcgccaagcagagcuggcugcugagacuguucgagagcaagcuguucgacaucagcauggccaucagcuaccuguacaacagcaaggagcccggcgugcaggccuacaucggcaacagacuguucugcuucagaaacgaggacguggacuucuaccugccccagcugcugaacauguacauccacauggacgaggacgugggcgacgccaucaagcccuacaucgugcacagaugcagacagagcaucaacuucagccugcagugcgcccugcugcugggcgccuacagcagcgacaugcacaucagcacccagagacacagcagaggcaccaagcugagaaagcugauccugagcgacgagcugaagcccgcccacagaaagagagagcugcccagccugagccccgcccccgacaccggccugagccccagcaagagaacccaccagagaagcaagagcgacgccaccgccagcaucagccugagcagcaaccugaagagaaccgccagcaaccccaagguggagaacgaggacgagcccgugagacuggcccccgagagagaguucaucaagagccugauggccaucggcaagagacuggccacccugcccaccaaggagcagaagacccagagacugaucagcgagcugagccugcugaaccacaagcugcccgccagaguguggcugcccaccgccggcuucgaccaccacguggugagagugccccacacccaggccguggugcugaacagcaaggacaaggcccccuaccugaucuacguggaggugcuggagugcgagaacuucgacaccaccagcgugcccgccagaauccccgagaacagaaucagaagcaccagaagcguggagaaccugcccgagugcggcaucacccacgagcagagagccggcagcuucagcaccgugcccaacuacgacaacgacgacgaggccuggagcguggacgacaucggcgagcugcagguggagcugcccgaggugcacaccaacagcugcgacaacaucagccaguucagcguggacagcaucaccagccaggagagcaaggagcccguguucaucgccgccggcgacaucagaagaagacugagcgagcagcuggcccacacccccaccgccuucaagagagaccccgaggaccccagcgccguggcccugaaggagcccuggcaggagaaggugagaagaaucagagagggcagccccuacggccaccugcccaacuggagacugcugagcgugaucgugaagugcggcgacgaccugagacaggagcugcuggccuuccaggugcugaagcagcugcagagcaucugggagcaggagagagugccccuguggaucaagcccuacaagauccuggugaucagcgccgacagcggcaugaucgagcccguggugaacgccgugagcauccaccaggugaagaagcagagccagcugagccugcuggacuacuuccugcaggagcacggcagcuacaccaccgaggccuuccugagcgcccagagaaacuucgugcagagcugcgccggcuacugccuggugugcuaccugcugcaggugaaggacagacacaacggcaacauccugcuggacgccgagggccacaucauccacaucgacuucggcuucauccugagcagcagccccagaaaccugggcuucgagaccagcgccuucaagcugaccaccgaguucguggacgugaugggcggccuggacggcgacauguucaacuacuacaagaugcugaugcugcagggccugaucgccgccagaaagcacauggacaagguggugcagaucguggagaucaugcagcagggcagccagcugcccugcuuccacggcagcagcaccaucagaaaccugaaggagagauuccacaugagcaugaccgaggagcagcugcagcugcugguggagcagaugguggacggcagcaugagaagcaucaccaccaagcuguacgacggcuuccaguaccugaccaacggcaucauguaa

SEQ ID NO: 21503 - RNA, 1956 nt, Artificial Sequence
  PIAS1__Homo_sapiens__NP_057250
auggccgacagcgccgagcugaagcagauggugaugagccugagagugagcgagcugcaggugcugcugggcuacgccggcagaaacaagcacggcagaaagcacgagcugcugaccaaggcccugcaccugcugaaggccggcugcagccccgccgugcagaugaagaucaaggagcuguacagaagaagauucccccagaagaucaugacccccgccgaccugagcauccccaacgugcacagcagccccaugcccgccacccugagccccagcaccaucccccagcugaccuacgacggccaccccgccagcagcccccugcugcccgugagccugcugggccccaagcacgagcuggagcugccccaccugaccagcgcccugcaccccgugcaccccgacaucaagcugcagaagcugcccuucuacgaccugcuggacgagcugaucaagcccaccagccuggccagcgacaacagccagagauucagagagaccugcuucgccuucgcccugaccccccagcaggugcagcagaucagcagcagcauggacaucagcggcaccaagugcgacuucaccgugcaggugcagcugagauucugccugagcgagaccagcugcccccaggaggaccacuucccccccaaccugugcgugaaggugaacaccaagcccugcagccugcccggcuaccugccccccaccaagaacggcguggagcccaagagacccagcagacccaucaacaucaccagccuggugagacugagcaccaccgugcccaacaccaucguggugagcuggaccgccgagaucggcagaaacuacagcauggccguguaccuggugaagcagcugagcagcaccgugcugcugcagagacugagagccaagggcaucagaaaccccgaccacagcagagcccugaucaaggagaagcugaccgccgaccccgacagcgagaucgccaccaccagccugagagugagccugcugugcccccugggcaagaugagacugaccauccccugcagagcccugaccugcagccaccugcagugcuucgacgccacccuguacauccagaugaacgagaagaagcccaccugggugugccccgugugcgacaagaaggcccccuacgagcaccugaucaucgacggccuguucauggagauccugaaguacugcaccgacugcgacgagauccaguucaaggaggacggcaccugggcccccaugagaagcaagaaggaggugcaggaggugagcgccagcuacaacggcguggacggcugccugagcagcacccuggagcaccagguggccagccaccaccagagcagcaacaagaacaagaagguggaggugaucgaccugaccaucgacagcagcagcgacgaggaggaggaggagcccagcgccaagagaaccugccccagccugagccccaccagcccccugaacaacaagggcauccugagccugccccaccaggccagccccgugagcagaacccccagccugcccgccguggacaccagcuacaucaacaccagccugauccaggacuacagacaccccuuccacaugacccccaugcccuacgaccugcagggccuggacuucuuccccuuccugagcggcgacaaccagcacuacaacaccagccugcuggccgccgccgccgccgccgugagcgacgaccaggaccugcugcacagcagcagauucuuccccuacaccagcagccagauguuccuggaccagcugagcgccggcggcagcaccagccugcccaccaccaacggcagcagcagcggcagcaacagcagccuggugagcagcaacagccugagagagagccacagccacaccgugaccaacagaagcagcaccgacaccgccagcaucuucggcaucauccccgacaucaucagccuggacuaa

SEQ ID NO: 21504 - RNA, 1866 nt, Artificial Sequence
  PIAS2__Homo_sapiens__NP_004662
auggccgacuucgaggagcugagaaacauggugagcagcuucagagugagcgagcugcaggugcugcugggcuucgccggcagaaacaagagcggcagaaagcacgaccugcugaugagagcccugcaccugcugaagagcggcugcagccccgccgugcagaucaagaucagagagcuguacagaagaagauaccccagaacccuggagggccugagcgaccugagcaccaucaagagcagcguguucagccuggacggcggcagcagccccguggagcccgaccuggccguggccggcauccacagccugcccagcaccagcgugaccccccacagccccagcagccccgugggcagcgugcugcugcaggacaccaagcccaccuucgagaugcagcagcccagcccccccaucccccccgugcaccccgacgugcagcugaagaaccugcccuucuacgacgugcuggacgugcugaucaagcccaccagccuggugcagagcagcauccagagauuccaggagaaguucuucaucuucgcccugaccccccagcaggugagagagaucugcaucagcagagacuuccugcccggcggcagaagagacuacaccgugcaggugcagcugagacugugccuggccgagaccagcugcccccaggaggacaacuaccccaacagccugugcaucaaggugaacggcaagcuguucccccugcccggcuacgcccccccccccaagaacggcaucgagcagaagagacccggcagaccccugaacaucaccagccuggugagacugagcagcgccgugcccaaccagaucagcaucagcugggccagcgagaucggcaagaacuacagcaugagcguguaccuggugagacagcugaccagcgccaugcugcugcagagacugaagaugaagggcaucagaaaccccgaccacagcagagcccugaucaaggagaagcugaccgccgaccccgacagcgagaucgccaccaccagccugagagugagccugaugugcccccugggcaagaugagacugaccauccccugcagagccgugaccugcacccaccugcagugcuucgacgccgcccuguaccugcagaugaacgagaagaagcccaccuggaucugccccgugugcgacaagaaggccgccuacgagagccugauccuggacggccuguucauggagauccugaacgacugcagcgacguggacgagaucaaguuccaggaggacggcagcuggugccccaugagacccaagaaggaggccaugaaggugagcagccagcccugcaccaagaucgagagcagcagcgugcugagcaagcccugcagcgugaccguggccagcgaggccagcaagaagaagguggacgugaucgaccugaccaucgagagcagcagcgacgaggaggaggacccccccgccaagagaaagugcaucuucaugagcgagacccagagcagccccaccaagggcgugcugauguaccagcccagcagcgugagagugcccagcgugaccagcguggaccccgccgccaucccccccagccugaccgacuacagcgugcccuuccaccacacccccaucagcagcaugagcagcgaccugcccggccuggacuuccugagccugauccccguggacccccaguacugcccccccauguuccuggacagccugaccagcccccugaccgccagcagcaccagcgugaccaccaccagcagccacgagagcagcacccacgugagcagcagcagcagcagaagcgagaccggcgugaucaccagcagcggcagcaacauccccgacaucaucagccuggacuaa

SEQ ID NO: 21505 - RNA, 1533 nt, Artificial Sequence
  PIAS4__Homo_sapiens__NP_056981
auggccgccgagcugguggaggccaagaacauggugaugagcuucagagugagcgaccugcagaugcugcugggcuucgugggcagaagcaagagcggccugaagcacgagcuggugaccagagcccugcagcuggugcaguucgacugcagccccgagcuguucaagaagaucaaggagcuguacgagaccagauacgccaagaagaacagcgagcccgccccccagccccacagaccccuggacccccugaccaugcacagcaccuacgacagagccggcgccgugcccagaaccccccuggccggccccaacaucgacuaccccgugcuguacggcaaguaccugaacggccugggcagacugcccgccaagacccugaagcccgaggugagacuggugaagcugcccuucuucaacaugcuggacgagcugcugaagcccaccgagcuggugccccagaacaacgagaagcugcaggagagccccugcaucuucgcccugacccccagacagguggagcugaucagaaacagcagagagcugcagcccggcgugaaggccgugcagguggugcugagaaucugcuacagcgacaccagcugcccccaggaggaccaguacccccccaacaucgccgugaaggugaaccacagcuacugcagcgugcccggcuacuaccccagcaacaagcccggcguggagcccaagagacccugcagacccaucaaccugacccaccugauguaccugagcagcgccaccaacagaaucaccgugaccuggggcaacuacggcaagagcuacagcguggcccuguaccuggugagacagcugaccagcagcgagcugcugcagagacugaagaccaucggcgugaagcaccccgagcugugcaaggcccuggugaaggagaagcugagacuggaccccgacagcgagaucgccaccaccggcgugagagugagccugaucugcccccuggugaagaugagacugagcgugcccugcagagccgagaccugcgcccaccugcagugcuucgacgccguguucuaccugcagaugaacgagaagaagcccaccuggaugugccccgugugcgacaagcccgcccccuacgaccagcugaucaucgacggccugcugagcaagauccugagcgagugcgaggacgccgacgagaucgaguaccugguggacggcagcuggugccccaucagagccgagaaggagagaagcugcagcccccagggcgccauccuggugcugggccccagcgacgccaacggccugcugcccgcccccagcgugaacggcagcggcgcccugggcagcaccggcggcggcggccccgugggcagcauggagaacggcaagcccggcgccgacgugguggaccugacccuggacagcagcagcagcagcgaggacgaggaggaggaggaggaggaggaggaggacgaggacgaggagggccccagacccaagagaagaugccccuuccagaagggccuggugcccgccugcuaa

SEQ ID NO: 21506 - RNA, 2274 nt, Artificial Sequence
  PIBF1__Homo_sapiens__NP_006337
augagcagaaagaucagcaaggagagcaagaaggugaacaucagcagcagccuggagagcgaggacaucagccuggagaccaccgugcccaccgacgacaucagcagcagcgaggagagagagggcaaggugagaaucaccagacagcugaucgagagaaaggagcugcugcacaacauccagcugcugaagaucgagcugagccagaagaccaugaugaucgacaaccugaagguggacuaccugaccaagaucgaggagcuggaggagaagcugaacgacgcccugcaccagaagcagcugcugacccugagacuggacaaccagcuggccuuccagcagaaggacgccagcaaguaccaggagcugaugaagcaggagauggagaccauccugcugagacagaagcagcuggaggagaccaaccugcagcugagagagaaggccggcgacgugagaagaaaccugagagacuucgagcugaccgaggagcaguacaucaagcugaaggccuuccccgaggaccagcugagcauccccgaguacgugagcgugagauucuacgagcuggugaacccccugagaaaggagaucugcgagcugcaggugaagaagaacauccuggccgaggagcugagcaccaacaagaaccagcugaagcagcugaccgagaccuacgaggaggacagaaagaacuacagcgaggugcagaucagaugccagagacuggcccuggagcuggccgacaccaagcagcugauccagcagggcgacuacagacaggagaacuacgacaaggugaagagcgagagagacgcccuggagcaggaggugaucgagcugagaagaaagcacgagauccuggaggccagccacaugauccagaccaaggagagaagcgagcugagcaaggagguggugacccuggagcagaccgugacccugcugcagaaggacaaggaguaccugaacagacagaacauggagcugagcgugagaugcgcccacgaggaggacagacuggagagacugcaggcccagcuggaggagagcaagaaggccagagaggagauguacgagaaguacguggccagcagagaccacuacaagaccgaguacgagaacaagcugcacgacgagcuggagcagaucagacugaagaccaaccaggagaucgaccagcugagaaacgccagcagagagauguacgagagagagaacagaaaccugagagaggccagagacaacgccguggccgagaaggagagagccgugauggccgagaaggacgcccuggagaagcacgaccagcugcuggacagauacagagagcugcagcugagcaccgagagcaaggugaccgaguuccugcaccagagcaagcugaagagcuucgagagcgagagagugcagcugcugcaggaggagaccgccagaaaccugacccagugccagcuggagugcgagaaguaccagaagaagcuggaggugcugaccaaggaguucuacagccugcaggccagcagcgagaagagaaucaccgagcugcaggcccagaacagcgagcaccaggccagacuggacaucuacgagaagcuggagaaggagcuggacgagaucaucaugcagaccgccgagaucgagaacgaggacgaggccgagagagugcuguucagcuacggcuacggcgccaacgugcccaccaccgccaagagaagacugaagcagagcgugcaccuggccagaagagugcugcagcuggagaagcagaacagccugauccugaaggaccuggagcacagaaaggaccaggugacccagcugagccaggagcuggacagagccaacagccugcugaaccagacccagcagcccuacagauaccugaucgagagcgugagacagagagacagcaagaucgacagccugaccgagagcaucgcccagcuggagaaggacgugagcaaccugaacaaggagaagagcgcccugcugcagaccaagaaccagauggcccuggaccuggagcagcugcugaaccacagagaggagcuggccgccaugaagcagauccuggugaagaugcacagcaagcacagcgagaacagccugcugcugaccaagaccgagcccaagcacgugaccgagaaccagaagagcaagacccugaacgugcccaaggagcacgaggacaacaucuucacccccaagcccacccuguucaccaagaaggaggcccccgaguggagcaagaagcagaagaugaagaccuaa

SEQ ID NO: 21507 - RNA, 1833 nt, Artificial Sequence
  PICALM__Homo_sapiens__NP_001008660
augagcggccagagccugaccgacagaaucaccgccgcccagcacagcgugaccggcagcgccgugagcaagaccgugugcaaggccaccacccacgagaucaugggccccaagaagaagcaccuggacuaccugauccagugcaccaacgagaugaacgugaacaucccccagcuggccgacagccuguucgagagaaccaccaacagcagcuggguggugguguucaagagccugaucaccacccaccaccugaugguguacggcaacgagagauucauccaguaccuggccagcagaaacacccuguucaaccugagcaacuuccuggacaagagcggccugcagggcuacgacaugagcaccuucaucagaagauacagcagauaccugaacgagaaggccgugagcuacagacagguggccuucgacuucaccaaggugaagagaggcgccgacggcgugaugagaaccaugaacaccgagaagcugcugaagaccgugcccaucauccagaaccagauggacgcccugcuggacuucaacgugaacagcaacgagcugaccaacggcgugaucaacgccgccuucaugcugcuguucaaggacgccaucagacuguucgccgccuacaacgagggcaucaucaaccugcuggagaaguacuucgacaugaagaagaaccagugcaaggagggccuggacaucuacaagaaguuccugaccagaaugaccagaaucagcgaguuccugaagguggccgagcaggugggcaucgacagaggcgacauccccgaccugagccaggcccccagcagccugcuggacgcccuggagcagcaccuggccagccuggagggcaagaagaucaaggacagcaccgccgccagcagagccaccacccugagcaacgccgugagcagccuggccagcaccggccugagccugaccaagguggacgagagagagaagcaggccgcccuggaggaggagcaggccagacugaaggcccugaaggagcagagacugaaggagcuggccaagaagccccacaccagccugaccaccgccgccagccccgugagcaccagcgccggcggcaucaugaccgcccccgccaucgacaucuucagcacccccagcagcagcaacagcaccagcaagcugcccaacgaccugcuggaccugcagcagcccaccuuccaccccagcgugcaccccaugagcaccgccagccagguggccagcaccuggggcggcuucacccccagccccguggcccagccccaccccagcgccggccugaacguggacuucgagagcguguucggcaacaagagcaccaacgugaucguggacagcggcggcuucgacgagcugggcggccugcugaagcccaccguggccagccagaaccagaaccugcccguggccaagcugccccccagcaagcuggugagcgacgaccuggacagcagccuggccaaccuggugggcaaccugggcaucggcaacggcaccaccaagaacgacgugaacuggagccagcccggcgagaagaagcugaccggcggcagcaacuggcagcccaagguggcccccaccaccgccuggaacgccgccaccaugaacggcaugcacuucccccaguacgccccccccgugauggccuaccccgccaccacccccaccggcaugaucggcuacggcauccccccccagaugggcagcgugcccgugaugacccagcccacccugaucuacagccagcccgugaugagaccccccaaccccuucggccccgugagcggcgcccagauccaguucauguaa

SEQ ID NO: 21508 - RNA, 1248 nt, Artificial Sequence
  PICK1__Homo_sapiens__NP_001034673
auguucgccgaccuggacuacgacaucgaggaggacaagcugggcauccccaccgugcccggcaaggugacccugcagaaggacgcccagaaccugaucggcaucagcaucggcggcggcgcccaguacugccccugccuguacaucgugcagguguucgacaacacccccgccgcccuggacggcaccguggccgccggcgacgagaucaccggcgugaacggcagaagcaucaagggcaagaccaagguggagguggccaagaugauccaggaggugaagggcgaggugaccauccacuacaacaagcugcaggccgaccccaagcagggcaugagccuggacaucgugcugaagaaggugaagcacagacugguggagaacaugagcagcggcaccgccgacgcccugggccugagcagagccauccugugcaacgacggccuggugaagagacuggaggagcuggagagaaccgccgagcuguacaagggcaugaccgagcacaccaagaaccugcugagagccuucuacgagcugagccagacccacagagccuucggcgacguguucagcgugaucggcgugagagagccccagcccgccgccagcgaggccuucgugaaguucgccgacgcccacagaagcaucgagaaguucggcaucagacugcugaagaccaucaagcccaugcugaccgaccugaacaccuaccugaacaaggccauccccgacaccagacugaccaucaagaaguaccuggacgugaaguucgaguaccugagcuacugccugaaggugaaggagauggacgacgaggaguacagcugcaucgcccugggcgagccccuguacagagugagcaccggcaacuacgaguacagacugauccugagaugcagacaggaggccagagccagauucagccagaugagaaaggacgugcuggagaagauggagcugcuggaccagaagcacgugcaggacaucguguuccagcugcagagacuggugagcaccaugagcaaguacuacaacgacugcuacgccgugcugagagacgccgacguguuccccaucgagguggaccuggcccacaccacccuggccuacggccugaaccaggaggaguucaccgacggcgaggaggaggaggaggaggaggacaccgccgccggcgagcccagcagagacaccagaggcgccgccggcccccuggacaagggcggcagcuggugcgacagcuaa

SEQ ID NO: 21509 - RNA, 654 nt, Artificial Sequence
  PID1__Homo_sapiens__NP_001094288
auguggcagcccgccaccgagagacugcagcacuuccagaccaugcugaagagcaagcugaacgugcugacccugaagaaggagccccugcccgccgugaucuuccacgagcccgaggccaucgagcugugcaccaccaccccccugaugaagaccagaacccacagcggcugcaaggugaccuaccugggcaaggugagcaccaccggcaugcaguuccugagcggcugcaccgagaagcccgugaucgagcuguggaagaagcacacccuggccagagaggacguguuccccgccaacgcccugcuggagaucagacccuuccagguguggcugcaccaccuggaccacaagggcgaggccaccgugcacauggacaccuuccagguggccagaaucgccuacugcaccgccgaccacaacgugagccccaacaucuucgccuggguguacagagagaucaacgacgaccugagcuaccagauggacugccacgccguggagugcgagagcaagcuggaggccaagaagcuggcccacgccaugauggaggccuucagaaagaccuuccacagcaugaagagcgacggcagaauccacagcaacagcagcagcgaggaggugagccaggagcuggagagcgacgacggcuaa

SEQ ID NO: 21510 - RNA, 2763 nt, Artificial Sequence
  PIDD1__Homo_sapiens__XP_011518511
augcagcugcccagagcccugcccggccaggccugccugagagccggcaccugccuggccagcaaggacagaagaugggccauggccgccaccguggagggccccgagcuggaggccgccgccgccgccggcgacgccagcgaggacagcgacgccggcagcagagcccugcccuuccugggcggcaacagacugagccuggaccuguaccccggcggcugccagcagcugcugcaccugugcgugcagcagccccugcagcugcugcagguggaguuccugagacugagcacccacgaggacccccagcugcuggaggccacccuggcccagcugccccagagccugagcugccugagaagccuggugcugaagggcggccagagaagagacacccugggcgccugccugagaggcgcccugaccaaccugcccgccggccugagcggccuggcccaccuggcccaccuggaccugagcuucaacagccuggagacccugcccgccugcgugcugcagaugagaggccugggcgcccugcugcugagccacaacugccugagcgagcugcccgaggcccugggcgcccugcccgcccugaccuuccugaccgugacccacaacagacugcagacccugccccccgcccugggcgcccugagcacccugcagagacuggaccugagccagaaccugcuggacacccugccccccgagaucggcggccugggcagccugcuggagcugaaccuggccagcaacagacugcagagccugcccgccagccuggccggccugagaagccugagacugcuggugcugcacagcaaccugcuggccagcgugcccgccgaccuggccagacugccccugcugaccagacuggaccugagagacaaccagcugagagaccugccccccgagcugcuggacgcccccuucgugagacugcagggcaacccccugggcgaggccagccccgacgcccccagcagccccguggccgcccugauccccgagaugcccagacuguuccugaccagcgaccuggacagcuuccccgugaccccccagggcugcagcgugacccuggccugcggcgugagacugcaguuccccgccggcgccaccgccacccccaucaccaucagauacagacugcugcugcccgagcccggccuggugccccugggcccccacgacgcccugcugagccacgugcuggagcugcagccccacggcguggccuuccagcaggacgugggccuguggcugcuguucacccccccccaggccagaagaugcagagaggugguggugagaaccagaaacgacaacagcuggggcgaccuggagaccuaccuggaggaggaggccccccagagacugugggcccacugccaggugccccacuucagcugguuccugguggugagcagacccgugagcaacgccugccuggugccccccgagggcacccugcugugcagcagcggccaccccggcgugaaggugaucuucccccccggcgccaccgaggagcccagaagagugagcaugcagguggugagaauggccggcagagagcugcaggcccugcugggcgagcccgaggccgccgugagcccccugcugugccugagccagagcggcccccccagcuuccugcagcccgugaccgugcagcugccccugcccagcggcaucaccggccugagccuggacagaagcagacugcaccugcuguacugggccccccccgccgccaccugggacgacaucaccgcccagguggugcuggagcugacccaccuguacgccagauuccaggugacccacuucagcugguacuggcugugguacaccaccaagaacugcgugggcggccuggccagaaaggccugggagagacugagacugcacagagugaaccugaucgcccugcagagaagaagagaccccgagcaggugcugcugcagugccugcccagaaacaagguggacgccacccugagaagacugcuggagagauacagaggccccgagcccagcgacaccguggagauguucgagggcgaggaguucuucgccgccuucgagagaggcaucgacguggacgccgacagacccgacugcguggagggcagaaucugcuucguguucuacagccaccugaagaacgugaaggaggugagcuucuacagaggcgccgugcccgugagagugcccgaggaggccgaggccgccagacagagaaagggcgccgacgcccuguggauggccacccugcccaucaagcugcccagacugagaggcagcgagggccccagaagaggcgccggccugagccuggccccccugaaccugggcgacgccgagaccggcuuccugacccagagcaaccugcugagcguggccggcagacugggccuggacuggcccgccguggcccugcaccugggcgugagcuacagagaggugcagagaaucagacacgaguucagagacgaccuggacgagcagaucagacacaugcuguucagcugggccgagagacaggccggccagcccggcgccgugggccugcuggugcaggcccuggagcagagcgacagacaggacguggccgaggaggugagagccgugcuggagcugggcagaagaaaguaccaggacagcaucagaagaaugggccuggcccccaaggaccccgcccugcccggcagcagcgccccccagccccccgagcccgcccaggccuaa

SEQ ID NO: 21511 - RNA, 7566 nt, Artificial Sequence
  PIEZO1__Homo_sapiens__NP_001136336
auggagccccacgugcugggcgccgugcuguacuggcugcugcugcccugcgcccugcuggccgccugccugcugagauucagcggccugagccugguguaccugcuguuccugcugcugcugcccugguuccccggccccaccagaugcggccugcagggccacaccggcagacugcugagagcccugcugggccugagccugcuguuccugguggcccaccuggcccugcagaucugccugcacaucgugcccagacuggaccagcugcugggccccagcugcagcagaugggagacccugagcagacacaucggcgugaccagacuggaccugaaggacauccccaacgccaucagacugguggcccccgaccugggcauccugguggugagcagcgugugccugggcaucugcggcagacuggccagaaacaccagacagagcccccaccccagagagcuggacgacgacgagagagacguggacgccagccccaccgccggccugcaggaggccgccacccuggcccccaccagaagaagcagacuggccgccagauucagagugaccgcccacuggcugcugguggccgccggcagagugcuggccgugacccugcuggcccuggccggcaucgcccaccccagcgcccugagcagcguguaccugcugcuguuccuggcccugugcaccuggugggccugccacuuccccaucagcaccagaggcuucagcagacugugcguggccgugggcugcuucggcgccggccaccugaucugccuguacugcuaccagaugccccuggcccaggcccugcugccccccgccggcaucugggccagagugcugggccugaaggacuucgugggccccaccaacugcagcagcccccacgcccuggugcugaacaccggccuggacuggcccguguacgccagccccggcgugcugcugcugcugugcuacgccaccgccagccugagaaagcugagagccuacagacccagcggccagagaaaggaggccgccaagggcuacgaggccagagagcuggagcuggccgagcuggaccaguggccccaggagagagagagcgaccagcacguggugcccaccgcccccgacaccgaggccgacaacugcaucgugcacgagcugaccggccagagcagcgugcugagaagacccgugagacccaagagagccgagcccagagaggccagcccccugcacagccugggccaccugaucauggaccagagcuacgugugcgcccugaucgccaugaugguguggagcaucaccuaccacagcuggcugaccuucgugcugcugcugugggccugccugaucuggaccgugagaagcagacaccagcuggccaugcugugcagccccugcauccugcuguacggcaugacccugugcugccugagauacgugugggccauggaccugagacccgagcugcccaccacccugggccccgugagccugagacagcugggccuggagcacaccagauaccccugccuggaccugggcgccaugcugcuguacacccugaccuucuggcugcugcugagacaguucgugaaggagaagcugcugaagugggccgagagccccgccgcccugaccgaggugaccguggccgacaccgagcccaccagaacccagacccugcugcagagccugggcgagcuggugaagggcguguacgccaaguacuggaucuacgugugcgccggcauguucaucguggugagcuucgccggcagacuggugguguacaagaucguguacauguuccuguuccugcugugccugacccuguuccagguguacuacagccuguggagaaagcugcugaaggccuucugguggcuggugguggccuacaccaugcuggugcugaucgccguguacaccuuccaguuccaggacuuccccgccuacuggagaaaccugaccggcuucaccgacgagcagcugggcgaccugggccuggagcaguucagcgugagcgagcuguucagcagcauccuggugcccggcuucuuccugcuggccugcauccugcagcugcacuacuuccacagacccuucaugcagcugaccgacauggagcacgugagccugcccggcaccagacugcccagaugggcccacagacaggacgccgugagcggcaccccccugcugagagaggagcagcaggagcaccagcagcagcagcaggaggaggaggaggaggaggaggacagcagagacgagggccugggcguggccaccccccaccaggccacccaggugcccgagggcgccgccaaguggggccugguggccgagagacugcuggagcuggccgccggcuucagcgacgugcugagcagagugcagguguuccugagaagacugcuggagcugcacguguucaagcugguggcccuguacaccguguggguggcccugaaggaggugagcgugaugaaccugcugcugguggugcugugggccuucgcccugcccuaccccagauucagacccauggccagcugccugagcaccguguggaccugcgugaucaucgugugcaagaugcuguaccagcugaagguggugaacccccaggaguacagcagcaacugcaccgagcccuuccccaacagcaccaaccugcugcccaccgagaucagccagagccugcuguacagaggccccguggaccccgccaacugguucggcgugagaaagggcuuccccaaccugggcuacauccagaaccaccugcaggugcugcugcugcugguguucgaggccaucguguacagaagacaggagcacuacagaagacagcaccagcuggccccccugcccgcccaggccguguucgccagcggcaccagacagcagcuggaccaggaccugcugggcugccugaaguacuucaucaacuucuucuucuacaaguucggccuggagaucugcuuccugauggccgugaacgugaucggccagagaaugaacuuccuggugacccugcacggcugcuggcugguggccauccugaccagaagacacagacaggccaucgccagacuguggcccaacuacugccuguuccuggcccuguuccugcuguaccaguaccugcugugccugggcaugccccccgcccugugcaucgacuaccccuggagauggagcagagccgugcccaugaacagcgcccugaucaaguggcuguaccugcccgacuucuucagagcccccaacagcaccaaccugaucagcgacuuccugcugcugcugugcgccagccagcaguggcagguguucagcgccgagagaaccgaggaguggcagagaauggccggcgugaacaccgacagacuggagccccugagaggcgagcccaaccccgugcccaacuucauccacugcagaagcuaccuggacaugcugaagguggccguguucagauaccuguucuggcuggugcugguggugguguucgugaccggcgccaccagaaucagcaucuucggccugggcuaccugcuggccugcuucuaccugcugcuguucggcaccgcccugcugcagagagacaccagagccagacuggugcugugggacugccugauccuguacaacgugaccgugaucaucagcaagaacaugcugagccugcuggccugcguguucguggagcagaugcagaccggcuucugcugggugauccagcuguucagccuggugugcaccgugaagggcuacuacgaccccaaggagaugauggacagagaccaggacugccugcugcccguggaggaggccggcaucaucugggacagcgugugcuucuucuuccugcugcugcagagaagaguguuccugagccacuacuaccugcacgugagagccgaccugcaggccaccgcccugcuggccagcagaggcuucgcccuguacaacgccgccaaccugaagagcaucgacuuccacagaagaaucgaggagaagagccuggcccagcugaagagacagauggagagaaucagagccaagcaggagaagcacagacagggcagaguggacagaagcagaccccaggacacccugggccccaaggaccccggccuggagcccggccccgacagccccggcggcagcagcccccccagaagacagugguggagacccuggcuggaccacgccaccgugauccacagcggcgacuacuuccuguucgagagcgacagcgaggaggaggaggaggccgugcccgaggaccccagacccagcgcccagagcgccuuccagcuggccuaccaggccugggugaccaacgcccaggccgugcugagaagaagacagcaggagcaggagcaggccagacaggagcaggccggccagcugcccaccggcggcggccccagccaggagguggagcccgccgagggccccgaggaggccgccgccggcagaagccacguggugcagagagugcugagcaccgcccaguuccuguggaugcugggccaggcccugguggacgagcugaccagauggcugcaggaguucaccagacaccacggcaccaugagcgacgugcugagagccgagagauaccugcugacccaggagcugcugcagggcggcgaggugcacagaggcgugcuggaccagcuguacaccagccaggccgaggccacccugcccggccccaccgaggcccccaacgcccccagcaccgugagcagcggccugggcgccgaggagccccugagcagcaugaccgacgacaugggcagcccccugagcaccggcuaccacaccagaagcggcagcgaggaggccgugaccgaccccggcgagagagaggccggcgccagccuguaccagggccugaugagaaccgccagcgagcugcugcuggacagaagacugagaauccccgagcuggaggaggccgagcuguucgccgagggccagggcagagcccugagacugcugagagccguguaccagugcguggccgcccacagcgagcugcugugcuacuucaucaucauccugaaccacauggugaccgccagcgccggcagccuggugcugcccgugcugguguuccugugggccaugcugagcauccccagacccagcaagagauucuggaugaccgccaucguguucaccgagaucgccgugguggugaaguaccuguuccaguucggcuucuuccccuggaacagccacguggugcugagaagauacgagaacaagcccuacuucccccccagaauccugggccuggagaagaccgacggcuacaucaaguacgaccuggugcagcugauggcccuguucuuccacagaagccagcugcugugcuacggccugugggaccacgaggaggacagccccagcaaggagcacgacaagagcggcgaggaggagcagggcgccgaggagggccccggcgugcccgccgccaccaccgaggaccacauccagguggaggccagagugggccccaccgacggcacccccgagccccagguggagcugagacccagagacaccagaagaaucagccugagauucagaagaagaaagaaggagggccccgccagaaagggcgccgccgccaucgaggccgaggacagagaggaggaggagggcgaggaggagaaggaggcccccaccggcagagagaagagacccagcagaagcggcggcagagugagagccgccggcagaagacugcagggcuucugccugagccuggcccagggcaccuacagaccccugagaagauucuuccacgacauccugcacaccaaguacagagccgccaccgacguguacgcccugauguuccuggccgacgugguggacuucaucaucaucaucuucggcuucugggccuucggcaagcacagcgccgccaccgacaucaccagcagccugagcgacgaccaggugcccgaggccuuccuggugaugcugcugauccaguucagcaccauggugguggacagagcccuguaccugagaaagaccgugcugggcaagcuggccuuccagguggcccuggugcuggccauccaccuguggauguucuucauccugcccgccgugaccgagagaauguucaaccagaacgugguggcccagcugugguacuucgugaagugcaucuacuucgcccugagcgccuaccagaucagaugcggcuaccccaccagaauccugggcaacuuccugaccaagaaguacaaccaccugaaccuguuccuguuccagggcuucagacuggugcccuuccugguggagcugagagccgugauggacuggguguggaccgacaccacccugagccugagcagcuggaugugcguggaggacaucuacgccaacaucuucaucaucaagugcagcagagagaccgagaagaaguacccccagcccaagggccagaagaagaagaagaucgugaaguacggcaugggcggccugaucauccuguuccugaucgccaucaucugguucccccugcuguucaugagccuggugagaagcguggugggcguggugaaccagcccaucgacgugaccgugacccugaagcugggcggcuacgagccccuguucaccaugagcgcccagcagcccagcaucauccccuucaccgcccaggccuacgaggagcugagcagacaguucgacccccagccccuggccaugcaguucaucagccaguacagccccgaggacaucgugaccgcccagaucgagggcagcagcggcgcccuguggagaaucagcccccccagcagagcccagaugaagagagagcuguacaacggcaccgccgacaucacccugagauucaccuggaacuuccagagagaccuggccaagggcggcaccguggaguacgccaacgagaagcacaugcuggcccuggcccccaacagcaccgccagaagacagcuggccagccugcuggagggcaccagcgaccagagcguggugauccccaaccuguuccccaaguacaucagagcccccaacggccccgaggccaaccccgugaagcagcugcagcccaacgaggaggccgacuaccugggcgugagaauccagcugagaagagagcagggcgccggcgccaccggcuuccuggaguggugggugaucgagcugcaggagugcagaaccgacugcaaccugcugcccauggugaucuucagcgacaaggugagcccccccagccugggcuuccuggccggcuacggcaucaugggccuguacgugagcaucgugcuggugaucggcaaguucgugagaggcuucuucagcgagaucagccacagcaucauguucgaggagcugcccugcguggacagaauccugaagcugugccaggacaucuuccuggugagagagaccagagagcuggagcuggaggaggagcuguacgccaagcugaucuuccuguacagaagccccgagaccaugaucaaguggaccagagagaaggaguaa

SEQ ID NO: 21512 - RNA, 8259 nt, Artificial Sequence
  PIEZO2__Homo_sapiens__NP_071351
auggccagcgagguggugugcggccugaucuucagacugcugcugcccaucugccuggccguggccugcgccuucagauacaacggccugagcuucguguaccugaucuaccugcugcugaucccccuguucagcgagcccaccaagaccaccaugcagggccacaccggcagacugcugaagagccugugcuucaucagccugagcuuccugcugcugcacaucaucuuccacaucacccuggugagccuggaggcccagcacagaaucgcccccggcuacaacugcagcaccugggagaagaccuucagacagaucggcuucgagagccugaagggcgccgacgccggcaacggcaucagaguguucgugcccgacaucggcauguucaucgccagccugaccaucuggcugcugugcagaaacaucgugcagaagcccgugaccgacgaggccgcccagagcaaccccgaguucgagaacgaggagcuggccgagggcgagaagaucgacagcgaggaggcccugaucuacgaggaggacuucaacggcggcgacggcguggagggcgagcuggaggagagcaccaagcugaagauguucagaagacuggccagcguggccagcaagcugaaggaguucaucggcaacaugaucaccaccgccggcaaggugguggugaccauccugcugggcagcagcggcaugaugcugcccagccugaccagcagcguguacuucuucguguuccugggccugugcaccugguggagcuggugcagaaccuucgacccccugcuguucagcugccugugcgugcugcuggccaucuucaccgccggccaccugaucggccuguaccuguaccaguuccaguucuuccaggaggccgugccccccaacgacuacuacgccagacuguucggcaucaagagcgugauccagaccgacugcagcagcaccuggaagaucaucgugaaccccgaccugagcugguaccaccacgccaaccccauccugcugcuggugauguacuacacccuggccacccugaucagaaucuggcugcaggagccccuggugcaggacgagggcaccaaggaggaggacaaggcccuggccugcagccccauccagaucaccgccggcagaagaagaagccugugguacgccacccacuaccccaccgacgagagaaagcugcugagcaugacccaggacgacuacaagcccagcgacggccugcuggugaccgugaacggcaaccccguggacuaccacaccauccaccccagccugcccauggagaacggccccggcaaggccgaccuguacagcaccccccaguacagaugggagcccagcgacgagagcagcgagaagagagaggaggaggaggaggagaaggaggaguucgaggaggagagaagcagagaggagaagagaagcaucaaggugcacgccauggugagcguguuccaguucaucaugaagcagagcuacaucugcgcccugaucgccaugauggccuggagcaucaccuaccacagcuggcugaccuucgugcugcugaucuggagcugcacccuguggaugaucagaaacagaagaaaguacgccaugaucagcagccccuucauggugguguacggcaaccugcugcugauccugcaguacaucuggagcuucgagcugcccgagaucaagaaggugcccggcuuccuggagaagaaggagcccggcgagcuggccagcaagauccuguucaccaucaccuucuggcugcugcugagacagcaccugaccgagcagaaggcccugcaggagaaggaggcccugcugagcgaggugaagaucggcagccaggagaacgaggagaaggacgaggagcugcaggacauccagguggagggcgagcccaaggaggaggaggaggaggaggccaaggaggagaagcaggagagaaagaagguggagcaggaggaggccgaggaggaggacgagcaggacaucaugaaggugcugggcaaccuggugguggccauguucaucaaguacuggaucuacgugugcggcggcauguucuucuucgugagcuucgagggcaagaucgugauguacaagaucaucuacauggugcuguuccuguucugcguggcccuguaccaggugcacuacgagugguggagaaagauccugaaguacuucuggaugagcguggugaucuacaccaugcuggugcugaucuucaucuacaccuaccaguucgagaacuuccccggccuguggcagaacaugaccggccugaagaaggagaagcuggaggaccugggccugaagcaguucaccguggccgagcuguucaccagaaucuucauccccaccagcuuccugcuggugugcauccugcaccugcacuacuuccacgacagauuccuggagcugaccgaccugaagagcauccccagcaaggaggacaacaccaucuacagacuggcccaccccgagggcagccugcccgaccugaccaugaugcaccugaccgccagccuggagaagcccgaggugagaaagcuggccgagcccggcgaggagaagcuggagggcuacagcgagaaggcccagaagggcgaccugggcaaggacagcgaggagagcgaggaggacggcgaggaggaggaggagagcgaggaggaggaggagaccagcgaccugagaaacaaguggcaccuggugaucgacagacugaccgugcuguuccugaaguuccuggaguacuuccacaagcugcagguguucaugugguggauccuggagcugcacaucaucaagaucgugagcagcuacaucaucugggugagcgugaaggaggugagccuguucaacuacguguuccugaucagcugggccuucgcccugcccuacgccaagcugagaagacuggccagcagcgugugcaccguguggaccugcgugaucaucgugugcaagaugcuguaccagcugcagaccaucaagcccgagaacuucagcgugaacugcagccugcccaacgagaaccagaccaacauccccuucaacgagcugaacaagagccugcuguacagcgcccccaucgaccccaccgagugggugggccugagaaagagcagcccccugcugguguaccugagaaacaaccugcugaugcuggccauccuggccuucgaggugaccaucuacagacaccaggaguacuacagaggcagaaacaaccugaccgcccccgugagcagaaccaucuuccacgacaucaccagacugcaccuggacgacggccugaucaacugcgccaaguacuucaucaacuacuucuucuacaaguucggccuggagaccugcuuccugaugagcgugaacgugaucggccagagaauggacuucuacgccaugauccacgccugcuggcugaucgccgugcuguacagaagaagaagaaaggccaucgccgagaucuggcccaaguacugcugcuuccuggccugcaucaucaccuuccaguacuucaucugcaucggcaucccccccgcccccugcagagacuaccccuggagauucaagggcgccagcuucaacgacaacaucaucaaguggcuguacuuccccgacuucaucgugagacccaaccccguguuccugguguacgacuucaugcugcugcugugcgccagccugcagagacagaucuucgaggacgagaacaaggccgccgugagaaucauggccggcgacaacguggagaucugcaugaaccuggacgccgccagcuucagccagcacaaccccgugcccgacuucauccacugcagaagcuaccuggacaugagcaaggugaucaucuucagcuaccuguucugguucgugcugaccaucaucuucaucaccggcaccaccagaaucagcaucuucugcaugggcuaccugguggccugcuucuacuuccugcuguucggcggcgaccugcugcugaagcccaucaagagcauccugagauacugggacuggcugaucgccuacaacguguucgugaucaccaugaagaacauccugagcaucggcgccugcggcuacaucggcacccuggugcacaacagcugcuggcugauccaggccuucagccuggccugcaccgugaagggcuaccagaugcccgccgccaacagccccugcacccugcccagcggcgaggccggcaucaucugggacagcaucugcuucgccuuccugcugcugcagagaagaguguucaugagcuacuacuuccugcacgugguggccgacaucaaggccagccagauccuggccagcagaggcgccgagcuguuccaggccaccaucgugaaggccgugaaggccagaaucgaggaggagaagaagagcauggaccagcugaagagacagauggacagaaucaaggccagacagcagaaguacaagaagggcaaggagagaaugcugagccugacccaggagcccggcgagggccaggacaugcagaagcugagcgaggaggacgacgagagagaggccgacaagcagaaggccaagggcaagaagaagcagugguggagacccuggguggaccacgccagcauggugagaagcggcgacuacuaccuguucgagaccgacagcgaggaggaggaggaggaggagcugaagaaggaggacgaggagccccccagaagaagcgccuuccaguucguguaccaggccuggaucaccgaccccaagaccgcccugagacagagacacaaggagaagaagagaagcgccagagaggagagaaagagaagaagaaagggcagcaaggagggccccguggagugggaggacagagaggacgagcccaucaagaagaagagcgacggccccgacaacaucaucaagagaaucuucaacauccugaaguucaccugggugcuguuccuggccaccguggacagcuucaccaccuggcugaacagcaucagcagagagcacaucgacaucagcaccgugcugagaaucgagagaugcaugcugaccagagagaucaagaagggcaacgugcccaccagagagagcauccacauguacuaccagaaccacaucaugaaccugagcagagagagcggccuggacaccaucgacgagcaccccggcgccgccagcggcgcccagaccgcccacagaauggacagccuggacagccacgacagcaucagcagcgagcccacccagugcaccaugcuguacagcagacagggcaccaccgagaccaucgaggagguggaggccgagcaggaggaggaggccggcagcaccgcccccgagcccagagaggccaaggaguacgaggccaccggcuacgacgugggcgccaugggcgccgaggaggccagccugacccccgaggaggagcugacccaguucagcacccuggacggcgacguggaggccccccccagcuacagcaaggccgugagcuucgagcaccugagcuucggcagccaggacgacagcgccggcaagaacagaauggccgugagccccgacgacagcagaaccgacaagcugggcagcagcauccugcccccccugacccacgagcugaccgccagcgagcugcugcugaagaagauguuccacgacgacgagcuggaggagagcgagaaguucuacgugggccagcccagauuccugcugcuguucuacgccauguacaacacccugguggccagaagcgagauggugugcuacuucgugaucauccugaaccacauggugagcgccagcaugaucacccugcugcugcccauccugaucuuccugugggccaugcugagcgugcccagacccagcagaagauucuggaugauggccaucguguacaccgagguggccaucguggugaaguacuucuuccaguucggcuucuuccccuggaacaagaacguggaggugaacaaggacaagcccuaccacccccccaacaucaucggcguggagaagaaggagggcuacgugcuguacgaccugauccagcugcuggcccuguucuuccacagaagcauccugaagugccacggccugugggacgaggacgacaugaccgagagcggcauggccagagaggagagcgacgacgagcugagccugggccacggcagaagagacagcagcgacagccugaagagcaucaaccuggccgccagcguggagagcgugcacgugaccuuccccgagcagcagaccgccgugagaagaaagagaagcggcagcagcagcgagcccagccagagaagcagcuucagcagcaacagaagccagagaggcagcaccagcaccagaaacagcagccagaagggcagcagcgugcugagcaucaagcagaagggcaagagagagcuguacauggagaagcugcaggagcaccugaucaaggccaaggccuucaccaucaagaagacccuggagaucuacgugcccaucaagcaguucuucuacaaccugauccaccccgaguacagcgccgugaccgacguguacgugcugauguuccuggccgacaccguggacuucaucaucaucguguucggcuucugggccuucggcaagcacagcgccgccgccgacaucaccagcagccugagcgaggaccaggugcccggccccuuccuggugauggugcugauccaguucggcaccauggugguggacagagcccuguaccugagaaagaccgugcugggcaaggugaucuuccaggugauccugguguucggcauccacuucuggauguucuucauccugcccggcgugaccgagagaaaguucagccagaaccugguggcccagcugugguacuucgugaagugcguguacuucggccugagcgccuaccagaucagaugcggcuaccccaccagagugcugggcaacuuccugaccaagagcuacaacuacgugaaccuguuccuguuccagggcuucagacuggugcccuuccugaccgagcugagagccgugauggacuggguguggaccgacaccacccugagccugagcagcuggaucugcguggaggacaucuacgcccacaucuucauccugaagugcuggagagagagcgagaagagauacccccagcccagaggccagaagaagaagaagguggugaaguacggcaugggcggcaugaucaucgugcugcugaucugcaucgugugguucccccugcuguucaugagccugaucaagagcguggccggcgugaucaaccagccccuggacgugagcgugaccaucacccugggcggcuaccagcccaucuucaccaugagcgcccagcagagccagcugaaggugauggaccagcagagcuucaacaaguucauccaggccuucagcagagacaccggcgccaugcaguuccuggagaacuacgagaaggaggacaucaccguggccgagcuggagggcaacagcaacagccuguggaccaucagcccccccagcaagcagaagaugauccacgagcugcuggaccccaacagcagcuucagcgugguguucagcuggagcauccagagaaaccugagccugggcgccaagagcgagaucgccaccgacaagcugagcuucccccugaagaacaucaccagaaagaacaucgccaagaugaucgccggcaacagcaccgagagcagcaagacccccgugaccaucgagaagaucuaccccuacuacgugaaggcccccagcgacagcaacagcaagcccaucaagcagcugcugagcgagaacaacuucauggacaucaccaucauccugagcagagacaacaccaccaaguacaacagcgaguggugggugcugaaccugaccggcaacagaaucuacaaccccaacagccaggcccuggagcuggugguguucaacgacaaggugagcccccccagccugggcuuccuggccggcuacggcaucaugggccuguacgccagcguggugcuggugaucggcaaguucgugagagaguucuucagcggcaucagccacagcaucauguucgaggagcugcccaacguggacagaauccugaagcugugcaccgacaucuuccuggugagagagaccggcgagcuggagcuggaggaggaccuguacgccaagcugaucuuccuguacagaagccccgagaccaugaucaaguggaccagagagaagaccaacuaa

SEQ ID NO: 21513 - RNA, 2124 nt, Artificial Sequence
  PIF1__Homo_sapiens__NP_001273426
augcugagcggcaucgaggccgccgccggcgaguacgaggacagcgagcugagaugcagaguggccguggaggagcugagccccggcggccagcccagaagaagacaggcccugagaaccgccgagcugagccugggcagaaacgagagaagagagcugaugcugagacugcaggcccccggccccgccggcagacccagaugcuucccccugagagccgccagacuguucaccagauucgccgaggccggcagaagcacccugagacugcccgcccacgacacccccggcgccggcgccgugcagcugcugcugagcgacugcccccccgacagacugagaagauuccugagaacccugagacugaagcuggccgccgcccccggccccggccccgccagcgccagagcccagcugcugggccccagacccagagacuucgugaccaucagccccgugcagcccgaggagagaagacugagagccgccaccagagugcccgacaccacccuggugaagagacccguggagccccaggccggcgccgagcccagcaccgaggcccccagauggccccugcccgugaagagacugagccugcccagcaccaagccccagcugagcgaggagcaggccgccgugcugagagccgugcugaagggccagagcaucuucuucaccggcagcgccggcaccggcaagagcuaccugcugaagagaauccugggcagccugccccccaccggcaccguggccaccgccagcaccggcguggccgccugccacaucggcggcaccacccugcacgccuucgccggcaucggcagcggccaggccccccuggcccagugcguggcccuggcccagagacccggcgugagacagggcuggcugaacugccagagacuggugaucgacgagaucagcaugguggaggccgaccuguucgacaagcuggaggccguggccagagccgugagacagcagaacaagcccuucggcggcauccagcugaucaucugcggcgacuuccugcagcugccccccgugaccaagggcagccagccccccagauucugcuuccagagcaagagcuggaagagaugcgugcccgugacccuggagcugaccaagguguggagacaggccgaccagaccuucaucagccugcugcaggccgugagacugggcagaugcagcgacgaggugaccagacagcugcaggccaccgccagccacaaggugggcagagacggcaucguggccaccagacugugcacccaccaggacgacguggcccugaccaacgagagaagacugcaggagcugcccggcaaggugcacagauucgaggccauggacagcaaccccgagcuggccagcacccuggacgcccagugccccgugagccagcugcugcagcugaagcugggcgcccaggugaugcuggugaagaaccugagcgugagcagaggccuggugaacggcgccagaggcgugguggugggcuucgaggccgagggcagaggccugccccaggugagauuccugugcggcgugaccgaggugauccacgccgacagauggaccgugcaggccaccggcggccagcugcugagcagacagcagcugccccugcagcuggccugggccaugagcauccacaagagccagggcaugacccuggacugcguggagaucagccugggcagaguguucgccagcggccaggccuacguggcccugagcagagccagaagccugcagggccugagagugcuggacuucgaccccauggccgugagaugcgaccccagagugcugcacuucuacgccacccugagaagaggcagaagccugagccuggccgccgagggcagaggcaacgaggacagaugcagcggcagcagcaucagagcccugggcggcgacugguggggccugagacugggcgccgccagcaagcagagaaccgagcugagaugcgugagcaccgccagacccagccuggcccagcccagaaccaacacccugcagagccugaccaaggagcacaagcugcagaacgugcaccccuacuucaagcugcuguuccagggcaucaacagcguguggggccacuaa

SEQ ID NO: 21514 - RNA, 477 nt, Artificial Sequence
  PIFO__Homo_sapiens__NP_001287760
augugcuucagcagagccgacgccgccgacaacuaccccuucggcaccugccagcagagaaagcuguucccccacuuccacccccccaaccugaucggcaacaaguucgugccccugagaggcagcccccacagaggccccggcugcuacuucagcgacgagaugaccccccacgccggcagauaccagaaggugagcccccagcaggagaagcacaagcagaacuucgcccccuucaacgugcuggugcccagauucaagaacuaccccaaggacaccuacuaccccagccccggcgccuacaaccccgagaagaagcccccccccaagaucgccuggcccaugaaguucggcagccccgacugggcccaggugcccugccugcagaagagaacccugaaggccgagcugagcaccgacaaggacuucagaaagcacagaaacagaguggccuaccugagccuguacuacaacuaa

SEQ ID NO: 21515 - RNA, 1455 nt, Artificial Sequence
  PIGA__Homo_sapiens__NP_002632
auggccugcagaggcggcgccggcaacggccacagagccagcgccacccugagcagagugagccccggcagccuguacaccugcagaaccagaacccacaacaucugcauggugagcgacuucuucuaccccaacaugggcggcguggagagccacaucuaccagcugagccagugccugaucgagagaggccacaaggugaucaucgugacccacgccuacggcaacagaaagggcaucagauaccugaccagcggccugaagguguacuaccugccccugaaggugauguacaaccagagcaccgccaccacccuguuccacagccugccccugcugagauacaucuucgugagagagagagugaccaucauccacagccacagcagcuucagcgccauggcccacgacgcccuguuccacgccaagaccaugggccugcagaccguguucaccgaccacagccuguucggcuucgccgacgugagcagcgugcugaccaacaagcugcugaccgugagccugugcgacaccaaccacaucaucugcgugagcuacaccagcaaggagaacaccgugcugagagccgcccugaaccccgagaucgugagcgugauccccaacgccguggaccccaccgacuucacccccgaccccuucagaagacacgacagcaucaccaucgugguggugagcagacugguguacagaaagggcaucgaccugcugagcggcaucauccccgagcugugccagaaguaccccgaccugaacuucaucaucggcggcgagggccccaagagaaucauccuggaggaggugagagagagauaccagcugcacgacagagugagacugcugggcgcccuggagcacaaggacgugagaaacgugcuggugcagggccacaucuuccugaacaccagccugaccgaggccuucugcauggccaucguggaggccgccagcugcggccugcagguggugagcaccagagugggcggcauccccgaggugcugcccgagaaccugaucauccugugcgagcccagcgugaagagccugugcgagggccuggagaaggccaucuuccagcugaagagcggcacccugcccgcccccgagaacauccacaacaucgugaagaccuucuacaccuggagaaacguggccgagagaaccgagaagguguacgacagagugagcguggaggccgugcugcccauggacaagagacuggacagacugaucagccacugcggccccgugaccggcuacaucuucgcccugcuggccguguucaacuuccuguuccugaucuuccugagauggaugacccccgacagcaucaucgacguggccaucgacgccaccggccccagaggcgccuggaccaacaacuacagccacagcaagagaggcggcgagaacaacgagaucagcgagaccagauaa

SEQ ID NO: 21516 - RNA, 660 nt, Artificial Sequence
  PIGF__Homo_sapiens__NP_002634
augaaggacaacgacaucaagagacugcuguacacccaccugcugugcaucuucagcaucauccugagcguguucauccccagccuguuccuggagaacuucagcauccuggagacccaccugaccuggcugugcaucugcagcggcuucgugaccgccgugaaccuggugcuguaccugguggugaagcccaacaccagcagcaagagaagcagccugagccacaaggugaccggcuuccugaagugcugcaucuacuuccugaugagcugcuucagcuuccacgugaucuucgugcuguacggcgccccccugaucgagcuggcccuggagaccuuccuguucgccgugauccugagcaccuucaccaccgugcccugccugugccugcugggccccaaccugaaggccuggcugagaguguucagcagaaacggcgugaccagcaucugggagaacagccugcagaucaccaccaucagcagcuucgugggcgccuggcugggcgcccugcccaucccccuggacugggagagacccuggcagguguggcccaucagcugcacccugggcgccaccuucggcuacguggccggccuggugaucagcccccuguggaucuacuggaacagaaagcagcugaccuacaagaacaacuaa

SEQ ID NO: 21517 - RNA, 2952 nt, Artificial Sequence
  PIGG__Homo_sapiens__NP_001120650
augagacugggcagcggcaccuucgccaccugcugcguggccaucgaggugcugggcaucgccguguuccugagaggcuucuuccccgcccccgugagaagcagcgccagagccgagcacggcgccgagccccccgcccccgagcccagcgccggcgccagcagcaacuggaccacccugccccccccccuguucagcaagguggugaucgugcugaucgacgcccugagagacgacuucguguucggcagcaagggcgugaaguucaugcccuacaccaccuaccugguggagaagggcgccagccacagcuucguggccgaggccaagccccccaccgugaccaugcccagaaucaaggcccugaugaccggcagccugcccggcuucguggacgugaucagaaaccugaacagccccgcccugcuggaggacagcgugaucagacaggccaaggccgccggcaagagaaucguguucuacggcgacgagaccugggugaagcuguuccccaagcacuucguggaguacgacggcaccaccagcuucuucgugagcgacuacaccgagguggacaacaacgugaccagacaccuggacaaggugcugaagagaggcgacugggacauccugauccugcacuaccugggccuggaccacaucggccacaucagcggccccaacagcccccugaucggccagaagcugagcgagauggacagcgugcugaugaagauccacaccagccugcagagcaaggagagagagaccccccugcccaaccugcuggugcugugcggcgaccacggcaugagcgagaccggcagccacggcgccagcagcaccgaggaggugaacaccccccugauccugaucagcagcgccuucgagagaaagcccggcgacaucagacaccccaagcacgugcagcagaccgacguggccgccacccuggccaucgcccugggccugcccauccccaaggacagcgugggcagccugcuguuccccgugguggagggcagacccaugagagagcagcugagauuccugcaccugaacaccgugcagcugagcaagcugcugcaggagaacgugcccagcuacgagaaggaccccggcuucgagcaguucaagaugagcgagagacugcacggcaacuggaucagacuguaccuggaggagaagcacagcgaggugcuguucaaccugggcagcaaggugcugagacaguaccuggacgcccugaagacccugagccugagccugagcgcccagguggcccaguacgacaucuacagcaugauggugggcaccgugguggugcuggaggugcugacccugcugcugcugagcgugccccaggcccugagaagaaaggccgagcuggaggugccccugagcagccccggcuucagccugcuguucuaccuggugauccuggugcugagcgccgugcacgugaucgugugcaccagcgccgagagcagcugcuacuucugcggccugagcuggcuggccgccggcggcgugauggugcuggccagcgcccugcugugcgugaucgugagcgugcugaccaacgugcuggugggcggcaacacccccagaaagaaccccaugcaccccagcagcagauggagcgagcuggaccugcugauccugcugggcaccgccggccacgugcugagccugggcgccagcagcuucguggaggaggagcaccagaccugguacuuccuggugaacacccugugccuggcccugagccaggagaccuacagaaacuacuuccugggcgacgacggcgagccccccugcggccugugcguggagcagggccacgacggcgccaccgccgccuggcaggacggccccggcugcgacgugcuggagagagacaagggccacggcagccccagcaccagcgaggugcugagaggcagagagaaguggauggugcuggccagccccuggcugauccuggccugcugcagacugcugagaagccugaaccagaccggcgugcagugggcccacagacccgaccugggccacuggcugaccagcagcgaccacaaggccgagcugagcgugcuggccgcccugagccugcuggugguguucgugcuggugcagagaggcugcagccccgugagcaaggccgcccuggcccugggccugcugggcguguacugcuacagagccgccaucggcagcgugagauuccccuggagacccgacagcaaggacaucagcaagggcaucaucgaggccagauucguguacguguucgugcugggcauccuguucaccggcaccaaggaccugcugaagagccaggugaucgccgccgacuucaagcugaagaccgugggccugugggagaucuacagcggccuggugcugcuggccgcccugcuguucagaccccacaaccugcccgugcuggccuucagccugcugauccagacccugaugaccaaguucaucuggaagccccugagacacgacgccgccgagaucaccgugaugcacuacugguucggccaggccuucuucuacuuccagggcaacagcaacaacaucgccaccguggacaucagcgccggcuucgugggccuggacaccuacguggagauccccgccgugcugcugaccgccuucggcaccuacgccggccccgugcugugggccagccaccuggugcacuuccugagcagcgagaccagaagcggcagcgcccugagccacgccugcuucugcuacgcccugaucugcagcauccccguguucaccuacaucgugcuggugaccagccugagauaccaccuguucaucuggagcguguucagccccaagcugcuguacgagggcaugcaccugcugaucaccgccgccgugugcguguucuucaccgccauggaccagaccagacugacccagagcuaa

SEQ ID NO: 21518 - RNA, 759 nt, Artificial Sequence
  PIGL__Homo_sapiens__NP_004269
auggaggccauguggcugcugugcguggcccuggccgugcuggccuggggcuuccugugggugugggacagcagcgagagaaugaagagcagagagcagggcggcagacugggcgccgagagcagaacccugcuggugaucgcccaccccgacgacgaggccauguucuucgcccccaccgugcugggccuggccagacugagacacuggguguaccugcugugcuucagcgccggcaacuacuacaaccagggcgagaccagaaagaaggagcugcugcagagcugcgacgugcugggcaucccccugagcagcgugaugaucaucgacaacagagacuuccccgacgaccccggcaugcagugggacaccgagcacguggccagagugcugcugcagcacaucgaggugaacggcaucaaccugguggugaccuucgacgccggcggcgugagcggccacagcaaccacaucgcccuguacgccgccgugagagcccugcacagcgagggcaagcugcccaagggcugcagcgugcugacccugcagagcgugaacgugcugagaaaguacaucagccugcuggaccugccccugagccugcugcacacccaggacgugcuguucgugcugaacagcaaggagguggcccaggccaagaaggccaugagcugccacagaagccagcugcugugguucagaagacuguacaucaucuucagcagauacaugagaaucaacagccugagcuuccuguaa

SEQ ID NO: 21519 - RNA, 1272 nt, Artificial Sequence
  PIGM__Homo_sapiens__NP_660150
augggcagcaccaagcacuggggcgaguggcugcugaaccugaagguggcccccgccggcguguucggcguggccuuccuggccagaguggcccugguguucuacggcguguuccaggacagaacccugcacgugagauacaccgacaucgacuaccagguguucaccgacgccgccagauucgugaccgagggcagaagccccuaccugagagccaccuacagauacaccccccugcugggcuggcugcugacccccaacaucuaccugagcgagcuguucggcaaguuccuguucaucagcugcgaccugcugaccgccuuccugcuguacagacugcugcugcugaagggccugggcagaagacaggccugcggcuacugcguguucuggcugcugaacccccugcccauggccgugagcagcagaggcaacgccgacagcaucguggccagccuggugcugauggugcuguaccugaucaagaagagacugguggccugcgccgccguguucuacggcuucgccgugcacaugaagaucuaccccgugaccuacauccugcccaucacccugcaccugcugcccgacagagacaacgacaagagccugagacaguucagauacaccuuccaggccugccuguacgagcugcugaagagacugugcaacagagccgugcugcuguucguggccguggccggccugaccuucuucgcccugagcuucggcuucuacuacgaguacggcugggaguuccuggagcacaccuacuucuaccaccugaccagaagagacaucagacacaacuucagccccuacuucuacaugcuguaccugaccgccgagagcaaguggagcuucagccugggcaucgccgccuuccugccccagcugauccugcugagcgccgugagcuucgccuacuacagagaccugguguucugcugcuuccugcacaccagcaucuucgugaccuucaacaaggugugcaccagccaguacuuccugugguaccugugccugcugccccuggugaugccccuggugagaaugcccuggaagagagccguggugcugcugaugcugugguucaucggccaggccauguggcuggcccccgccuacgugcuggaguuccagggcaagaacaccuuccuguucaucuggcuggccggccuguucuuccugcugaucaacugcagcauccugauccagaucaucagccacuacaaggaggagccccugaccgagagaaucaaguacgacuaa

SEQ ID NO: 21520 - RNA, 2796 nt, Artificial Sequence
  PIGN__Homo_sapiens__NP_789744
augcugcuguucuucacccugggccugcugauccacuucguguucuucgccagcaucuucgacaucuacuucaccagcccccuggugcacggcaugaccccccaguucaccccccugcccccccccgccagaagacuggugcuguucguggccgacggccugagagccgacgcccuguacgagcuggacgagaacggcaacagcagagcccccuucaucagaaacaucaucaugcacgagggcagcuggggcaucagccacaccagagugcccaccgagagcagacccggccacguggcccugaucgccggcuucuacgaggacgugagcgccguggccaagggcuggaaggagaaccccguggaguucgacagccuguucaacgagagcaaguacaccuggagcuggggcagccccgacauccugcccauguucgccaagggcgccagcggcgaccacguguacaccuacagcuacgacgccaagagagaggacuucggcgcccaggacgccaccaagcuggacaccuggguguucgacaacgugaaggacuucuuccaccacgccagaaacaaccagagccuguucagcaagaucaacgaggagaagaucguguucuuccugcaccugcugggcaucgacaccaacggccacgcccacagacccagcagcagagacuacaagcacaacaucaagaagguggacgacggcgugaaggagaucgugagcauguucaaccacuucuacggcaacgacggcaagaccaccuucaucuucaccagcgaccacggcaugaccgacuggggcagccacggcgccggccaccccagcgagacccugaccccccuggugaccuggggcgccggcaucaaguacccccagagagugagcgcccagcaguucgacgacgccuuccugaaggaguggagacuggagaacuggaagagacuggacgugaaccaggccgacaucgccccccugaugaccagccugaucggcgugcccuucccccugaacagcgugggcauccugcccguggacuaccugaacaacaccgaccuguucaaggccgagagcauguucaccaacgccgugcagauccuggagcaguucaaggugaagaugacccagaagaaggaggugacccugcccuuccuguucacccccuucaagcugcugagcgacagcaagcaguucaacauccugagaaaggccagaagcuacaucaagcacagaaaguucgacgagguggugagccugugcaaggagcugauccaccuggcccugaagggccugagcuacuaccacaccuacgacagauucuuccugggcgugaacguggugaucggcuucgugggcuggaucagcuacgccagccugcugaucaucaagagccacagcaaccugaucaagggcgugagcaaggaggugaagaagcccagccaccugcugcccugcagcuucguggccaucggcauccugguggccuucuuccugcugauccaggccugccccuggaccuacuacguguacggccugcugccccugcccaucugguacgccgugcugagagaguuccaggugauccaggaccugguggugagcgugcugaccuacccccugagccacuucgugggcuaccugcuggccuucacccugggcaucgaggugcuggugcugagcuucuucuacagauacaugcugaccgccggccugaccgccuucgccgccuggcccuuccugaccagacuguggaccagagccaagaugaccagccugagcuggaccuucuucagccugcugcuggccguguucccccugaugcccguggugggcagaaagcccgacaucagccuggugaugggcgccggccugcuggugcugcugcugagccugugcguggugaccagccugaugaagagaaaggacagcuucaucaaggaggagcugcuggugcaccugcugcaggugcugagcaccgugcugagcauguacgugguguacagcacccagagcagccugcugagaaagcagggccugccccugaugaaccagaucaucagcugggccacccuggccagcagccugguggugccccugcugagcagccccgugcuguuccagagacuguucagcauccugcugagccugaugagcaccuaccugcugcugagcaccggcuacgaggcccuguucccccuggugcugagcugccugauguucguguggaucaacaucgagcaggagacccugcagcagagcggcgugugcugcaagcagaagcugaccagcauccaguucagcuacaacaccgacaucacccaguucagacagcuguaccuggacgacaucagaagagccuucuuccugguguucuuccuggugaccgccuucuucggcaccggcaacaucgccagcaucaacagcuucgaccuggccagcguguacugcuuccugaccguguucagccccuucaugaugggcgcccugaugauguggaagauccugauccccuucgugcuggugaugugcgccuucgaggccgugcagcugaccacccagcugagcagcaagagccuguuccugaucgugcuggugaucagcgacaucauggcccugcacuucuucuuccuggugaaggacuacggcagcuggcuggacaucggcaccagcaucagccacuacgugaucgugaugagcaugaccaucuuccugguguuccugaacggccuggcccagcugcugaccaccaagaagcugagacugugcggcaagcccaagagccacuucauguaa

SEQ ID NO: 21521 - RNA, 2019 nt, Artificial Sequence
  PIGO__Homo_sapiens__NP_001188413
augcagaaggccagcgugcugcuguuccuggccugggugugcuuccuguucuacgccggcaucgcccuguucaccagcggcuuccugcugaccagacuggagcugaccaaccacagcagcugccaggagccccccggccccggcagccugcccuggggcagccagggcaagcccggcgccugcuggauggccagcagauucagcagaguggugcuggugcugaucgacgcccugagauucgacuucgcccagccccagcacagccacgugcccagagagccccccgugagccugcccuuccugggcaagcugagcagccugcagagaauccuggagauccagccccaccacgccagacuguacagaagccagguggacccccccaccaccaccaugcagagacugaaggcccugaccaccggcagccugcccaccuucaucgacgccggcagcaacuucgccagccacgccaucguggaggacaaccugaucaagcagcugaccagcgccggcagaagagugguguucaugggcgacgacaccuggaaggaccuguuccccggcgccuucagcaaggccuucuucuuccccagcuucaacgugagagaccuggacaccguggacaacggcauccuggagcaccuguaccccaccauggacagcggcgagugggacgugcugaucgcccacuuccugggcguggaccacugcggccacaagcacggcccccaccaccccgagauggccaagaagcugagccagauggaccaggugauccagggccugguggagagacuggagaacgacacccugcuggugguggccggcgaccacggcaugaccaccaacggcgaccacggcggcgacagcgagcuggaggugagcgccgcccuguuccuguacagccccaccgccguguuccccagcaccccccccgaggagcccgaggugaucccccaggugagccuggugcccacccuggcccugcugcugggccugcccauccccuucggcaacaucggcgaggugauggccgagcuguucagcggcggcgaggacagccagccccacagcagcgcccuggcccaggccagcgcccugcaccugaacgcccagcaggugagcagauuccugcacaccuacagcgccgccacccaggaccugcaggccaaggagcugcaccagcugcagaaccuguucagcaaggccagcgccgacuaccaguggcugcugcagagccccaagggcgccgaggccacccugcccaccgugaucgccgagcugcagcaguuccugagaggcgccagagccaugugcaucgagagcugggccagauucagccugagcuuccugcugcugcaccugcuggccgccggcauccccgugaccacccccggccccuucaccgugcccuggcaggccgugagcgccugggcccugauggccacccagaccuucuacagcaccggccaccagcccguguuccccgccauccacuggcacgccgccuucgugggcuuccccgagggccacggcagcugcaccuggcugcccgcccugcuggugggcgccaacaccuucgccagccaccugcuguucgccgugggcugcccccugcugcugcuguggcccuuccugugcgagagccagggccugagaaagagacagcagccccccggcaacgaggccgacgccagagugagacccgaggaggaggaggagccccugauggagaugagacugagagacgccccccagcacuucuacgccgcccugcugcagcugggccugaaguaccuguucauccugggcauccagauccuggccugcgcccuggccgccagcauccugagaagacaccugaugguguggaagguguucgcccccaaguucaucuucgaggccgugggcuucaucgugagcagcgugggccugcugcugggcaucgcccuggugaugagaguggacggcgccgugagcagcugguucagacagcuguuccuggcccagcagagauaa

SEQ ID NO: 21522 - RNA, 477 nt, Artificial Sequence
  PIGP__Homo_sapiens__NP_710148
auggugcccagaagcaccagccugacccugaucguguuccuguuccacagacugagcaaggcccccggcaagaugguggagaacagccccagcccccugcccgagagagccaucuacggcuucgugcuguuccugagcagccaguucggcuucauccuguaccuggugugggccuucauccccgagagcuggcugaacagccugggccugaccuacuggccccagaaguacugggccguggcccugcccguguaccugcugaucgccaucgugaucggcuacgugcugcuguucggcaucaacaugaugagcaccagcccccuggacagcauccacaccaucaccgacaacuacgccaagaaccagcagcagaagaaguaccaggaggaggccauccccgcccugagagacaucagcaucagcgaggugaaccagauguucuuccuggccgccaaggagcuguacaccaagaacuaa

SEQ ID NO: 21523 - RNA, 1746 nt, Artificial Sequence
  PIGQ__Homo_sapiens__NP_004195
auggugcugaaggccuucuuccccaccugcugcgugagcaccgacagcggccugcuggugggcagaugggugcccgagcagagcagcgccguggugcuggccgugcugcacuuccccuucauccccauccaggugaagcagcugcuggcccaggugagacaggccagccaggugggcguggccgugcugggcaccuggugccacugcagacaggagcccgaggagagccugggcagauuccuggagagccugggcgccguguucccccacgagcccuggcugagacugugcagagagagaggcggcaccuucuggagcugcgaggccacccacagacaggcccccaccgcccccggcgcccccggcgaggaccaggugaugcugaucuucuacgaccagagacaggugcugcugagccagcugcaccugcccaccgugcugcccgacagacaggccggcgccaccaccgccagcaccggcggccuggccgccguguucgacaccguggccagaagcgaggugcuguucagaagcgacagauucgacgagggccccgugagacugagccacuggcagagcgagggcguggaggccagcauccuggccgagcuggccagaagagccagcggccccaucugccugcugcuggccagccugcugagccuggugagcgccgugagcgccugcagaguguucaagcuguggccccugagcuuccugggcagcaagcugagcaccugcgagcagcugagacacagacuggagcaccugacccugaucuucagcaccagaaaggccgagaaccccgcccagcugaugagaaaggccaacaccguggccagcgugcugcuggacguggcccugggccugaugcugcugagcuggcugcacggcagaagcagaaucggccaccuggccgacgcccuggugcccguggccgaccacguggccgaggagcugcagcaccugcugcaguggcugaugggcgcccccgccggccugaagaugaacagagcccuggaccaggugcugggcagauucuuccuguaccacauccaccuguggaucagcuacauccaccugaugagccccuucguggagcacauccuguggcacgugggccugagcgccugccugggccugaccguggcccugagccugcugagcgacaucaucgcccugcugaccuuccacaucuacugcuucuacguguacggcgccagacuguacugccugaagauccacggccugagcagccuguggagacuguucagaggcaagaaguggaacgugcugagacagagaguggacagcugcagcuacgaccuggaccagcuguucaucggcacccugcuguucaccauccugcuguuccugcugcccaccaccgcccuguacuaccugguguucacccugcugagacugcuggugguggccgugcagggccugauccaccugcugguggaccugaucaacagccugccccuguacagccugggccugagacugugcagacccuacagacuggccgccggcgugaaguucagagugcugagacacgaggccggcagaccccugagacugcugaugcagaucaacccccugcccuacagcagaguggugcacaccuacagacugcccagcugcggcugccaccccaagcacagcuggggcgcccugugcagaaagcuguuccugggcgagcugaucuaccccuggagacagagaggcgacaagcaggacuaa

SEQ ID NO: 21524 - RNA, 2295 nt, Artificial Sequence
  PIGR__Homo_sapiens__XP_011507931
augcugcuguucgugcugaccugccugcuggccguguuccccgccaucagcaccaagagccccaucuucggccccgaggaggugaacagcguggagggcaacagcgugagcaucaccugcuacuacccccccaccagcgugaacagacacaccagaaaguacuggugcagacagggcgccagaggcggcugcaucacccugaucagcagcgagggcuacgugagcagcaaguacgccggcagagccaaccugaccaacuuccccgagaacggcaccuucguggugaacaucgcccagcugagccaggacgacagcggcagauacaagugcggccugggcaucaacagcagaggccugagcuucgacgugagccuggaggugagccagggccccggccugcugaacgacaccaagguguacaccguggaccugggcagaaccgugaccaucaacugccccuucaagaccgagaacgcccagaagagaaagagccuguacaagcagaucggccuguaccccgugcuggugaucgacagcagcggcuacgugaaccccaacuacaccggcagaaucagacuggacauccagggcaccggccagcugcuguucagcguggugaucaaccagcugagacugagcgacgccggccaguaccugugccaggccggcgacgacagcaacagcaacaagaagaacgccgaccugcaggugcugaagcccgagcccgagcugguguacgaggaccugagaggcagcgugaccuuccacugcgcccugggccccgagguggccaacguggccaaguuccugugcagacagagcagcggcgagaacugcgacgugguggugaacacccugggcaagagagcccccgccuucgagggcagaauccugcugaacccccaggacaaggacggcagcuucagcguggugaucaccggccugagaaaggaggacgccggcagauaccugugcggcgcccacagcgacggccagcugcaggagggcagccccauccaggccuggcagcuguucgugaacgaggagagcaccauccccagaagccccaccguggugaagggcguggccggcggcagcguggccgugcugugccccuacaacagaaaggagagcaagagcaucaaguacuggugccugugggagggcgcccagaacggcagaugcccccugcugguggacagcgagggcugggugaaggcccaguacgagggcagacugagccugcuggaggagcccggcaacggcaccuucaccgugauccugaaccagcugaccagcagagacgccggcuucuacuggugccugaccaacggcgacacccuguggagaaccaccguggagaucaagaucaucgagggcgagcccaaccugaaggugcccggcaacgugaccgccgugcugggcgagacccugaaggugcccugccacuuccccugcaaguucagcagcuacgagaaguacuggugcaaguggaacaacaccggcugccaggcccugcccagccaggacgagggccccagcaaggccuucgugaacugcgacgagaacagcagacuggugagccugacccugaaccuggugaccagagccgacgagggcugguacuggugcggcgugaagcagggccacuucuacggcgagaccgccgccguguacguggccguggaggagagaaaggccgccggcagcagagacgugagccuggccaaggccgacgccgcccccgacgagaaggugcuggacagcggcuucagagagaucgagaacaaggccauccaggaccccagacuguucgccgaggagaaggccguggccgacaccagagaccaggccgacggcagcagagccagcguggacagcggcagcagcgaggagcagggcggcagcagcagagcccuggugagcacccuggugccccugggccuggugcuggccgugggcgccguggccgugggcguggccagagccagacacagaaagaacguggacagagugagcaucagaagcuacagaaccgacaucagcaugagcgacuucgagaacagcagagaguucggcgccaacgacaacaugggcgccagcagcaucacccaggagaccagccugggcggcaaggaggaguucguggccaccaccgagagcaccaccgagaccaaggagcccaagaaggccaagagaagcagcaaggaggaggccgagauggccuacaaggacuuccugcugcagagcagcaccguggccgccgaggcccaggacggcccccaggaggccuaa

SEQ ID NO: 21525 - RNA, 1569 nt, Artificial Sequence
  PIGT__Homo_sapiens__NP_001171657
auggccgccgccaugccccuggcccugcuggugcugcugcugcugggccccggcggcuggugccuggccgagccccccagagacagccugagagaggagcuggugaucaccccccugcccagcggcgacguggccgccaccuuccaguucagaaccagaugggacagcgagcugcagagagagggcgugagccacuacagacuguuccccaaggcccugggccagcugaucagcaaguacagccugagagagcugcaccugagcuucacccagggcuucuggagaaccagauacuggggcccccccuuccugcaggcccccagcgacaccgaccacuacuuccugagauacgccgugcugcccagagagguggugugcaccgagaaccugacccccuggaagaagcugcugcccugcagcagcaaggccggccugagcgugcugcugaaggccgacagacuguuccacaccagcuaccacagccaggccgugcacaucagacccgugugcagaaacgccagaugcaccagcaucagcugggagcugagacagacccugagcgugguguucgacgccuucaucaccggccagggcaagaaggacuggagccuguucagaauguucagcagaacccugaccgagcccugcccccuggccagcgagagcagaguguacguggacaucaccaccuacaaccaggacaacgagacccuggaggugcaccccccccccaccaccaccuaccaggacgugauccugggcaccagaaagaccuacgccaucuacgaccugcuggacaccgccaugaucaacaacagcagaaaccugaacauccagcugaaguggaagagaccccccgagaacgaggccccccccgugcccuuccugcacgcccagagauacgugagcggcuacggccugcagaagggcgagcugagcacccugcuguacaacacccaccccuacagagccuuccccgugcugcugcuggacaccgugcccugguaccugagacuguacgugcacacccugaccaucaccagcaagggcaaggagaacaagcccagcuacauccacuaccagcccgcccaggacagacugcagccccaccugcuggagaugcugauccagcugcccgccaacagcgugaccaaggugagcauccaguucgagagagcccugcugaaguggaccgaguacacccccgaccccaaccacggcuucuacgugagccccagcgugcugagcgcccuggugcccagcaugguggccgccaagcccguggacugggaggagagcccccuguucaacagccuguuccccgugagcgacggcagcaacuacuucgugagacuguacaccgagccccugcuggugaaccugcccacccccgacuucagcaugcccuacaacgugaucugccugaccugcaccgugguggccgugugcuacggcagcuucuacaaccugcugaccagaaccuuccacaucgaggagcccagaaccggcggccuggccaagagacuggccaaccugaucagaagagccagaggcgugcccccccuguaa

SEQ ID NO: 21526 - RNA, 1308 nt, Artificial Sequence
  PIGU__Homo_sapiens__NP_536724
auggccgccccccuggugcuggugcuggugguggccgugaccgugagagccgcccuguucagaagcagccuggccgaguucaucagcgagagaguggagguggugagcccccugagcagcuggaagagagugguggagggccugagccugcuggaccugggcgugagccccuacagcggcgccguguuccacgagaccccccugaucaucuaccuguuccacuuccugaucgacuacgccgagcugguguucaugaucaccgacgcccugaccgccaucgcccuguacuucgccauccaggacuucaacaaggugguguucaagaagcagaagcugcugcuggagcuggaccaguacgcccccgacguggccgagcugaucagaacccccauggagaugagauacaucccccugaagguggcccuguucuaccugcugaaccccuacaccauccugagcugcguggccaagagcaccugcgccaucaacaacacccugaucgccuucuucauccugaccaccaucaagggcagcgccuuccugagcgccaucuuccuggcccuggccaccuaccagagccuguacccccugacccuguucgugcccggccugcuguaccugcugcagagacaguacauccccgugaagaugaagagcaaggccuucuggaucuucagcugggaguacgccaugauguacgugggcagccugguggugaucaucugccugagcuucuuccugcugagcagcugggacuucauccccgccguguacggcuucauccugagcgugcccgaccugacccccaacaucggccuguucugguacuucuucgccgagauguucgagcacuucagccuguucuucgugugcguguuccagaucaacguguucuucuacaccaucccccuggccaucaagcugaaggagcaccccaucuucuucauguucauccagaucgccgugaucgccaucuucaagagcuaccccaccgugggcgacguggcccuguacauggccuucuuccccguguggaaccaccuguacagauuccugagaaacaucuucgugcugaccugcaucaucaucgugugcagccugcuguuccccgugcuguggcaccuguggaucuacgccggcagcgccaacagcaacuucuucuacgccaucacccugaccuucaacgugggccagauccugcugaucagcgacuacuucuacgccuuccugagaagagaguacuaccugacccacggccuguaccugaccgccaaggacggcaccgaggccaugcuggugcugaaguaa

SEQ ID NO: 21527 - RNA, 1515 nt, Artificial Sequence
  PIGW__Homo_sapiens__NP_848612
augagcgagaagcagaugaaggaggccuucgugagcaaccugaacggcaccaccgugcuggagaucacccagggccugugcuuccccgccuucugcauccugugcagaggcuuccugaucaucuucagccaguaccugugcagcuucagccccaccuggaagaccagauuccugaccgacuucguggugcugaucgugcccaugguggccacccugaccaucugggccagcuucauccugcuggagcugcugggcgugaucaucuucggcgccggccugcuguaccagaucuacagaagaagaaccugcuacgccagacugcccuuccugaagauccuggagaaguuccugaacaucagccuggagagcgaguacaaccccgccaucagcugcuucagagugaucaccagcgccuucaccgccaucgccauccuggccguggacuucccccuguuccccagaagauucgccaagaccgagcuguacggcaccggcgccauggacuucggcgugggcggcuucguguucggcagcgccauggugugccuggaggugagaagaagaaaguacauggagggcagcaagcugcacuacuucaccaacagccuguacagcguguggccccugguguuccugggcaucggcagacuggccaucaucaagagcaucggcuaccaggagcaccugaccgaguacggcgugcacuggaacuucuucuucaccaucaucguggugaagcugaucaccccccugcugcugaucaucuucccccugaacaagagcuggaucaucgcccugggcaucaccgugcuguaccagcuggcccuggacuucaccagccugaagagacugauccuguacggcaccgacggcagcggcaccagagugggccugcugaacgccaacagagagggcaucaucagcacccugggcuacguggccauccacauggccggcgugcagaccggccuguacaugcacaagaacagaagccacaucaaggaccugaucaagguggccugcuuccugcugcuggccgccaucagccuguucaucagccuguacguggugcaggugaacguggaggccgugagcagaagaauggccaaccuggccuucugcaucuggaucguggccagcagccugauccugcugagcagccugcugcugggcgacaucauccugagcuucgccaaguuccugaucaagggcgcccuggugcccugcagcuggaagcugauccagagccccgugaccaacaagaagcacagcgagagccuggugcccgaggccgagagaauggagcccagccugugccugaucaccgcccugaacagaaagcagcugaucuucuuccugcugagcaacaucaccaccggccugaucaaccugaugguggacacccugcacagcagcacccugugggcccuguucguggugaaccuguacauguucagcaacugccugaucguguacgugcuguaccugcaggacaagaccgugcaguucugguaa

SEQ ID NO: 21528 - RNA, 216 nt, Artificial Sequence
  PIGY__Homo_sapiens__NP_001036081
auguuccugagccugcccacccugaccgugcugaucccccuggugagccuggccggccuguucuacagcgccagcguggaggagaacuucccccagggcugcaccagcaccgccagccugugcuucuacagccugcugcugcccaucaccauccccguguacguguucuuccaccuguggaccuggaugggcaucaagcuguucagacacaacuaa

SEQ ID NO: 21529 - RNA, 873 nt, Artificial Sequence
  PIH1D1__Homo_sapiens__NP_060386
auggccaaccccaagcugcugggcaugggccugagcgaggccgaggccaucggcgccgacagcgccagauucgaggagcugcugcugcaggccagcaaggagcugcagcaggcccagaccaccagacccgagagcacccagauccagccccagcccggcuucugcaucaagaccaacagcagcgagggcaagguguucaucaacaucugccacagccccagcauccccccccccgccgacgugaccgaggaggagcugcugcagaugcuggaggaggaccaggccggcuucagaauccccaugagccugggcgagccccacgccgagcuggacgccaagggccagggcugcaccgccuacgacguggccgugaacagcgacuucuacagaagaaugcagaacagcgacuuccugagagagcuggugaucaccaucgccagagagggccuggaggacaaguacaaccugcagcugaaccccgaguggagaaugaugaagaacagacccuucaugggcagcaucagccagcagaacaucagaagcgagcagagacccagaauccaggagcugggcgaccuguacacccccgcccccggcagagccgagagcggccccgagaagccccaccugaaccuguggcuggaggcccccgaccugcugcuggccgagguggaccugcccaagcuggacggcgcccugggccugagccuggagaucggcgagaacagacuggugaugggcggcccccagcagcuguaccaccuggacgccuacaucccccugcagaucaacagccacgagagcaaggccgccuuccacagaaagagaaagcagcugaugguggccaugccccugcugcccgugcccagcuaa

SEQ ID NO: 21530 - RNA, 2418 nt, Artificial Sequence
  PIK3AP1__Homo_sapiens__NP_689522
auggccgccagcggcgugcccagaggcugcgacauccugaucguguacagccccgacgccgaggaguggugccaguaccugcagacccuguuccugagcagcagacaggugagaagccagaagauccugacccacagacugggccccgaggccagcuucagcgccgaggaccugagccuguuccugagcaccagaugcgugguggugcugcugagcgccgagcuggugcagcacuuccacaagcccgcccugcugccccugcugcagagagccuuccaccccccccacagaguggugagacugcugugcggcgugagagacagcgaggaguuccuggacuucuuccccgacugggcccacuggcaggagcugaccugcgacgacgagcccgagaccuacguggccgccgugaagaaggccaucagcgaggacagcggcugcgacagcgugaccgacaccgagcccgaggacgagaagguggugagcuacagcaagcagcagaaccugcccaccgugaccagccccggcaaccugaugguggugcagcccgacagaaucagaugcggcgccgagaccaccguguacgugaucgugagaugcaagcuggacgacagaguggccaccgaggccgaguucagccccgaggacagccccagcgugagaauggaggccaagguggagaacgaguacaccaucagcgugaaggcccccaaccugagcagcggcaacgugagccugaagaucuacagcggcgaccugguggugugcgagaccgugaucagcuacuacaccgacauggaggagaucggcaaccugcugagcaacgccgccaaccccguggaguucaugugccaggccuucaagaucgugcccuacaacaccgagacccuggacaagcugcugaccgagagccugaagaacaacauccccgccagcggccugcaccuguucggcaucaaccagcuggaggaggaggacaugaugaccaaccagagagacgaggagcugcccacccugcugcacuucgccgccaaguacggccugaagaaccugaccgcccugcugcugaccugccccggcgcccugcaggccuacagcguggccaacaagcacggccacuaccccaacaccaucgccgagaagcacggcuucagagaccugagacaguucaucgacgaguacguggagaccguggacaugcugaagagccacaucaaggaggagcugaugcacggcgaggaggccgacgccguguacgagagcauggcccaccugagcaccgaccugcugaugaagugcagccugaaccccggcugcgacgaggaccuguacgagagcauggccgccuucgugcccgccgccaccgaggaccuguacguggagaugcugcaggccagcaccagcaaccccauccccggcgacggcuucagcagagccaccaaggacagcaugaucagaaaguuccuggagggcaacagcaugggcaugaccaaccuggagagagaccagugccaccugggccaggaggaggacguguaccacaccguggacgacgacgaggccuucagcguggaccuggccagcagaccccccgugcccgugcccagacccgagaccaccgcccccggcgcccaccagcugcccgacaacgagcccuacaucuucaagguguucgccgagaagagccaggagagacccggcaacuucuacgugagcagcgagagcaucagaaagggcccccccgugagacccuggagagacagaccccagagcagcaucuacgaccccuucgccggcaugaagacccccggccagagacagcugaucacccugcaggagcaggugaagcugggcaucgugaacguggacgaggccgugcugcacuucaaggaguggcagcugaaccagaagaagagaagcgagagcuucagauuccagcaggagaaccugaagagacugagagacagcaucaccagaagacagagagagaagcagaagagcggcaagcagaccgaccuggagaucaccgugcccaucagacacagccagcaccugcccgccaagguggaguucggcguguacgagagcggccccagaaagagcgugaucccccccagaaccgagcugagaagaggcgacuggaagaccgacagcaccagcagcaccgccagcagcaccagcaacagaagcagcaccagaagccugcugagcgugagcagcggcauggagggcgacaacgaggacaacgaggugcccgaggugaccagaagcagaagccccggccccccccagguggacggcacccccaccaugagccuggagagaccccccagagugccccccagagccgccagccagagaccccccaccagagagaccuuccacccccccccccccgugccccccagaggcagauaa

SEQ ID NO: 21531 - RNA, 5061 nt, Artificial Sequence
  PIK3C2A__Homo_sapiens__NP_002636
auggcccagaucagcagcaacagcggcuucaaggagugccccagcagccaccccgagcccaccagagccaaggacguggacaaggaggaggcccugcagauggaggccgaggcccuggccaagcugcagaaggacagacaggugaccgacaaccagagaggcuucgagcugagcagcagcaccagaaagaaggcccagguguacaacaagcaggacuacgaccugaugguguuccccgagagcgacagccagaagagagcccuggacaucgacguggagaagcugacccaggccgagcuggagaagcugcugcuggacgacagcuucgagaccaagaagacccccgugcugcccgugacccccauccugagccccagcuucagcgcccagcuguacuucagacccaccauccagagaggccaguggccccccggccugcccggccccagcaccuacgcccugcccagcaucuaccccagcaccuacagcaagcaggccgccuuccagaacggcuucaaccccagaaugcccaccuuccccagcaccgagcccaucuaccugagccugcccggccagagccccuacuucagcuacccccugacccccgccacccccuuccacccccagggcagccugcccaucuacagacccguggugagcaccgacauggccaagcuguucgacaagaucgccagcaccagcgaguuccugaagaacggcaaggccagaaccgaccuggagaucaccgacagcaaggugagcaaccugcaggugagccccaagagcgaggacaucagcaaguucgacuggcuggaccuggacccccugagcaagcccaagguggacaacguggaggugcuggaccacgaggaggagaagaacgugagcagccugcuggccaaggaccccugggacgccgugcugcuggaggagagaagcaccgccaacugccaccuggagagaaaggugaacggcaagagccugagcguggccaccgugaccagaagccagagccugaacaucagaaccacccagcuggccaaggcccagggccacaucagccagaaggaccccaacggcaccagcagccugcccaccggcagcagccugcugcaggagguggaggugcagaacgaggagauggccgccuucugcagaagcaucaccaagcugaagaccaaguuccccuacaccaaccacagaaccaaccccggcuaccugcugagccccgugaccgcccagagaaacaucugcggcgagaacgccagcgugaaggugagcaucgacaucgagggcuuccagcugcccgugaccuucaccugcgacgugagcagcaccguggagaucaucaucaugcaggcccugugcugggugcacgacgaccugaaccagguggacgugggcagcuacgugcugaaggugugcggccaggaggaggugcugcagaacaaccacugccugggcagccacgagcacauccagaacugcagaaagugggacaccgagaucagacugcagcugcugaccuucagcgccaugugccagaaccuggccagaaccgccgaggacgacgagacccccguggaccugaacaagcaccuguaccagaucgagaagcccugcaaggaggccaugaccagacaccccguggaggagcugcuggacagcuaccacaaccagguggagcuggcccugcagaucgagaaccagcacagagccguggaccaggugaucaaggccgugagaaagaucugcagcgcccuggacggcguggagacccuggccaucaccgagagcgugaagaagcugaagagagccgugaaccugcccagaagcaagaccgccgacgugaccagccuguucggcggcgaggacaccagcagaagcagcaccagaggcagccugaaccccgagaaccccgugcaggugagcaucaaccagcugaccgccgccaucuacgaccugcugagacugcacgccaacagcggcagaagccccaccgacugcgcccagagcagcaagagcgugaaggaggccuggaccaccaccgagcagcugcaguucaccaucuucgccgcccacggcaucagcagcaacugggugagcaacuacgagaaguacuaccugaucugcagccugagccacaacggcaaggaccuguucaagcccauccagagcaagaaggugggcaccuacaagaacuucuucuaccugaucaagugggacgagcugaucaucuuccccauccagaucagccagcugccccuggagagcgugcugcaccugacccuguucggcauccugaaccagagcagcggcagcagccccgacagcaacaagcagagaaagggccccgaggcccugggcaaggugagccugccccuguucgacuucaagagauuccugaccugcggcaccaagcugcuguaccuguggaccagcagccacaccaacagcgugcccggcaccgugaccaagaagggcuacgugauggagagaaucgugcugcagguggacuuccccagccccgccuucgacaucaucuacaccaccccccagguggacagaagcaucauccagcagcacaaccuggagacccuggagaacgacaucaagggcaagcugcuggacauccugcacaaggacagcagccugggccugagcaaggaggacaaggccuuccugugggagaagagauacuacugcuucaagcaccccaacugccugcccaagauccuggccagcgcccccaacuggaagugggugaaccuggccaagaccuacagccugcugcaccaguggcccgcccuguacccccugaucgcccuggagcugcuggacagcaaguucgccgaccaggaggugagaagccuggccgugaccuggaucgaggccaucagcgacgacgagcugaccgaccugcugccccaguucgugcaggcccugaaguacgagaucuaccugaacagcagccuggugcaguuccugcugagcagagcccugggcaacauccagaucgcccacaaccuguacuggcugcugaaggacgcccugcacgacgugcaguucagcaccagauacgagcacgugcugggcgcccugcugagcgugggcggcaagagacugagagaggagcugcugaagcagaccaagcuggugcagcugcugggcggcguggccgagaaggugagacaggccagcggcagcgccagacagguggugcugcagagaagcauggagagagugcagagcuucuuccagaagaacaagugcagacugccccugaagcccagccugguggccaaggagcugaacaucaagagcugcagcuucuucagcagcaacgccgugccccugaaggugaccauggugaacgccgaccccaugggcgaggagaucaacgugauguucaaggugggcgaggaccugagacaggacaugcuggcccugcagaugaucaagaucauggacaagaucuggcugaaggagggccuggaccugagaauggugaucuucaagugccugagcaccggcagagacagaggcaugguggagcuggugcccgccagcgacacccugagaaagauccagguggaguacggcgugaccggcagcuucaaggacaagccccuggccgaguggcugagaaaguacaaccccagcgaggaggaguacgagaaggccagcgagaacuucaucuacagcugcgccggcugcugcguggccaccuacgugcugggcaucugcgacagacacaacgacaacaucaugcugagaagcaccggccacauguuccacaucgacuucggcaaguuccugggccacgcccagauguucggcagcuucaagagagacagagcccccuucgugcugaccagcgacauggccuacgugaucaacggcggcgagaagcccaccaucagauuccagcuguucguggaccugugcugccaggccuacaaccugaucagaaagcagaccaaccuguuccugaaccugcugagccugaugauccccagcggccugcccgagcugaccagcauccaggaccugaaguacgugagagacgcccugcagccccagaccaccgacgccgaggccaccaucuucuucaccagacugaucgagagcagccugggcagcaucgccaccaaguucaacuucuucauccacaaccuggcccagcugagauucagcggccugcccagcaacgacgagcccauccugagcuucagccccaagaccuacagcuucagacaggacggcagaaucaaggaggugagcguguucaccuaccacaagaaguacaaccccgacaagcacuacaucuacguggugagaauccugagagagggccagaucgagcccagcuucguguucagaaccuucgacgaguuccaggagcugcacaacaagcugagcaucaucuucccccuguggaagcugcccggcuuccccaacagaauggugcugggcagaacccacaucaaggacguggccgccaagagaaagaucgagcugaacagcuaccugcagagccugaugaacgccagcaccgacguggccgagugcgaccuggugugcaccuucuuccacccccugcugagagacgagaaggccgagggcaucgccagaagcgccgacgccggcagcuucagccccacccccggccagaucggcggcgccgugaagcugagcaucagcuacagaaacggcacccuguucaucauggugaugcacaucaaggaccuggugaccgaggacggcgccgaccccaaccccuacgugaagaccuaccugcugcccgacaaccacaagaccagcaagagaaagaccaagaucagcagaaagaccagaaaccccaccuucaacgagaugcugguguacagcggcuacagcaaggagacccugagacagagagagcugcagcugagcgugcugagcgccgagagccugagagagaacuucuuccugggcggcgugacccugccccugaaggacuucaaccugagcaaggagaccgugaagugguaccagcugaccgccgccaccuaccuguaa

SEQ ID NO: 21532 - RNA, 4905 nt, Artificial Sequence
  PIK3C2B__Homo_sapiens__NP_002637
augagcagcacccagggcaacggcgagcacuggaagagccuggagagcgugggcaucagcagaaaggagcuggccauggccgaggcccugcagauggaguacgacgcccugagcagacugagacacgacaaggaggagaacagagccaagcagaacgccgaccccagccugaucagcugggacgagcccggcguggacuucuacagcaagcccgccggcagaagaaccgaccugaagcugcugagaggccugagcggcagcgaccccacccugaacuacaacagccugagcccccaggagggcccccccaaccacagcaccagccagggcccccagcccggcagcgaccccuggcccaagggcagccugagcggcgacuaccuguacaucuucgacggcagcgacggcggcgugagcagcagccccggccccggcgacaucgagggcagcugcaagaagcugagcccccccccccugccccccagagccagcaucugggacacccccccccugccccccagaaagggcagccccagcagcagcaagaucagccagcccagcgacaucaacaccuucagccugguggagcagcugcccggcaagcugcuggagcacagaauccuggaggaggaggaggugcugggcggcggcggccagggcagacugcugggcagcguggacuacgacggcaucaacgacgccaucaccagacugaaccugaagagcaccuacgacgccgagaugcugagagacgccaccagaggcuggaaggagggcagaggcccccuggacuucagcaaggacaccagcggcaagcccguggccagaagcaagaccaugcccccccaggugccccccagaaccuacgccagcagauacggcaacagaaagaacgccacccccggcaagaacagaagaaucagcgccgcccccgugggcagcagaccccacaccguggccaacggccacgagcuguucgaggugagcgaggagagagacgaggagguggccgccuucugccacaugcuggacauccugagaagcggcagcgacauccaggacuacuuccugaccggcuacguguggagcgccgugacccccagccccgagcaccugggcgacgaggugaaccugaaggugaccgugcugugcgacagacugcaggaggcccugaccuucaccugcaacugcagcagcaccguggaccugcugaucuaccagacccugugcuacacccacgacgaccugagaaacguggacgugggcgacuucgugcugaagcccugcggccuggaggaguuccugcagaacaagcacgcccugggcagccacgaguacauccaguacugcagaaaguucgacaucgacaucagacugcagcugauggagcagaagguggugagaagcgaccuggccagaaccgugaacgacgaccagagccccagcacccugaacuaccuggugcaccugcaggagagacccgugaagcagaccaucagcagacaggcccugagccugcuguucgacaccuaccacaacgagguggacgccuuccugcuggccgacggcgacuucccccugaaggccgacagaguggugcagagcgugaaggccaucugcaacgcccuggccgccguggagacccccgagaucaccagcgcccugaaccagcugccccccugccccagcagaaugcagcccaagauccagaaggaccccagcgugcuggccgugagagagaacagagagaaggugguggaggcccugaccgccgccauccuggaccugguggagcuguacugcaacaccuucaacgccgacuuccagaccgccgugcccggcagcagaaagcacgaccuggugcaggaggccugccacuucgccagaagccuggccuucaccguguacgccacccacagaauccccaucaucugggccaccagcuacgaggacuucuaccugagcugcagccugagccacggcggcaaggagcugugcagcccccugcagaccagaagagcccacuucagcaaguaccuguuccaccugaucgugugggaccagcagaucugcuuccccgugcaggugaacagacugcccagagagacccugcugugcgccacccuguacgcccugcccauccccccccccggcagcagcagcgaggccaacaagcagagaagagugcccgaggcccugggcugggugaccaccccccuguucaacuucagacaggugcugaccugcggcagaaagcugcugggccuguggcccgccacccaggagaaccccagcgccagauggagcgcccccaacuuccaccagcccgacagcgugauccugcagaucgacuuccccaccagcgccuucgacaucaaguucaccagcccccccggcgacaaguucagccccagauacgaguucggcagccugagagaggaggaccagagaaagcugaaggacaucaugcagaaggagagccuguacuggcugaccgacgccgacaagaagagacugugggagaagagauacuacugccacagcgaggugagcagccugccccuggugcuggccagcgcccccagcugggagugggccugccugcccgacaucuacgugcugcugaagcaguggacccacaugaaccaccaggacgcccugggccugcugcacgccaccuuccccgaccaggaggugagaagaauggccgugcaguggaucggcagccugagcgacgccgagcugcuggacuaccugccccagcuggugcaggcccugaaguacgagugcuaccuggacagcccccuggugagauuccugcugaagagagccgugagcgaccugagagugacccacuacuucuucuggcugcugaaggacggccugaaggacagccaguucagcaucagauaccaguaccugcuggccgcccugcugugcugcugcggcaagggccugagagaggaguucaacagacagugcuggcuggugaacgcccuggccaagcuggcccagcaggugagagaggccgcccccagcgccagacagggcauccugagaaccggccuggaggaggugaagcaguucuucgcccugaacggcagcugcagacugccccugagccccagccugcuggugaagggcaucgugcccagagacugcagcuacuucaacagcaacgccgugccccugaagcugagcuuccagaacguggacccccugggcgagaacaucagagugaucuucaagugcggcgacgaccugagacaggacaugcugacccugcagaugaucagaaucaugagcaagaucugggugcaggagggccuggacaugagaauggugaucuucagaugcuucagcaccggcagaggcagaggcaugguggagaugauccccaacgccgagacccugagaaagauccagguggagcacggcgugaccggcagcuucaaggacagaccccuggccgacuggcugcagaagcacaaccccggcgaggacgaguacgagaaggccguggagaacuucaucuacagcugcgccggcugcugcguggccaccuacgugcugggcaucugcgacagacacaacgacaacaucaugcugaagaccaccggccacauguuccacaucgacuucggcagauuccugggccacgcccagauguucggcaacaucaagagagacagagcccccuucguguucaccagcgacauggccuacgugaucaacggcggcgacaagcccagcagcagauuccacgacuucguggaccugugcugccaggccuacaaccugaucagaaagcacacccaccuguuccugaaccugcugggccugaugcugagcugcggcauccccgagcugagcgaccuggaggaccugaaguacguguacgacgcccugagaccccaggacaccgaggccaacgccaccaccuacuucaccagacugaucgagagcagccugggcagcguggccaccaagcugaacuucuucauccacaaccuggcccagaugaaguucaccggcagcgacgacagacugacccugagcuucgccagcagaacccacacccugaagagcagcggcagaaucagcgacguguuccugugcagacacgagaagaucuuccaccccaacaagggcuacaucuacguggugaaggugaugagagagaacacccacgaggccaccuacauccagagaaccuucgaggaguuccaggagcugcacaacaagcugagacugcuguuccccagcagccaccugcccagcuuccccagcagauucgugaucggcagaagcagaggcgaggccguggccgagagaagaagagaggagcugaacggcuacaucuggcaccugauccacgccccccccgagguggccgagugcgaccugguguacaccuucuuccacccccugcccagagacgagaaggccaugggcaccagccccgcccccaagagcagcgacggcaccugggccagacccgugggcaaggugggcggcgaggugaagcugagcaucagcuacaagaacaacaagcuguucaucauggugaugcacaucagaggccugcagcugcugcaggacggcaacgaccccgaccccuacgugaagaucuaccugcugcccgacccccagaagaccaccaagagaaagaccaagguggccagaaagaccugcaaccccaccuacaacgagaugcugguguacgacggcauccccaagggcgaccugcagcagagagagcugcagcugagcgugcugagcgagcagggcuucugggagaacgugcugcugggcgaggugaacaucagacugagagagcuggaccuggcccaggagaagaccggcugguucgcccugggcagcagaagccacggcacccuguaa

SEQ ID NO: 21533 - RNA, 4461 nt, Artificial Sequence
  PIK3C2G__Homo_sapiens__NP_001275701
auggccuacagcuggcagaccgaccccaaccccaacgagagccacgagaagcaguacgagcaccaggaguuccuguucgugaaccagccccacagcagcagccaggugagccugggcuucgaccagaucguggacgagaucagcggcaagaucccccacuacgagagcgagaucgacgagaacaccuucuucgugcccaccgcccccaagugggacagcaccggccacagccugaacgaggcccaccagaucagccugaacgaguucaccagcaagagcagagagcugagcuggcaccaggugagcaaggcccccgccaucggcuucagccccagcgugcugcccaagccccagaacaccaacaaggagugcagcuggggcagccccaucggcaagcaccacggcgccgacgacagcagauucagcauccuggcccccagcuucaccagccuggacaagaucaaccuggagaaggagcuggagaacgagaaccacaacuaccacaucggcuucgagagcagcaucccccccaccaacagcagcuucagcagcgacuucaugcccaaggaggagaacaagagaagcggccacgugaacaucguggagcccagccugaugcugcugaagggcagccugcagcccggcaugugggagagcaccuggcagaagaacaucgagagcaucggcugcagcauccagcugguggaggugccccagagcagcaacaccagccuggccagcuucugcaacaaggugaagaagaucagagagagauaccacgccgccgacgugaacuucaacagcggcaagaucuggagcaccaccaccgccuuccccuaccagcuguucagcaagaccaaguucaacauccacaucuucaucgacaacagcacccagccccugcacuucaugcccugcgccaacuaccuggugaaggaccugaucgccgagauccugcacuucugcaccaacgaccagcugcugcccaaggaccacauccugagcgugugcggcagcgaggaguuccugcagaacgaccacugccugggcagccacaagauguuccagaaggacaagagcgugauccagcugcaccugcagaagagcagagaggcccccggcaagcugagcagaaagcacgaggaggaccacagccaguucuaccugaaccagcugcuggaguucaugcacaucuggaaggugagcagacagugccugcugacccugaucagaaaguacgacuuccaccugaaguaccugcugaagacccaggagaacguguacaacaucaucgaggaggugaagaagaucugcagcgugcugggcugcguggagaccaagcagaucaccgacgccgugaacgagcugagccugauccugcagagaaagggcgagaacuucuaccagagcagcgagaccagcgccaagggccugaucgagaaggugaccaccgagcugagcaccagcaucuaccagcugaucaacguguacugcaacagcuucuacgccgacuuccagcccgugaacgugcccagaugcaccagcuaccugaaccccggccugcccagccaccugagcuucaccguguacgccgcccacaacauccccgagaccugggugcacagcuacaaggccuucagcuucaccugcuggcugaccuacgccggcaagaagcugugccaggugagaaacuacagaaacauccccgacaagaagcuguucuucuuccuggugaacuggaacgagaccaucaacuucccccuggagaucaagagccugcccagagagagcaugcugaccgugaagcuguucggcaucgccugcgccaccaacaacgccaaccugcuggccuggaccugccugccccuguuccccaaggagaagagcauccugggcagcaugcuguucagcaugacccugcagagcgagccccccguggagaugaucacccccggcgugugggacgugagccagcccagccccgugacccugcagaucgacuuccccgccaccggcugggaguacaugaagcccgacagcgaggagaacagaagcaaccuggaggagccccugaaggagugcaucaagcacaucgccagacugagccagaagcagaccccccugcugcugagcgaggagaagaagagauaccugugguucuacagauucuacugcaacaacgagaacugcagccugccccuggugcugggcagcgcccccggcugggacgagagaaccgugagcgagaugcacaccauccugagaagauggaccuucagccagccccuggaggcccugggccugcugaccagcagcuuccccgaccaggagaucagaaagguggccgugcagcagcuggacaaccugcugaacgacgagcugcuggaguaccugccccagcuggugcaggccgugaaguucgaguggaaccuggagagcccccuggugcagcugcugcugcacagaagccugcagagcauccagguggcccacagacuguacuggcugcugaagaacgccgagaacgaggccuacuucaagagcugguaccagaagcugcuggccgcccugcaguucugcgccggcaaggcccugaacgacgaguucagcaaggagcagaagcugaucaagauccugggcgacaucggcgagagagugaagagcgccagcgaccaccagagacaggaggugcugaagaaggagaucggcagacuggaggaguucuuccaggacgugaacaccugccaccugccccugaaccccgcccugugcaucaagggcaucgaccacgacgccugcagcuacuucaccagcaacgcccugccccugaagaucaccuucaucaacgccaaccccaugggcaagaacaucagcaucaucuucaaggccggcgacgaccugagacaggacaugcuggugcugcagcugauccaggugauggacaacaucuggcugcaggagggccuggacaugcagaugaucaucuacagaugccugagcaccggcaaggaccagggccuggugcagauggugcccgacgccgugacccuggccaagauccacagacacagcggccugaucggcccccugaaggagaacaccaucaagaagugguucagccagcacaaccaccugaaggccgacuacgagaaggcccugagaaacuucuucuacagcugcgccggcuggugcguggugaccuucauccugggcgugugcgacagacacaacgacaacaucaugcugaccaagagcggccacauguuccacaucgacuucggcaaguuccugggccacgcccagaccuucggcggcaucaagagagacagagcccccuucaucuucaccagcgagauggaguacuucaucaccgagggcggcaagaacccccagcacuuccaggacuucguggagcugugcugcagagccuacaacaucaucagaaagcacagccagcugcugcugaaccugcuggagaugaugcuguacgccggccugcccgagcugagcggcauccaggaccugaaguacguguacaacaaccugagaccccaggacaccgaccuggaggccaccagccacuucaccaagaagaucaaggagagccuggagugcuuccccgugaagcugaacaaccugauccacacccuggcccagaugagcgccaucagccccgccaagagcaccagccagaccuucccccaggagagcugccugcugagcaccaccagaagcaucgagagagccaccauccugggcuucagcaagaagagcagcaaccuguaccugauccaggugacccacagcaacaacgagaccagccugaccgagaagagcuucgagcaguucagcaagcugcacagccagcugcagaagcaguucgccagccugacccugcccgaguucccccacugguggcaccugcccuucaccaacagcgaccacagaagauucagagaccugaaccacuacauggagcagauccugaacgugagccacgaggugaccaacagcgacugcgugcugagcuucuuccugagcgaggccgugcagcagaccguggaggagagcagccccguguaccugggcgagaaguuccccgacaagaagcccaaggugcagcuggugaucagcuacgaggacgugaagcugaccauccuggugaagcacaugaagaacauccaccugcccgacggcagcgcccccagcgcccacguggaguucuaccugcugcccuaccccagcgaggugagaagaagaaagaccaagagcgugcccaagugcaccgaccccaccuacaacgagaucgugguguacgacgaggugaccgagcugcagggccacgugcugaugcugaucgugaagagcaagaccguguucgugggcgccaucaacaucagacugugcagcgugccccuggacaaggagaagugguacccccugggcaacagcaucaucuaa

SEQ ID NO: 21534 - RNA, 2664 nt, Artificial Sequence
  PIK3C3__Homo_sapiens__NP_002638
augggcgaggccgagaaguuccacuacaucuacagcugcgaccuggacaucaacgugcagcugaagaucggcagccuggagggcaagagagagcagaagagcuacaaggccgugcuggaggaccccaugcugaaguucagcggccuguaccaggagaccugcagcgaccuguacgugaccugccagguguucgccgagggcaagccccuggcccugcccgugagaaccagcuacaaggccuucagcaccagauggaacuggaacgaguggcugaagcugcccgugaaguaccccgaccugcccagaaacgcccagguggcccugaccaucugggacguguacggccccggcaaggccgugcccgugggcggcaccaccgugagccuguucggcaaguacggcauguucagacagggcaugcacgaccugaagguguggcccaacguggaggccgacggcagcgagcccaccaagacccccggcagaaccagcagcacccugagcgaggaccagaugagcagacuggccaagcugaccaaggcccacagacagggccacauggugaagguggacuggcuggacagacugaccuucagagagaucgagaugaucaacgagagcgagaagagaagcagcaacuucauguaccugaugguggaguucagaugcgugaagugcgacgacaaggaguacggcaucguguacuacgagaaggacggcgacgagagcagccccauccugaccagcuucgagcuggugaaggugcccgacccccagaugagcauggagaaccugguggagagcaagcaccacaagcuggccagaagccugagaagcggccccagcgaccacgaccugaagcccaacgccgccaccagagaccagcugaacaucaucgugagcuacccccccaccaagcagcugaccuacgaggagcaggaccugguguggaaguucagauacuaccugaccaaccaggagaaggcccugaccaaguuccugaagugcgugaacugggaccugccccaggaggccaagcaggcccuggagcugcugggcaaguggaagcccauggacguggaggacagccuggagcugcugagcagccacuacaccaaccccaccgugagaagauacgccguggccagacugagacaggccgacgacgaggaccugcugauguaccugcugcagcuggugcaggcccugaaguacgagaacuucgacgacaucaagaacggccuggagcccaccaagaaggacagccagagcagcgugagcgagaacgugagcaacagcggcaucaacagcgccgagaucgacagcagccagaucaucaccagcccccugcccagcgugagcagccccccccccgccagcaagaccaaggaggugcccgacggcgagaaccuggagcaggaccugugcaccuuccugaucagcagagccugcaagaacagcacccuggccaacuaccuguacugguacgugaucguggagugcgaggaccaggacacccagcagagagaccccaagacccacgagauguaccugaacgugaugagaagauucagccaggcccugcugaagggcgacaagagcgugagagugaugagaagccugcuggccgcccagcagaccuucguggacagacuggugcaccugaugaaggccgugcagagagagagcggcaacagaaagaagaagaacgagagacugcaggcccugcugggcgacaacgagaagaugaaccugagcgacguggagcugaucccccugccccuggagccccaggugaagaucagaggcaucauccccgagaccgccacccuguucaagagcgcccugaugcccgcccagcuguucuucaagaccgaggacggcggcaaguaccccgugaucuucaagcacggcgacgaccugagacaggaccagcugauccugcagaucaucagccugauggacaagcugcugagaaaggagaaccuggaccugaagcugacccccuacaaggugcuggccaccagcaccaagcacggcuucaugcaguucauccagagcgugcccguggccgaggugcuggacaccgagggcagcauccagaacuucuucagaaaguacgcccccagcgagaacggccccaacggcaucagcgccgaggugauggacaccuacgugaagagcugcgccggcuacugcgugaucaccuacauccugggcgugggcgacagacaccuggacaaccugcugcugaccaagaccggcaagcuguuccacaucgacuucggcuacauccugggcagagaccccaagccccugcccccccccaugaagcugaacaaggagaugguggagggcaugggcggcacccagagcgagcaguaccaggaguucagaaagcagugcuacaccgccuuccugcaccugagaagauacagcaaccugauccugaaccuguucagccugaugguggacgccaacauccccgacaucgcccuggagcccgacaagaccgugaagaaggugcaggacaaguucagacuggaccugagcgacgaggaggccgugcacuacaugcagagccugaucgacgagagcgugcacgcccuguucgccgccgugguggagcagauccacaaguucgcccaguacuggagaaaguaa

SEQ ID NO: 21535 - RNA, 3207 nt, Artificial Sequence
  PIK3CA__Homo_sapiens__NP_006209
augccccccagacccagcagcggcgagcuguggggcauccaccugaugccccccagaauccugguggagugccugcugcccaacggcaugaucgugacccuggagugccugagagaggccacccugaucaccaucaagcacgagcuguucaaggaggccagaaaguacccccugcaccagcugcugcaggacgagagcagcuacaucuucgugagcgugacccaggaggccgagagagaggaguucuucgacgagaccagaagacugugcgaccugagacuguuccagcccuuccugaaggugaucgagcccgugggcaacagagaggagaagauccugaacagagagaucggcuucgccaucggcaugcccgugugcgaguucgacauggugaaggaccccgaggugcaggacuucagaagaaacauccugaacgugugcaaggaggccguggaccugagagaccugaacagcccccacagcagagccauguacguguacccccccaacguggagagcagccccgagcugcccaagcacaucuacaacaagcuggacaagggccagaucaucguggugaucugggugaucgugagccccaacaacgacaagcagaaguacacccugaagaucaaccacgacugcgugcccgagcaggugaucgccgaggccaucagaaagaagaccagaagcaugcugcugagcagcgagcagcugaagcugugcgugcuggaguaccagggcaaguacauccugaaggugugcggcugcgacgaguacuuccuggagaaguacccccugagccaguacaaguacaucagaagcugcaucaugcugggcagaaugcccaaccugaugcugauggccaaggagagccuguacagccagcugcccauggacugcuucaccaugcccagcuacagcagaagaaucagcaccgccacccccuacaugaacggcgagaccagcaccaagagccugugggugaucaacagcgcccugagaaucaagauccugugcgccaccuacgugaacgugaacaucagagacaucgacaagaucuacgugagaaccggcaucuaccacggcggcgagccccugugcgacaacgugaacacccagagagugcccugcagcaaccccagauggaacgaguggcugaacuacgacaucuacauccccgaccugcccagagccgccagacugugccugagcaucugcagcgugaagggcagaaagggcgccaaggaggagcacugcccccuggccuggggcaacaucaaccuguucgacuacaccgacacccuggugagcggcaagauggcccugaaccuguggcccgugccccacggccuggaggaccugcugaaccccaucggcgugaccggcagcaaccccaacaaggagacccccugccuggagcuggaguucgacugguucagcagcguggugaaguuccccgacaugagcgugaucgaggagcacgccaacuggagcgugagcagagaggccggcuucagcuacagccacgccggccugagcaacagacuggccagagacaacgagcugagagagaacgacaaggagcagcugaaggccaucagcaccagagacccccugagcgagaucaccgagcaggagaaggacuuccuguggagccacagacacuacugcgugaccauccccgagauccugcccaagcugcugcugagcgugaaguggaacagcagagacgagguggcccagauguacugccuggugaaggacuggccccccaucaagcccgagcaggccauggagcugcuggacugcaacuaccccgaccccauggugagaggcuucgccgugagaugccuggagaaguaccugaccgacgacaagcugagccaguaccugauccagcuggugcaggugcugaaguacgagcaguaccuggacaaccugcuggugagauuccugcugaagaaggcccugaccaaccagagaaucggccacuucuucuucuggcaccugaagagcgagaugcacaacaagaccgugagccagagauucggccugcugcuggagagcuacugcagagccugcggcauguaccugaagcaccugaacagacagguggaggccauggagaagcugaucaaccugaccgacauccugaagcaggagaagaaggacgagacccagaaggugcagaugaaguuccugguggagcagaugagaagacccgacuucauggacgcccugcagggcuuccugagcccccugaaccccgcccaccagcugggcaaccugagacuggaggagugcagaaucaugagcagcgccaagagaccccuguggcugaacugggagaaccccgacaucaugagcgagcugcuguuccagaacaacgagaucaucuucaagaacggcgacgaccugagacaggacaugcugacccugcagaucaucagaaucauggagaacaucuggcagaaccagggccuggaccugagaaugcugcccuacggcugccugagcaucggcgacugcgugggccugaucgagguggugagaaacagccacaccaucaugcagauccagugcaagggcggccugaagggcgcccugcaguucaacagccacacccugcaccaguggcugaaggacaagaacaagggcgagaucuacgacgccgccaucgaccuguucaccagaagcugcgccggcuacugcguggccaccuucauccugggcaucggcgacagacacaacagcaacaucauggugaaggacgacggccagcuguuccacaucgacuucggccacuuccuggaccacaagaagaagaaguucggcuacaagagagagagagugcccuucgugcugacccaggacuuccugaucgugaucagcaagggcgcccaggagugcaccaagaccagagaguucgagagauuccaggagaugugcuacaaggccuaccuggccaucagacagcacgccaaccuguucaucaaccuguucagcaugaugcugggcagcggcaugcccgagcugcagagcuucgacgacaucgccuacaucagaaagacccuggcccuggacaagaccgagcaggaggcccuggaguacuucaugaagcagaugaacgacgcccaccacggcggcuggaccaccaagauggacuggaucuuccacaccaucaagcagcacgcccugaacuaa

SEQ ID NO: 21536 - RNA, 3213 nt, Artificial Sequence
  PIK3CB__Homo_sapiens__NP_006210
augugcuucagcuucaucaugccccccgccauggccgacauccuggacaucugggccguggacagccagaucgccagcgacggcagcauccccguggacuuccugcugcccaccggcaucuacauccagcuggaggugcccagagaggccaccaucagcuacaucaagcagaugcuguggaagcaggugcacaacuaccccauguucaaccugcugauggacaucgacagcuacauguucgccugcgugaaccagaccgccguguacgaggagcuggaggacgagaccagaagacugugcgacgugagacccuuccugcccgugcugaagcuggugaccagaagcugcgaccccggcgagaagcuggacagcaagaucggcgugcugaucggcaagggccugcacgaguucgacagccugaaggaccccgaggugaacgaguucagaagaaagaugagaaaguucagcgaggagaagauccugagccuggugggccugagcuggauggacuggcugaagcagaccuacccccccgagcacgagcccagcauccccgagaaccuggaggacaagcuguacggcggcaagcugaucguggccgugcacuucgagaacugccaggacguguucagcuuccaggugagccccaacaugaaccccaucaaggugaacgagcuggccauccagaagagacugaccauccacggcaaggaggacgaggugagccccuacgacuacgugcugcaggugagcggcagaguggaguacguguucggcgaccacccccugauccaguuccaguacaucagaaacugcgugaugaacagagcccugccccacuucauccugguggagugcugcaagaucaagaagauguacgagcaggagaugaucgccaucgaggccgccaucaacagaaacagcagcaaccugccccugccccugccccccaagaagaccagaaucaucagccacgugugggagaacaacaaccccuuccagaucgugcuggugaagggcaacaagcugaacaccgaggagaccgugaaggugcacgugagagccggccuguuccacggcaccgagcugcugugcaagaccaucgugagcagcgaggugagcggcaagaacgaccacaucuggaacgagccccuggaguucgacaucaacaucugcgaccugcccagaauggccagacugugcuucgccguguacgccgugcuggacaaggugaagaccaagaagagcaccaagaccaucaaccccagcaaguaccagaccaucagaaaggccggcaaggugcacuaccccguggccugggugaacaccaugguguucgacuucaagggccagcugagaaccggcgacaucauccugcacagcuggagcagcuuccccgacgagcuggaggagaugcugaaccccaugggcaccgugcagaccaaccccuacaccgagaacgccaccgcccugcacgugaaguuccccgagaacaagaagcagcccuacuacuacccccccuucgacaagaucaucgagaaggccgccgagaucgccagcagcgacagcgccaacgugagcagcagaggcggcaagaaguuccugcccgugcugaaggagauccuggacagagacccccugagccagcugugcgagaacgagauggaccugaucuggacccugagacaggacugcagagagaucuucccccagagccugcccaagcugcugcugagcaucaaguggaacaagcuggaggacguggcccagcugcaggcccugcugcagaucuggcccaagcugccccccagagaggcccuggagcugcuggacuucaacuaccccgaccaguacgugagagaguacgccgugggcugccugagacagaugagcgacgaggagcugagccaguaccugcugcagcuggugcaggugcugaaguacgagcccuuccuggacugcgcccugagcagauuccugcuggagagagcccugggcaacagaagaaucggccaguuccuguucuggcaccugagaagcgaggugcacauccccgccgugagcgugcaguucggcgugauccuggaggccuacugcagaggcagcgugggccacaugaaggugcugagcaagcagguggaggcccugaacaagcugaagacccugaacagccugaucaagcugaacgccgugaagcugaacagagccaagggcaaggaggccaugcacaccugccugaagcagagcgccuacagagaggcccugagcgaccugcagagcccccugaaccccugcgugauccugagcgagcuguacguggagaagugcaaguacauggacagcaagaugaagccccuguggcugguguacaacaacaagguguucggcgaggacagcgugggcgugaucuucaagaacggcgacgaccugagacaggacaugcugacccugcagaugcugagacugauggaccugcuguggaaggaggccggccuggaccugagaaugcugcccuacggcugccuggccaccggcgacagaagcggccugaucgagguggugagcaccagcgagaccaucgccgacauccagcugaacagcagcaacguggccgccgccgccgccuucaacaaggacgcccugcugaacuggcugaaggaguacaacagcggcgacgaccuggacagagccaucgaggaguucacccugagcugcgccggcuacugcguggccagcuacgugcugggcaucggcgacagacacagcgacaacaucauggugaagaagaccggccagcuguuccacaucgacuucggccacauccugggcaacuucaagagcaaguucggcaucaagagagagagagugcccuucauccugaccuacgacuucauccacgugauccagcagggcaagaccggcaacaccgagaaguucggcagauucagacagugcugcgaggacgccuaccugauccugagaagacacggcaaccuguucaucacccuguucgcccugaugcugaccgccggccugcccgagcugaccagcgugaaggacauccaguaccugaaggacagccuggcccugggcaagagcgaggaggaggcccugaagcaguucaagcagaaguucgacgaggcccugagagagagcuggaccaccaaggugaacuggauggcccacaccgugagaaaggacuacagaagcuaa

SEQ ID NO: 21537 - RNA, 2487 nt, Artificial Sequence
  PIK3CD__Homo_sapiens__XP_011539885
auggccugcgcccugagaaagaaggccaccguguucagacagccccugguggagcagcccgaggacuacacccugcaggugaacggcagacacgaguaccuguacggcagcuacccccugugccaguuccaguacaucugcagcugccugcacagcggccugaccccccaccugaccauggugcacagcagcagcauccuggccaugagagacgagcagagcaaccccgccccccaggugcagaagcccagagccaagcccccccccauccccgccaagaagcccagcagcgugagccuguggagccuggagcagcccuucagaaucgagcugauccagggcagcaaggugaacgccgacgagagaaugaagcugguggugcaggccggccuguuccacggcaacgagaugcugugcaagaccgugagcagcagcgaggugagcgugugcagcgagcccguguggaagcagagacuggaguucgacaucaacaucugcgaccugcccagaauggccagacugugcuucgcccuguacgccgugaucgagaaggccaagaaggccagaagcaccaagaagaagagcaagaaggccgacugccccaucgccugggccaaccugaugcuguucgacuacaaggaccagcugaagaccggcgagagaugccuguacauguggcccagcgugcccgacgagaagggcgagcugcugaaccccaccggcaccgugagaagcaaccccaacaccgacagcgccgccgcccugcugaucugccugcccgagguggccccccaccccguguacuaccccgcccuggagaagauccuggagcugggcagacacagcgagugcgugcacgugaccgaggaggagcagcugcagcugagagagauccuggagagaagaggcagcggcgagcuguacgagcacgagaaggaccugguguggaagcugagacacgaggugcaggagcacuuccccgaggcccuggccagacugcugcuggugaccaaguggaacaagcacgaggacguggcccagaugcuguaccugcugugcagcuggcccgagcugcccgugcugagcgcccuggagcugcuggacuucagcuuccccgacugccacgugggcagcuucgccaucaagagccugagaaagcugaccgacgacgagcuguuccaguaccugcugcagcuggugcaggugcugaaguacgagagcuaccuggacugcgagcugaccaaguuccugcuggacagagcccuggccaacagaaagaucggccacuuccuguucuggcaccugagaagcgagaugcacgugcccagcguggcccugagauucggccugauccuggaggccuacugcagaggcagcacccaccacaugaaggugcugaugaagcagggcgaggcccugagcaagcugaaggcccugaacgacuucgugaagcugagcagccagaagacccccaagccccagaccaaggagcugaugcaccugugcaugagacaggaggccuaccuggaggcccugagccaccugcagagcccccuggaccccagcacccugcuggccgaggugugcguggagcagugcaccuucauggacagcaagaugaagccccuguggaucauguacagcaacgaggaggccggcagcggcggcagcgugggcaucaucuucaagaacggcgacgaccugagacaggacaugcugacccugcagaugauccagcugauggacgugcuguggaagcaggagggccuggaccugagaaugacccccuacggcugccugcccaccggcgacagaaccggccugaucgagguggugcugagaagcgacaccaucgccaacauccagcugaacaagagcaacauggccgccaccgccgccuucaacaaggacgcccugcugaacuggcugaagagcaagaaccccggcgaggcccuggacagagccaucgaggaguucacccugagcugcgccggcuacugcguggccaccuacgugcugggcaucggcgacagacacagcgacaacaucaugaucagagagagcggccagcuguuccacaucgacuucggccacuuccugggcaacuucaagaccaaguucggcaucaacagagagagagugcccuucauccugaccuacgacuucgugcacgugauccagcagggcaagaccaacaacagcgagaaguucgagagauucagaggcuacugcgagagagccuacaccauccugagaagacacggccugcuguuccugcaccuguucgcccugaugagagccgccggccugcccgagcugagcugcagcaaggacauccaguaccugaaggacagccuggcccugggcaagaccgaggaggaggcccugaagcacuucagagugaaguucaacgaggcccugagagagagcuggaagaccaaggugaacuggcuggcccacaacgugagcaaggacaacagacaguaa

SEQ ID NO: 21538 - RNA, 3309 nt, Artificial Sequence
  PIK3CG__Homo_sapiens__NP_001269355
auggagcuggagaacuacaagcagcccguggugcugagagaggacaacugcagaagaagaagaagaaugaagcccagaagcgccgccgccagccugagcagcauggagcugauccccaucgaguucgugcugcccaccagccagagaaagugcaagagccccgagaccgcccugcugcacguggccggccacggcaacguggagcagaugaaggcccagguguggcugagagcccuggagaccagcguggccgccgacuucuaccacagacugggcccccaccacuuccugcugcuguaccagaagaagggccagugguacgagaucuacgacaaguaccagguggugcagacccuggacugccugagauacuggaaggccacccacagaagccccggccagauccaccuggugcagagacacccccccagcgaggagagccaggccuuccagagacagcugaccgcccugaucggcuacgacgugaccgacgugagcaacgugcacgacgacgagcuggaguucaccagaagaggccuggugacccccagaauggccgagguggccagcagagaccccaagcuguacgccaugcaccccugggugaccagcaagccccugcccgaguaccuguggaagaagaucgccaacaacugcaucuucaucgugauccacagaagcaccaccagccagaccaucaaggugagccccgacgacacccccggcgccauccugcagagcuucuucaccaagauggccaagaagaagagccugauggacauccccgagagccagagcgagcaggacuucgugcugagagugugcggcagagacgaguaccuggugggcgagacccccaucaagaacuuccagugggugagacacugccugaagaacggcgaggagauccacguggugcuggacaccccccccgaccccgcccuggacgaggugagaaaggaggaguggccccugguggacgacugcaccggcgugaccggcuaccacgagcagcugaccauccacggcaaggaccacgagagcguguucaccgugagccugugggacugcgacagaaaguucagagugaagaucagaggcaucgacauccccgugcugcccagaaacaccgaccugaccguguucguggaggccaacauccagcacggccagcaggugcugugccagagaagaaccagccccaagcccuucaccgaggaggugcuguggaacguguggcuggaguucagcaucaagaucaaggaccugcccaagggcgcccugcugaaccugcagaucuacugcggcaaggcccccgcccugagcagcaaggccagcgccgagagccccagcagcgagagcaagggcaaggugcagcugcuguacuacgugaaccugcugcugaucgaccacagauuccugcugagaagaggcgaguacgugcugcacauguggcagaucagcggcaagggcgaggaccagggcagcuucaacgccgacaagcugaccagcgccaccaaccccgacaaggagaacagcaugagcaucagcauccugcuggacaacuacugccaccccaucgcccugcccaagcaccagcccacccccgaccccgagggcgacagagugagagccgagaugcccaaccagcugagaaagcagcuggaggccaucaucgccaccgacccccugaacccccugaccgccgaggacaaggagcugcuguggcacuucagauacgagagccugaagcaccccaaggccuaccccaagcuguucagcagcgugaaguggggccagcaggagaucguggccaagaccuaccagcugcuggccagaagagaggugugggaccagagcgcccuggacgugggccugaccaugcagcugcuggacugcaacuucagcgacgagaacgugagagccaucgccgugcagaagcuggagagccuggaggacgacgacgugcugcacuaccugcugcagcuggugcaggccgugaaguucgagcccuaccacgacagcgcccuggccagauuccugcugaagagaggccugagaaacaagagaaucggccacuuccuguucugguuccugagaagcgagaucgcccagagcagacacuaccagcagagauucgccgugauccuggaggccuaccugagaggcugcggcaccgccaugcugcacgacuucacccagcaggugcaggugaucgagaugcugcagaaggugacccuggacaucaagagccugagcgccgagaaguacgacgugagcagccaggugaucagccagcugaagcagaagcuggagaaccugcagaacagccagcugcccgagagcuucagagugcccuacgaccccggccugaaggccggcgcccuggccaucgagaagugcaaggugauggccagcaagaagaagccccuguggcuggaguucaagugcgccgaccccaccgcccugagcaacgagaccaucggcaucaucuucaagcacggcgacgaccugagacaggacaugcugauccugcagauccugagaaucauggagagcaucugggagaccgagagccuggaccugugccugcugcccuacggcugcaucagcaccggcgacaagaucggcaugaucgagaucgugaaggacgccaccaccaucgccaagauccagcagagcaccgugggcaacaccggcgccuucaaggacgaggugcugaaccacuggcugaaggagaagagccccaccgaggagaaguuccaggccgccguggagagauucguguacagcugcgccggcuacugcguggccaccuucgugcugggcaucggcgacagacacaacgacaacaucaugaucaccgagaccggcaaccuguuccacaucgacuucggccacauccugggcaacuacaagagcuuccugggcaucaacaaggagagagugcccuucgugcugacccccgacuuccuguucgugaugggcaccagcggcaagaagaccagcccccacuuccagaaguuccaggacaucugcgugaaggccuaccuggcccugagacaccacaccaaccugcugaucauccuguucagcaugaugcugaugaccggcaugccccagcugaccagcaaggaggacaucgaguacaucagagacgcccugaccgugggcaagaacgaggaggacgccaagaaguacuuccuggaccagaucgaggugugcagagacaagggcuggaccgugcaguucaacugguuccugcaccuggugcugggcaucaagcagggcgagaagcacagcgccuaa

SEQ ID NO: 21539 - RNA, 522 nt, Artificial Sequence
  PIK3IP1__Homo_sapiens__NP_001129383
augcugcuggccugggugcaggccuuccuggugagcaacaugcugcuggccgaggccuacggcagcggcggcugcuucugggacaacggccaccuguacagagaggaccagaccagccccgcccccggccugagaugccugaacuggcuggacgcccagagcggccuggccagcgcccccgugagcggcgccggcaaccacagcuacugcagaaaccccgacgaggaccccagaggccccuggugcuacgugagcggcgaggccggcgugcccgagaagagacccugcgaggaccugagaugccccgagaccaccagccaggcccugcccgccuucaccaccgagauccaggaggccagcgagggccccggcgccgacgaggugcagguguucgcccccgccaacgcccugcccgccagaagcgaggccgccgccgugcagcccgugaucggcaucagccagagagugagaaugaacagcaaggagaagaaggaccugggcacccugggcggcagaaucuaa

SEQ ID NO: 21540 - RNA, 1086 nt, Artificial Sequence
  PIK3R1__Homo_sapiens__NP_001229395
augcacggcgacuacacccugacccugagaaagggcggcaacaacaagcugaucaagaucuuccacagagacggcaaguacggcuucagcgacccccugaccuucagcagcgugguggagcugaucaaccacuacagaaacgagagccuggcccaguacaaccccaagcuggacgugaagcugcuguaccccgugagcaaguaccagcaggaccagguggugaaggaggacaacaucgaggccgugggcaagaagcugcacgaguacaacacccaguuccaggagaagagcagagaguacgacagacuguacgaggaguacaccagaaccagccaggagauccagaugaagagaaccgccaucgaggccuucaacgagaccaucaagaucuucgaggagcagugccagacccaggagagauacagcaaggaguacaucgagaaguucaagagagagggcaacgagaaggagauccagagaaucaugcacaacuacgacaagcugaagagcagaaucagcgagaucaucgacagcagaagaagacuggaggaggaccugaagaagcaggccgccgaguacagagagaucgacaagagaaugaacagcaucaagcccgaccugauccagcugagaaagaccagagaccaguaccugauguggcugacccagaagggcgugagacagaagaagcugaacgaguggcugggcaacgagaacaccgaggaccaguacagccugguggaggacgacgaggaccugccccaccacgacgagaagaccuggaacgugggcagcagcaacagaaacaaggccgagaaccugcugagaggcaagagagacggcaccuuccuggugagagagagcagcaagcagggcugcuacgccugcagcguggugguggacggcgaggugaagcacugcgugaucaacaagaccgccaccggcuacggcuucgccgagcccuacaaccuguacagcagccugaaggagcuggugcugcacuaccagcacaccagccuggugcagcacaacgacagccugaacgugacccuggccuaccccguguacgcccagcagagaagauaa

SEQ ID NO: 21541 - RNA, 2187 nt, Artificial Sequence
  PIK3R2__Homo_sapiens__NP_005018
auggccggccccgagggcuuccaguacagagcccuguaccccuucagaagagagagacccgaggaccuggagcugcugcccggcgacgugcugguggugagcagagccgcccugcaggcccugggcguggccgagggcggcgagagaugcccccagagcgugggcuggaugcccggccugaacgagagaaccagacagagaggcgacuuccccggcaccuacguggaguuccugggccccguggcccuggccagacccggccccagacccagaggccccagaccccugcccgccagacccagagacggcgcccccgagcccggccugacccugcccgaccugcccgagcaguucagcccccccgacguggcccccccccugcuggugaagcugguggaggccaucgagagaaccggccuggacagcgagagccacuacagacccgagcugcccgcccccagaaccgacuggagccugagcgacguggaccagugggacaccgccgcccuggccgacggcaucaagagcuuccugcuggcccugcccgccccccuggugacccccgaggccagcgccgaggccagaagagcccugagagaggccgccggccccgugggccccgcccuggagccccccacccugccccugcacagagcccugacccugagauuccugcugcagcaccugggcagaguggccagaagagcccccgcccugggccccgccgugagagcccugggcgccaccuucggcccccugcugcugagagccccccccccccccagcagccccccccccggcggcgcccccgacggcagcgagcccagccccgacuuccccgcccugcugguggagaagcugcugcaggagcaccuggaggagcaggagguggccccccccgcccugccccccaagccccccaaggccaagcccgcccccaccgugcuggccaacggcggcagcccccccagccugcaggacgccgagugguacuggggcgacaucagcagagaggaggugaacgagaagcugagagacacccccgacggcaccuuccuggugagagacgccagcagcaagauccagggcgaguacacccugacccugagaaagggcggcaacaacaagcugaucaagguguuccacagagacggccacuacggcuucagcgagccccugaccuucugcagcgugguggaccugaucaaccacuacagacacgagagccuggcccaguacaacgccaagcuggacaccagacugcuguaccccgugagcaaguaccagcaggaccagaucgugaaggaggacagcguggaggccgugggcgcccagcugaagguguaccaccagcaguaccaggacaagagcagagaguacgaccagcuguacgaggaguacaccagaaccagccaggagcugcagaugaagagaaccgccaucgaggccuucaacgagaccaucaagaucuucgaggagcagggccagacccaggagaagugcagcaaggaguaccuggagagauucagaagagagggcaacgagaaggagaugcagagaauccugcugaacagcgagagacugaagagcagaaucgccgagauccacgagagcagaaccaagcuggagcagcagcugagagcccaggccagcgacaacagagagaucgacaagagaaugaacagccugaagcccgaccugaugcagcugagaaagaucagagaccaguaccugguguggcugacccagaagggcgccagacagaagaagaucaacgaguggcugggcaucaagaacgagaccgaggaccaguacgcccugauggaggacgaggacgaccugccccaccacgaggagagaaccugguacgugggcaagaucaacagaacccaggccgaggagaugcugagcggcaagagagacggcaccuuccugaucagagagagcagccagagaggcugcuacgccugcagcguggugguggacggcgacaccaagcacugcgugaucuacagaaccgccaccggcuucggcuucgccgagcccuacaaccuguacggcagccugaaggagcuggugcugcacuaccagcacgccagccuggugcagcacaacgacgcccugaccgugacccuggcccaccccgugagagcccccggccccggccccccccccgccgccagauaa

SEQ ID NO: 21542 - RNA, 1524 nt, Artificial Sequence
  PIK3R3__Homo_sapiens__NP_001290356
augggccccagcagacuggugagaggccccagaccccagggcaugagaagccccuacagaagacccggcaugggcuggcccagacccagauuccccagaauguucaagugcagcagaagaagauaccagcagggccugagaggcagaaccgccagcagcgccgccaucaaccccgccaccagagccaugggcaucaacaacacccacaccgacaccaccaucguguggaucuuccccccccaggcccugccccccaagccccccaagcccaugaccagcgccgugcccaacggcaugaaggacagcagcgugagccugcaggacgccgagugguacuggggcgacaucagcagagaggaggugaacgacaagcugagagacaugcccgacggcaccuuccuggugagagacgccagcaccaagaugcagggcgacuacacccugacccugagaaagggcggcaacaacaagcugaucaagaucuaccacagagacggcaaguacggcuucagcgacccccugaccuucaacagcgugguggagcugaucaaccacuaccaccacgagagccuggcccaguacaaccccaagcuggacgugaagcugauguaccccgugagcagauaccagcaggaccagcuggugaaggaggacaacaucgacgccgugggcaagaagcugcaggaguaccacagccaguaccaggagaagagcaaggaguacgacagacuguacgaggaguacaccagaaccagccaggagauccagaugaagagaaccgccaucgaggccuucaacgagaccaucaagaucuucgaggagcagugccacacccaggagcagcacagcaaggaguacaucgagagauucagaagagagggcaacgagaaggagaucgagagaaucaugaugaacuacgacaagcugaagagcagacugggcgagauccacgacagcaagaugagacuggagcaggaccugaagaaccaggcccuggacaacagagagaucgacaagaagaugaacagcaucaagcccgaccugauccagcugagaaagaucagagaccagcaccugguguggcugaaccacaagggcgugagacagaagagacugaacguguggcugggcaucaagaacgaggacgccgacgagaacuacuucaucaacgaggaggacgagaaccugccccacuacgacgagaagaccugguucguggaggacaucaacagagugcaggccgaggaccugcuguacggcaagcccgacggcgccuuccugaucagagagagcagcaagaagggcugcuacgccugcagcgugguggccgacggcgaggugaagcacugcgugaucuacagcaccgccagaggcuacggcuucgccgagcccuacaaccuguacagcagccugaaggagcuggugcugcacuaccagcagaccagccuggugcagcacaacgacagccugaacgugagacuggccuaccccgugcacgcccagaugcccagccugugcagauaa

SEQ ID NO: 21543 - RNA, 4077 nt, Artificial Sequence
  PIK3R4__Homo_sapiens__NP_055417
augggcaaccagcuggccggcaucgcccccagccagauccugagcguggagagcuacuucagcgacauccacgacuucgaguacgacaagagccugggcagcaccagauucuucaagguggccagagccaagcacagagagggccuggugguggugaagguguucgccauccaggaccccacccugccccugaccagcuacaagcaggagcuggaggagcugaagaucagacugaacagcgcccagaacugccugcccuuccagaaggccagcgagaaggccagcgagaaggccgccaugcuguucagacaguacgugagagacaaccuguacgacagaaucagcaccagacccuuccugaacaacaucgagaagagauggaucgccuuccagauccugaccgccguggaccaggcccacaagagcggcgugagacacggcgacaucaagaccgagaacgugauggugaccagcuggaacugggugcugcugaccgacuucgccagcuucaagcccaccuaccugcccgaggacaaccccgccgacuucaacuacuucuucgacaccagcagaagaagaaccugcuacaucgcccccgagagauucguggacggcggcauguucgccaccgagcuggaguacaugagagaccccagcaccccccugguggaccugaacagcaaccagagaaccagaggcgagcugaagagagccauggacaucuucagcgccggcugcgugaucgccgagcuguucaccgagggcgugccccuguucgaccugagccagcugcuggccuacagaaacggccacuucuuccccgagcaggugcugaacaagaucgaggaccacagcaucagagagcuggugacccagaugauccacagagagcccgacaagagacuggaggccgaggacuaccugaagcagcagagaggcaacgccuuccccgagaucuucuacaccuuccugcagcccuacauggcccaguucgccaaggagaccuuccugagcgccgacgagagaauccuggugaucagaaaggaccugggcaacaucauccacaaccugugcggccacgaccugcccgagaaggccgagggcgagcccaaggagaacggccuggugauccuggugagcgugaucaccagcugccugcagacccugaaguacugcgacagcaagcuggccgcccuggagcugauccugcaccuggcccccagacugagcguggagauccugcuggacagaaucacccccuaccugcugcacuucagcaacgacagcgugcccagagugagagccgaggcccugagaacccugaccaaggugcuggcccuggugaaggaggugcccagaaacgacaucaacaucuaccccgaguacauccugcccggcaucgcccaccuggcccaggacgacgccaccaucgugagacuggccuacgccgagaacaucgcccugcuggccgagaccgcccugagauuccuggagcuggugcagcugaagaaccugaacauggagaacgaccccaacaacgaggagaucgacgaggugacccaccccaacggcaacuacgacaccgagcugcaggcccugcacgagauggugcagcagaagguggugacccugcugagcgaccccgagaacaucgugaagcagacccugauggagaacggcaucaccagacugugcguguucuucggcagacagaaggccaacgacgugcugcugagccacaugaucaccuuccugaacgacaagaacgacuggcaccugagaggcgccuucuucgacagcaucgugggcguggccgccuacgugggcuggcagagcagcagcauccugaagccccugcugcagcagggccugagcgacgccgaggaguucgugaucgugaaggcccuguacgcccugaccugcaugugccagcugggccugcugcagaagccccacguguacgaguucgccagcgacaucgcccccuuccugugccaccccaaccuguggaucagauacggcgccgugggcuucaucaccgugguggccagacagaucagcaccgccgacguguacugcaagcugaugcccuaccuggaccccuacaucacccagcccaucauccagaucgagagaaagcuggugcugcugagcgugcugaaggagcccgugagcagaagcaucuucgacuacgcccugagaagcaaggacaucaccagccuguucagacaccugcacaugagacagaagaagagaaacggcagccugcccgacugccccccccccgaggaccccgccaucgcccagcugcugaagaagcugcugagccagggcaugaccgaggaggaggaggacaagcugcuggcccugaaggacuucaugaugaagagcaacaaggccaaggccaacaucguggaccagagccaccugcacgacagcagccagaagggcgugaucgaccuggccgcccugggcaucaccggcagacagguggaccuggugaagaccaagcaggagcccgacgacaagagagccagaaagcacgugaagcaggacagcaacgugaacgaggaguggaagagcauguucggcagccuggacccccccaacaugccccaggcccugcccaagggcagcgaccaggaggugauccagaccggcaagccccccagaagcgagagcagcgccggcaucugcgugccccugagcaccagcagccaggugcccgaggugaccaccgugcagaacaagaagcccgugauccccgugcugagcagcaccauccugcccagcaccuaccagaucagaaucaccaccugcaagaccgagcugcagcagcugauccagcagaagagagagcagugcaacgccgagagaaucgccaagcagaugauggagaacgccgagugggagagcaagccccccccccccggcuggagacccaagggccugcugguggcccaccugcacgagcacaagagcgccgugaacagaaucagagugagcgacgagcacagccuguucgccaccugcagcaacgacggcaccgugaagaucuggaacagccagaagauggagggcaagaccaccaccaccagaagcauccugaccuacagcagaaucggcggcagagugaagacccugaccuucugccagggcagccacuaccuggccaucgccagcgacaacggcgccgugcagcugcugggcaucgaggccagcaagcugcccaagagccccaagauccacccccugcagagcagaauccuggaccagaaggaggacggcugcgugguggacaugcaccacuucaacagcggcgcccagagcgugcuggccuacgccaccgugaacggcagccuggugggcugggaccugagaagcagcagcaacgccuggacccugaagcacgaccugaagagcggccugaucaccagcuucgccguggacauccaccagugcuggcugugcaucggcaccagcagcggcaccauggccugcugggacaugagauuccagcugcccaucagcagccacugccaccccagcagagccagaaucagaagacugagcaugcacccccuguaccagagcugggugaucgccgccgugcagggcaacaacgaggugagcaugugggacauggagaccggcgacagaagauucacccugugggccagcagcgcccccccccugagcgagcugcagcccagcccccacagcgugcacggcaucuacugcagccccgccgacggcaaccccauccugcugaccgccggcagcgacaugaagaucagauucugggaccuggccuaccccgagagaagcuacgugguggccggcagcaccagcagccccagcgugagcuacuacagaaagaucaucgagggcaccgagguggugcaggagauccagaacaagcagaaggugggccccagcgacgacacccccagaagaggccccgagagccugcccgugggccaccacgacaucaucaccgacguggccaccuuccagaccacccagggcuucaucgugaccgccagcagagacggcaucgugaagguguggaaguaa

SEQ ID NO: 21544 - RNA, 2643 nt, Artificial Sequence
  PIK3R5__Homo_sapiens__NP_055123
augcagcccggcgccaccaccugcaccgaggacagaauccagcacgcccuggagagaugccugcacggccugagccugagcagaagaagcaccagcuggagcgccggccugugccugaacugcuggagccugcaggagcuggugagcagagaccccggccacuuccugauccugcuggagcagauccugcagaagaccagagaggugcaggagaagggcaccuacgaccugcugaccccccuggcccugcuguucuacagcaccgugcugugcaccccccacuucccccccgacagcgaccugcugcugaaggccgccagcaccuaccacagauuccugaccuggcccgugcccuacugcagcaucugccaggagcugcugaccuucaucgacgccgagcugaaggcccccggcaucagcuaccagagacuggugagagccgagcagggccugcccaucagaagccacagaagcagcaccgugaccgugcugcugcugaaccccguggaggugcaggccgaguuccuggccguggccaacaagcugagcacccccggccacagcccccacagcgccuacaccacccugcugcugcacgccuuccaggccaccuucggcgcccacugcgacgugcccggccugcacugcagacugcaggccaagacccuggccgagcuggaggacaucuucaccgagaccgccgaggcccaggagcuggccagcggcaucggcgacgccgccgaggccagaagauggcugagaaccaagcugcaggccgugggcgagaaggccggcuuccccggcgugcuggacaccgccaagcccggcaagcugcacaccauccccauccccguggccagaugcuacaccuacagcuggagccaggacagcuucgacauccugcaggagauccugcugaaggagcaggagcugcugcagcccggcauccugggcgacgacgaggaggaggaggaggaggaggaggagguggaggaggaccuggagaccgacggccacugcgccgagagagacagccugcugagcaccagcagccuggccagccacgacagcacccugagccuggccagcagccaggccagcggccccgcccugagcagacaccugcugaccagcuucgugagcggccugagcgacggcauggacagcggcuacguggaggacagcgaggagagcagcagcgaguggcccuggagaagaggcagccaggagagaagaggccacagaagacccggccagaaguucaucagaaucuacaagcuguucaagagcaccagccagcuggugcugagaagagacagcagaagccuggagggcagcagcgacaccgcccugccccugagaagagccggcagccugugcagcccccuggacgagcccgugagcccccccagcagagcccagagaagcagaagccugccccagcccaagcugggcacccagcugcccagcuggcugcuggcccccgccagcagaccccagagaagaagacccuuccugagcggcgacgaggaccccaaggccagcacccugagaguggugguguucggcagcgacagaaucagcggcaagguggccagagccuacagcaaccugagaagacuggagaacaacagaccccugcugaccagauucuucaagcugcaguucuucuacgugcccgugaagagaagccacggcaccagccccggcgccugccccccccccagaagccagacccccagcccccccaccgacagccccagacacgccagccccggcgagcugggcaccacccccugggaggagagcaccaacgacaucagccacuaccugggcaugcuggaccccugguacgagagaaacgugcugggccugaugcaccugccccccgaggugcugugccagcagagccugaaggccgaggcccaggcccuggagggcagccccacccagcugcccauccuggccgacaugcugcuguacuacugcagauucgccgccagacccgugcugcugcagguguaccagaccgagcugaccuucaucaccggcgagaagaccaccgagaucuucauccacagccuggagcugggccacagcgccgccaccagagccaucaaggccagcggccccggcagcaagagacugggcaucgacggcgacagagaggccgugccccugacccugcagaucaucuacagcaagggcgccaucagcggcagaagcagauggagcaaccuggagaaggugugcaccagcgugaaccugaacaaggccugcagaaagcaggaggagcuggacagcagcauggaggcccugacccugaaccugaccgagguggugaagagacagaacagcaagagcaagaagggcuucaaccagaucagcaccagccagaucaagguggacaaggugcagaucaucggcagcaacagcugccccuucgccgugugccuggaccaggacgagagaaagauccugcagagcguggugagaugcgaggugagccccugcuacaagcccgagaagagcgaccugagcagccccccccagaccccccccgaccugcccgcccaggccgcccccgaccugugcagccugcugugccugcccaucaugaccuucagcggcgcccugcccuaa

SEQ ID NO: 21545 - RNA, 1647 nt, Artificial Sequence
  PIKFYVE__Homo_sapiens__NP_001171471
auggccaccgacgacaagaccagccccacccuggacagcgccaacgaccugcccagaagccccaccagccccagccaccugacccacuucaagccccugacccccgaccaggacgagccccccuucaagagcgccuacagcagcuucgugaaccuguucagauucaacaaggagagagccgagggcggccagggcgagcagcagccccugagcggcagcuggaccagcccccagcugcccagcagaacccagagcgugagaagccccacccccuacaagaagcagcugaacgaggagcugcagagaagaagcagcgcccuggacaccagaagaaaggccgagcccaccuucggcggccacgaccccagaaccgccgugcagcugagaagccugagcaccgugcugaagagacugaaggagaucauggagggcaagagccaggacagcgaccugaagcaguacuggaugcccgacagccagugcaaggagugcuacgacugcagcgagaaguucaccaccuucagaagaagacaccacugcagacugugcggccagaucuucugcagcagaugcugcaaccaggagauccccggcaaguucaugggcuacaccggcgaccugagagccugcaccuacugcagaaagaucgcccugagcuacgcccacagcaccgacagcaacagcaucggcgaggaccugaacgcccugagcgacagcgccugcagcgugagcgugcuggaccccagcgagcccagaacccccgugggcagcagaaaggccagcagaaacaucuuccuggaggacgaccuggccuggcagagccugauccaccccgacagcagcaacaccccccugagcaccagacuggugagcgugcaggaggacgccggcaagagccccgccagaaacagaagcgccagcaucaccaaccugagccuggacagaagcggcagccccauggugcccagcuacgagaccagcgugagcccccaggccaacagaaccuacgugagaaccgagaccaccgaggacgagagaaagauccugcuggacagcgugcagcugaaggaccuguggaagaagaucugccaccacagcagcggcauggaguuccaggaccacagauacuggcugagaacccaccccaacugcaucgugggcaaggagcuggugaacuggcugaucagaaacggccacaucgccaccagagcccaggccaucgccaucggccaggccaugguggacggcagauggcuggacugcgugagccaccacgaccagcuguucagagacgaguacgcccuguacagaccccugcagagcaccgaguucagcgagacccccagccccgacagcgacagcgugaacagcguggagggccacagcgagcccagcugguucaaggacaucaaguucgacgacagcgacaccgagcagaucgccgaggagggcgacgacaaccuggccaacagcgccagccccagcaagagaaccagcgugagcagcuuccagagcaccguggacagcgacagcgccgccagcaucagccugaacguggagcuggacaacgugaacuuccacaucaagaagcccagcaaguacccccacgugcccccccaccccgccgaccagaagggcagaagauaa

SEQ ID NO: 21546 - RNA, 912 nt, Artificial Sequence
  PILRA__Homo_sapiens__NP_038467
augggcagaccccugcugcugccccugcugccccugcugcugccccccgccuuccugcagcccagcggcagcaccggcagcggccccagcuaccuguacggcgugacccagcccaagcaccugagcgccagcaugggcggcagcguggagauccccuucagcuucuacuaccccugggagcuggccaccgcccccgacgugagaaucagcuggagaagaggccacuuccacagacagagcuucuacagcaccagaccccccagcauccacaaggacuacgugaacagacuguuccugaacuggaccgagggccagaagagcggcuuccugagaaucagcaaccugcagaagcaggaccagagcguguacuucugcagaguggagcuggacaccagaagcagcggcagacagcaguggcagagcaucgagggcaccaagcugagcaucacccaggccgugaccaccaccacccagagacccagcagcaugaccaccaccuggagacugagcagcaccaccaccaccaccggccugagagugacccagggcaagagaagaagcgacagcuggcacaucagccuggagaccgccgugggcguggccguggccgugaccgugcugggcaucaugauccugggccugaucugccugcugagauggagaagaagaaagggccagcagagaaccaaggccaccacccccgccagagagcccuuccagaacaccgaggagcccuacgagaacaucagaaacgagggccagaacaccgaccccaagcugaaccccaaggacgacggcaucguguacgccagccuggcccugagcagcagcaccagccccagagccccccccagccacagaccccugaagagcccccagaacgagacccuguacagcgugcugaaggccuaa

SEQ ID NO: 21547 - RNA, 1215 nt, Artificial Sequence
  PIM1__Homo_sapiens__NP_001230115
augccccacgagccccacgagccccugaccccccccuucagcgcccugcccgaccccgccggcgcccccagcagaagacagagcagacagagaccccagcugagcagcgacagccccagcgccuucagagccagcagaagccacagcagaaacgccaccagaagccacagccacagccacagccccagacacagccugagacacagccccggcagcggcagcugcggcagcagcagcggccacagacccugcgccgacauccuggaggugggcaugcugcugagcaagaucaacagccuggcccaccugagagccgcccccugcaacgaccugcacgccaccaagcuggcccccggcaaggagaaggagccccuggagagccaguaccaggugggcccccugcugggcagcggcggcuucggcagcguguacagcggcaucagagugagcgacaaccugcccguggccaucaagcacguggagaaggacagaaucagcgacuggggcgagcugcccaacggcaccagagugcccauggagguggugcugcugaagaaggugagcagcggcuucagcggcgugaucagacugcuggacugguucgagagacccgacagcuucgugcugauccuggagagacccgagcccgugcaggaccuguucgacuucaucaccgagagaggcgcccugcaggaggagcuggccagaagcuucuucuggcaggugcuggaggccgugagacacugccacaacugcggcgugcugcacagagacaucaaggacgagaacauccugaucgaccugaacagaggcgagcugaagcugaucgacuucggcagcggcgcccugcugaaggacaccguguacaccgacuucgacggcaccagaguguacagcccccccgaguggaucagauaccacagauaccacggcagaagcgccgccguguggagccugggcauccugcuguacgacauggugugcggcgacauccccuucgagcacgacgaggagaucaucagaggccagguguucuucagacagagagugagcagcgagugccagcaccugaucagauggugccuggcccugagacccagcgacagacccaccuucgaggagauccagaaccaccccuggaugcaggacgugcugcugccccaggagaccgccgagauccaccugcacagccugagccccggccccagcaaguaa

SEQ ID NO: 21548 - RNA, 936 nt, Artificial Sequence
  PIM2__Homo_sapiens__NP_006866
augcugaccaagccccugcagggcccccccgccccccccggcacccccacccccccccccggcggcaaggacagagaggccuucgaggccgaguacagacugggcccccugcugggcaagggcggcuucggcaccguguucgccggccacagacugaccgacagacugcagguggccaucaaggugauccccagaaacagagugcugggcuggagcccccugagcgacagcgugaccugcccccuggagguggcccugcuguggaaggugggcgccggcggcggccaccccggcgugaucagacugcuggacugguucgagacccaggagggcuucaugcuggugcuggagagaccccugcccgcccaggaccuguucgacuacaucaccgagaagggcccccugggcgagggccccagcagaugcuucuucggccaggugguggccgccauccagcacugccacagcagaggcguggugcacagagacaucaaggacgagaacauccugaucgaccugagaagaggcugcgccaagcugaucgacuucggcagcggcgcccugcugcacgacgagcccuacaccgacuucgacggcaccagaguguacagcccccccgaguggaucagcagacaccaguaccacgcccugcccgccaccguguggagccugggcauccugcuguacgacauggugugcggcgacauccccuucgagagagaccaggagauccuggaggccgagcugcacuuccccgcccacgugagccccgacugcugcgcccugaucagaagaugccuggcccccaagcccagcagcagacccagccuggaggagauccugcuggaccccuggaugcagacccccgccgaggacgugccccugaaccccagcaagggcggccccgccccccuggccuggagccugcugcccuaa

SEQ ID NO: 21549 - RNA, 981 nt, Artificial Sequence
  PIM3__Homo_sapiens__NP_001001852
augcugcugagcaaguucggcagccuggcccaccugugcggccccggcggcguggaccaccugcccgugaagauccugcagcccgccaaggccgacaaggagagcuucgagaaggccuaccaggugggcgccgugcugggcagcggcggcuucggcaccguguacgccggcagcagaaucgccgacggccugcccguggccgugaagcacguggugaaggagagagugaccgaguggggcagccugggcggcgccaccgugccccuggagguggugcugcugagaaaggugggcgccgccggcggcgccagaggcgugaucagacugcuggacugguucgagagacccgacggcuuccugcuggugcuggagagacccgagcccgcccaggaccuguucgacuucaucaccgagagaggcgcccuggacgagccccuggccagaagauucuucgcccaggugcuggccgccgugagacacugccacagcugcggcguggugcacagagacaucaaggacgagaaccugcugguggaccugagaagcggcgagcugaagcugaucgacuucggcagcggcgcccugcugaaggacaccguguacaccgacuucgacggcaccagaguguacagcccccccgaguggaucagauaccacagauaccacggcagaagcgccaccguguggagccugggcgugcugcuguacgacauggugugcggcgacauccccuucgagcaggacgaggagauccugagaggcagacugcuguucagaagaagagugagccccgagugccagcagcugaucagauggugccugagccugagacccagcgagagacccagccuggaccagaucgccgcccaccccuggaugcugggcgccgacggcggcgugcccgagagcugcgaccugagacugugcacccuggaccccgacgacguggccagcaccaccagcagcagcgagagccuguaa

SEQ ID NO: 21550 - RNA, 492 nt, Artificial Sequence
  PIN1__Homo_sapiens__NP_006212
auggccgacgaggagaagcugccccccggcugggagaagagaaugagcagaagcagcggcagaguguacuacuucaaccacaucaccaacgccagccagugggagagacccagcggcaacagcagcagcggcggcaagaacggccagggcgagcccgccagagugagaugcagccaccugcuggugaagcacagccagagcagaagacccagcagcuggagacaggagaagaucaccagaaccaaggaggaggcccuggagcugaucaacggcuacauccagaagaucaagagcggcgaggaggacuucgagagccuggccagccaguucagcgacugcagcagcgccaaggccagaggcgaccugggcgccuucagcagaggccagaugcagaagcccuucgaggacgccagcuucgcccugagaaccggcgagaugagcggccccguguucaccgacagcggcauccacaucauccugagaaccgaguaa

SEQ ID NO: 21551 - RNA, 402 nt, Artificial Sequence
  PIN4__Homo_sapiens__NP_001164218
augcccauggccggccugcugaagggccuggugagacagcuggagagauucagcgugcagcagcaggccagcaagaugccccccaagggcaagagcggcagcggcaaggccggcaagggcggcgccgccagcggcagcgacagcgccgacaagaaggcccagggccccaagggcggcggcaacgccgugaaggugagacacauccugugcgagaagcacggcaagaucauggaggccauggagaagcugaagagcggcaugagauucaacgagguggccgcccaguacagcgaggacaaggccagacagggcauccccagccugcagcagcacgccggccaccacagagaccugagaagcacccugaucagccuggugagcuaccugcagaccacccccuaa

SEQ ID NO: 21552 - RNA, 525 nt, Artificial Sequence
  PINX1__Homo_sapiens__NP_001271285
augagcaugcuggccgagagaagaagaaagcagaagugggccguggacccccagaacaccgccuggagcaacgacgacagcaaguucggccagagaaugcuggagaagaugggcuggagcaagggcaagggccugggcgcccaggagcagggcgccaccgaccacaucaaggugcaggugaagaacaaccaccugggccugggcgccaccaucaacaacgaggacaacuggaucgcccaccaggacgacuucaaccagcugcuggccgagcugaacaccugccacggccaggagaccaccgacagcagcgacaagaaggagaagaagagcuucagccuggaggagaagagcaagaucagcaagaacagagugcacuacaugaaguucaccaagggcagaugccagagccugcacagcagaggcgagagaaaccacgacaaccagagacugcaccaccccggcgugcugugccaggccgacggcagcaccgaggagcaggcccccggcagcagcagcagaguguaa

SEQ ID NO: 21553 - RNA, 1221 nt, Artificial Sequence
  PIP4K2A__Homo_sapiens__NP_005019
auggccacccccggcaaccugggcagcagcgugcuggccagcaagaccaagaccaagaagaagcacuucguggcccagaaggugaagcuguucagagccagcgacccccugcugagcgugcugauguggggcgugaaccacagcaucaacgagcugagccacgugcagauccccgugaugcugaugcccgacgacuucaaggccuacagcaagaucaagguggacaaccaccuguucaacaaggagaacaugcccagccacuucaaguucaaggaguacugccccaugguguucagaaaccugagagagagauucggcaucgacgaccaggacuuccagaacagccugaccagaagcgccccccugcccaacgacagccaggccagaagcggcgccagauuccacaccagcuacgacaagagauacaucaucaagaccaucaccagcgaggacguggccgagaugcacaacauccugaagaaguaccaccaguacaucguggagugccacggcaucacccugcugccccaguuccugggcauguacagacugaacguggacggcguggagaucuacgugaucgugaccagaaacguguucagccacagacugagcguguacagaaaguacgaccugaagggcagcaccguggccagagaggccagcgacaaggagaaggccaaggagcugcccacccugaaggacaacgacuucaucaacgagggccagaagaucuacaucgacgacaacaacaagaagguguuccuggagaagcugaagaaggacguggaguuccuggcccagcugaagcugauggacuacagccugcuggugggcauccacgacguggagagagccgagcaggaggagguggagugcgaggagaacgacggcgaggaggagggcgagagcgacggcacccaccccgugggcaccccccccgacagccccggcaacacccugaacagcagccccccccuggcccccggcgaguucgaccccaacaucgacguguacggcaucaagugccacgagaacagccccagaaaggagguguacuucauggccaucaucgacauccugacccacuacgacgccaagaagaaggccgcccacgccgccaagaccgugaagcacggcgccggcgccgagaucagcaccgugaaccccgagcaguacagcaagagauuccuggacuucaucggccacauccugaccuaa

SEQ ID NO: 21554 - RNA, 1251 nt, Artificial Sequence
  PIP4K2B__Homo_sapiens__NP_003550
augagcagcaacugcaccagcaccaccgccguggccguggccccccugagcgccagcaagaccaagaccaagaagaagcacuucgugugccagaaggugaagcuguucagagccagcgagcccauccugagcgugcugauguggggcgugaaccacaccaucaacgagcugagcaacgugcccgugcccgugaugcugaugcccgacgacuucaaggccuacagcaagaucaagguggacaaccaccuguucaacaaggagaaccugcccagcagauucaaguucaaggaguacugccccaugguguucagaaaccugagagagagauucggcaucgacgaccaggacuaccagaacagcgugaccagaagcgcccccaucaacagcgacagccagggcagaugcggcaccagauuccugaccaccuacgacagaagauucgugaucaagaccgugagcagcgaggacguggccgagaugcacaacauccugaagaaguaccaccaguucaucguggagugccacggcaacacccugcugccccaguuccugggcauguacagacugaccguggacggcguggagaccuacaugguggugaccagaaacguguucagccacagacugaccgugcacagaaaguacgaccugaagggcagcaccguggccagagaggccagcgacaaggagaaggccaaggaccugcccaccuucaaggacaacgacuuccugaacgagggccagaagcugcacgugggcgaggagagcaagaagaacuuccuggagaagcugaagagagacguggaguuccuggcccagcugaagaucauggacuacagccugcuggugggcauccacgacguggacagagccgagcaggaggagauggagguggaggagagagccgaggacgaggagugcgagaacgacggcgugggcggcaaccugcugugcagcuacggcaccccccccgacagccccggcaaccugcugagcuuccccagauucuucggccccggcgaguucgaccccagcguggacguguacgccaugaagagccacgagagcagccccaagaaggagguguacuucauggccaucaucgacauccugacccccuacgacaccaagaagaaggccgcccacgccgccaagaccgugaagcacggcgccggcgccgagaucagcaccgugaaccccgagcaguacagcaagagauucaacgaguucaugagcaacauccugaccuaa

SEQ ID NO: 21555 - RNA, 1212 nt, Artificial Sequence
  PIP4K2C__Homo_sapiens__NP_001139731
auggccagcagcagcgugccccccgccaccgugagcgccgccaccgccggccccggccccggcuucggcuucgccagcaagaccaagaagaagcacuucgugcagcagaaggugaagguguucagagccgccgacccccuggugggcguguuccuguggggcguggcccacagcaucaacgagcugagccaggugcccccccccgugaugcugcugcccgacgacuucaaggccagcagcaagaucaaggaguacugcccccagguguucagaaaccugagagacagauucggcaucgacgaccaggacuaccuggugagccugaccagaaacccccccagcgagagcgagggcagcgacggcagauuccugaucagcuacgacagaacccuggugaucaaggaggugagcagcgaggacaucgccgacaugcacagcaaccugagcaacuaccaccaguacaucgugaagugccacggcaacacccugcugccccaguuccugggcauguacagagugagcguggacaacgaggacagcuacaugcuggugaugagaaacauguucagccacagacugcccgugcacagaaaguacgaccugaagggcagccuggugagcagagaggccagcgacaaggagaaggugaaggagcugcccacccugaaggacauggacuuccugaacaagaaccagaagguguacaucggcgaggaggagaagaagaucuuccuggagaagcugaagagagacguggaguuccuggugcagcugaagaucauggacuacagccugcugcugggcauccacgacaucaucagaggcagcgagcccgaggaggaggcccccgugagagaggacgagagcgagguggacggcgacugcagccugaccggcccccccgcccuggugggcagcuacggcaccagccccgagggcaucggcggcuacauccacagccacagaccccugggccccggcgaguucgagagcuucaucgacguguacgccaucagaagcgccgagggcgccccccagaaggagguguacuucaugggccugaucgacauccugacccaguacgacgccaagaagaaggccgcccacgccgccaagaccgugaagcacggcgccggcgccgagaucagcaccgugcaccccgagcaguacgccaagagauuccuggacuucaucaccaacaucuucgccuaa

SEQ ID NO: 21556 - RNA, 1569 nt, Artificial Sequence
  PIP5K1A__Homo_sapiens__NP_001129108
auggccagcgccagcagcggccccagcagcagcgugggcuucagcagcuucgaccccgccgugcccagcugcacccugagcagcgccgccagcggcaucaagagacccauggccagcgaggugcccuacgccagcggcaugcccaucaagaagaucggccacagaagcguggacagcagcggcgagaccaccuacaagaagaccaccagcagcgcccugaagggcgccauccagcugggcaucacccacaccgugggcagccugagcaccaagcccgagagagacgugcugaugcaggacuucuacgugguggagagcaucuucuuccccagcgagggcagcaaccugacccccgcccaccacuacaacgacuucagauucaagaccuacgcccccguggccuucagauacuucagagagcuguucggcaucagacccgacgacuaccuguacagccugugcagcgagccccugaucgagcugugcagcagcggcgccagcggcagccuguucuacgugagcagcgacgacgaguucaucaucaagaccgugcagcacaaggaggccgaguuccugcagaagcugcugcccggcuacuacaugaaccugaaccagaaccccagaacccugcugcccaaguucuacggccuguacugcgugcaggccggcggcaagaacaucagaaucguggugaugaacaaccugcugcccagaagcgugaagaugcacaucaaguacgaccugaagggcagcaccuacaagagaagagccagccagaaggagagagagaagccccugcccaccuucaaggaccuggacuuccugcaggacauccccgacggccuguuccuggacgccgacauguacaacgcccugugcaagacccugcagagagacugccuggugcugcagagcuucaagaucauggacuacagccugcugaugagcauccacaacaucgaccacgcccagagagagccccugagcagcgagacccaguacagcguggacaccagaagacccgccccccagaaggcccuguacagcaccgccauggagagcauccagggcgaggccagaagaggcggcaccauggagaccgacgaccaguucgugaagaagcuggagcacagcuggaaggcccuggugcacgacggcgacaccgugagcgugcacagacccggcuucuacgccgagagauuccagagauucaugugcaacaccguguucaagaagaucccccugaagcccagccccagcaagaaguucagaagcggcagcagcuucagcagaagagccggcagcagcggcaacagcugcaucaccuaccagcccagcgugagcggcgagcacaaggcccaggugaccaccaaggccgagguggagcccggcgugcaccugggcagacccgacgugcugccccagacccccccccuggaggagaucagcgagggcagccccauccccgaccccagcuucagcccccuggugggcgagacccugcagaugcugaccaccagcaccacccuggagaagcuggagguggccgagagcgaguucacccacuaa

SEQ ID NO: 21557 - RNA, 1509 nt, Artificial Sequence
  PIP5K1B__Homo_sapiens__XP_006717364
augagcagcgccgccgagaacggcgaggccgcccccggcaagcagaacgaggagaagaccuacaagaagaccgccagcagcgccaucaagggcgccauccagcugggcaucggcuacaccgugggcaaccugaccagcaagcccgagagagacgugcugaugcaggacuucuacgugguggagagcguguuccugcccagcgagggcagcaaccugacccccgcccaccacuaccccgacuucagauucaagaccuacgccccccuggccuucagauacuucagagagcuguucggcaucaagcccgacgacuaccuguacagcaucugcagcgagccccugaucgagcugagcaaccccggcgccagcggcagccuguucuucgugaccagcgacgacgaguucaucaucaagaccgugcagcacaaggaggccgaguuccugcagaagcugcugcccggcuacuacaugaaccugaaccagaaccccagaacccugcugcccaaguucuacggccuguacugcaugcagagcggcggcaucaacaucagaaucguggugaugaacaacgugcugcccagaagcaugagaaugcacuucaccuacgaccugaagggcagcaccuacaagagaagagccagcagaaaggagagagagaagagcaaccccaccuucaaggaccuggacuuccugcaggacaugcacgagggccuguacuucgacaccgagaccuacaacgcccugaugaagacccugcagagagacugcagagugcuggagagcuucaagaucauggacuacagccugcugcugggcauccacuuccuggaccacagccugaaggagaaggaggaggagaccccccagaacgugcccgacgccaagagaaccggcaugcagaaggugcuguacagcaccgccauggagagcauccagggccccggcaagagcggcgacggcaucaucaccgagaaccccgacaccaugggcggcauccccgccaagagccacagaggcgagaagcugcugcuguucaugggcaucaucgacauccugcagagcuacagacugaugaagaagcuggagcacagcuggaaggcccugguguacgacggcgacaccgugagcgugcacagacccagcuucuacgccgacagauuccugaaguucaugaacagcagaguguucaagaagauccaggcccugaaggccagccccagcaagaagagaugcaacagcaucgccgcccugaaggccaccagccaggagaucgugagcagcaucagccaggaguggaaggacgagaagagagaccugcugaccgagggccagagcuucagcagccuggacgaggaggcccugggcagcagacacagacccgaccuggugcccagcacccccagccuguucgaggccgccagccuggccaccaccaucagcagcagcagccuguacgugaacgagcacuacccccacgacagacccacccuguacagcaacagcaaguaa

SEQ ID NO: 21558 - RNA, 1923 nt, Artificial Sequence
  PIP5K1C__Homo_sapiens__NP_001182662
auggagcuggaggugcccgacgaggccgagagcgccgaggccggcgccgugcccagcgaggccgccugggccgccgagagcggcgccgccgccggccuggcccagaagaaggccgcccccaccgaggugcugagcaugaccgcccagcccggccccggccacggcaagaagcugggccacagaggcguggacgccagcggcgagaccaccuacaagaagaccaccagcagcacccugaagggcgccauccagcugggcaucggcuacaccgugggccaccugagcagcaagcccgagagagacgugcugaugcaggacuucuacgugguggagagcaucuucuuccccagcgagggcagcaaccugacccccgcccaccacuuccaggacuucagauucaagaccuacgcccccguggccuucagauacuucagagagcuguucggcaucagacccgacgacuaccuguacagccugugcaacgagccccugaucgagcugagcaaccccggcgccagcggcagccuguucuacgugaccagcgacgacgaguucaucaucaagaccgugaugcacaaggaggccgaguuccugcagaagcugcugcccggcuacuacaugaaccugaaccagaaccccagaacccugcugcccaaguucuacggccuguacugcgugcagagcggcggcaagaacaucagagugguggugaugaacaacauccugcccagaguggugaagaugcaccugaaguucgaccugaagggcagcaccuacaagagaagagccagcaagaaggagaaggagaagagcuuccccaccuacaaggaccuggacuucaugcaggacaugcccgagggccugcugcuggacgccgacaccuucagcgcccuggugaagacccugcagagagacugccuggugcuggagagcuucaagaucauggacuacagccugcugcugggcgugcacaacaucgaccagcacgagagagagagacaggcccagggcgcccagagcaccagcgacgagaagagacccgugggccagaaggcccuguacagcaccgccauggagagcauccagggcggcgccgccagaggcgaggccaucgagagcgacgacaccaugggcggcauccccgccgugaacggcagaggcgagagacugcugcugcacaucggcaucaucgacauccugcagagcuacagauucaucaagaagcuggagcacaccuggaaggcccuggugcacgacggcgacaccgugagcgugcacagacccagcuucuacgccgagagauucuucaaguucaugagcaacaccguguucagaaagaacagcagccugaagagcagccccagcaagaagggcagaggcggcgcccugcuggccgugaagccccugggccccaccgccgccuucagcgccagccagauccccagcgagagagaggaggcccaguacgaccugagaggcgccagaagcuaccccacccuggaggacgagggcagacccgaccugcugcccugcaccccccccagcuucgaggaggccaccaccgccagcaucgccaccacccugagcagcaccagccugagcauccccgagagaagccccagcgagaccagcgagcagcccagauacagaagaagaacccagagcagcggccaggacggcagaccccaggaggagccccccgccgaggaggaccugcagcagaucaccgugcagguggagcccgccugcagcguggagaucguggugcccaaggaggaggacgccggcguggaggccagccccgccggcgccagcgccgccguggagguggagaccgccagccaggccagcgacgaggagggcgcccccgccagccaggccagcgacgaggaggacgcccccgccaccgacaucuacuucuaa

SEQ ID NO: 21559 - RNA, 1185 nt, Artificial Sequence
  PIP5KL1__Homo_sapiens__NP_001128691
auggccgcccccagccccggccccagagaggugcuggcccccagccccgaggccggcugcagagccgugaccagcagcagaagaggccugcuguggagacugagagacaagcagagcagacugggccuguucgagaucagccccggccacgagcugcacggcaugaccugcaugaugcaggccggccugugggccgccacccaggugagcauggaccacccccccaccggcccccccagcagagacgacuucagcgaggugcugacccaggugcacgagggcuucgagcugggcacccuggccggccccgccuucgccuggcugagaagaagccugggccuggccgaggaggacuaccaggccgcccugggccccggcggccccuaccugcaguuccugagcaccagcaagagcaaggccagcuucuuccugagccacgaccagagauucuuccugaagacccagggcagaagagaggugcaggcccugcuggcccaccugcccagauacgugcagcaccugcagagacacccccacagccugcuggccagacugcugggcgugcacagccugagaguggacagaggcaagaagaccuacuucaucgugaugcagagcguguucuaccccgccggcagaaucagcgagagauacgacaucaagggcugcgaggugagcagauggguggaccccgcccccgagggcagcccccuggugcuggugcugaaggaccugaacuuccagggcaagaccaucaaccugggcccccagagaagcugguuccugagacagauggagcuggacaccaccuuccugagagagcugaacgugcuggacuacagccugcugaucgccuuccagagacugcacgaggacgagagaggccccggcagcagccugaucuucagaaccgccagaagcgugcagggcgcccagagccccgaggagagcagagcccagaacagaagacugcugcccgacgcccccaacgcccugcacauccuggacggccccgagcagagauacuuccugggcgugguggaccuggccaccguguacggccugagaaagagacuggagcaccuguggaagacccugagauaccccggcagaaccuucagcaccgugagccccgccagauacgccagaagacugugccaguggguggaggcccacaccgaguaa

SEQ ID NO: 21560 - RNA, 441 nt, Artificial Sequence
  PIP__Homo_sapiens__NP_002643
augagacugcugcagcugcuguucagagccagccccgccacccugcugcuggugcugugccugcagcugggcgccaacaaggcccaggacaacaccagaaagaucaucaucaagaacuucgacauccccaagagcgugagacccaacgacgaggugaccgccgugcuggccgugcagaccgagcugaaggagugcaugguggugaagaccuaccugaucagcagcaucccccugcagggcgccuucaacuacaaguacaccgccugccugugcgacgacaaccccaagaccuucuacugggacuucuacaccaacagaaccgugcagaucgccgccgugguggacgugaucagagagcugggcaucugccccgacgacgccgccgugauccccaucaagaacaacagauucuacaccaucgagauccugaagguggaguaa

SEQ ID NO: 21561 - RNA, 1173 nt, Artificial Sequence
  PIPOX__Homo_sapiens__NP_057602
auggccgcccagaaggaccugugggacgccaucgugaucggcgccggcauccagggcugcuucaccgccuaccaccuggccaagcacagaaagagaauccugcugcuggagcaguucuuccugccccacagcagaggcagcagccacggccagagcagaaucaucagaaaggccuaccuggaggacuucuacaccagaaugaugcacgagugcuaccagaucugggcccagcuggagcacgaggccggcacccagcugcacagacagaccggccugcugcugcugggcaugaaggagaaccaggagcugaagaccauccaggccaaccugagcagacagagaguggagcaccagugccugagcagcgaggagcugaagcagagauuccccaacaucagacugcccagaggcgaggugggccugcuggacaacagcggcggcgugaucuacgccuacaaggcccugagagcccugcaggacgccaucagacagcugggcggcaucgugagagacggcgagaaggugguggagaucaaccccggccugcuggugaccgugaagaccaccagcagaagcuaccaggccaagagccuggugaucaccgccggccccuggaccaaccagcugcugagaccccugggcaucgagaugccccugcagacccugagaaucaacgugugcuacuggagagagauggugcccggcagcuacggcgugagccaggccuuccccugcuuccuguggcugggccugugcccccaccacaucuacggccugcccaccggcgaguaccccggccugaugaaggugagcuaccaccacggcaaccacgccgaccccgaggagagagacugccccaccgccagaaccgacaucggcgacgugcagauccugagcagcuucgugagagaccaccugcccgaccugaagcccgagcccgccgugaucgagagcugcauguacaccaacacccccgacgagcaguucauccuggacagacaccccaaguacgacaacaucgugaucggcgccggcuucagcggccacggcuucaagcuggcccccguggugggcaagauccuguacgagcugagcaugaagcugacccccagcuacgaccuggcccccuucagaaucagcagauuccccagccugggcaaggcccaccuguaa

SEQ ID NO: 21562 - RNA, 873 nt, Artificial Sequence
  PIR__Homo_sapiens__NP_003653
augggcagcagcaagaaggugacccugagcgugcugagcagagagcagagcgagggcgugggcgccagagugagaagaagcaucggcagacccgagcugaagaaccuggaccccuuccugcuguucgacgaguucaagggcggcagacccggcggcuuccccgaccacccccacagaggcuucgagaccgugagcuaccugcuggagggcggcagcauggcccacgaggacuucugcggccacaccggcaagaugaaccccggcgaccugcaguggaugaccgccggcagaggcauccugcacgccgagaugcccugcagcgaggagcccgcccacggccugcagcugugggugaaccugagaagcagcgagaagaugguggagccccaguaccaggagcugaagagcgaggagauccccaagcccagcaaggacggcgugaccguggccgugaucagcggcgaggcccugggcaucaagagcaagguguacaccagaacccccacccuguaccuggacuucaagcuggaccccggcgccaagcacagccagcccauccccaagggcuggaccagcuucaucuacaccaucagcggcgacguguacaucggccccgacgacgcccagcagaagaucgagccccaccacaccgccgugcugggcgagggcgacagcgugcagguggagaacaaggaccccaagagaagccacuucgugcugaucgccggcgagccccugagagagcccgugauccagcacggccccuucgugaugaacaccaacgaggagaucagccaggccauccuggacuucagaaacgccaagaacggcuucgagagagccaagaccuggaagagcaagaucggcaacuaa

SEQ ID NO: 21563 - RNA, 1230 nt, Artificial Sequence
  PISD__Homo_sapiens__XP_005261512
auggccaccagcgugggccacagaugccugggccugcugcacggcguggcccccuggagaagcagccugcaccccugcgagaucaccgcccugagccagagccugcagccccugagaaagcugcccuucagagccuucagaaccgacgccagaaagauccacaccgcccccgccagaaccauguuccugcugagaccccugcccauccugcuggugaccggcggcggcuacgccggcuacagacaguacgagaaguacagagagagagagcuggagaagcugggccuggagaucccccccaagcuggccggccacugggagguggcccuguacaagagcgugcccaccagacugcugagcagagccuggggcagacugaaccagguggagcugccccacuggcugagaagacccguguacagccuguacaucuggaccuucggcgugaacaugaaggaggccgccguggaggaccugcaccacuacagaaaccugagcgaguucuucagaagaaagcugaagccccaggccagacccgugugcggccugcacagcgugaucagccccagcgacggcagaauccugaacuucggccaggugaagaacugcgagguggagcaggugaagggcgugaccuacagccuggagagcuuccugggccccagaaugugcaccgaggaccugcccuucccccccgccgccagcugcgacagcuucaagaaccagcuggugaccagagagggcaacgagcuguaccacugcgugaucuaccuggcccccggcgacuaccacugcuuccacagccccaccgacuggaccgugagccacagaagacacuuccccggcagccugaugagcgugaaccccggcauggccagauggaucaaggagcuguucugccacaacgagagaguggugcugaccggcgacuggaagcacggcuucuucagccugaccgccgugggcgccaccaacgugggcagcaucagaaucuacuucgacagagaccugcacaccaacagccccagacacagcaagggcagcuacaacgacuucagcuucgugacccacaccaacagagagggcgugcccaugagaaagggcgagcaccugggcgaguucaaccugggcagcaccaucgugcugaucuucgaggcccccaaggacuucaacuuccagcugaagaccggccagaagaucagauucggcgaggcccugggcagccuguaa

SEQ ID NO: 21564 - RNA, 813 nt, Artificial Sequence
  PITPNA__Homo_sapiens__NP_006215
auggugcugcugaaggaguacagagugauccugcccgugagcguggacgaguaccaggugggccagcuguacagcguggccgaggccagcaagaacgagaccggcggcggcgagggcguggaggugcuggugaacgagcccuacgagaaggacggcgagaagggccaguacacccacaagaucuaccaccugcagagcaaggugcccaccuucgugagaaugcuggcccccgagggcgcccugaacauccacgagaaggccuggaacgccuaccccuacugcagaaccgugaucaccaacgaguacaugaaggaggacuuccugaucaagaucgagaccuggcacaagcccgaccugggcacccaggagaacgugcacaagcuggagcccgaggccuggaagcacguggaggccguguacaucgacaucgccgacagaagccaggugcugagcaaggacuacaaggccgaggaggaccccgccaaguucaagagcaucaagaccggcagaggcccccugggccccaacuggaagcaggagcuggugaaccagaaggacugccccuacaugugcgccuacaagcuggugaccgugaaguucaagugguggggccugcagaacaagguggagaacuucauccacaagcaggagagaagacuguucaccaacuuccacagacagcuguucugcuggcuggacaaguggguggaccugaccauggacgacaucagaagaauggaggaggagaccaagagacagcuggacgagaugagacagaaggaccccgugaagggcaugaccgccgacgacuaa

SEQ ID NO: 21565 - RNA, 3732 nt, Artificial Sequence
  PITPNM1__Homo_sapiens__NP_001124320
augcugaucaaggaguaccacauccugcugcccaugagccuggacgaguaccagguggcccagcuguacaugauccagaagaagagcagagaggagagcagcggcgagggcagcggcguggagauccuggccaacagacccuacaccgacggccccggcggcagcggccaguacacccacaagguguaccacgugggcagccacauccccggcugguucagagcccugcugcccaaggccgcccugcagguggaggaggagagcuggaacgccuaccccuacaccagaaccagauacaccugccccuucguggagaaguucagcaucgagaucgagaccuacuaccugcccgacggcggccagcagcccaacguguucaaccugagcggcgccgagagaagacagagaauccuggacaccaucgacaucgugagagacgccguggcccccggcgaguacaaggccgaggaggaccccagacuguaccacagcgugaagaccggcagaggcccccugagcgacgacugggccagaaccgccgcccagaccggcccccugaugugcgccuacaagcugugcaagguggaguucagauacuggggcaugcaggccaagaucgagcaguucauccacgacgugggccugagaagagugaugcugagagcccacagacaggccuggugcuggcaggacgaguggaccgagcugagcauggccgacaucagagcccuggaggaggagaccgccagaaugcuggcccagagaauggccaagugcaacaccggcagcgagggcagcgaggcccagccccccggcaagcccagcaccgaggccagaagcgccgccagcaacaccggcacccccgacggccccgaggccccccccggccccgacgccagccccgacgccagcuucggcaagcaguggagcagcagcagcagaagcagcuacagcagccagcacggcggcgccgugagcccccagagccugagcgaguggagaaugcagaacaucgccagagacagcgagaacagcagcgaggaggaguucuucgacgcccacgagggcuucagcgacagcgaggagguguuccccaaggagaugaccaaguggaacagcaacgacuucaucgacgccuucgccagccccguggaggccgagggcacccccgagcccggcgccgaggccgccaagggcaucgaggacggcgcccaggcccccagagacagcgagggccuggacggcgccggcgagcugggcgccgaggccugcgccgugcacgcccuguuccugauccugcacagcggcaacauccuggacagcggccccggcgacgccaacagcaagcaggccgacgugcagacccugagcagcgccuucgaggccgugaccagaauccacuuccccgaggcccugggccacguggcccugagacuggugcccugcccccccaucugcgccgccgccuacgcccuggugagcaaccugagccccuacagccacgacggcgacagccugagcagaagccaggaccacaucccccuggccgcccugccccugcuggccaccagcagcagcagauaccagggcgccguggccaccgugaucgccagaaccaaccaggccuacagcgccuuccugagaagccccgagggcgccggcuucugcggccagguggcccugaucggcgacggcgugggcggcauccugggcuucgacgcccugugccacagcgccaacgccggcaccggcagcagaggcagcagcagaagaggcagcaugaacaacgagcugcugagccccgaguucggccccgugagagacccccuggccgacggcguggagggccugggcagaggcagccccgagcccagcgcccugcccccccagagaauccccagcgacauggccagccccgagcccgagggcagccagaacagccugcaggccgcccccgccaccaccagcagcugggagcccagaagagccagcaccgccuucugcccccccgccgccagcagcgaggcccccgacggccccagcagcaccgccagacuggacuucaaggugagcggcuucuuccuguucggcagcccccugggccuggugcuggcccugagaaagaccgugaugcccgcccuggaggcccagaugagacccgccugcgagcagaucuacaaccuguuccacgccgccgaccccugcgccagcagacuggagccccugcuggcccccaaguuccaggccaucgccccccugaccgugcccagauaccagaaguucccccugggcgacggcagcagccugcugcuggccgacacccugcagacccacagcagccuguuccuggaggagcuggagaugcuggugcccagcacccccaccagcaccagcggcgccuucuggaagggcagcgagcuggccaccgacccccccgcccagcccgccgcccccagcaccaccagcgagguggugaagauccuggagagaugguggggcaccaagagaaucgacuacagccuguacugccccgaggcccugaccgccuuccccaccgugacccugccccaccuguuccacgccagcuacugggagagcgccgacgugguggccuucauccugagacaggugaucgagaaggagagaccccagcuggccgagugcgaggagcccagcaucuacagccccgccuuccccagagagaaguggcagagaaagagaacccaggugaagaucagaaacgugaccagcaaccacagagccagcgacaccguggugugcgagggcagaccccaggugcugagcggcagauucauguacggcccccuggacguggugacccugaccggcgagaagguggacguguacaucaugacccagccccugagcggcaaguggauccacuucggcaccgaggugaccaacagcagcggcagacugaccuuccccgugccccccgagagagcccugggcaucggcguguaccccgugagaaugguggugagaggcgaccacaccuacgccgagugcugccugaccgugguggccagaggcaccgaggccgugguguucagcaucgacggcagcuucaccgccagcgugagcaucaugggcagcgaccccaaggugagagccggcgccguggacguggugagacacuggcaggacagcggcuaccugaucguguacgugaccggcagacccgacaugcagaagcacagagugguggccuggcugagccagcacaacuucccccacggcguggugagcuucugcgacggccugacccacgacccccugagacagaaggccauguuccugcagagccuggugcaggagguggagcugaacaucguggccggcuacggcagccccaaggacguggccguguacgccgcccugggccugagccccagccagaccuacaucgugggcagagccgugagaaagcugcaggcccagugccaguuccugagcgacggcuacguggcccaccugggccagcuggaggccggcagccacagccacgccagcagcggcccccccagagccgcccugggcaagagcagcuacggcguggccgcccccguggacuuccugagaaagcagagccagcugcugagaagcagaggccccagccaggccgagagagagggccccggcaccccccccaccacccuggccagaggcaaggccagaagcaucagccugaagcuggacagcgaggaguaa

SEQ ID NO: 21566 - RNA, 2817 nt, Artificial Sequence
  PITPNM3__Homo_sapiens__NP_001159438
auggccaaggccggcagagccggcggccccccccccggcggcggcgcccccuggcaccugagaaacgugcugagcgacagcguggagagcagcgacgacgaguucuucgacgccagaggcgagggcaccgcccccugcaccagcagcauccugcaggagaagcagagagagcuguacagagugagccugagaagacagagauuccccgcccagggcagcaucgagauccacgaggacagcgaggagggcugcccccagagaagcugcaagacccacgugcugcugcuggugcugcacggcggcaacauccuggacaccggcgccggcgaccccagcugcaaggccgccgacauccacaccuucagcagcgugcuggagaaggugaccagagcccacuuccccgccgcccugggccacauccugaucaaguucgugcccugccccgccaucugcagcgaggccuucagccuggugagccaccugaaccccuacagccacgacgagggcugccugagcagcagccaggaccacgugccccuggccgcccugccccugcuggccaucagcagcccccaguaccaggacgccguggccaccgugaucgagagagccaaccagguguacagagaguuccugaagagcagcgacggcaucggcuucagcggccaggugugccugaucggcgacugcgugggcggccugcuggccuucgacgccaucugcuacagcgccggccccagcggcgacagccccgccagcagcagcagaaagggcagcaucagcagcacccaggacacccccguggccguggaggaggacugcagccuggccagcagcaagagacugagcaagagcaacaucgacaucagcagcggccuggaggacgaggagcccaagagaccccugcccagaaagcagagcgacagcagcaccuacgacugcgaggccaucacccagcaccacgccuuccugagcagcauccacagcagcgugcugaaggacgagagcgagacccccgccgccggcggcccccagcugcccgaggugagccugggcagauucgacuucgacgugagcgacuucuuccuguucggcagcccccugggccuggugcuggccaugagaagaaccgugcugcccggccuggacggcuuccaggugagacccgccugcagccagguguacagcuucuuccacugcgccgaccccagcgccagcagacuggagccccugcuggagcccaaguuccaccuggugccccccgugagcgugcccagauaccagagauucccccugggcgacggccagagccugcugcuggccgacgcccugcacacccacagcccccuguuccuggagggcagcagcagagacagccccccccugcuggacgcccccgccagccccccccaggccagcagauuccagagacccggcagaagaaugagcgagggcagcagccacagcgagagcagcgagagcagcgacagcauggcccccgugggcgccagcagaaucaccgccaagugguggggcagcaagagaaucgacuacgcccuguacugccccgacgugcugaccgccuuccccaccguggcccugccccaccuguuccacgccagcuacugggagagcaccgacgugguggccuucauccugagacaggugaugagauacgagagcgugaacaucaaggagagcgccagacuggaccccgccgcccugagccccgccaaccccagagagaaguggcugagaaagagaacccaggugaagcugagaaacgugaccgccaaccacagagccaacgacgugaucgccgccgaggacggcccccaggugcuggugggcagauucauguacggcccccuggacaugguggcccugaccggcgagaagguggacauccuggugauggccgagcccagcagcggcagaugggugcaccuggacaccgagaucaccaacagcagcggcagaaucaccuacaacgugcccagacccagaagacugggcgugggcguguaccccgugaagaugguggugagaggcgaccagaccugcgccaugagcuaccugaccgugcugcccagaggcauggagugcgugguguucagcaucgacggcagcuucgccgccagcgugagcaucaugggcagcgaccccaaggugagacccggcgccguggacguggugagacacuggcaggaccugggcuacaugauccuguacaucaccggcagacccgacaugcagaagcagagaguggugagcuggcugagccagcacaacuucccccagggcaugaucuucuucagcgacggccuggugcacgacccccugagacagaaggccaucuuccugagaaaccugaugcaggagugcuucaucaagaucagcgccgccuacggcagcaccaaggacaucagcguguacagcgugcugggccugcccgccagccagaucuucaucgugggcagacccaccaagaaguaccagacccagugccaguuccugagcgagggcuacgccgcccaccuggccgcccuggaggccagccacagaagcagacccaagaagaacaacagcagaaugauccugagaaagggcagcuucggccugcacgcccagcccgaguuccugagaaagagaaaccaccugagaagaaccaugagcgugcagcagcccgacccccccgccgccaaccccaagcccgagagagcccagagccagcccgagagcgacaaggaccacgagagaccccugcccgcccugagcugggccagaggcccccccaaguucgagagcgugcccuaa

SEQ ID NO: 21567 - RNA, 3117 nt, Artificial Sequence
  PITRM1__Homo_sapiens__NP_001229236
auguggagaugcggcggcagacagggccugugcgugcugagaagacugagcggcggccacgcccaccacagagccuggagauggaacagcaacagagccugcgagagagcccugcaguacaagcugggcgacaagauccacggcuucaccgugaaccaggugaccagcgugcccgagcuguuccugaccgccgugaagcugacccacgacgacaccggcgccagauaccugcaccuggccagagaggacaccaacaaccuguucagcgugcaguucagaaccacccccauggacagcaccggcgugccccacauccuggagcacaccgugcugugcggcagccagaaguaccccugcagagaccccuucuucaagaugcugaacagaagccugagcaccuucaugaacgccuucaccgccagcgacuacacccuguaccccuucagcacccagaaccccaaggacuuccagaaccugcugagcguguaccuggacgccaccuucuuccccugccugagagagcuggacuucuggcaggagggcuggagacuggagcacgagaaccccagcgacccccagaccccccugguguucaagggcgugguguucaacgagaugaagggcgccuucaccgacaacgagagaaucuucagccagcaccugcagaacagacugcugcccgaccacaccuacagcguggugagcggcggcgacccccugugcauccccgagcugaccugggagcagcugaagcaguuccacgccacccacuaccaccccagcaacgccagauucuucaccuacggcaacuucccccuggagcagcaccugaagcagauccacgaggaggcccugagcaaguuccagaagaucgagcccagcaccguggugcccgcccagacccccugggacaagcccagagaguuccagaucaccugcggccccgacagcuucgccaccgaccccagcaagcagaccaccaucagcgugagcuuccugcugcccgacaucaccgacaccuucgaggccuucacccugagccugcugagcagccugcugaccagcggccccaacagccccuucuacaaggcccugaucgagagcggccugggcaccgacuucagccccgacgugggcuacaacggcuacaccagagaggccuacuucagcgugggccugcagggcaucgccgagaaggacaucgagaccgugagaagccugaucgacagaaccaucgacgaggugguggagaagggcuucgaggacgacagaaucgaggcccugcugcacaagaucgagauccagaugaagcaccagagcaccagcuucggccugaugcugaccagcuacaucgccagcugcuggaaccacgacggcgaccccguggagcugcugaagcugggcaaccagcuggccaaguucagacagugccugcaggagaaccccaaguuccugcaggagaaggugaagcaguacuucaagaacaaccagcacaagcugacccugagcaugagacccgacgacaaguaccacgagaagcaggcccagguggaggccaccaagcugaagcagaagguggaggcccugagccccggcgacagacagcagaucuacgagaagggccuggagcugagaagccagcagagcaagccccaggacgccagcugccugcccgcccugaaggugagcgacaucgagcccaccauccccgugaccgagcuggacguggugcugaccgccggcgacauccccgugcaguacugcgcccagcccaccaacggcaugguguacuucagagccuucagcagccugaacacccugcccgaggagcugagacccuacgugccccuguucugcagcgugcugaccaagcugggcugcggccugcuggacuacagagagcaggcccagcagaucgagcugaagaccggcggcaugagcgccagcccccacgugcugcccgacgacagccacauggacaccuacgagcaggugggcgugcuguucagcagccugugccuggacagaaaccugcccgacaugaugcagcuguggagcgagaucuucaacaaccccugcuucgaggaggaggagcacuucaaggugcuggugaagaugaccgcccaggagcuggccaacggcauccccgacagcggccaccuguacgccagcaucagagccggcagaacccugacccccgccggcgaccugcaggagaccuucagcggcauggaccaggugagacugaugaagagaaucgccgagaugaccgacaucaagcccauccugagaaagcugcccagaaucaagaagcaccugcugaacggcgacaacaugagaugcagcgugaacgccaccccccagcagaugccccagaccgagaaggccguggaggacuuccugagaagcaucggcagaagcaagaaggagagaagacccgugagaccccacaccguggagaagcccgugcccagcagcagcggcggcgacgcccacgugccccacggcagccaggugaucagaaagcuggugauggagcccaccuucaagcccuggcagaugaagacccacuuccugaugcccuuccccgugaacuacgugggcgagugcaucagaaccgugcccuacaccgaccccgaccacgccagccugaagauccuggccagacugaugaccgccaaguuccugcacaccgagaucagagagaagggcggcgccuacggcggcggcgccaagcugagccacaacggcaucuucacccuguacagcuacagagaccccaacaccaucgagacccugcagagcuucggcaaggccguggacugggccaagagcggcaaguucacccagcaggacaucgacgaggccaagcugagcguguucagcaccguggacgcccccguggcccccagcgacaagggcauggaccacuuccuguacggccugagcgacgagaugaagcaggcccacagagagcagcuguucgccgugagccacgacaagcugcuggccgugagcgacagauaccugggcaccggcaagagcacccacggccuggccauccugggccccgagaaccccaagaucgccaaggaccccagcuggaucauccaguaa

SEQ ID NO: 21568 - RNA, 945 nt, Artificial Sequence
  PITX1__Homo_sapiens__NP_002644
auggacgccuucaagggcggcaugagccuggagagacugcccgagggccugagacccccccccccccccccccacgacaugggccccgccuuccaccuggccagacccgccgaccccagagagccccuggagaacagcgccagcgagagcagcgacaccgagcugcccgagaaggagagaggcggcgagcccaagggccccgaggacagcggcgccggcggcaccggcugcggcggcgccgacgaccccgccaagaagaagaagcagagaagacagagaacccacuucaccagccagcagcugcaggagcuggaggccaccuuccagagaaacagauaccccgacaugagcaugagagaggagaucgccguguggaccaaccugaccgagcccagagugagagugugguucaagaacagaagagccaaguggagaaagagagagagaaaccagcagcuggaccugugcaagggcggcuacgugccccaguucagcggccuggugcagcccuacgaggacguguacgccgccggcuacagcuacaacaacugggccgccaagagccuggcccccgccccccugagcaccaagagcuucaccuucuucaacagcaugagcccccugagcagccagagcauguucagcgcccccagcagcaucagcagcaugaccaugcccagcagcaugggccccggcgccgugcccggcaugcccaacagcggccugaacaacaucaacaaccugaccggcagcagccugaacagcgccaugagccccggcgccugccccuacggcacccccgccagccccuacagcguguacagagacaccugcaacagcagccuggccagccugagacugaagagcaagcagcacagcagcuucggcuacggcggccugcagggccccgccagcggccugaacgccugccaguacaacagcuaa

SEQ ID NO: 21569 - RNA, 975 nt, Artificial Sequence
  PITX2__Homo_sapiens__NP_000316
augaacugcaugaagggcccccugcaccuggagcacagagccgccggcaccaagcugagcgccgugagcagcagcagcugccaccacccccagccccuggccauggccagcgugcuggcccccggccagcccagaagccuggacagcagcaagcacagacuggaggugcacaccaucagcgacaccagcagccccgaggccgccgagaaggacaagagccagcagggcaagaacgaggacgugggcgccgaggaccccagcaagaagaagagacagagaagacagagaacccacuucaccagccagcagcugcaggagcuggaggccaccuuccagagaaacagauaccccgacaugagcaccagagaggagaucgccguguggaccaaccugaccgaggccagagugagagugugguucaagaacagaagagccaaguggagaaagagagagagaaaccagcaggccgagcugugcaagaacggcuucggcccccaguucaacggccugaugcagcccuacgacgacauguaccccggcuacagcuacaacaacugggccgccaagggccugaccagcgccagccugagcaccaagagcuuccccuucuucaacagcaugaacgugaacccccugagcagccagagcauguucagcccccccaacagcaucagcagcaugagcaugagcagcagcauggugcccagcgccgugaccggcgugcccggcagcagccugaacagccugaacaaccugaacaaccugagcagccccagccugaacagcgccgugcccacccccgccugccccuacgccccccccaccccccccuacguguacagagacaccugcaacagcagccuggccagccugagacugaaggccaagcagcacagcagcuucggcuacgccagcgugcagaaccccgccagcaaccugagcgccugccaguacgccguggacagacccguguaa

SEQ ID NO: 21570 - RNA, 909 nt, Artificial Sequence
  PITX3__Homo_sapiens__NP_005020
auggaguucggccugcugagcgaggccgaggccagaagccccgcccugagccugagcgacgccggcaccccccacccccagcugcccgagcacggcugcaagggccaggagcacagcgacagcgagaaggccagcgccagccugcccggcggcagccccgaggacggcagccugaagaagaagcagagaagacagagaacccacuucaccagccagcagcugcaggagcuggaggccaccuuccagagaaacagauaccccgacaugagcaccagagaggagaucgccguguggaccaaccugaccgaggccagagugagagugugguucaagaacagaagagccaaguggagaaagagagagagaagccagcaggccgagcugugcaagggcagcuucgccgccccccugggcggccuggugccccccuacgaggagguguaccccggcuacagcuacggcaacuggccccccaaggcccuggcccccccccuggccgccaagaccuuccccuucgccuucaacagcgugaacgugggcccccuggccagccagcccguguucagcccccccagcagcaucgccgccagcauggugcccagcgccgccgccgcccccggcaccgugcccggccccggcgcccugcagggccugggcggcggcccccccggccuggcccccgccgccgugagcagcggcgccgugagcugccccuacgccagcgccgccgccgccgccgccgccgccgccagcagccccuacguguacagagaccccugcaacagcagccuggccagccugagacugaaggccaagcagcacgccagcuucagcuaccccgccgugcacggccccccccccgccgccaaccugagccccugccaguacgccguggagagacccguguaa

SEQ ID NO: 21571 - RNA, 2490 nt, Artificial Sequence
  PIWIL1__Homo_sapiens__NP_001177900
augaccggcagagccagagccagagccagaggcagagccagaggccaggagaccgcccagcuggugggcagcaccgccagccagcagcccggcuacauccagcccagaccccagcccccccccgccgagggcgagcuguucggcagaggcagacagagaggcaccgccggcggcaccgccaagagccagggccugcagaucagcgccggcuuccaggagcugagccuggccgagagaggcggcagaagaagagacuuccacgaccugggcgugaacaccagacagaaccuggaccacgugaaggagagcaagaccggcagcagcggcaucaucgugagacugagcaccaaccacuucagacugaccagcagaccccagugggcccuguaccaguaccacaucgacuacaacccccugauggaggccagaagacugagaagcgcccugcuguuccagcacgaggaccugaucggcaagugccacgccuucgacggcaccauccuguuccugcccaagagacugcagcagaaggugaccgagguguucagcaagaccagaaacggcgaggacgugagaaucaccaucacccugaccaacgagcugccccccaccagccccaccugccugcaguucuacaacaucaucuucagaagacugcugaagaucaugaaccugcagcagaucggcagaaacuacuacaaccccaacgaccccaucgacauccccagccacagacuggugaucuggcccggcuucaccaccagcauccugcaguacgagaacagcaucaugcugugcaccgacgugagccacaaggugcugagaagcgagaccgugcuggacuucauguucaacuucuaccaccagaccgaggagcacaaguuccaggagcaggugagcaaggagcugaucggccugguggugcugaccaaguacaacaacaagaccuacagaguggacgacaucgacugggaccagaaccccaagagcaccuucaagaaggccgacggcagcgaggugagcuuccuggaguacuacagaaagcaguacaaccaggagaucaccgaccugaagcagcccgugcuggugagccagcccaagagaagaagaggccccggcggcacccugcccggccccgccaugcugauccccgagcugugcuaccugaccggccugaccgacaagaugagaaacgacuucaacgugaugaaggaccuggccgugcacaccagacugacccccgagcagagacagagagaggugggcagacugaucgacuacauccacaagaacgacaacgugcagagagagcugagagacuggggccugagcuucgacagcaaccugcugagcuucagcggcagaauccugcagaccgagaagauccaccagggcggcaagaccuucgacuacaacccccaguucgccgacuggagcaaggagaccagaggcgccccccugaucagcgugaagccccuggacaacuggcugcugaucuacaccagaagaaacuacgaggccgccaacagccugauccagaaccuguucaaggugacccccgccaugggcaugcagaugagaaaggccaucaugaucgagguggacgacagaaccgaggccuaccugagagugcugcagcagaaggugaccgccgacacccagaucguggugugccugcugagcagcaacagaaaggacaaguacgacgccaucaagaaguaccugugcaccgacugccccacccccagccagugcgugguggccagaacccugggcaagcagcagaccgugauggccaucgccaccaagaucgcccugcagaugaacugcaagaugggcggcgagcuguggagaguggacaucccccugaagcuggugaugaucgugggcaucgacugcuaccacgacaugaccgccggcagaagaagcaucgccggcuucguggccagcaucaacgagggcaugaccagaugguucagcagaugcaucuuccaggacagaggccaggagcugguggacggccugaaggugugccugcaggccgcccugagagccuggaacagcugcaacgaguacaugcccagcagaaucaucguguacagagacggcgugggcgacggccagcugaagacccuggugaacuacgaggugccccaguuccuggacugccugaagagcaucggcagaggcuacaaccccagacugaccgugaucguggugaagaagagagugaacaccagauucuucgcccagagcggcggcagacugcagaacccccugcccggcaccgugaucgacguggaggugaccagacccgagugguacgacuucuucaucgugagccaggccgugagaagcggcagcgugagccccacccacuacaacgugaucuacgacaacagcggccugaagcccgaccacauccagagacugaccuacaagcugugccacaucuacuacaacuggcccgugagcgccagcaccugcuaa

SEQ ID NO: 21572 - RNA, 2922 nt, Artificial Sequence
  PIWIL2__Homo_sapiens__NP_001129193
auggaccccuucagacccagcuucagaggccagagccccauccaccccagccagugccaggccgugagaaugcccggcugcuggccccaggccagcaagccccuggaccccgcccugggcagaggcgcccccgccggcagaggccacguguucggcaagcccgaggagcccagcacccagagaggccccgcccagagagagagcgugggccuggugagcauguucagaggccugggcaucgagaccgugagcaagaccccccugaagagagagaugcugcccagcggcagaggcauccugggcagaggccugagcgccaaccuggugagaaaggacagagaggagcugagccccaccuucugggaccccaaggugcuggccgccggcgacagcaagauggccgagaccagcgugggcuggagcagaacccugggcagaggcagcagcgacgccagccugcugccccugggcagagccgccggcggcaucagcagagagguggacaagccccccugcaccuucagcacccccagcagaggccccccccagcugagcagcccccccgcccugccccagagcccccugcacagccccgacagaccccuggugcugaccguggagcacaaggagaaggagcugaucgugaagcagggcagcaagggcaccccccagagccugggccugaaccuggugaagauccagugccacaacgaggccguguaccaguaccacgugaccuucagccccaacguggagugcaagagcaugagauucggcaugcugaaggaccaccaggccgugaccggcaacgugaccgccuucgacggcagcauccuguaccugcccgugaagcugcagcaggugcuggagcugaagagccagagaaagaccgacagcgccgagaucagcaucaagauccagaugaccaagauccuggagcccugcagcgaccugugcauccccuucuacaacgugguguucagaagagugaugaagcugcuggacaugaagcuggugggcagaaacuucuacgaccccaccagcgccauggugcugcagcagcacagacugcagaucuggcccggcuacgccgccagcaucagaagaaccgacggcggccuguuccugcuggccgacgugagccacaaggugaucagaaacgacugcgugcuggacgugaugcacgccaucuaccagcagaacaaggagcacuuccaggacgagugcaccaagcugcuggugggcaacaucgugaucaccagauacaacaacagaaccuacagaaucgacgacguggacuggaacaagacccccaaggacagcuucaccaugagcgacggcaaggagaucaccuuccuggaguacuacagcaagaacuacggcaucaccgugaaggaggaggaccagccccugcugauccacagacccagcgagagacaggacaaccacggcaugcugcugaagggcgagauccugcugcugcccgagcugagcuucaugaccggcauccccgagaagaugaagaaggacuucagagccaugaaggaccuggcccagcagaucaaccugagccccaagcagcaccacagcgcccuggagugccugcugcagagaaucgccaagaacgaggccgccaccaacgagcugaugagauggggccugagacugcagaaggacgugcacaagaucgagggcagagugcugcccauggagagaaucaaccugaagaacaccagcuucaucaccagccaggagcugaacugggugaaggaggugaccagagaccccagcauccugaccauccccaugcacuucugggcccuguucuaccccaagagagccauggaccaggccagagagcuggugaacaugcuggagaagaucgccggccccaucggcaugagaaugagcccccccgccuggguggagcugaaggacgacagaaucgagaccuacgugagaaccauccagagcacccugggcgccgagggcaagauccagaugguggugugcaucaucaugggccccagagacgaccuguacggcgccaucaagaagcugugcugcgugcagagccccgugcccagccagguggugaacgugagaaccaucggccagcccaccagacugagaagcguggcccagaagauccugcugcagaucaacugcaagcugggcggcgagcuguggggcguggacaucccccugaagcagcugauggugaucggcauggacguguaccacgaccccagcagaggcaugagaagcguggugggcuucguggccagcaucaaccugacccugaccaagugguacagcagagugguguuccagaugccccaccaggagaucguggacagccugaagcugugccuggugggcagccugaagaaguucuacgaggugaaccacugccugcccgagaagaucgugguguacagagacggcgugagcgacggccagcugaagaccguggccaacuacgagaucccccagcugcagaagugcuucgaggccuucgagaacuaccagcccaagauggugguguucguggugcagaagaagaucagcaccaaccuguaccuggccgccccccagaacuucgugacccccacccccggcaccgugguggaccacaccaucaccagcugcgaguggguggacuucuaccugcuggcccaccacgugagacagggcugcggcauccccacccacuacgugugcgugcugaacaccgccaaccugagccccgaccacaugcagagacugaccuucaagcugugccacauguacuggaacuggcccggcaccaucagagugcccgcccccugcaaguacgcccacaagcuggccuuccugagcggccacauccugcaccacgagcccgccauccagcugugcgagaaccuguucuuccuguaa

SEQ ID NO: 21573 - RNA, 2649 nt, Artificial Sequence
  PIWIL3__Homo_sapiens__NP_001008496
augcccggcagagccagaaccagagccagaggcagagccagaagaagagagagcuaccagcaggaggcccccggcggccccagagcccccggcagcgccaccacccaggagcccccccagcugcagagcacccccagaccccugcaggaggaggugcccguggugagaccccugcagcccagagccgccagaggcggcgccggcggcggcgcccagagccagggcgugaaggagcccggccccgaggccggccugcacaccgccccccugcaggagagaagaaucggcggcguguuccaggaccugguggugaacaccagacaggacaugaagcacgugaaggacagcaagaccggcagcgagggcaccguggugcagcugcuggccaaccacuucagagugaucagcagaccccaguggguggccuacaaguacaacguggacuacaagcccgacaucgaggacggcaaccugagaaccauccugcuggaccagcacagaagaaaguucggcgagagacacaucuucgacggcaacagccugcugcugagcagaccccugaaggagagaagaguggaguggcugagcaccaccaaggacaagaacaucgugaagaucaccguggaguucagcaaggagcugacccccaccagccccgacugccugagauacuacaacauccuguucagaagaaccuucaagcugcuggacuucgagcaggugggcagaaacuacuacaccaagaagaaggccauccagcuguacagacacggcaccagccuggagaucuggcugggcuacgugaccagcgugcugcaguacgagaacagcaucacccugugcgccgacgugagccacaagcugcugagaaucgagaccgccuacgacuucaucaagagaaccagcgcccaggcccagaccggcaacaucagagaggaggugaccaacaagcugaucggcagcaucgugcugaccaaguacaacaacaagaccuacagaguggacgacaucgacuggaagcagaaccccgaggacaccuucaacaagagcgacggcagcaagaucaccuacaucgacuacuacagacagcagcacaaggagaucgugaccgugaagaagcagccccugcuggugagccagggcagauggaagaagggccugaccggcacccagagagagcccauccugcugaucccccagcugugccacaugaccggccugaccgacgagaucugcaaggacuacagcaucgugaaggagcuggccaagcacaccagacugagccccagaagaagacaccacacccugaaggaguucaucaacacccugcaggacaacaagaaggugagagagcugcugcagcugugggaccugaaguucgacaccaacuuccugagcgugcccggcagagugcugaagaacgccaacaucgugcagggcagaagaauggugaaggccaacagccagggcgacuggagcagagagaucagagagcugccccugcugaacgccaugccccugcacagcuggcugauccuguacagcagaagcagccacagagaggccaugagccugaagggccaccugcagagcgugaccgcccccaugggcaucaccaugaagcccgccgagaugaucgagguggacggcgacgccaacagcuacaucgacacccugagaaaguacaccagacccacccugcagaugggcaugagcugccugcugguguucaaggugaucugcauccugcccaacgacgacaagagaagauacgacagcaucaagagauaccugugcaccaagugccccauccccagccagugcguggugaagaagacccuggagaaggugcaggccagaaccaucgugaccaagaucgcccagcagaugaacugcaagaugggcggcgcccuguggaagguggagaccgacgugcagagaaccauguucgugggcaucgacugcuuccacgacaucgugaacagacagaagagcaucgccggcuucguggccagcaccaacgccgagcugaccaagugguacagccagugcgugauccagaagaccggcgaggagcuggugaaggagcuggagaucugccugaaggccgcccuggacguguggugcaagaacgagagcagcaugccccacagcgugaucguguacagagacggcgugggcgacggccagcugcaggcccugcuggaccacgaggccaagaagaugagcaccuaccugaagaccaucagccccaacaacuucacccuggccuucaucguggugaagaagagaaucaacaccagauucuuccugaagcacggcagcaacuuccagaaccccccccccggcaccgugaucgacguggagcugaccagaaacgagugguacgacuucuucaucgugagccagagcgugcaggacggcaccgugacccccacccacuacaacgugaucuacgacaccaucggccugagccccgacaccgugcagagacugaccuacugccugugccacauguacuacaaccugcccggcaucaucagagugcccgcccccugccacuacgcccacaagcuggccuaccuggugggccagagcauccaccaggagcccaacagaagccugagcaccagacuguucuaccuguaa

SEQ ID NO: 21574 - RNA, 2559 nt, Artificial Sequence
  PIWIL4__Homo_sapiens__NP_689644
augagcggcagagccagagugaaggccagaggcaucgccagaagccccagcgccaccgaggugggcagaauccaggccagcccccugcccagaagcguggaccugagcaacaacgaggccagcagcagcaacggcuuccugggcaccagcagaaucagcaccaacgacaaguacggcaucagcagcggcgacgccggcagcaccuucauggagagaggcgugaagaacaagcaggacuucauggaccugagcaucugcaccagagagaagcuggcccacgugagaaacugcaagaccggcagcagcggcauccccgugaagcuggugaccaaccuguucaaccuggacuucccccaggacuggcagcuguaccaguaccacgugaccuacauccccgaccuggccagcagaagacugagaaucgcccugcuguacagccacagcgagcugagcaacaaggccaaggccuucgacggcgccauccuguuccugagccagaagcuggaggagaaggugaccgagcugagcagcgagacccagagaggcgagaccaucaagaugaccaucacccugaagagagagcugcccagcagcagccccgugugcauccagguguucaacaucaucuucagaaagauccugaagaagcugagcauguaccagaucggcagaaacuucuacaaccccagcgagcccauggagaucccccagcacaagcugagccuguggcccggcuucgccaucagcgugagcuacuucgagagaaagcugcuguucagcgccgacgugagcuacaaggugcugagaaacgagaccgugcuggaguucaugaccgcccugugccagagaaccggccugagcugcuucacccagaccugcgagaagcagcugaucggccugaucgugcugaccagauacaacaacagaaccuacagcaucgacgacaucgacuggagcgugaagcccacccacaccuuccagaagagagacggcaccgagaucaccuacguggacuacuacaagcagcaguacgacaucaccgugagcgaccugaaccagcccaugcuggugagccugcugaagaagaagagaaacgacaacagcgaggcccagcuggcccaccugauccccgagcugugcuuccugaccggccugaccgaccaggccaccagcgacuuccagcugaugaaggccguggccgagaagaccagacugagccccagcggcagacagcagagacuggccagacugguggacaacauccagagaaacaccaacgccagauucgagcuggagaccuggggccugcacuucggcagccagaucagccugaccggcagaaucgugcccagcgagaagauccugaugcaggaccacaucugccagcccgugagcgccgccgacuggagcaaggacaucagaaccugcaagauccugaacgcccagagccugaacaccuggcugauccugugcagcgacagaaccgaguacguggccgagagcuuccugaacugccugagaagaguggccggcagcaugggcuucaacguggacuaccccaagaucaucaaggugcaggagaaccccgccgccuucgugagagccauccagcaguacguggaccccgacgugcagcuggugaugugcauccugcccagcaaccagaagaccuacuacgacagcaucaagaaguaccugagcagcgacugccccgugcccagccagugcgugcuggccagaacccugaacaagcagggcaugaugaugagcaucgccaccaagaucgccaugcagaugaccugcaagcugggcggcgagcugugggccguggagaucccccugaagagccugaugguggugggcaucgacgugugcaaggacgcccugagcaaggacgugaugguggugggcugcguggccagcgugaaccccagaaucaccagaugguucagcagaugcauccugcagagaaccaugaccgacguggccgacugccugaagguguucaugaccggcgcccugaacaagugguacaaguacaaccacgaccugcccgccagaaucaucguguacagagccggcgugggcgacggccagcugaagacccugaucgaguacgaggugccccagcugcugagcagcguggccgagagcagcagcaacaccagcagcagacugagcgugaucguggugagaaagaagugcaugcccagauucuucaccgagaugaacagaaccgugcagaaccccccccugggcaccgugguggacagcgaggccaccagaaacgagugguacgacuucuaccugaucagccagguggccugcagaggcaccgugagccccaccuacuacaacgugaucuacgacgacaacggccugaagcccgaccacaugcagagacugaccuucaagcugugccaccuguacuacaacuggcccggcaucgugagcgugcccgcccccugccaguacgcccacaagcugaccuuccugguggcccagagcauccacaaggagcccagccuggagcuggccaaccaccuguucuaccuguaa

SEQ ID NO: 21575 - RNA, 1368 nt, Artificial Sequence
  PJA1__Homo_sapiens__NP_071763
augggccaggagagcagcaagcccguguggcccaaccccaccggcggcuaccagagcaacaccggcagaagauacggcagaagacacgccuacgugagcuucagaccccccaccagccagagagagagaaucgccagccagagaaagaccaacagcgaggugcccaugcacagaagcgcccccagccagaccaccaagagaagcagaagccccuucagcaccaccagaagaagcugggacgacagcgagagcagcggcaccaaccugaacaucgacaacgaggacuacagcagcaccagcagauggagagacaccgccaacgacaacgagggccacagcgacggccuggccagaagaggcagaggcgagagcagcagcggcuaccccgagcccaaguaccccgaggacaagagagaggccagaagcgaccaggugaagcccgagaaggugcccagaagaagaagaaccauggccgaccccgacuucuggacccacagcgacgacuacuacaaguacugcgacgaggacagcgacagcgacaaggaguggaucgccgcccugagaagaaaguacagaagcagagagcagacccugagcagcagcggcgagagcugggagacccugcccggcaaggaggagagagagcccccccaggccaaggugagcgccagcaccggcaccagccccggccccggcgccagcgccagcgccggcgccggcgccggcgccagcgccggcagcaacggcagcaacuaccuggaggaggugagagagcccagccugcaggaggagcaggccagccuggaggagggcgagauccccuggcugcaguaccacgagaacgacagcagcagcgagggcgacaacgacagcggccacgagcugaugcagcccggcguguucaugcuggacggcaacaacaaccuggaggacgacagcagcgugagcgaggaccuggagguggacuggagccuguucgacggcuucgccgacggccugggcguggccgaggccaucagcuacguggacccccaguuccugaccuacauggcccuggaggagagacuggcccaggccauggagaccgcccuggcccaccuggagagccuggccguggacguggagguggccaacccccccgccagcaaggagagcaucgacgcccugcccgagauccuggugaccgaggaccacggcgccgugggccaggagaugugcugccccaucugcugcagcgaguacgugaagggcgagguggccaccgagcugcccugccaccacuacuuccacaagcccugcgugagcaucuggcugcagaagagcggcaccugccccgugugcagaugcauguucccccccccccuguaa

SEQ ID NO: 21576 - RNA, 2127 nt, Artificial Sequence
  PJA2__Homo_sapiens__NP_055634
augagccaguacaccgagaaggagcccgccgccauggaccaggagagcggcaaggccguguggcccaagcccgccggcggcuaccagaccaucaccggcagaagauacggcagaagacacgccuacgugagcuucaagcccugcaugaccagacacgagagaagccugggcagagccggcgacgacuacgaggugcuggagcuggacgacgugcccaaggagaacagcagcggcagcagcccccuggaccagguggacagcagccugcccagcgagcccaucuucgagaagagcgagaccgagauccccaccugcggcagcgcccugaaccagaccaccgagagcagccagagcuucguggccgugcaccacagcgaggagggcagagacacccugggcagcagcaccaaccugcacaaccacagcgagggcgaguacauccccggcgccugcagcgccagcagcgugcagaacggcaucgcccuggugcacaccgacagcuacgaccccgacggcaagcacggcgaggacaacgaccaccugcagcugagcgccgaggugguggagggcagcagauaccaggagagccugggcaacaccguguucgagcuggagaacagagaggccgaggccuacaccggccugagcccccccgugcccagcuucaacugcgaggugagagacgaguucgaggagcuggacagcgugccccuggugaagagcagcgccggcgacaccgaguucgugcaccagaacagccaggagauccagagaagcagccaggacgagauggugagcaccaagcagcagaacaacaccagccaggagagacagaccgagcacagccccgaggacgccgccugcggccccggccacaucugcagcgagcagaacaccaacgacagagagaagaaccacggcagcagccccgagcagguggugagacccaaggugagaaagcugaucagcagcagccagguggaccaggagaccggcuucaacagacacgaggccaagcagagaagcgugcagagauggagagaggcccuggagguggaggagagcggcagcgacgaccugcugaucaagugcgaggaguacgacggcgagcacgacugcauguuccuggacccccccuacagcagagugaucacccagagagagaccgagaacaaccagaugaccagcgagagcggcgccaccgccggcagacaggagguggacaacaccuucuggaacggcugcggcgacuacuaccagcuguacgacaaggacgaggacagcagcgagugcagcgacggcgaguggagcgccagccugccccacagauucagcggcaccgagaaggaccagagcagcagcgacgagagcugggagacccugcccggcaaggacgagaacgagcccgagcugcagagcgacagcagcggccccgaggaggagaaccaggagcugagccugcaggagggcgagcagaccagccuggaggagggcgagauccccuggcugcaguacaacgaggugaacgagagcagcagcgacgagggcaacgagcccgccaacgaguucgcccagcccgccuucaugcuggacggcaacaacaaccuggaggacgacagcagcgugagcgaggaccuggacguggacuggagccuguucgacggcuucgccgacggccugggcguggccgaggccaucagcuacguggacccccaguuccugaccuacauggcccuggaggagagacuggcccaggccauggagaccgcccuggcccaccuggagagccuggccguggacguggagguggccaacccccccgccagcaaggagagcaucgacggccugcccgagacccuggugcuggaggaccacaccgccaucggccaggagcagugcugccccaucugcugcagcgaguacaucaaggacgacaucgccaccgagcugcccugccaccacuucuuccacaagcccugcgugagcaucuggcugcagaagagcggcaccugccccgugugcagaagacacuucccccccgccgugaucgaggccagcgccgcccccagcagcgagcccgaccccgacgccccccccagcaacgacagcaucgccgaggcccccuaa

SEQ ID NO: 21577 - RNA, 12909 nt, Artificial Sequence
  PKD1__Homo_sapiens__NP_000287
augccccccgccgcccccgccagacuggcccuggcccugggccugggccuguggcugggcgcccuggccggcggccccggcagaggcugcggccccugcgagccccccugccugugcggccccgcccccggcgccgccugcagagugaacugcagcggcagaggccugagaacccugggccccgcccugagaauccccgccgacgccaccgcccuggacgugagccacaaccugcugagagcccuggacgugggccugcuggccaaccugagcgcccuggccgagcuggacaucagcaacaacaagaucagcacccuggaggagggcaucuucgccaaccuguucaaccugagcgagaucaaccugagcggcaaccccuucgagugcgacugcggccuggccuggcugcccagaugggccgaggagcagcaggugagaguggugcagcccgaggccgccaccugcgccggccccggcagccuggccggccagccccugcugggcaucccccugcuggacagcggcugcggcgaggaguacguggccugccugcccgacaacagcagcggcaccguggccgccgugagcuucagcgccgcccacgagggccugcugcagcccgaggccugcagcgccuucugcuucagcaccggccagggccuggccgcccugagcgagcagggcuggugccugugcggcgccgcccagcccagcagcgccagcuucgccugccugagccugugcagcggccccccccccccccccgcccccaccugcagaggccccacccugcugcagcacguguuccccgccagccccggcgccacccuggugggcccccacggcccccuggccagcggccagcuggccgccuuccacaucgccgccccccugcccgugaccgccaccagaugggacuucggcgacggcagcgccgagguggacgccgccggccccgccgccagccacagauacgugcugcccggcagauaccacgugaccgccgugcuggcccugggcgccggcagcgcccugcugggcaccgacgugcagguggaggccgcccccgccgcccuggagcuggugugccccagcagcgugcagagcgacgagagccuggaccugagcauccagaacagaggcggcagcggccuggaggccgccuacagcaucguggcccugggcgaggagcccgccagagccgugcacccccugugccccagcgacaccgagaucuuccccggcaacggccacugcuacagacuggugguggagaaggccgccuggcugcaggcccaggagcagugccaggccugggccggcgccgcccuggccaugguggacagccccgccgugcagagauuccuggugagcagagugaccagaagccuggacguguggaucggcuucagcaccgugcagggcguggaggugggccccgccccccagggcgaggccuucagccuggagagcugccagaacuggcugcccggcgagccccaccccgccaccgccgagcacugcgugagacugggccccaccggcuggugcaacaccgaccugugcagcgccccccacagcuacgugugcgagcugcagcccggcggccccgugcaggacgccgagaaccugcuggugggcgcccccagcggcgaccugcagggcccccugaccccccuggcccagcaggacggccugagcgccccccacgagcccguggaggugaugguguuccccggccugagacugagcagagaggccuuccugaccaccgccgaguucggcacccaggagcugagaagacccgcccagcugagacugcagguguacagacugcugagcaccgccggcacccccgagaacggcagcgagcccgagagcagaagccccgacaacagaacccagcuggcccccgccugcaugcccggcggcagauggugccccggcgccaacaucugccugccccuggacgccagcugccacccccaggccugcgccaacggcugcaccagcggccccggccugcccggcgcccccuacgcccuguggagagaguuccuguucagcgugcccgccggcccccccgcccaguacagcgugacccugcacggccaggacgugcugaugcugcccggcgaccuggugggccugcagcacgacgccggccccggcgcccugcugcacugcagccccgcccccggccaccccggcccccaggcccccuaccugagcgccaacgccagcagcuggcugccccaccugcccgcccagcuggagggcaccugggccugccccgccugcgcccugagacugcuggccgccaccgagcagcugaccgugcugcugggccugagacccaaccccggccugagacugcccggcagauacgaggugagagccgaggugggcaacggcgugagcagacacaaccugagcugcagcuucgacguggugagccccguggccggccugagagugaucuaccccgcccccagagacggcagacuguacgugcccaccaacggcagcgcccuggugcugcagguggacagcggcgccaacgccaccgccaccgccagauggcccggcggcagcgugagcgccagauucgagaacgugugccccgcccugguggccaccuucgugcccggcugccccugggagaccaacgacacccuguucagcgugguggcccugcccuggcugagcgagggcgagcacgugguggacguggugguggagaacagcgccagcagagccaaccugagccugagagugaccgccgaggagcccaucugcggccugagagccacccccagccccgaggccagagugcugcagggcgugcuggugagauacagccccgugguggaggccggcagcgacaugguguucagauggaccaucaacgacaagcagagccugaccuuccagaacgugguguucaacgugaucuaccagagcgccgccguguucaagcugagccugaccgccagcaaccacgugagcaacgugaccgugaacuacaacgugaccguggagagaaugaacagaaugcagggccugcaggugagcaccgugcccgccgugcugagccccaacgccacccuggcccugaccgccggcgugcugguggacagcgccguggagguggccuuccuguggaccuucggcgacggcgagcaggcccugcaccaguuccagccccccuacaacgagagcuuccccgugcccgaccccagcguggcccaggugcugguggagcacaacgugaugcacaccuacgccgcccccggcgaguaccugcugaccgugcuggccagcaacgccuucgagaaccugacccagcaggugcccgugagcgugagagccagccugcccagcguggccgugggcgugagcgacggcgugcugguggccggcagacccgugaccuucuacccccacccccugcccagccccggcggcgugcuguacaccugggacuucggcgacggcagccccgugcugacccagagccagcccgccgccaaccacaccuacgccagcagaggcaccuaccacgugagacuggaggugaacaacaccgugagcggcgccgccgcccaggccgacgugagaguguucgaggagcugagaggccugagcguggacaugagccuggccguggagcagggcgcccccgugguggugagcgccgccgugcagaccggcgacaacaucaccuggaccuucgacaugggcgacggcaccgugcugagcggccccgaggccaccguggagcacguguaccugagagcccagaacugcaccgugaccgugggcgccgccagccccgccggccaccuggccagaagccugcacgugcugguguucgugcuggaggugcugagaguggagcccgccgccugcauccccacccagcccgacgccagacugaccgccuacgugaccggcaaccccgcccacuaccuguucgacuggaccuucggcgacggcagcagcaacaccaccgugagaggcugccccaccgugacccacaacuucaccagaagcggcaccuucccccuggcccuggugcugagcagcagagugaacagagcccacuacuucaccagcaucugcguggagcccgaggugggcaacgugacccugcagcccgagagacaguucgugcagcugggcgacgaggccuggcugguggccugcgccuggccccccuuccccuacagauacaccugggacuucggcaccgaggaggccgcccccaccagagccagaggccccgaggugaccuucaucuacagagaccccggcagcuaccuggugaccgugaccgccagcaacaacaucagcgccgccaacgacagcgcccugguggaggugcaggagcccgugcuggugaccagcaucaaggugaacggcagccugggccuggagcugcagcagcccuaccuguucagcgccgugggcagaggcagacccgccagcuaccugugggaccugggcgacggcggcuggcuggagggccccgaggugacccacgccuacaacagcaccggcgacuucaccgugagaguggccggcuggaacgaggugagcagaagcgaggccuggcugaacgugaccgugaagagaagagugagaggccugguggugaacgccagcagaaccguggugccccugaacggcagcgugagcuucagcaccagccuggaggccggcagcgacgugagauacagcugggugcugugcgacagaugcacccccauccccggcggccccaccaucagcuacaccuucagaagcgugggcaccuucaacaucaucgugaccgccgagaacgaggugggcagcgcccaggacagcaucuucguguacgugcugcagcugaucgagggccugcagguggugggcggcggcagauacuuccccaccaaccacaccgugcagcugcaggccguggugagagacggcaccaacgugagcuacagcuggaccgccuggagagacagaggccccgcccuggccggcagcggcaagggcuucagccugaccgugcuggaggccggcaccuaccacgugcagcugagagccaccaacaugcugggcagcgccugggccgacugcaccauggacuucguggagcccgugggcuggcugaugguggccgccagccccaaccccgccgccgugaacaccagcgugacccugagcgccgagcuggccggcggcagcggcgugguguacaccuggagccuggaggagggccugagcugggagaccagcgagcccuucaccacccacagcuuccccacccccggccugcaccuggugaccaugaccgccggcaacccccugggcagcgccaacgccaccguggagguggacgugcaggugcccgugagcggccugagcaucagagccagcgagcccggcggcagcuucguggccgccggcagcagcgugcccuucuggggccagcuggccaccggcaccaacgugagcuggugcugggccgugcccggcggcagcagcaagagaggcccccacgugaccaugguguuccccgacgccggcaccuucagcaucagacugaacgccagcaacgccgugagcugggugagcgccaccuacaaccugaccgccgaggagcccaucgugggccuggugcugugggccagcagcaaggugguggcccccggccagcuggugcacuuccagauccugcuggccgccggcagcgccgugaccuucagacugcaggugggcggcgccaaccccgaggugcugcccggccccagauucagccacagcuuccccagagugggcgaccacguggugagcgugagaggcaagaaccacgugagcugggcccaggcccaggugagaaucguggugcuggaggccgugagcggccugcaggugcccaacugcugcgagcccggcaucgccaccggcaccgagagaaacuucaccgccagagugcagagaggcagcagaguggccuacgccugguacuucagccugcagaaggugcagggcgacagccuggugauccugagcggcagagacgugaccuacacccccguggccgccggccugcuggagauccaggugagagccuucaacgcccugggcagcgagaacagaacccuggugcuggaggugcaggacgccgugcaguacguggcccugcagagcggccccugcuucaccaacagaagcgcccaguucgaggccgccaccagccccagccccagaagaguggccuaccacugggacuucggcgacggcagccccggccaggacaccgacgagcccagagccgagcacagcuaccugagacccggcgacuacagagugcaggugaacgccagcaaccuggugagcuucuucguggcccaggccaccgugaccgugcaggugcuggccugcagagagcccgagguggacguggugcugccccugcaggugcugaugagaagaagccagagaaacuaccuggaggcccacguggaccugagagacugcgugaccuaccagaccgaguacagaugggagguguacagaaccgccagcugccagagacccggcagacccgccagaguggcccugcccggcguggacgugagcagacccagacuggugcugcccagacuggcccugcccgugggccacuacugcuucguguucguggugagcuucggcgacaccccccugacccagagcauccaggccaacgugaccguggcccccgagagacuggugcccaucaucgagggcggcagcuacagaguguggagcgacaccagagaccuggugcuggacggcagcgagagcuacgaccccaaccuggaggacggcgaccagaccccccugagcuuccacugggccugcguggccagcacccagagagaggccggcggcugcgcccugaacuucggccccagaggcagcagcaccgugaccauccccagagagagacuggccgccggcguggaguacaccuucagccugaccguguggaaggccggcagaaaggaggaggccaccaaccagaccgugcugaucagaagcggcagagugcccaucgugagccuggagugcgugagcugcaaggcccaggccguguacgaggugagcagaagcagcuacguguaccuggagggcagaugccugaacugcagcagcggcagcaagagaggcagaugggccgccagaaccuucagcaacaagacccuggugcuggacgagaccaccaccagcaccggcagcgccggcaugagacuggugcugagaagaggcgugcugagagacggcgagggcuacaccuucacccugaccgugcugggcagaagcggcgaggaggagggcugcgccagcaucagacugagccccaacagacccccccugggcggcagcugcagacuguucccccugggcgccgugcacgcccugaccaccaaggugcacuucgagugcaccggcuggcacgacgccgaggacgccggcgccccccugguguacgcccugcugcugagaagaugcagacagggccacugcgaggaguucugcguguacaagggcagccugagcagcuacggcgccgugcugccccccggcuucagaccccacuucgaggugggccuggccgugguggugcaggaccagcugggcgccgccgugguggcccugaacagaagccuggccaucacccugcccgagcccaacggcagcgccaccggccugaccguguggcugcacggccugaccgccagcgugcugcccggccugcugagacaggccgacccccagcacgugaucgaguacagccuggcccuggugaccgugcugaacgaguacgagagagcccuggacguggccgccgagcccaagcacgagagacagcacagagcccagaucagaaagaacaucaccgagacccuggugagccugagagugcacaccguggacgacauccagcagaucgccgccgcccuggcccagugcaugggccccagcagagagcuggugugcagaagcugccugaagcagacccugcacaagcuggaggccaugaugcugauccugcaggccgagaccaccgccggcaccgugacccccaccgccaucggcgacagcauccugaacaucaccggcgaccugauccaccuggccagcagcgacgugagagccccccagcccagcgagcugggcgccgagagccccagcagaaugguggccagccaggccuacaaccugaccagcgcccugaugagaauccugaugagaagcagagugcugaacgaggagccccugacccuggccggcgaggagaucguggcccagggcaagagaagcgaccccagaagccugcugugcuacggcggcgcccccggccccggcugccacuucagcauccccgaggccuucagcggcgcccuggccaaccugagcgacguggugcagcugaucuuccugguggacagcaaccccuuccccuucggcuacaucagcaacuacaccgugagcaccaagguggccagcauggccuuccagacccaggccggcgcccagauccccaucgagagacuggccagcgagagagccaucaccgugaaggugcccaacaacagcgacugggccgccagaggccacagaagcagcgccaacagcgccaacagcgugguggugcagccccaggccagcgugggcgccguggugacccuggacagcagcaaccccgccgccggccugcaccugcagcugaacuacacccugcuggacggccacuaccugagcgaggagcccgagcccuaccuggccguguaccugcacagcgagcccagacccaacgagcacaacugcagcgccagcagaagaaucagacccgagagccugcagggcgccgaccacagacccuacaccuucuucaucagccccggcagcagagaccccgccggcagcuaccaccugaaccugagcagccacuucagauggagcgcccugcaggugagcgugggccuguacaccagccugugccaguacuucagcgaggaggacaugguguggagaaccgagggccugcugccccuggaggagaccagccccagacaggccgugugccugaccagacaccugaccgccuucggcgccagccuguucgugccccccagccacgugagauucguguuccccgagcccaccgccgacgugaacuacaucgugaugcugaccugcgccgugugccuggugaccuacauggugauggccgccauccugcacaagcuggaccagcuggacgccagcagaggcagagccauccccuucugcggccagagaggcagauucaaguacgagauccuggugaagaccggcuggggcagaggcagcggcaccaccgcccacgugggcaucaugcuguacggcguggacagcagaagcggccacagacaccuggacggcgacagagccuuccacagaaacagccuggacaucuucagaaucgccaccccccacagccugggcagcguguggaagaucagaguguggcacgacaacaagggccugagccccgccugguuccugcagcacgugaucgugagagaccugcagaccgccagaagcgccuucuuccuggugaacgacuggcugagcguggagaccgaggccaacggcggccugguggagaaggaggugcuggccgccagcgacgccgcccugcugagauucagaagacugcugguggccgagcugcagagaggcuucuucgacaagcacaucuggcugagcaucugggacagaccccccagaagcagauucaccagaauccagagagccaccugcugcgugcugcugaucugccuguuccugggcgccaacgccgugugguacggcgccgugggcgacagcgccuacagcaccggccacgugagcagacugagcccccugagcguggacaccguggccgugggccuggugagcagcguggugguguaccccguguaccuggccauccuguuccuguucagaaugagcagaagcaagguggccggcagccccagccccacccccgccggccagcaggugcuggacaucgacagcugccuggacagcagcgugcuggacagcagcuuccugaccuucagcggccugcacgccgaggccuucgugggccagaugaagagcgaccuguuccuggacgacagcaagagccuggugugcuggcccagcggcgagggcacccugagcuggcccgaccugcugagcgaccccagcaucgugggcagcaaccugagacagcuggccagaggccaggccggccacggccugggccccgaggaggacggcuucagccuggccagccccuacagccccgccaagagcuucagcgccagcgacgaggaccugauccagcaggugcuggccgagggcgugagcagccccgcccccacccaggacacccacauggagaccgaccugcugagcagccugagcagcacccccggcgagaagaccgagacccuggcccugcagagacugggcgagcugggcccccccagccccggccugaacugggagcagccccaggccgccagacugagcagaaccggccugguggagggccugagaaagagacugcugcccgccuggugcgccagccuggcccacggccugagccugcugcugguggccguggccguggccgugagcggcugggugggcgccagcuucccccccggcgugagcguggccuggcugcugagcagcagcgccagcuuccuggccagcuuccugggcugggagccccugaaggugcugcuggaggcccuguacuucagccugguggccaagagacugcaccccgacgaggacgacacccugguggagagccccgccgugacccccgugagcgccagagugcccagagugagacccccccacggcuucgcccuguuccuggccaaggaggaggccagaaaggugaagagacugcacggcaugcugagaagccugcugguguacaugcuguuccugcuggugacccugcuggccagcuacggcgacgccagcugccacggccacgccuacagacugcagagcgccaucaagcaggagcugcacagcagagccuuccuggccaucaccagaagcgaggagcuguggcccuggauggcccacgugcugcugcccuacgugcacggcaaccagagcagccccgagcugggcccccccagacugagacaggugagacugcaggaggcccuguaccccgacccccccggccccagagugcacaccugcagcgccgccggcggcuucagcaccagcgacuacgacgugggcugggagagcccccacaacggcagcggcaccugggccuacagcgcccccgaccugcugggcgccuggagcuggggcagcugcgccguguacgacagcggcggcuacgugcaggagcugggccugagccuggaggagagcagagacagacugagauuccugcagcugcacaacuggcuggacaacagaagcagagccguguuccuggagcugaccagauacagccccgccgugggccugcacgccgccgugacccugagacuggaguuccccgccgccggcagagcccuggccgcccugagcgugagacccuucgcccugagaagacugagcgccggccugagccugccccugcugaccagcgugugccugcugcuguucgccgugcacuucgccguggccgaggccagaaccuggcacagagagggcagauggagagugcugagacugggcgccugggccagauggcugcugguggcccugaccgccgccaccgcccuggugagacuggcccagcugggcgccgccgacagacaguggaccagauucgugagaggcagacccagaagauucaccagcuucgaccagguggcccagcugagcagcgccgccagaggccuggccgccagccugcuguuccugcugcuggugaaggccgcccagcagcugagauucgugagacaguggagcguguucggcaagacccugugcagagcccugcccgagcugcugggcgugacccugggccugguggugcugggcguggccuacgcccagcuggccauccugcuggugagcagcugcguggacagccuguggagcguggcccaggcccugcuggugcugugccccggcaccggccugagcacccugugccccgccgagagcuggcaccugagcccccugcugugcgugggccugugggcccugagacuguggggcgcccugagacugggcgccgugauccugagauggagauaccacgcccugagaggcgagcuguacagacccgccugggagccccaggacuacgagaugguggagcuguuccugagaagacugagacuguggaugggccugagcaaggugaaggaguucagacacaaggugagauucgagggcauggagccccugcccagcagaagcagcagaggcagcaaggugagccccgacgugcccccccccagcgccggcagcgacgccagccaccccagcaccagcagcagccagcuggacggccugagcgugagccugggcagacugggcaccagaugcgagcccgagcccagcagacugcaggccguguucgaggcccugcugacccaguucgacagacugaaccaggccaccgaggacguguaccagcuggagcagcagcugcacagccugcagggcagaagaagcagcagagcccccgccggcagcagcagaggccccagccccggccugagacccgcccugcccagcagacuggccagagccagcagaggcguggaccuggccaccggccccagcagaaccccccugagagccaagaacaaggugcaccccagcagcaccuaa

SEQ ID NO: 21578 - RNA, 8550 nt, Artificial Sequence
  PKD1L1__Homo_sapiens__NP_612152
auggccgaggaggccgcccagaacaucagcgacgaccaggagagaugccugcaggccgccugcugccugagcuucggcggcgagcugagcgugagcaccgacaagagcuggggccugcaccugugcagcugcagcccccccggcggcggccuguggguggagguguacgccaaccacgugcugcugaugagcgacggcaagugcggcugccccuggugcgcccugaacggcaaggccgaggacagagagagccagagccccagcagcagcgccagcagacagaagaacaucuggaagaccaccagcgaggccgcccugagcguggugaacgagaagacccaggccguggugaacgagaagacccaggccccccuggacugcgacaacagcgccgacagaaucccccacaagcccuucaucaucaucgccagagccuggagcagcggcggccccagauuccaccacagaagacugugcgccaccggcaccgccgacagcaccuucagcgcccugcugcagcugcagggcaccaccagcgccgccgcccccugcagccugaagauggaggccagcugcugcgugcugagacugcugugcugcgccgaggacguggccaccggccugcugcccggcaccgugaccauggagacccccaccaagguggccagacccacccagaccagcagccagagagugccccuguggcccaucagccacuuccccaccagccccagaagcagccacggccugccccccggcauccccagaacccccagcuucaccgccagccagagcggcagcgagauccuguacccccccacccagcacccccccguggccauccuggccagaaacagcgacaacuucaugaaccccgugcugaacugcagccuggagguggaggccagagccccccccaaccugggcuucagagugcacauggccagcggcgaggcccugugccugaugauggacuucggcgacagcagcggcguggagaugagacugcacaacaugagcgaggccauggccgugaccgccuaccaccaguacagcaagggcaucuucuuccaccugcugcacuuccagcuggacaugagcaccuacaaggaggccgagacccagaacaccacccugaacguguaccugugccagagcgagaacagcugccuggaggacagcgaccccagcaaccugggcuacgagcugaucagcgccuucgugaccaagggcguguacaugcugaaggccgugaucuacaacgaguuccacggcaccgagguggagcugggccccuacuacguggagaucggccacgaggccgugagcgccuucaugaacagcagcagcgugcacgaggacgaggugcugguguucgccgacagccaggugaaccagaagagcaccguggugauccaccacuuccccagcauccccagcuacaacgugagcuucaucagccagacccaggugggcgacagccaggccuggcacagcaugaccgugugguacaagaugcagagcgugagcguguacaccaacggcaccguguucgccaccgacaccgacaucaccuucaccgccgugaccaaggagaccaucccccuggaguucgagugguacuucggcgaggacccccccgugagaaccaccagcagaagcaucaagaagagacugagcaucccccagugguacagagugauggugaaggccagcaacagaaugagcagcguggugagcgagccccacgugaucagagugcagaagaagaucguggccaacagacugaccagccccagcagcgcccuggugaacgccagcguggccuucgagugcuggaucaacuucggcaccgacguggccuaccugugggacuucggcgacggcaccgugagccugggcagcagcagcagcagccacguguacagcagagagggcgaguucaccguggaggugcuggccuucaacaacgugagcgccagcacccugagacagcagcuguucaucgugugcgagcccugccagcccccccuggugaagaacaugggccccggcaaggugcagaucuggagaagccagcccgugagacugggcgugaccuucgaggccgccguguucugcgacaucagccagggccugagcuacaccuggaaccugauggacagcgagggccugcccgugagccugcccgccgccguggacacccacagacagacccugauccugcccagccacacccuggaguacggcaacuacaccgcccuggccaaggugcagaucgagggcagcgugguguacagcaacuacugcgugggccuggaggugagagcccaggcccccgugagcgugaucagcgagggcacccaccuguucuucagcagaaccaccagcagccccaucgugcugagaggcacccagagcuucgaccccgacgaccccggcgccacccugagauaccacugggagugcgccaccgccggcagccccgcccaccccugcuucgacagcagcaccgcccaccagcuggacgccgccgcccccaccgugagcuucgaggcccaguggcugagcgacagcuacgaccaguuccuggugaugcugagagugagcagcggcggcagaaacagcagcgagaccagaguguuccugagccccuaccccgacagcgccuucagauucgugcacaucagcugggugagcuucaaggacaccuucgugaacuggaacgacgagcugagccugcaggccaugugcgaggacugcagcgagauccccaaccugagcuacagcugggaccuguuccuggugaacgccaccgagaagaacagaaucgaggugcccuucugcagaguggugggccugcugggcagccugggccugggcgccaucagcgagagcagccagcugaaccugcugcccaccgagcccggcaccgccgaccccgacgccaccaccacccccuucagcagagagcccagccccgugacccugggccagcccgccaccagcgcccccagaggcacccccaccgagcccaugaccggcguguacuggaucccccccgccggcgacagcgccgugcugggcgaggcccccgaggagggcagccuggaccuggagcccggcccccagagcaagggcagccugaugaccggcagaagcgagagaagccagcccacccacagccccgacccccaccugagcgacuucgaggccuacuacagcgacauccaggaggccauccccagcggcggcagacagcccgccaaggacaccagcuuccccggcagcggccccagccugagcgccgaggagagccccggcgacggcgacaaccugguggaccccagccugagcgccggcagagccgagcccgugcugaugaucgacuggcccaaggcccugcugggcagagccguguuccagggcuacagcagcagcggcaucaccgagcagaccgugaccaucaagcccuacagccugagcagcggcgagaccuacgugcugcaggugagcguggccagcaagcacggccugcugggcaaggcccagcuguaccugaccgugaaccccgcccccagagacauggccugccaggugcagccccaccacggccuggaggcccacaccguguucagcguguucugcaugagcggcaagcccgacuuccacuacgaguucagcuaccagaucggcaacaccagcaagcacacccuguaccacggcagagacacccaguacuacuucgugcugcccgccggcgagcaccuggacaacuacaaggugauggugagcaccgagaucaccgacggcaagggcagcaaggugcagcccugcaccgugguggugaccgugcugcccagauaccacggcaacgacugccugggcgaggaccuguacaacagcagccugaagaaccugagcacccugcagcugaugggcagcuacaccgagaucagaaacuacaucaccgugaucaccagaauccugagcagacugagcaaggaggacaagaccgccagcugcaaccaguggagcagaauccaggacgcccugaucagcagcgugugcagacuggccuucguggaccaggaggagaugaucggcagcgugcugaugcugagagaccuggugagcuucagcaacaagcugggcuucaugagcgccgugcugauccugaaguacaccagagcccugcuggcccagggccaguucagcggccccuucgugaucgacaagggcgugagacuggagcugaucggccugaucagcagagugugggaggugagcgagcaggagaacagcaaggaggagguguacagacacgaggagggcaucaccgugaucagcgaccugcugcugggcugccugagccugaaccacgugagcaccggccagauggaguucagaacccugcugcacuacaaccugcagagcagcgugcagagccugggcagcgugcaggugcaccugcccggcgaccuggccggccacagccccgccggcgccgagacccagagccccugcuacaucagccagcugauccuguucaagaagaaccccuaccccggcagccaggcccccggccagaucggcggcguggugggccugaaccuguacaccugcagcagcagaagacccaucaacagacaguggcugagaaagcccgugaugguggaguucggcgaggaggacggccuggacaacagaagaaacaagaccaccuucgugcugcugagagacaaggugaaccugcaccaguucaccgagcugagcgagaacccccaggagagccugcagaucgagaucgaguucagcaagcccgugaccagagccuuccccgugaugcugcuggugagauucagcgagaagcccacccccagcgacuuccuggugaagcagaucuacuucugggacgagagcaucgugcagaucuacauccccgccgccagccagaaggacgccagcgugggcuaccugagccugcuggacgccgacuacgacagaaagccccccaacagauaccuggccaaggccgugaacuacaccgugcacuuccaguggaucagaugccuguucugggacaagagagaguggaagagcgagagauucagcccccagcccggcaccagccccgagaaggugaacugcagcuaccacagacuggccgccuucgcccugcugagaagaaagcugaaggccagcuucgaggugagcgacaucagcaagcugcagagccaccccgagaaccugcugcccagcaucuucaucaugggcagcgugauccuguacggcuuccugguggccaagagcagacagguggaccaccacgagaagaagaaggccggcuacaucuuccugcaggaggccagccugcccggccaccagcuguacgccguggugaucgacaccggcuucagagcccccgccagacugaccagcaagguguacaucgugcugugcggcgacaacggccugagcgagaccaaggagcugagcugccccgagaagccccuguucgagagaaacagcagacacaccuucauccugagcgcccccgcccagcugggccugcugagaaagaucagacuguggcacgacagcagaggccccagccccggcugguucaucagccacgugauggugaaggagcugcacaccggccagggcugguucuuccccgcccagugcuggcugagcgccggcagacacgacggcagaguggagagagagcugaccugccugcagggcggccugggcuucagaaagcuguucuacugcaaguucaccgaguaccuggaggacuuccacguguggcugagcguguacagcagacccagcagcagcagauaccugcacacccccagacugaccgugagcuucagccugcugugcguguacgccugccugaccgcccugguggccgccggcggccaggagcagccccaccuggacgugagccccacccugggcagcuucagagugggccugcugugcacccugcuggccagccccggcgcccagcugcugagccugcuguucagacugagcaaggaggcccccggcagcgccagaguggagccccacagcccccugagaggcggcgcccagaccgaggccccccacggccccaacagcuggggcagaauccccgacgcccaggagcccagaaagcagcccgccagcgccauccugagcggcagcggcagagcccagagaaaggccgccagcgacaacggcaccgccugccccgcccccaagcugcaggugcacggcgccgaccacagcagaaccagccugaugggcaagagccacugcugccccccccacacccaggcccccagcagcggccuggagggccugaugccccaguggagcagagcccugcagcccugguggagcagcgccgugugggccaucugcggcaccgccagccuggccugcagccugggcaccggcuuccuggccuacagauucggccaggagcagugcgugcaguggcugcaccugcugagccugagcguggugugcugcaucuucaucacccagccccugauggugugccugauggcccugggcuucgccuggaagagaagagccgacaaccacuucuucaccgagagccugugcgaggccaccagagaccuggacagcgagcuggccgagagaagcuggaccagacugcccuucagcagcagcugcagcauccccgacugcgccggcgagguggagaaggugcuggccgccagacagcaggccagacaccugagaugggcccacccccccagcaaggcccagcugagaggcaccagacagagaaugagaagagagagcagaaccagagccgcccugagagacaucagcauggacauccugaugcugcugcugcugcugugcgugaucuacggcagauucagccaggacgaguacagccugaaccaggccaucagaaaggaguucaccagaaacgccagaaacugccugggcggccugagaaacaucgccgacuggugggacuggagccugaccacccugcuggacggccuguaccccggcggcacccccagcgccagagugcccggcgcccagcccggcgcccugggcggcaagugcuaccugaucggcagcagcgugaucagacagcugaagguguuccccagacaccugugcaagccccccagacccuucagcgcccugaucgaggacagcauccccaccugcagccccgaggugggcggccccgagaaccccuaccugaucgaccccgagaaccagaacgugacccugaacggccccggcggcugcggcaccagagaggacugcgugcugagccugggcagaaccagaaccgaggcccacaccgcccugagcagacugagagccagcauguggaucgacagaagcaccagagccgugagcgugcacuucacccuguacaacccccccacccagcuguucaccagcgugagccugagaguggagauccugcccaccggcagccuggugcccagcagccugguggagagcuucagcaucuucagaagcgacagcgcccugcaguaccaccugaugcugccccagcugguguuccuggcccugagccugauccaccugugcgugcagcuguacagaaugauggacaagggcgugcugagcuacuggagaaagcccagaaacuggcuggagcugagcguggugggcgugagccugaccuacuacgccgugagcggccaccuggugacccuggccggcgacgugaccaaccaguuccacagaggccugugcagagccuucauggaccugacccugauggccagcuggaaccagagagccagauggcugagaggcauccugcuguuccuguucacccugaagugcguguaccugcccggcauccagaacaccauggccagcugcagcagcaugaugagacacagccugcccagcaucuucguggccggccuggugggcgcccugaugcuggccgcccugagccaccugcacagauuccugcugagcaugugggugcugccccccggcaccuucaccgacgccuuccccggccugcuguuccacuuccccagaagaagccagaaggacugccugcugggccugagcaagagcgaccagagagccauggccugcuacuucggcauccugcugaucgugagcgccacccugugcuucggcaugcugagaggcuuccugaugacccugccccagaagagaaagagcuuccagagcaagagcuucgugagacugaaggacgugaccgccuacaugugggagaaggugcugaccuuccugagacuggagacccccaagcuggaggaggccgagaugguggagaaccacaacuacuaccuggacgaguucgccaaccugcuggacgagcugcugaugaagaucaacggccugagcgacagccugcagcugccccugcuggagaagaccagcaacaacaccggcgaggccagaaccgaggagagcccccugguggacaucagcagcuaccaggccgccgagcccgccgacaucaaggacuucuaa

SEQ ID NO: 21579 - RNA, 2976 nt, Artificial Sequence
  PKD1L2__Homo_sapiens__NP_001070248
augagcgccgugggccuggugcugcuggugcuggcccugagacugagagccaccaccgugaagcccgaggagggcagcuucugcagcaacagccagguggccuucagagacgccugcuacgaguucgugccccugggcagaaccuucagagacgcccagagcuggugcgagggccagggcggccaccugguguucauccaggacgagggcacccagugguuccugcagaagcacaucagccaggacagagagugguggaucggccugaccuggaaccuggccagaaacggcaccaccgagggccccggcaccuggcuggacaccagcaacgugaccuacagcaacuggcacggcggccaggccgccgccgcccccgacaccugcggccacaucggcagaggccccagcagcgagugggugaccagcgacugcgcccagaccuucgccuucaugugcgaguucagagugggccagagccuggccugcgagggccugaacgccaccgugcacugcggccugggccaggugauccaggugcaggacgccguguacggcagacagaacccccacuucugcacccaggacgccggcagacccagcgaccuggagcagggcugcagcugggccaacgugaaggaggagguggccggccagugccaggagcugcagagcugccagguggccgccgacgagaccuacuucggcaaccugugccccacccagggcagcuaccugugggugcaguaccagugcagagaggcccugcagcugauggugagcagcgagagcuucaucuucgacaacgugaccaucagccugaccuggcugcugagccccuacaucggcaaccugagcugcaucaucagcaccggcgacagccacaccuucgaccccuacaacccccccagcgugagcagcaacgugacccaccaguucaccagccccggcgaguucaccguguucgccgagugcaccaccagcgaguggcacgugaccgcccagagacaggugaccgugagagacaagauggagacccugagcgugaccgccugcagcggccugagccagagcggcgccggcccccugugccaggccguguucggcgacccccuguggauccagguggagcuggacggcggcaccggcgugaccuacaccgugcugcugggcgacaucacccuggccgagagcaccacccagaagggcagccugcccuacaaccugauccuggacagagagacccagaagcugaugggccccggcagacacagacuggagauccaggccaccggcaacaccaccaccagcaccaucagcagaaacaucaccgugcaccugguggagcugcugagcggccugcaggccagcugggccagcgaccaccuggagcugggccaggaccugcugaucaccaucagccuggcccagggcacccccgaggagcugaccuucgagguggccggccugaacgccaccuucagccacgagcaggugagcuucggcgagcccuucggcaucugcagacuggccgugcccguggagggcaccuuccuggugaccaugcuggugagaaacgccuucagcaaccugagccuggagaucggcaacaucaccaucaccgcccccagcggccugcaggagcccagcggcaugaacgccgagggcaagagcaaggacaagggcgacauggagguguacauccagcccggccccuacguggaccccuucaccaccgugacccugggcuggcccgacaacgacaaggagcugagauuccaguggagcugcggcagcugcugggcccuguggagcagcugcguggagagacagcugcugagaaccgaccagagagagcugguggugcccgccagcugccugcccccccccgacagcgccgugacccugagacuggccgugcugagaggccaggagcuggagaacagagccgagcagugccuguacgugagcgcccccugggagcugagacccagagugagcugcgagagaaacugcagacccgugaacgccagcaaggacauccugcugagagugaccaugggcgaggacagccccguggccauguucagcugguaccuggacaacacccccaccgagcaggccgagccccugcuggacgccugcagacugagaggcuucuggcccagaagccugacccugcugcagagcaacaccagcacccugcugcugaacagcagcuuccugcagagcagaggcgaggugaucagaaucagagccaccgcccugaccagacacgccuacggcgaggacaccuacgugaucagcaccgugccccccagagaggugcccgccugcaccaucgcccccgaggagggcaccgugcugaccagcuucgccaucuucugcaacgccagcaccgcccugggcccccuggaguucugcuucugccuggagagcggcagcugccugcacugcggccccgagcccgcccugcccagcguguaccugccccugggcgaggagaacaacgacuucgugcugaccguggugaucagcgccaccaacagagccggcgacacccagcagacccaggccauggccaagguggcccugggcgacaccugcguggaggacguggccuuccaggccgccgugagcgagaagauccccaccgcccugcagggcgagggcggccccgagcagcugcugcagcuggccaaggccgugagcagcaugcugaaccaggagcacgagagccagggcagcggccagagccugagcaucgacgugagacagaaggugagagagcacgugcugggcagccugagcgccgugaccaccggccuggaggacgugcagagagugcaggagcuggccgaggugcugagagaggugaccugcagaagcaaggagcugacccccagcgcccagggcagcugcaugggcgacagcugggagggcgccccccccgccgcccacgugagccacgccagauaa

SEQ ID NO: 21580 - RNA, 5199 nt, Artificial Sequence
  PKD1L3__Homo_sapiens__NP_853514
auguucuucaagggcggcagcuggcuguggcuguacaucagaaccagcaucauccugggcagcgagcugaacagccccgccccccacggccagaacaacugcuaccagcugaacagauuccagugcagcuucgaggaggcccagcacuacugccacgugcagagaggcuuccuggcccacaucuggaacaaggaggugcaggaccugaucagagacuaccuggaggagggcaagaagugguggaucggccagaacgugaugccccugaagaagcaccaggacaacaaguaccccgccgacguggccgccaacggcccccccaagccccugagcugcaccuaccugagcagaaacuucaucagaaucagcagcaagggcgacaagugccugcugaaguacuacuucaucugccagaccggcgacuuccuggacggcgacgcccacuacgagagaaacggcaacaacagccaccuguaccagagacacaagaagaccaagagaggcguggccaucgccagagacaagaugccccccggccccggccaccugcccaccaccugccacuacccccugcccgcccaccugagcaagacccugugccaccccaucagccaguuccccagcgugcugagcagcaucaccagccaggugaccagcgccgccagcgagcccagcagccagccccugcccgugaucacccagcugaccaugcccgugagcgugacccacgccggccagagccuggccgagaccaccagcagccccaaggaggagggccaccccaacaccuucaccagcuaccugcaggugagccugcagaaggccagcggccaggugaucgacgagaucgccggcaacuucagcagagccgugcacggccugcaggcccugaacaagcugcaggaggccugcgaguuccugcagaagcugaccgcccugacccccagauucagcaagcccgcccaggugaaccugaucaacagccugaucuaccugagcgaggagcugcugagaauccccuuccagaacaacaacagccugggcuucaaggugccccccaccgugugccccuuccacagccugaacaacgugaccaaggccggcgagggcagcuggcuggagagcaagagacacaccgagcccguggaggacauccuggagaugagccugguggaguucggcaacaucggcgaggccuuccuggagcagaaccagagccccgagagcagcgugacccugaccagcgccaacgccacccugcugcugagcagacagaacaucagcacccugccccugagcagcuacacccugggccaccccgcccccgugagacugggcuuccccagcgcccuggcccugaaggagcugcugaacaagcaccccggcgugaacgugcagaucaccggccuggccuucaaccccuucaaggaccuggacaacagaaacaucgugggcagcaucggcagcgugcugcugagcgccaacagaaagcugcugcaggugcacgaccugauggaggacaucgagaucaugcuguggagaaacgugagccuggagacccaccccaccagccugaacaugagcacccaccagcugaccaucaccgugaacgugaccagccuggagaagagccugaucgugagcaucgaccccgacagcccccugcugaugacccuguaccugggcuuccaguaccagcccaacugcacccacuuccaccugaacaucacccugcccaaggacaagguguggcagaaggacgaggaguacaccugggugcugaaccccgagcaccugcagcacggcaucggcaccuacuacaucaccgccgugcugagcgagagacaggagggcgcccagcagacccccagccuggugagcgugaucaccgccgugacccagugcuacuacugggagauccacaaccagaccuggagcagcgccggcugccaggugggcccccagagcaccauccugagaacccagugccugugcaaccaccugaccuucuucgccagcgacuucuucguggugcccagaaccgugaacguggaggacaccaucaagcuguuccugagagugaccaacaaccccgugggcgugagccugcuggccagccugcugggcuucuacgugaucaccguggugugggccagaaagaaggaccaggccgacaugcagaaggugaaggugaccgugcuggccgacaacgaccccagcgcccaguuccacuaccugauccagguguacaccggcuacagaagaagcgccgccaccaccgccaagguggugaucacccuguacggcagcgagggcagaagcgagccccaccaccugugcgacccccagaagaccguguucgagagaggcggccuggacguguuccugcugaccaccuggaccagccugggcaaccugcacagccugagacuguggcacgacaacagcggcgugagccccagcugguacgugagccaggugaucgugugcgacauggccgugaagagaaaguggcacuuccugugcaacugcuggcuggccguggaccugggcgacugcgagcuggacagaguguucauccccgugagcaagagagagcuguucagcuucagacaccuguucagcagcaugaucguggagaaguucacccaggacuaccuguggcugagcaucgccaccagacaccccuggaaccaguucaccagagugcagagacugagcugcugcaugacccugcugcugugcaacauggugaucaacgugauguucuggaagaucaacagcaccaccgccaagagagacgagcagaugagacccuucgccguggccuggagcgagcugcuggugagcauccacaccgccgugauccuguuccccaucaaccuggugaucggcagacuguucccccugaucgagccccaggagacccugccccuguucccccccauccaggccagcugccugagcgacgccagcguggagccccugagcgccaccauggugguggaggagcugaaggagaccgugagauuccugcugagaagaaacaccuaccugcugagcaagugcgagcagccccccuggagcagcugggacaucaccaagcuggugaagcugcugagcagccuggugagcagccaccuggagggccagggcugccaccagcagggcgagagacacugggccagaguggugcccgagaaccaccaccacuucugcugcuaccugcacagagugcugcagagacugaagagccaccugggcacccugggccugacccagggccaccagagcugcgacuuccuggacgccgccagccagcugcagaagcugcaggagcugcuggagacccacauccugcccaccgagcaggagcccagcagagaggugaccagcuucgccauccugagcagcgaggagggcaagaagcccaucagcaacggccugagcaaguggcugaccagcgugugcuggcugcugcugggcuucaccagccuggccagcgccuucuucaccgcccuguacagccuggagcugagcaaggaccaggccaccagcuggaugaucagcaucauccugagcgugcugcagaacaucuucaucagccagcccgugaaggugguguucuucaccuuccuguacagccugaugaugagcagaaugcccagacugaacaaggagaacgagcagcagaccaagagaauccuggcccugcuggccaagugcagcagcagcgugcccggcagcagagacaagaacaaccccguguacguggcccccgccaucaacagccccaccaagcaccccgagagaacccugaagaagaagaagcuguucaagcugaccggcgacauccuggugcagauccuguuccugacccugcugaugaccgccaucuacagcgccaagaacagcaacagauucuaccugcaccaggccaucuggaagaccuucagccaccaguucagcgagaucaagcugcugcaggacuucuaccccugggccaaccacauccugcugcccagccuguacggcgacuacagaggcaagaacgccgugcuggagcccagccacugcaagugcggcgugcagcugaucuuccagauccccagaaccaagaccuacgagaagguggacgagggccagcuggccuucugcgacaacggccacaccugcggcagacccaagagccuguuccccggccugcaccugagaagauucagcuacaucugcagccccagacccauggugcugauccccaccgacgagcugcacgagagacugaccagcaagaacgagaacggcuucagcuacaucaugagaggcgccuucuucaccagccugagacuggagagcuucaccagccugcagaugagcaagaagggcugcguguggagcaucaucagccaggugaucuacuaccugcuggugugcuacuacgccuucauccagggcugccagcugaagcagcagaaguggagauucuucaccggcaagagaaacauccuggacaccagcaucauccugaucagcuucauccugcugggccuggacaugaagagcaucagccugcacaagaagaacauggccagauacagagacgaccaggacagauucaucagcuucuacgaggccgugaaggugaacagcgccgccacccaccuggugggcuuccccgugcugcuggccaccgugcagcuguggaaccugcugagacacagccccagacugagagugaucagcagaacccugagcagagccugggacgagguggugggcuuccugcugaucauccugauccugcugaccggcuacgccaucgccuucaaccugcuguucggcugcagcaucagcgacuacagaaccuucuucagcagcgccgugaccguggugggccugcugaugggcaucagccaccaggaggagguguucgcccuggaccccgugcugggcaccuuccugauccugaccagcgugauccugauggugcugguggugaucaaccuguucgugagcgccauccugauggccuucggcaaggagagaaagagccugaagaaggaggccgcccugaucgacacccugcugcagaagcugagcaaccugcugggcaucagcuggccccagaagaccagcagcgagcaggccgccaccaccgccgugggcagcgacaccgaggugcuggacgagcugcccuaa

SEQ ID NO: 21581 - RNA, 2907 nt, Artificial Sequence
  PKD2__Homo_sapiens__NP_000288
auggugaacagcagcagagugcagccccagcagcccggcgacgccaagagaccccccgcccccagagcccccgaccccggcagacugauggccggcugcgccgccgugggcgccagccuggccgcccccggcggccugugcgagcagagaggccuggagaucgagaugcagagaaucagacaggccgccgccagagacccccccgccggcgccgccgccagccccagccccccccugagcagcugcagcagacaggccuggagcagagacaaccccggcuucgaggccgaggaggaggaggaggagguggagggcgaggagggcggcauggugguggagauggacguggaguggagacccggcagcagaagaagcgccgccagcagcgccgugagcagcgugggcgccagaagcagaggccugggcggcuaccacggcgccggccaccccagcggcagaagaagaagaagagaggaccagggcccccccugccccagccccgugggcggcggcgacccccugcacagacaccugccccuggagggccagccccccagaguggccugggccgagagacuggugagaggccugagaggccuguggggcaccagacugauggaggagagcagcaccaacagagagaaguaccugaagagcgugcugagagagcuggugaccuaccugcuguuccugaucgugcugugcauccugaccuacggcaugaugagcagcaacguguacuacuacaccagaaugaugagccagcuguuccuggacacccccgugagcaagaccgagaagaccaacuucaagacccugagcagcauggaggacuucuggaaguucaccgagggcagccugcuggacggccuguacuggaagaugcagcccagcaaccagaccgaggccgacaacagaagcuucaucuucuacgagaaccugcugcugggcgugcccagaaucagacagcugagagugagaaacggcagcugcagcaucccccaggaccugagagacgagaucaaggagugcuacgacguguacagcgugagcagcgaggacagagcccccuucggccccagaaacggcaccgccuggaucuacaccagcgagaaggaccugaacggcagcagccacuggggcaucaucgccaccuacagcggcgccggcuacuaccuggaccugagcagaaccagagaggagaccgccgcccagguggccagccugaagaagaacguguggcuggacagaggcaccagagccaccuucaucgacuucagcguguacaacgccaacaucaaccuguucugcguggugagacugcugguggaguuccccgccaccggcggcgugauccccagcuggcaguuccagccccugaagcugaucagauacgugaccaccuucgacuucuuccuggccgccugcgagaucaucuucugcuucuucaucuucuacuacgugguggaggagauccuggagaucagaauccacaagcugcacuacuucagaagcuucuggaacugccuggacguggugaucguggugcugagcgugguggccaucggcaucaacaucuacagaaccagcaacguggaggugcugcugcaguuccuggaggaccagaacaccuuccccaacuucgagcaccuggccuacuggcagauccaguucaacaacaucgccgccgugaccguguucuucguguggaucaagcuguucaaguucaucaacuucaacagaaccaugagccagcugagcaccaccaugagcagaugcgccaaggaccuguucggcuucgccaucauguucuucaucaucuuccuggccuacgcccagcuggccuaccugguguucggcacccagguggacgacuucagcaccuuccaggagugcaucuucacccaguucagaaucauccugggcgacaucaacuucgccgagaucgaggaggccaacagagugcugggccccaucuacuucaccaccuucguguucuucauguucuucauccugcugaacauguuccuggccaucaucaacgacaccuacagcgaggugaagagcgaccuggcccagcagaaggccgagauggagcugagcgaccugaucagaaagggcuaccacaaggcccuggugaagcugaagcugaagaagaacaccguggacgacaucagcgagagccugagacagggcggcggcaagcugaacuucgacgagcugagacaggaccugaagggcaagggccacaccgacgccgagaucgaggccaucuucaccaaguacgaccaggacggcgaccaggagcugaccgagcacgagcaccagcagaugagagacgaccuggagaaggagagagaggaccuggaccuggaccacagcagccugcccagacccaugagcagcagaagcuuccccagaagccuggacgacagcgaggaggacgacgacgaggacagcggccacagcagcagaagaagaggcagcaucagcagcggcgugagcuacgaggaguuccaggugcuggugagaagaguggacagaauggagcacagcaucggcagcaucgugagcaagaucgacgccgugaucgugaagcuggagaucauggagagagccaagcugaagagaagagaggugcugggcagacugcuggacggcguggccgaggacgagagacugggcagagacagcgagauccacagagagcagauggagagacuggugagagaggagcuggagagaugggagagcgacgacgccgccagccagaucagccacggccugggcacccccgugggccugaacggccagcccagacccagaagcagcagacccagcagcagccagagcaccgagggcauggagggcgccggcggcaacggcagcagcaacgugcacguguaa

SEQ ID NO: 21582 - RNA, 2277 nt, Artificial Sequence
  PKD2L1__Homo_sapiens__NP_001240766
augaaccccagaagaagacacaccggccccagaugccccgccgccgccagcaucagcgugaaggccagcgaggccagccugcccugcccccugggccuguggggcaccacccugaccgagaacaccgccgagaacagagagcuguacaucaagaccacccugagagagcugcugguguacaucguguuccugguggacaucugccugcugaccuacggcaugaccagcagcagcgccuacuacuacaccaaggugaugagcgagcuguuccugcacacccccagcgacaccggcgugagcuuccaggccaucagcagcauggccgacuucugggacuucgcccagggcccccugcuggacagccuguacuggaccaagugguacaacaaccagagccugggccacggcagccacagcuucaucuacuacgagaacaugcugcugggcgugcccagacugagacagcugaaggugagaaacgacagcugcguggugcacgaggacuucagagaggacauccugagcugcuacgacguguacagccccgacaaggaggagcagcugcccuucggccccuucaacggcaccgccuggaccuaccacagccaggacgagcugggcggcuucagccacuggggcagacugaccagcuacagcggcggcggcuacuaccuggaccugcccggcagcagacagggcagcgccgaggcccugagagcccugcaggagggccuguggcuggacagaggcaccagagugguguucaucgacuucagcguguacaacgccaacaucaaccuguucugcgugcugagacuggugguggaguuccccgccaccggcggcgccauccccagcuggcagaucagaaccgugaagcugaucagauacgugagcaacugggacuucuucaucgugggcugcgaggugaucuucugcguguucaucuucuacuacgugguggaggagauccuggagcugcacauccacagacugagauaccugagcagcaucuggaacauccuggaccugguggugauccugcugagcaucguggccgugggcuuccacaucuucagaacccuggaggugaacagacugaugggcaagcugcugcagcagcccaacaccuacgccgacuucgaguuccuggccuucuggcagacccaguacaacaacaugaacgccgugaaccuguucuucgccuggaucaagaucuucaaguacaucagcuucaacaagaccaugacccagcugagcagcacccuggccagaugcgccaaggacauccugggcuucgccgugauguucuucaucguguucuucgccuacgcccagcugggcuaccugcuguucggcacccagguggagaacuucagcaccuucaucaagugcaucuucacccaguucagaaucauccugggcgacuucgacuacaacgccaucgacaacgccaacagaauccugggccccgccuacuucgugaccuacguguucuucguguucuucgugcugcugaacauguuccuggccaucaucaacgacaccuacagcgaggugaaggaggagcuggccggccagaaggacgagcugcagcugagcgaccugcugaagcagggcuacaacaagacccugcugagacugagacugagaaaggagagagugagcgacgugcagaaggugcugcagggcggcgagcaggagauccaguucgaggacuucaccaacacccugagagagcugggccacgccgagcacgagaucaccgagcugaccgccaccuucaccaaguucgacagagacggcaacagaauccuggacgagaaggagcaggagaagaugagacaggaccuggaggaggagagaguggcccugaacaccgagaucgagaagcugggcagaagcaucgugagcagcccccagggcaagagcggccccgaggccgccagagccggcggcugggugagcggcgaggaguucuacaugcugaccagaagagugcugcagcuggagaccgugcuggagggcguggugagccagaucgacgccgugggcagcaagcugaagaugcuggagagaaagggcuggcuggcccccagccccggcgugaaggagcaggccaucuggaagcacccccagcccgcccccgccgugacccccgaccccuggggcgugcagggcggccaggagagcgaggugcccuacaagagagaggaggaggcccuggaggagagaagacugagcagaggcgagauccccacccugcagagaagcuaa

SEQ ID NO: 21583 - RNA, 1482 nt, Artificial Sequence
  PKDCC__Homo_sapiens__NP_612379
augagaagaagaagagccgccguggccgccggcuucugcgccagcuuccugcugggcagcgugcugaacgugcuguucgcccccggcagcgagccccccagacccggccagagccccgagcccagccccgcccccggccccggcagaagaggcggcagaggcgagcuggccagacagaucagagccagauacgaggaggugcagagauacagcagaggcggccccggccccggcgccggcagacccgagagaagaagacugauggaccuggcccccggcggccccggccugcccagacccagaccccccugggccagaccccugagcgacggcgcccccggcuggccccccgcccccggccccggcagccccggccccggccccagacugggcugcgccgcccugagaaacgugagcggcgcccaguacaugggcagcggcuacaccaaggccguguacagagugagacugcccggcggcgccgccguggcccugaaggccguggacuucagcggccacgaccugggcagcugcgugagagaguucggcgugagaagaggcugcuacagacuggccgcccacaagcugcugaaggagauggugcugcuggagagacugagacaccccaacgugcugcagcuguacggcuacugcuaccaggacagcgaggacauccccgacacccugaccaccaucaccgagcugggcgcccccguggagaugauccagcugcugcagaccagcugggaggacagauucagaaucugccugagccugggcagacugcugcaccaccuggcccacagcccccugggcagcgugacccugcuggacuucagacccagacaguucgugcugguggacggcgagcugaaggugaccgaccuggacgacgccagaguggaggagacccccugcgccggcagcaccgacugcauccuggaguuccccgccagaaacuucacccugcccugcagcgcccagggcuggugcgagggcaugaacgagaagagaaaccuguacaacgccuacagauucuucuucaccuaccugcugccccacagcgccccccccagccugagaccccugcuggacagcaucgugaacgccaccggcgagcuggccuggggcguggacgagacccuggcccagcuggagaaggugcugcaccuguacagaagcggccaguaccugcagaacagcaccgccagcagcagcaccgaguaccagugcauccccgacagcaccaucccccaggaggacuacagaugcuggcccagcuaccaccacggcagcugccugcugagcguguucaaccuggccgaggccguggacgugugcgagagccacgcccagugcagagccuucguggugaccaaccagaccaccuggaccggcagacagcugguguucuucaagaccggcuggagccagguggugcccgaccccaacaagaccaccuacgugaaggccagcggcuaa

SEQ ID NO: 21584 - RNA, 6762 nt, Artificial Sequence
  PKDREJ__Homo_sapiens__NP_006062
augagacccggccccgcccugcugcugcugggcgugggccugagccugagcgugggcagacugccccugccccccgugcccagaggcgcccaggccgccgugagcggcgcccccggcggccugcugagaggcgcccccggccugggcgugagaggcggcagagcccugcugagccugagacccagcgccgugagagccggcggcgccgugcugagcggcagaggcagccugugcuucccccacggcggcaccggcagaagaugguacugccuggaccugagagugcugcugagcgcccagagacugcccuggcccgccgcccccgcccuggcccugguggaccugcagcugagcgccagaggcggcagacugagccugaccuggagcgugagacugcccagaagccccggcagacuggccugggccuucagacugagacugcugggccccggcgccgccagacccgccagccccgccgccagagugagccccagaagcgccgcccccggccccagaccccagcagggcuucguggccagaaccgagugccccaccgacggccccgccagagugaugcugcaggccgugaacagcagcagccacagagccguggagagcagcgugagcugccagaucaacgccugcgugauccagagagugagaaucaacaccgaccagaagggcgcccccgugagacugagcaugcaggccgaggccaccaucaacgccagcgugcagcuggacugccccgccgccagagccaucgcccaguacuggcagguguucagcgugcccgccgugggccaggcccccgacuggacccagccccuggaccugccccagcuggagaucagaaacagcccccuguucauccacauccccaacaacagccugcaguggggcguguacguguucaacuucaccgugagcaucaccaccggcaaccccaagaugcccgaggugaaggacagcgacgccguguacguguggaucgugagaagcagccugcaggccgugaugcugggcgacgccaacaucaccgccaacuucaccgagcagcugauccuggacggcagcaccagcagcgaccccgacgccgacagcccccugcagggccugcaguucuucugguacugcaccaccgaccccagaaacuacggcggcgacagaaucauccugggcagcaaggaggugugccaccccgagcaggccaaccugaaguggcccugggccagcggccccgugcugacccugcugcccgagacccugaagggcgaccacguguacuucuucagaauggugaucagaaaggacagcagaaccgccuucagcgacaagagagugcacgugcugcagggccccaaggccaucgcccacaucaccugcaucgagaacugcgagagaaacuucaucgugagcgacagauucagccuguuccugaacugcaccaacugcgccagcagagacuucuacaaguggagcauccugagcagcagcggcggcgagaugcuguucgacuggaugggcgagaccgugaccggcagaaacggcgccuaccugagcaucaaggccuucgccuucagacacuuccuggaggccgaguucagcaucagccuguaccuggccugcuggagcggcgugaccagcguguucagacacagcuucaucaucaaccacggcccccagaucggcgagugcaagaucaaccccgccaagggcaucgcccugaucaccaaguucguggugcagugcagcaacuucagagacaagcacgugccccugaccuacaagaucaucgugagcgaccugcacagcgugggcgagaucagcagcgugaaggagaacacccugggcaccauccuguaccugggcccccagagcaccgugccccccagcuuccugcccgugggcaugcuggccagccaguacggccugaagaucuacgcccagguguacgacagccugggcgccuucagccaggugacccugcacgccaccgcccaggcccccaccgacaagaacagcagcaagaccgugcugaaccagcugcugagcuucaccgugggccccagcagccugcugagcacccugauccagaagaaggacuuccugcccgccggcuaccugcuguacaucguggccagcgugcugaacaacaugaagaccgagcugccccugagagacgacagagugaaccugagaaagcaccugaucgaccagagcuuccugcugcccgugagcacccugguggagaucggccagguggugaugaccaucaccaagcugacccagaagcccagcgaguucaccugggacgcccagaagagagccaccaugagaguguggcaggccaaccaggcccugcaggaguaccagcagaaggacaagagauucagaagcgagcagaucgagaucgugagcaccggcauccugaugagccugagcaacauccugaagaugaccagcccccaccagguggugaaggaccccuucuacgugaucgagagccugagcgacaccauccuggccaacaaggugcccggcaacaagaccaccagcaugagaacccccaacuucaacauguacgugaagaagguggagaaguggggcaucaaccagcuguucagaaacgagaagcacugcagaaacugcuucuaccccacccugaacgugagcagcgugcccggccugagcgccaacggccccaucagcaccauguucugcgacuucaccaacgaccuguuccccuggcugaacgaccaggagaacaccagcguggaggugagcggcuucagaaugaccggcguggccgacaacggcagcgugcuggagaucacccccgacguggccgagguguaccuggugagaaagaaccugaccuucgccgccuucaaccugaccgugggccccaacagcgagguggacggcagccugaagaagaccaccggcggcuucagcuuccagguggacagcaccgugcugagagaggugcuggugcacaucgugaccgaggugauggugcuguucaccgugcugguguacaccggcagccagaucacccccaccgcccugguggccaccuuccuggugccccacgacaucccccccuucgccagccagagcgcccuguucgaccccgccugcaccgugaagaaggccagaguggugugccugcccgugagccugcugcagcugaucgcccagcacagccacagcccccacugcaccgugagcaucgugcugcaggcccccagauucgugaugaagcugaacgacaagcuggugagaaucagcaucuucagcgugcagugccuggacauguacggcauccagagcgaguggagagagggcuacugcauccugggcgagaagaccagcugguacgaggugcacugcaucugcaagaacguggugagagccagaagacagcugggcaccaucggccugaccggcauccaccugcacacccacuacgugauggccaaggugaucgugauccccaaccccguggaccugagacugaacaucaucaagagccugcaccagaaccccgugacccuguucaccgugcuguucaucauccugcuguacgugggccuggccuucugggcccuguacagagacgagauggaccagcaccugagaggccacgugaucgugcugcccgacaacgaccccuacgacaaccugugcuaccuggugaccaucuucaccggcagcagauggggcagcggcaccagagccaacguguucgugcagcugagaggcaccgugagcaccagcgacgugcacugccugagccacccccacuucaccacccuguacagaggcagcaucaacaccuuccugcugaccaccaagagcgaccugggcgacauccacagcaucagaguguggcacaacaacgagggcagaagccccagcugguaccugagcagaaucaagguggagaaccuguucagcagacacaucuggcuguucaucugccagaaguggcugagcguggacaccacccuggacagaaccuuccacgugacccaccccgacgagagacugaccagaaaggacuucuucuucaucgacgugagcagcaaccugagaaagaaccacaugugguucagcaucuucgccagcgugguggccaagaccuucaacagacugcagagacugagcugcugccuggccaugcugcugagcagccugcugugcaacaucauguucuucaaccugaacagacaggagcagaccgagagcagagagagaaaguacaugagaagcaugaugaucggcaucgagagcgugcugaucaccauccccgugcagcugcugaucaccuuccuguucaccugcagccagagaaagccccaggccgaccugaaggaggugagcccccagaagcacccccugaugagcgaggccagcgagcacugggaggaguaccugagaaaguggcacgccuacgagaccgccaaggugcaccccagagagguggccaagcccgccagcaagggcaagcccagacugcccaaggccagccccaaggccaccagcaagcccaagcacagacacagaaaggcccagaucaagacccccgagacccugggccccaacaccaacagcaacaacaacaucgaggacgaccaggacgugcacagcgagcagcaccccagccagaaggaccugcagcagcugaagaagaagcccagaaucgugcugcccugguggugcguguacguggccugguuccugguguucgccaccagcagcaucagcagcuucuucaucguguucuacggccugaccuacggcuacgacaagagcaucgaguggcuguucgccagcuucugcagcuucugccagagcgugcugcuggugcagcccagcaagaucauccugcugagcggcuucagaaccaacaagcccaaguacugcaagaaccugagcuggagcaccaaguacaaguacaccgagaucagacuggacggcaugagaaugcaccccgaggagaugcagagaauccacgaccagaucgugagaaucagaggcaccagaauguaccagccccugaccgaggacgagaucagaaucuucaagagaaagaagagaaucaagagaagagcccugcuguuccugagcuacauccugacccacuucaucuuccuggcccugcugcugauccugaucgugcugcugagacacaccgacugcuucuacuacaaccaguucaucagagacagauucagcauggaccuggccaccgugaccaagcuggaggacaucuacagauggcugaacagcgugcugcugccccugcugcacaacgaccugaaccccaccuuccugcccgagagcagcagcaagauccugggccugccccugaugagacaggugagagccaagagcagcgagaagaugugccugcccgccgagaaguucgugcagaacagcaucagaagagagauccacugccaccccaaguacggcaucgaccccgaggacaccaagaacuacagcggcuucuggaacgagguggacaagcaggccaucgacgagagcaccaacggcuucaccuacaagccccagggcacccaguggcuguacuacagcuacggccugcugcacaccuacggcagcggcggcuacgcccuguacuucuuccccgagcagcagagauucaacagcacccugagacugaaggagcugcaggagagcaacuggcuggacgagaagaccugggccguggugcuggagcugaccaccuucaaccccgacaucaaccuguucugcagcaucagcgugaucuucgaggugagccagcugggcguggugaacaccagcaucagccugcacagcuucagccuggccgacuucgacagaaaggccagcgccgagaucuaccuguacguggccauccugaucuucuuccuggccuacgugguggacgagggcugcaucaucaugcaggagagagccagcuacgugagaagcguguacaaccugcugaacuucgcccugaagugcaucuucaccgugcugaucgugcuguuccugagaaagcacuuccuggccaccggcaucaucagauucuaccugagcaaccccgaggacuucauccccuuccacgccgugagccagguggaccacaucaugagaaucauccugggcuuccugcuguuccugaccauccugaagacccugagauacagcagauucuucuacgacgugagacuggcccagagagccauccaggccgcccugcccggcaucugccacauggccuucguggugagcguguacuucuucguguacauggccuucggcuaccugguguucggccagcacgaguggaacuacagcaaccugauccacagcacccagaccguguucagcuacugcgugagcgccuuccagaacaccgaguucagcaacaacagaauccugggcgugcuguuccugagcagcuucaugcuggugaugaucugcgugcugaucaaccuguuccaggccgugauccugagcgccuacgaggagaugaagcagcccguguacgaggagcccagcgacgagguggaggccaugaccuaccugugcagaaagcugagaaccauguucagcuuccugaccagccagagcaaggccaaggacgagcccgaguucuucaucgacaugcuguacggccagcccgagaagaacagccacagauaccugggccugaagaccagaaacaucaacggcaagaagaugguguaccuggugguguaa

SEQ ID NO: 21585 - RNA, 10191 nt, Artificial Sequence
  PKHD1__Homo_sapiens__NP_733842
augaccgccuggcugaucagccugaugagcaucgaggugcugcugcuggccgugagacaccugagccugcacaucgagcccgaggagggcagccuggccggcggcaccuggaucaccgugaucuucgacggccuggagcugggcgugcuguaccccaacaacggcagccagcuggagauccaccuggugaacgugaacaugguggugcccgcccugagaagcgugcccugcgacguguuccccguguuccuggaccugcccguggugaccugcagaaccagaagcgugcugagcgaggcccacgagggccuguacuuccuggaggccuacuucggcggccagcuggugagcagccccaaccccggccccagagacagcugcaccuucaaguucagcaaggcccagacccccaucgugcaccagguguacccccccagcggcgugcccggcaagcugauccacguguacggcuggaucaucaccggcagacuggagaccuucgacuucgacgccgaguacaucgacagccccgugauccuggaggcccagggcgacaagugggugacccccugcagccugaucaacagacagaugggcagcugcuaccccauccaggaggaccacggccugggcacccugcagugccacguggagggcgacuacaucggcagccagaacgugagcuucagcguguucaacaagggcaagagcauggugcacaagaaggccuggcugaucagcgccaagcaggaccuguuccuguaccagacccacagcgagauccugagcguguuccccgagaccggcagccugggcggcagaaccaacaucaccaucaccggcgacuucuucgacaacagcgcccaggugaccaucgccggcauccccugcgacaucagacacgugagccccagaaagaucgagugcaccaccagagcccccggcaaggacgugagacugaccaccccccagcccggcaacagaggccugcuguucgaggugggcgacgccguggagggccuggagcugaccgaggccacccccggcuacagauggcagaucgugcccaacgccagcagccccuucggcuucuggagccaggagggccagcccuucagagccagacugagcggcuucuucguggcccccgagaccaacaacuacaccuucuggauccaggccgacagccaggccagccugcacuucagcuggagcgaggagcccagaaccaaggugaagguggccagcaucagcgugggcaccgccgacugguucgacagcugggagcagaacagagacgagggcaccuggcagcagaagacccccaagcuggagcugcugggcggcgccauguacuaccuggaggccgagcaccacggcaucgcccccagcagaggcaugagaaucggcgugcagauccacaacaccuggcugaaccccgacguggugaccaccuaccugagagagaagcaccagaucagagugagagcccagagacugcccgaggugcaggugcugaacgugagcggcagaggcaacuucuuccugaccugggacaacgugagcagccagcccauccccgccaacgccaccgcccaccugauccagaccaccaucgaggagcugcuggccgugaagugcaagcuggagccccuguggagcaacauccugcugagacugggcuucgagagaggccccgaggugagcaacagcgacggcgaccugaccagcggcaccgagcccuucugcggcagauucagccugagacagcccagacaccuggugcugaccccccccgccgcccagaagggcuacagacuggaccaguacacccaccugugccuggccuacaagggccacaugaacaagauccugaagaugaucgugagcuucaccaucggcuuccagaacauggugaagaacaccaccugcgacuggagccugaccagaaccagccccgagagcuggcaguucgacugcaccgaccugugggagaccugcgugagaugcuucggcgaccugcagcccccccccgccaacagccccgugcuggugcaccagaucaaccugcugccccuggcccaggagaccggccuguucuacguggacgagaucaucaucgccgacaccaacgugaccgugagccaggccgacagcggcaccgccagacccggcggcaaccugguggagagcgugagcguggugggcagcccccccguguacagcgugaccagcuggcuggccggcugcggcaccgagcugccccugaucaccgccagaagcgugcccaccgagggcaccgaggagggcagcggccuggugcuggugaccacccagagaagacagagaaccagccccccccugggcggccacuucagaauccagcugcccaacaccgugaucagcgacgugcccgugcagaucagcgcccaccaccugcaccagcugcugcagaacaacgccgacgacuucaccagcagauaccugaacgccagcgacuucaccgugaaggaggaccuguacaccugcuacgagcacguguggacccugagcuggagcacccagaucggcgaccugcccaacuucaucagagugagcgacgagaaccugaccggcgugaaccccgccgccgccaccagagugguguacgacggcggcguguuccugggccccaucuucggcgacaugcuggccaccgccaaccagcacacccaggugguggugagagugaacgacgugcccgcccacugccccggcagcugcagcuuccaguaccugcagggcagcacccccugcgugcacagcgugugguacagcaucgacggcgacaucaaccugaugaucuacaucaccggcaccggcuucagcggcgacagccaguuccugcaggugaccgugaacaagaccagcugcaaggugaucuucagcaaccagaccaacguggugugccagaccgaccugcugcccgugggcaugcacagaauccugaugcuggugagacccagcggccuggccaucagcgccaccggcgaggaccuguuccugaacgugaagcccagacuggacaugguggagcccagcagagccgccgacaucggcggccugugggccaccaucagaggcagcagccuggagggcgugagccugauccuguucggcagcuacagcugcgccaucaacguggccaccagcaacagcagcagaauccagugcaaggugccccccagaggcaaggacggcagaaucgugaacgugaccgugaucagaggcgacuacagcgccgugcugcccagagccuucaccuacgugagcagccugaaccccgugaucgugacccugagcagaaacaucagcaacaucgccggcggcgagacccuggugaucggcguggccagacugaugaacuacaccgaccuggacguggaggugcacgugcaggacgcccuggcccccgugcacacccagagcgccuggggccuggagguggcccugcccccccugcccgccggccugcacagaaucagcgugagcaucaacggcgugagcauccacagccagggcguggaccugcacauccaguaccugaccgagguguucagcaucgagcccugcugcggcagccugcugggcggcaccauccugagcaucagcggcaucggcuucagcagagaccccgcccuggugugggugcuggugggcaacagaagcugcgacaucgugaaccugaccgaggccagcaucuggugcgagacccugcccgccccccagauccccgacgccggcgcccccaccgugcccgccgccguggaggugugggccggcaacagauucuucgccagaggccccagccccagccuggugggcaagggcuucaccuucauguacgaggccgccgccacccccguggugaccgccaugcagggcgagaucaccaacagcagccugagccugcacgugggcggcagcaaccugagcaacagcgugauccugcugggcaaccugaacugcgacguggagacccagagcuuccagggcaacgugagccugagcggcugcagcaucccccugcacagccuggaggccggcaucuacccccugcaggugagacagaagcagaugggcuucgccaacaugagcguggugcugcagcaguucgccgugaugcccagaaucauggccaucuuccccagccagggcagcgccugcggcggcaccauccugaccgugagaggccugcugcugaacagcagaagaagaagcgugagaguggaccugagcggccccuucaccugcgugauccugagccugggcgaccacaccauccugugccaggugagccuggagggcgacccccugcccggcgccagcuucagccugaacgugaccgugcuggugaacggccugaccagcgagugccagggcaacugcacccuguucaucagagaggaggccagccccgugauggacgcccugagcaccaacaccagcggcagccugaccaccgugcugaucagaggccagagacuggccaccaccgccgacgagcccaugguguucguggacgaccagcugcccugcaacgugaccuucuucaacgccagccacguggugugccagaccagagaccuggcccccggcccccacuaccugagcguguucuacaccagaaacggcuacgccugcagcggcaacgugagcagacacuucuacaucaugccccagguguuccacuacuuccccaagaacuucagccugcacggcggcagccugcugaccaucgagggcaccggccugagaggccagaacaccaccagcguguacaucgaccagcagaccugccugaccgugaacaucggcgccgagcugaucagaugcaucgugcccaccggcaacggcagcguggcccuggagaucgagguggacggccugugguaccacaucggcgugaucggcuacaacaaggccuucacccccgagcugaucagcaucagccagagcgacgacauccugaccuucgccguggcccagaucagcggcgccgccaacaucgacaucuucaucggcaugagccccugcgugggcgugagcggcaaccacaccgugcugcagugcguggugcccagccugcccgccggcgaguaccacgugagaggcuacgacugcaucagaggcugggccagcagcgcccugguguucaccagcagagugaucaucaccgccgugaccgagaacuucggcugccugggcggcagacuggugcacguguucggcgccggcuucagccccggcaacgugagcgccgccgugugcggcgcccccugcagagugcuggccaacgccaccgugagcgccuucagcugccuggugcugccccuggacgugagccuggccuuccugugcggccugaagagagaggaggacagcugcgaggccgccagacacaccuacgugcagugcgaccugaccguggccauggccaccgagcagcugcuggagagcuggcccuaccuguacaucugcgaggagagcagccagugccuguucgugcccgaccacugggccgagagcauguuccccagcuucagcggccuguucaucagccccaagcuggagagagacgaggugcugaucuacaacagcagcugcaacaucaccauggagaccgaggccgagauggagugcgagacccccaaccagcccaucaccgugaagaucaccgagaucagaaagagauggggccagaacacccagggcaacuucagccugcaguucugcagaagauggagcagaacccacagcugguuccccgagagacugccccaggacggcgacaacgugaccguggagaacggccagcugcugcugcuggacaccaacaccagcauccugaaccugcugcacaucaagggcggcaagcugaucuucauggcccccggccccaucgagcugagagcccacgccauccuggugagcgacggcggcgagcugagaaucggcagcgaggacaagcccuuccagggcagagcccagaucacccuguacggcagcagcuacagcacccccuucuuccccuacggcgugaaguuccuggccgugagaaacggcacccugagccugcacggcagccugcccgaggugaucgugaccugccugagagccaccgcccacgcccuggacaccgugcuggcccuggaggacgccguggacuggaaccccggcgacgagguggugaucaucagcggcaccggcgugaagggcgccaagcccauggaggagaucgugaccguggagaccgugcaggacaccgaccuguaccugaagagcccccugagauacagccacaacuucaccgagaacuggguggccggcgagcaccacauccugaaggccaccguggcccugcugagcagaagcaucaccauccagggcaaccugaccaacgagagagagaagcugcuggugagcugccaggaggccaacgcccccgagggcaaccugcagcacugccuguacagcaugagcgagaagaugcugggcagcagagacaugggcgccagagugaucgugcagagcuuccccgaggagcccagccaggugcagcugaagggcgugcaguuccaggugcugggccaggccuuccacaagcaccugagcagccugacccuggugggcgccaugagagagagcuucauccagggcugcaccgugagaaacagcuucagcagaggccugagcaugugcggcacccugggccugaagguggacagcaacguguucuacaacauccugggccacgcccugcuggugggcaccugcaccgagaugagauacaucagcugggaggccauccacggcagaaaggacgacuggagcggccacggcaacaucaucagaaacaacgugaucauccaggugagcggcgccgagggccugagcaaccccgagaugcugacccccagcggcaucuacaucugcagccccaccaacgugaucgagggcaacagagugugcggcgccggcuacggcuacuucuuccaccugaugaccaaccagaccagccaggccccccugcugagcuucacccagaacaucgcccacagcugcaccagauacggccuguucguguaccccaaguuccagccccccugggacaacgugaccggcaccacccuguuccagagcuucaccgugugggagagcgccggcggcgcccagaucuucagaagcagcaaccugagacugaagaacuucaagguguacagcugcagagacuucggcaucgacgugcuggagagcgacgccaacaccagcgugaccgacagccugcugcugggccacuucgcccacaagggcagccugugcaugagcagcggcaucaagacccccaagagaugggagcugauggugagcaacaccaccuucgugaacuucgaccugaucaacugcguggccaucagaaccugcagcgacugcagccagggccagggcggcuucaccgugaagaccagccagcugaaguucaccaacagcagcaaccugguggccuuccccuucccccacgccgccauccuggaggaccuggacggcagccugagcggcaagaacagaagccacauccuggccagcauggagacccugagcgccagcugccuggugaacagcagcuucggcagaguggugcacggcagcgccugcggcggcggcgugcuguuccacagaaugagcaucggccuggccaacacccccgaggugagcuacgaccugaccaugaccgacagcagaaacaagaccaccaccgugaacuacgugagagacacccugagcaaccccagaggcuggauggcccugcugcuggaccaggagaccuacagccugcagagcgagaaccuguggaucaacagaagccugcaguacagcgccaccuucgacaacuucgcccccggcaacuaccugcugcuggugcacaccgaccugccccccuaccccgacauccugcugagaugcggcagcagagugggccugagcuuccccuuccugcccagccccggccagaaccagggcugcgacugguucuucaacagccagcugagacagcugaccuaccuggugagcggcgagggccaggugcaggugauccugagagugaaggagggcaugccccccaccaucagcgccagcaccagcgcccccgagagcgcccugaaguggagccugcccgagaccuggcagggcguggaggagggcuggggcggcuacaacaacaccauccccggccccggcgacgacgugcugauccugcccaacagaaccgugcugguggacaccgaccugcccuucuucaagggccuguacgugaugggcacccuggacuuccccguggacagaagcaacgugcugagcguggccugcauggugaucgccggcggcgagcugaaggugggcacccuggagaacccccuggagaaggagcagaagcugcugauccugcugagagccagcgagggcguguucugcgacagaaugaacggcauccacaucgaccccggcaccaucggcguguacggcaaggugcaccuguacagcgccuaccccaagaacagcuggacccaccugggcgccgacaucgccagcggcaacgagagaaucaucguggaggacgccguggacuggagaccccacgacaagaucgugcugagcagcagcagcuacgagccccacgaggccgaggugcugaccgugaaggaggugaagggccaccacgugagaaucuacgagagacugaagcacagacacaucggcagcgugcacgugaccgaggacggcagacacaucagacuggccgccgaggugggccugcugaccagaaacauccagauccagcccgacgugagcugcagaggcagacuguucgugggcagcuucagaaagagcagcagagaggaguucagcggcgugcugcagcugcugaacguggagauccagaacuucggcagcccccuguacagcagcguggaguucagcaacgugagcgccggcagcuggaucaucagcagcacccugcaccagagcugcggcggcggcauccacgccgccgccagccacggcgugcugcugaacgacaacaucguguucggcaccgccggccacggcaucgaccuggagggccaggccuacaccgugaccaacaaccugguggugcugaugacccagcccgccuggagcaccaucuggguggccggcaucaaggugaaccaggugaaggacaucaaccugcacggcaacgugguggccggcagcgagagacugggcuuccacaucagaggccacaagugcagcagcugcgagcugcuguggagcgacaacguggcccacagcagccugcacggccugcaccuguacaaggagagcggccuggacaacugcaccagaaucagcggcuuccuggccuucaagaacuucgacuacggcgccaugcugcacguggagaacagcguggagaucgagaacaucacccugguggacaacaccaucggccugcuggccgugguguacguguucagcgccccccagaacagcgugaagaaggugcagaucgugcugagaaacagcgugaucguggccaccagcagcagcuucgacugcauccaggacaaggugaagccccacagcgccaaccugaccagcaccgacagagcccccagcaaccccagaggcggcagaaucggcauccuguggcccguguucaccagcgagcccaaccaguggccccaggagcccuggcacaaggugagaaacgaccacagcaucagcggcaucaugaagcugcaggacgugaccuucagcagcuucgugaagagcugcuacagcgacgaccuggacgugugcauccugcccaacgccgagaacagcggcaucaugcaccccaucaccgccgagagaaccagaaugcugaagaucaaggacaagaacaaguucuacuuccccagccugcagcccagaaaggaccugggcaagguggugugccccgagcuggacugcgccagccccagaaaguaccuguucaaggaccuggacggcagagcccugggccugcccccccccgugagcguguuccccaagaccgaggccgaguggaccgccagcuucuucaacgccgugaccaccgagcaggcccugaagaucagcgaguaa

SEQ ID NO: 21586 - RNA, 231 nt, Artificial Sequence
  PKIA__Homo_sapiens__NP_006814
augaccgacguggagaccaccuacgccgacuucaucgccagcggcagaaccggcagaagaaacgccauccacgacauccuggugagcagcgccagcggcaacagcaacgagcuggcccugaagcuggccggccuggacaucaacaagaccgagggcgaggaggacgcccagagaagcagcaccgagcagagcggcgaggcccagggcgaggccgccaagagcgagagcuaa

SEQ ID NO: 21587 - RNA, 258 nt, Artificial Sequence
  PKIB__Homo_sapiens__NP_001257323
augagccaccaggacguggccaugagaaccgacagcagcaagaugaccgacguggagagcggcguggccaacuucgccagcagcgccagagccggcagaagaaacgcccugcccgacauccagagcagcgccgccaccgacggcaccagcgaccugccccugaagcuggaggcccugagcgugaaggaggacgccaaggagaaggacgagaagaccacccaggaccagcuggagaagccccagaacgaggagaaguaa

SEQ ID NO: 21588 - RNA, 1725 nt, Artificial Sequence
  PKLR__Homo_sapiens__NP_000289
augagcauccaggagaacaucagcagccugcagcugagaagcugggugagcaagagccagagagaccuggccaagagcauccugaucggcgcccccggcggccccgccggcuaccugagaagagccagcguggcccagcugacccaggagcugggcaccgccuucuuccagcagcagcagcugcccgccgccauggccgacaccuuccuggagcaccugugccugcuggacaucgacagcgagcccguggccgccagaagcaccagcaucaucgccaccaucggccccgccagcagaagcguggagagacugaaggagaugaucaaggccggcaugaacaucgccagacugaacuucagccacggcagccacgaguaccacgccgagagcaucgccaacgugagagaggccguggagagcuucgccggcagcccccugagcuacagacccguggccaucgcccuggacaccaagggccccgagaucagaaccggcauccugcagggcggccccgagagcgagguggagcuggugaagggcagccaggugcuggugaccguggaccccgccuucagaaccagaggcaacgccaacaccguguggguggacuaccccaacaucgugagaguggugcccgugggcggcagaaucuacaucgacgacggccugaucagccugguggugcagaagaucggccccgagggccuggugacccagguggagaacggcggcgugcugggcagcagaaagggcgugaaccugcccggcgcccagguggaccugcccggccugagcgagcaggacgugagagaccugagauucggcguggagcacggcguggacaucguguucgccagcuucgugagaaaggccagcgacguggccgccgugagagccgcccugggccccgagggccacggcaucaagaucaucagcaagaucgagaaccacgagggcgugaagagauucgacgagauccuggaggugagcgacggcaucaugguggccagaggcgaccugggcaucgagauccccgccgagaagguguuccuggcccagaagaugaugaucggcagaugcaaccuggccggcaagcccguggugugcgccacccagaugcuggagagcaugaucaccaagcccagacccaccagagccgagaccagcgacguggccaacgccgugcuggacggcgccgacugcaucaugcugagcggcgagaccgccaagggcaacuuccccguggaggccgugaagaugcagcacgccaucgccagagaggccgaggccgccguguaccacagacagcuguucgaggagcugagaagagccgccccccugagcagagaccccaccgaggugaccgccaucggcgccguggaggccgccuucaagugcugcgccgccgccaucaucgugcugaccaccaccggcagaagcgcccagcugcugagcagauacagacccagagccgccgugaucgccgugaccagaagcgcccaggccgccagacaggugcaccugugcagaggcguguucccccugcuguacagagagccccccgaggccaucugggccgacgacguggacagaagagugcaguucggcaucgagagcggcaagcugagaggcuuccugagagugggcgaccuggugaucguggugaccggcuggagacccggcagcggcuacaccaacaucaugagagugcugagcaucagcuaa

SEQ ID NO: 21589 - RNA, 1818 nt, Artificial Sequence
  PKM__Homo_sapiens__NP_001193725
augcaguggagcagcgagagaggcgagagacugcugacccccggcgccugcagcagcgaggugcccagcgccgugcccagcagaagcggcggcagccccggccacaccguguucagcagcgagagaagccugcuggugagacccagaagccaccccgagcccaagggcgagcacuacgugaccggcagccccacccccgagaaccagagaaccagcgccgccaugagcaagccccacagcgaggccggcaccgccuucauccagacccagcagcugcacgccgccauggccgacaccuuccuggagcacaugugcagacuggacaucgacagcccccccaucaccgccagaaacaccggcaucaucugcaccaucggccccgccagcagaagcguggagacccugaaggagaugaucaagagcggcaugaacguggccagacugaacuucagccacggcacccacgaguaccacgccgagaccaucaagaacgugagaaccgccaccgagagcuucgccagcgaccccauccuguacagacccguggccguggcccuggacaccaagggccccgagaucagaaccggccugaucaagggcagcggcaccgccgagguggagcugaagaagggcgccacccugaagaucacccuggacaacgccuacauggagaagugcgacgagaacauccuguggcuggacuacaagaacaucugcaaggugguggaggugggcagcaagaucuacguggacgacggccugaucagccugcaggugaagcagaagggcgccgacuuccuggugaccgagguggagaacggcggcagccugggcagcaagaagggcgugaaccugcccggcgccgccguggaccugcccgccgugagcgagaaggacauccaggaccugaaguucggcguggagcaggacguggacaugguguucgccagcuucaucagaaaggccagcgacgugcacgaggugagaaaggugcugggcgagaagggcaagaacaucaagaucaucagcaagaucgagaaccacgagggcgugagaagauucgacgagauccuggaggccagcgacggcaucaugguggccagaggcgaccugggcaucgagauccccgccgagaagguguuccuggcccagaagaugaugaucggcagaugcaacagagccggcaagcccgugaucugcgccacccagaugcuggagagcaugaucaagaagcccagacccaccagagccgagggcagcgacguggccaacgccgugcuggacggcgccgacugcaucaugcugagcggcgagaccgccaagggcgacuacccccuggaggccgugagaaugcagcaccugaucgccagagaggccgaggccgccauguuccacagaaagcuguucgaggagcuggugagagccagcagccacagcaccgaccugauggaggccauggccaugggcagcguggaggccagcuacaagugccuggccgccgcccugaucgugcugaccgagagcggcagaagcgcccaccagguggccagauacagacccagagcccccaucaucgccgugaccagaaacccccagaccgccagacaggcccaccuguacagaggcaucuuccccgugcugugcaaggaccccgugcaggaggccugggccgaggacguggaccugagagugaacuucgccaugaacgugggcaaggccagaggcuucuucaagaagggcgacguggugaucgugcugaccggcuggagacccggcagcggcuucaccaacaccaugagaguggugcccgugcccuaa

SEQ ID NO: 21590 - RNA, 1293 nt, Artificial Sequence
  PKMYT1__Homo_sapiens__NP_001245379
augcuggagagauggcaccagcugcagcccagaagagugagcuucagaggcgaggccagcgagacccugcagagccccggcuacgaccccagcagacccgagagcuucuuccagcagagcuuccagagacugagcagacugggccacggcagcuacggcgagguguucaaggugagaagcaaggaggacggcagacuguacgccgugaagagaagcaugagccccuucagaggccccaaggacagagccagaaagcuggccgaggugggcagccacgagaaggugggccagcaccccugcugcgugagacuggagcaggccugggaggagggcggcauccuguaccugcagaccgagcugugcggccccagccugcagcagcacugcgaggccuggggcgccagccugcccgaggcccagguguggggcuaccugagagacacccugcuggcccuggcccaccugcacagccagggccuggugcaccuggacgugaagcccgccaacaucuuccugggccccagaggcagaugcaagcugggcgacuucggccugcugguggagcugggcaccgccggcgccggcgaggugcaggagggcgaccccagauacauggcccccgagcugcugcagggcagcuacggcaccgccgccgacguguucagccugggccugaccauccuggagguggccugcaacauggagcugccccacggcggcgagggcuggcagcagcugagacagggcuaccugccccccgaguucaccgccggccugagcagcgagcugagaagcgugcuggugaugaugcuggagcccgaccccaagcugagagccaccgccgaggcccugcuggcccugcccgugcugagacagcccagagccuggggcgugcuguggugcauggccgccgaggcccugagcagaggcugggcccuguggcaggcccugcuggcccugcugugcuggcuguggcacggccuggcccaccccgccagcuggcugcagccccugggcccccccgccaccccccccggcagcccccccugcagccugcugcuggacagcagccugagcagcaacugggacgacgacagccugggccccagccugagccccgaggccgugcuggccagaaccgugggcagcaccagcacccccagaagcagaugcacccccagagacgcccuggaccugagcgacaucaacagcgagccccccagaggcagcuuccccagcuucgagcccagaaaccugcugagccuguucgaggacacccuggaccccaccuaa

SEQ ID NO: 21591 - RNA, 2829 nt, Artificial Sequence
  PKN1__Homo_sapiens__NP_002732
auggccagcgacgccgugcagagcgagcccagaagcuggagccugcuggagcagcugggccuggccggcgccgaccuggccgcccccggcgugcagcagcagcuggagcuggagagagagagacugagaagagagaucagaaaggagcugaagcugaaggagggcgccgagaaccugagaagagccaccaccgaccugggcagaagccugggccccguggagcugcugcugagaggcagcagcagaagacuggaccugcugcaccagcagcugcaggagcugcacgcccacguggugcugcccgaccccgccgccacccacgacggcccccagagccccggcgccggcggccccaccugcagcgccaccaaccugagcagaguggccggccuggagaagcagcuggccaucgagcugaaggugaagcagggcgccgagaacaugauccagaccuacagcaacggcagcaccaaggacagaaagcugcugcugaccgcccagcagaugcugcaggacagcaagaccaagaucgacaucaucagaaugcagcugagaagagcccugcaggccggccagcuggagaaccaggccgcccccgacgacacccagggcagccccgaccugggcgccguggagcugagaaucgaggagcugagacaccacuucagaguggagcacgccguggccgagggcgccaagaacgugcugagacugcugagcgccgccaaggcccccgacagaaaggccgugagcgaggcccaggagaagcugaccgagagcaaccagaagcugggccugcugagagaggcccuggagagaagacugggcgagcugcccgccgaccaccccaagggcagacugcugagagaggagcuggccgccgccagcagcgccgccuucagcaccagacuggccggccccuuccccgccacccacuacagcacccugugcaagcccgccccccugaccggcacccuggaggugagaguggugggcugcagagaccugcccgagaccauccccuggaaccccacccccagcaugggcggccccggcacccccgacagcagaccccccuuccugagcagacccgccagaggccuguacagcagaagcggcagccugagcggcagaagcagccugaaggccgaggccgagaacaccagcgaggugagcaccgugcugaagcuggacaacaccguggugggccagaccagcuggaagcccugcggccccaacgccugggaccagagcuucacccuggagcuggagagagccagagagcuggagcuggccguguucuggagagaccagagaggccugugcgcccugaaguuccugaagcuggaggacuuccuggacaacgagagacacgaggugcagcuggacauggagccccagggcugccugguggccgaggugaccuucagaaaccccgugaucgagagaauccccagacugagaagacagaagaagaucuucagcaagcagcagggcaaggccuuccagagagccagacagaugaacaucgacguggccaccugggugagacugcugagaagacugauccccaacgccaccggcaccggcaccuucagccccggcgccagccccggcagcgaggccagaaccaccggcgacaucagcguggagaagcugaaccugggcaccgacagcgacagcagcccccagaagagcagcagagacccccccagcagccccagcagccugagcagccccauccaggagagcaccgcccccgagcugcccagcgagacccaggagacccccggccccgcccugugcagcccccugagaaagagcccccugacccuggaggacuucaaguuccuggccgugcugggcagaggccacuucggcaaggugcugcugagcgaguucagacccagcggcgagcuguucgccaucaaggcccugaagaagggcgacaucguggccagagacgagguggagagccugaugugcgagaagagaauccuggccgccgugaccagcgccggccaccccuuccuggugaaccuguucggcugcuuccagacccccgagcacgugugcuucgugauggaguacagcgccggcggcgaccugaugcugcacauccacagcgacguguucagcgagcccagagccaucuucuacagcgccugcguggugcugggccugcaguuccugcacgagcacaagaucguguacagagaccugaagcuggacaaccugcugcuggacaccgagggcuacgugaagaucgccgacuucggccugugcaaggagggcaugggcuacggcgacagaaccagcaccuucugcggcacccccgaguuccuggcccccgaggugcugaccgacaccagcuacaccagagccguggacugguggggccugggcgugcugcuguacgagaugcuggugggcgagagccccuuccccggcgacgacgaggaggagguguucgacagcaucgugaacgacgaggugagauaccccagauuccugagcgccgaggccaucggcaucaugagaagacugcugagaagaaaccccgagagaagacugggcagcagcgagagagacgccgaggacgugaagaagcagcccuucuucagaacccugggcugggaggcccugcuggccagaagacugcccccccccuucgugcccacccugagcggcagaaccgacgugagcaacuucgacgaggaguucaccggcgaggcccccacccugagcccccccagagacgccagaccccugaccgccgccgagcaggccgccuuccuggacuucgacuucguggccggcggcugcuaa

SEQ ID NO: 21592 - RNA, 3036 nt, Artificial Sequence
  PKN2__Homo_sapiens__XP_011540071
auggccagcaaccccgagagaggcgagauccugcugaccgagcugcagaacugcggccacagcggcggccuggccugcuucaucuacugggaguuccagggcugggagaaggugcagaacgagaagagcggcgacagcagaagccugcccuucagcgagaacgugagcgccgugcagaagcuggacuucagcgacaccauggugcagcagaagcuggacgacaucaaggacagaaucaagagagagaucagaaaggagcugaagaucaaggagggcgccgagaaccugagaaaggugaccaccgacaagaagagccuggccuacguggacaacauccugaagaagagcaacaagaagcuggaggagcugcaccacaagcugcaggagcugaacgcccacaucguggugagcgaccccgaggacaucaccgacugccccagaacccccgacacccccaacaacgaccccagaugcagcaccagcaacaacagacugaaggcccugcagaagcagcuggacaucgagcugaaggugaagcagggcgccgagaacaugauccagauguacagcaacggcagcagcaaggacagaaagcugcacggcaccgcccagcagcugcugcaggacagcaagaccaagaucgaggugaucagaaugcagauccugcaggccgugcagaccaacgagcuggccuucgacaacgccaagcccgugaucagcccccuggagcugagaauggaggagcugagacaccacuucagaaucgaguucgccguggccgagggcgccaagaacgugaugaagcugcugggcagcggcaaggugaccgacagaaaggcccugagcgaggcccaggccagauucaacgagagcagccagaagcuggaccugcugaaguacagccuggagcagagacugaacgaggugcccaagaaccaccccaagagcagaaucaucaucgaggagcugagccugguggccgccagccccacccugagccccagacagagcaugaucagcacccagaaccaguacagcacccugagcaagcccgccgcccugaccggcacccuggaggugagacugaugggcugccaggacauccuggagaacgugcccggcagaagcaaggccaccagcguggcccugcccggcuggagccccagcgagaccagaagcagcuucaugagcagaaccagcaagagcaagagcggcagcagcagaaaccugcugaagaccgacgaccugagcaacgacgugugcgccgugcugaagcuggacaacaccguggugggccagaccagcuggaagcccaucagcaaccagagcugggaccagaaguucacccuggagcuggacagaagcagagagcuggagaucagcguguacuggagagacuggagaagccugugcgccgugaaguuccugagacuggaggacuuccuggacaaccagagacacggcaugugccuguaccuggagccccagggcacccuguucgccgaggugaccuucuucaaccccgugaucgagagaagacccaagcugcagagacagaagaagaucuucagcaagcagcagggcaagaccuuccugagagccccccagaugaacaucaacaucgccaccuggggcagacuggugagaagagccauccccaccgugaaccacagcggcaccuucagcccccaggcccccgugcccaccaccgugcccgugguggacgugagaaucccccagcuggccccccccgccagcgacagcaccgugaccaagcuggacuucgaccuggagcccgagcccccccccgccccccccagagccagcagccugggcgagaucgacgagagcagcgagcugagagugcuggacauccccggccaggacagcgagaccguguucgacauccagaacgacagaaacagcauccugcccaagagccagagcgaguacaagcccgacaccccccagagcggccuggaguacagcggcauccaggagcuggaggacagaagaagccagcagagauuccaguucaaccugcaggacuucagaugcugcgccgugcugggcagaggccacuucggcaaggugcugcuggccgaguacaagaacaccaacgagauguucgccaucaaggcccugaagaagggcgacaucguggccagagacgagguggacagccugaugugcgagaagagaaucuucgagaccgugaacagcgugagacaccccuuccuggugaaccuguucgccugcuuccagaccaaggagcacgugugcuucgugauggaguacgccgccggcggcgaccugaugaugcacauccacaccgacguguucagcgagcccagagccguguucuacgccgccugcguggugcugggccugcaguaccugcacgagcacaagaucguguacagagaccugaagcuggacaaccugcugcuggacaccgagggcuucgugaagaucgccgacuucggccugugcaaggagggcaugggcuacggcgacagaaccagcaccuucugcggcacccccgaguuccuggcccccgaggugcugaccgagaccagcuacaccagagccguggacugguggggccugggcgugcugaucuacgagaugcuggugggcgagagccccuuccccggcgacgacgaggaggagguguucgacagcaucgugaacgacgaggugagauaccccagauuccugagcaccgaggccaucagcaucaugagaagacugcugagaagaaaccccgagagaagacugggcgccagcgagaaggacgccgaggacgugaagaagcaccccuucuucagacugaucgacuggagcgcccugauggacaagaaggugaagccccccuucauccccaccaucagaggcagagaggacgugagcaacuucgacgacgaguucaccagcgaggcccccauccugaccccccccagagagcccagaauccugagcgaggaggagcaggagauguucagagacuucgacuacaucgccgacuggugcuaa

SEQ ID NO: 21593 - RNA, 2670 nt, Artificial Sequence
  PKN3__Homo_sapiens__NP_037487
auggaggagggcgcccccagacagcccggccccagccaguggccccccgaggacgagaaggaggugaucagaagagccauccagaaggagcugaagaucaaggagggcguggagaaccugagaagaguggccaccgacagaagacaccugggccacgugcagcagcugcugagaagcagcaacagaagacuggagcagcugcacggcgagcugagagagcugcacgccagaauccugcugcccggccccggccccggccccgccgagcccguggccagcggccccagacccugggccgagcagcugagagccagacaccuggaggcccugagaagacagcugcacguggagcugaaggugaagcagggcgccgagaacaugacccacaccugcgccagcggcacccccaaggagagaaagcugcuggccgccgcccagcagaugcugagagacagccagcugaagguggcccugcugagaaugaagaucagcagccuggaggccagcggcagccccgagcccggccccgagcugcuggccgaggagcugcagcacagacugcacguggaggccgccguggccgagggcgccaagaacguggugaagcugcugagcagcagaagaacccaggacagaaaggcccuggccgaggcccaggcccagcugcaggagagcagccagaagcuggaccugcugagacuggcccuggagcagcugcuggagcagcugccccccgcccacccccugagaagcagagugaccagagagcugagagccgccgugcccggcuacccccagcccagcggcacccccgugaagcccaccgcccugaccggcacccugcaggugagacugcugggcugcgagcagcugcugaccgccgugcccggcagaagccccgccgccgcccuggccagcagccccagcgagggcuggcugagaaccaaggccaagcaccagagaggcagaggcgagcuggccagcgaggugcuggccgugcugaagguggacaacagaguggugggccagaccggcuggggccagguggccgagcagagcugggaccagaccuucgugaucccccuggagagagccagagagcuggagaucggcgugcacuggagagacuggagacagcugugcggcguggccuuccugagacuggaggacuuccuggacaacgccugccaccagcugagccugagccuggugccccagggccugcuguucgcccaggugaccuucugcgaccccgugaucgagagaagacccagacugcagagacaggagagaaucuucagcaagagaagaggccaggacuuccugagagccagccagaugaaccugggcauggccgccuggggcagacuggugaugaaccugcugccccccugcagcagccccagcaccaucagcccccccaagggcugccccagaacccccaccacccugagagaggccagcgaccccgccacccccagcaacuuccugcccaagaagaccccccugggcgaggagaugacccccccccccaagccccccagacuguaccugccccaggagcccaccagcgaggagacccccagaaccaagagaccccacauggagcccagaaccagaagaggccccagcccccccgccagccccaccagaaagccccccagacugcaggacuucagaugccuggccgugcugggcagaggccacuucggcaaggugcugcuggugcaguucaagggcaccggcaaguacuacgccaucaaggcccugaagaagcaggaggugcugagcagagacgagaucgagagccuguacugcgagaagagaauccuggaggccgugggcugcaccggccaccccuuccugcugagccugcuggccugcuuccagaccagcagccacgccugcuucgugaccgaguucgugcccggcggcgaccugaugaugcagauccacgaggacguguuccccgagccccaggccagauucuacguggccugcguggugcugggccugcaguuccugcacgagaagaagaucaucuacagagaccugaagcuggacaaccugcugcuggacgcccagggcuuccugaagaucgccgacuucggccugugcaaggagggcaucggcuucggcgacagaaccagcaccuucugcggcacccccgaguuccuggcccccgaggugcugacccaggaggccuacaccagagccguggacugguggggccugggcgugcugcuguacgagaugcuggugggcgagugccccuuccccggcgacaccgaggaggagguguucgacugcaucgugaacauggacgcccccuaccccggcuuccugagcgugcagggccuggaguucauccagaagcugcugcagaagugccccgagaagagacugggcgccggcgagcaggacgccgaggagaucaaggugcagcccuucuucagaaccaccaacuggcaggcccugcuggccagaaccauccagccccccuucgugcccacccugugcggccccgccgaccugagauacuucgagggcgaguucaccggccugccccccgcccugaccccccccgccccccacagccugcugaccgccagacagcaggccgccuucagagacuucgacuucgugagcgagagauuccuggagcccuaa

SEQ ID NO: 21594 - RNA, 960 nt, Artificial Sequence
  PKNOX1__Homo_sapiens__NP_001273187
auggugaaggccauccaggugcugagaauccaccugcuggagcuggagaaggugaacgagcugugcaaggacuucugcagcagauacaucgccugccugaagaccaagaugaacagcgagacccugcugagcggcgagcccggcagccccuacagccccgugcagagccagcagauccagagcgccaucaccggcaccaucagcccccagggcaucguggugcccgccagcgcccugcagcagggcaacguggccauggccaccguggccggcggcaccguguaccagcccgugaccguggugaccccccagggccagguggugacccagacccugagccccggcaccaucagaauccagaacagccagcugcagcugcagcugaaccaggaccugagcauccugcaccaggacgacggcagcagcaagaacaagagaggcgugcugcccaagcacgccaccaacgugaugagaagcuggcuguuccagcacaucggccaccccuaccccaccgaggacgagaagaagcagaucgccgcccagaccaaccugacccugcugcaggugaacaacugguucaucaacgccagaagaagaauccugcagcccaugcuggacagcagcugcagcgagacccccaagaccaagaagaagaccgcccagaacagacccgugcagagauucuggcccgacagcaucgccagcggcguggcccagcccccccccagcgagcugaccaugagcgagggcgccguggugaccaucaccacccccgugaacaugaacguggacagccugcagagccugagcagcgacggcgccacccuggccgugcagcaggugaugauggccggccagagcgaggacgagagcguggacagcaccgaggaggacgccggcgcccuggcccccgcccacaucagcggccuggugcuggagaacagcgacagccugcaguaa

SEQ ID NO: 21595 - RNA, 1332 nt, Artificial Sequence
  PKNOX2__Homo_sapiens__XP_005271700
augaccgccaccgcccagccccccagcaaggcccaggccgugcacaucagcgcccccagcgccgccgccagcacccccgugcccagcgcccccaucgacccccaggcccagcuggaggccgacaagagagccguguacagacacccccuguucccccugcugacccugcuguucgagaagugcgagcaggccacccagggcagcgagugcaucaccagcgccagcuucgacguggacaucgagaacuucgugcaccagcaggagcaggagcacaagcccuucuucagcgacgaccccgagcuggacaaccugauggugaaggccauccaggugcugagaauccaccugcuggagcuggagaaggugaacgagcugugcaaggacuucugcaacagauacaucaccugccugaagaccaagaugcacagcgacaaccugcugagaaacgaccugggcggccccuacagccccaaccagcccagcaucaaccugcacagccaggaccugcugcagaacagccccaacagcaugagcggcgugagcaacaacccccagggcaucguggugcccgccagcgcccugcagcagggcaacaucgccaugaccaccgugaacagccagguggugagcggcggcgcccuguaccagcccgugaccauggugaccagccagggccagguggugacccaggccaucccccagggcgccauccagauccagaacacccaggugaaccuggaccugaccagccugcuggacaacgaggacaagaagagcaagaacaagagaggcgugcugcccaagcacgccaccaacaucaugagaagcuggcuguuccagcaccugaugcaccccuaccccaccgaggacgagaagagacagaucgccgcccagaccaaccugacccugcugcaggugaacaacugguucaucaacgccagaagaagaauccugcagcccaugcuggacgccagcaaccccgaccccgcccccaaggccaagaagaucaagagccagcacagacccacccagagauucuggcccaacagcaucgccgccggcgugcugcagcagcagggcggcgcccccggcaccaaccccgacggcagcaucaaccuggacaaccugcagagccugagcagcgacagcgccaccauggccaugcagcaggccaugauggccgcccacgacgacagccuggacggcaccgaggaggaggacgaggacgagauggaggaggaggaggaggaggagcuggaggaggagguggacgagcugcagaccaccaacgugagcgaccugggccuggagcacagcgacagccuggaguaa

SEQ ID NO: 21596 - RNA, 2244 nt, Artificial Sequence
  PKP1__Homo_sapiens__NP_000290
augaaccacagcccccugaagaccgcccuggccuacgagugcuuccaggaccaggacaacagcacccuggcccugcccagcgaccagaagaugaagaccggcaccagcggcagacagagagugcaggagcaggugaugaugaccgugaagagacagaagagcaagagcagccagagcagcacccugagccacagcaacagaggcagcauguacgacggccuggccgacaacuacaacuacggcaccaccagcagaagcagcuacuacagcaaguuccaggccggcaacggcagcuggggcuaccccaucuacaacggcacccugaagagagagcccgacaacagaagauucagcagcuacagccagauggagaacuggagcagacacuaccccagaggcagcugcaacaccaccggcgccggcagcgacaucugcuucaugcagaagaucaaggccagcagaagcgagcccgaccuguacugcgaccccagaggcacccugagaaagggcacccugggcagcaagggccagaagaccacccagaacagauacagcuucuacagcaccugcagcggccagaaggccaucaagaagugccccgugagaccccccagcugcgccagcaagcaggaccccguguacaucccccccaucagcugcaacaaggaccugagcuucggccacagcagagccagcagcaagaucugcagcgaggacaucgagugcagcggccugaccauccccaaggccgugcaguaccugagcagccaggacgagaaguaccaggccaucggcgccuacuacauccagcacaccugcuuccaggacgagagcgccaagcagcagguguaccagcugggcggcaucugcaagcugguggaccugcugagaagccccaaccagaacgugcagcaggccgccgccggcgcccugagaaaccugguguucagaagcaccaccaacaagcuggagaccagaagacagaacggcaucagagaggccgugagccugcugagaagaaccggcaacgccgagauccagaagcagcugaccggccugcuguggaaccugagcagcaccgacgagcugaaggaggagcugaucgccgacgcccugcccgugcuggccgacagagugaucauccccuucagcggcuggugcgacggcaacagcaacaugagcagagaggugguggaccccgagguguucuucaacgccaccggcugccugagaaagagacugggcaugagagagcugcuggcccuggugccccagagagccaccagcagcagagugaaccugagcagcgccgacgccggcagacagaccaugagaaacuacagcggccugaucgacagccugauggccuacgugcagaacugcguggccgccagcagaugcgacgacaagagcguggagaacugcaugugcgugcugcacaaccugagcuacagacuggacgccgaggugcccaccagauacagacagcuggaguacaacgccagaaacgccuacaccgagaagagcagcaccggcugcuucagcaacaagagcgacaagaugaugaacaacaacuacgacugcccccugcccgaggaggagaccaaccccaagggcagcggcuggcuguaccacagcgacgccaucagaaccuaccugaaccugaugggcaagagcaagaaggacgccacccuggaggccugcgccggcgcccugcagaaccugaccgccagcaagggccugaugagcagcggcaugagccagcugaucggccugaaggagaagggccugccccagaucgccagacugcugcagagcggcaacagcgacguggugagaagcggcgccagccugcugagcaacaugagcagacacccccugcugcacagagugaugggcaaccagguguuccccgaggugaccagacugcugaccagccacaccggcaacaccagcaacagcgaggacauccugagcagcgccugcuacaccgugagaaaccugauggccagccagccccagcuggccaagcaguacuucagcagcagcaugcugaacaacaucaucaaccugugcagaagcagcgccagccccaaggccgccgaggccgccagacugcugcugagcgacauguggagcagcaaggagcugcagggcgugcugagacagcagggcuucgacagaaacaugcugggcacccuggccggcgccaacagccugagaaacuucaccagcagauucuaa

SEQ ID NO: 21597 - RNA, 2514 nt, Artificial Sequence
  PKP2__Homo_sapiens__NP_001005242
auggccgcccccggcgcccccgccgaguacggcuacaucagaaccgugcugggccagcagauccugggccagcuggacagcagcagccuggcccugcccagcgaggccaagcugaagcuggccggcagcagcggcagaggcggccagaccgugaagagccugagaauccaggagcaggugcagcagacccuggccagaaagggcagaagcagcgugggcaacggcaaccugcacagaaccagcagcgugcccgaguacguguacaaccugcaccugguggagaacgacuucgugggcggcagaagccccgugcccaagaccuacgacaugcugaaggccggcaccaccgccaccuacgagggcagauggggcagaggcaccgcccaguacagcagccagaagagcguggaggagagaagccugagacacccccugagaagacuggagaucagccccgacagcagccccgagagagcccacuacacccacagcgacuaccaguacagccagagaagccaggccggccacacccugcaccaccaggagagcagaagagccgcccugcuggugccccccagauacgccagaagcgagaucgugggcgugagcagagccggcaccaccagcagacagagacacuucgacaccuaccacagacaguaccagcacggcagcgugagcgacaccguguucgacagcauccccgccaaccccgcccugcugaccuaccccagacccggcaccagcagaagcaugggcaaccugcuggagaaggagaacuaccugaccgccggccugaccgugggccaggugagaccccuggugccccugcagcccgugacccagaacagagccagcagaagcagcuggcaccagagcagcuuccacagcaccagaacccugagagaggccggccccagcguggccguggacagcagcggcagaagagcccaccugaccgugggccaggccgccgccggcggcagcggcaaccugcugaccgagagaagcaccuucaccgacagccagcugggcaacgccgacauggagaugacccuggagagagccgugagcaugcuggaggccgaccacaugcugcccagcagaaucagcgccgccgccaccuucauccagcacgagugcuuccagaagagcgaggccagaaagagagugaaccagcugagaggcauccugaagcugcugcagcugcugaaggugcagaacgaggacgugcagagagccgugugcggcgcccugagaaaccugguguucgaggacaacgacaacaagcuggagguggccgagcugaacggcgugcccagacugcugcaggugcugaagcagaccagagaccuggagaccaagaagcagaucaccggccugcuguggaaccugagcagcaacgacaagcugaagaaccugaugaucaccgaggcccugcugacccugaccgagaacaucaucauccccuucagcggcuggcccgagggcgacuaccccaaggccaacggccugcuggacuucgacaucuucuacaacgugaccggcugccugagaaacaugagcagcgccggcgccgacggcagaaaggccaugagaagaugcgacggccugaucgacagccuggugcacuacgugagaggcaccaucgccgacuaccagcccgacgacaaggccaccgagaacugcgugugcauccugcacaaccugagcuaccagcuggaggccgagcugcccgagaaguacagccagaacaucuacauccagaacagaaacauccagaccgacaacaacaagagcaucggcugcuucggcagcagaagcagaaaggugaaggagcaguaccaggacgugcccaugcccgaggagaagagcaaccccaagggcguggaguggcuguggcacagcaucgugaucagaauguaccugagccugaucgccaagagcgugagaaacuacacccaggaggccagccugggcgcccugcagaaccugaccgccggcagcggccccaugcccaccagcguggcccagaccguggugcagaaggagagcggccugcagcacaccagaaagaugcugcacgugggcgaccccagcgugaagaagaccgccaucagccugcugagaaaccugagcagaaaccugagccugcagaacgagaucgccaaggagacccugcccgaccuggugagcaucauccccgacaccgugcccagcaccgaccugcugaucgagaccaccgccagcgccugcuacacccugaacaacaucauccagaacagcuaccagaacgccagagaccugcugaacaccggcggcauccagaagaucauggccaucagcgccggcgacgccuacgccagcaacaaggccagcaaggccgccagcgugcugcuguacagccugugggcccacaccgagcugcaccacgccuacaagaaggcccaguucaagaagaccgacuucgugaacagcagaaccgccaaggccuaccacagccugaaggacuaa

SEQ ID NO: 21598 - RNA, 2394 nt, Artificial Sequence
  PKP3__Homo_sapiens__NP_009114
augcaggacggcaacuuccugcugagcgcccugcagcccgaggccggcgugugcagccuggcccugcccagcgaccugcagcuggacagaagaggcgccgagggccccgaggccgagagacugagagccgccagagugcaggagcaggugagagccagacugcugcagcugggccagcagcccagacacaacggcgccgccgagcccgagcccgaggccgagaccgccagaggcaccagcagaggccaguaccacacccugcaggccggcuucagcagcagaagccagggccugagcggcgacaagaccagcggcuucagacccaucgccaagcccgccuacagccccgccagcuggagcagcagaagcgccguggaccugagcugcagcagaagacugagcagcgcccacaacggcggcagcgccuucggcgccgccggcuacggcggcgcccagcccaccccccccaugcccaccagacccgugagcuuccacgagagaggcggcgugggcagcagagccgacuacgacacccugagccugagaagccugagacugggccccggcggccuggacgacagauacagccuggugagcgagcagcuggagcccgccgccaccagcaccuacagagccuucgccuacgagagacaggccagcagcagcagcagcagagccggcggccuggacuggcccgaggccaccgaggugagccccagcagaaccaucagagcccccgccgugagaacccugcagagauuccagagcagccacagaagcagaggcgugggcggcgccgugcccggcgccgugcuggagcccguggccagagcccccagcgugagaagccugagccugagccuggccgacagcggccaccugcccgacgugcacggcuucaacagcuacggcagccacagaacccugcagagacugagcagcggcuucgacgacaucgaccugcccagcgccgugaaguaccugauggccagcgaccccaaccugcaggugcugggcgccgccuacauccagcacaagugcuacagcgacgccgccgccaagaagcaggccagaagccugcaggccgugcccagacuggugaagcuguucaaccacgccaaccaggaggugcagagacacgccaccggcgccaugagaaaccugaucuacgacaacgccgacaacaagcuggcccugguggaggagaacggcaucuucgagcugcugagaacccugagagagcaggacgacgagcugagaaagaacgugaccggcauccuguggaaccugagcagcagcgaccaccugaaggacagacuggccagagacacccuggagcagcugaccgaccuggugcugagcccccugagcggcgccggcggccccccccugauccagcagaacgccagcgaggccgagaucuucuacaacgccaccggcuuccugagaaaccugagcagcgccagccaggccaccagacagaagaugagagagugccacggccugguggacgcccuggugaccagcaucaaccacgcccuggacgccggcaagugcgaggacaagagcguggagaacgccgugugcgugcugagaaaccugagcuacagacuguacgacgagaugccccccagcgcccugcagagacuggagggcagaggcagaagagaccuggccggcgccccccccggcgagguggugggcugcuucaccccccagagcagaagacugagagagcugccccuggccgccgacgcccugaccuucgccgaggugagcaaggaccccaagggccuggaguggcuguggagcccccagaucgugggccuguacaacagacugcugcagagaugcgagcugaacagacacaccaccgaggccgccgccggcgcccugcagaacaucaccgccggcgacagaagaugggccggcgugcugagcagacuggcccuggagcaggagagaauccugaacccccugcuggacagagugagaaccgccgaccaccaccagcugagaagccugaccggccugaucagaaaccugagcagaaacgccagaaacaaggacgagaugagcaccaagguggugagccaccugaucgagaagcugcccggcagcgugggcgagaagagcccccccgccgaggugcuggugaacaucaucgccgugcugaacaaccuggugguggccagccccaucgccgccagagaccugcuguacuucgacggccugagaaagcugaucuucaucaagaagaagagagacagccccgacagcgagaagagcagcagagccgccagcagccugcuggccaaccuguggcaguacaacaagcugcacagagacuucagagccaagggcuacagaaaggaggacuuccugggccccuaa

SEQ ID NO: 21599 - RNA, 3450 nt, Artificial Sequence
  PKP4__Homo_sapiens__NP_001005476
augcccgcccccgagcaggccagccugguggaggagggccagccccagaccagacaggaggccgccagcaccggccccggcauggagcccgagaccaccgccaccaccauccuggccagcgugaaggagcaggagcugcaguuccagagacugaccagagagcuggagguggagagacagaucguggccagccagcuggagagaugcagacugggcgccgagagccccagcaucgccagcaccagcagcaccgagaagagcuuccccuggagaagcaccgacgugcccaacaccggcgugagcaagcccagagugagcgacgccgugcagcccaacaacuaccugaucagaaccgagcccgagcagggcacccuguacagccccgagcagaccagccugcacgagagcgagggcagccugggcaacagcagaagcagcacccagaugaacagcuacagcgacagcggcuaccaggaggccggcagcuuccacaacagccagaacgugagcaaggccgacaacagacagcagcacagcuucaucggcagcaccaacaaccacguggugagaaacagcagagccgagggccagacccuggugcagcccagcguggccaacagagccaugagaagagugagcagcgugcccagcagagcccagagccccagcuacgugaucagcaccggcgugagccccagcagaggcagccugagaaccagccugggcagcggcuucggcagccccagcgugaccgaccccagaccccugaaccccagcgccuacagcagcaccacccugcccgccgccagagccgccagccccuacagccagagacccgccagccccaccgccaucagaagaaucggcagcgugaccagcagacagaccagcaaccccaacggccccaccccccaguaccagaccaccgccagagugggcagcccccugacccugaccgacgcccagaccagaguggccagccccagccagggccaggugggcagcagcagccccaagagaagcggcaugaccgccgugccccagcaccugggccccagccugcagagaaccgugcacgacauggagcaguucggccagcagcaguacgacaucuacgagagaauggugccccccagacccgacagccugaccggccugagaagcagcuacgccagccagcacagccagcugggccaggaccugagaagcgccgugagccccgaccugcacaucacccccaucuacgagggcagaaccuacuacagccccguguacagaagccccaaccacggcaccguggagcugcagggcagccagaccgcccuguacagaaccggcagcgugggcaucggcaaccugcagagaaccagcagccagagaagcacccugaccuaccagagaaacaacuacgcccugaacaccaccgccaccuacgccgagcccuacagacccauccaguacagagugcaggagugcaacuacaacagacugcagcacgccgugcccgccgacgacggcaccaccagaagccccagcaucgacagcauccagaaggaccccagagaguucgccuggagagaccccgagcugcccgaggugauccacaugcugcagcaccaguuccccagcgugcaggccaacgccgccgccuaccugcagcaccugugcuucggcgacaacaaggugaagauggaggugugcagacugggcggcaucaagcaccugguggaccugcuggaccacagagugcuggaggugcagaagaacgccugcggcgcccugagaaaccugguguucggcaagagcaccgacgagaacaagaucgccaugaagaacgugggcggcauccccgcccugcugagacugcugagaaagagcaucgacgccgaggugagagagcuggugaccggcgugcuguggaaccugagcagcugcgacgccgugaagaugaccaucaucagagacgcccugagcacccugaccaacaccgugaucgugccccacagcggcuggaacaacagcagcuucgacgacgaccacaagaucaaguuccagaccagccuggugcugagaaacaccaccggcugccugagaaaccugagcagcgccggcgaggaggccagaaagcagaugagaagcugcgagggccugguggacagccugcuguacgugauccacaccugcgugaacaccagcgacuacgacagcaagaccguggagaacugcgugugcacccugagaaaccugagcuacagacuggagcuggaggugccccaggccagacugcugggccugaacgagcuggacgaccugcugggcaaggagagccccagcaaggacagcgagcccagcugcuggggcaagaagaagaagaagaagaagagaaccccccaggaggaccagugggacggcgugggccccauccccggccugagcaagagccccaagggcguggagaugcuguggcaccccagcguggugaagcccuaccugacccugcuggccgagagcagcaaccccgccacccuggagggcagcgccggcagccugcagaaccugagcgccggcaacuggaaguucgccgccuacaucagagccgccgugagaaaggagaagggccugcccauccugguggagcugcugagaauggacaacgacagaguggugagcagcguggccaccgcccugagaaacauggcccuggacgugagaaacaaggagcugaucggcaaguacgccaugagagaccuggugaacagacugcccggcggcaacggccccagcgugcugagcgacgagaccauggccgccaucugcugcgcccugcacgaggugaccagcaagaacauggagaacgccaaggcccuggccgacagcggcggcaucgagaagcuggugaacaucaccaagggcagaggcgacagaagcagccugaagguggugaaggccgccgcccaggugcugaacacccuguggcaguacagagaccugagaagcaucuacaagaaggacggcuggaaccagaaccacuucaucacccccgugagcacccuggagagagacagauucaagagccaccccagccugagcaccaccaaccagcagaugagccccaucauccagagcggcagcagcaagcccagccccaucuacaucagcagcuacagcagccccgccagagagcagaacagaagacugcagcaccagcagcuguacuacagccaggacgacagcaacagaaagaacuucgacgccuacagacuguaccugcagagcccccacagcuacgaggaccccuacuucgacgacagagugcacuuccccgccagcaccgacuacagcacccaguacggccugaagagcaccaccaacuacguggacuucuacagcaccaagagacccagcuacagagccgagcaguaccccggcagccccgacagcuggguguaa

SEQ ID NO: 21600 - RNA, 1323 nt, Artificial Sequence
  PLA1A__Homo_sapiens__NP_001193889
augccccccggccccugggagagcugcuucugggugggcggccugauccuguggcugagcgugggcagcagcggcgacgccccccccaccccccagcccaagugcgccgacuuccagagcgccaaccuguucgagggcaccgaccugaaggugcaguuccugcuguucgugcccagcaaccccagcugcggccagcugguggagggcagcagcgaccugcagaacagcggcuucaacgccacccugggcaccaagcugaucauccacggcuucagagugcugggcaccaagcccagcuggaucgacaccuucaucagaacccugcugagagccaccaacgccaacgugaucgccguggacuggaucuacggcagcaccggcguguacuucagcgccgugaagaacgugcugggcgugagcgagagcagcauccacaucaucggcgugagccugggcgcccacgugggcggcauggugggccagcuguucggcggccagcugggccagaucaccggccuggaccccgccggccccgaguacaccagagccagcguggaggagagacuggacgccggcgacgcccuguucguggaggccauccacaccgacaccgacaaccugggcaucagaauccccgugggccacguggacuacuucgugaacggcggccaggaccagcccggcugccccaccuucuucuacgccggcuacagcuaccugaucugcgaccacaugagagccgugcaccuguacaucagcgcccuggagaacagcugcccccugauggccuuccccugcgccagcuacaaggccuuccuggccggcagaugccuggacugcuucaaccccuuccugcugagcugccccagaaucggccugguggagcagggcggcgugaagaucgagccccugcccaaggaggugaagguguaccugcugaccaccagcagcgcccccuacugcaugcaccacagccugguggaguuccaccugaaggagcugagaaacaaggacaccaacaucgaggugaccuuccugagcagcaacaucaccagcagcagcaagaucaccauccccaagcagcagagauacggcaagggcaucaucgcccacgccaccccccagugccagaucaaccaggugaaguucaaguuccagagcagcaacagaguguggaagaaggacagaaccaccaucaucggcaaguucugcaccgcccugcugcccgugaacgacagagagaagauggugugccugcccgagcccgugaaccugcaggccagcgugaccgugagcugcgaccugaagaucgccugcguguaa

SEQ ID NO: 21601 - RNA, 498 nt, Artificial Sequence
  PLA2G10__Homo_sapiens__NP_003552
augggcccccugcccgugugccugcccaucaugcugcugcugcugcugcccagccugcugcugcugcugcugcugcccggccccggcagcggcgaggccagcagaauccugagagugcacagaagaggcauccuggagcuggccggcaccgugggcugcgugggccccagaacccccaucgccuacaugaaguacggcugcuucugcggccugggcggccacggccagcccagagacgccaucgacuggugcugccacggccacgacugcugcuacaccagagccgaggaggccggcugcagccccaagaccgagagauacagcuggcagugcgugaaccagagcgugcugugcggccccgccgagaacaagugccaggagcugcugugcaagugcgaccaggagaucgccaacugccuggcccagaccgaguacaaccugaaguaccuguucuacccccaguuccugugcgagcccgacagccccaagugcgacuaa

SEQ ID NO: 21602 - RNA, 570 nt, Artificial Sequence
  PLA2G12A__Homo_sapiens__NP_110448
auggcccugcugagcagacccgcccugacccugcugcugcugcugauggccgccguggugagaugccaggagcaggcccagaccaccgacuggagagccacccugaagaccaucagaaacggcgugcacaagaucgacaccuaccugaacgccgcccuggaccugcugggcggcgaggacggccugugccaguacaagugcagcgacggcagcaagcccuuccccagauacggcuacaagcccagcccccccaacggcugcggcagcccccuguucggcgugcaccugaacaucggcauccccagccugaccaagugcugcaaccagcacgacagaugcuacgagaccugcggcaagagcaagaacgacugcgacgaggaguuccaguacugccugagcaagaucugcagagacgugcagaagacccugggccugacccagcacgugcaggccugcgagaccaccguggagcugcuguucgacagcgugauccaccugggcugcaagcccuaccuggacagccagagagccgccugcagaugccacuacgaggagaagaccgaccuguaa

SEQ ID NO: 21603 - RNA, 588 nt, Artificial Sequence
  PLA2G12B__Homo_sapiens__NP_115951
augaagcuggccagcggcuuccuggugcuguggcugagccugggcggcggccuggcccagagcgacaccagccccgacaccgaggagagcuacagcgacuggggccugagacaccugagaggcagcuucgagagcgugaacagcuacuucgacagcuuccuggagcugcugggcggcaagaacggcgugugccaguacagaugcagauacggcaaggcccccaugcccagacccggcuacaagccccaggagcccaacggcugcggcagcuacuuccugggccugaaggugcccgagagcauggaccugggcauccccgccaugaccaagugcugcaaccagcuggacgugugcuacgacaccugcggcgccaacaaguacagaugcgacgccaaguucagauggugccugcacagcaucugcagcgaccugaagagaagccugggcuucgugagcaagguggaggccgccugcgacagccugguggacaccguguucaacaccguguggacccugggcugcagacccuucaugaacagccagagagccgccugcaucugcgccgaggaggagaaggaggagcuguaa

SEQ ID NO: 21604 - RNA, 1239 nt, Artificial Sequence
  PLA2G15__Homo_sapiens__NP_036452
augggccugcaccugagacccuacagagugggccugcugcccgacggccugcuguuccugcugcugcugcugaugcugcuggccgaccccgcccugcccgccggcagacacccccccguggugcuggugcccggcgaccugggcaaccagcuggaggccaagcuggacaagcccaccguggugcacuaccugugcagcaagaagaccgagagcuacuucaccaucuggcugaaccuggagcugcugcugcccgugaucaucgacugcuggaucgacaacaucagacugguguacaacaagaccagcagagccacccaguuccccgacggcguggacgugagagugcccggcuucggcaagaccuucagccuggaguuccuggaccccagcaagagcagcgugggcagcuacuuccacaccaugguggagagccuggugggcuggggcuacaccagaggcgaggacgugagaggcgcccccuacgacuggagaagagcccccaacgagaacggccccuacuuccuggcccugagagagaugaucgaggagauguaccagcuguacggcggccccguggugcugguggcccacagcaugggcaacauguacacccuguacuuccugcagagacagccccaggccuggaaggacaaguacaucagagccuucgugagccugggcgcccccuggggcggcguggccaagacccugagagugcuggccagcggcgacaacaacagaauccccgugaucggcccccugaagaucagagagcagcagagaagcgccgugagcaccagcuggcugcugcccuacaacuacaccuggagccccgagaagguguucgugcagacccccaccaucaacuacacccugagagacuacagaaaguucuuccaggacaucggcuucgaggacggcuggcugaugagacaggacaccgagggccugguggaggccaccaugccccccggcgugcagcugcacugccuguacggcaccggcgugcccacccccgacagcuucuacuacgagagcuuccccgacagagaccccaagaucugcuucggcgacggcgacggcaccgugaaccugaagagcgcccugcagugccaggccuggcagagcagacaggagcaccaggugcugcugcaggagcugcccggcagcgagcacaucgagaugcuggccaacgccaccacccuggccuaccugaagagagugcugcugggccccuaa

SEQ ID NO: 21605 - RNA, 489 nt, Artificial Sequence
  PLA2G16__Homo_sapiens__NP_009000
augagagcccccauccccgagcccaagcccggcgaccugaucgagaucuucagacccuucuacagacacugggccaucuacgugggcgacggcuacguggugcaccuggccccccccagcgagguggccggcgccggcgccgccagcgugaugagcgcccugaccgacaaggccaucgugaagaaggagcugcuguacgacguggccggcagcgacaaguaccaggugaacaacaagcacgacgacaaguacagcccccugcccugcagcaagaucauccagagagccgaggagcuggugggccaggaggugcuguacaagcugaccagcgagaacugcgagcacuucgugaacgagcugagauacggcguggccagaagcgaccaggugagagacgugaucaucgccgccagcguggccggcaugggccuggccgccaugagccugaucggcgugauguucagcagaaacaagagacagaagcaguaa

SEQ ID NO: 21606 - RNA, 447 nt, Artificial Sequence
  PLA2G1B__Homo_sapiens__NP_000919
augaagcugcuggugcuggccgugcugcugaccguggccgccgccgacagcggcaucagccccagagccguguggcaguucagaaagaugaucaagugcgugauccccggcagcgaccccuuccuggaguacaacaacuacggcugcuacugcggccugggcggcagcggcacccccguggacgagcuggacaagugcugccagacccacgacaacugcuacgaccaggccaagaagcuggacagcugcaaguuccugcuggacaaccccuacacccacaccuacagcuacagcugcagcggcagcgccaucaccugcagcagcaagaacaaggagugcgaggccuucaucugcaacugcgacagaaacgccgccaucugcuucagcaaggcccccuacaacaaggcccacaagaaccuggacaccaagaaguacugccagagcuaa

SEQ ID NO: 21607 - RNA, 1530 nt, Artificial Sequence
  PLA2G3__Homo_sapiens__NP_056530
augggcgugcaggccggccuguucggcaugcugggcuuccugggcguggcccugggcggcagccccgcccugagaugguacagaaccagcugccaccugaccaaggccgugcccggcaacccccugggcuaccugagcuuccuggccaaggacgcccagggccuggcccugauccacgccagaugggacgcccacagaagacugcagagcugcagcugggaggacgagcccgagcugaccgccgccuacggcgcccugugcgcccacgagaccgccuggggcagcuucauccacacccccggccccgagcugcagagagcccuggccacccugcagagccagugggaggccugcagagcccuggaggagagccccgccggcgccagaaagaagagagccgccggccagagcggcgugcccggcggcggccaccagagagagaagagaggcuggaccaugcccggcacccuguggugcggcgugggcgacagcgccggcaacagcagcgagcugggcguguuccagggccccgaccugugcugcagagagcacgacagaugcccccagaacaucagcccccugcaguacaacuacggcaucagaaacuacagauuccacaccaucagccacugcgacugcgacaccagauuccagcagugccugcagaaccagcacgacagcaucagcgacaucgugggcguggccuucuucaacgugcuggagauccccugcuucgugcuggaggagcaggaggccugcguggccugguacugguggggcggcugcagaauguacggcaccgugccccuggccagacugcagcccagaaccuucuacaacgccagcuggagcagcagagccaccagccccacccccagcagcagaagccccgccccccccaagcccagacagaagcagcaccugagaaagggccccccccaccagaagggcagcaagagacccagcaaggccaacaccaccgcccugcaggaccccauggugagccccagacuggacguggcccccaccggccugcagggcccccagggcggccugaagccccagggcgccagaugggugugcagaagcuucagaagacaccuggaccagugcgagcaccagaucggccccagagagaucgaguuccagcugcugaacagcgcccaggagccccuguuccacugcaacugcaccagaagacuggccagauuccugagacugcacagcccccccgaggugaccaacaugcugugggagcugcugggcaccaccugcuucaagcuggcccccccccuggacugcguggagggcaagaacugcagcagagaccccagagccaucagagugagcgccagacaccugagaagacugcagcagagaagacaccagcugcaggacaagggcaccgacgagagacagcccuggcccagcgagccccugagaggccccaugagcuucuacaaccagugccugcagcugacccaggccgccagaagacccgacagacagcagaagagcuggagccaguaa

SEQ ID NO: 21608 - RNA, 2250 nt, Artificial Sequence
  PLA2G4A__Homo_sapiens__NP_077734
augagcuucaucgaccccuaccagcacaucaucguggagcaccaguacagccacaaguucaccgugguggugcugagagccaccaaggugaccaagggcgccuucggcgacaugcuggacacccccgaccccuacguggagcuguucaucagcaccacccccgacagcagaaagagaaccagacacuucaacaacgacaucaaccccguguggaacgagaccuucgaguucauccuggaccccaaccaggagaacgugcuggagaucacccugauggacgccaacuacgugauggacgagacccugggcaccgccaccuucaccgugagcagcaugaaggugggcgagaagaaggaggugcccuucaucuucaaccaggugaccgagauggugcuggagaugagccuggaggugugcagcugccccgaccugagauucagcauggcccugugcgaccaggagaagaccuucagacagcagagaaaggagcacaucagagagagcaugaagaagcugcugggccccaagaacagcgagggccugcacagcgccagagacgugcccgugguggccauccugggcagcggcggcggcuucagagccauggugggcuucagcggcgugaugaaggcccuguacgagagcggcauccuggacugcgccaccuacguggccggccugagcggcagcaccugguacaugagcacccuguacagccaccccgacuuccccgagaagggccccgaggagaucaacgaggagcugaugaagaacgugagccacaacccccugcugcugcugaccccccagaaggugaagagauacguggagagccuguggaagaagaagagcagcggccagcccgugaccuucaccgacaucuucggcaugcugaucggcgagacccugauccacaacagaaugaacaccacccugagcagccugaaggagaaggugaacaccgcccagugcccccugccccuguucaccugccugcacgugaagcccgacgugagcgagcugauguucgccgacuggguggaguucagccccuacgagaucggcauggccaaguacggcaccuucauggcccccgaccuguucggcagcaaguucuucaugggcaccguggugaagaaguacgaggagaacccccugcacuuccugaugggcguguggggcagcgccuucagcauccuguucaacagagugcugggcgugagcggcagccagagcagaggcagcaccauggaggaggagcuggagaacaucaccaccaagcacaucgugagcaacgacagcagcgacagcgacgacgagagccacgagcccaagggcaccgagaacgaggacgccggcagcgacuaccagagcgacaaccaggccagcuggauccacagaaugaucauggcccuggugagcgacagcgcccuguucaacaccagagagggcagagccggcaaggugcacaacuucaugcugggccugaaccugaacaccagcuacccccugagcccccugagcgacuucgccacccaggacagcuucgacgacgacgagcuggacgccgccguggccgaccccgacgaguucgagagaaucuacgagccccuggacgugaagagcaagaagauccacgugguggacagcggccugaccuucaaccugcccuacccccugauccugagaccccagagaggcguggaccugaucaucagcuucgacuucagcgccagacccagcgacagcagcccccccuucaaggagcugcugcuggccgagaagugggccaagaugaacaagcugcccuuccccaagaucgaccccuacguguucgacagagagggccugaaggagugcuacguguucaagcccaagaaccccgacauggagaaggacugccccaccaucauccacuucgugcuggccaacaucaacuucagaaaguacaaggcccccggcgugcccagagagaccgaggaggagaaggagaucgccgacuucgacaucuucgacgaccccgagagccccuucagcaccuucaacuuccaguaccccaaccaggccuucaagagacugcacgaccugaugcacuucaacacccugaacaacaucgacgugaucaaggaggccaugguggagagcaucgaguacagaagacagaaccccagcagaugcagcgugagccugagcaacguggaggccagaagauucuucaacaaggaguuccugagcaagcccaaggccuaa

SEQ ID NO: 21609 - RNA, 2346 nt, Artificial Sequence
  PLA2G4B__Homo_sapiens__NP_001108105
auggccguggccgaggugagcagaaccugccugcugaccgugagagugcugcaggcccacagacugcccagcaaggaccuggugacccccagcgacugcuacgugacccuguggcugcccaccgccugcagccacagacugcagaccagaaccgugaagaacagcagcagccccguguggaaccagagcuuccacuucagaauccacagacagcugaagaacgugauggagcugaagguguucgaccaggaccuggugaccggcgacgaccccgugcugagcgugcuguucgacgccggcacccugagagccggcgaguucagaagagagagcuucagccugagcccccagggcgagggcagacuggagguggaguucagacugcagagccuggccgacagaggcgaguggcuggugagcaacggcgugcugguggccagagagcugagcugccugcacgugcagcuggaggagaccggcgaccagaagagcagcgagcacagagugcagcugguggugcccggcagcugcgagggcccccaggaggccagcgugggcaccggcaccuucagauuccacugccccgccugcugggagcaggagcugagcaucagacugcaggacgcccccgaggagcagcugaaggccccccugagcgcccugcccagcggccagguggugagacugguguuccccaccagccaggagccccugaugagaguggagcugaagaaggaggccggccugagagagcuggccgugagacugggcuucggccccugcgccgaggagcaggccuuccugagcagaagaaagcaggugguggccgccgcccugagacaggcccugcagcuggacggcgaccugcaggaggacgagauccccgugguggccaucauggccaccggcggcggcaucagagccaugaccagccuguacggccagcuggccggccugaaggagcugggccugcuggacugcgugagcuacaucaccggcgccagcggcagcaccugggcccuggccaaccuguacgaggaccccgaguggagccagaaggaccuggccggccccaccgagcugcugaagacccaggugaccaagaacaagcugggcgugcuggcccccagccagcugcagagauacagacaggagcuggccgagagagccagacugggcuaccccagcugcuucaccaaccugugggcccugaucaacgaggcccugcugcacgacgagccccacgaccacaagcugagcgaccagagagaggcccugagccacggccagaacccccugcccaucuacugcgcccugaacaccaagggccagagccugaccaccuucgaguucggcgaguggugcgaguucagccccuacgaggugggcuuccccaaguacggcgccuucauccccagcgagcuguucggcagcgaguucuucaugggccagcugaugaagagacugcccgagagcagaaucugcuuccuggagggcaucuggagcaaccuguacgccgccaaccugcaggacagccuguacugggccagcgagcccagccaguucugggacagaugggugagaaaccaggccaaccuggacaaggagcaggugccccugcugaagaucgaggagccccccagcaccgccggcagaaucgccgaguucuucaccgaccugcugaccuggagaccccuggcccaggccacccacaacuuccugagaggccugcacuuccacaaggacuacuuccagcacccccacuucagcaccuggaaggccaccacccuggacggccugcccaaccagcugacccccagcgagccccaccugugccugcuggacgugggcuaccugaucaacaccagcugccugccccugcugcagcccaccagagacguggaccugauccugagccuggacuacaaccugcacggcgccuuccagcagcugcagcugcugggcagauucugccaggagcagggcauccccuucccccccaucagccccagccccgaggagcagcugcagcccagagagugccacaccuucagcgaccccaccugccccggcgcccccgccgugcugcacuucccccuggugagcgacagcuucagagaguacagcgcccccggcgugagaagaacccccgaggaggccgccgccggcgaggugaaccugagcagcagcgacagccccuaccacuacaccaaggugaccuacagccaggaggacguggacaagcugcugcaccugacccacuacaacgugugcaacaaccaggagcagcugcuggaggcccugagacaggccgugcagagaagaagacagagaagaccccacuaa

SEQ ID NO: 21610 - RNA, 1656 nt, Artificial Sequence
  PLA2G4C__Homo_sapiens__NP_001152794
augagaaccagacccagacccagacugagaagaaccgagaacuuccugaccgccgugcaccacggcaagaaggaggagaaggccgccguggagagaagaagacugcacgugcugaaggcccugaagaagcugagaaucgaggccgacgaggcccccgugguggccgugcugggcagcggcggcggccugagagcccacaucgccugccugggcgugcugagcgagaugaaggagcagggccugcuggacgccgugaccuaccuggccggcgugagcggcagcaccugggccaucagcagccuguacaccaacgacggcgacauggaggcccuggaggccgaccugaagcacagauucaccagacaggagugggaccuggccaagagccugcagaagaccauccaggccgccagaagcgagaacuacagccugaccgacuucugggccuacauggugaucagcaagcagaccagagagcugcccgagagccaccugagcaacaugaagaagcccguggaggagggcacccugcccuaccccaucuucgccgccaucgacaacgaccugcagcccagcuggcaggaggccagagcccccgagaccugguucgaguucaccccccaccacgccggcuucagcgcccugggcgccuucgugagcaucacccacuucggcagcaaguucaagaagggcagacuggugagaacccaccccgagagagaccugaccuuccugagaggccuguggggcagcgcccugggcaacaccgaggugaucagagaguacaucuucgaccagcugagaaaccugacccugaagggccuguggagaagagccguggccaacgccaagagcaucggccaccugaucuucgccagacugcugagacugcaggagagcagccagggcgagcaccccccccccgaggacgagggcggcgagcccgagcacaccuggcugaccgagaugcuggagaacuggaccagaaccagccuggagaagcaggagcagccccacgaggaccccgagagaaagggcagccugagcaaccugauggacuucgugaagaagaccggcaucugcgccagcaagugggaguggggcaccacccacaacuuccuguacaagcacggcggcaucagagacaagaucaugagcagcagaaagcaccugcaccugguggacgccggccuggccaucaacacccccuucccccuggugcugccccccaccagagaggugcaccugauccugagcuucgacuucagcgccggcgaccccuucgagaccaucagagccaccaccgacuacugcagaagacacaagauccccuucccccagguggaggaggccgagcuggaccuguggagcaaggcccccgccagcugcuacauccugaagggcgagaccggccccguggugaugcacuucccccuguucaacaucgacgccugcggcggcgacaucgaggccuggagcgacaccuacgacaccuucaagcuggccgacaccuacacccuggacgugguggugcugcugcuggcccuggccaagaagaacgugagagagaacaagaagaagauccugagagagcugaugaacguggccggccuguacuaccccaaggacagcgccagaagcugcugccuggccuaa

SEQ ID NO: 21611 - RNA, 2457 nt, Artificial Sequence
  PLA2G4D__Homo_sapiens__NP_828848
auggagagccugagccccggcggcccccccggccaccccuaccagggcgaggccagcaccugcuggcagcugaccgugagagugcuggaggccagaaaccugagaugggccgaccugcugagcgaggccgaccccuacgugauccugcagcugagcaccgcccccggcaugaaguucaagaccaagacccugaccgacaccagccaccccguguggaacgaggccuucagauuccugauccagagccaggugaagaacgugcuggagcugagcaucuacgacgaggacagcgugaccgaggacgacaucugcuucaaggugcuguacgacaucagcgaggugcugcccggcaagcugcugagaaagaccuucagccagagcccccagggcgaggaggagcuggacguggaguuccugauggaggagaccagcgacagacccgagaaccugaucaccaacaaggugaucguggccagagagcugagcugccuggacgugcaccuggacagcaccggcagcaccgccgugguggccgaccaggacaagcuggagcuggagcuggugcugaagggcagcuacgaggacacccagaccagcuuccugggcaccgccagcgccuucagauuccacuacauggccgcccuggagaccgagcugagcggcagacugagaagcagcagaagcaacggcuggaacggcgacaacagcgccggcuaccugaccgugccccugagaccccugaccaucggcaaggaggugaccauggacgugcccgcccccaacgcccccggcgugagacugcagcugaaggccgagggcugccccgaggagcuggccgugcaccugggcuucaaccugugcgccgaggagcaggccuuccugagcagaagaaagcaggugguggccaaggcccugaagcaggcccugcagcuggacagagaccugcaggaggacgaggugcccguggugggcaucauggccaccggcggcggcgccagagccaugaccagccuguacggccaccugcuggcccugcagaagcugggccugcuggacugcgugaccuacuucagcggcaucagcggcagcaccuggaccauggcccaccuguacggcgaccccgaguggagccagagagaccuggagggccccaucagauacgccagagagcaccuggccaagagcaagcuggagguguucagccccgagagacuggccagcuacagaagagagcuggagcugagagccgagcagggccaccccaccaccuucguggaccugugggcccuggugcuggagagcaugcugcacggccaggugauggaccagaagcugagcggccagagagccgcccuggagagaggccagaacccccugccccuguaccugagccugaacgugaaggagaacaaccuggagacccuggacuucaaggaguggguggaguucagccccuacgaggugggcuuccugaaguacggcgccuucgugccccccgagcuguucggcagcgaguucuucaugggcagacugaugagaagaauccccgagcccagaaucugcuuccuggaggccaucuggagcaacaucuucagccugaaccugcuggacgccugguacgaccugaccagcagcggcgagagcuggaagcagcacaucaaggacaagaccagaagccuggagaaggagccccugaccaccagcggcaccagcagcagacuggaggccagcuggcugcagcccggcaccgcccuggcccaggccuucaagggcuuccugaccggcagaccccugcaccagagaagccccaacuuccugcagggccugcagcugcaccaggacuacugcagccacaaggacuucagcaccugggccgacuaccagcuggacagcaugcccagccagcugacccccaaggagcccagacugugccugguggacgccgccuacuucaucaacaccagcagccccagcauguucagacccggcagaagacuggaccugauccugagcuucgacuacagccugagcgcccccuucgaggcccugcagcagaccgagcuguacugcagagccagaggccugcccuuccccagaguggagcccagcccccaggaccagcaccagcccagagagugccaccuguucagcgaccccgccugccccgaggcccccauccugcugcacuucccccuggugaacgccagcuucaaggaccacagcgcccccggcgugcagagaagccccgccgagcugcagggcggccagguggaccugaccggcgccaccugccccuacacccugagcaacaugaccuacaaggaggaggacuucgagagacugcugagacugagcgacuacaacgugcagaccagccagggcgccauccugcaggcccugagaaccgcccugaagcacagaacccuggaggccagaccccccagagcccagaccuaa

SEQ ID NO: 21612 - RNA, 510 nt, Artificial Sequence
  PLA2G5__Homo_sapiens__XP_011539888
auggaggugagaaccaagagacccagaaucggcaccgacaccaacagacccuucguggaggaggagauccagauggccaucagaacccccgagaugaagggccugcugccccuggccugguuccuggccugcagcgugcccgccgugcagggcggccugcuggaccugaagagcaugaucgagaaggugaccggcaagaacgcccugaccaacuacggcuucuacggcugcuacugcggcuggggcggcagaggcacccccaaggacggcaccgacuggugcugcugggcccacgaccacugcuacggcagacuggaggagaagggcugcaacaucagaacccagagcuacaaguacagauucgccuggggcguggugaccugcgagcccggccccuucugccacgugaaccugugcgccugcgacagaaagcugguguacugccugaagagaaaccugagaagcuacaacccccaguaccaguacuuccccaacauccugugcagcuaa

SEQ ID NO: 21613 - RNA, 2259 nt, Artificial Sequence
  PLA2G6__Homo_sapiens__NP_001186491
augcaguucuucggcagacuggugaacaccuucagcggcgugaccaaccuguucagcaaccccuucagagugaaggagguggccguggccgacuacaccagcagcgacagagugagagaggagggccagcugauccuguuccagaacacccccaacagaaccugggacugcgugcuggugaaccccagaaacagccagagcggcuucagacuguuccagcuggagcuggaggccgacgcccuggugaacuuccaccaguacagcagccagcugcugcccuucuacgagagcagcccccaggugcugcacaccgaggugcugcagcaccugaccgaccugaucagaaaccaccccagcuggagcguggcccaccuggccguggagcugggcaucagagagugcuuccaccacagcagaaucaucagcugcgccaacugcgccgagaacgaggagggcugcaccccccugcaccuggccugcagaaagggcgacggcgagauccugguggagcuggugcaguacugccacacccagauggacgugaccgacuacaagggcgagaccguguuccacuacgccgugcagggcgacaacagccaggugcugcagcugcugggcagaaacgccguggccggccugaaccaggugaacaaccagggccugaccccccugcaccuggccugccagcugggcaagcaggagauggugagagugcugcugcugugcaacgccagaugcaacaucaugggccccaacggcuaccccauccacagcgccaugaaguucagccagaagggcugcgccgagaugaucaucagcauggacagcagccagauccacagcaaggaccccagauacggcgccagcccccugcacugggccaagaacgccgagauggccagaaugcugcugaagagaggcugcaacgugaacagcaccagcagcgccggcaacaccgcccugcacguggccgugaugagaaacagauucgacugcgccaucgugcugcugacccacggcgccaacgccgacgccagaggcgagcacggcaacaccccccugcaccuggccaugagcaaggacaacguggagaugaucaaggcccugaucguguucggcgccgagguggacacccccaacgacuucggcgagacccccaccuuccuggccagcaagaucggcagacagcugcaggaccugaugcacaucagcagagccagaaagcccgccuucauccugggcagcaugagagacgagaagagaacccacgaccaccugcugugccuggacggcggcggcgugaagggccugaucaucauccagcugcugaucgccaucgagaaggccagcggcguggccaccaaggaccuguucgacuggguggccggcaccagcaccggcggcauccuggcccuggccauccugcacagcaagagcauggccuacaugagaggcauguacuucagaaugaaggacgagguguucagaggcagcagacccuacgagagcggcccccuggaggaguuccugaagagagaguucggcgagcacaccaagaugaccgacgugagaaagcccaaggugaugcugaccggcacccugagcgacagacagcccgccgagcugcaccuguucagaaacuacgacgcccccgagaccgugagagagcccagauucaaccagaacgugaaccugagaccccccgcccagcccagcgaccagcugguguggagagccgccagaagcagcggcgccgcccccaccuacuucagacccaacggcagauuccuggacggcggccugcuggccaacaaccccacccuggacgccaugaccgagauccacgaguacaaccaggaccugaucagaaagggccaggccaacaaggugaagaagcugagcaucguggugagccugggcaccggcagaagcccccaggugcccgugaccugcguggacguguucagacccagcaaccccugggagcuggccaagaccguguucggcgccaaggagcugggcaagauggugguggacugcugcaccgaccccgacggcagagccguggacagagccagagccuggugcgagauggugggcauccaguacuucagacugaacccccagcugggcaccgacaucaugcuggacgaggugagcgacaccgugcuggugaacgcccugugggagaccgagguguacaucuacgagcacagagaggaguuccagaagcugauccagcugcugcugagccccuaa

SEQ ID NO: 21614 - RNA, 1326 nt, Artificial Sequence
  PLA2G7__Homo_sapiens__NP_005075
auggugccccccaagcugcacgugcuguucugccugugcggcugccuggccgugguguaccccuucgacuggcaguacaucaaccccguggcccacaugaagagcagcgccugggugaacaagauccaggugcugauggccgccgccagcuucggccagaccaagauccccagaggcaacggccccuacagcgugggcugcaccgaccugauguucgaccacaccaacaagggcaccuuccugagacuguacuaccccagccaggacaacgacagacuggacacccuguggauccccaacaaggaguacuucuggggccugagcaaguuccugggcacccacuggcugaugggcaacauccugagacugcuguucggcagcaugaccacccccgccaacuggaacagcccccugagacccggcgagaaguacccccuggugguguucagccacggccugggcgccuucagaacccuguacagcgccaucggcaucgaccuggccagccacggcuucaucguggccgccguggagcacagagacagaagcgccagcgccaccuacuacuucaaggaccagagcgccgccgagaucggcgacaagagcuggcuguaccugagaacccugaagcaggaggaggagacccacaucagaaacgagcaggugagacagagagccaaggagugcagccaggcccugagccugauccuggacaucgaccacggcaagcccgugaagaacgcccuggaccugaaguucgacauggagcagcugaaggacagcaucgacagagagaagaucgccgugaucggccacagcuucggcggcgccaccgugauccagacccugagcgaggaccagagauucagaugcggcaucgcccuggacgccuggauguucccccugggcgacgagguguacagcagaaucccccagccccuguucuucaucaacagcgaguacuuccaguaccccgccaacaucaucaagaugaagaagugcuacagccccgacaaggagagaaagaugaucaccaucagaggcagcgugcaccagaacuucgccgacuucaccuucgccaccggcaagaucaucggccacaugcugaagcugaagggcgacaucgacagcaacguggccaucgaccugagcaacaaggccagccuggccuuccugcagaagcaccugggccugcacaaggacuucgaccagugggacugccugaucgagggcgacgacgagaaccugauccccggcaccaacaucaacaccaccaaccagcacaucaugcugcagaacagcagcggcaucgagaaguacaacuaa

SEQ ID NO: 21615 - RNA, 3975 nt, Artificial Sequence
  PLA2R1__Homo_sapiens__NP_001007268
augcugcugagccccagccugcugcugcugcugcugcugggcgcccccagaggcugcgccgagggcguggccgccgcccugacccccgagagacugcuggaguggcaggacaagggcaucuucgugauccagagcgagagccugaagaagugcauccaggccggcaagagcgugcugacccuggagaacugcaagcaggccaacaagcacaugcuguggaagugggugagcaaccacggccuguucaacaucggcggcagcggcugccugggccugaacuucagcgcccccgagcagccccugagccuguacgagugcgacagcacccuggugagccugagauggagaugcaacagaaagaugaucaccggcccccugcaguacagcgugcagguggcccacgacaacaccgugguggccagcagaaaguacauccacaaguggaucagcuacggcagcggcggcggcgacaucugcgaguaccugcacaaggaccugcacaccaucaagggcaacacccacggcaugcccugcauguuccccuuccaguacaaccaccaguggcaccacgagugcaccagagagggcagagaggacgaccugcuguggugcgccaccaccagcagauacgagagagacgagaaguggggcuucugccccgaccccaccagcgccgaggugggcugcgacaccaucugggagaaggaccugaacagccacaucugcuaccaguucaaccugcugagcagccugagcuggagcgaggcccacagcagcugccagaugcagggcggcacccugcugagcaucaccgacgagaccgaggagaacuucaucagagagcacaugagcagcaagaccguggagguguggaugggccugaaccagcuggacgagcacgccggcuggcaguggagcgacggcaccccccugaacuaccugaacuggagccccgaggugaacuucgagcccuucguggaggaccacugcggcaccuucagcagcuucaugcccagcgccuggagaagcagagacugcgagagcacccugcccuacaucugcaagaaguaccugaaccacaucgaccacgagaucguggagaaggacgccuggaaguacuacgccacccacugcgagcccggcuggaaccccuacaacagaaacugcuacaagcugcagaaggaggagaagaccuggcacgaggcccugagaagcugccaggccgacaacagcgcccugaucgacaucaccagccuggccgagguggaguuccuggugacccugcugggcgacgagaacgccagcgagaccuggaucggccugagcagcaacaagauccccgugagcuucgaguggagcaacgacagcagcgugaucuucaccaacuggcacacccuggagccccacaucuuccccaacagaagccagcugugcgugagcgccgagcagagcgagggccacuggaaggugaagaacugcgaggagagacuguucuacaucugcaagaaggccggccacgugcugagcgacgccgagagcggcugccaggagggcugggagagacacggcggcuucugcuacaagaucgacaccgugcugagaagcuucgaccaggccagcagcggcuacuacugcccccccgcccuggugaccaucaccaacagauucgagcaggccuucaucaccagccugaucagcagcguggugaagaugaaggacagcuacuucuggaucgcccugcaggaccagaacgacaccggcgaguacaccuggaagcccgugggccagaagcccgagcccgugcaguacacccacuggaacacccaccagcccagauacagcggcggcugcguggccaugagaggcagacacccccugggcagaugggaggugaagcacugcagacacuucaaggccaugagccugugcaagcagcccguggagaaccaggagaaggccgaguacgaggagagauggcccuuccaccccugcuaccuggacugggagagcgagcccggccuggccagcugcuucaagguguuccacagcgagaaggugcugaugaagagaaccuggagagaggccgaggccuucugcgaggaguucggcgcccaccuggccagcuucgcccacaucgaggaggagaacuucgugaacgagcugcugcacagcaaguucaacuggaccgaggagagacaguucuggaucggcuucaacaagagaaacccccugaacgccggcagcugggaguggagcgacagaacccccguggugagcagcuuccuggacaacaccuacuucggcgaggacgccagaaacugcgccguguacaaggccaacaagacccugcugccccugcacugcggcagcaagagagaguggaucugcaagauccccagagacgugaagcccaagauccccuucugguaccaguacgacgugcccuggcuguucuaccaggacgccgaguaccuguuccacaccuucgccagcgaguggcugaacuucgaguucgugugcagcuggcugcacagcgaccugcugaccauccacagcgcccacgagcaggaguucauccacagcaagaucaaggcccugagcaaguacggcgccagcugguggaucggccugcaggaggagagagccaacgacgaguucagauggagagacggcacccccgugaucuaccagaacugggacaccggcagagagagaaccgugaacaaccagagccagagaugcggcuucaucagcagcaucaccggccuguggggcagcgaggagugcagcgugagcaugcccagcaucugcaagagaaagaagguguggcugaucgagaagaagaaggacacccccaagcagcacggcaccugccccaagggcuggcuguacuucaacuacaagugccugcugcugaacauccccaaggaccccagcagcuggaagaacuggacccacgcccagcacuucugcgccgaggagggcggcacccugguggccaucgagagcgagguggagcaggccuucaucaccaugaaccuguucggccagaccaccagcguguggaucggccugcagaacgacgacuacgagaccuggcugaacggcaagcccgugguguacagcaacuggagccccuucgacaucaucaacauccccagccacaacaccaccgaggugcagaagcacaucccccugugcgcccugcugagcagcaaccccaacuuccacuucaccggcaagugguacuucgaggacugcggcaaggagggcuacggcuucgugugcgagaagaugcaggacaccagcggccacggcgugaacaccagcgacauguaccccaugcccaacacccuggaguacggcaacagaaccuacaagaucaucaacgccaacaugaccugguacgccgccaucaagaccugccugaugcacaaggcccagcuggugagcaucaccgaccaguaccaccagagcuuccugaccguggugcugaacagacugggcuacgcccacuggaucggccuguucaccaccgacaacggccugaacuucgacuggagcgacggcaccaagagcagcuucaccuucuggaaggacgaggagagcagccugcugggcgacugcguguucgccgacagcaacggcagauggcacagcaccgccugcgagagcuuccugcagggcgccaucugccacgugccccccgagaccagacagagcgagcaccccgagcugugcagcgagaccagcauccccuggaucaaguucaagagcaacugcuacagcuucagcaccgugcuggacagcaugagcuucgaggccgcccacgaguucugcaagaaggagggcagcaaccugcugaccaucaaggacgaggccgagaacgccuuccugcuggaggagcuguucgccuucggcagcagcgugcagaugguguggcugaacgcccaguucgacggcaacagcaaguaa

SEQ ID NO: 21616 - RNA, 2388 nt, Artificial Sequence
  PLAA__Homo_sapiens__NP_001026859
augaccagcggcgccaccagauacagacugagcugcagccugagaggccacgagcuggacgugagaggccuggugugcugcgccuacccccccggcgccuucgugagcgugagcagagacagaaccaccagacugugggcccccgacagccccaacagaagcuucaccgagaugcacugcaugagcggccacagcaacuucgugagcugcgugugcaucauccccagcagcgacaucuacccccacggccugaucgccaccggcggcaacgaccacaacaucugcaucuucagccuggacagccccaugccccuguacauccugaagggccacaagaacaccgugugcagccugagcagcggcaaguucggcacccugcugagcggcagcugggacaccaccgccaagguguggcugaacgacaagugcaugaugacccugcagggccacaccgccgccgugugggccgugaagauccugcccgagcagggccugaugcugaccggcagcgccgacaagaccgugaagcuguggaaggccggcagaugcgagagaaccuucagcggccacgaggacugcgugagaggccuggccauccugagcgagaccgaguuccugagcugcgccaacgacgccagcaucagaagauggcagaucaccggcgagugccuggagguguacuacggccacaccaacuacaucuacagcaucagcguguuccccaacugcagagacuucgugaccaccgccgaggacagaagccugagaaucuggaagcacggcgagugcgcccagaccaucagacugcccgcccagagcaucuggugcugcugcgugcuggacaacggcgacaucguggugggcgccagcgacggcaucaucagaguguucaccgagagcgaggacagaaccgccagcgccgaggagaucaaggccuucgagaaggagcugagccacgccaccaucgacagcaagaccggcgaccugggcgacaucaacgccgagcagcugcccggcagagagcaccugaacgagcccggcaccagagagggccagaccagacugaucagagacggcgagaagguggaggccuaccaguggagcgugagcgagggcagauggaucaagaucggcgacguggugggcagcagcggcgccaaccagcagaccagcggcaaggugcuguacgagggcaaggaguucgacuacguguucagcaucgacgugaacgagggcggccccagcuacaagcugcccuacaacaccagcgacgaccccuggcugaccgccuacaacuuccugcagaagaacgaccugaaccccauguuccuggaccagguggccaaguucaucaucgacaacaccaagggccagaugcugggccugggcaaccccagcuucagcgaccccuucaccggcggcggcagauacgugcccggcagcagcggcagcagcaacacccugcccaccgccgaccccuucaccggcgccggcagauacgugcccggcagcgccagcaugggcaccaccauggccggcguggaccccuucaccggcaacagcgccuacagaagcgccgccagcaagaccaugaacaucuacuuccccaagaaggaggccgugaccuucgaccaggccaaccccacccagauccugggcaagcugaaggagcugaacggcaccgcccccgaggagaagaagcugaccgaggacgaccugauccugcuggagaagauccugagccugaucugcaacagcagcagcgagaagcccaccgugcagcagcugcagauccuguggaaggccaucaacugccccgaggacaucguguuccccgcccuggacauccugagacugagcaucaagcaccccagcgugaacgagaacuucugcaacgagaaggagggcgcccaguucagcagccaccugaucaaccugcugaaccccaagggcaagcccgccaaccagcugcuggcccugagaaccuucugcaacugcuucgugggccaggccggccagaagcugaugaugagccagagagagagccugaugagccacgccaucgagcugaagagcggcagcaacaagaacauccacaucgcccuggccacccuggcccugaacuacagcgugugcuuccacaaggaccacaacaucgagggcaaggcccagugccugagccugaucagcaccauccuggagguggugcaggaccuggaggccaccuucagacugcugguggcccugggcacccugaucagcgacgacagcaacgccgugcagcuggccaagagccugggcguggacagccagaucaagaaguacagcagcgugagcgagcccgccaaggugagcgagugcugcagauucauccugaaccugcuguaa

SEQ ID NO: 21617 - RNA, 639 nt, Artificial Sequence
  PLAC1__Homo_sapiens__NP_068568
augaagguguucaaguucaucggccugaugauccugcugaccagcgccuucagcgccggcagcggccagagccccaugaccgugcugugcagcaucgacugguucauggugaccgugcaccccuucaugcugaacaacgacgugugcgugcacuuccacgagcugcaccugggccugggcugcccccccaaccacgugcagccccacgccuaccaguucaccuacagagugaccgagugcggcaucagagccaaggccgugagccaggacauggugaucuacagcaccgagauccacuacagcagcaagggcacccccagcaaguucgugauccccgugagcugcgccgccccccagaagagccccuggcugaccaagcccugcagcaugagaguggccagcaagagcagagccaccgcccagaaggacgagaagugcuacgagguguucagccugagccagagcagccagagacccaacugcgacugcccccccugcguguucagcgaggaggagcacacccaggugcccugccaccaggccggcgcccaggaggcccagccccugcagcccagccacuuccuggacaucagcgaggacuggagccugcacaccgacgacaugaucggcagcauguaa

SEQ ID NO: 21618 - RNA, 348 nt, Artificial Sequence
  PLAC8__Homo_sapiens__NP_001124187
augcaggcccaggcccccguggugguggugacccagcccggcgugggccccggccccgccccccagaacagcaacuggcagaccggcaugugcgacugcuucagcgacugcggcgugugccugugcggcaccuucugcuuccccugccugggcugccagguggccgccgacaugaacgagugcugccugugcggcaccagcguggccaugagaacccuguacagaaccagauacggcauccccggcagcaucugcgacgacuacauggccacccugugcugcccccacugcacccugugccagaucaagagagacaucaacagaagaagagccaugagaaccuucuaa

SEQ ID NO: 21619 - RNA, 1503 nt, Artificial Sequence
  PLAG1__Homo_sapiens__NP_001108106
auggccaccgugauccccggcgaccugagcgaggugagagacacccagaaggugcccagcggcaagagaaagagaggcgagaccaagcccagaaagaacuuccccugccagcugugcgacaaggccuucaacagcguggagaagcugaaggugcacagcuacagccacaccggcgagagacccuacaagugcauccagcaggacugcaccaaggccuucgugagcaaguacaagcugcagagacacauggccacccacagccccgagaagacccacaagugcaacuacugcgagaagauguuccacagaaaggaccaccugaagaaccaccugcacacccacgaccccaacaaggagaccuucaagugcgaggagugcggcaagaacuacaacaccaagcugggcuucaagagacaccuggcccugcacgccgccaccagcggcgaccugaccugcaaggugugccugcagaccuucgagagcaccggcgugcugcuggagcaccugaagagccacgccggcaagagcagcggcggcgugaaggagaagaagcaccagugcgagcacugcgacagaagauucuacaccagaaaggacgugagaagacacaugguggugcacaccggcagaaaggacuuccugugccaguacugcgcccagagauucggcagaaaggaccaccugaccagacacaugaagaagagccacaaccaggagcugcugaaggugaagaccgagcccguggacuuccuggaccccuucaccugcaacgugagcgugcccaucaaggacgagcugcugcccgugaugagccugcccagcagcgagcugcugagcaagcccuucaccaacacccugcagcugaaccuguacaacacccccuuccagagcaugcagagcagcggcagcgcccaccagaugaucaccacccugccccugggcaugaccugccccaucgacauggacaccgugcaccccagccaccaccugagcuucaaguaccccuucagcagcaccagcuacgccaucagcauccccgagaaggagcagccccugaagggcgagaucgagagcuaccugauggagcugcagggcggcgugcccagcagcagccaggacagccaggccagcagcagcagcaagcugggccuggacccccagaucggcagccuggacgacggcgccggcgaccugagccugagcaagagcagcaucagcaucagcgacccccugaacacccccgcccuggacuucagccagcuguucaacuucaucccccugaacggcccccccuacaacccccugagcgugggcagccugggcaugagcuacagccaggaggaggcccacagcagcgugagccagcugcccccccagacccaggaccugcaggaccccgccaacaccaucggccugggcagccugcacagccugagcgccgccuucaccagcagccugagcaccagcaccacccugcccagauuccaccaggccuuccaguaa

SEQ ID NO: 21620 - RNA, 1236 nt, Artificial Sequence
  PLAGL1__Homo_sapiens__NP_001275966
auggccacccacagcccccagaagagccaccagugcgcccacugcgagaagaccuucaacagaaaggaccaccugaagaaccaccugcagacccacgaccccaacaagauggccuucggcugcgaggagugcggcaagaaguacaacaccaugcugggcuacaagagacaccuggcccugcacgccgccagcagcggcgaccugaccugcggcgugugcgcccuggagcugggcagcaccgaggugcugcuggaccaccugaaggcccacgccgaggagaagccccccagcggcaccaaggagaagaagcaccagugcgaccacugcgagagaugcuucuacaccagaaaggacgugagaagacaccugguggugcacaccggcugcaaggacuuccugugccaguucugcgcccagagauucggcagaaaggaccaccugaccagacacaccaagaagacccacagccaggagcugaugaaggagagccugcagaccggcgaccugcugagcaccuuccacaccaucagccccagcuuccagcugaaggccgccgcccugccccccuucccccugggcgccagcgcccagaacggccuggccagcagccugcccgccgaggugcacagccugacccugagcccccccgagcaggccgcccagcccaugcagccccugcccgagagccuggccagccugcaccccagcgugagccccggcagccccccccccccccugcccaaccacaaguacaacaccaccagcaccagcuacagcccccuggccagccugccccugaaggccgacaccaagggcuucugcaacaucagccuguucgaggaccugccccugcaggagccccagagcccccagaagcugaaccccggcuucgaccuggccaagggcaacgccggcaaggugaaccugcccaaggagcugcccgccgacgccgugaaccugaccauccccgccagccuggaccugagcccccugcugggcuucuggcagcugcccccccccgccacccagaacaccuucggcaacagcacccuggcccugggccccggcgagagccugccccacagacugagcugccugggccagcagcagcaggagcccccccuggccaugggcaccgugagccugggccagcugccccugccccccaucccccacguguucagcgccggcaccggcagcgccauccugccccacuuccaccacgccuucagauaa

SEQ ID NO: 21621 - RNA, 1491 nt, Artificial Sequence
  PLAGL2__Homo_sapiens__NP_002648
augaccaccuucuucaccagcgugccccccuggauccaggacgccaagcaggaggaggaggugggcuggaagcuggugcccagacccagaggcagagaggccgagagccaggugaagugccagugcgagaucagcggcacccccuucagcaacggcgagaagcugagaccccacagccugccccagcccgagcagagacccuacagcugcccccagcugcacugcggcaaggccuucgccagcaaguacaagcuguacagacacauggccacccacagcgcccagaagccccaccagugcauguacugcgacaagauguuccacagaaaggaccaccugagaaaccaccugcagacccacgaccccaacaaggaggcccugcacugcagcgagugcggcaagaacuacaacaccaagcugggcuacagaagacaccuggccaugcacgccgccagcagcggcgaccugagcugcaaggugugccugcagaccuucgagagcacccaggcccugcuggagcaccugaaggcccacagcagaagaguggccggcggcgccaaggagaagaagcaccccugcgaccacugcgacagaagauucuacaccagaaaggacgugagaagacaccugguggugcacaccggcagaaaggacuuccugugccaguacugcgcccagagauucggcagaaaggaccaccugaccagacacgugaagaagagccacagccaggagcugcugaagaucaagaccgagcccguggacaugcugggccugcugagcugcagcagcaccgugagcgugaaggaggagcugagccccgugcugugcauggccagcagagacgugaugggcaccaaggccuuccccggcaugcugcccaugggcauguacggcgcccacauccccaccaugcccagcaccggcgugccccacagccuggugcacaacacccugcccaugggcaugagcuacccccuggagagcagccccaucagcagccccgcccagcugccccccaaguaccagcugggcagcaccagcuaccugcccgacaagcugcccaagguggagguggacagcuuccuggccgagcugcccggcagccugagccugagcagcgccgagccccagcccgccagcccccagcccgccgccgccgccgcccugcuggacgaggcccugcuggccaagagccccgccaaccugagcgaggcccugugcgccgccaacguggacuucagccaccugcugggcuuccugccccugaaccugccccccugcaacccccccggcgccaccggcggccuggugaugggcuacagccaggccgaggcccagccccugcugaccacccugcaggcccagccccaggacagccccggcgccggcggcccccugaacuucggcccccugcacagccugccccccguguucaccagcggccugagcagcaccacccugcccagauuccaccaggccuuccaguaa

SEQ ID NO: 21622 - RNA, 1689 nt, Artificial Sequence
  PLAT__Homo_sapiens__NP_000921
auggacgccaugaagagaggccugugcugcgugcugcugcugugcggcgccguguucgugagccccagccaggagauccacgccagauucagaagaggcgccagaagcuaccaggugaucugcagagacgagaagacccagaugaucuaccagcagcaccagagcuggcugagacccgugcugagaagcaacagaguggaguacugcuggugcaacagcggcagagcccagugccacagcgugcccgugaagagcugcagcgagcccagaugcuucaacggcggcaccugccagcaggcccuguacuucagcgacuucgugugccagugccccgagggcuucgccggcaagugcugcgagaucgacaccagagccaccugcuacgaggaccagggcaucagcuacagaggcaccuggagcaccgccgagagcggcgccgagugcaccaacuggaacagcagcgcccuggcccagaagcccuacagcggcagaagacccgacgccaucagacugggccugggcaaccacaacuacugcagaaaccccgacagagacagcaagcccuggugcuacguguucaaggccggcaaguacagcagcgaguucugcagcacccccgccugcagcgagggcaacagcgacugcuacuucggcaacggcagcgccuacagaggcacccacagccugaccgagagcggcgccagcugccugcccuggaacagcaugauccugaucggcaagguguacaccgcccagaaccccagcgcccaggcccugggccugggcaagcacaacuacugcagaaaccccgacggcgacgccaagcccuggugccacgugcugaagaacagaagacugaccugggaguacugcgacgugcccagcugcagcaccugcggccugagacaguacagccagccccaguucagaaucaagggcggccuguucgccgacaucgccagccaccccuggcaggccgccaucuucgccaagcacagaagaagccccggcgagagauuccugugcggcggcauccugaucagcagcugcuggauccugagcgccgcccacugcuuccaggagagauuccccccccaccaccugaccgugauccugggcagaaccuacagaguggugcccggcgaggaggagcagaaguucgagguggagaaguacaucgugcacaaggaguucgacgacgacaccuacgacaacgacaucgcccugcugcagcugaagagcgacagcagcagaugcgcccaggagagcagcguggugagaaccgugugccugccccccgccgaccugcagcugcccgacuggaccgagugcgagcugagcggcuacggcaagcacgaggcccugagccccuucuacagcgagagacugaaggaggcccacgugagacuguaccccagcagcagaugcaccagccagcaccugcugaacagaaccgugaccgacaacaugcugugcgccggcgacaccagaagcggcggcccccaggccaaccugcacgacgccugccagggcgacagcggcggcccccuggugugccugaacgacggcagaaugacccuggugggcaucaucagcuggggccugggcugcggccagaaggacgugcccggcguguacaccaaggugaccaacuaccuggacuggaucagagacaacaugagacccuaa

SEQ ID NO: 21623 - RNA, 1245 nt, Artificial Sequence
  PLAU__Homo_sapiens__NP_001138503
augguguuccaccugagaaccagauacgagcaggccaacugcgacugccugaacggcggcaccugcgugagcaacaaguacuucagcaacauccacuggugcaacugccccaagaaguucggcggccagcacugcgagaucgacaagagcaagaccugcuacgagggcaacggccacuucuacagaggcaaggccagcaccgacaccaugggcagacccugccugcccuggaacagcgccaccgugcugcagcagaccuaccacgcccacagaagcgacgcccugcagcugggccugggcaagcacaacuacugcagaaaccccgacaacagaagaagacccuggugcuacgugcaggugggccugaagccccuggugcaggagugcauggugcacgacugcgccgacggcaagaagcccagcagcccccccgaggagcugaaguuccagugcggccagaagacccugagacccagauucaagaucaucggcggcgaguucaccaccaucgagaaccagcccugguucgccgccaucuacagaagacacagaggcggcagcgugaccuacgugugcggcggcagccugaucagccccugcugggugaucagcgccacccacugcuucaucgacuaccccaagaaggaggacuacaucguguaccugggcagaagcagacugaacagcaacacccagggcgagaugaaguucgagguggagaaccugauccugcacaaggacuacagcgccgacacccuggcccaccacaacgacaucgcccugcugaagaucagaagcaaggagggcagaugcgcccagcccagcagaaccauccagaccaucugccugcccagcauguacaacgacccccaguucggcaccagcugcgagaucaccggcuucggcaaggagaacagcaccgacuaccuguaccccgagcagcugaagaugaccguggugaagcugaucagccacagagagugccagcagccccacuacuacggcagcgaggugaccaccaagaugcugugcgccgccgacccccaguggaagaccgacagcugccagggcgacagcggcggcccccuggugugcagccugcagggcagaaugacccugaccggcaucgugagcuggggcagaggcugcgcccugaaggacaagcccggcguguacaccagagugagccacuuccugcccuggaucagaagccacaccaaggaggagaacggccuggcccuguaa

SEQ ID NO: 21624 - RNA, 846 nt, Artificial Sequence
  PLAUR__Homo_sapiens__NP_001005376
augggccaccccccccugcugccccugcugcugcugcugcacaccugcgugcccgccagcuggggccugagaugcaugcagugcaagaccaacggcgacugcagaguggaggagugcgcccugggccaggaccugugcagaaccaccaucgugagacugugggaggagggcgaggagcuggagcugguggagaagagcugcacccacagcgagaagaccaacagaacccugagcuacagaaccggccugaagaucaccagccugaccgagguggugugcggccuggaccugugcaaccagggcaacagcggcagagccgugaccuacagcagaagcagauaccuggagugcaucagcugcggcagcagcgacaugagcugcgagagaggcagacaccagagccugcagugcagaagccccgaggagcagugccuggacguggugacccacuggauccaggagggcgaggagggcagacccaaggacgacagacaccugagaggcugcggcuaccugcccggcugccccggcagcaacggcuuccacaacaacgacaccuuccacuuccugaagugcugcaacaccaccaagugcaacgagggccccauccuggagcuggagaaccugccccagaacggcagacagugcuacagcugcaagggcaacagcacccacggcugcagcagcgaggagaccuuccugaucgacugcagaggccccaugaaccagugccugguggccaccggcacccacgagagaagccuguggggcagcuggcugcccugcaagagcaccaccgcccugagaccccccugcugcgaggaggcccaggccacccacguguaa

SEQ ID NO: 21625 - RNA, 4344 nt, Artificial Sequence
  PLB1__Homo_sapiens__NP_001164056
augggccugagacccggcaucuuccugcuggagcugcugcugcugcugggccagggcaccccccagauccacaccagccccagaaagagcacccuggagggccagcuguggcccgagacccugaagaacagccccuuccccugcaaccccaacaagcugggcgugaacaugcccagcaagagcgugcacagccugaagcccagcgacaucaaguucguggccgccaucggcaaccuggagaucccccccgaccccggcaccggcgaccuggagaagcaggacuggaccgagagaccccagcaggugugcaugggcgugaugaccgugcugagcgacaucaucagauacuucagccccagcgugcccaugcccgugugccacaccggcaagagagugaucccccacgacggcgccgaggaccuguggauccaggcccaggagcuggugagaaacaugaaggagaaccugcagcuggacuuccaguucgacuggaagcugaucaacguguucuucagcaacgccagccagugcuaccugugccccagcgcccagcaggcccccagccugagcaccgugcugcugagccagaacggccuggccgccggcggcguggacgagcugaugggcgugcuggacuaccugcagcaggaggugcccagagccuucgugaaccugguggaccugagcgagguggccgaggugagcagacaguaccacggcaccuggcugagccccgcccccgagcccugcaacugcagcgaggagaccaccagacuggccaagguggugaugcaguggagcuaccaggaggccuggaacagccugcuggccagcagcagauacagcgagcaggagagcuucaccgugguguuccagcccuucuucuacgagaccacccccagccugcacagcgaggaccccagacugcaggacagcaccacccuggccuggcaccuguggaacagaaugauggagcccgccggcgagaaggacgagccccugagcgugaagcacggcagacccaugaagugccccagccaggagagccccuaccuguucagcuacagaaacagcaacuaccugaccagacugcagaagccccaggacaagcuggaggugagagagggcgccgagaucagaugccccgacaaggaccccagcgacaccgugcccaccagcgugcacagacugaagcccgccgacaucaacgugaucggcgcccugggcgacagccugaccgccggcaacggcgccggcagcacccccggcaacgugcuggacgugcugacccaguacagaggccugagcuggagcgugggcggcgacgagaacaucggcaccgugaccacccuggccaacauccugagagaguucaaccccagccugaagggcuucagcgugggcaccggcaaggagaccagccccaacgccuuccugaaccaggccguggccggcggcagagccgaggaccugcccgugcaggccagaagacugguggaccugaugaagaacgacaccagaauccacuuccaggaggacuggaagaucaucacccuguucaucggcggcaacgaccugugcgacuucugcaacgaccuggugcccagagccuucgugaaccuggugaccgugcuggagaucgugaaccugagagagcuguaccaggagaagaagguguacugccccagaaugauccugagaagccugugccccugcgugcugaaguucgacgacaacagcaccgagcuggccacccugaucgaguucaacaagaaguuccaggagaagacccaccagcugaucgagagcggcagauacgacaccagagaggacuucaccgugguggugcagcccuucuucgagaacguggacaugcccaagaccagcgagggccugcccgacaacagcuucuucgcccccgacugcuuccacuucagcagcaagagccacagcagagccgccagcgcccuguggaacaacaugcuggagcccgugggccagaagaccaccagacacaaguucgagaacaagaucaacaucaccugccccaaccaggugcagcccuuccugagaaccuacaagaacagcaugcagggccacggcaccuggcugcccugcagagacagagcccccagcgcccugcaccccaccagcgugcacgcccugagacccgccgacauccaggugguggccgcccugggcgacagccugaccgccggcaacggcaucggcagcaagcccgacgaccugcccgacgugaccacccaguacagaggccugagcuacagcgccggcggcgacggcagccuggagaacgugaccacccugcccaacauccugagagaguucaacagaaaccugaccggcuacgccgugggcaccggcgacgccaacgacaccaacgccuuccugaaccaggccgugcccggcgccaaggccgaggaccugaugagccaggugcagacccugaugcagaagaugaaggacgaccacagagugaacuuccacgaggacuggaaggugaucaccgugcugaucggcggcagcgaccugugcgacuacugcaccgacagcaaccuguacagcgccgccaacuucgugcaccaccugagaaacgcccuggacgugcugcacagagaggugcccagagugcuggugaaccugguggacuuccugaaccccaccaucaugagacagguguuccugggcaaccccgacaagugccccgugcagcaggccagcgugcugugcaacugcgugcugacccugagagagaacagccaggagcuggccagacuggaggccuucagcagagccuacagaagcagcaugagagagcuggugggcagcggcagauacgacacccaggaggacuucagcguggugcugcagcccuucuuccagaacauccagcugcccgugcuggccgacggccugcccgacaccagcuucuucgcccccgacugcauccaccccaaccagaaguuccacagccagcuggccagagcccuguggaccaacaugcuggagccccugggcagcaagaccgagacccuggaccugagagccgagaugcccaucaccugccccacccagaacgagcccuuccugagaacccccagaaacagcaacuacaccuaccccaucaagcccgccaucgagaacuggggcagcgacuuccugugcaccgaguggaaggccagcaacagcgugcccaccagcgugcaccagcugagacccgccgacaucaaggugguggccgcccugggcgacagccugaccaccgccgugggcgccagacccaacaacagcagcgaccugcccaccagcuggagaggccugagcuggagcaucggcggcgacggcaaccuggagacccacaccacccugcccaacauccugaagaaguucaaccccuaccugcugggcuucagcaccagcaccugggagggcaccgccggccugaacguggccgccgagggcgccagagccagagacaugcccgcccaggccugggaccugguggagagaaugaagaacagccccgacaucaaccuggagaaggacuggaagcuggugacccuguucaucggcgugaacgaccugugccacuacugcgagaaccccgaggcccaccuggccaccgaguacgugcagcacauccagcaggcccuggacauccugagcgaggagcugcccagagccuucgugaacgugguggaggugauggagcuggccagccuguaccagggccagggcggcaagugcgccaugcuggccgcccagaacaacugcaccugccugagacacagccagagcagccuggagaagcaggagcugaagaaggugaacuggaaccugcagcacggcaucagcagcuucagcuacuggcaccaguacacccagagagaggacuucgccgugguggugcagcccuucuuccagaacacccugaccccccugaacgagagaggcgacaccgaccugaccuucuucagcgaggacugcuuccacuucagcgacagaggccacgccgagauggccaucgcccuguggaacaacaugcuggagcccgugggcagaaagaccaccagcaacaacuucacccacagcagagccaagcugaagugccccagccccgagagccccuaccuguacacccugagaaacagcagacugcugcccgaccaggccgaggaggcccccgaggugcuguacugggccgugcccguggccgccggcgugggccugguggugggcaucaucggcaccgugguguggagaugcagaagaggcggcagaagagaggacccccccaugagccugagaaccguggcccuguaa

SEQ ID NO: 21626 - RNA, 1662 nt, Artificial Sequence
  PLBD1__Homo_sapiens__NP_079105
augaccagaggcggccccggcggcagacccggccugccccagccccccccccugcugcugcugcugcugcugcugccccugcugcuggugaccgccgagccccccaagcccgccggcguguacuacgccaccgccuacuggaugcccgccgagaagaccgugcaggugaagaacgugauggacaagaacggcgacgccuacggcuucuacaacaacagcgugaagaccaccggcuggggcauccuggagaucagagccggcuacggcagccagacccugagcaacgagaucaucauguucguggccggcuuccuggagggcuaccugaccgccccccacaugaacgaccacuacaccaaccuguacccccagcugaucaccaagcccagcaucauggacaaggugcaggacuucauggagaagcaggacaaguggaccagaaagaacaucaaggaguacaagaccgacagcuucuggagacacaccggcuacgugauggcccagaucgacggccuguacgugggcgccaagaagagagccauccuggagggcaccaagcccaugacccuguuccagauccaguuccugaacagcgugggcgaccugcuggaccugauccccagccugagccccaccaagaacggcagccugaagguguucaagagaugggacaugggccacugcagcgcccugaucaaggugcugcccggcuucgagaacauccuguucgcccacagcagcugguacaccuacgccgccaugcugagaaucuacaagcacugggacuucaacgugaucgacaaggacaccagcagcagcagacugagcuucagcagcuaccccggcuuccuggagagccuggacgacuucuacauccugagcagcggccugauccugcugcagaccaccaacagcguguucaacaagacccugcugaagcaggugauccccgagacccugcugagcuggcagagagugagaguggccaacaugauggccgacagcggcaagagaugggccgacaucuucagcaaguacaacagcggcaccuacaacaaccaguacauggugcuggaccugaagaaggugaagcugaaccacagccuggacaagggcacccuguacaucguggagcagauccccaccuacguggaguacagcgagcagaccgacgugcugagaaagggcuacuggcccagcuacaacgugcccuuccacgagaagaucuacaacuggagcggcuacccccugcuggugcagaagcugggccuggacuacagcuacgaccuggcccccagagccaagaucuucagaagagaccagggcaaggugaccgacaccgccagcaugaaguacaucaugagauacaacaacuacaagaaggaccccuacagcagaggcgaccccugcaacaccaucugcugcagagaggaccugaacagccccaaccccagccccggcggcugcuacgacaccaagguggccgacaucuaccuggccagccaguacaccagcuacgccaucagcggccccaccgugcagggcggccugcccguguucagaugggacagauucaacaagacccugcaccagggcaugcccgagguguacaacuucgacuucaucaccaugaagcccauccugaagcuggacaucaaguaa

SEQ ID NO: 21627 - RNA, 3651 nt, Artificial Sequence
  PLCB1__Homo_sapiens__NP_056007
auggccggcgcccagcccggcgugcacgcccugcagcugaagcccgugugcgugagcgacagccugaagaagggcaccaaguucgugaagugggacgacgacagcaccaucgugacccccaucauccugagaaccgacccccagggcuucuucuucuacuggaccgaccagaacaaggagaccgagcugcuggaccugagccuggugaaggacgccagaugcggcagacacgccaaggcccccaaggaccccaagcugagagagcugcuggacgugggcaacaucggcagacuggagcagagaaugaucaccgugguguacggccccgaccuggugaacaucagccaccugaaccugguggccuuccaggaggagguggccaaggaguggaccaacgagguguucagccuggccaccaaccugcuggcccagaacaugagcagagacgccuuccuggagaaggccuacaccaagcugaagcugcaggugacccccgagggcagaaucccccugaagaacaucuacagacuguucagcgccgacagaaagagaguggagaccgcccuggaggccugcagccugcccagcagcagaaacgacagcaucccccaggaggacuucacccccgagguguacagaguguuccugaacaaccugugccccagacccgagaucgacaacaucuucagcgaguucggcgccaagagcaagcccuaccugaccguggaccagaugauggacuucaucaaccugaagcagagagaccccagacugaacgagauccuguaccccccccugaagcaggagcaggugcaggugcugaucgagaaguacgagcccaacaacagccuggccagaaagggccagaucagcguggacggcuucaugagauaccugagcggcgaggagaacggcguggugagccccgagaagcuggaccugaacgaggacaugagccagccccugagccacuacuucaucaacagcagccacaacaccuaccugaccgccggccagcuggccggcaacagcagcguggagauguacagacaggugcugcugagcggcugcagaugcguggagcuggacugcuggaagggcagaaccgccgaggaggagcccgugaucacccacggcuucaccaugaccaccgagaucagcuucaaggaggugaucgaggccaucgccgagugcgccuucaagaccagccccuuccccauccugcugagcuucgagaaccacguggacagccccaagcagcaggccaagauggccgaguacugcagacugaucuucggcgacgcccugcugauggagccccuggagaaguacccccuggagagcggcgugccccugcccagccccauggaccugauguacaagauccuggugaagaacaagaagaagagccacaagagcagcgagggcagcggcaagaagaagcugagcgagcaggccagcaacaccuacagcgacagcagcagcauguucgagcccagcagccccggcgccggcgaggccgacaccgagagcgacgacgacgacgacgacgacgacugcaagaagagcagcauggacgagggcaccgccggcagcgaggccauggccaccgaggagaugagcaaccuggugaacuacauccagcccgugaaguucgagagcuucgagaucagcaagaagagaaacaagagcuucgagaugagcagcuucguggagaccaagggccuggagcagcugaccaagagccccguggaguucguggaguacaacaagaugcagcugagcagaaucuaccccaagggcaccagaguggacagcagcaacuacaugccccagcuguucuggaacgccggcugccagaugguggcccugaacuuccagaccauggaccuggccaugcagaucaacaugggcauguacgaguacaacggcaagagcggcuacagacugaagcccgaguucaugagaagacccgacaagcacuucgaccccuucaccgagggcaucguggacggcaucguggccaacacccugagcgugaagaucaucagcggccaguuccugagcgacaagaaggugggcaccuacguggagguggacauguucggccugcccguggacaccagaagaaaggccuucaagaccaagaccagccagggcaacgccgugaaccccgugugggaggaggagcccaucguguucaagaagguggugcugcccacccuggccugccugagaaucgccguguacgaggagggcggcaaguucaucggccacagaauccugcccgugcaggccaucagacccggcuaccacuacaucugccugagaaacgagagaaaccagccccugacccugcccgccguguucguguacaucgaggugaaggacuacgugcccgacaccuacgccgacgugaucgaggcccugagcaaccccaucagauacgugaaccugauggagcagagagccaagcagcuggccgcccugacccuggaggacgaggaggaggugaagaaggaggccgaccccggcgagacccccagcgaggcccccagcgaggccagaaccacccccgccgagaacggcgugaaccacaccaccacccugacccccaagccccccagccaggcccugcacagccagcccgcccccggcagcgugaaggcccccgccaagaccgaggaccugauccagagcgugcugaccgagguggaggcccagaccaucgaggagcugaagcagcagaagagcuucgugaagcugcagaagaagcacuacaaggagaugaaggaccuggugaagagacaccacaagaagaccaccgaccugaucaaggagcacaccaccaaguacaacgagauccagaacgacuaccugagaagaagagccgcccuggagaagagcgccaagaaggacagcaagaagaagagcgagcccagcagccccgaccacggcagcagcaccaucgagcaggaccuggccgcccuggacgccgagaugacccagaagcugaucgaccugaaggacaagcagcagcagcagcugcugaaccugagacaggagcaguacuacagcgagaaguaccagaagagagagcacaucaagcugcugauccagaagcugaccgacguggccgaggagugccagaacaaccagcugaagaagcugaaggagaucugcgagaaggagaagaaggagcugaagaagaagauggacaagaagagacaggagaagaucaccgaggccaagagcaaggacaagagccagauggaggaggagaagaccgagaugaucagaagcuacauccaggagguggugcaguacaucaagagacuggaggaggcccagagcaagagacaggagaagcugguggagaagcacaaggagaucagacagcagauccuggacgagaagcccaagcugcagguggagcuggagcaggaguaccaggacaaguucaagagacugccccuggagauccuggaguucgugcaggaggccaugaagggcaagaucagcgaggacagcaaccacggcagcgccccccugagccugagcagcgaccccggcaaggugaaccacaagacccccagcagcgaggagcugggcggcgacauccccggcaaggaguucgacaccccccuguaa

SEQ ID NO: 21628 - RNA, 3546 nt, Artificial Sequence
  PLCB2__Homo_sapiens__NP_001271226
augagccugcugaaccccgugcugcugccccccaaggugaaggccuaccugagccagggcgagagauucaucaagugggacgacgagaccaccguggccagccccgugauccugagaguggaccccaagggcuacuaccuguacuggaccuaccagagcaaggagauggaguuccuggacaucaccagcaucagagacaccagauucggcaaguucgccaagaugcccaagagccagaagcugagagacguguucaacauggacuuccccgacaacagcuuccugcugaagacccugaccguggugagcggccccgacaugguggaccugaccuuccacaacuucgugagcuacaaggagaacgugggcaaggccugggccgaggacgugcuggcccuggugaagcacccccugaccgccaacgccagcagaagcaccuuccuggacaagauccuggugaagcugaagaugcagcugaacagcgagggcaagauccccgugaagaacuucuuccagauguuccccgccgacagaaagagaguggaggccgcccugagcgccugccaccugcccaagggcaagaacgacgccaucaaccccgaggacuuccccgagcccguguacaagagcuuccugaugagccugugccccagacccgagaucgacgagaucuucaccagcuaccacgccaaggccaagcccuacaugaccaaggagcaccugaccaaguucaucaaccagaagcagagagacagcagacugaacagccugcuguucccccccgccagacccgaccaggugcagggccugaucgacaaguacgagcccagcggcaucaacgcccagagaggccagcugagccccgagggcauggugugguuccugugcggccccgagaacagcgugcuggcccaggacaagcugcugcugcaccacgacaugacccagccccugaaccacuacuucaucaacagcagccacaacaccuaccugaccgccggccaguucagcggccugagcagcgccgagauguacagacaggugcugcugagcggcugcagaugcguggagcuggacugcuggaagggcaagccccccgacgaggagcccaucaucacccacggcuucaccaugaccaccgacaucuucuucaaggaggccaucgaggccaucgccgagagcgccuucaagaccagccccuaccccaucauccugagcuucgagaaccacguggacagccccagacagcaggccaagauggccgaguacugcagaaccaucuucggcgacaugcugcugaccgagccccuggagaaguucccccugaagcccggcgugccccugcccagccccgaggaccugagaggcaagauccugaucaagaacaagaagaaccaguucagcggccccaccagcagcagcaaggacaccggcggcgaggccgagggcagcagcccccccagcgcccccgccgugugggccggcgaggagggcaccgagcuggaggaggaggagguggaggaggaggaggaggaggagagcggcaaccuggacgaggaggagaucaagaagaugcagagcgacgagggcaccgccggccuggaggugaccgccuacgaggagaugagcagccuggugaacuacauccagcccaccaaguucgugagcuucgaguucagcgcccagaagaacagaagcuacgugaucagcagcuucaccgagcugaaggccuacgaccugcugagcaaggccagcgugcaguucguggacuacaacaagagacagaugagcagaaucuaccccaagggcaccagaauggacagcagcaacuacaugccccagauguucuggaacgccggcugccagaugguggcccugaacuuccagaccauggaccugcccaugcagcagaacauggccguguucgaguucaacggccagagcggcuaccugcugaagcacgaguucaugagaagacccgacaagcaguucaaccccuucagcguggacagaaucgacguggugguggccaccacccugagcaucaccgugaucagcggccaguuccugagcgagagaagcgugagaaccuacguggagguggagcuguucggccugcccggcgaccccaagagaagauacagaaccaagcugagccccagcaccaacagcaucaaccccguguggaaggaggagcccuucguguucgagaagauccugaugcccgagcuggccagccugagaguggccgugauggaggagggcaacaaguuccugggccacagaaucauccccaucaacgcccugaacagcggcuaccaccaccugugccugcacagcgagagcaacaugccccugaccaugcccgcccuguucaucuuccuggagaugaaggacuacauccccggcgccugggccgaccugaccguggcccuggccaaccccaucaaguucuucagcgcccacgacaccaagagcgugaagcugaaggaggccaugggcggccugcccgagaagcccuucccccuggccagccccguggccagccaggugaacggcgcccuggcccccaccagcaacggcagccccgccgccagagccggcgccagagaggaggccaugaaggaggccgccgagcccagaaccgccagccuggaggagcugagagagcugaagggcguggugaagcugcagagaagacacgagaaggagcugagagagcuggagagaagaggcgccagaagaugggaggagcugcugcagagaggcgccgcccagcuggccgagcugggcccccccggcgugggcggcgugggcgccugcaagcugggccccggcaagggcagcagaaagaagagaagccugcccagagaggagagcgccggcgccgcccccggcgagggccccgagggcguggacggcagagugagagagcugaaggacagacuggagcuggagcugcugagacagggcgaggagcaguacgagugcgugcugaagagaaaggagcagcacguggccgagcagaucagcaagaugauggagcuggccagagagaagcaggccgccgagcugaaggcccugaaggagaccagcgagaacgacaccaaggagaugaagaagaagcuggagaccaagagacuggagagaauccagggcaugaccaaggugaccaccgacaagauggcccaggagagacugaagagagagaucaacaacagccacauccaggagguggugcaggugaucaagcagaugaccgagaaccuggagagacaccaggagaagcuggaggagaagcaggccgccugccuggagcagaucagagagauggagaagcaguuccagaaggaggcccuggccgaguacgaggccagaaugaagggccuggaggccgaggugaaggagagcgugagagccugccugagaaccugcuuccccagcgaggccaaggacaagcccgagagagccugcgagugcccccccgagcugugcgagcaggacccccugaucgccaaggccgacgcccaggagagcagacuguaa

SEQ ID NO: 21629 - RNA, 3504 nt, Artificial Sequence
  PLCB3__Homo_sapiens__NP_001171812
auggccggcgcccagcccggcgugcacgcccugcagcuggagccccccaccgugguggagacccugagaagaggcagcaaguucaucaagugggacgaggagaagcugaugaccguggugagcggccccgaccccgugaacaccguguuccugaacuucauggccgugcaggacgacaccgccaagguguggagcgaggagcuguucaagcuggccaugaacauccuggcccagaacgccagcagaaacaccuuccugagaaaggccuacaccaagcugaagcugcaggugaaccaggacggcagaauccccgugaagaacauccugaagauguucagcgccgacaagaagagaguggagaccgcccuggagagcugcggccugaaguucaacagaagcgagagcaucagacccgacgaguucagccuggagaucuucgagagauuccugaacaagcugugccugagacccgacaucgacaagauccugcuggagaucggcgccaagggcaagcccuaccugacccuggagcagcugauggacuucaucaaccagaagcagagagaccccagacugaacgaggugcuguaccccccccugagacccagccaggccagacugcugaucgagaaguacgagcccaaccagcaguuccuggagagagaccagaugagcauggagggcuucagcagauaccugggcggcgaggagaacggcauccugccccuggaggcccuggaccugagcaccgacaugacccagccccugagcgccuacuucaucaacagcagccacaacaccuaccugaccgccggccagcuggccggcaccagcagcguggagauguacagacaggcccugcuguggggcugcagaugcguggagcuggacguguggaagggcagaccccccgaggaggagcccuucaucacccacggcuucaccaugaccaccgaggugccccugagagacgugcuggaggccaucgccgagaccgccuucaagaccagccccuaccccgugauccugagcuucgagaaccacguggacagcgccaagcagcaggccaagauggccgaguacugcagaagcaucuucggcgacgcccugcugaucgagccccuggacaaguacccccuggcccccggcgugccccugcccagcccccaggaccugaugggcagaauccuggugaagaacaagaagagacacagacccagcgccggcggccccgacagcgccggcagaaagagaccccuggagcagagcaacagcgcccugagcgagagcagcgccgccaccgagcccagcagcccccagcugggcagccccagcagcgacagcugccccggccugagcaacggcgaggaggugggccuggagaagcccagccuggagccccagaagagccugggcgacgagggccugaacagaggccccuacgugcugggccccgccgacagagaggacgaggaggaggacgaggaggaggaggagcagaccgaccccaagaagcccaccaccgacgagggcaccgccagcagcgaggugaacgccaccgaggagaugagcacccuggugaacuacaucgagcccgugaaguucaagagcuucgaggccgccagaaagagaaacaagugcuucgagaugagcagcuucguggagaccaaggccauggagcagcugaccaagagccccauggaguucguggaguacaacaagcagcagcugagcagaaucuaccccaagggcaccagaguggacagcagcaacuacaugccccagcuguucuggaacgugggcugccagcugguggcccugaacuuccagacccuggacguggccaugcagcugaacgccggcguguucgaguacaacggcagaagcggcuaccugcugaagcccgaguucaugagaagacccgacaagagcuucgaccccuucaccgaggugaucguggacggcaucguggccaacgcccugagagugaaggugaucagcggccaguuccugagcgacagaaaggugggcaucuacguggagguggacauguucggccugcccguggacaccagaagaaaguacagaaccagaaccagccagggcaacagcuucaaccccgugugggacgaggagcccuucgacuuccccaagguggugcugcccacccuggccagccugagaaucgccgccuucgaggagggcggcaaguucgugggccacagaauccugcccgugagcgccaucagaagcggcuaccacuacgugugccugagaaacgaggccaaccagccccugugccugcccgcccugcugaucuacaccgaggccagcgacuacauccccgacgaccaccaggacuacgccgaggcccugaucaaccccaucaagcacgugagccugauggaccagagagccagacagcuggccgcccugaucggcgagagcgaggcccaggccggccaggagaccugccaggacacccagagccagcagcugggcagccagcccagcagcaaccccacccccagcccccuggacgccagccccagaagaccccccggccccaccaccagccccgccagcaccagccugagcagccccggccagagagacgaccugaucgccagcauccugagcgagguggcccccaccccccuggacgagcugagaggccacaaggcccuggugaagcugagaagcagacaggagagagaccugagagagcugagaaagaagcaccagagaaaggccgugacccugaccagaagacugcuggacggccuggcccaggcccaggccgagggcagaugcagacugagacccggcgcccugggcggcgccgccgacguggaggacaccaaggagggcgaggacgaggccaagagauaccaggaguuccagaacagacaggugcagagccugcuggagcugagagaggcccagguggacgccgaggcccagagaagacuggagcaccugagacaggcccugcagagacugagagagguggugcuggacgccaacaccacccaguucaagagacugaaggagaugaacgagagagagaagaaggagcugcagaagauccuggacagaaagagacacaacagcaucagcgaggccaagaugagagacaagcacaagaaggaggccgagcugaccgagaucaacagaagacacaucaccgagagcgugaacagcaucagaagacuggaggaggcccagaagcagagacacgacagacugguggccggccagcagcaggugcugcagcagcuggccgaggaggagcccaagcugcuggcccagcuggcccaggagugccaggagcagagagccagacugccccaggagaucagaagaagccugcugggcgagaugcccgagggccugggcgacggcccccugguggccugcgccagcaacggccacgcccccggcagcagcggccaccugagcggcgccgacagcgagagccaggaggagaacacccagcuguaa

SEQ ID NO: 21630 - RNA, 3585 nt, Artificial Sequence
  PLCB4__Homo_sapiens__NP_000924
auggccaagcccuacgaguucaacuggcagaaggaggugcccagcuuccugcaggagggcgccguguucgacagauacgaggaggagagcuucguguucgagcccaacugccuguucaagguggacgaguucggcuucuuccugaccuggagaagcgagggcaaggagggccaggugcuggagugcagccugaucaacagcaucagaagcggcgccauccccaaggaccccaagauccuggccgcccuggaggccgugggcaagagcgagaacgaccuggagggcagaaucgugugcgugugcagcggcaccgaccuggugaacaucagcuucaccuacaugguggccgagaaccccgaggugaccaagcaguggguggagggccugagaagcaucauccacaacuucagagccaacaacgugagccccaugaccugccugaagaagcacuggaugaagcuggccuucaugaccaacaccaacggcaagauccccgugagaagcaucaccagaaccuucgccagcggcaagaccgagaaggugaucuuccaggcccugaaggagcugggccugcccagcggcaagaacgacgagaucgagcccaccgccuucagcuacgagaaguucuacgagcugacccagaagaucugccccagaaccgacaucgaggaccuguucaagaagaucaacggcgacaagaccgacuaccugaccguggaccagcuggugagcuuccugaacgagcaccagagagaccccagacugaacgagauccuguuccccuucuacgacgccaagagagccaugcagaucaucgagauguacgagcccgacgaggaccugaagaagaagggccugaucagcagcgacggcuucugcagauaccugaugagcgacgagaacgcccccguguuccuggacagacuggagcuguaccaggagauggaccacccccuggcccacuacuucaucagcagcagccacaacaccuaccugaccggcagacaguucggcggcaagagcagcguggagauguacagacaggugcugcuggccggcugcagaugcguggagcuggacugcugggacggcaagggcgaggaccaggagcccaucaucacccacggcaaggccaugugcaccgacauccuguucaaggacgugauccaggccaucaaggagaccgccuucgugaccagcgaguaccccgugauccugagcuucgagaaccacugcagcaaguaccagcaguacaagaugagcaaguacugcgaggaccuguucggcgaccugcugcugaagcaggcccuggagagccacccccuggagcccggcagagcccugcccagccccaacgaccugaagagaaagauccugaucaagaacaagagacugaagcccgagguggagaagaagcagcuggaggcccugagaagcaugauggaggccggcgagagcgccagccccgccaacauccuggaggacgacaacgaggaggagaucgagagcgccgaccaggaggaggaggcccaccccgaguucaaguucggcaacgagcugagcgccgacgaccugggccacaaggaggccguggccaacagcgugaagaagggccuggugaccguggaggacgagcaggccuggauggccagcuacaaguacgugggcgccaccaccaacauccaccccuaccugagcaccaugaucaacuacgcccagcccgugaaguuccagggcuuccacguggccgaggagagaaacauccacuacaacaugagcagcuucaacgagagcgugggccugggcuaccugaagacccacgccaucgaguucgugaacuacaacaagagacagaugagcagaaucuaccccaagggcggcagaguggacagcagcaacuacaugccccagaucuucuggaacgccggcugccagauggugagccugaacuaccagacccccgaccuggccaugcagcugaaccagggcaaguucgaguacaacggcagcugcggcuaccugcugaagcccgacuucaugagaagacccgacagaaccuucgaccccuucagcgagacccccguggacggcgugaucgccgccaccugcagcgugcaggugaucagcggccaguuccugagcgacaagaagaucggcaccuacguggagguggacauguacggccugcccaccgacaccaucagaaaggaguucagaaccagaauggugaugaacaacggccugaaccccguguacaacgaggagagcuucguguucagaaaggugauccugcccgaccuggccgugcugagaaucgccguguacgacgacaacaacaagcugaucggccagagaauccugccccuggacggccugcaggccggcuacagacacaucagccugagaaacgagggcaacaagccccugagccugcccaccaucuucugcaacaucgugcugaagaccuacgugcccgacggcuucggcgacaucguggacgcccugagcgaccccaagaaguuccugagcaucaccgagaagagagccgaccagaugagagccaugggcaucgagaccagcgacaucgccgacgugcccagcgacaccagcaagaacgacaagaagggcaaggccaacaccgccaaggccaacgugaccccccagagcagcagcgagcugagacccaccaccaccgccgcccuggccagcggcguggaggccaagaagggcaucgagcugaucccccaggugagaaucgaggaccugaagcagaugaaggccuaccugaagcaccugaagaagcagcagaaggagcugaacagccugaagaagaagcacgccaaggagcacagcaccaugcagaagcugcacugcacccagguggacaagaucguggcccaguacgacaaggagaagagcacccacgagaagauccuggagaaggccaugaagaagaagggcggcagcaacugccuggagaugaagaaggagaccgagaucaagauccagacccugaccagcgaccacaagagcaaggugaaggagaucguggcccagcacaccaaggaguggagcgagaugaucaacacccacagcgccgaggagcaggagaucagagaccugcaccugagccagcagugcgagcugcugaagaagcugcugaucaacgcccacgagcagcagacccagcagcugaagcugagccacgacagagagagcaaggagaugagagcccaccaggccaagaucagcauggagaacagcaaggccaucagccaggacaagagcaucaagaacaaggccgagagagagagaagagugagagagcugaacagcagcaacaccaagaaguuccuggaggagagaaagagacuggccaugaagcagagcaaggagauggaccagcugaagaaggugcagcuggagcaccuggaguuccuggagaagcagaacgagcagcugcugaagagcugccacgccgugagccagacccagggcgagggcgacgccgccgacggcgagaucggcagcagagacggcccccagaccagcaacagcagcaugaagcugcagaacgccaacuaa

SEQ ID NO: 21631 - RNA, 2334 nt, Artificial Sequence
  PLCD1__Homo_sapiens__NP_001124436
augcagugccugggcaucagaagcagaagcagaagcagagagcuguaccugcaggagagaagccugaagguggccgcccugaacggcagaagacugggccugcaggacgacgaggaccugcaggcccugcugaagggcagccagcugcugaaggugaagagcagcagcuggagaagagagagauucuacaagcugcaggaggacugcaagaccaucuggcaggagagcagaaaggugaugagaacccccgagagccagcuguucagcaucgaggacauccaggaggugagaaugggccacagaaccgagggccuggagaaguucgccagagacgugcccgaggacagaugcuucagcaucguguucaaggaccagagaaacacccuggaccugaucgcccccagccccgccgacgcccagcacugggugcugggccugcacaagaucauccaccacagcggcagcauggaccagagacagaagcugcagcacuggauccacagcugccugagaaaggccgacaagaacaaggacaacaagaugagcuucaaggagcugcagaacuuccugaaggagcugaacauccagguggacgacagcuacgccagaaagaucuucagagagugcgaccacagccagaccgacagccuggaggacgaggagaucgaggccuucuacaagaugcugacccagagaguggagaucgacagaaccuucgccgaggccgccggcagcggcgagacccugagcguggaccagcuggugaccuuccugcagcaccagcagagagaggaggccgccggccccgcccuggcccugagccugaucgagagauacgagcccagcgagaccgccaaggcccagagacagaugaccaaggacggcuuccugauguaccugcugagcgccgacggcagcgccuucagccuggcccacagaagaguguaccaggacaugggccagccccugagccacuaccuggugagcagcagccacaacaccuaccugcuggaggaccagcuggccggccccagcagcaccgaggccuacaucagagcccugugcaagggcugcagaugccuggagcuggacugcugggacggccccaaccaggagcccaucaucuaccacggcuacaccuucaccagcaagauccuguucugcgacgugcugagagccaucagagacuacgccuucaaggccagccccuaccccgugauccugagccuggagaaccacugcacccuggagcagcagagagugauggccagacaccugcacgccauccugggccccaugcugcugaacagaccccuggacggcgugaccaacagccugcccagccccgagcagcugaagggcaagauccugcugaagggcaagaagcugggcggccugcugccccccggcggcgagggcggccccgaggccaccguggugagcgacgaggacgaggccgccgagauggaggacgaggccgugagaagcagagugcagcacaagcccaaggaggacaagcugagacuggcccaggagcugagcgacauggugaucuacugcaagagcgugcacuucggcggcuucagcagccccggcacccccggccaggccuucuacgagauggccagcuucagcgagaacagagcccugagacugcugcaggagagcggcaacggcuucgugagacacaacgugggccaccugagcagaaucuaccccgccggcuggagaaccgacagcagcaacuacagccccguggagauguggaacggcggcugccagaucguggcccugaacuuccagacccccggccccgagauggacguguaccagggcagauuccaggacaacggcgccugcggcuacgugcugaagcccgccuuccugagagaccccaacggcaccuucaaccccagagcccuggcccagggccccuggugggccagaaagagacugaacaucagagugaucagcggccagcagcugcccaaggugaacaagaacaagaacagcaucguggaccccaaggugaccguggagauccacggcgugagcagagacguggccagcagacagaccgccgugaucaccaacaacggcuucaaccccuggugggacaccgaguucgccuucgaggugguggugcccgaccuggcccugaucagauuccugguggaggacuacgacgccagcagcaagaacgacuucaucggccagagcaccaucccccugaacagccugaagcagggcuacagacacgugcaccugaugagcaagaacggcgaccagcaccccagcgccacccuguucgugaagaucagccugcaggacuaa

SEQ ID NO: 21632 - RNA, 2370 nt, Artificial Sequence
  PLCD3__Homo_sapiens__NP_588614
augcugugcggcagauggagaagaugcagaagaccccccgaggagccccccguggccgcccagguggccgcccagguggccgcccccguggcccugcccagcccccccacccccagcgacggcggcaccaagagacccggccugagagcccugaagaagaugggccugaccgaggacgaggacgugagagccaugcugagaggcagcagacugagaaagaucagaagcagaaccuggcacaaggagagacuguacagacugcaggaggacggccugagcgugugguuccagagaagaauccccagagcccccagccagcacaucuucuucgugcagcacaucgaggccgugagagagggccaccagagcgagggccugagaagauucggcggcgccuucgcccccgccagaugccugaccaucgccuucaagggcagaagaaagaaccuggaccuggccgcccccaccgccgaggaggcccagagaugggugagaggccugaccaagcugagagccagacuggacgccaugagccagagagagagacuggaccacuggauccacagcuaccugcacagagccgacagcaaccaggacagcaagaugagcuucaaggagaucaagagccugcugagaauggugaacguggacaugaacgacauguacgccuaccugcuguucaaggagugcgaccacagcaacaacgacagacuggagggcgccgagaucgaggaguuccugagaagacugcugaagagacccgagcuggaggagaucuuccaccaguacagcggcgaggacagagugcugagcgcccccgagcugcuggaguuccuggaggaccagggcgaggagggcgccacccuggccagagcccagcagcugauccagaccuacgagcugaacgagaccgccaagcagcacgagcugaugacccuggacggcuucaugauguaccugcugagccccgagggcgccgcccuggacaacacccacaccugcguguuccaggacaugaaccagccccuggcccacuacuucaucagcagcagccacaacaccuaccugaccgacagccagaucggcggccccagcagcaccgaggccuacgugagagccuucgcccagggcugcagaugcguggagcuggacugcugggagggccccggcggcgagcccgugaucuaccacggccacacccugaccagcaagauccuguucagagacguggugcaggccgugagagaccacgccuucacccugagccccuaccccgugauccugagccuggagaaccacugcggccuggagcagcaggccgccauggccagacaccugugcaccauccugggcgacaugcuggugacccaggcccuggacagccccaaccccgaggagcugcccagccccgagcagcugaagggcagagugcuggugaagggcaagaagcugcccgccgccagaagcgaggacggcagagcccugagcgacagagaggaggaggaggaggacgacgaggaggaggaggaggagguggaggccgccgcccagagaagacuggccaagcagaucagccccgagcugagcgcccuggccguguacugccacgccaccagacugagaacccugcaccccgcccccaacgccccccagcccugccaggugagcagccugagcgagagaaaggccaagaagcugaucagagaggccggcaacagcuucgugagacacaacgccagacagcugaccagaguguacccccugggccugagaaugaacagcgccaacuacagcccccaggagauguggaacagcggcugccagcugguggcccugaacuuccagacccccggcuacgagauggaccugaacgccggcagauuccuggugaacggccagugcggcuacgugcugaagcccgccugccugagacagcccgacagcaccuucgaccccgaguaccccggcccccccagaaccacccugagcauccaggugcugaccgcccagcagcugcccaagcugaacgccgagaagccccacagcaucguggacccccuggugagaaucgagauccacggcgugcccgccgacugcgccagacaggagaccgacuacgugcugaacaacggcuucaaccccagauggggccagacccugcaguuccagcugagagcccccgagcuggcccuggugagauucgugguggaggacuacgacgccaccagccccaacgacuucgugggccaguucacccugccccugagcagccugaagcagggcuacagacacauccaccugcugagcaaggacggcgccagccugagccccgccacccuguucauccagaucagaauccagagaagcuaa

SEQ ID NO: 21633 - RNA, 2289 nt, Artificial Sequence
  PLCD4__Homo_sapiens__NP_116115
auggccagccugcugcaggaccagcugaccaccgaccaggaccugcugcugaugcaggagggcaugcccaugagaaaggugagaagcaagagcuggaagaagcugagauacuucagacugcagaacgacggcaugaccguguggcacgccagacaggccagaggcagcgccaagcccagcuucagcaucagcgacguggagaccaucagaaacggccacgacagcgagcugcugagaagccuggccgaggagcugccccuggagcagggcuucaccaucguguuccacggcagaagaagcaaccuggaccugauggccaacagcguggaggaggcccagaucuggaugagaggccugcagcugcugguggaccuggugaccagcauggaccaccaggagagacuggaccaguggcugagcgacugguuccagagaggcgacaagaaccaggacggcaagaugagcuuccaggaggugcagagacugcugcaccugaugaacguggagauggaccaggaguacgccuucagccuguuccaggccgccgacaccagccagagcggcacccuggagggcgaggaguucgugcaguucuacaaggcccugaccaagagagccgaggugcaggagcuguucgagagcuucagcgccgacggccagaagcugacccugcuggaguuccuggacuuccugcaggaggagcagaaggagagagacugcaccagcgagcuggcccuggagcugaucgacagauacgagcccagcgacagcggcaagcugagacacgugcugagcauggacggcuuccugagcuaccugugcagcaaggacggcgacaucuucaaccccgccugccugcccaucuaccaggacaugacccagccccugaaccacuacuucaucugcagcagccacaacaccuaccuggugggcgaccagcugugcggccagagcagcguggagggcuacaucagagcccugaagagaggcugcagaugcguggagguggacgugugggacggccccagcggcgagcccgugguguaccacggccacacccugaccagcagaauccuguucaaggacgugguggccaccguggcccaguacgccuuccagaccagcgacuaccccgugauccugagccuggagacccacugcagcugggagcagcagcagaccauggccagacaccugaccgagauccugggcgagcagcugcugagcaccacccuggacggcgugcugcccacccagcugcccagccccgaggagcugagaagaaagauccuggugaagggcaagaagcugacccuggaggaggaccuggaguacgaggaggaggaggccgagcccgagcuggaggagagcgagcuggcccuggagagccaguucgagaccgagcccgagccccaggagcagaaccugcagaacaaggacaagaagaagaagagcaagcccauccugugccccgcccugagcagccuggugaucuaccugaagagcgugagcuucagaagcuucacccacagcaaggagcacuaccacuucuacgagaucagcagcuucagcgagaccaaggccaagagacugaucaaggaggccggcaacgaguucgugcagcacaacaccuggcagcugagcagaguguaccccagcggccugagaaccgacagcagcaacuacaacccccaggagcuguggaacgccggcugccagaugguggccaugaacaugcagaccgccggccuggagauggacaucugcgacggccacuucagacagaacggcggcugcggcuacgugcugaagcccgacuuccugagagacauccagagcagcuuccaccccgagaagcccaucagccccuucaaggcccagacccugcugauccaggugaucagcggccagcagcugcccaagguggacaagaccaaggagggcagcaucguggacccccuggugaaggugcagaucuucggcgugagacuggacaccgccagacaggagaccaacuacguggagaacaacggcuucaaccccuacuggggccagacccugugcuucagagugcuggugcccgagcuggccaugcugagauucguggugauggacuacgacuggaagagcagaaacgacuucaucggccaguacacccugcccuggaccugcaugcagcagggcuacagacacauccaccugcugagcaaggacggcaucagccugagacccgccagcaucuucguguacaucugcauccaggagggccuggagggcgacgagagcuaa

SEQ ID NO: 21634 - RNA, 5985 nt, Artificial Sequence
  PLCE1__Homo_sapiens__NP_001159451
auggugagcgagggcagcgccgccggcagagacuucgccggcauggaggaggugagacagcugcacgugagauucugcaagggcaucaagaucuggcaccaggccugguuccugugcagccugcugggcagagagccccaggagagagaggccggcugccagcuguggcugugcacccugagcgccgugcugaaggugggcuggcuguucccccugagcgaggugcccaacuucacccugcugaaggacggcugcggcugcuggagacugaaggaggaccagaucuacaacgccgugagaagagaggagaccgagaacaccgugggcagccugcugcacuuccugaccaagcugcccgccagcgagaccgcccacggcagaaucagcgugggccccugccugaagcagugcgugagagacaccgugugcgaguacagagccacccugcagagaaccagcaucagccaguacaucaccggcagccugcuggaggccaccaccagccugggcgccagaagcggccugcugagcaccuucggcggcagcaccggcagaaugaugcugaaggagagacagcccggccccagcguggccaacagcaacgcccugcccagcagcagcgccggcaucagcaaggagcugaucgaccugcagccccugauccaguuccccgaggagguggccagcauccugauggagcaggagcagaccaucuacagaagagugcugcccguggacuaccugugcuuccugaccagagaccugggcacccccgagugccagagcagccugcccugccugaaggccagcaucagcgccagcauccugaccacccagaacggcgagcacaacgcccuggaggaccuggugaugagauucaacgaggugagcagcugggugaccuggcugauccugaccgccggcagcauggaggagaagagagagguguucagcuaccuggugcacguggccaagugcugcuggaacaugggcaacuacaacgccgugauggaguuccuggccggccugagaagcagaaaggugcugaagauguggcaguucauggaccagagcgacaucgagaccaugagaagccugaaggacgccauggcccagcacgagagcagcugcgaguacagaaagguggugaccagagcccugcacauccccggcugcaagguggugcccuucugcggcguguuccugaaggagcugugcgaggugcuggacggcgccagcggccugaugaagcugugccccagauacaacagccaggaggagacccuggaguucguggccgacuacagcggccaggacaacuuccugcagagagugggccagaacggccugaagaacagcgagaaggagagcaccgugaacagcaucuuccaggugaucagaagcugcaacagaagccuggagaccgacgaggaggacagccccagcgagggcaacagcagcagaaagagcagccugaaggacaagagcagauggcaguucaucaucggcgaccugcuggacagcgacaacgacaucuucgagcagagcaaggaguacgacagccacggcagcgaggacagccagaaggccuucgaccacggcaccgagcugauccccugguacgugcugagcauccaggccgacgugcaccaguuccugcugcagggcgccaccgugauccacuacgaccaggacacccaccugagcgccagaugcuuccugcagcugcagcccgacaacagcacccugaccugggugaagcccaccaccgccagccccgccagcagcaaggccaagcugggcgugcugaacaacaccgccgagcccggcaaguucccccugcugggcaacgccggccugagcagccugaccgagggcgugcuggaccuguucgccgugaaggccguguacaugggccaccccggcaucgacauccacaccgugugcgugcagaacaagcugggcagcauguuccugagcgagaccggcgugacccugcuguacggccugcagaccaccgacaacagacugcugcacuucguggcccccaagcacaccgccaagaugcuguucagcggccugcuggagcugaccagagccgugagaaagaugagaaaguuccccgaccagagacagcaguggcugagaaagcaguacgugagccuguaccaggaggacggcagauacgagggccccacccuggcccacgccguggagcuguucggcggcagaagauggagcgccagaaaccccagccccggcaccagcgccaagaacgccgagaagcccaacaugcagagaaacaacacccugggcaucagcaccaccaagaagaagaagaagauccugaugagaggcgagagcggcgaggugaccgacgacgagauggccaccagaaaggccaagaugcacaaggagugcagaagcagaagcggcagcgacccccaggacaucaacgagcaggaggagagcgaggugaacgccaucgccaacccccccaacccccugcccagcagaagagcccacagccugaccaccgccggcagccccaaccuggccgccggcaccagcagccccaucagacccgugagcagccccgugcugagcagcagcaacaagagccccagcagcgccuggagcagcagcagcuggcacggcagaaucaagggcggcaugaagggcuuccagagcuucauggugagcgacagcaacaugagcuucguggaguucguggagcuguucaagagcuucagcgugagaagcagaaaggaccugaaggaccuguucgacguguacgccgugcccugcaacagaagcggcagcgagagcgccccccuguacaccaaccugaccaucgacgagaacaccagcgaccugcagcccgaccuggaccugcugaccagaaacgugagcgaccugggccuguucaucaagagcaagcagcagcugagcgacaaccagagacagaucagcgacgccaucgccgccgccagcaucgugaccaacggcaccggcaucgagagcaccagccugggcaucuucggcgugggcauccugcagcugaacgacuuccuggugaacugccagggcgagcacugcaccuacgacgagauccugagcaucauccagaaguucgagcccagcaucagcaugugccaccagggccugaugagcuucgagggcuucgccagauuccugauggacaaggagaacuucgccagcaagaacgacgagagccaggagaacaucaaggagcugcagcugccccugagcuacuacuacaucgagagcagccacaacaccuaccugaccggccaccagcugaagggcgagagcagcguggagcuguacagccaggugcugcugcagggcugcagaagcguggagcuggacugcugggacggcgacgacggcaugcccaucaucuaccacggccacacccugaccaccaagauccccuucaaggaggugguggaggccaucgacagaagcgccuucaucaacagcgaccugcccaucaucaucagcaucgagaaccacugcagccugccccagcagagaaagauggccgagaucuucaagaccguguucggcgagaagcuggugaccaaguuccuguucgagaccgacuucagcgacgaccccaugcugcccagccccgaccagcugagaaagaaggugcugcugaagaacaagaagcugaaggcccaccagacccccguggacauccugaagcagaaggcccaccagcuggccagcaugcaggugcaggccuacaacggcggcaacgccaaccccagacccgccaacaacgaggaggaggaggacgaggaggacgaguacgacuacgacuacgagagccugagcgacgacaacauccuggaggacagacccgagaacaagagcugcaacgacaagcugcaguucgaguacaacgaggagauccccaagagaaucaagaaggccgacaacagcgccugcaacaagggcaagguguacgacauggagcugggcgaggaguucuaccuggaccagaacaagaaggagagcagacagaucgcccccgagcugagcgaccuggugaucuacugccaggccgugaaguuccccggccugagcacccugaacgccagcggcagcagcagaggcaaggagagaaagagcagaaagagcaucuucggcaacaaccccggcagaaugagccccggcgagaccgccagcuucaacaagaccagcggcaagagcagcugcgagggcaucagacagaccugggaggagagcagcagcccccugaaccccaccaccagccugagcgccaucaucagaacccccaagugcuaccacaucagcagccugaacgagaacgccgccaagagacugugcagaagauacagccagaagcugacccagcacaccgccugccagcugcugagaaccuaccccgccgccaccagaaucgacagcagcaaccccaacccccugauguucuggcugcacggcauccagcugguggcccugaacuaccagaccgacgaccugccccugcaccugaacgccgccauguucgaggccaacggcggcugcggcuacgugcugaagccccccgugcugugggacaagaacugccccauguaccagaaguucagcccccuggagagagaccuggacagcauggaccccgccguguacagccugaccaucgugagcggccagaacgugugccccagcaacagcaugggcagccccugcaucgagguggacgugcugggcaugccccuggacagcugccacuucagaaccaagcccauccacagaaacacccugaaccccauguggaacgagcaguuccuguuccacgugcacuucgaggaccugguguuccugagauucgccgugguggagaacaacagcagcgccgugaccgcccagagaaucaucccccugaaggcccugaagagaggcuacagacaccugcagcugagaaaccugcacaacgaggugcuggagaucagcagccuguucaucaacagcagaagaauggaggagaacagcagcggcaacaccaugagcgccagcagcauguucaacaccgaggagagaaagugccugcagacccacagagugaccgugcacggcgugcccggccccgagcccuucaccguguucaccaucaacggcggcaccaaggccaagcagcugcugcagcagauccugaccaacgagcaggacaucaagcccgugaccaccgacuacuuccugauggaggagaaguacuucaucagcaaggagaagaacgagugcagaaagcagcccuuccagagagccaucggccccgaggaggagaucaugcagauccugagcagcugguuccccgaggagggcuacaugggcagaaucgugcugaagacccagcaggagaaccuggaggagaagaacaucgugcaggacgacaaggaggugauccugagcagcgaggaggagagcuucuucgugcaggugcacgacgugagccccgagcagcccagaaccgugaucaaggcccccagagugagcaccgcccaggacgugauccagcagacccugugcaaggccaaguacagcuacagcauccugagcaaccccaaccccagcgacuacgugcugcuggaggagguggugaaggacaccaccaacaagaagaccaccacccccaagagcagccagagagugcugcuggaccaggagugcguguuccaggcccagagcaaguggaagggcgccggcaaguucauccugaagcugaaggagcaggugcaggccagcagagaggacaagaagaagggcaucagcuucgccagcgagcugaagaagcugaccaagagcaccaagcagcccagaggccugaccagccccagccagcugcugaccagcgagagcauccagaccaaggaggagaagcccgugggcggccugagcagcagcgacaccauggacuacagacaguaa

SEQ ID NO: 21635 - RNA, 3876 nt, Artificial Sequence
  PLCG1__Homo_sapiens__NP_002651
auggccggcgccgccagccccugcgccaacggcugcggccccggcgcccccagcgacgccgaggugcugcaccugugcagaagccuggaggugggcaccgugaugacccuguucuacagcaagaagagccagagacccgagagaaagaccuuccaggugaagcuggagaccagacagaucaccuggagcagaggcgccgacaagaucgagggcgccaucgacaucagagagaucaaggagaucagacccggcaagaccagcagagacuucgacagauaccaggaggaccccgccuucagacccgaccagagccacugcuucgugauccuguacggcauggaguucagacugaagacccugagccugcaggccaccagcgaggacgaggugaacauguggaucaagggccugaccuggcugauggaggacacccugcaggcccccaccccccugcagaucgagagauggcugagaaagcaguucuacagcguggacagaaacagagaggacagaaucagcgccaaggaccugaagaacaugcugagccaggugaacuacagagugcccaacaugagauuccugagagagagacugaccgaccuggagcagagaagcggcgacaucaccuacggccaguucgcccagcuguacagaagccugauguacagcgcccagaagaccauggaccugcccuuccuggaggccagcacccugagagccggcgagagacccgagcugugcagagugagccugcccgaguuccagcaguuccugcuggacuaccagggcgagcugugggccguggacagacugcaggugcaggaguucaugcugagcuuccugagagacccccugagagagaucgaggagcccuacuucuuccuggacgaguucgugaccuuccuguucagcaaggagaacagcguguggaacagccagcuggacgccgugugccccgacaccaugaacaacccccugagccacuacuggaucagcagcagccacaacaccuaccugaccggcgaccaguucagcagcgagagcagccuggaggccuacgccagaugccugagaaugggcugcagaugcaucgagcuggacugcugggacggccccgacggcaugcccgugaucuaccacggccacacccugaccaccaagaucaaguucagcgacgugcugcacaccaucaaggagcacgccuucguggccagcgaguaccccgugauccugagcaucgaggaccacugcagcaucgcccagcagagaaacauggcccaguacuucaagaaggugcugggcgacacccugcugaccaagcccguggagaucagcgccgacggccugcccagccccaaccagcugaagagaaagauccugaucaagcacaagaagcuggccgagggcagcgccuacgaggaggugcccaccagcaugauguacagcgagaacgacaucagcaacagcaucaagaacggcauccuguaccuggaggaccccgugaaccacgagugguacccccacuacuucgugcugaccagcagcaagaucuacuacagcgaggagaccagcagcgaccagggcaacgaggacgaggaggagcccaaggaggugagcagcagcaccgagcugcacagcaacgagaagugguuccacggcaagcugggcgccggcagagacggcagacacaucgccgagagacugcugaccgaguacugcaucgagaccggcgcccccgacggcagcuuccuggugagagagagcgagaccuucgugggcgacuacacccugagcuucuggagaaacggcaaggugcagcacugcagaauccacagcagacaggacgccggcacccccaaguucuuccugaccgacaaccugguguucgacagccuguacgaccugaucacccacuaccagcaggugccccugagaugcaacgaguucgagaugagacugagcgagcccgugccccagaccaacgcccacgagagcaaggagugguaccacgccagccugaccagagcccaggccgagcacaugcugaugagagugcccagagacggcgccuuccuggugagaaagagaaacgagcccaacagcuacgccaucagcuucagagccgagggcaagaucaagcacugcagagugcagcaggagggccagaccgugaugcugggcaacagcgaguucgacagccugguggaccugaucagcuacuacgagaagcacccccuguacagaaagaugaagcugagauaccccaucaacgaggaggcccuggagaagaucggcaccgccgagcccgacuacggcgcccuguacgagggcagaaaccccggcuucuacguggaggccaaccccaugcccaccuucaagugcgccgugaaggcccuguucgacuacaaggcccagagagaggacgagcugaccuucaucaagagcgccaucauccagaacguggagaagcaggagggcggcugguggagaggcgacuacggcggcaagaagcagcugugguuccccagcaacuacguggaggagauggugaaccccguggcccuggagcccgagagagagcaccuggacgagaacagcccccugggcgaccugcugagaggcgugcuggacgugcccgccugccagaucgccaucagacccgagggcaagaacaacagacuguucguguucagcaucagcauggccagcguggcccacuggagccuggacguggccgccgacagccaggaggagcugcaggacugggugaagaagaucagagagguggcccagaccgccgacgccagacugaccgagggcaagaucauggagagaagaaagaagaucgcccuggagcugagcgagcuggugguguacugcagacccgugcccuucgacgaggagaagaucggcaccgagagagccugcuacagagacaugagcagcuuccccgagaccaaggccgagaaguacgugaacaaggccaagggcaagaaguuccugcaguacaacagacugcagcugagcagaaucuaccccaagggccagagacuggacagcagcaacuacgacccccugcccauguggaucugcggcagccagcugguggcccugaacuuccagacccccgacaagcccaugcagaugaaccaggcccuguucaugaccggcagacacugcggcuacgugcugcagcccagcaccaugagagacgaggccuucgaccccuucgacaagagcagccugagaggccuggagcccugcgccaucagcaucgaggugcugggcgccagacaccugcccaagaacggcagaggcaucgugugccccuucguggagaucgagguggccggcgccgaguacgacagcaccaagcagaagaccgaguucgugguggacaacggccugaaccccguguggcccgccaagcccuuccacuuccagaucagcaaccccgaguucgccuuccugagauucgugguguacgaggaggacauguucagcgaccagaacuuccuggcccaggccaccuuccccgugaagggccugaagaccggcuacagagccgugccccugaagaacaacuacagcgaggaccuggagcuggccagccugcugaucaagaucgacaucuuccccgccaagcaggagaacggcgaccugagccccuucagcggcaccagccugagagagagaggcagcgacgccagcggccagcuguuccacggcagagccagagagggcagcuucgagagcagauaccagcagcccuucgaggacuucagaaucagccaggagcaccuggccgaccacuucgacagcagagagagaagagcccccagaagaaccagagugaacggcgacaacagacuguaa

SEQ ID NO: 21636 - RNA, 3798 nt, Artificial Sequence
  PLCG2__Homo_sapiens__NP_002652
augagcaccaccgugaacguggacagccuggccgaguacgagaagagccagaucaagagagcccuggagcugggcaccgugaugaccguguucagcuucagaaagagcacccccgagagaagaaccgugcaggugaucauggagaccagacagguggccuggagcaagaccgccgacaagaucgagggcuuccuggacaucauggagaucaaggagaucagacccggcaagaacagcaaggacuucgagagagccaaggccgugagacagaaggaggacugcugcuucaccauccuguacggcacccaguucgugcugagcacccugagccuggccgccgacagcaaggaggacgccgugaacuggcugagcggccugaagauccugcaccaggaggccaugaacgccagcacccccaccaucaucgagagcuggcugagaaagcagaucuacagcguggaccagaccagaagaaacagcaucagccugagagagcugaagaccauccugccccugaucaacuucaaggugagcagcgccaaguuccugaaggacaaguucguggagaucggcgcccacaaggacgagcugagcuucgagcaguuccaccuguucuacaagaagcugauguucgagcagcagaagagcauccuggacgaguucaagaaggacagcagcguguucauccugggcaacaccgacagacccgacgccagcgccguguaccugcacgacuuccagagauuccugauccacgagcagcaggagcacugggcccaggaccugaacaaggugagagagagaaugaccaaguucaucgacgacaccaugagagagaccgccgagcccuuccuguucguggacgaguuccugaccuaccuguucagcagagagaacagcaucugggacgagaaguacgacgccguggacaugcaggacaugaacaacccccugagccacuacuggaucagcagcagccacaacaccuaccugaccggcgaccagcugagaagcgagagcagccccgaggccuacaucagaugccugagaaugggcugcagaugcaucgagcuggacugcugggacggccccgacggcaagcccgugaucuaccacggcuggaccagaaccaccaagaucaaguucgacgacguggugcaggccaucaaggaccacgccuucgugaccagcagcuuccccgugauccugagcaucgaggagcacugcagcguggagcagcagagacacauggccaaggccuucaaggagguguucggcgaccugcugcugaccaagcccaccgaggccagcgccgaccagcugcccagccccagccagcugagagagaagaucaucaucaagcacaagaagcugggccccagaggcgacguggacgugaacauggaggacaagaaggacgagcacaagcagcagggcgagcuguacaugugggacagcaucgaccagaaguggaccagacacuacugcgccaucgccgacgccaagcugagcuucagcgacgacaucgagcagaccauggaggaggaggugccccaggacaucccccccaccgagcugcacuucggcgagaagugguuccacaagaagguggagaagagaaccagcgccgagaagcugcugcaggaguacugcauggagaccggcggcaaggacggcaccuuccuggugagagagagcgagaccuuccccaacgacuacacccugagcuucuggagaagcggcagagugcagcacugcagaaucagaagcaccauggagggcggcacccugaaguacuaccugaccgacaaccugaccuucagcagcaucuacgcccugauccagcacuacagagagacccaccugagaugcgccgaguucgagcugagacugaccgaccccgugcccaaccccaacccccacgagagcaagcccugguacuacgacagccugagcagaggcgaggccgaggacaugcugaugagaauccccagagacggcgccuuccugaucagaaagagagagggcagcgacagcuacgccaucaccuucagagccagaggcaaggugaagcacugcagaaucaacagagacggcagacacuucgugcugggcaccagcgccuacuucgagagccugguggagcuggugagcuacuacgagaagcacagccuguacagaaagaugagacugagauaccccgugacccccgagcugcuggagagauacaacauggagagagacaucaacagccuguacgacgugagcagaauguacguggaccccagcgagaucaaccccagcaugccccagagaaccgugaaggcccuguacgacuacaaggccaagagaagcgacgagcugagcuucugcagaggcgcccugauccacaacgugagcaaggagcccggcggcugguggaagggcgacuacggcaccagaauccagcaguacuuccccagcaacuacguggaggacaucagcaccgccgacuucgaggagcuggagaagcagaucaucgaggacaacccccugggcagccugugcagaggcauccuggaccugaacaccuacaacguggugaaggccccccagggcaagaaccagaagagcuucguguucauccuggagcccaagcagcagggcgacccccccguggaguucgccaccgacagaguggaggagcuguucgagugguuccagagcaucagagagaucaccuggaagaucgacaccaaggagaacaacaugaaguacugggagaagaaccagagcaucgccaucgagcugagcgaccuggugguguacugcaagcccaccagcaagaccaaggacaaccuggagaaccccgacuucagagagaucagaagcuucguggagaccaaggccgacagcaucaucagacagaagcccguggaccugcugaaguacaaccagaagggccugaccagaguguaccccaagggccagagaguggacagcagcaacuacgaccccuucagacuguggcugugcggcagccagaugguggcccugaacuuccagaccgccgacaaguacaugcagaugaaccacgcccuguucagccugaacggcagaaccggcuacgugcugcagcccgagagcaugagaaccgagaaguacgaccccaugccccccgagagccagagaaagauccugaugacccugaccgugaaggugcugggcgccagacaccugcccaagcugggcagaagcaucgccugccccuucguggagguggagaucugcggcgccgaguacgacaacaacaaguucaagaccaccguggugaacgacaacggccugagccccaucugggcccccacccaggagaaggugaccuucgagaucuacgaccccaaccuggccuuccugagauucgugguguacgaggaggacauguucagcgaccccaacuuccuggcccacgccaccuaccccaucaaggccgugaagagcggcuucagaagcgugccccugaagaacggcuacagcgaggacaucgagcuggccagccugcugguguucugcgagaugagacccgugcuggagagcgaggaggagcuguacagcagcugcagacagcugagaagaagacaggaggagcugaacaaccagcuguuccuguacgacacccaccagaaccugagaaacgccaacagagacgcccuggugaaggaguucagcgugaacgagaaccagcugcagcuguaccaggagaagugcaacaagagacugagagagaagagagugagcaacagcaaguucuacagcuaa

SEQ ID NO: 21637 - RNA, 5082 nt, Artificial Sequence
  PLCH1__Homo_sapiens__NP_001124432
auggccgaccuggagguguacaagaaccugagccccgagaagguggagagaugcaugagcgugaugcagagcggcacccagaugaucaagcugaagagaggcaccaagggccuggugagacuguucuaccuggacgagcacagaaccagacugagauggagacccagcagaaagagcgagaaggccaagauccugaucgacagcaucuacaaggugaccgagggcagacagagcgagaucuuccacagacaggccgagggcaacuucgaccccagcugcugcuucaccaucuaccacggcaaccacauggagagccuggaccugaucaccagcaaccccgaggaggccagaaccuggaucaccggccugaaguaccugauggccggcaucagcgacgaggacagccuggccaagagacagagaacccacgaccagugggugaagcagaccuucgaggaggccgacaagaacggcgacggccugcugaacaucgaggagauccaccagcugaugcacaagcugaacgugaaccugcccagaagaaaggugagacagauguuccaggaggccgacaccgacgagaaccagggcacccugaccuucgaggaguucugcguguucuacaagaugaugagccugagaagagaccuguaccugcugcugcugagcuacagcgacaagaaggaccaccugaccguggaggagcuggcccaguuccugaagguggagcagaagaugaacaacgugaccaccgacuacugccuggacaucaucaagaaguucgaggugagcgaggagaacaaggugaagaacgugcugggcaucgagggcuucaccaacuucaugagaagccccgccugcgacaucuucaacccccugcaccacgagguguaccaggacauggaccagccccugugcaacuacuacaucgccagcagccacaacaccuaccugaccggcgaccagcugcugagccagagcaagguggacauguacgccagagugcugcaggagggcugcagaugcguggagguggacugcugggacggccccgacggcgagcccguggugcaccacggcuacacccugaccagcaagauccuguucagagacgugguggagaccaucaacaagcacgccuucgugaagaacgaguuccccgugauccugagcaucgagaaccacugcagcauccagcagcagagaaagaucgcccaguaccugaagggcaucuucggcgacaagcuggaccugagcagcguggacaccggcgagugcaagcagcugcccagcccccagagccugaagggcaagauccuggugaagggcaagaagcugcccuaccaccugggcgacgacgccgaggagggcgaggugagcgacgaggacagcgccgacgagaucgaggacgagugcaaguucaagcugcacuacagcaacggcaccaccgagcaccagguggagagcuucaucagaaagaagcuggagagccugcugaaggagagccagaucagagacaaggaggaccccgacagcuucaccgugagagcccugcugaaggccacccacgagggccugaacgcccaccugaagcagagccccgacgugaaggagagcggcaagaagagccacggcagaagccugaugaccaacuucggcaagcacaagaagaccaccaagagcagaagcaagagcuacagcaccgacgacgaggaggacacccagcagagcaccggcaaggagggcggccagcuguacagacugggcagaagaagaaagaccaugaagcugugcagagagcugagcgaccuggugguguacaccaacagcguggccgcccaggacaucguggacgacggcaccaccggcaacgugcugagcuucagcgagaccagagcccaccagguggugcagcagaagagcgagcaguucaugaucuacaaccagaagcagcugaccagaaucuaccccagcgccuacagaaucgacagcagcaacuucaacccccugcccuacuggaacgccggcugccagcugguggcccugaacuaccagagcgagggcagaaugaugcagcugaacagagccaaguucaaggccaacggcaacugcggcuacgugcugaagccccagcagaugugcaagggcaccuucaaccccuucagcggcgacccccugcccgccaaccccaagaagcagcugauccugaaggugaucagcggccagcagcugcccaagccccccgacagcauguucggcgacagaggcgagaucaucgaccccuucguggagguggagaucaucggccugcccguggacugcugcaaggaccagaccagagugguggacgacaacggcuucaaccccgugugggaggagacccugaccuucaccgugcacaugcccgagaucgcccuggugagauuccuggugugggaccacgaccccaucggcagagacuucgugggccagagaaccgugaccuucagcagccuggugcccggcuacagacacguguaccuggagggccugaccgaggccagcaucuucgugcacaucaccaucaacgagaucuacggcaaguggagcccccugauccugaaccccagcuacaccauccugcacuuccugggcgccaccaagaacagacagcugcagggccugaagggccuguucaacaagaaccccagacacagcagcagcgagaacaacagccacuacgugagaaagagaagcaucggcgacagaauccugagaagaaccgccagcgcccccgccaagggcagaaagaagagcaagaugggcuuccaggagaugguggagaucaaggacagcgugagcgaggccaccagagaccaggacggcgugcugagaagaaccaccagaagccugcaggccagacccgugagcaugcccguggacagaaaccugcugggcgcccugagccugcccgugagcgagaccgccaaggacaucgagggcaaggagaacagccuggccgaggacaaggacggcagaagaaagggcaaggccagcaucaaggacccccacuuccugaacuucaacaagaagcugagcagcagcagcagcgcccugcugcacaaggacaccagccagggcgacaccaucgugagcaccgcccacaugagcgugaccggcgagcagcugggcaugagcagccccagaggcggcagaaccaccagcaacgccaccagcaacugccaggagaaccccugccccagcaagagccugagccccaagcagcaccuggcccccgaccccguggugaaccccacccaggaccugcacggcgugaagaucaaggagaagggcaaccccgaggacuucguggagggcaagagcauccugagcggcagcgugcugagccacagcaaccuggagaucaagaaccuggagggcaacagaggcaagggcagagccgccaccagcuucagccugagcgacgugagcaugcugugcagcgacauccccgaccugcacagcaccgccauccugcaggagagcgugaucagccaccugaucgacaacgugacccugaccaacgagaacgagcccggcagcagcaucagcgcccugaucggccaguucgacgagaccaacaaccaggcccugaccguggugagccaccugcacaacaccagcgugaugagcggccacugcccccugcccagccugggccugaagaugcccaucaagcacggcuucugcaagggcaagagcaagagcagcuuccugugcagcagccccgagcugaucgcccugagcagcagcgagaccaccaagcacgccaccaacaccguguacgagaccaccugcacccccaucagcaagaccaagcccgacgacgaccugagcagcaaggccaagaccgccgcccuggagagcaaccugcccggcagccccaacaccagcagaggcuggcugcccaagagccccaccaagggcgaggacugggagacccugaagagcugcagccccgccagcagccccgaccugacccuggaggacgugaucgccgaccccacccugugcuucaacagcggcgagagcagccugguggagaucgacggcgagagcgagaaccugagccugaccaccugcgaguacagaagagagggcaccagccagcuggccagcccccugaagcugaaguacaaccagggcgugguggagcacuuccagagaggccugagaaacggcuacugcaaggagacccugagacccagcgugcccgagaucuucaacaacauccaggacgugaagacccagagcaucagcuaccuggccuaccagggcgccggcuucgugcacaaccacuucagcgacagcgacgccaagauguuccagaccugcgugccccagcagagcagcgcccaggacaugcacgugcccgugcccaagcagcuggcccaccugccccugcccgcccugaagcugcccagccccugcaagagcaagagccugggcgaccugaccagcgaggacaucgccugcaacuucgagagcaaguaccagugcaucagcaagagcuucgugaccaccggcaucagagacaagaagggcgugaccgugaagaccaagagccuggagcccaucgacgcccugaccgagcagcugagaaagcuggugagcuucgaccaggaggacaacugccaggugcuguacagcaagcaggacgccaaccagcugcccagagcccuggugagaaagcugagcagcagaagccagagcagagugagaaacaucgccagcagagccaaggagaagcaggaggccaacaagcagaaggugcccaaccccagcaacggcgccggcguggugcugagaaacaagcccagcgcccccacccccgccgugaacagacacagcaccggcagcuacaucgccggcuaccugaagaacaccaagggcggcggccuggagggcagaggcauccccgagggcgccugcaccgcccugcacuacggccacguggaccaguucugcagcgacaacagcgugcugcagaccgagcccagcagcgacgacaagcccgagaucuacuuccugcugagacuguaa

SEQ ID NO: 21638 - RNA, 3288 nt, Artificial Sequence
  PLCL1__Homo_sapiens__NP_006217
auggccgagggcgccgccggcagagaggaccccgccccccccgacgccgccggcggcgaggacgaccccagagugggccccgacgccgccggcgacugcgugaccgccgccagcggcggcagaaugagagacagaagaagcggcguggcccugcccggcgccgccggcacccccgccgacagcgaggccggccugcuggaggccgccagagccacccccagaagaagcagcaucaucaaggaccccagcaaccagaagugcggcggcagaaagaagaccgugagcuucagcagcaugcccagcgagaagaagaucagcagcgccaacgacugcaucagcuucaugcaggccggcugcgagcugaagaaggugagacccaacagcagaaucuacaacagauucuucacccuggacaccgaccugcaggcccugagaugggagcccagcaagaaggaccuggagaaggccaagcuggacaucagcgccaucaaggagaucagacugggcaagaacaccgagaccuucagaaacaacggccuggccgaccagaucugcgaggacugcgccuucagcauccugcacggcgagaacuacgagagccuggaccugguggccaacagcgccgacguggccaacaucugggugagcggccugagauaccuggugagcagaagcaagcagccccuggacuucauggagggcaaccagaacacccccagauucauguggcugaagaccguguucgaggccgccgacguggacggcaacggcaucaugcuggaggacaccagcguggagcugaucaagcagcugaaccccacccugaaggaggccaagaucagacugaaguucaaggagauccagaagagcaaggagaagcugaccaccagagugaccgaggaggaguucugcgaggccuucugcgagcugugcaccagacccgagguguacuuccugcuggugcagaucagcaagaacaaggaguaccuggacgccaacgaccugaugcuguuccuggaggccgagcagggcgugacccacaucaccgaggacaucugccuggacaucaucagaagauacgagcugagcgaggagggcagacagaagggcuuccuggccaucgacggcuucacccaguaccugcugagcagcgagugcgacaucuucgaccccgagcagaagaagguggcccaggacaugacccagccccugagccacuacuacaucaacgccagccacaacaccuaccugaucgaggaccaguucagaggccccgccgacaucaacggcuacaucagagcccugaagaugggcugcagaagcguggagcuggacgugagcgacggcagcgacaacgagcccauccugugcaacagaaacaacaugaccacccacgugagcuucagaagcgugaucgaggugaucaacaaguucgccuucguggccagcgaguacccccugauccugugccugggcaaccacugcagccugccccagcagaaggugauggcccagcagaugaagaagguguucggcaacaagcuguacaccgaggccccccugcccagcgagagcuaccugcccagccccgagaagcugaagagaaugaucaucgugaagggcaagaagcugcccagcgaccccgacgugcuggagggcgaggugaccgacgaggacgaggaggccgagaugagcagaagaaugagcguggacuacaacggcgagcagaagcagaucagacugugcagagagcugagcgaccuggugagcaucugcaagagcgugcaguacagagacuucgagcugagcaugaagagccagaacuacugggagaugugcagcuucagcgagaccgaggccagcagaaucgccaacgaguaccccgaggacuucgugaacuacaacaagaaguuccugagcagaaucuaccccagcgccaugagaaucgacagcagcaaccugaacccccaggacuucuggaacugcggcugccagaucguggccaugaacuuccagacccccggccccaugauggaccugcacaccggcugguuccugcagaacggcggcugcggcuacgugcugagacccagcaucaugagagacgaggugagcuacuucagcgccaacaccaagggcauccugcccggcgugagcccccuggcccugcacaucaagaucaucagcggccagaacuuccccaagcccaagggcgccugcgccaagggcgacgugaucgaccccuacgugugcaucgagauccacggcauccccgccgacugcagcgagcagagaaccaagaccgugcagcagaacagcgacaaccccaucuucgacgagaccuucgaguuccaggugaaccugcccgagcuggccaugaucagauucguggugcuggacgacgacuacaucggcgacgaguucaucggccaguacaccauccccuucgagugccugcagcccggcuacagacacgugccccugagaagcuucgugggcgacaucauggagcacgugacccuguucgugcacaucgccaucaccaacagaagcggcggcggcaaggcccagaagagaagccugagcgugagaaugggcaagaaggugagagaguacaccaugcugagaaacaucggccugaagaccaucgacgacaucuucaagaucgccgugcacccccugagagaggccaucgacaugagagagaacaugcagaacgccaucgugagcaucaaggagcugugcggccugccccccaucgccagccugaagcagugccugcugacccugagcagcagacugaucaccagcgacaacacccccagcgugagccuggugaugaaggacagcuuccccuaccuggagccccugggcgccauccccgacgugcagaagaagaugcugaccgccuacgaccugaugauccaggagagcagauuccugaucgagauggccgacaccgugcaggagaagaucgugcagugccagaaggccggcauggaguuccacgaggagcugcacaaccugggcgccaaggagggccugaagggcagaaagcugaacaaggccaccgagagcuucgccuggaacaucaccgugcugaagggccagggcgaccugcugaagaacgccaagaacgaggccaucgagaacaugaagcagauccagcuggccugccugagcugcggccugagcaaggcccccagcagcagcgccgaggccaagagcaagagaagccuggaggccaucgaggagaaggagagcagcgaggagaacggcaagcuguaa

SEQ ID NO: 21639 - RNA, 3384 nt, Artificial Sequence
  PLCL2__Homo_sapiens__NP_001137854
auggccgagugcggcagaggcggcgccgccggcggcgcccugcccaccagccccggccccgcccugggcgccaagggcgcccugaaggccggcgugggcgagggcggcggcggcggcggcagacugggccacggcagagccagauacgacagcggcggcgugagcaacggcgacugcagccugggcgugagcggcgacgaggccagagccagccccaccagaggccccagaggcguggcccuggcccccacccccagcgccguggugugcacccugcccagagagagcaagcccggcggccugcccagaagaagcagcaucaucaaggacggcaccaagcagaagagagagagaaagaagaccgugagcuucagcagcaugcccaccgagaagaagaucagcagcgccagcgacugcaucaacagcaugguggagggcagcgagcugaagaaggugagaagcaacagcagaaucuaccacagauacuuccugcuggacgccgacaugcagagccugagaugggagcccagcaagaaggacagcgagaaggccaagaucgacaucaagagcaucaaggaggugagaaccggcaagaacaccgacaucuucagaagcaacggcaucagcgaccagaucagcgaggacugcgccuucagcgugaucuacggcgagaacuacgagagccuggaccugguggccaacagcgccgacguggccaacaucugggugaccggccugagauaccugaucagcuacggcaagcacacccuggacaugcuggagagcagccaggacaacaugagaaccagcugggugagccagauguucagcgagaucgacguggacaaccugggccacaucacccugugcaacgccgugcagugcaucagaaaccugaaccccggccugaagaccagcaagaucgagcugaaguucaaggagcugcacaagagcaaggacaaggccggcaccgaggugaccaaggaggaguucaucgagguguuccacgagcugugcaccagacccgagaucuacuuccugcuggugcaguucagcagcaacaaggaguuccuggacaccaaggaccugaugauguuccuggaggccgagcagggcguggcccacaucaacgaggagaucagccuggagaucauccacaaguacgagcccagcaaggagggccaggagaagggcuggcugagcaucgacggcuucaccaacuaccugaugagccccgacugcuacaucuucgaccccgagcacaagaaggugugccaggacaugaagcagccccugagccacuacuucaucaacagcagccacaacaccuaccugaucgaggaccaguucagaggccccagcgacaucaccggcuacaucagagcccugaagaugggcugcagaagcguggagcuggacgugugggacggccccgacaacgagcccgugaucuacaccggccacaccaugaccagccagaucguguucagaagcgugaucgacaucaucaacaaguacgccuucuucgccagcgaguacccccugauccugugccuggagaaccacugcagcaucaagcagcagaaggugauggugcagcacaugaagaagcugcugggcgacaagcuguacaccaccagccccaacguggaggagagcuaccugcccagccccgacgugcugaagggcaagauccugaucaaggccaagaagcugagcagcaacugcagcggcguggagggcgacgugaccgacgaggacgagggcgccgagaugagccagagaaugggcaaggagaacauggagcagcccaacaacgugcccgugaagagauuccagcugugcaaggagcugagcgagcuggugagcaucugcaagagcgugcaguucaaggaguuccaggugagcuuccaggugcagaaguacugggaggugugcagcuucaacgaggugcuggccagcaaguacgccaacgagaaccccggcgacuucgugaacuacaacaagagauuccuggccagaguguuccccagccccaugagaaucgacagcagcaacaugaacccccaggacuucuggaagugcggcugccagaucguggccaugaacuuccagacccccggccugaugauggaccugaacaucggcugguucagacagaacggcaacugcggcuacgugcugagacccgccaucaugagagaggaggugagcuucuucagcgccaacaccaaggacagcgugcccggcgugagcccccagcugcugcacaucaagaucaucagcggccagaacuuccccaagcccaagggcagcggcgccaagggcgacgugguggaccccuacguguacguggagauccacggcauccccgccgacugcgccgagcagagaaccaagaccgugcaccagaacggcgacgcccccaucuucgacgagagcuucgaguuccagaucaaccugcccgagcuggccauggugagauucguggugcuggacgacgacuacaucggcgacgaguucaucggccaguacaccauccccuucgagugccugcagaccggcuacagacacgugccccugcagagccugaccggcgaggugcuggcccacgccagccuguucgugcacguggccaucaccaacagaagaggcggcggcaagccccacaagagaggccugagcgugagaaagggcaagaagagcagagaguacgccagccugagaacccuguggaucaagaccguggacgagguguucaagaacgcccagccccccaucagagacgccaccgaccugagagagaacaugcagaacgccguggugagcuucaaggagcugugcggccugagcagcguggccaaccugaugcagugcaugcuggccgugagccccagauuccugggccccgacaacaccccccugguggugcugaaccugagcgagcaguaccccaccauggagcugcagggcaucgugcccgaggugcugaagaagaucgugaccaccuacgacaugaugauccagagccugaaggcccugaucgagaacgccgacgccguguacgagaagaucgugcacugccagaaggccgccauggaguuccacgagcaccugcacagcaucggcaccaaggagggccugaaggagagaaagcugcagaaggccguggagagcuucaccuggaacaucaccauccugaagggccaggccgaccugcugaaguacgccaagaacgagacccuggagaaccugaagcagauccacuucgccgccgugagcugcggccugaacaagcccggcaccgagaacgccgacgugcagaagcccagaagaagccuggaggugauccccgagaaggccaacgacgagaccggcgaguaa

SEQ ID NO: 21640 - RNA, 918 nt, Artificial Sequence
  PLCXD2__Homo_sapiens__NP_001172035
augcuggccgugagaaaggccagaagaaagcugagaaugggcaccaucugcagccccaaccccagcggcaccaagaccagcagcgaggugugcaacgccgacuggauggccagccugcccccccaccugcacaaccugccccugagcaaccuggccauccccggcagccacgacagcuucagcuacuggguggacgagaagagccccgugggccccgaccagacccaggccaucaagagacuggccagaaucagccuggugaagaagcugaugaagaaguggagcgugacccagaaccugaccuucagagagcagcuggaggccggcaucagauacuucgaccugagagugagcagcaagcccggcgacgccgaccaggagaucuacuucauccacggccuguucggcaucaaggugugggacggccugauggagaucgacagcuuccugacccagcacccccaggagaucaucuuccuggacuucaaccacuucuacgccauggacgagacccaccacaagugccuggugcugagaauccaggaggccuucggcaacaagcugugccccgccugcagcguggagagccugacccugagaacccugugggagaagaacugccaggugcugaucuucuaccacugccccuucuacaagcaguaccccuuccuguggcccggcaagaagauccccgcccccugggccaacaccaccagcgugagaaagcugauccuguuccuggagaccacccugagcgagagagccagcagaggcagcuuccacgugagccaggccauccugacccccagagugaagaccaucgccagaggccuggugggcggccugaagaacacccuggugcacagcaacagauggaacagccacggccccagccugcugagccaggagagaagcuaa

SEQ ID NO: 21641 - RNA, 966 nt, Artificial Sequence
  PLCXD3__Homo_sapiens__NP_001005473
auggccagcagccagggcaagaacgagcugaagcuggccgacuggauggccacccugcccgagagcaugcacagcaucccccugaccaaccuggccauccccggcagccacgacagcuucagcuucuacaucgacgaggccagccccgugggccccgagcagcccgagaccgugcagaacuucgugagcguguucggcaccguggccaagaagcugaugagaaaguggcuggccacccagaccaugaacuucaccggccagcugggcgccggcaucagauacuucgaccugagaaucagcaccaagcccagagaccccgacaacgagcuguacuucgcccacggccuguucagcgccaaggugaacgagggccuggaggagaucaacgccuuccugaccgaccaccacaaggaggugguguuccuggacuucaaccacuucuacggcaugcagaaguaccaccacgagaagcuggugcagaugcugaaggacaucuacggcaacaagaugugccccgccaucuucgcccaggaggugagccugaaguaccugugggagaaggacuaccaggugcugguguucuaccacagccccguggcccuggaggugcccuuccuguggcccggccagaugaugcccgcccccugggccaacaccaccgaccccgagaagcugauccaguuccugcaggccagcaucaccgagagaagaaagaagggcagcuucuucaucagccagguggugcugacccccaaggccagcaccguggugaagggcguggccagcggccugagagagaccaucaccgagagagcccugcccgccaugaugcagugggugagaacccagaagcccggcgagagcggcaucaacaucgugaccgccgacuucguggagcugggcgacuucaucagcaccgugaucaagcugaacuacguguucgacgagggcgaggccaacaccuaa

SEQ ID NO: 21642 - RNA, 1827 nt, Artificial Sequence
  PLCZ1__Homo_sapiens__NP_149114
auggagaugagaugguuccugagcaagauccaggacgacuucagaggcggcaagaucaaccuggagaagacccagagacugcuggagaagcuggacaucagaugcagcuacauccacgugaagcagaucuucaaggacaacgacagacugaagcagggcagaaucaccaucgaggaguucagagccaucuacagaaucaucacccacagagaggagaucaucgagaucuucaacaccuacagcgagaacagaaagauccugcuggccagcaaccuggcccaguuccugacccaggagcaguacgccgccgagaugagcaaggccaucgccuucgagaucauccagaaguacgagcccaucgaggaggugagaaaggcccaccagaugagccuggagggcuucaccagauacauggacagcagagagugccugcuguucaagaacgagugcagaaagguguaccaggacaugacccacccccugaacgacuacuucaucagcagcagccacaacaccuaccuggugagcgaccagcugcugggccccagcgaccuguggggcuacgugagcgcccuggugaagggcugcagaugccuggagaucgacugcugggacggcgcccagaacgagcccgugguguaccacggcuacacccugaccagcaagcugcuguucaagaccgugauccaggccauccacaaguacgccuucaugaccagcgacuaccccguggugcugagccuggagaaccacugcagcaccgcccagcaggaggugauggccgacaaccugcaggccaccuucggcgagagccugcugagcgacaugcuggacgacuuccccgacacccugcccagccccgaggcccugaaguucaagauccuggugaagaacaagaagaucggcacccugaaggagacccacgagagaaagggcagcgacaagagaggcgacaaccaggacaaggagaccggcgugaagaagcugcccggcgugaugcuguucaagaagaagaagaccagaaagcugaagaucgcccuggcccugagcgaccuggugaucuacaccaaggccgagaaguucaagagcuuccagcacagcagacuguaccagcaguucaacgagaacaacagcaucggcgagacccaggccagaaagcugagcaagcugagagugcacgaguucaucuuccacaccagaaaguucaucaccagaaucuaccccaaggccaccagagccgacagcagcaacuucaacccccaggaguucuggaacaucggcugccagaugguggcccugaacuuccagacccccggccugcccauggaccugcagaacggcaaguuccuggacaacggcggcagcggcuacauccugaagccccacuuccugagagagagcaagagcuacuucaaccccagcaacaucaaggagggcaugcccaucacccugaccaucagacugaucagcggcauccagcugccccugacccacagcagcagcaacaagggcgacagccuggugaucaucgagguguucggcgugcccaacgaccagaugaagcagcagaccagagugaucaagaagaacgccuucagccccagauggaacgagaccuucaccuucaucauccacgugcccgagcuggcccugaucagauucgugguggagggccagggccugaucgccggcaacgaguuccugggccaguacacccugccccugcugugcaugaacaagggcuacagaagaaucccccuguucagcagaaugggcgagagccuggagcccgccagccuguucguguacgugugguacgugagauaa

SEQ ID NO: 21643 - RNA, 3111 nt, Artificial Sequence
  PLD1__Homo_sapiens__NP_001123553
augagccugaagaacgagcccagagugaacaccagcgcccugcagaagaucgccgccgacaugagcaacaucaucgagaaccuggacaccagagagcugcacuucgagggcgaggagguggacuacgacgugagccccagcgaccccaagauccaggagguguacauccccuucagcgccaucuacaacacccagggcuucaaggagcccaacauccagaccuaccugagcggcugccccaucaaggcccaggugcuggagguggagagauucaccagcaccaccagagugcccagcaucaaccuguacaccaucgagcugacccacggcgaguucaaguggcaggugaagagaaaguucaagcacuuccaggaguuccacagagagcugcugaaguacaaggccuucaucagaauccccauccccaccagaagacacaccuucagaagacagaacgugagagaggagcccagagagaugcccagccugcccagaagcagcgagaacaugaucagagaggagcaguuccugggcagaagaaagcagcuggaggacuaccugaccaagauccugaagaugcccauguacagaaacuaccacgccaccaccgaguuccuggacaucagccagcugagcuucauccacgaccugggccccaagggcaucgagggcaugaucaugaagagaagcggcggccacagaauccccggccugaacugcugcggccagggcagagccugcuacagauggagcaagagauggcugaucgugaaggacagcuuccugcuguacaugaagcccgacagcggcgccaucgccuucgugcugcugguggacaaggaguucaagaucaaggugggcaagaaggagaccgagaccaaguacggcaucagaaucgacaaccugagcagaacccugauccugaagugcaacagcuacagacacgccagaugguggggcggcgccaucgaggaguucauccagaagcacggcaccaacuuccugaaggaccacagauucggcagcuacgccgccauccaggagaacgcccuggccaagugguacgugaacgccaagggcuacuucgaggacguggccaacgccauggaggaggccaacgaggagaucuucaucaccgacugguggcugagccccgagaucuuccugaagagacccgugguggagggcaacagauggagacuggacugcauccugaagagaaaggcccagcagggcgugagaaucuucaucaugcuguacaaggagguggagcuggcccugggcaucaacagcgaguacaccaagagaacccugaugagacugcaccccaacaucaaggugaugagacaccccgaccacgugagcagcaccguguaccugugggcccaccacgagaagcuggugaucaucgaccagagcguggccuucgugggcggcaucgaccuggccuacggcagaugggacgacaacgagcacagacugaccgacgugggcagcgugaagagagugaccagcggccccagccugggcagccugccccccgccgccauggagagcauggagagccugagacugaaggacaagaacgagcccgugcagaaccugcccauccagaagagcaucgacgacguggacagcaagcugaagggcaucggcaagcccagaaaguucagcaaguucagccuguacaagcagcugcacagacaccaccugcacgacgccgacagcaucagcagcaucgacagcaccagcaacaccggcagcaucagaagccugcagaccggcgugggcgagcugcacggcgagaccagauucuggcacggcaaggacuacugcaacuucguguucaaggacugggugcagcuggacaagcccuucgccgacuucaucgacagauacagcacccccagaaugcccuggcacgacaucgccagcgccgugcacggcaaggccgccagagacguggccagacacuucauccagagauggaacuucaccaagaucaugaagagcaaguacagaagccugagcuaccccuuccugcugcccaagagccagaccaccgcccacgagcugagauaccaggugcccggcagcgugcacgccaacgugcagcugcugagaagcgccgccgacuggagcgccggcaucaaguaccacgaggagagcauccacgccgccuacgugcacgugaucgagaacagcagacacuacaucuacaucgagaaccaguucuucaucagcugcgccgacgacaaggugguguucaacaagaucggcgacgccaucgcccagagaauccugaaggcccacagagagaaccagaaguacagaguguacguggugaucccccugcugcccggcuucgagggcgacaucagcaccggcggcggcaacgcccugcaggccaucaugcacuucaacuacagaaccaugugcagaggcgagaacagcauccugggccagcugaaggccgagcugggcaaccaguggaucaacuacaucagcuucugcggccugagaacccacgccgagcuggagggcaaccuggugaccgagcugaucuacgugcacagcaagcugcugaucgccgacgacaacaccgugaucaucggcagcgccaacaucaacgacagaagcaugcugggcaagagagacagcgagauggccgugaucgugcaggacaccgagaccgugcccagcgugauggacggcaaggaguaccaggccggcagauucgccagaggccugagacugcagugcuucagaguggugcugggcuaccuggacgaccccagcgaggacauccaggaccccgugagcgacaaguucuucaaggaggugugggugagcaccgccgccagaaacgccaccaucuacgacaagguguucagaugccugcccaacgacgaggugcacaaccugauccagcugagagacuucaucaacaagcccgugcuggccaaggaggaccccaucagagccgaggaggagcugaagaagaucagaggcuuccuggugcaguuccccuucuacuuccugagcgaggagagccugcugcccagcgugggcaccaaggaggccaucgugcccauggagguguggaccuaa

SEQ ID NO: 21644 - RNA, 2769 nt, Artificial Sequence
  PLD2__Homo_sapiens__NP_001230037
augaccgccacccccgagagccuguuccccaccggcgacgagcuggacagcagccagcugcagauggagagcgacgagguggacacccugaaggagggcgaggaccccgccgacagaaugcaccccuuccuggccaucuacgagcugcagagccugaaggugcacccccugguguucgcccccggcgugcccgugaccgcccagguggugggcaccgagagauacaccagcggcagcaaggugggcaccugcacccuguacagcgugagacugacccacggcgacuucagcuggaccaccaagaagaaguacagacacuuccaggagcugcacagagaccugcugagacacaaggugcugaugagccugcugccccuggccagauucgccguggccuacagccccgccagagacgccggcaacagagagaugcccagccugcccagagccggccccgagggcagcaccagacacgccgccagcaagcagaaguaccuggagaacuaccugaacagacugcugaccaugagcuucuacagaaacuaccacgccaugaccgaguuccuggaggugagccagcugagcuucauccccgaccugggcagaaagggccuggagggcaugaucagaaagagaagcggcggccacagagugcccggccugaccugcugcggcagagaccaggugugcuacagauggagcaagagauggcugguggugaaggacagcuuccugcuguacaugugccuggagaccggcgccaucagcuucgugcagcuguucgaccccggcuucgaggugcaggugggcaagagaagcaccgaggccagacacggcgugagaaucgacaccagccacagaagccugauccugaagugcagcagcuacagacaggccagauggugggcccaggagaucaccgagcuggcccagggccccggcagagacuuccugcagcugcacagacacgacagcuacgccccccccagacccggcacccuggccagaugguucgugaacggcgccggcuacuucgccgccguggccgacgccauccugagagcccaggaggagaucuucaucaccgacugguggcugagccccgagguguaccugaagagacccgcccacagcgacgacuggagacuggacaucaugcugaagagaaaggccgaggagggcgugagagugagcauccugcuguucaaggagguggagcuggcccugggcaucaacagcggcuacagcaagagagcccugaugcugcugcaccccaacaucaaggugaugagacaccccgaccaggugacccugugggcccaccacgagaagcugcuggugguggaccaggugguggccuuccugggcggccuggaccuggccuacggcagaugggacgaccugcacuacagacugaccgaccugggcgacagcagcgagagcgccgccagccagccccccacccccagacccgacagccccgccacccccgaccugagccacaaccaguucuucuggcugggcaaggacuacagcaaccugaucaccaaggacugggugcagcuggacagacccuucgaggacuucaucgacagagagaccacccccagaaugcccuggagagacgugggcgugguggugcacggccugcccgccagagaccuggccagacacuucauccagagauggaacuucaccaagaccaccaaggccaaguacaagacccccaccuaccccuaccugcugcccaagagcaccagcaccgccaaccagcugcccuucacccugcccggcggccagugcaccaccgugcaggugcugagaagcguggacagauggagcgccggcacccuggagaacagcauccugaacgccuaccugcacaccaucagagagagccagcacuuccuguacaucgagaaccaguucuucaucagcugcagcgacggcagaaccgugcugaacaaggugggcgacgagaucguggacagaauccugaaggcccacaagcagggcuggugcuacagaguguacgugcugcugccccugcugcccggcuucgagggcgacaucagcaccggcggcggcaacagcauccaggccauccugcacuucaccuacagaacccugugcagaggcgaguacagcauccugcacagacugaaggccgccaugggcaccgccuggagagacuacaucagcaucugcggccugagaacccacggcgagcugggcggccaccccgugagcgagcugaucuacauccacagcaaggugcugaucgccgacgacagaaccgugaucaucggcagcgccaacaucaacgacagaagccugcugggcaagagagacagcgagcuggccgugcugaucgaggacaccgagaccgagcccagccugaugaacggcgccgaguaccaggccggcagcgugauccugggcgccaacaccagacccgaccuggaccugagagaccccaucugcgacgacuucuuccagcuguggcaggacauggccgagagcaacgccaacaucuacgagcagaucuucagaugccugcccagcaacgccaccagaagccugagaacccugagagaguacguggccguggagccccuggccaccgugagccccccccuggccagaagcgagcugacccaggugcagggccaccuggugcacuucccccugaaguuccuggaggacgagagccugcugcccccccugggcagcaaggagggcaugaucccccuggagguguggaccuaa

SEQ ID NO: 21645 - RNA, 1473 nt, Artificial Sequence
  PLD3__Homo_sapiens__NP_001026866
augaagcccaagcugauguaccaggagcugaaggugcccgccgaggagcccgccaacgagcugcccaugaacgagaucgaggccuggaaggccgccgagaagaaggccagaugggugcugcuggugcugauccuggccguggugggcuucggcgcccugaugacccagcuguuccugugggaguacggcgaccugcaccuguucggccccaaccagagacccgcccccugcuacgaccccugcgaggccgugcugguggagagcauccccgagggccuggacuuccccaacgccagcaccggcaaccccagcaccagccaggccuggcugggccugcuggccggcgcccacagcagccuggacaucgccagcuucuacuggacccugaccaacaacgacacccacacccaggagcccagcgcccagcagggcgaggaggugcugagacagcugcagacccuggcccccaagggcgugaacgugagaaucgccgugagcaagcccagcggcccccagccccaggccgaccugcaggcccugcugcagagcggcgcccaggugagaaugguggacaugcagaagcugacccacggcgugcugcacaccaaguucugggugguggaccagacccacuucuaccugggcagcgccaacauggacuggagaagccugacccaggugaaggagcugggcguggugauguacaacugcagcugccuggccagagaccugaccaagaucuucgaggccuacugguuccugggccaggccggcagcagcauccccagcaccuggcccagauucuacgacaccagauacaaccaggagacccccauggagaucugccugaacggcacccccgcccuggccuaccuggccagcgccccccccccccugugccccagcggcagaacccccgaccugaaggcccugcugaacgugguggacaacgccagaagcuucaucuacguggccgugaugaacuaccugcccacccuggaguucagccacccccacagauucuggcccgccaucgacgacggccugagaagagccaccuacgagagaggcgugaaggugagacugcugaucagcugcuggggccacagcgagcccagcaugagagccuuccugcugagccuggccgcccugagagacaaccacacccacagcgacauccaggugaagcuguucguggugcccgccgacgaggcccaggccagaauccccuacgccagagugaaccacaacaaguacauggugaccgagagagccaccuacaucggcaccagcaacuggagcggcaacuacuucaccgagaccgccggcaccagccugcuggugacccagaacggcagaggcggccugagaagccagcuggaggccaucuuccugagagacugggacagccccuacagccacgaccuggacaccagcgccgacagcgugggcaacgccugcagacugcuguaa

SEQ ID NO: 21646 - RNA, 1521 nt, Artificial Sequence
  PLD4__Homo_sapiens__NP_620145
augcugaagccccuguggaaggccgccguggcccccaccuggcccugcagcaugccccccagaagacccugggacagagaggccggcacccugcaggugcugggcgcccuggccgugcuguggcugggcagcguggcccugaucugccugcuguggcaggugcccagaccccccaccuggggccaggugcagcccaaggacgugcccagaagcugggagcacggcagcagccccgccugggagccccuggaggccgaggccagacagcagagagacagcugccagcuggugcugguggagagcaucccccaggaccugcccagcgccgccggcagccccagcgcccagccccugggccaggccuggcugcagcugcuggacaccgcccaggagagcgugcacguggccagcuacuacuggagccugaccggccccgacaucggcgugaacgacagcagcagccagcugggcgaggcccugcugcagaagcugcagcagcugcugggcagaaacaucagccuggccguggccaccagcagccccacccuggccagaaccagcaccgaccugcaggugcuggccgccagaggcgcccacgugagacaggugcccaugggcagacugaccagaggcgugcugcacagcaaguucugggugguggacggcagacacaucuacaugggcagcgccaacauggacuggagaagccugacccaggugaaggagcugggcgccgugaucuacaacugcagccaccuggcccaggaccuggagaagaccuuccagaccuacugggugcugggcgugcccaaggccgugcugcccaagaccuggccccagaacuucagcagccacuucaacagauuccagcccuuccacggccuguucgacggcgugcccaccaccgccuacuucagcgccagcccccccgcccugugcccccagggcagaaccagagaccuggaggcccugcuggccgugaugggcagcgcccaggaguucaucuacgccagcgugauggaguacuuccccaccaccagauucagccacccccccagauacuggcccgugcuggacaacgcccugagagccgccgccuucggcaagggcgugagagugagacugcuggugggcugcggccugaacaccgaccccaccauguuccccuaccugagaagccugcaggcccugagcaaccccgccgccaacgugagcguggacgugaagguguucaucgugcccgugggcaaccacagcaacauccccuucagcagagugaaccacagcaaguucauggugaccgagaaggccgccuacaucggcaccagcaacuggagcgaggacuacuucagcagcaccgccggcgugggccugguggugacccagagccccggcgcccagcccgccggcgccaccgugcaggagcagcugagacagcuguucgagagagacuggagcagcagauacgccgugggccuggacggccaggcccccggccaggacugcguguggcagggcuaa

SEQ ID NO: 21647 - RNA, 1425 nt, Artificial Sequence
  PLD5__Homo_sapiens__NP_001182740
augagccagcagaagugcaucgugaucuucgcccuggugugcugcuucgccauccugguggcccugaucuucagcgccguggacaucaugggcgaggacgaggacggccugagcgagaagaacugccagaacaagugcagaaucgcccugguggagaacauccccgagggccugaacuacagcgagaacgcccccuuccaccugagccuguuccagggcuggaugaaccugcugaacauggccaagaagagcguggacaucgugagcagccacugggaccugaaccacacccaccccagcgccugccagggccagagacuguucgagaagcugcugcagcugaccagccagaacaucgagaucaagcuggugagcgacgugaccgccgacagcaaggugcuggaggcccugaagcugaagggcgccgaggugaccuacaugaacaugaccgccuacaacaagggcagacugcagagcagcuucuggaucguggacaagcagcacguguacaucggcagcgccggccuggacuggcagagccugggccagaugaaggagcugggcgugaucuucuacaacugcagcugccuggugcuggaccugcagagaaucuucgcccuguacagcagccugaaguucaagagcagagugccccagaccuggagcaagagacuguacggcguguacgacaacgagaagaagcugcagcugcagcugaacgagaccaagagccaggccuucgugagcaacagccccaagcuguucugccccaagaacagaagcuucgacaucgacgccaucuacagcgugaucgacgacgccaagcaguacguguacaucgccgugauggacuaccugcccaucagcagcaccagcaccaagagaaccuacuggcccgaccuggacgccaagaucagagaggcccuggugcugagaagcgugagagugagacugcugcugagcuucuggaaggagaccgacccccugaccuucaacuucaucagcagccugaaggccaucugcaccgagaucgccaacugcagccugaaggugaaguucuucgaccuggagagagagaacgccugcgccaccaaggagcagaagaaccacaccuuccccagacugaacagaaacaaguacauggugaccgacggcgccgccuacaucggcaacuucgacugggugggcaacgacuucacccagaacgccggcaccggccuggugaucaaccaggccgacgugagaaacaacagaagcaucaucaagcagcugaaggacguguucgagagagacugguacagccccuacgccaagacccugcagcccaccaagcagcccaacugcagcagccuguucaagcugaagccccugagcaacaagaccgccaccgacgacaccggcggcaaggaccccagaaacguguaa

SEQ ID NO: 21648 - RNA, 13725 nt, Artificial Sequence
  PLEC__Homo_sapiens__NP_000436
augagcggcgaggacgccgaggugagagccgugagcgaggacgugagcaacggcagcagcggcagccccagccccggcgacacccugcccuggaaccugggcaagacccagagaagcagaagaagcggcggcggcgccggcagcaacggcagcgugcuggaccccgccgagagagccgugaucagaaucgccgacgagagagacagagugcagaagaagaccuucaccaagugggugaacaagcaccugaucaaggcccagagacacaucagcgaccuguacgaggaccugagagacggccacaaccugaucagccugcuggaggugcugagcggcgacagccugcccagagagaagggcagaaugagauuccacaagcugcagaacgugcagaucgcccuggacuaccugagacacagacaggugaagcuggugaacaucagaaacgacgacaucgccgacggcaaccccaagcugacccugggccugaucuggaccaucauccugcacuuccagaucagcgacauccaggugagcggccagagcgaggacaugaccgccaaggagaagcugcugcuguggagccagagaaugguggagggcuaccagggccugagaugcgacaacuucaccagcagcuggagagacggcagacuguucaacgccaucauccacagacacaagccccugcugaucgacaugaacaagguguacagacagaccaaccuggagaaccuggaccaggccuucagcguggccgagagagaccugggcgugaccagacugcuggaccccgaggacguggacgugccccagcccgacgagaagagcaucaucaccuacgugagcagccuguacgacgccaugcccagagugcccgacgugcaggacggcgugagagccaacgagcugcagcugagauggcaggaguacagagagcuggugcugcugcugcugcaguggaugagacaccacaccgccgccuucgaggagagaagauuccccagcagcuucgaggagaucgagauccuguggagccaguuccugaaguucaaggagauggagcugcccgccaaggaggccgacaagaacagaagcaagggcaucuaccagagccuggagggcgccgugcaggccggccagcugaaggugccccccggcuaccacccccuggacguggagaaggaguggggcaagcugcacguggccauccuggagagagagaagcagcugagaagcgaguucgagagacuggagugccugcagagaaucgugaccaagcugcagauggaggccggccugugcgaggagcagcugaaccaggccgacgcccugcugcagagcgacgugagacugcuggccgccggcaaggugccccagagagccggcgagguggagagagaccuggacaaggccgacagcaugaucagacugcuguucaacgacgugcagacccugaaggacggcagacacccccagggcgagcagauguacagaagaguguacagacugcacgagagacugguggccaucagaaccgaguacaaccugagacugaaggccggcguggccgcccccgccacccagguggcccaggugacccugcagagcgugcagagaagacccgagcuggaggacagcacccugagauaccugcaggaccugcuggccuggguggaggagaaccagcacagaguggacggcgccgaguggggcguggaccugcccagcguggaggcccagcugggcagccacagaggccugcaccagagcaucgaggaguucagagccaagaucgagagagccagaagcgacgagggccagcugagccccgccaccagaggcgccuacagagacugccugggcagacuggaccugcaguacgccaagcugcugaacagcagcaaggccagacugagaagccuggagagccugcacagcuucguggccgccgccaccaaggagcugauguggcugaacgagaaggaggaggaggaggugggcuucgacuggagcgacagaaacaccaacaugaccgccaagaaggagagcuacagcgcccugaugagagagcuggagcugaaggagaagaagaucaaggagcugcagaacgccggcgacagacugcugagagaggaccaccccgccagacccaccguggagagcuuccaggccgcccugcagacccaguggagcuggaugcugcagcugugcugcugcaucgaggcccaccugaaggagaacgccgccuacuuccaguucuucagcgacgugagagaggccgagggccagcugcagaagcugcaggaggcccugagaagaaaguacagcugcgacagaagcgccaccgugaccagacuggaggaccugcugcaggacgcccaggacgagaaggagcagcugaacgaguacaagggccaccugagcggccuggccaagagagccaaggccguggugcagcugaagcccagacaccccgcccaccccaugagaggcagacugccccugcuggccgugugcgacuacaagcagguggaggugaccgugcacaagggcgacgagugccagcuggugggccccgcccagcccagccacuggaaggugcugagcagcagcggcagcgaggccgccgugcccagcgugugcuuccuggugcccccccccaaccaggaggcccaggaggccgugaccagacuggaggcccagcaccaggcccuggugacccuguggcaccagcugcacguggacaugaagagccugcuggccuggcagagccugagaagagacgugcagcugaucagaagcuggagccuggccaccuucagaacccugaagcccgaggagcagagacaggcccugcacagccuggagcugcacuaccaggccuuccugagagacagccaggacgccggcggcuucggccccgaggacagacugauggccgagagagaguacggcagcugcagccaccacuaccagcagcugcugcagagccuggagcagggcgcccaggaggagagcagaugccagagaugcaucagcgagcugaaggacaucagacugcagcuggaggccugcgagaccagaaccgugcacagacugagacugccccuggacaaggagcccgccagagagugcgcccagagaaucgccgagcagcagaaggcccaggccgagguggagggccugggcaagggcguggccagacugagcgccgaggccgagaaggugcuggcccugcccgagcccagccccgccgcccccacccugagaagcgagcuggagcugacccugggcaagcuggagcaggugagaagccugagcgccaucuaccuggagaagcugaagaccaucagccuggugaucagaggcacccagggcgccgaggaggugcugagagcccacgaggagcagcugaaggaggcccaggccgugcccgccacccugcccgagcuggaggccaccaaggccagccugaagaagcugagagcccaggccgaggcccagcagcccaccuucgacgcccugagagacgagcugagaggcgcccaggaggugggcgagagacugcagcagagacacggcgagagagacguggagguggagagauggagagagagaguggcccagcugcuggagagauggcaggccgugcuggcccagaccgacgugagacagagagagcuggagcagcugggcagacagcugagauacuacagagagagcgccgacccccugggcgccuggcugcaggacgccagaagaagacaggagcagauccaggccaugccccuggccgacagccaggccgugagagagcagcugagacaggagcaggcccugcuggaggagaucgagagacacggcgagaagguggaggagugccagagauucgccaagcaguacaucaacgccaucaaggacuacgagcugcagcuggugaccuacaaggcccagcuggagcccguggccagccccgccaagaagcccaaggugcagagcggcagcgagagcgugauccaggaguacguggaccugagaacccacuacagcgagcugaccacccugaccagccaguacaucaaguucaucagcgagacccugagaagaauggaggaggaggagagacuggccgagcagcagagagccgaggagagagagagacuggccgagguggaggccgcccuggagaagcagagacagcuggccgaggcccacgcccaggccaaggcccaggccgagagagaggccaaggagcugcagcagagaaugcaggaggagguggugagaagagaggaggccgccguggacgcccagcagcagaagagaagcauccaggaggagcugcagcagcugagacagagcagcgaggccgagauccaggccaaggccagacaggccgaggccgccgagagaagcagacugagaaucgaggaggagaucagaguggugagacugcagcuggaggccaccgagagacagagaggcggcgccgagggcgagcugcaggcccugagagccagagccgaggaggccgaggcccagaagagacaggcccaggaggaggccgagagacugagaagacaggugcaggacgagagccagagaaagagacaggccgagguggagcuggccagcagagugaaggccgaggccgaggccgccagagagaagcagagagcccugcaggcccuggaggagcugagacugcaggccgaggaggccgagagaagacugagacaggccgagguggagagagccagacaggugcagguggcccuggagaccgcccagagaagcgccgaggccgagcugcagagcaagagagccagcuucgccgagaagaccgcccagcuggagagaagccugcaggaggagcacguggccguggcccagcugagagaggaggccgagagaagagcccagcagcaggccgaggccgagagagccagagaggaggccgagagagagcuggagagauggcagcugaaggccaacgaggcccugagacugagacugcaggccgaggagguggcccagcagaagagccuggcccaggccgaggccgagaagcagaaggaggaggccgagagagaggccagaagaagaggcaaggccgaggagcaggccgugagacagagagagcuggccgagcaggagcuggagaagcagagacagcuggccgagggcaccgcccagcagagacuggccgccgagcaggagcugaucagacugagagccgagaccgagcagggcgagcagcagagacagcugcuggaggaggagcuggccagacugcagagagaggccgccgccgccacccagaagagacaggagcuggaggccgagcuggccaaggugagagccgagauggaggugcugcuggccagcaaggccagagccgaggaggagagcagaagcaccagcgagaagagcaagcagagacuggaggccgaggccggcagauucagagagcuggccgaggaggccgccagacugagagcccuggccgaggaggccaagagacagagacagcuggccgaggaggacgccgccagacagagagccgaggccgagagagugcuggccgagaagcuggccgccaucggcgaggccaccagacugaagaccgaggccgagaucgcccugaaggagaaggaggccgagaacgagagacugagaagacuggccgaggacgaggccuuccagagaagaagacuggaggagcaggccgcccagcacaaggccgacaucgaggagagacuggcccagcugagaaaggccagcgacagcgagcuggagagacagaagggccugguggaggacacccugagacagagaagacagguggaggaggagauccuggcccugaaggccagcuucgagaaggccgccgccggcaaggccgagcuggagcuggagcugggcagaaucagaagcaacgccgaggacacccugagaagcaaggagcaggccgagcuggaggccgccagacagagacagcuggccgccgaggaggagagaagaagaagagaggccgaggagagagugcagaagagccuggccgccgaggaggaggccgccagacagagaaaggccgcccuggaggagguggagagacugaaggccaagguggaggaggccagaagacugagagagagagccgagcaggagagcgccagacagcugcagcuggcccaggaggccgcccagaagagacugcaggccgaggagaaggcccacgccuucgccgugcagcagaaggagcaggagcugcagcagacccugcagcaggagcagagcgugcuggaccagcugagaggcgaggccgaggccgccagaagagccgccgaggaggccgaggaggccagagugcaggccgagagagaggccgcccagagcagaagacagguggaggaggccgagagacugaagcagagcgccgaggagcaggcccaggccagagcccaggcccaggccgccgccgagaagcugagaaaggaggccgagcaggaggccgccagaagagcccaggccgagcaggccgcccugagacagaagcaggccgccgacgccgagauggagaagcacaagaaguucgccgagcagacccugagacagaaggcccagguggagcaggagcugaccacccugagacugcagcuggaggagaccgaccaccagaagaaccugcuggacgaggagcugcagagacugaaggccgaggccaccgaggccgccagacagagaagccagguggaggaggagcuguucagcgugagagugcagauggaggagcugagcaagcugaaggccagaaucgaggccgagaacagagcccugauccugagagacaaggacaacacccagagauuccugcaggaggaggccgagaagaugaagcagguggccgaggaggccgccagacugagcguggccgcccaggaggccgccagacugagacagcuggccgaggaggaccuggcccagcagagagcccuggccgagaagaugcugaaggagaagaugcaggccgugcaggaggccaccagacugaaggccgaggccgagcugcugcagcagcagaaggagcuggcccaggagcaggccagaagacugcaggaggacaaggagcagauggcccagcagcuggccgaggagacccagggcuuccagagaacccuggaggccgagagacagagacagcuggagaugagcgccgaggccgagagacugaagcugagaguggccgagaugagcagagcccaggccagagccgaggaggacgcccagagauucagaaagcaggccgaggagaucggcgagaagcugcacagaaccgagcuggccacccaggagaaggugacccuggugcagacccuggagauccagagacagcagagcgaccacgacgccgagagacugagagaggccaucgccgagcuggagagagagaaggagaagcugcagcaggaggccaagcugcugcagcugaagagcgaggagaugcagaccgugcagcaggagcagcugcugcaggagacccaggcccugcagcagagcuuccugagcgagaaggacagccugcugcagagagagagauucaucgagcaggagaaggccaagcuggagcagcuguuccaggacgagguggccaaggcccagcagcugagagaggagcagcagagacagcagcagcagauggagcaggagagacagagacugguggccagcauggaggaggccagaagaagacagcacgaggccgaggagggcgugagaagaaagcaggaggagcugcagcagcuggagcagcagagaagacagcaggaggagcugcuggccgaggagaaccagagacugagagagcagcugcagcugcuggaggagcagcacagagccgcccuggcccacagcgaggaggugaccgccagccagguggccgccaccaagacccugcccaacggcagagacgcccuggacggccccgccgccgaggccgagcccgagcacagcuucgacggccugagaagaaaggugagcgcccagagacugcaggaggccggcauccugagcgccgaggagcugcagagacuggcccagggccacaccaccguggacgagcuggccagaagagaggacgugagacacuaccugcagggcagaagcagcaucgccggccugcugcugaaggccaccaacgagaagcugagcguguacgccgcccugcagagacagcugcugagccccggcaccgcccugauccugcuggaggcccaggccgccagcggcuuccugcuggaccccgugagaaacagaagacugaccgugaacgaggccgugaaggagggcguggugggccccgagcugcaccacaagcugcugagcgccgagagagccgugaccggcuacaaggaccccuacaccggccagcagaucagccuguuccaggccaugcagaagggccugaucgugagagagcacggcaucagacugcuggaggcccagaucgccaccggcggcgugaucgaccccgugcacagccacagagugcccguggacguggccuacagaagaggcuacuucgacgaggagaugaacagagugcuggccgaccccagcgacgacaccaagggcuucuucgaccccaacacccacgagaaccugaccuaccugcagcugcuggagagaugcguggaggaccccgagaccggccugugccugcugccccugaccgacaaggccgccaagggcggcgagcugguguacaccgacagcgaggccagagacguguucgagaaggccaccgugagcgcccccuucggcaaguuccagggcaagaccgugaccaucugggagaucaucaacagcgaguacuucaccgccgagcagagaagagaccugcugagacaguucagaaccggcagaaucaccguggagaagaucaucaagaucaucaucaccgugguggaggagcaggagcagaagggcagacugugcuucgagggccugagaagccuggugcccgccgccgagcugcuggagagcagagugaucgacagagagcuguaccagcagcugcagagaggcgagagaagcgugagagacguggccgagguggacaccgugagaagagcccugagaggcgccaacgugaucgccggcguguggcuggaggaggccggccagaagcugagcaucuacaacgcccugaagaaggaccugcugcccagcgacauggccguggcccugcuggaggcccaggccggcaccggccacaucaucgaccccgccaccagcgccagacugaccguggacgaggccgugagagccggccuggugggccccgaguuccacgagaagcugcugagcgccgagaaggccgugaccggcuacagagaccccuacaccggccagagcgugagccuguuccaggcccugaagaagggccugauccccagagagcagggccugagacugcuggacgcccagcugagcaccggcggcaucguggaccccagcaagagccacagagugccccuggacguggccugcgccagaggcugccuggacgaggagaccagcagagcccugagcgcccccagagccgacgccaaggccuacagcgaccccagcaccggcgagcccgccaccuacggcgagcugcagcagagaugcagacccgaccagcugaccggccugagccugcugccccugagcgagaaggccgccagagccagacaggaggagcuguacagcgagcugcaggccagagagaccuucgagaagacccccguggaggugcccgugggcggcuucaagggcagaaccgugaccgugugggagcugaucagcagcgaguacuucaccgccgagcagagacaggagcugcugagacaguucagaaccggcaaggugaccguggagaaggugaucaagauccugaucaccaucguggaggagguggagacccugagacaggagagacugagcuucagcggccugagagcccccgugcccgccagcgagcugcuggccagcggcgugcugagcagagcccaguucgagcagcugaaggacggcaagaccaccgugaaggaccugagcgagcugggcagcgugagaacccugcugcagggcagcggcugccuggccggcaucuaccuggaggacaccaaggagaaggugagcaucuacgaggccaugagaagaggccugcugagagccaccaccgccgcccugcugcuggaggcccaggccgccaccggcuuccugguggaccccgugagaaaccagagacuguacgugcacgaggccgugaaggccggcguggugggccccgagcugcacgagcagcugcugagcgccgagaaggccgugaccggcuacagagaccccuacagcggcagcaccaucagccuguuccaggccaugcagaagggccuggugcugagacagcacggcaucagacugcuggaggcccagaucgccaccggcggcaucaucgaccccgugcacagccacagagugcccguggacguggccuaccagagaggcuacuucagcgaggagaugaacagagugcuggccgaccccagcgacgacaccaagggcuucuucgaccccaacacccacgagaaccugaccuacagacagcugcuggagagaugcguggaggaccccgagaccggccugagacugcugccccugaagggcgccgagaaggccgaggugguggagaccacccagguguacaccgaggaggagaccagaagagccuucgaggagacccagaucgacauccccggcggcggcagccacggcggcagcaccaugagccugugggaggugaugcagagcgaccugauccccgaggagcagagagcccagcugauggccgacuuccaggccggcagagugaccaaggagagaaugaucaucaucaucaucgagaucaucgagaagaccgagaucaucagacagcagggccuggccagcuacgacuacgugagaagaagacugaccgccgaggaccuguucgaggccagaaucaucagccuggagaccuacaaccugcugagagagggcaccagaagccugagagaggcccuggaggccgagagcgccuggugcuaccuguacggcaccggcagcguggccggcguguaccugcccggcagcagacagacccugagcaucuaccaggcccugaagaagggccugcugagcgccgagguggccagacugcugcuggaggcccaggccgccaccggcuuccugcuggaccccgugaagggcgagagacugaccguggacgaggccgugagaaagggccuggugggccccgagcugcacgacagacugcugagcgccgagagagccgugaccggcuacagagaccccuacaccgagcagaccaucagccuguuccaggccaugaagaaggagcugauccccaccgaggaggcccugagacugcuggacgcccagcuggccaccggcggcaucguggaccccagacugggcuuccaccugccccuggagguggccuaccagagaggcuaccugaacaaggacacccacgaccagcugagcgagcccagcgaggugagaagcuacguggaccccagcaccgacgagagacugagcuacacccagcugcugagaagaugcagaagagacgacggcaccggccagcugcugcugccccugagcgacgccagaaagcugaccuucagaggccugagaaagcagaucaccauggaggagcuggugagaagccaggugauggacgaggccaccgcccugcagcugagagagggccugaccagcaucgaggaggugaccaagaaccugcagaaguuccuggagggcaccagcugcaucgccggcguguucguggacgccaccaaggagagacugagcguguaccaggccaugaagaagggcaucaucagacccggcaccgccuucgagcugcuggaggcccaggccgccaccggcuacgugaucgaccccaucaagggccugaagcugaccguggaggaggccgugagaaugggcaucgugggccccgaguucaaggacaagcugcugagcgccgagagagccgugaccggcuacaaggaccccuacagcggcaagcugaucagccuguuccaggccaugaagaagggccugauccugaaggaccacggcaucagacugcuggaggcccagaucgccaccggcggcaucaucgaccccgaggagagccacagacugcccguggagguggccuacaagagaggccuguucgacgaggagaugaacgagauccugaccgaccccagcgacgacaccaagggcuucuucgaccccaacaccgaggagaaccugaccuaccugcagcugauggagagaugcaucaccgacccccagaccggccugugccugcugccccugaaggagaagaagagagagagaaagaccagcagcaagagcagcgugagaaagagaagaguggugaucguggaccccgagaccggcaaggagaugagcguguacgaggccuacagaaagggccugaucgaccaccagaccuaccuggagcugagcgagcaggagugcgagugggaggagaucaccaucagcagcagcgacggcguggugaagagcaugaucaucgacagaagaagcggcagacaguacgacaucgacgacgccaucgccaagaaccugaucgacagaagcgcccuggaccaguacagagccggcacccugagcaucaccgaguucgccgacaugcugagcggcaacgccggcggcuucagaagcagaagcagcagcgugggcagcagcagcagcuaccccaucagccccgccgugagcagaacccagcuggccagcuggagcgaccccaccgaggagaccggccccguggccggcauccuggacaccgagacccuggagaaggugagcaucaccgaggccaugcacagaaaccugguggacaacaucaccggccagagacugcuggaggcccaggccugcaccggcggcaucaucgaccccagcaccggcgagagauuccccgugaccgacgccgugaacaagggccugguggacaagaucaugguggacagaaucaaccuggcccagaaggccuucugcggcuucgaggaccccagaaccaagaccaagaugagcgccgcccaggcccugaagaagggcuggcuguacuacgaggccggccagagauuccuggaggugcaguaccugaccggcggccugaucgagcccgacacccccggcagagugccccuggacgaggcccugcagagaggcaccguggacgccagaaccgcccagaagcugagagacgugggcgccuacagcaaguaccugaccugccccaagaccaagcugaagaucagcuacaaggacgcccuggacagaagcaugguggaggagggcaccggccugagacugcuggaggccgccgcccagagcaccaagggcuacuacagccccuacagcgugagcggcagcggcagcaccgccggcagcagaaccggcagcagaaccggcagcagagccggcagcagaagaggcagcuucgacgccaccggcagcggcuucagcaugaccuucagcagcagcagcuacagcagcagcggcuacggcagaagauacgccagcggcagcagcgccagccugggcggccccgagagcgccguggccuaa

SEQ ID NO: 21649 - RNA, 1062 nt, Artificial Sequence
  PLEK2__Homo_sapiens__NP_057529
auggaggacggcgugcugaaggagggcuuccuggugaagagaggccacaucgugcacaacuggaaggccagaugguucauccugagacagaacacccugguguacuacaagcuggagggcggcagaagagugaccccccccaagggcagaauccugcuggacggcugcaccaucaccugccccugccuggaguacgagaacagaccccugcugaucaagcugaagacccagaccagcaccgaguacuuccuggaggccugcagcagagaggagagagacgccugggccuucgagaucaccggcgccauccacgccggccagcccggcaaggugcagcagcugcacagccugagaaacagcuucaagcugcccccccacaucagccugcacagaaucguggacaagaugcacgacagcaacaccggcaucagaagcagccccaacauggagcagggcagcaccuacaagaagaccuuccugggcagcagccugguggacuggcugaucagcaacagcuucaccgccagcagacuggaggccgugacccuggccagcaugcugauggaggagaacuuccugagacccgugggcgugagaagcaugggcgccaucagaagcggcgaccuggccgagcaguuccuggacgacagcaccgcccuguacaccuucgccgagagcuacaagaagaagaucagccccaaggaggagaucagccugagcaccguggagcugagcggcaccguggugaagcagggcuaccuggccaagcagggccacaagagaaagaacuggaaggugagaagauucgugcugagaaaggaccccgccuuccugcacuacuacgaccccagcaaggaggagaacagacccgugggcggcuucagccugagaggcagccuggugagcgcccuggaggacaacggcgugcccaccggcgugaagggcaacgugcagggcaaccuguucaaggugaucaccaaggacgacacccacuacuacauccaggccagcagcaaggccgagagagccgaguggaucgaggccaucaagaagcugaccuaa

SEQ ID NO: 21650 - RNA, 1215 nt, Artificial Sequence
  PLEKHA1__Homo_sapiens__NP_001001974
augcccuacguggacagacagaacagaaucugcggcuuccuggacaucgaggagaacgagaacagcggcaaguuccugagaagauacuucauccuggacaccagagaggacagcuucgugugguacauggacaacccccagaaccugcccagcggcagcagcagagugggcgccaucaagcugaccuacaucagcaaggugagcgacgccaccaagcugagacccaaggccgaguucugcuucgugaugaacgccggcaugagaaaguacuuccugcaggccaacgaccagcaggaccugguggagugggugaacgugcugaacaaggccaucaagaucaccgugcccaagcagagcgacagccagcccaacagcgacaaccugagcagacacggcgagugcggcaagaagcaggugagcuacagaaccgacaucgugggcggcgugcccaucaucacccccacccagaaggaggaggugaacgagugcggcgagagcaucgacagaaacaaccugaagagaagccagagccaccugcccuacuucacccccaagcccccccaggacagcgccgugaucaaggccggcuacugcgugaagcagggcgccgugaugaagaacuggaagagaagauacuuccagcuggacgagaacaccaucggcuacuucaagagcgagcuggagaaggagccccugagagugaucccccugaaggaggugcacaaggugcaggagugcaagcagagcgacaucaugaugagagacaaccuguucgagaucgugaccaccagcagaaccuucuacgugcaggccgacagccccgaggagaugcacagcuggaucaaggccgugagcggcgccaucguggcccagagaggccccggcagaagcgccagcagcgagcacccccccggccccagcgagagcaagcacgccuucagacccaccaacgccgccaccgccaccagccacagcaccgccagcagaagcaacagccuggugagcaccuucaccauggagaagagaggcuucuacgagagccuggccaaggugaagcccggcaacuucaaggugcagaccgugagccccagagagcccgccagcaaggugaccgagcaggcccugcugagaccccagagcaagaacggcccccaggagaaggacugcgaccugguggaccuggacgacgccagccugcccgugagcgacguguaa

SEQ ID NO: 21651 - RNA, 1278 nt, Artificial Sequence
  PLEKHA2__Homo_sapiens__NP_067636
augcccuacguggacagacagaacagaaucugcggcuuccuggacaucgaggagcacgagaacagcggcaaguuccugagaagauacuucauccuggacacccaggccaacugccugcugugguacauggacaacccccagaaccuggccaugggcgccggcgccgugggcgcccugcagcugaccuacaucagcaaggugagcaucgccacccccaagcagaagcccaagacccccuucugcuucgugaucaacgcccugagccagagauacuuccugcaggccaacgaccagaaggacaugaaggacuggguggaggcccugaaccaggccagcaagaucaccgugcccaagggcggcggccugcccaugaccaccgaggugcugaagagccuggccgccccccccgcccuggagaagaagccccagguggccuacaagaccgagaucaucggcggcgugguggugcacacccccaucagccagaacggcggcgacggccaggagggcagcgagcccggcagccacaccauccugagaagaagccagagcuacauccccaccagcggcugcagagccagcaccggccccccccugaucaagagcggcuacugcgugaagcagggcaacgugagaaagagcuggaagagaagauucuucgcccuggacgacuucaccaucugcuacuucaagugcgagcaggacagagagccccugagaaccaucuuccugaaggacgugcugaagacccacgagugccuggugaagagcggcgaccugcugaugagagacaaccuguucgagaucaucaccagcagcagaaccuucuacgugcaggccgacagccccgaggacaugcacagcuggaucaaggagaucggcgccgccgugcaggcccugaagugccaccccagagagaccagcuucagcagaagcaucagccugaccagacccggcagcagcagccugagcagcggccccaacagcauccugugcagaggcagacccccccuggaggagaagaaggcccugugcaaggcccccagcguggccagcagcuggcagcccuggacccccgugccccaggccggcgagaagcugcugccccccggcgacaccagcgaggacagccuguucacccccagacccggcgagggcagcgcccccggcgugcugcccagcagcagaaucagacacagaagcgagccccagcaccccaaggagaagcccuucauguucaaccuggacgacgagaacaucagaaccagcgacguguaa

SEQ ID NO: 21652 - RNA, 3525 nt, Artificial Sequence
  PLEKHA5__Homo_sapiens__NP_001137293
auggccgccgaccugaaccuggaguggaucagccugcccagaagcuggaccuacggcaucaccagaggcggcagaguguucuucaucaacgaggaggccaagagcaccaccuggcugcaccccgugaccggcgaggccguggugaccggccacagaagacagagcaccgaccugcccaccggcugggaggaggccuacaccuucgagggcgccagauacuacaucaaccacaacgagagaaaggugaccugcaagcaccccgugaccggccagcccagccaggacaacugcaucuucguggugaacgagcagaccguggccaccaugaccagcgaggagaagaaggagagacccaucagcaugaucaacgaggccagcaacuacaacgugaccagcgacuacgccgugcaccccaugagccccgugggcagaaccagcagagccagcaagaaggugcacaacuucggcaagagaagcaacagcaucaagagaaaccccaacgcccccguggugagaagaggcuggcuguacaagcaggacagcaccggcaugaagcuguggaagaagagaugguucgugcugagcgaccugugccuguucuacuacagagacgagaaggaggagggcauccugggcagcauccugcugcccagcuuccagaucgcccugcugaccagcgaggaccacaucaacagaaaguacgccuucaaggccgcccaccccaacaugagaaccuacuacuucugcaccgacaccggcaaggagauggagcuguggaugaaggccaugcuggacgccgcccuggugcagaccgagcccgugaagagaguggacaagaucaccagcgagaacgcccccaccaaggagaccaacaacauccccaaccacagagugcugaucaagcccgagauccagaacaaccagaagaacaaggagaugagcaagaucgaggagaagaaggcccuggaggccgagaaguacggcuuccagaaggacggccaggacagaccccugaccaagaucaacagcgugaagcugaacagccugcccagcgaguacgagagcggcagcgccugccccgcccagaccgugcacuacagacccaucaaccugagcagcagcgagaacaagaucgugaacgugagccuggccgaccugagaggcggcaacagacccaacaccggcccccuguacaccgaggccgacagagugauccagagaaccaacagcaugcagcagcuggagcaguggaucaagauccagaagggcagaggccacgaggaggagaccagaggcgugaucagcuaccagacccugcccagaaacaugcccagccacagagcccagaucauggccagauaccccgagggcuacagaacccugcccagaaacagcaagaccagacccgagagcaucugcagcgugacccccagcacccacgacaagacccugggccccggcgccgaggagaagagaagaagcaugagagacgacaccauguggcagcuguacgaguggcagcagagacaguucuacaacaagcagagcacccugcccagacacagcacccugagcagccccaagaccauggugaacaucagcgaccagaccaugcacagcauccccaccagccccagccacggcagcaucgccgccuaccagggcuacagcccccagagaaccuacagaagcgaggugagcagccccauccagagaggcgacgugaccaucgacagaagacacagagcccaccaccccaagcacguguacgugcccgacagaagaagcgugcccgccggccugacccugcagagcgugagcccccagagccugcagggcaagacccccgaggagcugacccugcugcugaucaagcugagaagacagcaggccgagcugagcagcaucagagagcacacccuggcccagcugaugcagcugaagcuggaggcccacagccccaagaacgagauccugagccaccaccugcagagaaacaccaucuaccuggaccaccagcugagccaggacgagggcagaggcacccuguacaaguacagacccgaggagguggacaucgacgccaagcugagcagacugugcgagcaggacaagguggugcacgcccuggaggagaagcugcagcagcugcacaaggagaaguacacccuggagcaggcccugcugagcgccagccaggagaucgagaugcacgccgacaaccccgccgccauccagaccguggugcugcagagagacgaccugcagaacggccugcugagcaccugcagagagcugagcagagccaccgccgagcuggagagagccuggagagaguacgacaagcuggaguacgacgugaccgugaccagaaaccagaugcaggagcagcuggaccaccugggcgaggugcagaccgagagcgccggcauccagagagcccagauccagaaggagcuguggagaauccaggacgugauggagggccugagcaagcacaagcagcagagaggcaccaccgagaucggcaugaucggcagcaagcccuucagcaccgugaaguacaagaacgagggccccgacuacagacuguacaagagcgagcccgagcugaccaccguggccgagguggacgagagcaacggcgaggagaagagcgagcccgugagcgagaucgagaccagcguggugaagggcagccacuuccccgugggcguggugccccccagagccaagagccccacccccgagagcagcaccaucgccagcuacgugacccugagaaagaccaagaagaugauggaccugagaaccgagagacccagaagcgccguggagcagcugugccuggccgagagcaccagacccagaaugaccguggaggagcagauggagagaaucagaagacaccagcaggccugccugagagagaagaagaagggccugaacgugaucggcgccagcgaccagagcccccugcagagccccagcaaccugagagacaaccccuucagaaccacccagaccagaagaagagacgacaaggagcuggacaccgccaucagagagaacgacgugaagcccgaccacgagacccccgccaccgagaucgugcagcugaaggagaccgagccccagaacguggacuucagcaaggagcugaagaagaccgagaacaucagcuacgagaugcuguucgagcccgagcccaacggcgugaacagcguggagaugauggacaaggagagaaacaaggacaagaugcccgaggacgugaccuucagcccccaggacgagacccagaccgccaaccacaagcccgaggagcaccccgaggagaacaccaagaacagcguggacgagcaggaggagaccgugaucagcuacgagagcacccccgaggugagcagaggcaaccagaccauggccgugaagagccugagccccagccccgagagcagcgccagccccgugcccagcacccagccccagcugaccgagggcagccacuucaugugcguguaa

SEQ ID NO: 21653 - RNA, 3147 nt, Artificial Sequence
  PLEKHA6__Homo_sapiens__NP_055750
augagcaacaagaccggcggcaagagacccgccaccaccaacagcgacauccccaaccacaacauggugagcgaggugccccccgagagacccagcgugagagccaccagaaccgccagaaaggccguggccuucggcaagagaagccacagcaugaagagaaaccccaacgcccccgugaccaaggccggcuggcuguucaagcaggccagcagcggcgugaagcaguggaacaagagaugguucgugcugguggacagaugccuguucuacuacaaggacgagaaggaggagagcauccugggcagcaucccccugcugagcuucagaguggccgccgugcagcccagcgacaacaucagcagaaagcacaccuucaaggccgagcacgccggcgugagaaccuacuucuucagcgccgagagccccgaggagcaggaggccuggauccaggccaugggcgaggccgccagagugcagaucccccccgcccagaagagcgugccccaggccgugagacacagccacgagaagcccgacagcgagaacgugccccccagcaagcaccaccagcagcccccccacaacagccugcccaagcccgagcccgaggccaagaccagaggcgagggcgacggcagaggcugcgagaaggccgagagaagacccgagagacccgaggugaagaaggagccccccgugaaggccaacggccugcccgccggccccgagcccgccagcgagcccggcagccccuaccccgagggccccagagugcccggcggcggcgagcagcccgcccagcccaacggcuggcaguaccacagccccagcagacccggcagcaccgccuuccccagccaggacggcgagaccggcggccacagaagaagcuucccccccagaaccaaccccgacaagaucgcccagagaaagagcagcaugaaccagcugcagcagugggugaaccugagaagaggcgugcccccccccgaggaccugagaagccccagcagauucuaccccgugagcagaagagugcccgaguacuacggccccuacagcagccaguaccccgacgacuaccaguacuacccccccggcgugagacccgagagcaucugcagcaugcccgccuacgacagaaucagcccccccugggcccuggaggacaagagacacgccuucagaaacggcggcggccccgccuaccagcugagagaguggaaggagcccgccagcuacggcagacaggacgccaccguguggauccccagccccagcagacagcccguguacuacgacgagcuggacgccgccagcagcagccugagaagacugagccugcagcccagaagccacagcgugcccagaagccccagccagggcagcuacagcagagccagaaucuacagccccgugagaagccccagcgccagauucgagagacugccccccagaagcgaggacaucuacgccgaccccgccgccuacgugaugagaagaagcaucagcagccccaaggugccccccuaccccgagguguucagagacagccugcacaccuacaagcugaacgagcaggacaccgacaagcugcugggcaagcugugcgagcagaacaagguggugagagagcaggacagacuggugcagcagcugagagccgagaaggagagccuggagagcgcccugaugggcacccaccaggagcuggagauguucggcagccagcccgccuaccccgagaagcugagacacaagaaggacagccugcagaaccagcugaucaacaucagaguggagcugagccaggccaccaccgcccugaccaacagcaccaucgaguacgagcaccuggagagcgaggugagcgcccugcacgacgaccugugggagcagcugaaccuggacacccagaacgaggugcugaacagacagauccagaaggagaucuggagaauccaggacgugauggagggccugagaaagaacaaccccagcagaggcaccgacaccgccaagcacagaggcggccugggccccagcgccaccuacagcagcaacagccccgccagcccccugagcagcgccagccugaccagcccccugagccccuucagccuggugagcggcagccagggcagccccaccaagcccggcagcaacgagcccaaggccaacuacgagcagagcaagaaggacccccaccagacccugccccuggacacccccagagacaucagccuggugcccaccagacaggagguggaggccgagaagcaggccgcccugaacaaggugggcguggugccccccagaaccaagagccccaccgacgacgaggugacccccagcgccguggugagaagaaacgccagcggccugaccaacggccugagcagccaggagagacccaagagcgccguguuccccggcgagggcaaggugaagaugagcguggaggagcagaucgacagaaugagaagacaccagagcggcagcaugagagagaagagaagaagccugcagcugcccgccagccccgcccccgaccccagccccagacccgccuacaagguggugagaagacacagaagcauccacgagguggacaucagcaaccuggaggccgcccugagagccgaggagcccggcggccacgccuacgagacccccagagaggagaucgccagacugagaaagauggagcuggagccccagcacuacgacguggacaucaacaaggagcugagcacccccgacaaggugcugauccccgagagauacaucgaccuggagcccgacaccccccugagccccgaggagcugaaggagaagcagaagaagguggagagaaucaagacccugaucgccaagagcagcaugcagaacguggugcccaucggcgagggcgacagcguggacgugccccaggacagcgagagccagcugcaggagcaggagaagagaaucgagaucagcugcgcccuggccaccgaggccagcagaagaggcagaaugcugagcgugcagugcgccacccccagcccccccaccagccccgccagccccgccccccccgccaacccccugagcagcgagagccccagaggcgccgacagcagcuacaccaugagaguguaa

SEQ ID NO: 21654 - RNA, 3366 nt, Artificial Sequence
  PLEKHA7__Homo_sapiens__NP_778228
auggccgccgccaccgugggcagagacacccugcccgagcacuggagcuacggcgugugcagagacggcagaguguucuucaucaacgaccagcugagaugcaccaccuggcugcaccccagaaccggcgagcccgugaacagcggccacaugaucagaagcgaccugcccagaggcugggaggagggcuucaccgaggagggcgccagcuacuucaucgaccacaaccagcagaccaccgccuucagacaccccgugaccggccaguucagccccgagaacagcgaguucauccugcaggaggagcccaacccccacaugagcaagcaggacagaaaccagagacccagcagcauggugagcgagaccagcaccgccggcaccgccagcacccuggaggccaagcccggccccaagaucaucaagagcagcagcaaggugcacagcuucggcaagagagaccaggccaucagaagaaaccccaacgugcccgugguggugagaggcuggcugcacaagcaggacagcagcggcaugagacuguggaagagaagaugguucgugcuggccgacuacugccuguucuacuacaaggacagcagagaggaggccgugcugggcagcaucccccugcccagcuacgugaucagccccguggcccccgaggacagaaucagcagaaaguacagcuucaaggccgugcacaccggcaugagagcccugaucuacaacagcagcaccgccggcagccaggccgagcagagcggcaugagaaccuacuacuucagcgccgacacccaggaggacaugaacgccugggugagagccaugaaccaggccgcccaggugcugagcagaagcagccugaagagagacauggagaagguggagagacaggccgugccccaggccaaccacaccgagagcugccacgagugcggcagagugggccccggccacaccagagacugcccccacagaggccacgacgacaucgugaacuucgagagacaggagcaggagggcgagcaguacagaagccagagagacccccuggagggcaagagagacagaagcaaggccagaagccccuacagccccgccgaggaggacgcccuguucauggaccugcccaccggccccagaggccagcaggcccagccccagagagccgagaagaacggcaugcugcccgccagcuacggccccggcgagcagaacggcaccggcggcuaccagagagccuucccccccagaaccaaccccgagaagcacagccagagaaagagcaaccuggcccagguggagcacugggccagagcccagaagggcgacagcagaagccugccccuggaccagacccugcccagacagggccccggccagagccugagcuuccccgagaacuaccagacccugcccaagagcaccagacaccccagcggcggcagcagccccccccccagaaaccugcccagcgacuacaaguacgcccaggacagagccagccaccugaagaugagcagcgaggagagaagagcccacagagacggcaccguguggcagcuguacgaguggcagcagagacagcaguucagacacggcagccccaccgcccccaucugccugggcagccccgaguucaccgaccagggcagaagcagaagcaugcuggaggugcccagaagcaucagcgugccccccagccccagcgacauccccccccccggcccccccagaguguucccccccagaagaccccacacccccgccgagagagugaccgugaagccccccgaccagagaagaagcguggacaucagccugggcgacagccccagaagagccagaggccacgccgugaagaacagcagccacguggacagaagaagcaugcccagcaugggcuacaugacccacaccgugagcgcccccagccugcacggcaagagcgccgacgacaccuaccugcagcugaagaaggaccuggaguaccuggaccugaagaugaccggcagagaccugcugaaggacagaagccugaagcccgugaagaucgccgagagcgacaccgacgugaagcugagcaucuucugcgagcaggacagagugcugcaggaccuggaggacaagaucagagcccugaaggagaacaaggaccagcuggagagcgugcuggaggugcugcacagacagauggagcaguacagagaccagccccagcaccuggagaagaucgccuaccagcagaagcugcugcaggaggaccuggugcacaucagagccgagcugagcagagagagcaccgagauggagaacgccuggaacgaguaccugaagcuggagaacgacguggagcagcugaagcagacccugcaggagcagcacagaagagccuucuucuuccaggagaagagccagauccagaaggaccuguggagaaucgaggacgugaccgccggccugagcgccaacaaggagaacuucagaauccugguggagagcgugaagaaccccgagagaaagaccgugccccuguucccccacccccccgugcccagccugagcaccagcgagagcaagccccccccccagcccagcccccccaccagccccgugagaaccccccuggaggugagacuguucccccagcugcagaccuacgugcccuacagaccccaccccccccagcugagaaaggugaccagcccccugcagagccccaccaaggccaagcccaagguggaggacgaggccccccccagacccccccugcccgagcuguacagccccgaggaccagccccccgccgugcccccccugcccagagaggccaccaucaucagacacaccagcgugagaggccugaagagacagagcgacgagagaaagagagacagagagcugggccagugcgugaacggcgacagcagaguggagcugagaagcuacgugagcgagcccgagcuggccacccugagcggcgacauggcccagcccagccugggccuggugggccccgagagcagauaccagacccugcccggcagaggccugagcggcagcaccagcagacugcagcagagcagcaccaucgcccccuacgugacccugagaagaggccugaacgccgagagcagcaaggccaccuuccccagacccaagagcgcccuggagagacuguacagcggcgaccaccagagaggcaagaugagcgccgaggagcagcuggagagaaugaagagacaccagaaggcccuggugagagagagaaagagaacccugggccagggcgagagaaccggccugcccagcagcagauaccugagcagaccccugcccggcgaccugggcagcgugugcuaa

SEQ ID NO: 21655 - RNA, 627 nt, Artificial Sequence
  PLEKHB1__Homo_sapiens__NP_001123505
augagccccgccgcccccgugccccccgacagcgcccuggagagccccuucgaggagauggcccuggugagaggcggcuggcuguggagacagagcagcauccugagaagauggaagagaaacugguucgcccuguggcuggacggcacccugggcuacuaccacgacgagaccgcccaggacgaggaggacagagugcugauccacuucaacgugagagacaucaagaucggccccgagugccacgacgugcagccccccgagggcagaagcagagacggccugcugaccgugaaccugagagagggcggcagacugcaccugugcgccgagaccaaggacgacgcccuggccuggaagaccgcccugcuggaggccaacagcacccccgugagaguguacagccccuaccaggacuacuacgagguggugccccccaacgcccacgaggccaccuacgugagaagcuacuacggcccccccuacgccggccccggcgugacccacgugaucgugagagaggaccccugcuacagcgccggcgccccccuggccaugggcaugcuggccggcgccgccaccggcgccgcccugggcagccugauguggagccccugcugguucuaa

SEQ ID NO: 21656 - RNA, 1521 nt, Artificial Sequence
  PLEKHD1__Homo_sapiens__NP_001154970
auguucaccagcaagagcaacagcgugagccccagccccagccuggagcaggccgacagcgacgcccuggacaucagcaccaaggugcagcuguacggcgugcuguggaagagacccuucggcagacccagcgccaaguggagcagaagauucuucaucaucaaggagagcuuccugcuguacuacagcgagagcgagaagaagagcuucgagaccaacaaguacuucaacauccaccccaagggcgugaucccccugggcggcugccugguggagcccaaggaggagcccagcaugcccuacgccaugaagaucagccaccaggacuuccacggcaacauccugcuggccgccgagagcgaguucgagcagacccaguggcuggagaugcugcaggagagcggcaaggugaccuggaagaacgcccagcugggcgaggccaugaucaagagccuggaggcccagggccugcagcuggccaaggagaagcaggaguaccuggacaagcugauggaggagaccgaggagcugugccugcagagagagcagagagaggagcuggagagacugaaccaggugcuggaggccgagaagcagcaguucgaggagguggugcaggagcugagaauggagcaggagcagaucaagagagagcuggagcugaccgccagaugccugaagggcguggagcaggagaagaaggagcugagacaccugaccgagagccugcagcagacccuggaggagcugagcaucgagaagaagaagacccuggagaugcuggaggagaacgagaaccaccugcagacccuggccaaccagagcgagcagcccccccccagcggcggccugcacagcaaccugagacagaucgaggagaagaugcagcagcugcuggaggagaagcugcuggccgagaagagaaugaaggagaacgaggagagaagcagagcccuggaggaggagagagaguucuacagcagccagagccaggcccugcagaacagccugcaggagcugaccgccgagaagcagcaggccgagagagagcugaaggccgaggugaaggugagaauggaccuggagagaagacugagagaggccgagggcgcccugagaagccuggagcagggccugaacagcaaggugagaaacaaggagaaggaggagagaaugagagccgacgugagccaccugaagagauucuucgaggagugcaucagaaacgccgagcuggaggccaagaugcccgugaucaugaagaacagcguguacauccacaaggccgccaccagaagaaucaagagcugcagauuccacagaagaagaagcagcaccagcuggaacgacaugaagcccagccagagcuucaugaccagccagcuggacgccaacaacauggaggagcugaaggagguggccaagagacugagcagagaccagagauucagagagagcaucuaccacaucauggccacccagcccggcgcccccagcgcccugagcagaggcggcaaguaa

SEQ ID NO: 21657 - RNA, 840 nt, Artificial Sequence
  PLEKHF1__Homo_sapiens__NP_077286
augguggaccaccuggccaacaccgagaucaacagccagagaaucgccgccguggagagcugcuucggcgccagcggccagccccuggcccugcccggcagagugcugcugggcgagggcgugcugaccaaggagugcagaaagaaggccaagcccagaaucuucuuccuguucaacgacauccugguguacggcagcaucgugcugaacaagagaaaguacagaagccagcacaucaucccccuggaggaggugacccuggagcugcugcccgagacccugcaggccaagaacagauggaugaucaagaccgccaagaagagcuucguggugagcgccgccagcgccaccgagagacaggaguggaucagccacaucgaggagugcgugagaagacagcugagagccaccggcagaccccccagcaccgagcacgccgcccccuggauccccgacaaggccaccgacaucugcaugagaugcacccagaccagauucagcgcccugaccagaagacaccacugcagaaagugcggcuucguggugugcgccgagugcagcagacagagauuccugcugcccagacugagccccaagcccgugagagugugcagccugugcuacagagagcuggccgcccagcagagacaggaggaggccgaggagcagggcgccggcagccccggccagcccgcccaccuggccagacccaucugcggcgccagcagcggcgacgacgacgacagcgacgaggacaaggagggcagcagagacggcgacuggcccagcagcguggaguucuacgccagcggcguggccuggagcgccuuccacagcuaa

SEQ ID NO: 21658 - RNA, 750 nt, Artificial Sequence
  PLEKHF2__Homo_sapiens__NP_078889
augguggacagacuggccaacagcgaggccaacaccagaagaaucagcaucguggagaacugcuucggcgccgccggccagccccugaccauccccggcagagugcugaucggcgagggcgugcugaccaagcugugcagaaagaagcccaaggccagacaguucuuccuguucaacgacauccugguguacggcaacaucgugauccagaagaagaaguacaacaagcagcacaucaucccccuggagaacgugaccaucgacagcaucaaggacgagggcgaccugagaaacggcuggcugaucaagacccccaccaagagcuucgccguguacgccgccaccgccaccgagaagagcgaguggaugaaccacaucaacaagugcgugaccgaccugcugagcaagagcggcaagacccccagcaacgagcacgccgccgugugggugcccgacagcgaggccaccgugugcaugagaugccagaaggccaaguucacccccgugaacagaagacaccacugcagaaagugcggcuucguggugugcggccccugcagcgagaagagauuccugcugcccagccagagcagcaagcccgugagaaucugcgacuucugcuacgaccugcugagcgccggcgacauggccaccugccagcccgccagaagcgacagcuacagccagagccugaagagcccccugaacgacaugagcgacgacgacgacgacgacgacagcagcgacuaa

SEQ ID NO: 21659 - RNA, 4158 nt, Artificial Sequence
  PLEKHG1__Homo_sapiens__NP_001025055
auggagcugagcgacagcgacagacccgugagcuucggcagcaccagcagcagcgccagcagcagagacagccacggcagcuucggcagcagaaugacccuggugagcaacagccacaugggccuguucaaccaggacaaggaggugggcgccaucaagcuggagcugauccccgccagacccuucagcagcagcgagcugcagagagacaaccccgccaccggccagcagaacgccgacgagggcagcgagagaccccccagagcccaguggagaguggacagcaacggcgcccccaagaccaucgccgacagcgccaccagccccaagcugcuguacguggacagaguggugcaggagauccuggagaccgagagaaccuacgugcaggaccugaagagcaucguggaggacuaccuggacugcaucagagaccagaccaagcugccccugggcaccgaggagagaagcgcccuguucggcaacauccaggacaucuaccacuucaacagcgagcugcugcaggaccuggagaacugcgagaacgaccccguggccaucgccgagugcuucgugagcaagagcgaggaguuccacaucuacacccaguacugcaccaacuaccccagaagcguggccgugcugaccgagugcaugagaaacaagauccuggccaaguucuucagagagagacaggagacccugaagcacagccugccccugggcagcuaccugcugaagcccgugcagagaauccugaaguaccaccugcugcugcacgagaucgagaaccaccuggacaaggacaccgagggcuacgacguggugcuggacgccaucgacaccaugcagagaguggccuggcacaucaacgacaugaagagaaagcacgagcacgccgugagacugcaggagauccagagccugcugaccaacuggaagggccccgaccugaccagcuacggcgagcuggugcuggagggcaccuucagaauccagagagccaagaacgagagaacccuguuccuguucgacaagcugcugcugaucaccaagaagagagacgacaccuucaccuacaaggcccacauccugugcggcaaccugaugcugguggaggugauccccaaggagccccugagcuucagcguguuccacuacaagaaccccaagcugcagcacaccgugcaggccaagagccagcaggacaagagacugugggugcugcaccugaagagacugauccuggagaaccacgccgccaagauccccgccaaggccaagcaggccauccuggagauggacgccauccaccaccccggcuucugcuacagccccgagggcggcaccaaggcccuguucggcagcaaggagggcagcgcccccuacagacugagaagaaagagcgagcccagcagcagaagccacaaggugcugaagaccagcgagaccgcccaggacauccagaaggugagcagagaggagggcagcccccagcugagcagcgccagacccagccccgcccagagaaacagccagcccagcagcagcaccaugaucagcgugcugagagccggcggcgcccugagaaacaucuggaccgaccaccagaucagacaggcccuguuccccagcagaagaagcccccaggagaacgaggacgacgaggacgacuaccagauguucgugcccagcuucagcagcagcgaccugaacagcaccagacugugcgaggacagcaccagcagcagacccugcagcuggcacaugggccagauggagagcaccgagaccagcagcagcggccacagaaucgugagaagagccagcagcgccggcgagagcaacaccugcccccccgagaucggcaccagcgacagaaccagagagcugcagaacagccccaagaccgagggccaggaggagaugacccccuucggcagcagcaucgagcugaccaucgacgacaucgaccacguguacgacaacaucagcuacgaggaccugaagcugaugguggccaagagagaggaggccgagagcacccccagcaagagcgccagagacagcgugagacccaagagcacccccgagcuggccuucaccaagagacaggccggccacagcaagggcagccuguacgcccagaccgacggcacccugagcggcggcgaggccagcagccagagcacccacgagcugcaggccguggaggagaacaucuacgacaccaucggccugcccgacccccccagccugggcuucaagugcagcagccugaagagagccaagagaagcaccuuccugggccuggaggccgacuucgugugcugcgacagccugagacccuucgugagccaggacagccugcagcugagcgaggacgaggcccccuaccaccaggccacccccgaccacggcuaccugagccugcuguacgacagccccagcggcaaccugagcaugccccacaagcccgugagcgacaagcugagcgaggagguggacgagaucuggaacgaccuggagaacuacaucaagaagaacgaggacaaggccagagacagacugcuggccgccuuccccgugagcaaggacgacgugcccgacagacugcacgccgagagcacccccgagcugagcagagacgugggcagaagcgugagcacccugagccugcccgagagccaggcccugcugacccccgugaagagcagagccggcagagccagcagagccaacugccccuucgaggaggaccugaucagcaaggagggcagcuucaugagccugaacagacugagccuggccagcgagaugccccugauggacaaccccuacgaccuggccaacagcggccugagccagaccgaccccgagaaccccgaccugggcauggaggccaccgacaagaccaagagcagaguguucaugauggccagacaguacagccagaagaucaagaaggccaaccagcugcugaaggugaagagccuggagcuggagcagccccccgccagccagcaccagaagagcaugcacaaggaccuggccgccauccuggaggagaagaagcagggcggccccgccaucggcgccagaaucgccgaguacagccagcuguacgaccagaucguguucagagagagcccccugaagauccagaaggacggcugggccagcccccaggagagcagccugcugagaagcgugagccccagccaggugcaccacggcagcggcgacuggcugcugcacagcaccuacagcaacggcgagcuggccgacuucugccugccccccgagcaggaccugagaagcagauaccccaccuucgagaucaacaccaagagcacccccagacagcugagcgccgccugcagcgugcccagccugcagaccagcgacccccugcccggcagcgugcagagaugcagcgugguggugagccagcccaacaaggagaacuggugccaggaccaccuguacaacagccugggcagaaagggcaucagcgccaagagccagcccuaccacagaagccagagcagcagcagcgugcugaucaacaagagcauggacagcaucaacuaccccagcgacgugggcaagcagcagcugcugagccugcacagaagcagcagaugcgagagccaccaggaccugcugcccgacaucgccgacagccaccagcagggcaccgagaagcugagcgaccugacccugcaggacagccagaagguggugguggugaacagaaaccugccccugaacgcccagaucgccacccagaacuacuucagcaacuucaaggagaccgacggcgacgaggacgacuacguggagaucaagagcgaggaggacgagagcgagcuggagcugagccacaacagaagaagaaagagcgacagcaaguucguggacgccgacuucagcgacaacgugugcagcggcaacacccugcacagccugaacagccccagaacccccaagaagcccgugaacagcaagcugggccugagccccuaccugacccccuacaacgacagcgacaagcugaacgacuaccuguggagaggccccagccccaaccagcagaacaucgugcagagccugagagagaaguuccagugccugagcagcagcagcuucgccuaa

SEQ ID NO: 21660 - RNA, 4161 nt, Artificial Sequence
  PLEKHG2__Homo_sapiens__NP_073746
augcccgagggcgcccagggccugagccugagcaagcccagccccagccugggcugcggcagaagaggcgaggugugcgacugcggcaccgugugcgagaccagaaccgcccccgccgcccccaccauggccagccccagaggcagcggcagcagcaccagccugagcaccgugggcagcgagggcgaccccgcccccggccccacccccgccugcagcgccagcagacccgagccccugcccggcccccccaucagacugcaccugagccccgugggcauccccggcagcgccagacccagcagacuggagagaguggccagagagaucguggagaccgagagagccuacgugagagaccugagaagcaucguggaggacuaccugggcccccugcuggacggcggcgugcugggccugagcguggagcaggugggcacccuguucgccaacaucgaggacaucuacgaguucagcagcgagcugcuggaggaccuggagaacagcagcagcgccggcggcaucgccgagugcuucgugcagagaagcgaggacuucgacaucuacacccuguacugcaugaacuaccccagcagccuggcccugcugagagagcugagccugagcccccccgccgcccuguggcugcaggagagacaggcccagcugagacacagccugccccugcagagcuuccugcugaagcccgugcagagaauccugaaguaccaccugcugcugcaggagcugggcaagcacugggccgagggccccggcaccggcggcagagagaugguggaggaggccaucgugagcaugaccgccguggccugguacaucaacgacaugaagagaaagcaggagcacgccgccagacugcaggaggugcagagaagacugggcggcuggaccggccccgagcugagcgccuucggcgagcuggugcuggagggcgccuucagaggcggcggcggcggcggccccagacugagaggcggcgagagacugcuguuccuguucagcagaaugcugcugguggccaagagaagaggccuggaguacaccuacaagggccacaucuucugcugcaaccugagcgugagcgagagccccagagacccccugggcuucaaggugagcgaccugaccauccccaagcacagacaccugcugcaggccaagaaccaggaggagaagagacuguggauccacugccugcagagacuguucuucgagaaccaccccgccagcauccccgccaaggccaagcaggugcugcuggagaacagccugcacugcgcccccaagagcaagcccgugcuggagccccugacccccccccugggcagccccagacccagagacgccagaagcuucacccccggcagaagaaacaccgcccccagccccggccccagcgugaucagaagaggcagaagacagagcgagcccgugaaggaccccuacgugauguucccccagaacgccaagcccggcuucaagcacgccggcagcgagggcgagcuguacccccccgagagccagccccccgugagcggcagcgccccccccgaggaccuggaggacgccggcccccccacccuggaccccagcggcaccagcaucaccgaggagauccuggagcugcugaaccagagaggccugagagaccccggccccagcacccacgacauccccaaguuccccggcgacagccaggugcccggcgacagcgagacccugaccuuccaggcccugcccagcagagacagcagcgaggaggaggaggaggaggaggagggccuggagauggacgagagaggccccagcccccugcacgugcuggagggccuggagagcagcaucgccgccgagaugcccagcauccccugccugaccaagauccccgacgugcccaaccugcccgagauccccagcagaugcgagauccccgagggcagcagacugcccagccugagcgacaucagcgacguguucgagaugcccugccugcccgccauccccagcgugcccaacacccccagccugagcagcacccccacccugagcugcgacagcuggcugcagggcccccugcaggagcccgccgaggcccccgccaccagaagagagcuguucagcggcagcaaccccggcaagcugggcgagccccccagcggcggcaaggccggccccgaggaggacgaggagggcgugagcuucaccgacuuccagccccaggacgugacccagcaccagggcuuccccgacgagcuggccuucagaagcugcagcgagaucagaagcgccuggcaggcccuggagcagggccagcuggccagacccggcuuccccgagccccugcugauccuggaggacagcgaccugggcggcgacagcggcagcggcaaggccggcgcccccagcagcgagagaaccgccagcagagugagagagcuggccagacuguacagcgagagaauccagcagaugcagagagccgagaccagagccagcgccaacgcccccagaagaagacccagagugcuggcccagccccagcccagccccugccugccccaggagcaggccgagcccggccugcugcccgccuucggccacgugcuggugugcgagcuggccuucccccugaccugcgcccaggagagcgugccccugggccccgccgugugggugcaggccgccaucccccugagcaagcagggcggcagccccgacggccagggccugcacgugagcaaccugcccaagcaggaccugcccggcauccacgugagcgccgccacccugcugcccgagcagggcggcagcagacacgugcaggcccccgccgccaccccccugcccaagcaggagggcccccugcaccugcaggugcccgcccugaccaccuucagcgaccagggccaccccgagauccaggugcccgccaccaccccccugcccgagcacagaagccacauggugauccccgcccccagcaccgccuucugccccgagcagggccacugcgccgacauccacgugcccaccacccccgcccugcccaaggagaucugcagcgacuucaccgugagcgugaccacccccgugcccaagcaggagggccaccuggacagcgagagccccaccaacaucccccugaccaagcagggcggcagcagagacgugcagggccccgaccccgugugcagccagcccauccagccccugagcuggcacggcagcagccuggacccccagggccccggcgacacccugcccccccugcccugccaccugcccgaccugcagauccccggcaccagcccccugcccgcccacggcagccaccuggaccacagaauccccgccaacgccccccugagccugagccaggagcugcccgacacccaggugcccgccaccaccccccugccccugccccaggugcugaccgacaucugggugcaggcccugcccaccagccccaagcagggcagccugcccgacauccagggccccgccgccgcccccccccugcccgagcccagccugaccgacacccaggugcagaagcugacccccagccuggagcagaagagccugaucgacgcccacgugcccgccgccaccccccugcccgagagaggcggcagccuggacauccagggccugagccccacccccgugcagaccaccauggugcugagcaagcccggcggcagccuggccagccacguggccagacuggagagcagcgaccugacccccccccacagccccccccccagcagcagacagcugcugggccccaacgccgccgcccugagcagauaccuggccgccagcuacaucagccagagccuggccagaagacagggccccggcggcggcgcccccgccgccagcagaggcagcuggagcagcgcccccaccagcagagccagcagcccccccccccagccccagcccccccccccccccgccagaagacugagcuacgccaccaccgugaacauccacgugggcggcggcggcagacugagacccgccaaggcccaggugagacugaaccaccccgcccugcuggccagcacccaggagagcaugggccugcacagagcccagggcgcccccgacgcccccuuccacauguaa

SEQ ID NO: 21661 - RNA, 4026 nt, Artificial Sequence
  PLEKHG3__Homo_sapiens__XP_011534927
augcccgugagcaccagccugcaccaggacggcagccaggagagacccgugagccugaccagcaccaccagcagcagcggcagcagcugcgacagcagaagcgccauggaggagcccagcagcagcgaggcccccgccaagaacggcgccggcagccugagaagcagacaccugcccaacagcaacaacaacagcagcagcuggcugaacgugaagggcccccugagccccuucaacagcagagccgccgccggccccgcccaccacaagcugagcuaccugggcagaguggugagagagaucguggagaccgagagaauguacgugcaggaccugagaagcaucguggaggacuaccugcugaagaucaucgacacccccggccugcugaagcccgagcaggugagcgcccuguucggcaacaucgagaacaucuacgcccugaacagccagcugcugagagaccuggacagcugcaacagcgaccccguggccguggccagcugcuucguggagagaagccaggaguucgacaucuacacccaguacugcaacaacuaccccaacagcguggccgcccugaccgagugcaugagagacaagcagcaggccaaguucuucagagacagacaggagcugcugcagcacagccugccccugggcagcuaccugcugaagcccgugcagagaauccugaaguaccaccugcugcugcaggagaucgccaagcacuucgacgaggaggaggacggcuucgaggugguggaggacgccaucgacaccaugaccugcguggccugguacaucaacgacaugaagagaagacacgagcacgccgugagacugcaggagauccagagccugcugaucaacuggaagggccccgaccugaccaccuacggcgagcuggugcuggagggcaccuucagagugcacagagugagaaacgagagaaccuucuuccuguucgacaagacccugcugaucaccaagaagagaggcgaccacuucguguacaagggcaacauccccugcagcagccugaugcugaucgagagcaccagagacagccugugcuucaccgugacccacuacaagcacagcaagcagcaguacagcauccaggccaagaccguggaggagaagagaaacuggacccaccacaucaagagacugauccuggagaaccaccacgccaccaucccccagaaggccaaggaggccauccuggagauggacagcuacuaccccaacagauacagaugcagccccgagagacugaagaaggccuggagcagccaggacgaggugagcaccaacgugagacagggcagaagacagagcgagcccggccacagccccuacagcagagccacccugcccagcggccagagaggcuucgugaugcccagccugaagggcagaagaaagagcgagcccaccaagcaccugcugagacagcugaacgagaaggccagagccgccggcaugaagcacgccggcagcgccggcacccugcuggacuucggccagcccagcagaaccagaggccugcagcccgaggccgagggcgccacccaggaggaggaggaggaggaggaggaggugguggaggaggaggaggaggaggaggaggaggagcaggccuuccaggugagccuggaggaccugaccggccacgagggcaacgagaagggcgccggccccgagccccccggcagcgaggaggaggaggaggagcaggaggagagccuggccguggccgagcagggcaagggcagaagagagagcgagagcagcagaagcagcagaagacccagcggcagaagccccaccagcaccgagaagagaaugagcuucgagagcaucagcagccugcccgagguggagcccgaccccgaggccggcagcgagcaggagguguucagcgccguggagggccccagcgccgaggagacccccagcgacaccgagagccccgaggugcuggagacccagcuggacgcccaccagggccugcugggcauggacccccccggcgacaugguggacuucguggccgccgagagcaccgaggaccugaaggcccugagcagcgaggaggaggaggagaugggcggcgccgcccaggagcccgagagccugcugccccccagcgugcuggaccaggccagcgugaucgccgagagauucgugagcagcuucagcagaagaagcagcguggcccaggaggacagcaagagcagcggcuucggcagccccagacuggugagcagaagcagcagcgugcugagccuggagggcagcgagaagggccuggccagacacggcagcgccaccgacagccugagcugccagcugagccccgagguggacaucagcgugggcguggccaccgaggacagccccagcgugaacggcauggagccccccagccccggcugccccguggagcccgacagaagcagcugcaagaagaaggagagcgcccugagcaccagagacagacugcugcuggacaagaucaagagcuacuacgagaacgccgagcaccacgacgccggcuucagcgugagaagaagagagagccugagcuacauccccaagggccuggugagaaacagcaucagcagauucaacagccugcccagacccgaccccgagcccgugccccccgugggcagcaagagacaggugggcagcagacccaccagcugggcccuguucgagcugcccggccccagccaggccgugaagggcgaccccccccccaucagcgacgccgaguucagacccagcagcgagaucgugaagaucugggagggcauggagagcagcggcggcagccccggcaagggccccggccagggccaggccaacggcuucgaccugcacgagccccuguucauccuggaggagcacgagcugggcgccaucaccgaggagagcgccaccgccagccccgagagcagcagccccaccgagggcagaagccccgcccaccuggccagagagcugaaggagcuggugaaggagcugagcagcagcacccagggcgagcugguggccccccugcaccccagaaucgugcagcugagccacgugauggacagccacgugagcgagagagugaagaacaagguguaccagcuggccagacaguacagccugagaaucaagagcaacaagcccgugauggccagacccccccugcagugggagaagguggcccccgagagagacggcaagagccccaccgugcccugccugcaggaggaggccggcgagccccugggcggcaagggcaagagaaagcccgugcugagccuguucgacuacgagcagcugauggcccaggagcacagcccccccaagcccagcagcgccggcgagaugagcccccagagauucuucuucaaccccagcgccgugagccagagaaccaccagccccggcggcagacccagcgccagaagcccccugagccccaccgagaccuucagcuggcccgacgugagagagcugugcagcaaguacgccagcagagacgaggccagaagagccggcggcggcagacccagaggcccccccgugaacagaagccacagcgugcccgagaacaugguggagcccccccugagcggcagagugggcagaugcagaagccugagcaccaagagaggcagaggcggcggcgaggccgcccagagccccggcccccugccccagagcaagcccgacggcggcgagacccuguacgugaccgccgaccugacccuggaggacaacagaagagugaucgugauggagaagggcccccugcccagccccaccgccggccuggaggagagcagcggccagggccccagcagccccguggcccugcugggccaggugcaggacuuccagcagagcgccgagugccagcccaaggaggagggcagcagagaccccgccgaccccagccagcagggcagagugagaaaccugagagagaaguuccaggcccugaacagcgugggcuaa

SEQ ID NO: 21662 - RNA, 3576 nt, Artificial Sequence
  PLEKHG4__Homo_sapiens__NP_001123201
auggagagaccccuggagaacggcgacgagagccccgacagccagggccacgccaccgacuggagauucgccgugugcagcuucagagacgccugggaggaggaggagcccgccagccagaugcacgugaaggaccccggcccccccagaccccccgccggcgccacccaggacgaggagcugcagggcagcccccugagcagaaaguuccagcugccccccgccgccgacgagagcggcgacgcccagagaggcaccguggagagcagcagcgugcugagcgagggccccggccccagcggcguggagagccugcugugccccaugagcagccaccugagccuggcccagggcgagagcgacacccccggcgugggccuggugggcgaccccggccccagcagagccaugcccagcggccugagccccggcgcccuggacagcgaccccgugggccugggcgacccccugagcgagaucagcaagcugcuggaggccgcccccagcggcagcggccugcccaagcccgccgacugccugcuggcccaggaccugugcugggagcugcuggccagcggcauggccacccugcccggcaccagagacgugcagggcagagccgugcugcugcugugcgcccacagccccgccuggcugcagagcgagugcagcagccaggagcugaucagacugcugcuguaccugagaagcauccccagacccgaggugcaggcccugggccugaccgugcugguggacgccagaaucugcgcccccagcagcagccuguucagcggccugagccagcugcaggaggccgcccccggcgccguguaccaggugcugcuggugggcagcacccugcugaaggaggugcccagcggccugcagcuggagcagcugcccagccagagccugcugacccacauccccaccgccggccugcccaccagccugggcggcggccugcccuacugccaccaggccuggcuggacuucagaagaagacuggaggcccugcugcagaacugccaggccgccugcgcccugcugcagggcgccaucgagagcgugaaggccgugccccagcccauggagcccggcgaggugggccagcugcugcagcagaccgaggugcugaugcagcaggugcuggacagccccuggcuggccuggcugcagugccagggcggcagagagcugaccuggcugaagcaggaggugcccgaggugacccugagccccgacuacagaaccgccauggacaaggccgacgagcuguacgacagaguggacggccugcugcaccagcugacccugcagagcaaccagagaauccaggcccuggagcuggugcagacccuggaggccagagagagcggccugcaccagaucgagguguggcugcagcaggugggcuggcccgcccuggaggaggccggcgagcccagccuggacaugcugcugcaggcccagggcagcuuccaggagcuguaccagguggcccaggagcaggugagacagggcgagaaguuccugcagccccugaccggcugggaggccgccgagcuggacccccccggcgccagauuccuggcccugagagcccagcugaccgaguucagcagagcccuggcccagagaugccagagacuggccgacgccgagagacuguuccagcuguucagagaggcccugaccugggccgaggagggccagagagugcuggccgagcuggagcaggagagacccggcguggugcugcagcagcugcagcugcacuggaccagacaccccgaccugccccccgcccacuucagaaagaugugggcccuggccaccggccugggcagcgaggccaucagacaggagugcagaugggccugggccagaugccaggacaccuggcuggcccuggaccagaagcuggaggccagccugaagcugccccccgugggcagcaccgccagccugugcgugagccaggugcccgccgcccccgcccaccccccccugagaaaggccuacagcuucgacagaaaccugggccagagccugagcgagcccgccugccacugccaccacgccgccaccaucgccgccugcagaagacccgaggccggcggcggcgcccugccccaggccagccccaccgugcccccccccggcagcagcgaccccagaagccugaacagacugcagcuggugcuggccgagaugguggccaccgagagagaguacgugagagcccuggaguacaccauggagaacuacuuccccgagcuggacagacccgacgugccccagggccugagaggccagagagcccaccuguucggcaaccuggagaagcugagagacuuccacugccacuucuuccugagagagcuggaggccugcaccagacacccccccagaguggccuacgccuuccugagacacagagugcaguucggcauguacgcccuguacagcaagaacaagcccagaagcgacgcccugaugagcagcuacggccacaccuucuucaaggacaagcagcaggcccugggcgaccaccuggaccuggccagcuaccugcugaagcccauccagagaaugggcaaguacgcccugcugcugcaggagcuggccagagccugcggcggccccacccaggagcugagcgcccugagagaggcccagagccuggugcacuuccagcugagacacggcaacgaccugcuggccauggacgccauccagggcugcgacgugaaccugaaggagcagggccagcuggugagacaggacgaguucguggugagaaccggcagacacaagagcgugagaagaaucuuccuguucgaggagcugcugcuguucagcaagcccagacacggccccaccggcguggacaccuucgccuacaagagaagcuucaagauggccgaccugggccugaccgagugcugcggcaacagcaaccugagauucgagaucugguucagaagaagaaaggccagagacaccuucgugcugcaggccagcagccuggccaucaagcaggccuggaccgccgacaucagccaccugcuguggagacaggccgugcacaacaaggaggugagaauggccgagauggugagcaugggcgugggcaacaaggccuucagagacaucgcccccagcgaggaggccaucaacgacagaaccgugaacuacgugcugaagugcagagaggugagaagcagagccagcaucgccguggcccccuucgaccacgacagccuguaccugggcgccagcaacagccugcccggcgaccccgccagcugcagcgugcugggcagccugaaccugcaccuguacagagaccccgcccugcugggccugagaugcccccuguaccccagcuuccccgaggaggccgcccuggaggccgaggccgagcugggcggccagcccagccugaccgccgaggacagcgagaucagcagccagugccccagcgccagcggcagcagcggcagcgacagcagcugcgugagcggccaggcccugggcagaggccuggaggaccugcccugcguguaa

SEQ ID NO: 21663 - RNA, 2373 nt, Artificial Sequence
  PLEKHG6__Homo_sapiens__NP_001138328
augaaggccuucggccccccccacgagggcccccugcagggccugguggccagcagaaucgagaccuacggcggcagacacagagccagcgcccagagcaccgccggcagacuguaccccagaggcuaccccgugcuggaccccagcagaagaagacugcagcaguacgugcccuucgccagaggcagcggccaggccagaggccugagccccaugagacugagagaccccgagcccgagaagagacacggcggccacgugggcgccggccugcugcacagccccaagcugaaggagcugaccaaggcccacgagcuggaggugagacugcacaccuucagcauguucggcaugcccagacugccccccgaggacagaagacacugggagaucggcgagggcggcgacagcggccugaccaucgagaagagcuggagagagcuggugcccggccacaaggagaugagccaggagcugugccaccagcaggaggcccugugggagcugcugaccaccgagcugaucuacgugagaaagcugaagaucaugaccgaccugcuggccgccggccugcugaaccugcagagagugggccugcugauggaggugagcgccgagacccuguucggcaacgugcccagccugaucagaacccacagaagcuucugggacgaggugcugggccccacccuggaggagaccagagccagcggccagccccuggaccccaucggccugcagagcggcuuccugaccuucggccagagauuccaccccuacgugcaguacugccugagagugaagcagaccauggccuacgccagagagcagcaggagaccaacccccuguuccacgccuucgugcaguggugcgagaagcacaagagaagcggcagacagaugcugugcgaccugcugaucaagccccaccagagaaucaccaaguacccccugcugcugcacgccgugcugaagagaagccccgaggccagagcccaggaggcccugaacgccaugaucgaggccguggagagcuuccugagacacaucaacggccaggugagacagggcgaggagcaggagagccuggccgccgccgcccagagaaucggccccuacgaggugcuggagccccccagcgacgagguggagaagaaccugagacccuucagcacccuggaccugaccagccccaugcugggcguggccagcgagcacaccagacagcugcugcuggagggccccgugagagugaaggagggcagagagggcaagcuggacguguaccuguuccuguucagcgacgugcugcuggugaccaagccccagagaaaggccgacaaggccaaggugaucagacccccccugaugcuggagaagcuggugugccagccccugagagaccccaacagcuuccugcugauccaccugaccgaguuccagugcgugagcagcgcccugcuggugcacugccccagccccaccgacagagcccaguggcuggagaagacccagcaggcccaggccgcccugcagaagcugaaggccgaggaguacgugcagcagaagagagagcugcugacccuguacagagaccaggacagagagagccccagcaccagacccagcacccccagccuggagggcagccagagcagcgccgagggcagaacccccgaguucagcaccaucaucccccaccugguggugaccgaggacaccgacgaggacgccccccuggugcccgacgacaccagcgacagcggcuacggcacccugauccccggcacccccaccggcagcagaagcccccugagcagacugagacagagagcccugagaagagaccccagacugaccuucagcacccuggagcugagagacaucccccugagaccccacccccccgacccccaggccccccagagaagaagcgcccccgagcugcccgagggcauccugaagggcggcagccugccccaggaggacccccccaccuggagcgaggaggaggacggcgccagcgagagaggcaacguggugguggagacccugcacagagccagacugagaggccagcugcccagcagccccacccacgccgacagcgccggcgagagccccugggagagcagcggcgaggaggaggaggagggcccccuguuccugaaggccggccacaccagccugagacccaugagagccgaggacaugcugagagagaucagagaggagcuggccagccagagaaucgagggcgccgaggagcccagagacagcagacccagaaagcugaccagagcccagcugcagagaaugagaggcccccacaucauccagcuggacaccccccugagcgccagcgagguguaa

SEQ ID NO: 21664 - RNA, 4482 nt, Artificial Sequence
  PLEKHH2__Homo_sapiens__NP_742066
auggccgagcugagcgagcccgagggccccguggacuggaaggagagaugcguggcccuggagagccagcugaugaaguucagagugcaggccagcaagaucagagagcugcuggccgagaagaugcagcagcuggagagacaggugaucgacgccgagagacaggccgagaaggccuuccagcaggugcaggugauggaggacaagcugaaggccgccaacauccagaccagcgagagcgagaccagacuguacaacaagugccaggaccuggagagccugauccaggagaaggacgacgugauccagaaccuggagcugcagcuggaggagcagaagcagaucagaauccaggaggccaagaucaucgaggagaaggccgccaagaucaaggagugggugaccgugaagcugaacgagcuggagcuggagaaccagaaccugagacugaucaaccagaaccagaccgaggagaucagaaccaugcagagcaagcugcaggaggugcagggcaagaagagcagcaccgugagcacccugaagcugagcgagggccagagacugagcagccugaccuucggcugcuuccugagcagagccagaagccccccccagguggugaagagcgaggagaugagcaagaucagcagcaaggagcccgaguucaccgagggcaaggacauggaggagauggagauccccgagaagagcguggacaaccaggugcuggagaacaacagaggccagagaacccugcaccagacccccugcggcagcgagcagaacagaaagaccagaaccagcuucgccaccgacggcggcaucagccagaacagcggcgcccccgugagcgacuggagcagcgacgaggaggacggcagcaagggcagaagcaagagcagaugcaccagcacccugagcagccacaccagcgaggagggcgugcagugcagcagaaugggcagcgagauguaccugaccgccagcgacgacagcagcagcaucuucgaggaggagaccuucggcaucaagagacccgagcacaagaagcuguacagcuggcagcaggaggcccaguggaaggcccugaacagcccccugggcaagggcaacagcgagcugagcaagaaggagcaggacagcagcagcgacgagcugaacaagaaguuccagagccagagacuggacuacagcagcagcagcagcgaggccaacacccccagccccauccugacccccgcccugaugcccaagcaccccaacagccugagcggcaagggcacccagcuggugcccagcagccaccugcccccccccaagcugagaauccccaacguguucagcaucagcguggcccuggccaagagacaccugagccagccccagcugagcagcgacagaauguucggcaccaacagaaacgccaucagcaugaucagaccccugagaccccaggagaccgaccuggaccugguggacggcgacagcaccgaggugcuggagaacauggacaccagcugcgacgacggccuguucagcuacgacagccuggacagccccaacagcgacgaccaggagcacugcgacagcgccaagaagguggccuacagcaagccccccacccccccccugcacagauuccccagcugggagagcagaaucuacgccguggccaagagcggcaucagaaugagcgaggccuucaacauggagagcgugaacaagaacagcgccgccacccugagcuacaccaccagcggccuguacaccagccugaucuacaagaacaugaccacccccguguacaccacccugaagggcaaggccacccagaucagcagcagccccuuccuggacgacagcagcggcagcgaggaggaggacagcagcagaagcagcagcagaaccagcgagagcgacagcagaagcagaagcggccccggcagccccagagccaugaagagaggcgugagccugagcagcguggccagcgagagcgacuacgccaucccccccgacgccuacagcaccgacaccgaguacagccagcccgagcagaagcugcccaagaccugcagcagcagcagcgacaacggcaagaacgagccccuggagaagagcggcuaccugcugaagaugagcggcaaggugaagagcuggaagagaagaugguucgugcugaagggcggcgagcugcuguacuacaagagccccagcgacgugaucagaaagccccagggccacaucgagcugagcgccagcugcagcauccugagaggcgacaacaagcagaccgugcagcugaccaccgagaagcacaccuacuaccugaccgccgacagccccaacauccuggaggaguggaucaaggugcugcagaacgugcugagagugcaggccgccaacccccugagccugcagcccgagggcaagcccaccaugaagggccugcugaccaaggugaagcacggcuacagcaagagaguguggugcacccugaucggcaagacccuguacuacuucagaagccaggaggacaaguucccccugggccagaucaagcugugggaggccaagguggaggagguggacagaagcugcgacagcgacgaggacuacgaggccagcggcagaagccugcugagcacccacuacaccaucgugauccaccccaaggaccagggccccaccuaccugcugaucggcagcaagcacgagaaggacaccuggcuguaccaccugaccguggccgccggcagcaacaacgugaacgugggcagcgaguucgagcagcuggugugcaagcugcugaacaucgacggcgagcccagcagccagaucuggagacaccccacccugugccacagcaaggagggcaucaucagcccccugaccacccugcccagcgaggcccugcagaccgaggccaucaagcuguucaagaccugccagcuguucaucaacgccgccguggacagccccgccaucgacuaccacaucagccuggcccagagcgcccugcagaucugccugacccaccccgagcugcagaacgagaucugcugccagcugaucaagcagaccagaagaagacagccccagaaccagcccggcccccugcagggcuggcagcugcuggcccugugcgugggccuguuccugccccaccaccccuuccuguggcugcugagacugcaccugaagagaaacgccgacagcagaaccgaguucggcaaguacgccaucuacugccagagaugcguggagagaacccagcagaacggcgacagagaggccagacccagcagaauggagauccugagcacccugcugagaaaccccuaccaccacagccugcccuucagcauccccgugcacuucaugaacggcaucuaccagguggugggcuucgacgccagcaccaccguggaggaguuccugaacacccugaaccaggacaccggcaugagaaagcccgcccagagcggcuucgcccuguucaccgacgaccccagcggcagagaccuggagcacugccugcagggcaacaucaagaucugcgacaucaucagcaagugggagcaggccagcaaggagcagcagcccggcaagugcgagggcaccagaaccgugagacugaccuacaagaacagacuguacuucagcgugcaggccagaggcgagaccgacagagagaagcugcugcugauguaccagaccaacgaccagaucaucaacggccuguucccccugaacaaggaccuggcccuggagauggccgcccugcugagccagguggagaucggcgacuucgagagacccuucagcacccccgccggccacgugaccaaccagugcaaggugaaccagacccugaagcaggugaucgagaaguucuaccccaagagauacagagacggcugcagcgaggagcagcugagacagcugugccagagacugagcaccagauggauggcccugagaggccacagcgccgccgacugcgugagaaucuaccugaccguggccagaaaguggcccuucuucggcgccaagcuguuccuggccaagcccaucacccccagcagccugggcagcaccuuccuguggcuggccgugcacgaggacggccugagccugcuggaguacaacagcaugagacugaucgugagcuacguguacaagagccugaugaccuucggcggcuaccaggacgacuucaugguggugaucaacaacacccacagcaaggacaagcccaccgagaagcugcuguucgccauggccaagcccaagauccuggagaucacccugcugaucgccagcuacaucaacaacuuccaccagcagaaggccgccuuccaccaccugagcgcccccgcccugcugagcgcccagaccagaggcccccaggccagaaugaugggcagccagccccugcugagcagcagcagacccaccaagggccccacccugcuguaa

SEQ ID NO: 21665 - RNA, 3171 nt, Artificial Sequence
  PLEKHM1__Homo_sapiens__NP_055613
augcugagcgugguggagaacggccuggacccccaggccgccauccccgugaucaagaagaagcuggugggcagcgugaaggcccugcagaagcaguacgugagccuggacaccguggugaccagcgaggacggcgacgccaacaccaugugcagcgcccuggaggccguguucauccacggccugcacgccaagcacaucagagccgaggccggcggcaagagaaagaagagcgcccaccagaagccccugccccagcccguguucuggccccugcugaaggccgugacccacaagcacaucaucagcgagcuggagcaccugaccuucgugaacaccgacgugggcagaugcagagccuggcugagacuggcccugaacgacggccugauggagugcuaccugaagcugcugcugcaggagcaggccagacugcacgaguacuaccagcccaccgcccugcugagagacgccgaggagggcgaguuccugcugagcuuccugcagggccugaccagccugagcuucgagcugagcuacaagagcgccauccugaacgaguggacccugaccccccuggcccugagcggccugugcccccugagcgagcuggacccccugagcaccagcggcgccgagcugcagagaaaggagagccuggacagcaucagccacagcagcggcagcgaggacaucgaggugcaccacagcggccacaagaucagaagaaaccagaagcugaccgccagcagccugagccuggacaccgccagcagcagccagcugagcugcagccugaacagcgacagcugccugcugcaggagaacggcagcaagagccccgaccacugcgaggagcccaugagcugcgacagcgaccugggcaccgccaacgccgaggacagcgacagaagccugcaggaggugcugcuggaguucagcaaggcccaggugaacagcgugcccaccaacggccugagccaggagaccgagauccccaccccccaggccagccugagccugcacggccugaacaccagcaccuaccugcacugcgaggcccccgccgagccccugcccgcccaggccgccagcggcacccaggacggcgugcacgugcaggagcccagaccccaggcccccagcccccuggaccugcagcagcccguggagagcaccagcggccagcagcccagcagcaccgugagcgagaccgccagagaggugggccagggcaacggccugcagaaggcccaggcccacgacggcgccggccugaagcugguggugagcagccccaccagccccaagaacaagagcuggaucagcgaggacgacuucuacagacccagcagagagcagccccuggagagcgccagcgaccaccccaucgccagcuacagaggcacccccggcagcagacccggccugcacagacacuucagccaggagcccagaaagaacugcagccugggcgcccuggaccaggccugcgugcccagccccggcagaagacaggcccaggccgcccccagccagggccacaagagcuucagaguggugcacagaagacagaugggccugagcaaccccuucagaggccugaugaagcugggcaccguggagagaagaggcgccaugggcaucuggaaggagcuguucugcgagcugagcccccuggaguucagacuguaccugagcaacgaggagcacaccugcguggagaacugcagccugcugagaugcgagagcgugggccccgcccacagcgacggcagauucgagcugguguucagcggcaagaagcuggcccugagagccagcagccaggacgaggccgaggacuggcuggacagagugagagaggcccugcagaaggugagaccccagcaggaggacgagugggugaacgugcaguaccccgaccagcccgaggagccccccgaggccccccagggcugccugagccccagcgaccugcugagcgagcccgccgcccugcagggcacccaguucgacuggagcagcgcccaggugcccgagcccgacgccaucaaggagagccugcuguaccuguacauggacagaaccuggaugcccuacaucuucagccugagccuggaggcccugaagugcuucagaaucagaaacaacgagaagaugcugagcgacagccacggcguggagaccaucagagacauccugcccgacaccagccugggcggccccagcuucuucaagaucaucaccgccaaggccgugcugaagcugcaggccggcaacgccgaggaggccgcccuguggagagaccuggugagaaaggugcuggccagcuaccuggagaccgccgaggaggccgugacccugggcggcagccuggacgagaacugccaggaggugcugaaguucgccaccagagagaacggcuuccugcugcaguaccugguggccauccccauggagaagggccuggacagccagggcugcuucugcgccggcugcagcagacagaucggcuucagcuucgugagacccaagcugugcgccuucagcggccuguacuacugcgacaucugccaccaggacgacgccagcgugauccccgccagaaucauccacaacugggaccugaccaagagacccaucugcagacaggcccugaaguuccugacccagaucagagcccagccccugaucaaccugcagauggugaacgccagccuguacgagcacguggagagaaugcaccugaucggcagaagaagagagcagcugaagcugcugggcgacuaccugggccugugcagaagcggcgcccugaaggagcugagcaagagacugaaccacagaaacuaccugcuggagagcccccacagauucagcguggccgaccugcagcagaucgccgacggcguguacgagggcuuccugaaggcccugaucgaguucgccagccagcacguguaccacugcgaccugugcacccagagaggcuucaucugccagaucugccagcaccacgacaucaucuuccccuucgaguucgacaccaccgugagaugcgccgagugcaagaccguguuccaccagagcugccaggccguggugaagaagggcugccccagaugcgccagaagaagaaaguaccaggagcagaacaucuucgccuaa

SEQ ID NO: 21666 - RNA, 681 nt, Artificial Sequence
  PLEKHO1__Homo_sapiens__NP_001291653
augcugacccuggaccugauccaggaggaggaccccagccccgaggagcccaccagcugcgccgagagcuucagaguggaccuggacaagagcguggcccagcuggccggcagcagaagaagagccgacagcgacagaauccagcccagcgccgacagagccagcagccugagcagacccugggagaagaccgacaagggcgccaccuacaccccccaggcccccaagaagcugacccccaccgagaagggcagaugcgccagccuggaggagauccugagccagagagacgccgccagcgccagaacccugcagcugagagccgaggagccccccacccccgcccugcccaaccccggccagcugagcagaauccaggaccugguggccagaaagcuggaggagacccaggagcugcuggccgaggugcagggccugggcgacggcaagagaaaggccaaggacccccccagaagcccccccgacagcgagagcgagcagcugcugcuggagaccgagagacugcugggcgaggccagcagcaacuggagccaggccaagagagugcugcaggaggugagagagcugagagaccuguacagacagauggaccugcagacccccgacagccaccugagacagaccaccccccacagccaguacagaaagagccugauguaa

SEQ ID NO: 21667 - RNA, 1473 nt, Artificial Sequence
  PLEKHO2__Homo_sapiens__NP_079477
auggaggaggagggcgugaaggaggccggcgagaagcccagaggcgcccagaugguggacaaggccggcuggaucaagaagagcagcggcggccugcugggcuucuggaaggacagauaccugcugcugugccaggcccagcugcugguguacgagaacgaggacgaccagaagugcguggagaccguggagcugggcagcuacgagaagugccaggaccugagagcccugcugaagagaaagcacagauucauccugcugagaagccccggcaacaaggugagcgacaucaaguuccaggcccccaccggcgaggagaaggagagcuggaucaaggcccugaacgagggcaucaacagaggcaagaacaaggccuucgacgaggugaagguggacaagagcugcgcccuggagcacgugaccagagacagagugagaggcggccagagaagaagaccccccaccagagugcaccugaaggagguggccagcgccgccagcgacggccugcugagacuggaccuggacgugcccgacagcggcccccccguguucgcccccagcaaccacgugagcgaggcccagcccagagagacccccagaccccugaugccccccaccaagcccuuccuggcccccgagaccaccagccccggcgacagaguggagacccccgugggcgagagagcccccacccccgugagcgccagcagcgaggugagccccgagagccaggaggacagcgagacccccgccgaggaggacagcggcagcgagcagccccccaacagcgugcugcccgacaagcugaaggugagcugggagaaccccagcccccaggaggcccccgccgccgagagcgccgagcccagccaggcccccugcagcgagaccagcgaggccgcccccagagagggcggcaagccccccacccccccccccaagauccugagcgagaagcugaaggccagcaugggcgagaugcaggccagcggcccccccgcccccggcaccgugcaggugagcgugaacggcauggacgacagccccgagcccgccaagcccagccaggccgagggcacccccggcaccccccccaaggacgccaccaccagcaccgcccugccccccugggaccugcccccccaguuccaccccagaugcagcagccugggcgaccugcugggcgagggccccagacacccccugcagcccagagagagacuguacagagcccagcuggaggugaagguggccagcgagcagaccgagaagcugcugaacaaggugcugggcagcgagcccgcccccgugagcgccgagacccugcugagccaggccguggagcagcugagacaggccacccaggugcugcaggagaugagagaccugggcgagcugagccaggaggcccccggccugagagagaagagaaaggagcuggugacccuguacagaagaagcgcccccuaa

SEQ ID NO: 21668 - RNA, 1053 nt, Artificial Sequence
  PLEK__Homo_sapiens__NP_002655
auggagcccaagagaaucagagagggcuaccuggugaagaagggcagcguguucaacaccuggaagcccauguggguggugcugcuggaggacggcaucgaguucuacaagaagaagagcgacaacagccccaagggcaugaucccccugaagggcagcacccugaccagccccugccaggacuucggcaagagaauguucguguucaagaucaccaccaccaagcagcaggaccacuucuuccaggccgccuuccuggaggagagagacgccugggugagagacaucaagaaggccaucaagugcaucgagggcggccagaaguucgccagaaagagcaccagaagaagcaucagacugcccgagaccaucgaccugggcgcccuguaccugagcaugaaggacaccgagaagggcaucaaggagcugaaccuggagaaggacaagaagaucuucaaccacugcuucaccggcaacugcgugaucgacuggcuggugagcaaccagagcgugagaaacagacaggagggccugaugaucgccagcagccugcugaacgagggcuaccugcagcccgccggcgacaugagcaagagcgccguggacggcaccgccgagaaccccuuccuggacaaccccgacgccuucuacuacuuccccgacagcggcuucuucugcgaggagaacagcagcgacgacgacgugauccugaaggaggaguucagaggcgugaucaucaagcagggcugccugcugaagcagggccacagaagaaagaacuggaaggugagaaaguucauccugagagaggaccccgccuaccugcacuacuacgaccccgccggcgccgaggacccccugggcgccauccaccugagaggcugcguggugaccagcguggagagcaacagcaacggcagaaagagcgaggaggagaaccuguucgagaucaucaccgccgacgaggugcacuacuuccugcaggccgccacccccaaggagagaaccgaguggaucagagccauccagauggccagcagaaccggcaaguaa

SEQ ID NO: 21669 - RNA, 2433 nt, Artificial Sequence
  PLG__Homo_sapiens__NP_000292
auggagcacaaggagguggugcugcugcugcugcuguuccugaagagcggccagggcgagccccuggacgacuacgugaacacccagggcgccagccuguucagcgugaccaagaagcagcugggcgccggcagcaucgaggagugcgccgccaagugcgaggaggacgaggaguucaccugcagagccuuccaguaccacagcaaggagcagcagugcgugaucauggccgagaacagaaagagcagcaucaucaucagaaugagagacguggugcuguucgagaagaagguguaccugagcgagugcaagaccggcaacggcaagaacuacagaggcaccaugagcaagaccaagaacggcaucaccugccagaaguggagcagcaccagcccccacagacccagauucagccccgccacccaccccagcgagggccuggaggagaacuacugcagaaaccccgacaacgacccccagggccccuggugcuacaccaccgaccccgagaagagauacgacuacugcgacauccuggagugcgaggaggagugcaugcacugcagcggcgagaacuacgacggcaagaucagcaagaccaugagcggccuggagugccaggccugggacagccagagcccccacgcccacggcuacauccccagcaaguuccccaacaagaaccugaagaagaacuacugcagaaaccccgacagagagcugagacccuggugcuucaccaccgaccccaacaagagaugggagcugugcgacauccccagaugcaccacccccccccccagcagcggccccaccuaccagugccugaagggcaccggcgagaacuacagaggcaacguggccgugaccgugagcggccacaccugccagcacuggagcgcccagaccccccacacccacaacagaacccccgagaacuuccccugcaagaaccuggacgagaacuacugcagaaaccccgacggcaagagagcccccuggugccacaccaccaacagccaggugagaugggaguacugcaagauccccagcugcgacagcagccccgugagcaccgagcagcuggcccccaccgccccccccgagcugacccccguggugcaggacugcuaccacggcgacggccagagcuacagaggcaccagcagcaccaccaccaccggcaagaagugccagagcuggagcagcaugaccccccacagacaccagaagacccccgagaacuaccccaacgccggccugaccaugaacuacugcagaaaccccgacgccgacaagggccccuggugcuucaccaccgaccccagcgugagaugggaguacugcaaccugaagaagugcagcggcaccgaggccagcgugguggcccccccccccguggugcugcugcccgacguggagacccccagcgaggaggacugcauguucggcaacggcaagggcuacagaggcaagagagccaccaccgugaccggcacccccugccaggacugggccgcccaggagccccacagacacagcaucuucacccccgagaccaaccccagagccggccuggagaagaacuacugcagaaaccccgacggcgacgugggcggccccuggugcuacaccaccaaccccagaaagcuguacgacuacugcgacgugccccagugcgccgcccccagcuucgacugcggcaagccccagguggagcccaagaagugccccggcagaguggugggcggcugcguggcccacccccacagcuggcccuggcaggugagccugagaaccagauucggcaugcacuucugcggcggcacccugaucagccccgagugggugcugaccgccgcccacugccuggagaagagccccagacccagcagcuacaaggugauccugggcgcccaccaggaggugaaccuggagccccacgugcaggagaucgaggugagcagacuguuccuggagcccaccagaaaggacaucgcccugcugaagcugagcagccccgccgugaucaccgacaaggugauccccgccugccugcccagccccaacuacgugguggccgacagaaccgagugcuucaucaccggcuggggcgagacccagggcaccuucggcgccggccugcugaaggaggcccagcugcccgugaucgagaacaaggugugcaacagauacgaguuccugaacggcagagugcagagcaccgagcugugcgccggccaccuggccggcggcaccgacagcugccagggcgacagcggcggcccccuggugugcuucgagaaggacaaguacauccugcagggcgugaccagcuggggccugggcugcgccagacccaacaagcccggcguguacgugagagugagcagauucgugaccuggaucgagggcgugaugagaaacaacuaa

SEQ ID NO: 21670 - RNA, 291 nt, Artificial Sequence
  PLGLB2__Homo_sapiens__NP_002656
auggagcacaaggagguggugcugcugcugcugcuguuccugaagagcggccagggcgagccccuggacgacuacgugaacacccagggccccagccuguucagcgugaccaagaagcagcugggcgccggcagcagagaggagugcgccgccaagugcgaggaggacaaggaguucaccugcagagccuuccaguaccacagcaaggagcagcagugcgugaucauggccgagaacagaaagagcagcaucaucaucagaaugagagacgccgugcuguucgagaaguaa

SEQ ID NO: 21671 - RNA, 1569 nt, Artificial Sequence
  PLIN1__Homo_sapiens__XP_005254991
auggccgugaacaagggccugacccugcuggacggcgaccugcccgagcaggagaacgugcugcagagagugcugcagcugcccguggugagcggcaccugcgagugcuuccagaagaccuacaccagcaccaaggaggcccacccccugguggccagcgugugcaacgccuacgagaagggcgugcagagcgccagcagccuggccgccuggagcauggagcccguggugagaagacugagcacccaguucaccgccgccaacgagcuggccugcagaggccuggaccaccuggaggagaagauccccgcccugcaguacccccccgagaagaucgccagcgagcugaaggacaccaucagcaccagacugagaagcgccagaaacagcaucagcgugcccaucgccagcaccagcgacaaggugcugggcgccgcccuggccggcugcgagcuggccuggggcguggccagagacaccgccgaguucgccgccaacaccagagccggcagacuggccagcggcggcgccgaccuggcccugggcagcaucgagaaggugguggaguaccugcugccccccgacaaggaggagagcgcccccgcccccggccaccagcaggcccagaagagccccaaggccaagcccagccugcugagcagagugggcgcccugaccaacacccugagcagauacaccgugcagaccauggccagagcccuggagcagggccacaccguggccauguggauccccggcguggugccccugagcagccuggcccaguggggcgccagcguggccaugcaggccgugagcagaagaagaagcgaggugagagugcccuggcugcacagccuggccgccgcccaggaggaggaccacgaggaccagaccgacaccgagggcgaggacaccgaggaggaggaggagcuggagaccgaggagaacaaguucagcgagguggccgcccugcccggccccagaggccugcugggcggcguggcccacacccugcagaagacccugcagaccaccaucagcgccgugaccugggcccccgccgccgugcugggcauggccggcagagugcugcaccugacccccgcccccgccgugagcagcaccaagggcagagccaugagccugagcgacgcccugaagggcgugaccgacaacgugguggacaccguggugcacuacgugccccugcccagacugagccugauggagcccgagagcgaguucagagacaucgacaacccccccgccgagguggagagaagagaggccgagagaagagccagcggcgcccccagcgccggccccgagcccgcccccagacuggcccagcccagaagaagccugagaagcgcccagagccccggcgccccccccggccccggccuggaggacgagguggccacccccgccgcccccagacccggcuuccccgccgugcccagagagaagcccaagagaagagugagcgacagcuucuucagacccagcgugauggagcccauccugggcagaacccacuacagccagcugagaaagaagagcuaa

SEQ ID NO: 21672 - RNA, 1314 nt, Artificial Sequence
  PLIN2__Homo_sapiens__NP_001113
auggccagcguggccguggacccccagcccagcguggugaccagaguggugaaccugccccuggugagcagcaccuacgaccugaugagcagcgccuaccugagcaccaaggaccaguaccccuaccugaagagcgugugcgagauggccgagaacggcgugaagaccaucaccagcguggccaugaccagcgcccugcccaucauccagaagcuggagccccagaucgccguggccaacaccuacgccugcaagggccuggacagaaucgaggagagacugcccauccugaaccagcccagcacccagaucguggccaacgccaagggcgccgugaccggcgccaaggacgccgugaccaccaccgugaccggcgccaaggacagcguggccagcaccaucaccggcgugauggacaagaccaagggcgccgugaccggcagcguggagaagaccaagagcguggugagcggcagcaucaacaccgugcugggcagcagaaugaugcagcuggugagcagcggcguggagaacgcccugaccaagagcgagcugcugguggagcaguaccugccccugaccgaggaggagcuggagaaggaggccaagaagguggagggcuucgaccuggugcagaagcccagcuacuacgugagacugggcagccugagcaccaagcugcacagcagagccuaccagcaggcccugagcagagugaaggaggccaagcagaagagccagcagaccaucagccagcugcacagcaccgugcaccugaucgaguucgccagaaagaacguguacagcgccaaccagaagauccaggacgcccaggacaagcuguaccugagcuggguggaguggaagagaagcaucggcuacgacgacaccgacgagagccacugcgccgagcacaucgagagcagaacccuggccaucgccagaaaccugacccagcagcugcagaccaccugccacacccugcugagcaacauccagggcgugccccagaacauccaggaccaggccaagcacaugggcgugauggccggcgacaucuacagcguguucagaaacgccgccagcuucaaggaggugagcgacagccugcugaccagcagcaagggccagcugcagaagaugaaggagagccuggacgacgugauggacuaccuggugaacaacaccccccugaacuggcuggugggccccuucuacccccagcugaccgagagccagaacgcccaggaccagggcgccgagauggacaagagcagccaggagacccagagaagcgagcacaagacccacuaa

SEQ ID NO: 21673 - RNA, 1269 nt, Artificial Sequence
  PLIN3__Homo_sapiens__NP_001157666
augagcgccgacggcgccgaggccgacggcagcacccaggugaccguggaggagcccgugcagcagcccagcgugguggacagaguggccagcaugccccugaucagcagcaccugcgacauggugagcgccgccuacgccagcaccaaggagagcuacccccacaucaagaccgugugcgacgccgccgagaagggcgugagaacccugaccgccgccgccgugagcggcgcccagcccauccugagcaagcuggagccccagaucgccagcgccagcgaguacgcccacagaggccuggacaagcuggaggagaaccugcccauccugcagcagcccaccgagaaggugagcggcgcccaggagauggugagcagcgccaaggacaccguggccacccagcugagcgaggccguggacgccaccagaggcgccgugcagagcggcguggacaagaccaagagcguggugaccggcggcgugcagagcgugaugggcagcagacugggccagauggugcugagcggcguggacaccgugcugggcaagagcgaggagugggccgacaaccaccugccccugaccgacgccgagcuggccagaaucgccaccagccuggacggcuucgacguggccagcgugcagcagcagagacaggagcagagcuacuucgugagacugggcagccugagcgagagacugagacagcacgccuacgagcacagccugggcaagcugagagccaccaagcagagagcccaggaggcccugcugcagcugagccaggugcugagccugauggagaccgugaagcagggcguggaccagaagcugguggagggccaggagaagcugcaccagauguggcugagcuggaaccagaagcagcugcagggccccgagaaggagccccccaagcccgagcagguggagagcagagcccugaccauguucagagacaucgcccagcagcugcaggccaccugcaccagccugggcagcagcauccagggccugcccaccaacgugaaggaccaggugcagcaggccagaagacagguggaggaccugcaggccaccuucagcagcauccacagcuuccaggaccugagcagcagcauccuggcccagagcagagagagaguggccagcgccagagaggcccuggaccacaugguggaguacguggcccagaacacccccgugaccuggcuggugggccccuucgcccccggcaucaccgagaaggcccccgaggagaagaaguaa

SEQ ID NO: 21674 - RNA, 4074 nt, Artificial Sequence
  PLIN4__Homo_sapiens__NP_001073869
augcagacccugggcagcuucuucggcagccugcccggcuucagcagcgccagaaaccugguggccaacgcccacagcagcgccagagccagacccgccgccgaccccaccggcgcccccgccgccgaggccgcccagccccaggcccagguggccgcccaccccgagcagaccgcccccuggaccgagaaggagcugcagcccagcgagaagcagauggugagcggcgccaaggaccuggugugcagcaagaugagcagagccaaggacgccgugagcagcggcguggccagcgugguggacguggccaagggcguggugcagggcggccuggacaccaccagaagcgcccugaccggcaccaaggagguggugagcagcggcgugaccggcgccauggacauggccaagggcgccgugcagggcggccuggacaccagcaaggccgugcugaccggcaccaaggacaccgugagcaccggccugaccggcgccgugaacguggccaagggcaccgugcaggccggcguggacaccaccaagaccgugcugaccggcaccaaggacaccgugaccaccggcgugaugggcgccgugaaccuggccaagggcaccgugcagaccggcguggagaccagcaaggccgugcugaccggcaccaaggacgccgugagcaccggccugaccggcgccgugaacguggccagaggcagcauccagaccggcguggacaccagcaagaccgugcugaccggcaccaaggacaccgugugcagcggcgugaccggcgccaugaacguggccaagggcaccauccagaccggcguggacaccagcaagaccgugcugaccggcaccaaggacaccgugugcagcggcgugaccggcgccaugaacguggccaagggcaccauccagaccggcguggacaccagcaagaccgugcugaccggcaccaaggacaccgugugcagcggcgugaccggcgccaugaacguggccaagggcaccauccagaccggcguggacaccaccaagaccgugcugaccggcaccaagaacaccgugugcagcggcgugaccggcgccgugaaccuggccaaggaggccauccagggcggccuggacaccaccaagagcauggugaugggcaccaaggacaccaugagcaccggccugaccggcgccgccaacguggccaagggcgccaugcagaccggccugaacaccacccagaacaucgccaccggcaccaaggacaccgugugcagcggcgugaccggcgccaugaaccuggccagaggcaccauccagaccggcguggacaccaccaagaucgugcugaccggcaccaaggacaccgugugcagcggcgugaccggcgccgccaacguggccaagggcgccgugcagggcggccuggacaccaccaagagcgugcugaccggcaccaaggacgccgugagcaccggccugaccggcgccgugaacguggccaagggcaccgugcagaccggcguggacaccaccaagaccgugcugaccggcaccaaggacaccgugugcagcggcgugaccagcgccgugaacguggccaagggcgccgugcagggcggccuggacaccaccaagagcguggugaucggcaccaaggacaccaugagcaccggccugaccggcgccgccaacguggccaagggcgccgugcagaccggcguggacaccgccaagaccgugcugaccggcaccaaggacaccgugaccaccggccuggugggcgccgugaacguggccaagggcaccgugcagaccggcauggacaccaccaagaccgugcugaccggcaccaaggacaccaucuacagcggcgugaccagcgccgugaacguggccaagggcgccgugcagaccggccugaagaccacccagaacaucgccaccggcaccaagaacaccuucggcagcggcgugaccagcgccgugaacguggccaagggcgccgcccagaccggcguggacaccgccaagaccgugcugaccggcaccaaggacaccgugaccaccggccugaugggcgccgugaacguggccaagggcaccgugcagaccagcguggacaccaccaagaccgugcugaccggcaccaaggacaccgugugcagcggcgugaccggcgccgccaacguggccaagggcgccauccagggcggccuggacaccaccaagagcgugcugaccggcaccaaggacgccgugagcaccggccugaccggcgccgugaagcuggccaagggcaccgugcagaccggcauggacaccaccaagaccgugcugaccggcaccaaggacgccgugugcagcggcgugaccggcgccgccaacguggccaagggcgccgugcagaugggcguggacaccgccaagaccgugcugaccggcaccaaggacaccgugugcagcggcgugaccggcgccgccaacguggccaagggcgccgugcagaccggccugaagaccacccagaacaucgccaccggcaccaagaacacccugggcagcggcgugaccggcgccgccaagguggccaagggcgccgugcagggcggccuggacaccaccaagagcgugcugaccggcaccaaggacgccgugagcaccggccugaccggcgccgugaaccuggccaagggcaccgugcagaccggcguggacaccagcaagaccgugcugaccggcaccaaggacaccgugugcagcggcgugaccggcgccgugaacguggccaagggcaccgugcagaccggcguggacaccgccaagaccgugcugagcggcgccaaggacgccgugaccaccggcgugaccggcgccgugaacguggccaagggcaccgugcagaccggcguggacgccagcaaggccgugcugaugggcaccaaggacaccguguucagcggcgugaccggcgccaugagcauggccaagggcgccgugcagggcggccuggacaccaccaagaccgugcugaccggcaccaaggacgccgugagcgccggccugaugggcagcggcaacguggccaccggcgccacccacaccggccugagcaccuuccagaacuggcugcccagcacccccgccaccagcuggggcggccugaccagcagcagaaccaccgacaacggcggcgagcagaccgcccugagcccccaggaggcccccuucagcggcaucagcaccccccccgacgugcugagcgugggccccgagcccgccugggaggccgccgccaccaccaagggccuggccaccgacguggccaccuucacccagggcgccgcccccggcagagaggacaccggccugcuggccaccacccacggccccgaggaggcccccagacuggccaugcugcagaacgagcuggagggccugggcgacaucuuccaccccaugaacgccgaggagcaggcccagcuggccgccagccagcccggccccaaggugcugagcgccgagcagggcagcuacuucgugagacugggcgaccugggccccagcuucagacagagagccuucgagcacgccgugagccaccugcagcacggccaguuccaggccagagacacccuggcccagcugcaggacugcuucagacugaucgagaaggcccagcaggcccccgagggccagcccagacuggaccagggcagcggcgccagcgccgaggacgccgccgugcaggaggagagagacgccggcgugcugagcagagugugcggccugcugagacagcugcacaccgccuacagcggccuggugagcagccugcagggccugcccgccgagcugcagcagcccgugggcagagccagacacagccugugcgagcuguacggcaucguggccagcgccggcagcguggaggagcugcccgccgagagacuggugcagagcagagagggcgugcaccaggccuggcagggccuggagcagcugcuggagggccugcagcacaaccccccccugagcuggcuggugggccccuucgcccugcccgccggcggccaguaa

SEQ ID NO: 21675 - RNA, 1392 nt, Artificial Sequence
  PLIN5__Homo_sapiens__NP_001013728
augagcgaggaggaggccgcccagauccccagaagcagcgugugggagcaggaccagcagaacguggugcagagagugguggcccugccccuggugagagccaccugcaccgccgugugcgacguguacagcgccgccaaggacagacacccccugcugggcagcgccugcagacuggccgagaacugcgugugcggccugaccaccagagcccuggaccacgcccagccccugcuggagcaccugcagccccagcuggccaccaugaacagccuggccugcagaggccuggacaagcuggaggagaagcugcccuuccugcagcagcccagcgagaccguggugaccagcgccaaggacgugguggccagcagcgugaccggcgugguggaccuggccagaagaggcagaagauggagcguggagcugaagagaagcgugagccacgccguggacguggugcuggagaagagcgaggagcugguggaccacuuccugcccaugaccgaggaggagcuggccgcccuggccgccgaggccgagggccccgaggugggcagcguggaggaccagagaagacagcagggcuacuucgugagacugggcagccugagcgccagaaucagacaccuggccuacgagcacagcgugggcaagcugagacagagcaagcacagagcccaggacacccuggcccagcugcaggagacccuggagcugaucgaccacaugcagugcggcgugacccccaccgcccccgccugccccggcaaggugcacgagcuguggggcgaguggggccagagaccccccgagagcagaagaagaagccaggccgagcuggagacccuggugcugagcagaagccugacccaggagcugcagggcaccguggaggcccuggagagcagcgugagaggccugcccgccggcgcccaggagaagguggccgaggugagaagaagcguggacgcccugcagaccgccuucgccgacgccagaugcuucagagacgugcccgccgccgcccuggccgagggcagaggcagaguggcccacgcccacgccugcguggacgagcugcuggagcugguggugcaggccgugccccugcccuggcuggugggccccuucgcccccauccugguggagagacccgagccccugcccgaccuggccgaccugguggacgaggugaucggcggccccgaccccagaugggcccaccuggacuggcccgcccagcagagagccugggaggccgagcacagagacggcagcggcaacggcgacggcgacagaaugggcguggccggcgacaucugcgagcaggagcccgagacccccagcugccccgugaagcacacccugaugcccgagcuggacuucuaa

SEQ ID NO: 21676 - RNA, 1812 nt, Artificial Sequence
  PLK1__Homo_sapiens__NP_005021
augagcgccgccgugaccgccggcaagcuggccagagcccccgccgaccccggcaaggccggcgugcccggcguggccgcccccggcgcccccgccgccgccccccccgccaaggagauccccgaggugcugguggaccccagaagcagaagaagauacgugagaggcagauuccugggcaagggcggcuucgccaagugcuucgagaucagcgacgccgacaccaaggagguguucgccggcaagaucgugcccaagagccugcugcugaagccccaccagagagagaagaugagcauggagaucagcauccacagaagccuggcccaccagcacguggugggcuuccacggcuucuucgaggacaacgacuucguguucguggugcuggagcugugcagaagaagaagccugcuggagcugcacaagagaagaaaggcccugaccgagcccgaggccagauacuaccugagacagaucgugcugggcugccaguaccugcacagaaacagagugauccacagagaccugaagcugggcaaccuguuccugaacgaggaccuggaggugaagaucggcgacuucggccuggccaccaagguggaguacgacggcgagagaaagaagacccugugcggcacccccaacuacaucgcccccgaggugcugagcaagaagggccacagcuucgagguggacguguggagcaucggcugcaucauguacacccugcuggugggcaagccccccuucgagaccagcugccugaaggagaccuaccugagaaucaagaagaacgaguacagcauccccaagcacaucaaccccguggccgccagccugauccagaagaugcugcagaccgaccccaccgccagacccaccaucaacgagcugcugaacgacgaguucuucaccagcggcuacauccccgccagacugcccaucaccugccugaccaucccccccagauucagcaucgcccccagcagccuggaccccagcaacagaaagccccugaccgugcugaacaagggccuggagaacccccugcccgagagacccagagagaaggaggagcccguggugagagagaccggcgaggugguggacugccaccugagcgacaugcugcagcagcugcacagcgugaacgccagcaagcccagcgagagaggccuggugagacaggaggaggccgaggaccccgccugcauccccaucuucugggugagcaaguggguggacuacagcgacaaguacggccugggcuaccagcugugcgacaacagcgugggcgugcuguucaacgacagcaccagacugauccuguacaacgacggcgacagccugcaguacaucgagagagacggcaccgagagcuaccugaccgugagcagccaccccaacagccugaugaagaagaucacccugcugaaguacuucagaaacuacaugagcgagcaccugcugaaggccggcgccaacaucacccccagagagggcgacgagcuggccagacugcccuaccugagaaccugguucagaaccagaagcgccaucauccugcaccugagcaacggcagcgugcagaucaacuucuuccaggaccacaccaagcugauccugugcccccugauggccgccgugaccuacaucgacgagaagagagacuucagaaccuacagacugagccugcuggaggaguacggcugcugcaaggagcuggccagcagacugagauacgccagaaccaugguggacaagcugcugagcagcagaagcgccagcaacagacugaaggccagcuaa

SEQ ID NO: 21677 - RNA, 2016 nt, Artificial Sequence
  PLK2__Homo_sapiens__NP_001239155
auggagcugcugagaaccaucaccuaccagcccgccgccagcaccaagaugugcgagcaggcccugggcaagggcugcggcgccgacagcaagaagaagagacccccccagccccccgaggagagccagcccccccagagccaggcccaggugccccccgccaucagcagaaucaucguggaccccaccaccggcaagagauacugcagaggcaaggugcugggcaagggcggcuucgccaagugcuacgagaugaccgaccugaccaacaacaagguguacgccgccaagaucaucccccacagcagaguggccaagccccaccagagagagaagaucgacaaggagaucgagcugcacagaauccugcaccacaagcacguggugcaguucuaccacuacuucgaggacaaggagaacaucuacauccugcuggaguacugcagcagaagaagcauggcccacauccugaaggccagaaaggugcugaccgagcccgaggugagauacuaccugagacagaucgugagcggccugaaguaccugcacgagcaggagauccugcacagagaccugaagcugggcaacuucuucaucaacgaggccauggagcugaaggugggcgacuucggccuggccgccagacuggagccccuggagcacagaagaagaaccaucugcggcacccccaacuaccugagccccgaggugcugaacaagcagggccacggcugcgagagcgacaucugggcccugggcugcgugauguacaccaugcugcugggcagaccccccuucgagaccaccaaccugaaggagaccuacagaugcaucagagaggccagauacaccaugcccagcagccugcuggcccccgccaagcaccugaucgccagcaugcugagcaagaaccccgaggacagacccagccuggacgacaucaucagacacgacuucuuccugcagggcuucacccccgacagacugagcagcagcugcugccacaccgugcccgacuuccaccugagcagccccgccaagaacuucuucaagaaggccgccgccgcccuguucggcggcaagaaggacaaggccagauacaucgacacccacaacagagugagcaaggaggacgaggacaucuacaagcugagacacgaccugaagaagaccagcaucacccagcagcccagcaagcacagaaccgacgaggagcugcagccccccaccaccaccguggccagaagcggcacccccgccguggagaacaagcagcagaucggcgacgccaucagaaugaucgugagaggcacccugggcagcugcagcagcagcagcgagugccuggaggacagcaccaugggcagcguggccgacaccguggccagagugcugagaggcugccuggagaacaugcccgaggccgacugcauccccaaggagcagcugagcaccagcuuccagugggugaccaaguggguggacuacagcaacaaguacggcuucggcuaccagcugagcgaccacaccgugggcgugcuguucaacaacggcgcccacaugagccugcugcccgacaagaagaccgugcacuacuacgccgagcugggccagugcagcguguuccccgccaccgacgcccccgagcaguucaucagccaggugaccgugcugaaguacuucagccacuacauggaggagaaccugauggacggcggcgaccugcccagcgugaccgacaucagaagacccagacuguaccugcugcaguggcugaagagcgacaaggcccugaugaugcuguucaacgacggcaccuuccaggugaacuucuaccacgaccacaccaagaucaucaucugcagccagaacgaggaguaccugcugaccuacaucaacgaggacagaaucagcaccaccuucagacugaccacccugcugaugagcggcugcagcagcgagcugaagaacagaauggaguacgcccugaacaugcugcugcagagaugcaacuaa

SEQ ID NO: 21678 - RNA, 2817 nt, Artificial Sequence
  PLK4__Homo_sapiens__NP_001177728
auggccaccugcaucggcgagaagaucgaggacuucaaggugggcaaccugcugggcaagggcagcuucgccggcguguacagagccgagagcauccacaccggccuggagguggccaucaagaugcuguacaacuacuucgaggacagcaacuacguguaccuggugcuggagaugugccacaacggcgagaugaacagauaccugaagaacagagugaagcccuucagcgagaacgaggccagacacuucaugcaccagaucaucaccggcaugcuguaccugcacagccacggcauccugcacagagaccugacccugagcaaccugcugcugaccagaaacaugaacaucaagaucgccgacuucggccuggccacccagcugaagaugccccacgagaagcacuacacccugugcggcacccccaacuacaucagccccgagaucgccaccagaagcgcccacggccuggagagcgacguguggagccugggcugcauguucuacacccugcugaucggcagaccccccuucgacaccgacaccgugaagaacacccugaacaagguggugcuggccgacuacgagaugcccagcuuccugagcaucgaggccaaggaccugauccaccagcugcugagaagaaaccccgccgacagacugagccugagcagcgugcuggaccaccccuucaugagcagaaacagcagcaccaagagcaaggaccugggcaccguggaggacagcaucgacagcggccacgccaccaucagcaccgccaucaccgccagcagcagcaccagcaucagcggcagccuguucgacaagagaagacugcugaucggccagccccugcccaacaagaugaccguguuccccaagaacaagagcagcaccgacuucagcagcagcggcgacggcaacagcuucuacacccaguggggcaaccaggagaccagcaacagcggcagaggcagagugauccaggacgccgaggagagaccccacagcagauaccugagaagagccuacagcagcgacagaagcggcaccagcaacagccagagccaggccaagaccuacaccauggagagaugccacagcgccgagaugcugagcgugagcaagagaagcggcggcggcgagaacgaggagagauacagccccaccgacaacaacgccaacaucuucaacuucuucaaggagaagaccagcagcagcagcggcagcuucgagagacccgacaacaaccaggcccugagcaaccaccugugccccggcaagacccccuuccccuucgccgaccccaccccccagaccgagaccgugcagcagugguucggcaaccugcagaucaacgcccaccugagaaagaccaccgaguacgacagcaucagccccaacagagacuuccagggccaccccgaccugcagaaggacaccagcaagaacgccuggaccgacaccaaggugaagaagaacagcgacgccagcgacaacgcccacagcgugaagcagcagaacaccaugaaguacaugaccgcccugcacagcaagcccgagaucauccagcaggagugcguguucggcagcgacccccugagcgagcagagcaagaccagaggcauggagccccccuggggcuaccagaacagaacccugagaagcaucaccagcccccugguggcccacagacugaagcccaucagacagaagaccaagaaggccguggugagcauccuggacagcgaggaggugugcguggagcuggugaaggaguacgccagccaggaguacgugaaggaggugcugcagaucagcagcgacggcaacaccaucaccaucuacuaccccaacggcggcagaggcuucccccuggccgacagaccccccagccccaccgacaacaucagcagauacagcuucgacaaccugcccgagaaguacuggagaaaguaccaguacgccagcagauucgugcagcuggugagaagcaagagccccaagaucaccuacuucaccagauacgccaagugcauccugauggagaacagccccggcgccgacuucgaggugugguucuacgacggcgugaagauccacaagaccgaggacuucauccaggugaucgagaagaccggcaagagcuacacccugaagagcgagagcgaggugaacagccugaaggaggagaucaagauguacauggaccacgccaacgagggccacagaaucugccuggcccuggagagcaucaucagcgaggaggagagaaagaccagaagcgcccccuucuuccccaucaucaucggcagaaagcccggcagcaccagcagccccaaggcccugagccccccccccagcguggacagcaacuaccccaccagagagagagccagcuucaacagaauggugaugcacagcgccgccagccccacccaggcccccauccugaaccccagcauggugaccaacgagggccugggccugaccaccaccgccagcggcaccgacaucagcagcaacagccugaaggacugccugcccaagagcgcccagcugcugaagagcguguucgugaagaacgugggcugggccacccagcugaccagcggcgccgugugggugcaguucaacgacggcagccagcugguggugcaggccggcgugagcagcaucagcuacaccagccccaacggccagaccaccagauacggcgagaacgagaagcugcccgacuacaucaagcagaagcugcagugccugagcagcauccugcugauguucagcaaccccacccccaacuuccacuaa

SEQ ID NO: 21679 - RNA, 1011 nt, Artificial Sequence
  PLK5__Homo_sapiens__NP_001230008
auguacaccgugcugaccggcaccccccccuucauggccagcccccugagcgagauguaccagaacaucagagagggccacuaccccgagcccgcccaccugagcgccaacgccagaagacugaucgugcaccugcuggcccccaaccccgccgagagacccagccuggaccaccugcugcaggacgacuucuucacccagggcuucacccccgacagacugcccgcccacagcugccacagcccccccaucuucgccaucccccccccccugggcagaaucuucagaaaggugggccagagacugcugacccagugcagaccccccugccccuucacccccaaggaggccagcggccccggcgagggcggccccgaccccgacagcauggagugggacggcgagagcagccugagcgccaaggaggugcccugccuggagggccccauccaccugguggcccagggcacccugcagagcgaccuggccggccccgagggcagcagaagacccgagguggaggccgcccugagacaccugcagcugugccuggacgugggcccccccgccacccaggacccccugggcgagcagcagcccauccugugggcccccaaguggguggacuacagcagcaaguacggcuucggcuaccagcugcuggacggcggcagaaccggcagacacccccacggccccgccacccccagaagagagggcacccugcccacccccgugccccccgccggccccggccugugccugcugagauuccuggccagcgagcacgcccugcugcugcuguucagcaacggcauggugcaggugagcuucagcggcgugcccgcccagcuggugcugagcggcgagggcgagggccugcagcugacccugugggagcagggcagccccggcaccagcuacagccuggacgugcccagaagccacggcugcgcccccaccaccggccagcaccugcaccacgcccugagaaugcugcagagcaucuaa

SEQ ID NO: 21680 - RNA, 549 nt, Artificial Sequence
  PLLP__Homo_sapiens__NP_057077
auggccgaguuccccagcaaggugagcaccagaaccagcagccccgcccagggcgccgaggccagcgugagcgcccugagacccgaccugggcuucgugagaagcagacugggcgcccugaugcugcugcagcuggugcugggccugcuggugugggcccugaucgccgacacccccuaccaccuguaccccgccuacggcugggugauguucguggccguguuccuguggcuggugaccaucgugcuguucaaccuguaccuguuccagcugcacaugaagcuguacauggugcccuggccccuggugcugaugaucuucaacaucagcgccaccgugcuguacaucaccgccuucaucgccugcagcgccgccguggaccugaccagccugagaggcaccagacccuacaaccagagagccgccgccagcuucuucgccugccuggugaugaucgccuacggcgugagcgccuucuucagcuaccaggccuggagaggcgugggcagcaacgccgccaccagccagauggccggcggcuacgccuaa

SEQ ID NO: 21681 - RNA, 159 nt, Artificial Sequence
  PLN__Homo_sapiens__NP_002658
auggagaaggugcaguaccugaccagaagcgccaucagaagagccagcaccaucgagaugccccagcaggccagacagaagcugcagaaccuguucaucaacuucugccugauccugaucugccugcugcugaucugcaucaucgugaugcugcuguaa

SEQ ID NO: 21682 - RNA, 2214 nt, Artificial Sequence
  PLOD2__Homo_sapiens__NP_000926
augggcggcugcaccgugaagccccagcugcugcugcuggcccuggugcugcaccccuggaaccccugccugggcgccgacagcgagaagcccagcagcauccccaccgacaagcugcuggugaucaccguggccaccaaggagagcgacggcuuccacagauucaugcagagcgccaaguacuucaacuacaccgugaaggugcugggccagggcgaggaguggagaggcggcgacggcaucaacagcaucggcggcggccagaaggugagacugaugaaggaggugauggagcacuacgccgaccaggacgaccugguggugauguucaccgagugcuucgacgugaucuucgccggcggccccgaggaggugcugaagaaguuccagaaggccaaccacaaggugguguucgccgccgacggcauccuguggcccgacaagagacuggccgacaaguaccccguggugcacaucggcaagagauaccugaacagcggcggcuucaucggcuacgcccccuacgugaacagaaucgugcagcaguggaaccugcaggacaacgacgacgaccagcuguucuacaccaagguguacaucgacccccugaagagagaggccaucaacaucacccuggaccacaagugcaagaucuuccagacccugaacggcgccguggacgagguggugcugaaguucgagaacggcaaggccagagccaagaacaccuucuacgagacccugcccguggccaucaacggcaacggccccaccaagauccugcugaacuacuucggcaacuacgugcccaacagcuggacccaggacaacggcugcacccugugcgaguucgacaccguggaccugagcgccguggacgugcaccccaacgugagcaucggcguguucaucgagcagcccacccccuuccugcccagauuccuggacauccugcugacccuggacuaccccaaggaggcccugaagcuguucauccacaacaaggagguguaccacgagaaggacaucaagguguucuucgacaaggccaagcacgagaucaagaccaucaagaucgugggccccgaggagaaccugagccaggccgaggccagaaacaugggcauggacuucugcagacaggacgagaagugcgacuacuacuucagcguggacgccgacguggugcugaccaaccccagaacccugaagauccugaucgagcagaacagaaagaucaucgccccccuggugaccagacacggcaagcuguggagcaacuucuggggcgcccugagccccgacggcuacuacgccagaagcgaggacuacguggacaucgugcagggcaacagagugggcguguggaacgugcccuacauggccaacguguaccugaucaagggcaagacccugagaagcgagaugaacgagagaaacuacuucgugagagacaagcuggaccccgacauggcccugugcagaaacgccagagagaugggcguguucauguacaucagcaacagacacgaguucggcagacugcugagcaccgccaacuacaacaccagccacuacaacaacgaccuguggcagaucuucgagaaccccguggacuggaaggagaaguacaucaacagagacuacagcaagaucuucaccgagaacaucguggagcagcccugccccgacguguucugguuccccaucuucagcgagaaggccugcgacgagcugguggaggagauggagcacuacggcaaguggagcggcggcaagcaccacgacagcagaaucagcggcggcuacgagaacgugcccaccgacgacauccacaugaagcagguggaccuggagaacguguggcugcacuucaucagagaguucaucgcccccgugacccugaagguguucgccggcuacuacaccaagggcuucgcccugcugaacuucguggugaaguacagccccgagagacagagaagccugagaccccaccacgacgccagcaccuucaccaucaacaucgcccugaacaacgugggcgaggacuuccagggcggcggcugcaaguuccugagauacaacugcagcaucgagagccccagaaagggcuggagcuucaugcaccccggcagacugacccaccugcacgagggccugcccgugaagaacggcaccagauacaucgccgugagcuucaucgaccccuaa

SEQ ID NO: 21683 - RNA, 834 nt, Artificial Sequence
  PLP1__Homo_sapiens__NP_000524
augggccugcuggagugcugcgccagaugccuggugggcgcccccuucgccagccugguggccaccggccugugcuucuucggcguggcccuguucugcggcugcggccacgaggcccugaccggcaccgagaagcugaucgagaccuacuucagcaagaacuaccaggacuacgaguaccugaucaacgugauccacgccuuccaguacgugaucuacggcaccgccagcuucuucuuccuguacggcgcccugcugcuggccgagggcuucuacaccaccggcgccgugagacagaucuucggcgacuacaagaccaccaucugcggcaagggccugagcgccaccgugaccggcggccagaagggcagaggcagcagaggccagcaccaggcccacagccuggagagagugugccacugccugggcaaguggcugggccaccccgacaaguucgugggcaucaccuacgcccugaccgugguguggcugcugguguucgccugcagcgccgugcccguguacaucuacuucaacaccuggaccaccugccagagcaucgccuuccccagcaagaccagcgccagcaucggcagccugugcgccgacgccagaauguacggcgugcugcccuggaacgccuuccccggcaaggugugcggcagcaaccugcugagcaucugcaagaccgccgaguuccagaugaccuuccaccuguucaucgccgccuucgugggcgccgccgccacccuggugagccugcugaccuucaugaucgccgccaccuacaacuucgccgugcugaagcugaugggcagaggcaccaaguucuaa

SEQ ID NO: 21684 - RNA, 459 nt, Artificial Sequence
  PLP2__Homo_sapiens__NP_002659
auggccgacagcgagagacugagcgcccccggcugcugggccgccugcaccaacuucagcagaaccagaaagggcauccugcuguucgccgagaucauccugugccuggugauccugaucugcuucagcgccagcacccccggcuacagcagccugagcgugaucgagaugauccuggccgccaucuucuucgugguguacaugugcgaccugcacaccaagauccccuucaucaacuggcccuggagcgacuucuucagaacccugaucgccgccauccuguaccugaucaccagcaucguggugcugguggagagaggcaaccacagcaagaucguggccggcgugcugggccugaucgccaccugccuguucggcuacgacgccuacgugaccuuccccgugagacagcccagacacaccgccgcccccaccgaccccgccgacggccccguguaa

SEQ ID NO: 21685 - RNA, 1518 nt, Artificial Sequence
  PLRG1__Homo_sapiens__NP_001188493
augguggaggaggugcagaagcacagcgugcacacccugguguucagaagccugaagagaacccacgacauguucguggccgacaacggcaagcccgugccccuggacgaggagagccacaagagaaagauggccaucaagcugagaaacgaguacggccccgugcugcacaugcccaccagcaaggagaaccugaaggagaagggcccccagaacgccaccgacagcuacgugcacaagcaguaccccgccaaccagggccaggagguggaguacuucguggccggcguggcccugaccgccgacaccaagauccagagaaugcccagcgagagcgccgcccagagccuggccguggcccugccccugcagaccaaggccgacgccaacagaaccgcccccagcggcagcgaguacagacaccccggcgccagcgacagaccccagcccaccgccaugaacagcaucgugauggagaccggcaacaccaagaacagcgcccugauggccaagaaggcccccaccaugcccaagccccaguggcacccccccuggaagcuguacagagugaucagcggccaccugggcugggugagaugcaucgccguggagcccggcaaccagugguucgugaccggcagcgccgacagaaccaucaagaucugggaccuggccagcggcaagcugaagcugagccugaccggccacaucagcaccgugagaggcgugaucgugagcaccagaagccccuaccuguucagcugcggcgaggacaagcaggugaagugcugggaccuggaguacaacaaggugaucagacacuaccacggccaccugagcgccguguacggccuggaccugcaccccaccaucgacgugcuggugaccugcagcagagacagcaccgccagaaucugggacgugagaaccaaggccagcgugcacacccugagcggccacaccaacgccguggccaccgugagaugccaggccgccgagccccagaucaucaccggcagccacgacaccaccaucagacugugggaccugguggccggcaagaccagagugacccugaccaaccacaagaagagcgugagagccguggugcugcaccccagacacuacaccuucgccagcggcagccccgacaacaucaagcaguggaaguuccccgacggcagcuucauccagaaccugagcggccacaacgccaucaucaacacccugaccgugaacagcgacggcgugcuggugagcggcgccgacaacggcaccaugcaccugugggacuggagaaccggcuacaacuuccagagagugcacgccgccgugcagcccggcagccuggacagcgagagcggcaucuucgccugcgccuucgaccagagcgagagcagacugcugaccgccgaggccgacaagaccaucaagguguacagagaggacgacaccgccaccgaggagacccaccccgugagcuggaagcccgagaucaucaagagaaagagauucuaa

SEQ ID NO: 21686 - RNA, 1890 nt, Artificial Sequence
  PLS1__Homo_sapiens__NP_001138791
auggagaacagcaccaccaccaucagcagagaggagcuggaggagcugcaggaggccuucaacaagaucgacaucgacaacagcggcuacgugagcgacuacgagcugcaggaccuguucaaggaggccagccugccccugcccggcuacaaggugagagagaucguggagaagauccugagcguggccgacagcaacaaggacggcaagaucagcuucgaggaguucgugagccugaugcaggagcugaagagcaaggacaucagcaagaccuucagaaagaucaucaacaagagagagggcaucaccgccaucggcggcaccagcaccaucagcagcgagggcacccagcacagcuacagcgaggaggagaagguggccuucgugaacuggaucaacaaggcccuggagaacgaccccgacugcaagcaccugauccccaugaaccccaacgacgacagccuguucaagagccuggccgacggcauccugcugugcaagaugaucaaccugagcgagcccgacaccaucgacgagagagccaucaacaagaagaagcugacccccuucaccaucagcgagaaccugaaccuggcccugaacagcgccagcgccaucggcugcaccguggugaacaucggcgccagcgaccugaaggagggcaagccccaccuggugcugggccugcuguggcagaucaucaaggugggccuguucgccgacaucgagaucagcagaaacgaggcccugaucgcccugcugaacgagggcgaggagcuggaggagcugaugaagcugagccccgaggagcugcugcugagaugggugaacuaccaccugaccaacgccggcuggcacaccaucagcaacuucagccaggacaucaaggacagcagagccuacuuccaccugcugaaccagaucgcccccaagggcggcgaggacggccccgccaucgccaucgaccugagcggcaucaacgagaccaacgaccugaagagagccggccugaugcugcaggaggccgacaagcugggcugcaagcaguucgugacccccgccgacguggugagcggcaaccccaagcugaaccuggccuucguggccaaccuguucaacaccuaccccugccugcacaagcccaacaacaacgacaucgacaugaaccugcuggagggcgagagcaaggaggagagaaccuucagaaacuggaugaacagccugggcgugaaccccuacaucaaccaccuguacagcgaccuggccgacgcccuggugaucuuccagcuguacgagaugaucagagugcccgugaacuggagccacgugaacaagccccccuaccccgcccugggcggcaacaugaagaagaucgagaacugcaacuacgccguggagcugggcaagaacaaggccaaguucagccuggugggcaucgccggccaggaccugaacgagggcaacagcacccugacccuggcccugguguggcagcugaugagaagauacacccugaacgugcugagcgaccugggcgagggcgagaaggugaacgacgagaucaucaucaagugggugaaccagacccugaagagcgccaacaagaagaccagcaucagcagcuucaaggacaagagcaucagcaccagccugcccgugcuggaccugaucgacgccaucgcccccaacgccgugagacaggagaugaucagaagagagaaccugagcgacgaggacaagcugaacaacgccaaguacgccaucagcguggccagaaagaucggcgccagaaucuacgcccugcccgacgaccugguggaggugaagcccaagauggugaugaccguguucgccugccugaugggcaagggccugaacagaaucaaguaa

SEQ ID NO: 21687 - RNA, 1854 nt, Artificial Sequence
  PLS3__Homo_sapiens__NP_001269266
auggaggaccugaacagcaacggcuucaucugcgacuacgagcugcacgagcuguucaaggaggccaacaugccccugcccggcuacaaggugagagagaucauccagaagcugaugcuggacggcgacagaaacaaggacggcaagaucagcuucgacgaguucguguacaucuuccaggaggugaagagcagcgacaucgccaagaccuucagaaaggccaucaacagaaaggagggcaucugcgcccugggcggcaccagcgagcugagcagcgagggcacccagcacagcuacagcgaggaggagaaguacgccuucgugaacuggaucaacaaggcccuggagaacgaccccgacugcagacacgugauccccaugaaccccaacaccgacgaccuguucaaggccgugggcgacggcaucgugcugugcaagaugaucaaccugagcgugcccgacaccaucgacgagagagccaucaacaagaagaagcugacccccuucaucauccaggagaaccugaaccuggcccugaacagcgccagcgccaucggcugccacguggugaacaucggcgccgaggaccugagagccggcaagccccaccuggugcugggccugcuguggcagaucaucaagaucggccuguucgccgacaucgagcugagcagaaacgaggcccuggccgcccugcugagagacggcgagacccuggaggagcugaugaagcugagccccgaggagcugcugcugagaugggccaacuuccaccuggagaacagcggcuggcagaagaucaacaacuucagcgccgacaucaagcugaucgacuucagcaacagcgugaaggacagcaaggccuacuuccaccugcugaaccagaucgcccccaagggccagaaggagggcgagcccagaaucgacaucaacaugagcggcuucaacgagaccgacgaccugaagagagccgagagcaugcugcagcaggccgacaagcugggcugcagacaguucgugacccccgccgacguggugagcggcaaccccaagcugaaccuggccuucguggccaaccuguucaacaaguaccccgcccugaccaagcccgagaaccaggacaucgacuggacccugcuggagggcgagaccagagaggagagaaccuucagaaacuggaugaacagccugggcgugaacccccacgugaaccaccuguacgccgaccugcaggacgcccuggugauccugcagcuguacgagagaaucaaggugcccguggacuggagcaaggugaacaagccccccuaccccaagcugggcgccaacaugaagaagcuggagaacugcaacuacgccguggagcugggcaagcaccccgccaaguucagccuggugggcaucggcggccaggaccugaacgacggcaaccagacccugacccuggcccugguguggcagcugaugagaagauacacccugaacgugcuggaggaccugggcgacggccagaaggccaacgacgacaucaucgugaacugggugaacagaacccugagcgaggccggcaagagcaccagcauccagagcuucaaggacaagaccaucagcagcagccuggccgugguggaccugaucgacgccauccagcccggcugcaucaacuacgaccuggugaagagcggcaaccugaccgaggacgacaagcacaacaacgccaaguacgccgugagcauggccagaagaaucggcgccagaguguacgcccugcccgaggaccugguggaggugaagcccaagauggugaugaccguguucgccugccugaugggcagaggcaugaagagaguguaa

SEQ ID NO: 21688 - RNA, 957 nt, Artificial Sequence
  PLSCR1__Homo_sapiens__NP_066928
auggacaagcagaacagccagaugaacgccagccaccccgagaccaaccugcccgugggcuaccccccccaguacccccccaccgccuuccagggcccccccggcuacagcggcuaccccggcccccaggugagcuacccccccccccccgccggccacagcggccccggccccgccggcuuccccgugcccaaccagcccguguacaaccagcccguguacaaccagcccgugggcgccgccggcgugcccuggaugcccgccccccagcccccccugaacugcccccccggccuggaguaccugagccagaucgaccagauccugauccaccagcagaucgagcugcuggaggugcugaccggcuucgagaccaacaacaaguacgagaucaagaacagcuucggccagagaguguacuucgccgccgaggacaccgacugcugcaccagaaacugcugcggccccagcagacccuucacccugagaaucaucgacaacaugggccaggaggugaucacccuggagagaccccugagaugcagcagcugcugcugccccugcugccugcaggagaucgagauccaggccccccccggcgugcccaucggcuacgugauccagaccuggcaccccugccugcccaaguucaccauccagaacgagaagagagaggacgugcugaagaucagcggccccugcguggugugcagcugcugcggcgacguggacuucgagaucaagagccuggacgagcagugcguggugggcaagaucagcaagcacuggaccggcauccugagagaggccuucaccgacgccgacaacuucggcauccaguucccccuggaccuggacgugaagaugaaggccgugaugaucggcgccugcuuccugaucgacuucauguucuucgagagcaccggcagccaggagcagaagagcggcgugugguaa

SEQ ID NO: 21689 - RNA, 888 nt, Artificial Sequence
  PLSCR3__Homo_sapiens__NP_065093
auggccggcuaccugccccccaagggcuacgcccccagcccccccccccccuaccccgugacccccggcuaccccgagcccgcccugcaccccggccccggccaggcccccgugcccgcccaggugcccgcccccgcccccggcuucgcccuguuccccagccccggccccguggcccugggcagcgccgcccccuuccugccccugcccggcgugcccagcggccuggaguuccuggugcagaucgaccagauccugauccaccagaaggccgagagaguggagaccuuccugggcugggagaccugcaacagauacgagcugagaagcggcgccggccagccccugggccaggccgccgaggagagcaacugcugcgccagacugugcugcggcgccagaagaccccugagagugagacuggccgaccccggcgacagagaggugcugagacugcugagaccccugcacugcggcugcagcugcugccccugcggccugcaggagauggaggugcaggccccccccggcaccaccaucggccacgugcugcagaccuggcaccccuuccugcccaaguucagcauccaggacgccgacagacagaccgugcugagaguggugggccccugcuggaccugcggcugcggcaccgacaccaacuucgaggugaagaccagagacgagagcagaagcgugggcagaaucagcaagcaguggggcggccuggugagagaggcccugaccgacgccgacgacuucggccugcaguucccccuggaccuggacgugagagugaaggccgugcugcugggcgccaccuuccugaucgacuacauguucuucgagaagagaggcggcgccggccccagcgccgugaccagcuaa

SEQ ID NO: 21690 - RNA, 720 nt, Artificial Sequence
  PLSCR4__Homo_sapiens__NP_001121778
augagcggcguggugcccaccgcccccgagcagcccgccggcgagauggagaaccagaccaagccccccgaccccagacccgacgccccccccgaguacaacagccacuuccugcccggcccccccggcaccgccgugcccccccccaccggcuaccccggcggccugcccaugggcuacuacagcccccagcagcccagcaccuucccccuguaccagcccgugggcggcauccaccccgugagauaccagcccggcaaguaccccaugcccaaccagagcgugcccaucaccuggaugcccggccccacccccauggccaacugcccccccggccuggaguaccuggugcagcuggaggugcagugcccccccggcgugaccaucggcuucguggccgagcacuggaaccugugcagagccguguacagcauccagaacgagaagaaggagaacgugaugagagugagaggccccugcagcaccuacggcugcggcagcgacagcguguucgaggugaagagccuggacggcaucagcaacaucggcagcaucaucagaaaguggaacggccugcugagcgccauggccgacgccgaccacuucgacauccacuucccccuggaccuggacgugaagaugaaggccaugaucuucggcgccugcuuccugaucgacuucauguacuucgagagaagccccccccagagaagcagauaa

SEQ ID NO: 21691 - RNA, 816 nt, Artificial Sequence
  PLSCR5__Homo_sapiens__NP_001078889
auggccagcaaggacgcccagaaccagagaagaggccugcccggcuuccugcccggcgcccccgaccccgaccagagccugcccgccagcagcaaccccggcaaccaggccuggcagcugagccugccccugcccagcagcuuccugcccaccgugagccugccccccggccuggaguaccugagccagcuggaccugaucaucauccaccagcagguggagcugcugggcaugauccugggcaccgagaccagcaacaaguacgagaucaagaacagccugggccagagaaucuacuucgccguggaggagagcaucugcuucaacagaaccuucugcagcacccugagaagcugcacccugagaaucaccgacaacagcggcagagaggugaucaccgugaacagaccccugagaugcaacagcugcuggugccccugcuaccugcaggagcuggagauccaggccccccccggcaccaucgugggcuacgugacccagaagugggaccccuuccugcccaaguucaccauccagaacgccaacaaggaggacauccugaagaucgugggccccugcgugaccugcggcugcuucggcgacguggacuucgaggugaagaccaucaacgagaagcugaccaucggcaagaucagcaaguacuggagcggcuucgugaacgacguguucaccaacgccgacaacuucggcauccacgugcccgccgaccuggacgugaccgugaaggccgccaugaucggcgccugcuuccuguucgacuucauguucuucgagcacagccuggccggccuguaa

SEQ ID NO: 21692 - RNA, 1197 nt, Artificial Sequence
  PLTP__Homo_sapiens__NP_001229849
auggcccuguucggcgcccuguuccuggcccugcuggccggcgcccacgccgaguuccccggcugcaagaucagagugaccagcaaggcccuggagcuggugaagcaggagggccugagauuccuggagcaggagcuggagaccaucaccauccccgaccugagaggcaaggagggccacuucuacuacaacaucagcgagaagguguacgacuuccugagcaccuucaucaccagcggcaugagauuccugcugaaccagcagaucugccccgugcuguaccacgccggcaccgugcugcugaacagccugcuggacaccgugcccgugagaagcagcguggacgagcuggugggcaucgacuacagccugaugaaggaccccguggccagcaccagcaaccuggacauggacuucagaggcgccuucuucccccugaccgagagaaacuggagccugcccaacagagccguggagccccagcugcaggaggaggagagaaugguguacguggccuucagcgaguucuucuucgacagcgccauggagagcuacuucagagccggcgcccugcagcugcugcuggugggcgacaaggugccccacgaccuggacaugcugcugagagccaccuacuucggcagcaucgugcugcugagccccgccgugaucgacagcccccugaagcuggagcugagagugcuggccccccccagaugcaccaucaagcccagcggcaccaccaucagcgugaccgccagcgugaccaucgcccuggugccccccgaccagcccgaggugcagcugagcagcaugaccauggacgccagacugagcgccaagauggcccugagaggcaaggcccugagaacccagcuggaccugagaagauucagaaucuacagcaaccacagcgcccuggagagccuggcccugaucccccugcaggccccccugaagaccaugcugcagaucggcgugaugcccaugcugaacgagagaaccuggagaggcgugcagaucccccugcccgagggcaucaacuucgugcacgagguggugaccaaccacgccggcuuccugaccaucggcgccgaccugcacuucgccaagggccugagagaggugaucgagaagaacagacccgccgacgugagagccagcaccgcccccacccccagcaccgccgccguguaa

SEQ ID NO: 21693 - RNA, 1329 nt, Artificial Sequence
  PLVAP__Homo_sapiens__NP_112600
augggccuggccauggagcacggcggcagcuacgccagagccggcggcagcagcagaggcugcugguacuaccugagauacuucuuccuguucgugagccugauccaguuccugaucauccugggccuggugcuguucaugguguacggcaacgugcacgugagcaccgagagcaaccugcaggccaccgagagaagagccgagggccuguacagccagcugcugggccugaccgccagccagagcaaccugaccaaggagcugaacuucaccaccagagccaaggacgccaucaugcagauguggcugaacgccagaagagaccuggacagaaucaacgccagcuucagacagugccagggcgacagagugaucuacaccaacaaccagagauacauggccgccaucauccugagcgagaagcagugcagagaccaguucaaggacaugaacaagagcugcgacgcccugcuguucaugcugaaccagaaggugaagacccuggagguggagaucgccaaggagaagaccaucugcaccaaggacaaggagagcgugcugcugaacaagagaguggccgaggagcagcugguggagugcgugaagaccagagagcugcagcaccaggagagacagcuggccaaggagcagcugcagaaggugcaggcccugugccugccccuggacaaggacaaguucgagauggaccugagaaaccuguggagagacagcaucauccccagaagccuggacaaccugggcuacaaccuguaccacccccugggcagcgagcuggccagcaucagaagagccugcgaccacaugcccagccugaugagcagcaagguggaggagcuggccagaagccugagagccgacaucgagagaguggccagagagaacagcgaccugcagagacagaagcuggaggcccagcagggccugagagccagccaggaggccaagcagaagguggagaaggaggcccaggccagagaggccaagcugcaggccgagugcagcagacagacccagcuggcccuggaggagaaggccgugcugagaaaggagagagacaaccuggccaaggagcuggaggagaagaagagagaggccgagcagcugagaauggagcuggccaucagaaacagcgcccuggacaccugcaucaagaccaagagccagcccaugaugcccgugagcagacccaugggccccgugcccaacccccagcccaucgaccccgccagccuggaggaguucaagagaaagauccuggagagccagagaccccccgccggcauccccguggcccccagcagcggcuaa

SEQ ID NO: 21694 - RNA, 1503 nt, Artificial Sequence
  PLXDC1__Homo_sapiens__NP_065138
augagaggcgagcuguggcugcuggugcuggugcugagagaggccgccagagcccugagcccccagcccggcgccggccacgacgagggccccggcagcggcugggccgccaagggcaccgugagaggcuggaacagaagagccagagagagccccggccacgugagcgagcccgacagaacccagcugagccaggaccugggcggcggcacccuggccauggacacccugcccgacaacagaaccagagugguggaggacaaccacagcuacuacgugagcagacuguacggccccagcgagccccacagcagagagcuguggguggacguggccgaggccaacagaagccaggugaagauccacaccauccugagcaacacccacagacaggccagcagaguggugcugagcuucgacuuccccuucuacggccacccccugagacagaucaccaucgccaccggcggcuucaucuucaugggcgacgugauccacagaaugcugaccgccacccaguacguggccccccugauggccaacuucaaccccggcuacagcgacaacagcaccgugguguacuucgacaacggcaccguguucguggugcagugggaccacguguaccugcagggcugggaggacaagggcagcuucaccuuccaggccgcccugcaccacgacggcagaaucguguucgccuacaaggagauccccaugagcgugcccgagaucagcagcagccagcaccccgugaagaccggccugagcgacgccuucaugauccugaaccccagccccgacgugcccgagagcagaagaagaagcaucuucgaguaccacagaaucgagcuggaccccagcaaggugaccagcaugagcgccguggaguucaccccccugcccaccugccugcagcacagaagcugcgacgccugcaugagcagcgaccugaccuucaacugcagcuggugccacgugcugcagagaugcagcagcggcuucgacagauacagacaggaguggauggacuacggcugcgcccaggaggccgagggcagaaugugcgaggacuuccaggacgaggaccacgacagcgccagccccgacaccagcuucagccccuacgacggcgaccugaccaccaccagcagcagccuguucaucgacagccugaccaccgaggacgacaccaagcugaaccccuacgccggcggcgacggccugcagaacaaccugagccccaagaccaagggcacccccgugcaccugggcaccaucgugggcaucgugcuggccgugcugcugguggccgccaucauccuggccggcaucuacaucaacggccaccccaccagcaacgccgcccuguucuucaucgagagaagaccccaccacuggcccgccaugaaguucagaagccaccccgaccacagcaccuacgccgagguggagcccagcggccacgagaaggagggcuucauggaggccgagcagugcuaa

SEQ ID NO: 21695 - RNA, 1443 nt, Artificial Sequence
  PLXDC2__Homo_sapiens__NP_001269665
auggccagauuccccaaggccgaccuggccgccgccggcgugaugcugcugugccacuucuucaccgaccaguuccaguucgccgacggcaagcccggcgaccagauccuggacuggcaguacggcgugacccaggccuucccccacaccgaggaggagguggagguggacagccacgccuacagccacagauggaagagaaaccuggacuuccugaaggccguggacaccaacagagccagcgugggccaggacagccccgagcccagaagcuucaccgaccugcugcuggacgacggccaggacaacaacacccagaucgagagagugaaccugagcuucgacuuccccuucuacggccacuuccugagagagaucaccguggccaccggcggcuucaucuacaccggcgagguggugcacagaaugcugaccgccacccaguacaucgccccccugauggccaacuucgaccccagcgugagcagaaacagcaccgugagauacuucgacaacggcaccgcccugguggugcagugggaccacgugcaccugcaggacaacuacaaccugggcagcuucaccuuccaggccacccugcugauggacggcagaaucaucuucggcuacaaggagauccccgugcuggugacccagaucagcagcaccaaccaccccgugaaggugggccugagcgacgccuucgugguggugcacagaauccagcagauccccaacgugagaagaagaaccaucuacgaguaccacagaguggagcugcagaugagcaagaucaccaacaucagcgccguggagaugaccccccugcccaccugccugcaguucaacagaugcggccccugcgugagcagccagaucggcuucaacugcagcuggugcagcaagcugcagagaugcagcagcggcuucgacagacacagacaggacuggguggacagcggcugccccgaggagagcaaggagaagaugugcgagaacaccgagcccguggagaccagcagcagaaccaccaccaccgugggcgccaccaccacccaguucagagugcugaccaccaccagaagagccgugaccagccaguuccccaccagccugcccaccgaggacgacaccaagaucgcccugcaccugaaggacaacggcgccagcaccgacgacagcgccgccgagaagaagggcggcacccugcacgccggccugaucaucggcauccugauccuggugcugaucguggccaccgccauccuggugaccguguacauguaccaccaccccaccagcgccgccagcaucuucuucaucgagagaagacccagcagauggcccgccaugaaguucagaagaggcagcggccaccccgccuacgccgagguggagcccgugggcgagaaggagggcuucaucgugagcgagcagugcuaa

SEQ ID NO: 21696 - RNA, 5691 nt, Artificial Sequence
  PLXNA1__Homo_sapiens__NP_115618
augccccugccccccagaagccugcaggugcugcugcugcugcugcugcugcugcugcugcugcccggcaugugggccgaggccggccugcccagagccggcggcggcagccagccccccuucagaaccuucagcgccagcgacuggggccugacccaccugguggugcacgagcagaccggcgagguguacgugggcgccgugaacagaaucuacaagcugagcggcaaccugacccugcugagagcccacgugaccggccccguggaggacaacgagaagugcuaccccccccccagcgugcagagcugcccccacggccugggcagcaccgacaacgugaacaagcugcugcugcuggacuacgccgccaacagacugcuggccugcggcagcgccagccagggcaucugccaguuccugagacuggacgaccuguucaagcugggcgagccccaccacagaaaggagcacuaccugagcagcgugcaggaggccggcagcauggccggcgugcugaucgccggcccccccggccagggccaggccaagcuguucgugggcacccccaucgacggcaagagcgaguacuuccccacccugagcagcagaagacugauggccaacgaggaggacgccgacauguucggcuucguguaccaggacgaguucgugagcagccagcugaagauccccagcgacacccugagcaaguuccccgccuucgacaucuacuacguguacagcuucagaagcgagcaguucguguacuaccugacccugcagcuggacacccagcugaccagccccgacgccgccggcgagcacuucuucaccagcaagaucgugagacugugcguggacgaccccaaguucuacagcuacguggaguuccccaucggcugcgagcaggccggcguggaguacagacuggugcaggacgccuaccugagcagacccggcagagcccuggcccaccagcugggccuggccgaggacgaggacgugcuguucaccguguucgcccagggccagaagaacagagugaagccccccaaggagagcgcccugugccuguucacccugagagccaucaaggagaagaucaaggagagaauccagagcugcuacagaggcgagggcaagcugagccugcccuggcugcugaacaaggagcugggcugcaucaacagcccccugcagaucgacgacgacuucugcggccaggacuucaaccagccccugggcggcaccgugaccaucgagggcaccccccuguucguggacaaggacgacggccugaccgccguggccgccuacgacuacagaggcagaaccgugguguucgccggcaccagaagcggcagaaucagaaagauccugguggaccugagcaaccccggcggcagacccgcccuggccuacgagagcgugguggcccaggagggcagccccauccugagagaccuggugcugagccccaaccaccaguaccuguacgccaugaccgagaagcaggugaccagagugcccguggagagcugcgugcaguacaccagcugcgagcugugccugggcagcagagacccccacugcggcuggugcgugcugcacagcaucugcagcagaagagacgccugcgagagagccgacgagccccagagauucgccgccgaccugcugcagugcgugcagcugaccgugcagcccagaaacgugagcgugaccaugagccaggugccccuggugcugcaggccuggaacgugcccgaccugagcgccggcgugaacugcagcuucgaggacuucaccgagagcgagagcgugcuggaggacggcagaauccacugcagaagccccagcgccagagagguggcccccaucaccagaggccagggcgaccagagaguggugaagcuguaccugaagagcaaggagaccggcaagaaguucgccagcguggacuucguguucuacaacugcagcgugcaccagagcugccugagcugcgugaacggcagcuuccccugccacuggugcaaguacagacacgugugcacccacaacguggccgacugcgccuuccuggagggcagagugaacgugagcgaggacugcccccagauccugcccagcacccagaucuacgugcccgugggcguggugaagcccaucacccuggccgccagaaaccugccccagccccagagcggccagagaggcuacgagugccuguuccacauccccggcagccccgccagagugaccgcccugagauucaacagcagcagccugcagugccagaacagcagcuacagcuacgagggcaacgacgugagcgaccugcccgugaaccugagcgugguguggaacggcaacuucgugaucgacaacccccagaacauccaggcccaccuguacaagugccccgcccugagagagagcugcggccugugccugaaggccgaccccagauucgagugcggcuggugcguggccgagagaagaugcagccugagacaccacugcgccgccgacacccccgccagcuggaugcacgccagacacggcagcagcagaugcaccgaccccaagauccugaagcugagccccgagaccggccccagacagggcggcaccagacugaccaucaccggcgagaaccugggccugagauucgaggacgugagacugggcgugagagugggcaaggugcugugcagccccguggagagcgaguacaucagcgccgagcagaucgugugcgagaucggcgacgccagcagcgugagagcccacgacgcccugguggaggugugcgugagagacugcagcccccacuacagagcccugagccccaagagauucaccuucgugacccccaccuucuacagagugagccccagcagaggcccccugagcggcggcaccuggaucggcaucgagggcagccaccugaacgccggcagcgacguggccgugagcgugggcggcagacccugcagcuucagcuggagaaacagcagagagaucagaugccugaccccccccggccagagccccggcagcgcccccaucaucaucaacaucaacagagcccagcugaccaaccccgaggugaaguacaacuacaccgaggaccccaccauccugagaaucgaccccgaguggagcaucaacagcggcggcacccugcugaccgugaccggcaccaaccuggccaccgugagagagcccagaaucagagccaaguacggcggcaucgagagagagaacggcugccugguguacaacgacaccaccauggugugcagagcccccagcguggccaaccccgugagaagcccccccgagcugggcgagagacccgacgagcugggcuucgugauggacaacgugagaagccugcuggugcugaacagcaccagcuuccuguacuaccccgaccccgugcuggagccccugagccccaccggccugcuggagcugaagcccagcagcccccugauccugaagggcagaaaccugcugccccccgcccccggcaacagcagacugaacuacaccgugcugaucggcagcacccccugcacccugaccgugagcgagacccagcugcugugcgaggcccccaaccugaccggccagcacaaggugaccgugagagccggcggcuucgaguucagccccggcacccugcagguguacagcgacagccugcugacccugcccgccaucgugggcaucggcggcggcggcggccugcugcugcuggugaucguggccgugcugaucgccuacaagagaaagagcagagacgccgacagaacccugaagagacugcagcugcagauggacaaccuggagagcagaguggcccuggagugcaaggaggccuucgccgagcugcagaccgacauccacgagcugaccaacgaccuggacggcgccggcauccccuuccuggacuacagaaccuacgccaugagagugcuguuccccggcaucgaggaccaccccgugcugaaggagauggaggugcaggccaacguggagaagagccugacccuguucggccagcugcugaccaagaagcacuuccugcugaccuucaucagaacccuggaggcccagagaagcuucagcaugagagacagaggcaacguggccagccugaucaugaccgcccugcagggcgagauggaguacgccaccggcgugcugaagcagcugcugagcgaccugaucgagaagaaccuggagagcaagaaccaccccaagcugcugcugagaagaaccgagagcguggccgagaagaugcugaccaacugguucaccuuccugcuguacaaguuccugaaggagugcgccggcgagccccuguucaugcuguacugcgccaucaagcagcagauggagaagggccccaucgacgccaucaccggcgaggccagauacagccugagcgaggacaagcugaucagacagcagaucgacuacaagacccugacccugaacugcgugaaccccgagaacgagaacgcccccgaggugcccgugaagggccuggacugcgacaccgugacccaggccaaggagaagcugcuggacgccgccuacaagggcgugcccuacagccagagacccaaggccgccgacauggaccuggaguggagacagggcagaauggccagaaucauccugcaggacgaggacgugaccaccaagaucgacaacgacuggaagagacugaacacccuggcccacuaccaggugaccgacggcagcagcguggcccuggugcccaagcagaccagcgccuacaacaucagcaacagcagcaccuucaccaagagccugagcagauacgagagcaugcugagaaccgccagcagccccgacagccugagaagcagaacccccaugaucacccccgaccuggagagcggcaccaagcuguggcaccuggugaagaaccacgaccaccuggaccagagagagggcgacagaggcagcaagauggugagcgagaucuaccugaccagacugcuggccaccaagggcacccugcagaaguucguggacgaccuguucgagaccaucuucagcaccgcccacagaggcagcgcccugccccuggccaucaaguacauguucgacuuccuggacgagcaggccgacaagcaccagauccacgacgccgacgugagacacaccuggaagagcaacugccugccccugagauucugggugaacgugaucaagaacccccaguucguguucgacauccacaagaacagcaucaccgacgccugccugagcgugguggcccagaccuucauggacagcugcagcaccagcgagcacaagcugggcaaggacagccccagcaacaagcugcuguacgccaaggacauccccaacuacaagagcuggguggagagauacuacgccgacaucgccaagaugcccgccaucagcgaccaggacaugagcgccuaccuggccgagcagagcagacugcaccugagccaguucaacagcaugagcgcccugcacgagaucuacagcuacaucaccaaguacaaggacgagauccuggccgcccuggagaaggacgagcaggccagaagacagagacugagaagcaagcuggagcaggugguggacaccauggcccugagcagcuaa

SEQ ID NO: 21697 - RNA, 5685 nt, Artificial Sequence
  PLXNA2__Homo_sapiens__NP_079455
auggagcagagaagacccuggcccagagcccuggagguggacagcagaagcguggugcugcugagcguggugugggugcugcuggccccccccgccgccggcaugccccaguucagcaccuuccacagcgagaacagagacuggaccuucaaccaccugaccgugcaccagggcaccggcgccguguacgugggcgccaucaacagaguguacaagcugaccggcaaccugaccauccagguggcccacaagaccggccccgaggaggacaacaagagcugcuaccccccccugaucgugcagcccugcagcgaggugcugacccugaccaacaacgugaacaagcugcugaucaucgacuacagcgagaacagacugcuggccugcggcagccuguaccagggcgugugcaagcugcugagacuggacgaccuguucauccugguggagcccagccacaagaaggagcacuaccugagcagcgugaacaagaccggcaccauguacggcgugaucgugagaagcgagggcgaggacggcaagcuguucaucggcaccgccguggacggcaagcaggacuacuuccccacccugagcagcagaaagcugcccagagaccccgagagcagcgccaugcuggacuacgagcugcacagcgacuucgugagcagccugaucaagauccccagcgacacccuggcccuggugagccacuucgacaucuucuacaucuacggcuucgccagcggcggcuucguguacuuccugaccgugcagcccgagacccccgagggcguggccaucaacagcgccggcgaccuguucuacaccagcagaaucgugagacugugcaaggacgaccccaaguuccacagcuacgugagccugcccuucggcugcaccagagccggcguggaguacagacugcugcaggccgccuaccuggccaagcccggcgacagccuggcccaggccuucaacaucaccagccaggacgacgugcuguucgccaucuucagcaagggccagaagcaguaccaccacccccccgacgacagcgcccugugcgccuuccccaucagagccaucaaccugcagaucaaggagagacugcagagcugcuaccagggcgagggcaaccuggagcugaacuggcugcugggcaaggacgugcagugcaccaaggcccccgugcccaucgacgacaacuucugcggccuggacaucaaccagccccugggcggcagcacccccguggagggccugacccuguacaccaccagcagagacagaaugaccagcguggccagcuacguguacaacggcuacagcgugguguucgugggcaccaagagcggcaagcugaagaagaucagagccgacggccccccccacggcggcgugcaguacgagauggugagcgugcugaaggacggcagccccauccugagagacauggccuucagcaucgaccagagauaccuguacgugaugagcgagagacaggugaccagagugcccguggagagcugcgagcaguacaccaccugcggcgagugccugagcagcggcgacccccacugcggcuggugcgcccugcacaacaugugcagcagaagagacaagugccagcaggccugggagcccaacagauucgccgccagcaucagccagugcgugagccuggccgugcaccccagcagcaucagcgugagcgagcacagcagacugcugagccugguggugagcgacgcccccgaccugagcgccggcaucgccugcgccuucggcaaccugaccgagguggagggccaggugagcggcagccaggugaucugcaucagccccggccccaaggacgugcccgugaucccccuggaccaggacugguucggccuggagcugcagcugagaagcaaggagaccggcaagaucuucgugagcaccgaguucaaguucuacaacugcagcgcccaccagcugugccugagcugcgugaacagcgccuucagaugccacuggugcaaguacagaaaccugugcacccacgaccccaccaccugcagcuuccaggagggcagaaucaacaucagcgaggacugcccccagcuggugcccaccgaggagauccugauccccgugggcgaggugaagcccaucacccugaaggccagaaaccugccccagccccagagcggccagagaggcuacgagugcgugcugaacauccagggcgccauccacagagugcccgcccugagauucaacagcagcagcgugcagugccagaacagcagcuaccaguacgacggcauggacaucagcaaccuggccguggacuucgccgugguguggaacggcaacuucaucaucgacaacccccaggaccugaaggugcaccuguacaagugcgccgcccagagagagagcugcggccugugccugaaggccgacagaaaguucgagugcggcuggugcagcggcgagagaagaugcacccugcaccagcacugcaccagccccagcagccccuggcuggacuggagcagccacaacgugaagugcagcaacccccagaucaccgagauccugaccgugagcggcccccccgagggcggcaccagagugaccauccacggcgugaaccugggccuggacuucagcgagaucgcccaccacgugcagguggccggcgugcccugcaccccccugcccggcgaguacaucaucgccgagcagaucgugugcgagaugggccacgcccuggugggcaccaccagcggccccgugagacugugcaucggcgagugcaagcccgaguucaugaccaagagccaccagcaguacaccuucgugaaccccagcgugcugagccugaaccccaucagaggccccgagagcggcggcaccauggugaccaucaccggccacuaccugggcgccggcagcagcguggccguguaccugggcaaccagaccugcgaguucuacggcagaagcaugagcgagaucgugugcgugagcccccccagcagcaacggccugggccccgugcccgugagcgugagcguggacagagcccacguggacagcaaccugcaguucgaguacaucgacgaccccagagugcagagaaucgagcccgaguggagcaucgccagcggccacaccccccugaccaucaccggcuucaaccuggacgugauccaggagcccagaaucagagugaaguucaacggcaaggagagcgugaacgugugcaagguggugaacaccaccacccugaccugccuggcccccagccugaccaccgacuacagacccggccuggacaccguggagagacccgacgaguucggcuucguguucaacaacgugcagagccugcugaucuacaacgacaccaaguucaucuacuaccccaaccccaccuucgagcugcugagccccaccggcgugcuggaccagaagcccggcagccccaucauccugaagggcaagaaccugugcccccccgccagcggcggcgccaagcugaacuacaccgugcugaucggcgagacccccugcgccgugaccgugagcgagacccagcugcugugcgagccccccaaccugaccggccagcacaaggugauggugcacgugggcggcaugguguucagccccggcagcgugagcgugaucagcgacagccugcugacccugcccgccaucgugagcaucgccgccggcggcagccugcugcugaucaucgugaucaucgugcugaucgccuacaagagaaagagcagagagaacgaccugacccugaagagacugcagaugcagauggacaaccuggagagcagaguggcccuggagugcaaggaggccuucgccgagcugcagaccgacaucaacgagcugaccagcgaccuggacagaagcggcauccccuaccuggacuacagaaccuacgccaugagagugcuguuccccggcaucgaggaccaccccgugcugagagagcuggaggugcagggcaacggccagcagcacguggagaaggcccugaagcuguucgcccagcugaucaacaacaagguguuccugcugaccuucaucagaacccuggagcugcagagaagcuucagcaugagagacagaggcaacguggccagccugaucaugaccggccugcagggcagacuggaguacgccaccgacgugcugaagcagcugcugagcgaccugaucgacaagaaccuggagaacaagaaccaccccaagcugcugcugagaagaaccgagagcguggccgagaagaugcugaccaacugguucgccuuccugcugcacaaguuccugaaggagugcgccggcgagccccuguucaugcuguacugcgccaucaagcagcagauggagaagggccccaucgacgccaucaccggcgaggccagauacagccugagcgaggacaagcugaucagacagcagaucgaguacaagacccugauccugaacugcgugaaccccgacaacgagaacagccccgagauccccgugaaggugcugaacugcgacaccaucacccaggugaaggagaagauccuggacgccguguacaagaacgugcccuacagccagagacccagagccguggacauggaccuggaguggagacagggcagaaucgccagaguggugcugcaggacgaggacaucaccaccaagaucgagggcgacuggaagagacugaacacccugaugcacuaccaggugagcgacagaagcgugguggcccuggugcccaagcagaccagcagcuacaacauccccgccagcgccagcaucagcagaaccagcaucagcagauacgacagcagcuucagauacaccggcagccccgacagccugagaagcagagcccccaugaucacccccgaccuggagagcggcgugaagguguggcaccuggugaagaaccacgaccacggcgaccagaaggagggcgacagaggcagcaagauggugagcgagaucuaccugaccagacugcuggccaccaagggcacccugcagaaguucguggacgaccuguucgagacccuguucagcaccgugcacagaggcagcgcccugccccuggccaucaaguacauguucgacuuccuggacgagcaggccgacagacacagcauccacgacaccgacgugagacacaccuggaagagcaacugccugccccugagauucugggugaacgugaucaagaacccccaguucguguucgacauccacaagggcagcaucaccgacgccugccugagcgugguggcccagaccuucauggacagcugcagcaccagcgagcacagacugggcaaggacagccccagcaacaagcugcuguacgccaaggacauccccagcuacaagagcuggguggagagauacuacgccgacaucgccaagcugcccgccaucagcgaccaggacaugaacgccuaccuggccgagcagagcagacugcacgccguggaguucaacaugcugagcgcccugaacgagaucuacagcuacgugagcaaguacagcgaggagcugaucggcgcccuggagcaggacgagcaggccagaagacagagacuggccuacaagguggagcagcugaucaacgccaugagcaucgagagcuaa

SEQ ID NO: 21698 - RNA, 5616 nt, Artificial Sequence
  PLXNA3__Homo_sapiens__NP_059984
augcccagcgugugccugcugcugcugcuguuccuggccgugggcggcgcccugggcaacagacccuucagagccuucguggugaccgacaccacccugacccaccuggccgugcacagagugaccggcgagguguucgugggcgccgugaacagaguguucaagcuggcccccaaccugaccgagcugagagcccacgugaccggccccguggaggacaacgccagaugcuaccccccccccagcaugagagugugcgcccacagacuggcccccguggacaacaucaacaagcugcugcugaucgacuacgccgccagaagacugguggccugcggcagcaucuggcagggcaucugccaguuccugagacuggacgaccuguucaagcugggcgagccccaccacagaaaggagcacuaccugagcggcgcccaggagcccgacagcauggccggcgugaucguggagcagggccagggccccagcaagcuguucgugggcaccgccguggacggcaagagcgaguacuuccccacccugagcagcagaaagcugaucagcgacgaggacagcgccgacauguucagccugguguaccaggacgaguucgugagcagccagaucaagauccccagcgacacccugagccuguaccccgccuucgacaucuacuacaucuacggcuucgugagcgccagcuucguguacuuccugacccugcagcuggacacccagcagacccugcuggacaccgccggcgagaaguucuucaccagcaagaucgugagaaugugcgccggcgacagcgaguucuacagcuacguggaguuccccaucggcugcagcuggagaggcguggaguacagacuggugcagagcgcccaccuggccaagcccggccugcugcuggcccaggcccugggcgugcccgccgacgaggacgugcuguucaccaucuucagccagggccagaagaacagagccagcccccccagacagaccauccugugccuguucacccugagcaacaucaacgcccacaucagaagaagaauccagagcugcuacagaggcgagggcacccuggcccugcccuggcugcugaacaaggagcugcccugcaucaacacccccaugcagaucaacggcaacuucugcggccuggugcugaaccagccccugggcggccugcacgugaucgagggccugccccugcuggccgacagcaccgacggcauggccagcguggccgccuacaccuacagacagcacagcgugguguucaucggcaccagaagcggcagccugaagaaggugagaguggacggcuuccaggacgcccaccuguacgagaccgugcccgugguggacggcagccccauccugagagaccugcuguucagccccgaccacagacacaucuaccugcugagcgagaagcaggugagccagcugcccguggagaccugcgagcaguaccagagcugcgccgccugccugggcagcggcgacccccacugcggcuggugcgugcugagacacagaugcugcagagagggcgccugccugggcgccagcgccccccacggcuucgccgaggagcugagcaagugcgugcaggugagagugagacccaacaacgugagcgugaccagccccggcgugcagcugaccgugacccugcacaacgugcccgaccugagcgccggcgugagcugcgccuucgaggccgccgccgagaacgaggccgugcugcugcccagcggcgagcugcugugccccagccccagccugcaggagcugagagcccugaccagaggccacggcgccaccagaaccgugagacugcagcugcugagcaaggagaccggcgugagauucgccggcgccgacuucguguucuacaacugcagcgugcugcagagcugcaugagcugcgugggcagccccuaccccugccacuggugcaaguacagacacaccugcaccagcagaccccacgagugcagcuuccaggagggcagagugcacagccccgagggcugccccgagauccugcccagcggcgaccugcugauccccgugggcgugaugcagccccugacccugagagccaagaaccugccccagccccagagcggccagaagaacuacgagugcguggugagagugcagggcagacagcagagagugcccgccgugagauucaacagcagcagcgugcagugccagaacgccagcuacagcuacgagggcgacgagcacggcgacaccgagcuggacuucagcguggugugggacggcgacuuccccaucgacaagccccccagcuucagagcccugcuguacaagugcugggcccagagacccagcugcggccugugccugaaggccgaccccagauucaacugcggcuggugcaucagcgagcacagaugccagcugagaacccacugccccgcccccaagaccaacuggaugcaccugagccagaagggcaccagaugcagccaccccagaaucacccagauccacccccuggugggccccaaggagggcggcaccagagugaccaucgugggcgagaaccugggccugcugagcagagaggugggccugagaguggccggcgugagaugcaacagcauccccgccgaguacaucagcgccgagagaaucgugugcgagauggaggagagccuggugcccagccccccccccggccccguggagcugugcgugggcgacugcagcgccgacuucagaacccagagcgagcagguguacagcuucgugacccccaccuucgaccaggugagccccagcagaggccccgccagcggcggcaccagacugaccaucagcggcagcagccuggacgccggcagcagagugaccgugaccgugagagacagcgagugccaguucgugagaagagacgccaaggccaucgugugcaucagcccccugagcacccugggccccagccaggcccccaucacccuggccaucgacagagccaacaucagcagccccggccugaucuacaccuacacccaggaccccaccgugaccagacuggagcccaccuggagcaucaucaacggcagcaccgccaucaccgugagcggcacccaccugcugaccgugcaggagcccagagugagagccaaguacagaggcaucgagaccaccaacaccugccaggugaucaacgacaccgccaugcugugcaaggcccccggcaucuuccugggcagaccccagcccagagcccagggcgagcaccccgacgaguucggcuuccugcuggaccacgugcagaccgccagaagccugaacagaagcagcuucaccuacuaccccgaccccagcuucgagccccugggccccagcggcgugcuggacgugaagcccggcagccacguggugcugaagggcaagaaccugauccccgccgccgccggcagcagcagacugaacuacaccgugcugaucggcggccagcccugcagccugaccgugagcgacacccagcugcugugcgacagccccagccagaccggcagacagcccgugauggugcuggugggcggccuggaguucuggcugggcacccugcacaucagcgccgagagagcccugacccugcccgccaugaugggccuggccgccggcggcggccugcugcugcuggccaucaccgccgugcugguggccuacaagagaaagacccaggacgccgacagaacccugaagagacugcagcugcagauggacaaccuggagagcagaguggcccuggagugcaaggaggccuucgccgagcugcagaccgacaucaacgagcugaccaaccacauggacgaggugcagauccccuuccuggacuacagaaccuacgccgugagagugcuguuccccggcaucgaggcccaccccgugcugaaggagcuggacaccccccccaacguggagaaggcccugagacuguucggccagcugcugcacagcagagccuucgugcugaccuucauccacacccuggaggcccagagcagcuucagcaugagagacagaggcaccguggccagccugaccaugguggcccugcagagcagacuggacuacgccaccggccugcugaagcagcugcuggccgaccugaucgagaagaaccuggagagcaagaaccaccccaagcugcugcugagaagaaccgagagcguggccgagaagaugcugaccaacugguucaccuuccugcugcacaaguuccugaaggagugcgccggcgagccccuguuccugcuguacugcgccaucaagcagcagauggagaagggccccaucgacgccaucaccggcgaggccagauacagccugagcgaggacaagcugaucagacagcagaucgacuacaagacccugacccugcacugcgugugccccgagaacgagggcagcgcccaggugcccgugaaggugcugaacugcgacagcaucacccaggccaaggacaagcugcuggacaccguguacaagggcauccccuacagccagagacccaaggccgaggacauggaccuggaguggagacagggcagaaugaccagaaucauccugcaggacgaggacgugaccaccaagaucgagugcgacuggaagagacugaacagccuggcccacuaccaggugaccgacggcagccugguggcccuggugcccaagcaggugagcgccuacaacauggccaacagcuucaccuucaccagaagccugagcagauacgagagccugcugagaaccgccagcagccccgacagccugagaagcagagcccccaugaucacccccgaccaggagaccggcaccaagcuguggcaccuggugaagaaccacgaccacgccgaccacagagagggcgacagaggcagcaagauggugagcgagaucuaccugaccagacugcuggccaccaagggcacccugcagaaguucguggacgaccuguucgagaccguguucagcaccgcccacagaggcagcgcccugccccuggccaucaaguacauguucgacuuccuggacgagcaggccgaccagagacagaucagcgaccccgacgugagacacaccuggaagagcaacugccugccccugagauucugggugaacgugaucaagaacccccaguucguguucgacauccacaagaacagcaucaccgacgccugccugagcgugguggcccagaccuucauggacagcugcagcaccagcgagcacagacugggcaaggacagccccagcaacaagcugcuguacgccaaggacauccccaacuacaagagcuggguggagagauacuacagagacaucgccaagauggccagcaucagcgaccaggacauggacgccuaccugguggagcagagcagacugcacgccagcgacuucagcgugcugagcgcccugaacgagcuguacuucuacgugaccaaguacagacaggagauccugaccgcccuggacagagacgccagcugcagaaagcacaagcugagacagaagcuggagcagaucaucagccuggugagcagcgacagcuaa

SEQ ID NO: 21699 - RNA, 1479 nt, Artificial Sequence
  PLXNA4__Homo_sapiens__NP_001099013
augaaggccaugcccuggaacuggaccugccugcugagccaccugcugauggugggcaugggcagcagcacccugcugaccagacagcccgccccccugagccagaagcagagaagcuucgugaccuucagaggcgagcccgccgagggcuucaaccaccuggugguggacgagagaaccggccacaucuaccugggcgccgugaacagaaucuacaagcugagcagcgaccugaaggugcuggugacccacgagaccggccccgacgaggacaaccccaagugcuacccccccagaaucgugcagaccugcaacgagccccugaccaccaccaacaacgugaacaagaugcugcugaucgacuacaaggagaacagacugaucgccugcggcagccuguaccagggcaucugcaagcugcugagacuggaggaccuguucaagcugggcgagcccuaccacaagaaggagcacuaccugagcggcgugaacgagagcggcagcguguucggcgugaucgugagcuacagcaaccuggacgacaagcuguucaucgccaccgccguggacggcaagcccgaguacuuccccaccaucagcagcagaaagcugaccaagaacagcgaggccgacggcauguucgccuacguguuccacgacgaguucguggccagcaugaucaagauccccagcgacaccuucaccaucauccccgacuucgacaucuacuacguguacggcuucagcagcggcaacuucguguacuuccugacccugcagcccgagauggugagcccccccggcagcaccaccaaggagcagguguacaccagcaagcuggugagacugugcaaggaggacaccgccuucaacagcuacguggaggugcccaucggcugcgagagaagcggcguggaguacagacugcugcaggccgccuaccugagcaaggccggcgccgugcugggcagaacccugggcgugcaccccgacgacgaccugcuguucaccguguucagcaagggccagaagagaaagaugaagagccuggacgagagcgcccugugcaucuucauccugaagcagaucaacgacagaaucaaggagagacugcagagcugcuacagaggcgagggcacccuggaccuggccuggcugaaggugaaggacauccccugcagcagcgcccugcugaccaucgacgacaacuucugcggccuggacaugaacgccccccugggcgugagcgacauggugagaggcauccccguguucaccgaggacagagacagaaugaccagcgugaucgccuacguguacaagaaccacagccuggccuucgugggcaccaagagcggcaagcugaagaagaugcccggcaccagccugugccccacccuggagcugcagaccggccccagaagccacagagccaccgugacccuggagcugcuguucagcagcugcagcagcaacuaa

SEQ ID NO: 21700 - RNA, 6408 nt, Artificial Sequence
  PLXNB1__Homo_sapiens__NP_001123554
augcccgcccugggccccgcccugcugcaggcccugugggccggcugggugcugacccugcagccccugccccccaccgccuucacccccaacggcaccuaccugcagcaccuggccagagaccccaccagcggcacccuguaccugggcgccaccaacuuccuguuccagcugagccccggccugcagcuggaggccaccgugagcaccggccccgugcuggacagcagagacugccugccccccgugaugcccgacgagugcccccaggcccagcccaccaacaaccccaaccagcugcugcuggugagccccggcgcccugguggugugcggcagcgugcaccagggcgugugcgagcagagaagacugggccagcuggagcagcugcugcugagacccgagagacccggcgacacccaguacguggccgccaacgaccccgccgugagcaccgugggccugguggcccagggccuggccggcgagccccugcuguucgugggcagaggcuacaccagcagaggcgugggcggcggcaucccccccaucaccaccagagcccuguggccccccgacccccaggccgccuucagcuacgaggagaccgccaagcuggccgugggcagacugagcgaguacagccaccacuucgugagcgccuucgccagaggcgccagcgccuacuuccuguuccugagaagagaccugcaggcccagagcagagccuucagagccuacgugagcagagugugccugagagaccagcacuacuacagcuacguggagcugccccuggccugcgagggcggcagauacggccugauccaggccgccgccguggccaccagcagagagguggcccacggcgaggugcuguucgccgccuucagcagcgccgccccccccaccgugggcagaccccccagcgccgccgccggcgccagcggcgccagcgcccugugcgccuucccccuggacgagguggacagacuggccaacagaaccagagacgccugcuacaccagagagggcagagccgaggacggcaccgagguggccuacaucgaguacgacgugaacagcgacugcgcccagcugcccguggacacccuggacgccuaccccugcggcagcgaccacacccccagccccauggccagcagagugccccuggaggccacccccauccuggaguggcccggcauccagcugaccgccguggccgugaccauggaggacggccacaccaucgccuuccugggcgacagccagggccagcugcacagaguguaccugggccccggcagcgacggccaccccuacagcacccagagcauccagcagggcagcgccgugagcagagaccugaccuucgacggcaccuucgagcaccuguacgugaugacccagagcacccugcugaaggugcccguggccagcugcgcccagcaccuggacugcgccagcugccuggcccacagagaccccuacugcggcuggugcgugcugcugggcagaugcagcagaagaagcgagugcagcagaggccagggccccgagcaguggcuguggagcuuccagcccgagcugggcugccugcagguggccgccaugagccccgccaacaucagcagagaggagaccagagagguguuccugagcgugcccgaccugcccccccuguggcccggcgagagcuacagcugccacuucggcgagcaccagagccccgcccugcugaccggcagcggcgugaugugccccagccccgaccccagcgaggcccccgugcugcccagaggcgccgacuacgugagcgugagcguggagcugagauucggcgccguggugaucgccaagaccagccugagcuucuacgacugcguggccgugaccgagcugagacccagcgcccagugccaggccugcgugagcagcagauggggcugcaacuggugcguguggcagcaccugugcacccacaaggccagcugcgacgccggccccaugguggccagccaccagagcccccuggugagccccgacccccccgccagaggcggccccagccccagcccccccaccgcccccaaggcccuggccacccccgcccccgacacccugcccguggagcccggcgcccccagcaccgccaccgccagcgacaucagccccggcgccagccccagccugcugagccccuggggccccugggccggcagcggcagcaucagcagccccggcagcaccggcagcccccugcacgaggagcccagcccccccagcccccagaacggccccggcaccgccgugcccgcccccaccgacuucagacccagcgccacccccgaggaccugcuggccagcccccugagccccagcgagguggccgccgugccccccgccgaccccggccccgaggcccugcaccccaccgugccccuggaccugccccccgccaccgugcccgccaccaccuuccccggcgccaugggcagcgugaagcccgcccuggacuggcugaccagagagggcggcgagcugcccgaggccgacgaguggaccggcggcgacgcccccgccuucagcaccagcacccugcugagcggcgacggcgacagcgccgagcuggagggcccccccgccccccugauccugcccagcagccuggacuaccaguacgacacccccggccugugggagcuggaggaggccacccugggcgccagcagcugccccugcguggagagcgugcagggcagcacccugaugcccgugcacguggagagagagaucagacugcugggcagaaaccugcaccuguuccaggacggccccggcgacaacgagugcgugauggagcuggagggccuggagguggugguggaggccagaguggagugcgagcccccccccgacacccagugccacgugaccugccagcagcaccagcugagcuacgaggcccugcagcccgagcugagagugggccuguuccugagaagagccggcagacugagaguggacagcgccgagggccugcacguggugcuguacgacugcagcgugggccacggcgacugcagcagaugccagaccgccaugccccaguacggcugcguguggugcgagggcgagagacccagaugcgugaccagagaggccugcggcgaggccgaggccguggccacccagugccccgccccccugauccacagcguggagccccugaccggccccguggacggcggcaccagagugaccaucagaggcagcaaccugggccagcacgugcaggacgugcugggcauggugaccguggccggcgugcccugcgccguggacgcccaggaguacgaggugagcagcagccuggugugcaucaccggcgccagcggcgaggagguggccggcgccaccgccguggaggugcccggcagaggcagaggcgugagcgagcacgacuucgccuaccaggaccccaaggugcacagcaucuuccccgccagaggccccagagccggcggcaccagacugacccugaacggcagcaagcugcugaccggcagacuggaggacaucagagugguggugggcgaccagcccugccaccugcugcccgagcagcagagcgagcagcugagaugcgagaccagccccagacccacccccgccacccugcccguggccgugugguucggcgccaccgagagaagacugcagagaggccaguucaaguacacccuggaccccaacaucaccagcgccggccccaccaagagcuuccugagcggcggcagagagaucugcgugagaggccagaaccuggacguggugcagacccccagaaucagagugaccguggugagcagaaugcugcagcccagccagggccugggcagaagaagaagaguggugcccgagaccgccugcagccugggccccagcugcagcagccagcaguucgaggagcccugccacgugaacagcagccagcugaucaccugcagaacccccgcccugcccggccugcccgaggaccccugggugagaguggaguucauccuggacaaccugguguucgacuucgccacccugaaccccacccccuucagcuacgaggccgaccccacccugcagccccugaaccccgaggaccccaccaugcccuucagacacaagcccggcagcguguucagcguggagggcgagaaccuggaccuggccaugagcaaggaggaggugguggccaugaucggcgacggccccugcguggugaagacccugaccagacaccaccuguacugcgagccccccguggagcagccccugcccagacaccacgcccugagagaggcccccgacagccugcccgaguucaccgugcagaugggcaaccugagauucagccugggccacgugcaguacgacggcgagagccccggcgccuuccccguggccgcccaggugggccugggcgugggcaccagccugcuggcccugggcgugaucaucaucgugcugauguacagaagaaagagcaagcaggcccugagagacuacaagaaggugcagauccagcuggagaaccuggagagcagcgugagagacagaugcaagaaggaguucaccgaccugaugaccgagaugaccgaccugaccagcgaccugcugggcagcggcauccccuuccuggacuacaagguguacgccgagagaaucuucuuccccggccacagagagagcccccugcacagagaccugggcgugcccgagagcagaagacccaccguggagcagggccugggccagcugagcaaccugcugaacagcaagcuguuccugaccaaguucauccacacccuggagagccagagaaccuucagcgccagagacagagccuacguggccagccugcugaccguggcccugcacggcaagcuggaguacuucaccgacauccugagaacccugcugagcgaccugguggcccaguacguggccaagaaccccaagcugaugcugagaagaaccgagaccgugguggagaagcugcugaccaacuggaugagcaucugccuguacaccuucgugagagacagcgugggcgagccccuguacaugcuguucagaggcaucaagcaccagguggacaagggccccguggacagcgugaccggcaaggccaaguacacccugaacgacaacagacugcugagagaggacguggaguacagaccccugacccugaacgcccugcuggccgugggccccggcgccggcgaggcccagggcgugcccgugaaggugcuggacugcgacaccaucagccaggccaaggagaagaugcuggaccagcuguacaagggcgugccccugacccagagacccgaccccagaacccuggacguggaguggagaagcggcguggccggccaccugauccugagcgacgaggacgugaccagcgaggugcagggccuguggagaagacugaacacccugcagcacuacaaggugcccgacggcgccaccguggcccuggugcccugccugaccaagcacgugcugagagagaaccaggacuacgugcccggcgagagaacccccaugcuggaggacguggacgagggcggcaucagacccuggcaccuggugaagcccagcgacgagcccgagccccccagacccagaagaggcagccugagaggcggcgagagagagagagccaaggccauccccgagaucuaccugaccagacugcugagcaugaagggcacccugcagaaguucguggacgaccuguuccaggugauccugagcaccagcagacccgugccccuggccgugaaguacuucuucgaccugcuggacgagcaggcccagcagcacggcaucagcgaccaggacaccauccacaucuggaagaccaacagccugccccugagauucuggaucaacaucaucaagaacccccaguucguguucgacgugcagaccagcgacaacauggacgccgugcugcuggugaucgcccagaccuucauggacgccugcacccuggccgaccacaagcugggcagagacagccccaucaacaagcugcuguacgccagagacauccccagauacaagagaaugguggagagauacuacgccgacaucagacagaccgugcccgccagcgaccaggagaugaacagcgugcuggccgagcugagcuggaacuacagcggcgaccugggcgccagaguggcccugcacgagcuguacaaguacaucaacaaguacuacgaccagaucaucaccgcccuggaggaggacggcaccgcccagaagaugcagcugggcuacagacugcagcagaucgccgccgccguggagaacaaggugaccgaccuguaa

SEQ ID NO: 21701 - RNA, 5799 nt, Artificial Sequence
  PLXNB3__Homo_sapiens__NP_001156729
auggagcugacccccgccagcagccugaccugcagccugcugagccccagacugcccggcagcuucccccagcugagaagagugccccccugcagcagacccuggcugcccaaggcccccgugauggccagauggccccccuucggccugugccugcugcugcugcugcugagcccccccccccugccccugaccggcgcccacagauucagcgcccccaacaccacccugaaccaccuggcccuggcccccggcagaggcacccuguacgugggcgccgugaacagacuguuccagcugagccccgagcugcagcuggaggccguggccgugaccggccccgugaucgacagccccgacugcgugcccuucagagaccccgccgagugcccccaggcccagcugaccgacaacgccaaccagcugcugcuggugagcagcagagcccaggagcugguggccugcggccaggugagacagggcgugugcgagaccagaagacugggcgacguggccgaggugcuguaccaggccgaggaccccggcgacggccaguucguggccgccaacacccccggcguggccaccgugggccugguggugccccugcccggcagagaccugcugcugguggccagaggccuggccggcaagcugagcgccggcgugcccccccuggccaucagacagcuggccggcagccagcccuucagcagcgagggccugggcagacugguggugggcgacuucagcgacuacaacaacagcuacgugggcgccuucgccgacgccagaagcgccuacuucguguucagaagaagaggcgccagagcccaggccgaguacagaagcuacguggccagagugugccugggcgacaccaaccuguacagcuacguggaggugccccuggccugccagggccagggccugauccaggccgccuuccuggcccccggcacccugcugggcguguucgccgccggccccagaggcacccaggccgcccugugcgccuuccccaugguggagcugggcgccagcauggagcaggccagaagacugugcuacaccgccggcggcagaggccccagcggcgccgaggaggccaccguggaguacggcgugaccagcagaugcgugacccugccccuggacagccccgagagcuaccccugcggcgacgagcacacccccagccccaucgccggcagacagccccuggaggugcagccccugcugaagcugggccagcccgugagcgccguggccgcccugcaggccgacggccacaugaucgccuuccugggcgacacccagggccagcuguacaagguguuccugcacggcagccagggccagguguaccacagccagcaggugggcccccccggcagcgccaucagccccgaccugcugcuggacagcagcggcagccaccuguacgugcugaccgcccaccagguggacagaauccccguggccgccugcccccaguuccccgacugcgccagcugccugcaggcccaggacccccugugcggcuggugcgugcugcagggcagaugcaccagaaagggccagugcggcagagccggccagcugaaccaguggcuguggagcuacgaggaggacagccacugccugcacauccagagccugcugcccggccaccaccccagacaggagcagggccaggugacccugagcgugcccagacugcccauccuggacgccgacgaguacuuccacugcgccuucggcgacuacgacagccuggcccacguggagggcccccacguggccugcgugacccccccccaggaccaggugccccugaacccccccggcaccgaccacgugaccgugccccuggcccugauguucgaggacgugaccguggccgccaccaacuucagcuucuacgacugcagcgccgugcaggcccuggaggccgccgcccccugcagagccugcgugggcagcaucuggagaugccacuggugcccccagagcagccacugcguguacggcgagcacugccccgagggcgagagaaccaucuacagcgcccaggagguggacauccaggugagaggccccggcgccugcccccagguggagggccuggccggcccccaccuggugcccgugggcugggagagccaccuggcccugagagugagaaaccugcagcacuucagaggccugcccgccagcuuccacugcuggcuggagcugcccggcgagcugagaggccugcccgccacccuggaggagaccgccggcgacagcggccugauccacugccaggcccaccaguucuaccccagcaugagccagagagagcugcccgugcccaucuacgugacccagggcgaggcccagagacuggacaacacccacgcccuguacgugauccuguacgacugcgccaugggccaccccgacugcagccacugccaggccgccaacagaagccugggcugccuguggugcgccgacggccagcccgccugcagauacggcccccugugcccccccggcgccguggagcugcugugccccgcccccagcaucgacgccguggagccccugaccggcccccccgagggcggccuggcccugaccauccugggcagcaaccugggcagagccuucgccgacgugcaguacgccgugagcguggccagcagacccugcaaccccgagcccagccuguacagaaccagcgccagaaucgugugcgugaccagccccgcccccaacggcaccaccggccccgugagaguggccaucaagagccagccccccggcaucagcagccagcacuucaccuaccaggaccccgugcugcugagccugagccccagauggggcccccaggccggcggcacccagcugaccaucagaggccagcaccugcagaccggcggcaacaccagcgccuucgugggcggccagcccugccccauccuggagcccgugugccccgaggccaucgugugcagaaccagaccccaggccgcccccggcgaggccgccgugcuggugguguucggccacgcccagagaacccugcuggccagccccuucagauacaccgccaacccccagcugguggccgccgagcccagcgccagcuucagaggcggcggcagacugaucagagugagaggcaccggccuggacguggugcagagaccccugcugagcguguggcuggaggccgacgccgaggugcaggccagcagagcccagccccaggacccccagcccagaagaagcugcggcgcccccgccgccgacccccaggccugcauccagcugggcggcggccugcugcagugcagcaccgugugcagcgugaacagcagcagccugcugcugugcagaagccccgccgugcccgacagagcccacccccagagaguguucuucacccuggacaacgugcagguggacuucgccagcgccagcggcggccagggcuuccuguaccagcccaaccccagacuggccccccugagcagagagggccccgccagacccuacagacugaagcccggccacgugcuggacguggagggcgagggccugaaccugggcaucagcaaggaggaggugagagugcacaucggcagaggcgagugccuggugaagacccugaccagaacccaccuguacugcgagccccccgcccacgccccccagcccgccaacggcagcggccugccccaguucguggugcagaugggcaacgugcagcuggcccugggccccgugcaguacgaggccgagcccccccugagcgccuuccccguggaggcccaggccggcgugggcaugggcgccgccgugcugaucgccgccgugcugcugcugacccugauguacagacacaagagcaagcaggcccugagagacuaccagaaggugcuggugcagcuggagagccuggagaccggcgugggcgaccagugcagaaaggaguucaccgaccugaugaccgagaugaccgaccugagcagcgaccuggagggcagcggcauccccuuccuggacuacagaaccuacgccgagagagccuucuuccccggccacggcggcugcccccugcagcccaagcccgagggccccggcgaggacggccacugcgccaccgugagacagggccugacccagcugagcaaccugcugaacagcaagcuguuccugcugacccugauccacacccuggaggagcagcccagcuucagccagagagacagaugccacguggccagccugcugagccuggcccugcacggcaagcuggaguaccugaccgacaucaugagaacccugcugggcgaccuggccgcccacuacgugcacagaaaccccaagcugaugcugagaagaaccgagaccaugguggagaagcugcugaccaacuggcugagcaucugccuguacgccuuccugagagagguggccggcgagccccuguacaugcuguucagagccauccaguaccagguggacaagggccccguggacgccgugaccggcaaggccaagagaacccugaacgacagcagacugcugagagaggacguggaguuccagccccugacccugauggugcuggugggccccggcgccggcggcgccgccggcagcagcgagaugcagagagugcccgccagagugcuggacaccgacaccaucacccaggugaaggagaaggugcuggaccagguguacaagggcacccccuucagccagagacccagcgugcacgcccuggaccuggaguggagaagcggccuggccggccaccugacccugagcgacgaggaccugaccagcgugacccagaaccacuggaagagacugaacacccugcagcacuacaaggugcccgacggcgccaccgugggccuggugccccagcugcacagaggcagcaccaucagccagagccuggcccagagaugcccccugggcgagaacauccccacccuggaggacggcgaggagggcggcgugugccuguggcaccuggugaaggccaccgaggagcccgagggcgccaaggugagaugcagcagccugagagagagagagcccgccagagccaaggccauccccgagaucuaccugaccagacugcugagcaugaagggcacccugcagaaguucguggacgacaccuuccaggccauccugagcgugaacagacccauccccaucgccgugaaguaccuguucgaccugcuggacgagcuggccgagaagcacggcaucgaggaccccggcacccugcacaucuggaagaccaacagccugcugcugagauucugggugaacgcccugaagaacccccagcugaucuucgacgugagagugagcgacaacguggacgccauccuggccgugaucgcccagaccuucaucgacagcugcaccaccagcgagcacaaggugggcagagacagccccgugaacaagcugcuguacgccagagagauccccagauacaagcagaugguggagagauacuacgccgacaucagacagagcagccccgccagcuaccaggagaugaacagcgcccuggccgagcugagcggcaacuacaccagcgccccccacugccuggaggcccugcaggagcuguacaaccacauccacagauacuacgaccagaucaucagcgcccuggaggaggaccccgugggccagaagcugcagcuggccugcagacugcagcagguggccgcccugguggagaacaaggugaccgaccuguaa

SEQ ID NO: 21702 - RNA, 4707 nt, Artificial Sequence
  PLXNC1__Homo_sapiens__NP_005752
auggaggugagcagaagaaaggccccccccagaccccccagacccgccgccccccugccccugcuggccuaccugcuggcccuggccgcccccggcagaggcgccgacgagcccguguggagaagcgagcaggccaucggcgccaucgccgccagccaggaggacggcguguucguggccagcggcagcugccuggaccagcuggacuacagccuggagcacagccugagcagacuguacagagaccaggccggcaacugcaccgagcccgugagccuggccccccccgccagacccagacccggcagcagcuucagcaagcugcugcugcccuacagagagggcgccgccggccugggcggccugcugcugaccggcuggaccuucgacagaggcgccugcgaggugagaccccugggcaaccugagcagaaacagccugagaaacggcaccgagguggugagcugccacccccagggcagcaccgccggcgugguguacagagccggcagaaacaacagaugguaccuggccguggccgccaccuacgugcugcccgagcccgagaccgccagcagaugcaaccccgccgccagcgaccacgacaccgccaucgcccugaaggacaccgagggcagaagccuggccacccaggagcugggcagacugaagcugugcgagggcgccggcagccugcacuucguggacgccuuccuguggaacggcagcaucuacuuccccuacuaccccuacaacuacaccagcggcgccgccaccggcuggcccagcauggccagaaucgcccagagcaccgaggugcuguuccagggccaggccagccuggacugcggccacggccaccccgacggcagaagacugcugcugagcagcagccugguggaggcccuggacgugugggccggcguguucagcgccgccgccggcgagggccaggagagaagaagccccaccaccaccgcccugugccuguucagaaugagcgagauccaggccagagccaagagagugagcugggacuucaagaccgccgagagccacugcaaggagggcgaccagcccgagagagugcagcccaucgccagcagcacccugauccacagcgaccugaccagcguguacggcaccguggugaugaacagaaccgugcuguuccugggcaccggcgacggccagcugcugaaggugauccugggcgagaaccugaccagcaacugccccgaggugaucuacgagaucaaggaggagacccccguguucuacaagcuggugcccgaccccgugaagaacaucuacaucuaccugaccgccggcaaggaggugagaagaaucagaguggccaacugcaacaagcacaagagcugcagcgagugccugaccgccaccgacccccacugcggcuggugccacagccugcagagaugcaccuuccagggcgacugcgugcacagcgagaaccuggagaacuggcuggacaucagcagcggcgccaagaagugccccaagauccagaucaucagaagcagcaaggagaagaccaccgugaccauggugggcagcuucagccccagacacagcaagugcauggugaagaacguggacagcagcagagagcugugccagaacaagagccagcccaacagaaccugcaccugcagcauccccaccagagccaccuacaaggacgugagcguggugaacgugauguucagcuucggcagcuggaaccugagcgacagauucaacuucaccaacugcagcagccugaaggagugccccgccugcguggagaccggcugcgccuggugcaagagcgccagaagaugcauccaccccuucaccgccugcgaccccagcgacuacgagagaaaccaggagcagugccccguggccguggagaagaccagcggcggcggcagacccaaggagaacaagggcaacagaaccaaccaggcccugcagguguucuacaucaagagcaucgagccccagaaggugagcacccugggcaagagcaacgugaucgugaccggcgccaacuucaccagagccagcaacaucaccaugauccugaagggcaccagcaccugcgacaaggacgugauccaggugagccacgugcugaacgacacccacaugaaguucagccugcccagcagcagaaaggagaugaaggacgugugcauccaguucgacggcggcaacugcagcagcgugggcagccugagcuacaucgcccugccccacugcagccugaucuuccccgccaccaccuggaucagcggcggccagaacaucaccaugaugggcagaaacuucgacgugaucgacaaccugaucaucagccacgagcugaagggcaacaucaacgugagcgaguacugcguggccaccuacugcggcuuccuggcccccagccugaagagcagcaaggugagaaccaacgugaccgugaagcugagagugcaggacaccuaccuggacugcggcacccugcaguacagagaggaccccagauucaccggcuacagaguggagagcgagguggacaccgagcuggaggugaagauccagaaggagaacgacaacuucaacaucagcaagaaggacaucgagaucacccuguuccacggcgagaacggccagcugaacugcagcuucgagaacaucaccagaaaccaggaccugaccaccauccugugcaagaucaagggcaucaagaccgccagcaccaucgccaacagcagcaagaaggugagagugaagcugggcaaccuggagcuguacguggagcaggagagcgugcccagcaccugguacuuccugaucgugcugcccgugcugcuggugaucgugaucuucgccgccgugggcgugaccagacacaagagcaaggagcugagcagaaagcagagccagcagcuggagcugcuggagagcgagcugagaaaggagaucagagacggcuucgccgagcugcagauggacaagcuggacgugguggacagcuucggcaccgugcccuuccuggacuacaagcacuucgcccugagaaccuucuuccccgagagcggcggcuucacccacaucuucaccgaggacaugcacaacagagacgccaacgacaagaacgagagccugaccgcccuggacgcccugaucugcaacaagagcuuccuggugaccgugauccacacccuggagaagcagaagaacuucagcgugaaggacagaugccuguucgccagcuuccugaccaucgcccugcagaccaagcugguguaccugaccagcauccuggaggugcugaccagagaccugauggagcagugcagcaacaugcagcccaagcugaugcugagaagaaccgagagcgugguggagaagcugcugaccaacuggaugagcgugugccugagcggcuuccugagagagaccgugggcgagcccuucuaccugcuggugaccacccugaaccagaagaucaacaagggccccguggacgugaucaccugcaaggcccuguacacccugaacgaggacuggcugcuguggcaggugcccgaguucagcaccguggcccugaacgugguguucgagaagauccccgagaacgagagcgccgacgugugcagaaacaucagcgugaacgugcuggacugcgacaccaucggccaggccaaggagaagaucuuccaggccuuccugagcaagaacggcagccccuacggccugcagcugaacgagaucggccuggagcugcagaugggcaccagacagaaggagcugcuggacaucgacagcagcagcgugauccuggaggacggcaucaccaagcugaacaccaucggccacuacgagaucagcaacggcagcaccaucaagguguucaagaagaucgccaacuucaccagcgacguggaguacagcgacgaccacugccaccugauccugcccgacagcgaggccuuccaggacgugcagggcaagagacacagaggcaagcacaaguucaaggugaaggagauguaccugaccaagcugcugagcaccaagguggccauccacagcgugcuggagaagcuguucagaagcaucuggagccugcccaacagcagagcccccuucgccaucaaguacuucuucgacuuccuggacgcccaggccgagaacaagaagaucaccgaccccgacguggugcacaucuggaagaccaacagccugccccugagauucugggugaacauccugaagaacccccaguucguguucgacaucaagaagaccccccacaucgacggcugccugagcgugaucgcccaggccuucauggacgccuucagccugaccgagcagcagcugggcaaggaggcccccaccaacaagcugcuguacgccaaggacauccccaccuacaaggaggaggugaagagcuacuacaaggccaucagagaccugcccccccugagcagcagcgagauggaggaguuccugacccaggagagcaagaagcacgagaacgaguucaacgaggagguggcccugaccgagaucuacaaguacaucgugaaguacuucgacgagauccugaacaagcuggagagagagagaggccuggaggaggcccagaagcagcugcugcacgugaaggugcuguucgacgagaagaagaagugcaaguggauguaa

SEQ ID NO: 21703 - RNA, 5778 nt, Artificial Sequence
  PLXND1__Homo_sapiens__NP_055918
auggcccccagagccgccggcggcgccccccugagcgccagagccgccgccgccagccccccccccuuccagaccccccccagaugccccgugccccugcugcugcugcugcugcugggcgccgccagagccggcgcccuggagauccagagaagauuccccagccccacccccaccaacaacuucgcccuggacggcgccgccggcaccguguaccuggccgccgugaacagacuguaccagcugagcggcgccaaccugagccuggaggccgaggccgccgugggccccgugcccgacagcccccugugccacgccccccagcugccccaggccagcugcgagcaccccagaagacugaccgacaacuacaacaagauccugcagcuggaccccggccagggccuggugguggugugcggcagcaucuaccagggcuucugccagcugagaagaagaggcaacaucagcgccguggccgugagauucccccccgccgccccccccgccgagcccgugaccguguuccccagcaugcugaacguggccgccaaccaccccaacgccagcaccgugggccuggugcugccccccgccgccggcgccggcggcagcagacugcuggugggcgccaccuacaccggcuacggcagcagcuucuuccccagaaacagaagccuggaggaccacagauucgagaacacccccgagaucgccaucagaagccuggacaccagaggcgaccuggccaagcuguucaccuucgaccugaaccccagcgacgacaacauccugaagaucaagcagggcgccaaggagcagcacaagcugggcuucgugagcgccuuccugcaccccagcgaccccccccccggcgcccagagcuacgccuaccuggcccugaacagcgaggccagagccggcgacaaggagagccaggccagaagccugcuggccagaaucugccugccccacggcgccggcggcgacgccaagaagcugaccgagagcuacauccagcugggccugcagugcgccggcggcgccggcagaggcgaccuguacagcagacuggugagcguguuccccgccagagagagacuguucgccguguucgagagaccccagggcagccccgccgccagagccgcccccgccgcccugugcgccuucagauucgccgacgugagagccgccaucagagccgccagaaccgccugcuucguggagcccgcccccgacgugguggccgugcuggacagcguggugcagggcaccggccccgccugcgagagaaagcugaacauccagcugcagcccgagcagcuggacugcggcgccgcccaccugcagcacccccugagcauccugcagccccugaaggccacccccguguucagagcccccggccugaccagcguggccguggccagcgugaacaacuacaccgccguguuccugggcaccgugaacggcagacugcugaagaucaaccugaacgagagcaugcagguggugagcagaagaguggugaccguggccuacggcgagcccgugcaccacgugaugcaguucgaccccgccgacagcggcuaccuguaccugaugaccagccaccagauggccagagugaagguggccgccugcaacgugcacagcaccugcggcgacugcgugggcgccgccgacgccuacugcggcuggugcgcccuggagaccagaugcacccugcagcaggacugcaccaacagcagccagcagcacuucuggaccagcgccagcgagggccccagcagaugccccgccaugaccgugcugcccagcgagaucgacgugagacaggaguaccccggcaugauccugcagaucagcggcagccugcccagccugagcggcauggagauggccugcgacuacggcaacaacaucagaaccguggccagagugcccggccccgccuucggccaccagaucgccuacugcaaccugcugcccagagaccaguucccccccuucccccccaaccaggaccacgugaccguggagaugagcgugagagugaacggcagaaacaucgugaaggccaacuucaccaucuacgacugcagcagaaccgcccagguguacccccacaccgccugcaccagcugccugagcgcccaguggcccugcuucuggugcagccagcagcacagcugcgugagcaaccagagcagaugcgaggccagccccaaccccaccagcccccaggacugccccagaacccugcugagcccccuggcccccgugcccaccggcggcagccagaacauccuggugccccuggccaacaccgccuucuuccagggcgccgcccuggagugcagcuucggccuggaggagaucuucgaggccgugugggugaacgagagcguggugagaugcgaccagguggugcugcacaccaccagaaagagccagguguucccccugagccugcagcugaagggcagacccgccagauuccuggacagccccgagcccaugaccgugaugguguacaacugcgccaugggcagccccgacugcagccagugccugggcagagaggaccugggccaccugugcauguggagcgacggcugcagacugagaggcccccugcagcccauggccggcaccugccccgcccccgagaucagagccaucgagccccugagcggcccccuggacggcggcacccugcugaccaucagaggcagaaaccugggcagaagacugagcgacguggcccacggcguguggaucggcggcguggccugcgagccccugcccgacagauacaccgugagcgaggagaucgugugcgugaccggccccgcccccggcccccugagcggcguggugaccgugaacgccagcaaggagggcaagagcagagacagauucagcuacgugcugccccuggugcacagccuggagcccaccaugggccccaaggccggcggcaccagaaucaccauccacggcaacgaccugcacgugggcagcgagcugcaggugcuggugaacgacaccgaccccugcaccgagcugaugagaaccgacaccagcaucgccugcaccaugcccgagggcgcccugcccgcccccgugcccgugugcgugagauucgagagaagaggcugcgugcacggcaaccugaccuucugguacaugcagaaccccgugaucaccgccaucagccccagaagaagccccgugagcggcggcagaaccaucaccguggccggcgagagauuccacauggugcagaacgugagcauggccgugcaccacaucggcagagagcccacccugugcaaggugcugaacagcacccugaucaccugccccagccccggcgcccugagcaacgccagcgcccccguggacuucuucaucaacggcagagccuacgccgacgagguggccguggccgaggagcugcuggaccccgaggaggcccagagaggcagcagauucagacuggacuaccugcccaacccccaguucagcaccgccaagagagagaaguggaucaagcaccaccccggcgagccccugacccuggugauccacaaggagcaggacagccugggccugcagagccacgaguacagagugaagaucggccaggugagcugcgacauccagaucgugagcgacagaaucauccacugcagcgugaacgagagccugggcgccgccgugggccagcugcccaucaccauccaggugggcaacuucaaccagaccaucgccacccugcagcugggcggcagcgagaccgccaucaucgugagcaucgugaucugcagcgugcugcugcugcugagcgugguggcccuguucguguucugcaccaagagcagaagagccgagagauacuggcagaagacccugcugcagauggaggagauggagagccagaucagagaggagaucagaaagggcuucgccgagcugcagaccgacaugaccgaccugaccaaggagcugaacagaagccagggcauccccuuccuggaguacaagcacuucgugaccagaaccuucuuccccaagugcagcagccuguacgaggagagauacgugcugcccagccagacccugaacagccagggcagcagccaggcccaggagacccacccccugcugggcgaguggaagauccccgagagcugcagacccaacauggaggagggcaucagccuguucagcagccugcugaacaacaagcacuuccugaucguguucgugcacgcccuggagcagcagaaggacuucgccgugagagacagaugcagccuggccagccugcugaccaucgcccugcacggcaagcuggaguacuacaccagcaucaugaaggagcugcugguggaccugaucgacgccagcgccgccaagaaccccaagcugaugcugagaagaaccgagagcgugguggagaagaugcugaccaacuggaugagcaucugcauguacagcugccugagagagaccgugggcgagcccuucuuccugcugcugugcgccaucaagcagcagaucaacaagggcagcaucgacgccaucaccggcaaggccagauacacccugaacgaggaguggcugcugagagagaacaucgaggccaagcccagaaaccugaacgugagcuuccagggcugcggcauggacagccugagcgugagagccauggacaccgacacccugacccaggugaaggagaagauccuggaggccuucugcaagaacgugcccuacagccaguggcccagagccgaggacguggaccuggagugguucgccagcagcacccagagcuacauccugagagaccuggacgacaccagcgugguggaggacggcagaaagaagcugaacacccuggcccacuacaagauccccgagggcgccagccuggccaugagccugaucgacaagaaggacaacacccugggcagagugaaggaccuggacaccgagaaguacuuccaccuggugcugcccaccgacgagcuggccgagcccaagaagagccacagacagagccacagaaagaaggugcugcccgagaucuaccugaccagacugcugagcaccaagggcacccugcagaaguuccuggacgaccuguucaaggccauccugagcaucagagaggacaagcccccccuggccgugaaguacuucuucgacuuccuggaggagcaggccgagaagagaggcaucagcgaccccgacacccugcacaucuggaagaccaacagccugccccugagauucugggugaacauccugaagaacccccaguucguguucgacaucgacaagaccgaccacaucgacgccugccugagcgugaucgcccaggccuucaucgacgccugcagcaucagcgaccugcagcugggcaaggacagccccaccaacaagcugcuguacgccaaggagauccccgaguacagaaagaucgugcagagauacuacaagcagauccaggacaugaccccccugagcgagcaggagaugaacgcccaccuggccgaggagagcagaaaguaccagaacgaguucaacaccaacguggccauggccgagaucuacaaguacgccaagagauacagaccccagaucauggccgcccuggaggccaaccccaccgccagaagaacccagcugcagcacaaguucgagcaggugguggcccugauggaggacaacaucuacgagugcuacagcgaggccuaa

SEQ ID NO: 21704 - RNA, 1509 nt, Artificial Sequence
  PM20D1__Homo_sapiens__NP_689704
auggcccagagaugcgugugcgugcuggcccugguggccaugcugcugcugguguuccccaccgugagcagaagcaugggccccagaagcggcgagcaccagagagccagcagaauccccagccaguucagcaaggaggagagaguggccaugaaggaggcccugaagggcgccauccagauccccaccgugaccuucagcagcgagaagagcaacaccaccgcccuggccgaguucggcaaguacauccacaagguguuccccaccguggugagcaccagcuucauccagcacgaggugguggaggaguacagccaccuguucaccauccagggcagcgaccccagccugcagcccuaccugcugauggcccacuucgacguggugcccgcccccgaggagggcugggaggugccccccuucagcggccuggagagagacggcaucaucuacggcagaggcacccuggacgacaagaacagcgugauggcccugcugcaggcccuggagcugcugcugaucagaaaguacauccccagaagaagcuucuucaucagccugggccacgacgaggagagcagcggcaccggcgcccagagaaucagcgcccugcugcagagcagaggcgugcagcuggccuucaucguggacgagggcggcuucauccuggacgacuucauccccaacuucaagaagcccaucgcccugaucgccgugagcgagaagggcagcaugaaccugaugcugcaggugaacaugaccagcggccacagcagcgccccccccaaggagaccagcaucggcauccuggccgccgccgugagcagacuggagcagacccccaugcccaucaucuucggcagcggcaccguggugaccgugcugcagcagcuggccaacgaguuccccuuccccgugaacaucauccugagcaaccccuggcuguucgagccccugaucagcagauucauggagagaaacccccugaccaacgccaucaucagaaccaccaccgcccugaccaucuucaaggccggcgugaaguucaacgugaucccccccguggcccaggccaccgugaacuucagaauccaccccggccagaccgugcaggaggugcuggagcugaccaagaacaucguggccgacaacagagugcaguuccacgugcugagcgccuucgacccccugcccgugagccccagcgacgacaaggcccugggcuaccagcugcugagacagaccgugcagagcguguuccccgaggugaacaucaccgcccccgugaccagcaucggcaacaccgacagcagauucuucaccaaccugaccaccggcaucuacagauucuaccccaucuacauccagcccgaggacuucaagagaauccacggcgugaacgagaagaucagcgugcaggccuacgagacccaggugaaguucaucuucgagcugauccagaacgccgacaccgaccaggagcccgugagccaccugcacaagcuguaa

SEQ ID NO: 21705 - RNA, 165 nt, Artificial Sequence
  PMAIP1__Homo_sapiens__NP_066950
augcccggcaagaaggccagaaagaacgcccagcccagccccgccagagcccccgccgagcuggagguggagugcgccacccagcugagaagauucggcgacaagcugaacuucagacagaagcugcugaaccugaucagcaagcuguucugcagcggcaccuaa

SEQ ID NO: 21706 - RNA, 498 nt, Artificial Sequence
  PMCH__Homo_sapiens__NP_002665
auggccaagaugaaccugagcagcuacauccugauccugaccuucagccuguucagccagggcauccugcugagcgccagcaagagcaucagaaaccuggacgacgacaugguguucaacaccuucagacugggcaagggcuuccagaaggaggacaccgccgagaagagcgugaucgcccccagccuggagcaguacaagaacgacgagagcagcuucaugaacgaggaggagaacaaggugagcaagaacaccggcagcaagcacaacuuccugaaccacggccugccccugaaccuggccaucaagcccuaccuggcccugaagggcagcguggccuuccccgccgagaacggcgugcagaacaccgagagcacccaggagaagagagagaucggcgacgaggagaacagcgccaaguuccccaucggcagaagagacuucgacaugcugagaugcaugcugggcagaguguacagacccugcuggcagguguaa

SEQ ID NO: 21707 - RNA, 1728 nt, Artificial Sequence
  PMEL__Homo_sapiens__NP_001186982
auggaccuggugcugaagagaugccugcugcaccuggccgugaucggcgcccugcuggccgugggcgccaccaagggcagccagguguggggcggccagcccguguacccccaggagaccgacgacgccugcaucuuccccgacggcggccccugccccagcggcagcuggagccagaagagaagcuucguguacguguggaagaccuggggccaguacuggcaggugcugggcggccccgugagcggccugagcaucggcaccggcagagccaugcugggcacccacaccauggaggugaccguguaccacagaagaggcagcagaagcuacgugccccuggcccacagcagcagcgccuucaccaucaccgaccaggugcccuucagcgugagcgugagccagcugagagcccuggacggcggcaacaagcacuuccugagaaaccagccccugaccuucgcccugcagcugcacgaccccagcggcuaccuggccgaggccgaccugagcuacaccugggacuucggcgacagcagcggcacccugaucagcagagcccugguggugacccacaccuaccuggagcccggccccgugaccgcccagguggugcugcaggccgccaucccccugaccagcugcggcagcagccccgugcccggcaccaccgacggccacagacccaccgccgaggcccccaacaccaccgccggccaggugcccaccaccgagguggugggcaccacccccggccaggcccccaccgccgagcccagcggcaccaccagcgugcaggugcccaccaccgaggugaucagcaccgcccccgugcagaugcccaccgccgagagcaccggcaugacccccgagaaggugcccgugagcgaggugaugggcaccacccuggccgagaugagcacccccgaggccaccggcaugacccccgccgaggugagcaucguggugcugagcggcaccaccgccgcccaggugaccaccaccgaguggguggagaccaccgccagagagcugcccauccccgagcccgagggccccgacgccagcagcaucaugagcaccgagagcaucaccggcagccugggcccccugcuggacggcaccgccacccugagacuggugaagagacaggugccccuggacugcgugcuguacagauacggcagcuucagcgugacccuggacaucgugcagggcaucgagagcgccgagauccugcaggccgugcccagcggcgagggcgacgccuucgagcugaccgugagcugccagggcggccugcccaaggaggccugcauggagaucagcagccccggcugccagccccccgcccagagacugugccagcccgugcugcccagccccgccugccagcuggugcugcaccagauccugaagggcggcagcggcaccuacugccugaacgugagccuggccgacaccaacagccuggccguggugagcacccagcugaucaugcccggccaggaggccggccugggccaggugccccugaucgugggcauccugcuggugcugauggccguggugcuggccagccugaucuacagaagaagacugaugaagcaggacuucagcgugccccagcugccccacagcagcagccacuggcugagacugcccagaaucuucugcagcugccccaucggcgagaacagcccccugcugagcggccagcagguguaa

SEQ ID NO: 21708 - RNA, 780 nt, Artificial Sequence
  PMEPA1__Homo_sapiens__NP_001242905
augcccgccauccccgcccacggcgccgagcuggaguucgugcagaucaucaucaucgugguggugaugauggugauggugguggugaucaccugccugcugagccacuacaagcugagcgccagaagcuucaucagcagacacagccagggcagaagaagagaggacgcccugagcagcgagggcugccuguggcccagcgagagcaccgugagcggcaacggcauccccgagccccagguguacgccccccccagacccaccgacagacuggccgugccccccuucgcccagagagagagauuccacagauuccagcccaccuaccccuaccugcagcacgagaucgaccugccccccaccaucagccugagcgacggcgaggagcccccccccuaccagggccccugcacccugcagcugagagaccccgagcagcagcuggagcugaacagagagagcgugagagccccccccaacagaaccaucuucgacagcgaccugauggacagcgccagacugggcggccccugcccccccagcagcaacagcggcaucagcgccaccugcuacggcagcggcggcagaauggagggccccccccccaccuacagcgaggugaucggccacuaccccggcagcagcuuccagcaccagcagagcagcggcccccccagccugcuggagggcaccagacugcaccacacccacaucgccccccuggagagcgccgccaucuggagcaaggagaaggacaagcagaagggccacccccuguaa

SEQ ID NO: 21709 - RNA, 663 nt, Artificial Sequence
  PMF1-BGLAP__Homo_sapiens__NP_001186590
auggccgaggccagcagcgccaaccugggcagcggcugcgaggagaagagacacgagggcagcagcagcgagagcgugccccccggcaccaccaucagcagagugaagcugcuggacaccaugguggacaccuuccugcagaagcugguggccgccggcagcuaccagagauucaccgacugcuacaagugcuucuaccagcugcagcccgccaugacccagcagaucuacgacaaguucaucgcccagcugcagaccagcaucagagaggagaucagcgacaucaaggaggagggcaaccuggaggccgugcugaacgcccuggacaagaucguggaggagggcaaggugagaaaggagcccgccugcaacggcacccccugcggcgccaugugcagaaacagaagacccagaaccagcagcuggcagaugcccagcuggcagggcggcggcagauggagaagcugcagcuacagaagcagacccagcagcagacccggcagaugcgaggcccagagaugcagagugcagcagagaugcagccugugcgugcaggccggcggccagagaggcagcgaggagacccaggcccugcccgugagcauggccggcagccccagcccccugcccggcagccccggcgcccaggagggcggcguguaa

SEQ ID NO: 21710 - RNA, 543 nt, Artificial Sequence
  PMF1__Homo_sapiens__NP_001186582
auggccgaggccagcagcgccaaccugggcagcggcugcgaggagaagagacacgagggcagcagcagcgagagcgugccccccggcaccaccaucagcagagugaagcugcuggacaccaugguggacaccuuccugcagaagcugguggccgccggcagcuaccagagauucaccgacugcuacaagugcuucuaccagcugcagcccgccaugacccagcagaucuacgacaaguucaucgcccagcugcagaccagcaucagagaggagaucagcgacaucaaggaggagggcaaccuggaggccgugcugaacgcccuggacaagaucguggaggagggcaaggugagaaaggagcccgccugcaacggcacccccugcggcgccaugugcagaaacagaagacccagaaccagcagcuggcagaugcccagcuggcagggcggcggcagauggagaagcugcagcuacagaagcagacccagcagcagacccggcagacuguacaccgagaacagaggcagcuggcugcugugcuaa

SEQ ID NO: 21711 - RNA, 1902 nt, Artificial Sequence
  PML__Homo_sapiens__NP_002666
auggagcccgcccccgccagaagccccagaccccagcaggaccccgccagaccccaggagcccaccaugcccccccccgagacccccagcgagggcagacagcccagccccagccccagccccaccgagagagcccccgccagcgaggaggaguuccaguuccugagaugccagcagugccaggccgaggccaagugccccaagcugcugcccugccugcacacccugugcagcggcugccuggaggccagcggcaugcagugccccaucugccaggcccccuggccccugggcgccgacacccccgcccuggacaacguguucuucgagagccugcagagaagacugagcguguacagacagaucguggacgcccaggccgugugcaccagaugcaaggagagcgccgacuucuggugcuucgagugcgagcagcugcugugcgccaagugcuucgaggcccaccagugguuccugaagcacgaggccagaccccuggccgagcugagaaaccagagcgugagagaguuccuggacggcaccagaaagaccaacaacaucuucugcagcaaccccaaccacagaacccccacccugaccagcaucuacugcagaggcugcagcaagccccugugcugcagcugcgcccugcuggacagcagccacagcgagcugaagugcgacaucagcgccgagauccagcagagacaggaggagcuggacgccaugacccaggcccugcaggagcaggacagcgccuucggcgccgugcacgcccagaugcacgccgccgugggccagcugggcagagccagagccgagaccgaggagcugaucagagagagagugagacaggugguggcccacgugagagcccaggagagagagcugcuggaggccguggacgccagauaccagagagacuacgaggagauggccagcagacugggcagacuggacgccgugcugcagagaaucagaaccggcagcgcccuggugcagagaaugaagugcuacgccagcgaccaggaggugcuggacaugcacggcuuccugagacaggcccugugcagacugagacaggaggagccccagagccugcaggccgccgugagaaccgacggcuucgacgaguucaaggugagacugcaggaccugagcagcugcaucacccagggcaaggacgccgccgugagcaagaaggccagccccgaggccgccagcacccccagagaccccaucgacguggaccugcccgaggaggccgagagagugaaggcccaggugcaggcccugggccuggccgaggcccagcccauggccguggugcagagcgugcccggcgcccaccccgugcccguguacgccuucagcaucaagggccccagcuacggcgaggacgugagcaacaccaccaccgcccagaagagaaagugcagccagacccagugccccagaaaggugaucaagauggagagcgaggagggcaaggaggccagacuggccagaagcagccccgagcagcccagacccagcaccagcaaggccgugagccccccccaccuggacggcccccccagccccagaagccccgugaucggcagcgagguguuccugcccaacagcaaccacguggccagcggcgccggcgaggccgaggagagagugguggugaucagcagcagcgaggacagcgacgccgagaacagcagcagcagagagcuggacgacagcagcagcgagagcagcgaccugcagcuggagggccccagcacccugagagugcuggacgagaaccuggccgacccccaggccgaggacagaccccugguguucuucgaccugaagaucgacaacgagagcggcuucagcuggggcuacccccaccccuuccugaucuaa

SEQ ID NO: 21712 - RNA, 789 nt, Artificial Sequence
  PMM1__Homo_sapiens__NP_002667
auggccgugaccgcccaggccgccagaagaaaggagagagugcugugccuguucgacguggacggcacccugacccccgccagacagaagaucgaccccgagguggccgccuuccugcagaagcugagaagcagagugcagaucggcguggugggcggcagcgacuacugcaagaucgccgagcagcugggcgacggcgacgaggugaucgagaaguucgacuacguguucgccgagaacggcaccgugcaguacaagcacggcagacugcugagcaagcagaccauccagaaccaccugggcgaggagcugcugcaggaccugaucaacuucugccugagcuacauggcccugcugagacugcccaagaagagaggcaccuucaucgaguucagaaacggcaugcugaacaucagccccaucggcagaagcugcacccuggaggagagaaucgaguucagcgagcuggacaagaaggagaagaucagagagaaguucguggaggcccugaagaccgaguucgccggcaagggccugagauucagcagaggcggcaugaucagcuucgacguguuccccgagggcugggacaagagauacugccuggacagccuggaccaggacagcuucgacaccauccacuucuucggcaacgagaccagccccggcggcaacgacuucgagaucuucgccgaccccagaaccgugggccacagcguggugagcccccaggacaccgugcagagaugcagagagaucuucuuccccgagaccgcccacgaggccuaa

SEQ ID NO: 21713 - RNA, 741 nt, Artificial Sequence
  PMM2__Homo_sapiens__NP_000294
auggccgcccccggccccgcccugugccuguucgacguggacggcacccugaccgcccccagacagaagaucaccaaggagauggacgacuuccugcagaagcugagacagaagaucaagaucggcguggugggcggcagcgacuucgagaaggugcaggagcagcugggcaacgacgugguggagaaguacgacuacguguuccccgagaacggccugguggccuacaaggacggcaagcugcugugcagacagaacauccagagccaccugggcgaggcccugauccaggaccugaucaacuacugccugagcuacaucgccaagaucaagcugcccaagaagagaggcaccuucaucgaguucagaaacggcaugcugaacgugagccccaucggcagaagcugcagccaggaggagagaaucgaguucuacgagcuggacaagaaggagaacaucagacagaaguucguggccgaccugagaaaggaguucgccggcaagggccugaccuucagcaucggcggccagaucagcuucgacguguuccccgacggcugggacaagagauacugccugagacacguggagaacgacggcuacaagaccaucuacuucuucggcgacaagaccaugcccggcggcaacgaccacgagaucuucaccgaccccagaaccaugggcuacagcgugaccgcccccgaggacaccagaagaaucugcgagcugcuguucagcuaa

SEQ ID NO: 21714 - RNA, 483 nt, Artificial Sequence
  PMP22__Homo_sapiens__NP_000295
augcugcugcugcugcugagcaucaucgugcugcacguggccgugcuggugcugcuguucgugagcaccaucgugagccaguggaucgugggcaacggccacgccaccgaccuguggcagaacugcagcaccagcagcagcggcaacgugcaccacugcuucagcagcagccccaacgaguggcugcagagcgugcaggccaccaugauccugagcaucaucuucagcauccugagccuguuccuguucuucugccagcuguucacccugaccaagggcggcagauucuacaucaccggcaucuuccagauccuggccggccugugcgugaugagcgccgccgccaucuacaccgugagacaccccgaguggcaccugaacagcgacuacagcuacggcuucgccuacauccuggccuggguggccuucccccuggcccugcugagcggcgugaucuacgugauccugagaaagagagaguaa

SEQ ID NO: 21715 - RNA, 1185 nt, Artificial Sequence
  PMPCA__Homo_sapiens__NP_001269873
augaagagaaacacccugguggagcugcugaccuucuggaagaacuggcacuucagacugcugcuggaccugaccgccaagaugaaguucugccugagauggaagagcaugggcgugagcgugaccgccagacaccaggacgaggagguggagaugaccagaauggccgugcaguucgagcuggaggaccugaaccugagacccgaccccgagccccugcugaccgagaugauccacgaggccgccuacagagagaacaccgugggccugcacagauucugccccaccgagaacguggccaagaucaacagagaggugcugcacagcuaccugagaaacuacuacacccccgacagaauggugcuggccggcgugggcguggagcacgagcaccugguggacugcgccagaaaguaccugcugggcgugcagcccgccuggggcagcgccgaggccguggacaucgacagaagcguggcccaguacaccggcggcaucgccaagcuggagagagacaugagcaacgugagccugggccccacccccauccccgagcugacccacaucauggugggccuggagagcugcagcuuccuggaggaggacuucauccccuucgccgugcugaacaugaugaugggcggcggcggcagcuucagcgccggcggccccggcaagggcauguucagcagacuguaccugaacgugcugaacagacaccacuggauguacaacgccaccagcuaccaccacagcuacgaggacaccggccugcugugcauccacgccagcgccgaccccagacaggugagagagaugguggagaucaucaccaaggaguucauccugaugggcggcaccguggacaccguggagcuggagagagccaagacccagcugaccagcaugcugaugaugaaccuggagagcagacccgugaucuucgaggacgugggcagacaggugcuggccaccagaagcagaaagcugccccacgagcugugcacccugaucagaaacgugaagcccgaggacgugaagagaguggccagcaagaugcugagaggcaagcccgccguggccgcccugggcgaccugaccgaccugcccaccuacgagcacauccagaccgcccugagcagcaaggacggcagacugcccagaaccuacagacuguucagauaa

SEQ ID NO: 21716 - RNA, 1470 nt, Artificial Sequence
  PMPCB__Homo_sapiens__NP_004270
auggccgccgccgccgccagaguggugcugagcagcgccgccagaagaagacuguggggcuucagcgagagccugcugaucagaggcgccgccggcagaagccuguacuucggcgagaacagacugagaagcacccaggccgccacccagguggugcugaacgugcccgagaccagagugaccugccuggagagcggccugagaguggccagcgaggacagcggccugagcaccugcaccgugggccuguggaucgacgccggcagcagauacgagaacgagaagaacaacggcaccgcccacuuccuggagcacauggccuucaagggcaccaagaagagaagccagcuggaccuggagcuggagaucgagaacaugggcgcccaccugaacgccuacaccagcagagagcagaccguguacuacgccaaggccuucagcaaggaccugcccagagccguggagauccuggccgacaucauccagaacagcacccugggcgaggccgagaucgagagagagagaggcgugauccugagagagaugcaggagguggagaccaaccugcaggaggugguguucgacuaccugcacgccaccgccuaccagaacaccgcccugggcagaaccauccugggccccaccgagaacaucaagagcaucagcagaaaggaccugguggacuacaucaccacccacuacaagggccccagaaucgugcuggccgccgccggcggcgugagccacgacgagcugcuggaccuggccaaguuccacuucggcgacagccugugcacccacaagggcgagauccccgcccugccccccugcaaguucaccggcagcgagaucagagugagagacgacaagaugccccuggcccaccuggccaucgccguggaggccgugggcugggcccaccccgacaccaucugccugaugguggccaacacccugaucggcaacugggacagaagcuucggcggcggcaugaaccugagcagcaagcuggcccagcugaccugccacggcaaccugugccacagcuuccagagcuucaacaccagcuacaccgacaccggccuguggggccuguacauggugugcgagagcagcaccguggccgacaugcugcacguggugcagaaggaguggaugagacugugcaccagcgugaccgagagcgagguggccagagccagaaaccugcugaagaccaacaugcugcugcagcuggacggcagcacccccaucugcgaggacaucggcagacagaugcugugcuacaacagaagaauccccauccccgagcuggaggccagaaucgacgccgugaacgccgagaccaucagagaggugugcaccaaguacaucuacaacagaagccccgccaucgccgccgugggccccaucaagcagcugcccgacuucaagcagaucagaagcaacaugugcuggcugagagacuaa

SEQ ID NO: 21717 - RNA, 2799 nt, Artificial Sequence
  PMS1__Homo_sapiens__NP_000525
augaagcagcugcccgccgccaccgugagacugcugagcagcagccagaucaucaccagcguggugagcguggugaaggagcugaucgagaacagccuggacgccggcgccaccagcguggacgugaagcuggagaacuacggcuucgacaagaucgaggugagagacaacggcgagggcaucaaggccguggacgcccccgugauggccaugaaguacuacaccagcaagaucaacagccacgaggaccuggagaaccugaccaccuacggcuucagaggcgaggcccugggcagcaucugcugcaucgccgaggugcugaucaccaccagaaccgccgccgacaacuucagcacccaguacgugcuggacggcagcggccacauccugagccagaagcccagccaccugggccagggcaccaccgugaccgcccugagacuguucaagaaccugcccgugagaaagcaguucuacagcaccgccaagaagugcaaggacgagaucaagaagauccaggaccugcugaugagcuucggcauccugaagcccgaccugagaaucguguucgugcacaacaaggccgugaucuggcagaagagcagagugagcgaccacaagauggcccugaugagcgugcugggcaccgccgugaugaacaacauggagagcuuccaguaccacagcgaggagagccagaucuaccugagcggcuuccugcccaagugcgacgccgaccacagcuucaccagccugagcacccccgagagaagcuucaucuucaucaacagcagacccgugcaccagaaggacauccugaagcugaucagacaccacuacaaccugaagugccugaaggagagcaccagacuguaccccguguucuuccugaagaucgacgugcccaccgccgacguggacgugaaccugacccccgacaagagccaggugcugcugcagaacaaggagagcgugcugaucgcccuggagaaccugaugaccaccugcuacggcccccugcccagcaccaacagcuacgagaacaacaagaccgacgugagcgccgccgacaucgugcugagcaagaccgccgagaccgacgugcuguucaacaagguggagagcagcggcaagaacuacagcaacguggacaccagcgugauccccuuccagaacgacaugcacaacgacgagagcggcaagaacaccgacgacugccugaaccaccagaucagcaucggcgacuucggcuacggccacugcagcagcgagaucagcaacaucgacaagaacaccaagaacgccuuccaggacaucagcaugagcaacgugagcugggagaacagccagaccgaguacagcaagaccugcuucaucagcagcgugaagcacacccagagcgagaacggcaacaaggaccacaucgacgagagcggcgagaacgaggaggaggccggccuggagaacagcagcgagaucagcgccgacgaguggagcagaggcaacauccugaagaacagcgugggcgagaacaucgagcccgugaagauccuggugcccgagaagagccugcccugcaaggugagcaacaacaacuaccccauccccgagcagaugaaccugaacgaggacagcugcaacaagaagagcaacgugaucgacaacaagagcggcaaggugaccgccuacgaccugcugagcaacagagugaucaagaagcccaugagcgccagcgcccuguucgugcaggaccacagaccccaguuccugaucgagaaccccaagaccagccuggaggacgccacccugcagaucgaggagcuguggaagacccugagcgaggaggagaagcugaaguacgaggagaaggccaccaaggaccuggagagauacaacagccagaugaagagagccaucgagcaggagagccagaugagccugaaggacggcagaaagaagaucaagcccaccagcgccuggaaccuggcccagaagcacaagcugaagaccagccugagcaaccagcccaagcuggacgagcugcugcagagccagaucgagaagagaagaagccagaacaucaagauggugcagauccccuucagcaugaagaaccugaagaucaacuucaagaagcagaacaagguggaccuggaggagaaggacgagcccugccugauccacaaccugagauuccccgacgccuggcugaugaccagcaagaccgaggugaugcugcugaaccccuacagaguggaggaggcccugcuguucaagagacugcuggagaaccacaagcugcccgccgagccccuggagaagcccaucaugcugaccgagagccuguucaacggcagccacuaccuggacgugcuguacaagaugaccgccgacgaccagagauacagcggcagcaccuaccugagcgaccccagacugaccgccaacggcuucaagaucaagcugauccccggcgugagcaucaccgagaacuaccuggagaucgagggcauggccaacugccugcccuucuacggcguggccgaccugaaggagauccugaacgccauccugaacagaaacgccaaggagguguacgagugcagacccagaaaggugaucagcuaccuggagggcgaggccgugagacugagcagacagcugcccauguaccugagcaaggaggacauccaggacaucaucuacagaaugaagcaccaguucggcaacgagaucaaggagugcgugcacggcagacccuucuuccaccaccugaccuaccugcccgagaccaccuaa

SEQ ID NO: 21718 - RNA, 2589 nt, Artificial Sequence
  PMS2__Homo_sapiens__NP_000526
auggagagagccgagagcagcagcaccgagcccgccaaggccaucaagcccaucgacagaaagagcgugcaccagaucugcagcggccagguggugcugagccugagcaccgccgugaaggagcugguggagaacagccuggacgccggcgccaccaacaucgaccugaagcugaaggacuacggcguggaccugaucgaggugagcgacaacggcugcggcguggaggaggagaacuucgagggccugacccugaagcaccacaccagcaagauccaggaguucgccgaccugacccagguggagaccuucggcuucagaggcgaggcccugagcagccugugcgcccugagcgacgugaccaucagcaccugccacgccagcgccaaggugggcaccagacugauguucgaccacaacggcaagaucauccagaagacccccuaccccagacccagaggcaccaccgugagcgugcagcagcuguucagcacccugcccgugagacacaaggaguuccagagaaacaucaagaaggaguacgccaagauggugcaggugcugcacgccuacugcaucaucagcgccggcaucagagugagcugcaccaaccagcugggccagggcaagagacagcccguggugugcaccggcggcagccccagcaucaaggagaacaucggcagcguguucggccagaagcagcugcagagccugauccccuucgugcagcugccccccagcgacagcgugugcgaggaguacggccugagcugcagcgacgcccugcacaaccuguucuacaucagcggcuucaucagccagugcacccacggcgugggcagaagcagcaccgacagacaguucuucuucaucaacagaagacccugcgaccccgccaaggugugcagacuggugaacgagguguaccacauguacaacagacaccaguaccccuucguggugcugaacaucagcguggacagcgagugcguggacaucaacgugacccccgacaagagacagauccugcugcaggaggagaagcugcugcuggccgugcugaagaccagccugaucggcauguucgacagcgacgugaacaagcugaacgugagccagcagccccugcuggacguggagggcaaccugaucaagaugcacgccgccgaccuggagaagcccaugguggagaagcaggaccagagccccagccugagaaccggcgaggagaagaaggacgugagcaucagcagacugagagaggccuucagccugagacacaccaccgagaacaagccccacagccccaagacccccgagcccagaagaagcccccugggccagaagagaggcaugcugagcagcagcaccagcggcgccaucagcgacaagggcgugcugagaccccagaaggaggccgugagcagcagccacggccccagcgaccccaccgacagagccgagguggagaaggacagcggccacggcagcaccagcguggacagcgagggcuucagcauccccgacaccggcagccacugcagcagcgaguacgccgccagcagccccggcgacagaggcagccaggagcacguggacagccaggagaaggcccccaagaccgacgacagcuucagcgacguggacugccacagcaaccaggaggacaccggcugcaaguucagagugcugccccagcccaccaaccuggccacccccaacaccaagagauucaagaaggaggagauccugagcagcagcgacaucugccagaagcuggugaacacccaggacaugagcgccagccagguggacguggccgugaagaucaacaagaagguggugccccuggacuucagcaugagcagccuggccaagagaaucaagcagcugcaccacgaggcccagcagagcgagggcgagcagaacuacagaaaguucagagccaagaucugccccggcgagaaccaggccgccgaggacgagcugagaaaggagaucagcaagaccauguucgccgagauggagaucaucggccaguucaaccugggcuucaucaucaccaagcugaacgaggacaucuucaucguggaccagcacgccaccgacgagaaguacaacuucgagaugcugcagcagcacaccgugcugcagggccagagacugaucgccccccagacccugaaccugaccgccgugaacgaggccgugcugaucgagaaccuggagaucuucagaaagaacggcuucgacuucgugaucgacgagaacgcccccgugaccgagagagccaagcugaucagccugcccaccagcaagaacuggaccuucggcccccaggacguggacgagcugaucuucaugcugagcgacagccccggcgugaugugcagacccagcagagugaagcagauguucgccagcagagccugcagaaagagcgugaugaucggcaccgcccugaacaccagcgagaugaagaagcugaucacccacaugggcgagauggaccaccccuggaacugcccccacggcagacccaccaugagacacaucgccaaccugggcgugaucagccagaacuaa

SEQ ID NO: 21719 - RNA, 579 nt, Artificial Sequence
  PMVK__Homo_sapiens__NP_006547
auggccccccugggcggcgcccccagacuggugcugcuguucagcggcaagagaaagagcggcaaggacuucgugaccgaggcccugcagagcagacugggcgccgacgugugcgccgugcugagacugagcggcccccugaaggagcaguacgcccaggagcacggccugaacuuccagagacugcuggacaccagcaccuacaaggaggccuucagaaaggacaugaucagauggggcgaggagaagagacaggccgaccccggcuucuucugcagaaagaucguggagggcaucagccagcccaucuggcuggugagcgacaccagaagagugagcgacauccagugguucagagaggccuacggcgccgugacccagaccgugagagugguggcccuggagcagagcagacagcagagaggcuggguguucacccccggcguggacgacgccgagagcgagugcggccuggacaacuucggcgacuucgacugggugaucgagaaccacggcguggagcagagacuggaggagcagcuggagaaccugaucgaguucaucagaagcagacuguaa

SEQ ID NO: 21720 - RNA, 1281 nt, Artificial Sequence
  PNCK__Homo_sapiens__NP_001034671
auggaggccgccuucggccagguggccggcagcgccugccccagaagaggcggcgagggcagagacuggaaggccgagagccuggccgaccuguggcccaagagcagccccggcgacagccacagauggugcaagggccccggcgccggccccgccggcccccagcugagagaggccgccagagccagcagcggccugggcggcggcggcagacaccccagcagaauccccgccaucgcccugcaggacaugcugcugcugaagaagcacaccgaggacaucagcagcguguacgagaucagagagagacugggcagcggcgccuucagcgagguggugcuggcccaggagagaggcagcgcccaccugguggcccugaagugcauccccaagaaggcccugagaggcaaggaggcccugguggagaacgagaucgccgugcugagaagaaucagccaccccaacaucguggcccuggaggacgugcacgagagccccagccaccuguaccuggccauggagcuggugaccggcggcgagcuguucgacagaaucauggagagaggcagcuacaccgagaaggacgccagccaccuggugggccaggugcugggcgccgugagcuaccugcacagccugggcaucgugcacagagaccugaagcccgagaaccugcuguacgccacccccuucgaggacagcaagaucauggugagcgacuucggccugagcaagauccaggccggcaacaugcugggcaccgccugcggcacccccggcuacguggcccccgagcugcuggagcagaagcccuacggcaaggccguggacgugugggcccugggcgugaucagcuacauccugcugugcggcuacccccccuucuacgacgagagcgaccccgagcuguucagccagauccugagagccagcuacgaguucgacagccccuucugggacgacaucagcgagagcgccaaggacuucaucagacaccugcuggagagagacccccagaagagauucaccugccagcaggcccugagacaccuguggaucagcggcgacaccgccuucgacagagacauccugggcagcgugagcgagcagaucagaaagaacuucgccagaacccacuggaagagagccuucaacgccaccagcuuccugagacacaucagaaagcugggccagauccccgagggcgagggcgccagcgagcagggcauggccagacacagccacagcggccugagagccggccagccccccaagugguaa

SEQ ID NO: 21721 - RNA, 429 nt, Artificial Sequence
  PNKD__Homo_sapiens__NP_001070867
auggccgccgugguggccgccaccgcccugaagggcagaggcgccagaaacgccagagugcugagaggcauccuggccggcgccaccgccaacaaggccagccacaacagaaccagagcccugcagagccacagcagccccgagggcaaggaggagcccgagccccugagccccgagcuggaguacauccccagaaagagaggcaagaaccccaugaaggccgugggccuggccugggccaucggcuuccccugcggcauccugcuguucauccugaccaagagagagguggacaaggacagagugaagcagaugaaggccagacagaacaugagacugagcaacaccggcgaguacgagagccagagauucagagccagcagccagagcgcccccagccccgacgugggcagcggcgugcagaccuaa

SEQ ID NO: 21722 - RNA, 1566 nt, Artificial Sequence
  PNKP__Homo_sapiens__NP_009185
augggcgagguggaggcccccggcagacuguggcuggagagcccccccggcggcgccccccccaucuuccugcccagcgacggccaggcccuggugcugggcagaggcccccugacccaggugaccgacagaaagugcagcagaacccagguggagcugguggccgaccccgagaccagaaccguggccgugaagcagcugggcgugaaccccagcaccaccggcacccaggagcugaagcccggccuggagggcagccugggcgugggcgacacccuguaccuggugaacggccugcacccccugacccugagaugggaggagaccagaacccccgagagccagcccgacaccccccccggcaccccccuggugagccaggacgagaagagagacgccgagcugcccaagaagagaaugagaaagagcaaccccggcugggagaaccuggagaagcugcugguguucaccgccgccggcgugaagccccagggcaagguggccggcuucgaccuggacggcacccugaucaccaccagaagcggcaagguguuccccaccggccccagcgacuggagaauccuguaccccgagauccccagaaagcugagagagcuggaggccgagggcuacaagcuggugaucuucaccaaccagaugagcaucggcagaggcaagcugcccgccgaggaguucaaggccaagguggaggccgugguggagaagcugggcgugcccuuccaggugcugguggccacccacgccggccuguacagaaagcccgugaccggcaugugggaccaccugcaggagcaggccaacgacggcacccccaucagcaucggcgacagcaucuucgugggcgacgccgccggcagacccgccaacugggcccccggcagaaagaagaaggacuucagcugcgccgacagacuguucgcccugaaccugggccugcccuucgccacccccgaggaguucuuccugaaguggcccgccgccggcuucgagcugcccgccuucgaccccagaaccgugagcagaagcggcccccugugccugcccgagagcagagcccugcugagcgccagccccgagguggugguggccgugggcuuccccggcgccggcaagagcaccuuccugaagaagcaccuggugagcgccggcuacgugcacgugaacagagacacccugggcagcuggcagagaugcgugaccaccugcgagaccgcccugaagcagggcaagagaguggccaucgacaacaccaaccccgacgccgccagcagagccagauacgugcagugcgccagagccgccggcgugcccugcagaugcuuccuguucaccgccacccuggagcaggccagacacaacaacagauucagagagaugaccgacagcagccacauccccgugagcgacauggugauguacggcuacagaaagcaguucgaggcccccacccuggccgagggcuucagcgccauccuggagauccccuucagacuguggguggagcccagacugggcagacuguacugccaguucagcgagggcuaa

SEQ ID NO: 21723 - RNA, 1596 nt, Artificial Sequence
  PNLDC1__Homo_sapiens__NP_001258791
auggacgugggcgccgacgaguucgaggagagccugccccugcugcaggagcuggugcaggaggccgacuucgugggccuggacaucgaguucaccggccugagaagcaaccugagcggcccccagcagaucagccuguucgaccugcccagcgagugguaccugaagaccagacagagcgugcagcaguucaccgugugccagaucggccugagcguguucagcgccaucgagggcgaggccaacaaguacaucgcccacagcugcaacuucuaccuguuccccaccaccuucggcauccuggacagcgaguucagcuuccaggccagcagcgugcaguuccugaaccaguacggcuucaacuacaacaaguuccugaagaacggcauccccuacaugaacgaggagcaggagaagaagaucagacacgacauccugaccggcaacuggagagugagaagcagccccgacaaggaccagaucaagguggugaucgacgaggugaccagauggcuggagcuggccaaggagggcgacuggaugacccugcccggcaucaccggcuuccaggccuucgaggugcagcuggugcugagacaggcccugcccaacaucuggaccgugcugaaggacgagggcgugguggugaagaaggugagcaagcagcacagaugguaccugcagaacaccagcugcgacagagagagcugcuggaaggagaacauccugcugagcgccagaggcuucagcguguucuuccagaugcuggugaaggcccagaagccccuggugggccacaacaugaugauggaccugcugcaccugcacgagaaguucuucagaccccugcccgagagcuacgaccaguucaagcagaacauccacagccuguuccccgugcugaucgacaccaagagcgugaccaaggacaucuggaaggagaugaacuuccccagagugagcaaccugagcgagguguacgaggugcugaacagcgaccugaaccccaccaagaacagcggccccgagaucgugcacgccagcagaugcgagaaguacguggagaccaagugcccccacgaggccgccuacgacgccuuccugugcggcagcgugcugcugaagguggcccaccugcugcugcagaagaucuaccacaucgaccccgugcccgagagcagcuucccccaguaccuggacgugcuggcccccuacgugaaccaggugaaccugaucagagccggcgugcccaagaucaacuucagcggccccgacuaccccagcaucagaccccccauccugauccugagcgugaagagauggcccggcgugagcgagcagcagguguaccacaaguuccagaaccugugcaaguucgacgugagaagacugaccagaagccaguuccugcugcugaccaacaaguucaaggacgccagaaacauccugaaggaguacagagaccaccccacccugugcaucagccuguacagauacuggagacacagccccaacgugaacugccugcugcaggugugcggcaucgugaccgccugggcccugcuggccuucauccugggcagaagcggcaccuaa

SEQ ID NO: 21724 - RNA, 1398 nt, Artificial Sequence
  PNLIP__Homo_sapiens__NP_000927
augcugccccuguggacccugagccugcugcugggcgccguggccggcaaggaggugugcuacgagagacugggcugcuucagcgacgacagccccuggagcggcaucaccgagagaccccugcacauccugcccuggagccccaaggacgugaacaccagauuccugcuguacaccaacgagaaccccaacaacuuccaggagguggccgccgacagcagcagcaucagcggcagcaacuucaagaccaacagaaagaccagauucaucauccacggcuucaucgacaagggcgaggagaacuggcuggccaacgugugcaagaaccuguucaagguggagagcgugaacugcaucugcguggacuggaagggcggcagcagaaccggcuacacccaggccagccagaacaucagaaucgugggcgccgagguggccuacuucguggaguuccugcagagcgccuucggcuacagccccagcaacgugcacgugaucggccacagccugggcgcccacgccgccggcgaggccggcagaagaaccaacggcaccaucggcagaaucaccggccuggaccccgccgagcccugcuuccagggcacccccgagcuggugagacuggaccccagcgacgccaaguucguggacgugauccacaccgacggcgcccccaucgugcccaaccugggcuucggcaugagccagguggugggccaccuggacuucuuccccaacggcggcguggagaugcccggcugcaagaagaacauccugagccagaucguggacaucgacggcaucugggagggcaccagagacuucgccgccugcaaccaccugagaagcuacaaguacuacaccgacagcaucgugaaccccgacggcuucgccggcuuccccugcgccagcuacaacguguucaccgccaacaagugcuuccccugccccagcggcggcugcccccagaugggccacuacgccgacagauaccccggcaagaccaacgacgugggccagaaguucuaccuggacaccggcgacgccagcaacuucgccagauggagauacaaggugagcgugacccugagcggcaagaaggugaccggccacauccuggugagccuguucggcaacaagggcaacagcaagcaguacgagaucuucaagggcacccugaagcccgacagcacccacagcaacgaguucgacagcgacguggacgugggcgaccugcagauggugaaguucaucugguacaacaacgugaucaaccccacccugcccagagugggcgccagcaagaucaucguggagaccaacgugggcaagcaguucaacuucugcagccccgagaccgugagagaggaggugcugcugacccugacccccugcuaa

SEQ ID NO: 21725 - RNA, 1413 nt, Artificial Sequence
  PNLIPRP2__Homo_sapiens__NP_005387
augaugcugccccccuggacccugggccugcugcugcuggccaccgugagaggcaaggaggugugcuacggccagcugggcugcuucagcgacgagaagcccugggccggcacccugcagagacccgugaagcugcugcccuggagccccgaggacaucgacaccagauuccugcuguacaccaacgagaaccccaacaacuuccagcugaucaccggcaccgagcccgacaccaucgaggccagcaacuuccagcuggacagaaagaccagauucaucauccacggcuuccuggacaaggccgaggacagcuggcccagcgacaugugcaagaagauguucgagguggagaaggugaacugcaucugcguggacuggagacacggcagcagagccauguacacccaggccgugcagaacaucagaguggugggcgccgagaccgccuuccugauccaggcccugagcacccagcugggcuacagccuggaggacgugcacgugaucggccacagccugggcgcccacaccgccgccgaggccggcagaagacugggcggcagagugggcagaaucaccggccuggaccccgccggccccugcuuccaggacgagcccgaggaggugagacuggaccccagcgacgccguguucguggacgugauccacaccgacagcagccccaucgugcccagccugggcuucggcaugagccagaaggugggccaccuggacuucuuccccaacggcggcaaggagaugcccggcugcaagaagaacgugcugagcaccaucaccgacaucgacggcaucugggagggcaucggcggcuucgugagcugcaaccaccugagaagcuucgaguacuacagcagcagcgugcugaaccccgacggcuuccugggcuaccccugcgccagcuacgacgaguuccaggagagcaagugcuuccccugccccgccgagggcugccccaagaugggccacuacgccgaccaguucaagggcaagaccagcgccguggagcagaccuucuuccugaacaccggcgagagcggcaacuucaccagcuggagauacaaggugagcgugacccugagcggcaaggagaaggugaacggcuacaucagaaucgcccuguacggcagcaacgagaacagcaagcaguacgagaucuucaagggcagccugaagcccgacgccagccacaccugcgccaucgacguggacuucaacgugggcaagauccagaaggugaaguuccuguggaacaagagaggcaucaaccugagcgagcccaagcugggcgccagccagaucaccgugcagagcggcgaggacggcaccgaguacaacuucugcagcagcgacaccguggaggagaacgugcugcagagccuguaccccugcuaa

SEQ ID NO: 21726 - RNA, 1062 nt, Artificial Sequence
  PNMA1__Homo_sapiens__NP_006020
auggccaugacccugcuggaggacuggugcagaggcauggacgugaacagccagagagcccugcugguguggggcauccccgugaacugcgacgaggccgagaucgaggagacccugcaggccgccaugccccaggugagcuacagaaugcugggcagaauguucuggagagaggagaacgccaaggccgcccugcuggagcugaccggcgccguggacuacgccgccauccccagagagaugcccggcaagggcggcguguggaaggugcuguucaagccccccaccagcgacgccgaguuccuggagagacugcaccuguuccuggccagagagggcuggaccgugcaggacguggccagagugcugggcuuccagaaccccacccccacccccggccccgagaugcccgccgagaugcugaacuacauccuggacaacgugauccagccccugguggagagcaucugguacaagagacugacccuguucagcggcagagacauccccggccccggcgaggagaccuucgaccccuggcuggagcacaccaacgaggugcuggaggaguggcaggugagcgacguggagaagagaagaagacugauggagagccugagaggccccgccgccgacgugaucagaauccugaagagcaacaaccccgccaucaccaccgccgagugccugaaggcccuggagcagguguucggcagcguggagagcagcagagacgcccagaucaaguuccugaacaccuaccagaaccccggcgagaagcugagcgccuacgugaucagacuggagccccugcugcagaaggugguggagaagggcgccaucgacaaggacaacgugaaccaggccagacuggagcaggugaucgccggcgccaaccacagcggcgccaucagaagacagcuguggcugaccggcgccggcgagggccccgcccccaaccuguuccagcugcuggugcagaucagagaggaggaggccaaggaggaggaggaggaggccgaggccacccugcugcagcugggccuggagggccacuucuaa

SEQ ID NO: 21727 - RNA, 1095 nt, Artificial Sequence
  PNMA2__Homo_sapiens__NP_009188
auggcccuggcccugcuggaggacuggugcagaaucaugagcguggacgagcagaagagccugauggugaccggcauccccgccgacuucgaggaggccgagauccaggaggugcugcaggagacccugaagagccugggcagauacagacugcugggcaagaucuucagaaagcaggagaacgccaacgccgugcugcuggagcugcuggaggacaccgacgugagcgccauccccagcgaggugcagggcaagggcggcguguggaaggugaucuucaagacccccaaccaggacaccgaguuccuggagagacugaaccuguuccuggagaaggagggccagaccgugagcggcauguucagagcccugggccaggagggcgugagccccgccaccgugcccugcaucagccccgagcugcuggcccaccugcugggccaggccauggcccacgccccccagccccugcugcccaugagauacagaaagcugagaguguucagcggcagcgccgugcccgcccccgaggaggagagcuucgagguguggcuggagcaggccaccgagaucgugaaggaguggcccgugaccgaggccgagaagaagagauggcuggccgagagccugagaggccccgcccuggaccugaugcacaucgugcaggccgacaaccccagcaucagcguggaggagugccuggaggccuucaagcagguguucggcagccuggagagcagaagaaccgcccaggugagauaccugaagaccuaccaggaggagggcgagaaggugagcgccuacgugcugagacuggagacccugcugagaagagccguggagaagagagccauccccagaagaaucgccgaccaggugagacuggagcaggugauggccggcgccacccugaaccagaugcuguggugcagacugagagagcugaaggaccagggccccccccccagcuuccuggagcugaugaaggugaucagagaggaggaggaggaggaggccagcuucgagaacgagagcaucgaggagcccgaggagagagacggcuacggcagauggaaccacgagggcgacgacuaa

SEQ ID NO: 21728 - RNA, 849 nt, Artificial Sequence
  PNMT__Homo_sapiens__NP_002677
augagcggcgccgacagaagccccaacgccggcgccgcccccgacagcgcccccggccaggccgccguggccagcgccuaccagagauucgagcccagagccuaccugagaaacaacuacgccccccccagaggcgaccugugcaaccccaacggcgugggccccuggaagcugagaugccuggcccagaccuucgccaccggcgaggugagcggcagaacccugaucgacaucggcagcggccccaccguguaccagcugcugagcgccugcagccacuucgaggacaucaccaugaccgacuuccuggaggugaacagacaggagcugggcagauggcugcaggaggagcccggcgccuucaacuggagcauguacagccagcacgccugccugaucgagggcaagggcgagugcuggcaggacaaggagagacagcugagagccagagugaagagagugcugcccaucgacgugcaccagccccagccccugggcgccggcagccccgccccccugcccgccgacgcccuggugagcgccuucugccuggaggccgugagccccgaccuggccagcuuccagagagcccuggaccacaucaccacccugcugagacccggcggccaccugcugcugaucggcgcccuggaggagagcugguaccuggccggcgaggccagacugaccguggugcccgugagcgaggaggaggugagagaggcccuggugagaagcggcuacaaggugagagaccugagaaccuacaucaugcccgcccaccugcagaccggcguggacgacgugaagggcguguucuucgccugggcccagaaggugggccuguaa

SEQ ID NO: 21729 - RNA, 2154 nt, Artificial Sequence
  PNN__Homo_sapiens__NP_002678
auggccguggccgugagaacccugcaggagcagcuggagaaggccaaggagagccugaagaacguggacgagaacaucagaaagcugaccggcagagaccccaacgacgugagacccauccaggccagacugcuggcccugagcggccccggcggcggcagaggcagaggcagccugcugcugagaagaggcuucagcgacagcggcggcggcccccccgccaagcagagagaccuggagggcgccgugagcagacugggcggcgagagaagaaccagaagagagagcagacaggagagcgaccccgaggacgacgacgugaagaagcccgcccugcagagcagcgugguggccaccagcaaggagagaaccagaagagaccugauccaggaccagaacauggacgagaagggcaagcagagaaacagaagaaucuucggccugcugaugggcacccugcagaaguucaagcaggagagcaccguggccaccgagagacagaagagaagacaggagaucgagcagaagcuggaggugcaggccgaggaggagagaaagcagguggagaacgagagaagagagcuguucgaggagagaagagccaagcagaccgagcugagacugcuggagcagaagguggagcuggcccagcugcaggaggaguggaacgagcacaacgccaagaucaucaaguacaucagaaccaagaccaagccccaccuguucuacauccccggcagaaugugccccgccacccagaagcugaucgaggagagccagagaaagaugaacgcccuguucgagggcagaagaaucgaguucgccgagcagaucaacaagauggaggccagacccagaagacagagcaugaaggagaaggagcaccagguggugagaaacgaggagcagaaggccgagcaggaggagggcaagguggcccagagagaggaggagcuggaggagaccggcaaccagcacaacgacguggagaucgaggaggccggcgaggaggaggagaaggagaucgccaucgugcacagcgacgccgagaaggagcaggaggaggaggagcagaagcaggagauggaggugaagauggaggaggagaccgaggugagagagagcgagaagcagcaggacagccagcccgaggaggugauggacgugcuggagaugguggagaacgugaagcacgugaucgccgaccaggaggugauggagaccaacagaguggagagcguggagcccagcgagaacgaggccagcaaggagcuggagcccgagauggaguucgagaucgagcccgacaaggagugcaagagccugagccccggcaaggagaacgugagcgcccuggacauggagaaggagagcgaggagaaggaggagaaggagagcgagccccagcccgagcccguggcccagccccagccccagagccagccccagcugcagcugcagagccagagccagcccgugcugcagagccagccccccagccagcccgaggaccugagccuggccgugcugcagcccaccccccaggugacccaggagcagggccaccugcugcccgagagaaaggacuuccccguggagagcgugaagcugaccgaggugcccguggagcccgugcugaccgugcaccccgagagcaagagcaagaccaagaccagaagcagaagcagaggcagagccagaaacaagaccagcaagagcagaagcagaagcagcagcagcagcagcagcagcagcagcagcaccagcagcagcagcggcagcagcagcagcagcggcagcagcagcagcagaagcagcagcagcagcagcagcagcaccagcggcagcagcagcagagacagcagcagcagcaccagcagcagcagcgagagcagaagcagaagcagaggcagaggccacaacagagacagaaagcacagaagaagcguggacagaaagagaagagacaccagcggccuggagagaagccacaagagcagcaagggcggcagcagcagagacaccaagggcagcaaggacaagaacagcagaagcgacagaaagagaagcaucagcgagagcagcagaagcggcaagagaagcagcagaagcgagagagacagaaagagcgacagaaaggacaagagaagauaa

SEQ ID NO: 21730 - RNA, 759 nt, Artificial Sequence
  PNO1__Homo_sapiens__NP_064528
auggagagcgagauggagacccagagcgccagagccgaggagggcuucacccaggugaccagaaagggcggcagaagagccaagaagagacaggccgagcagcugagcgccgccggcgagggcggcgacgccggcagaauggacaccgaggaggccagacccgccaagagacccguguuccccccccugugcggcgacggccugcugagcggcaaggaggagaccagaaagauccccgugcccgccaacagauacaccccccugaaggagaacuggaugaagaucuucacccccaucguggagcaccugggccugcagaucagauucaaccugaagagcagaaacguggagaucagaaccugcaaggagaccaaggacgugagcgcccugaccaaggccgccgacuucgugaaggccuucauccugggcuuccagguggaggacgcccuggcccugaucagacuggacgaccuguuccuggagagcuucgagaucaccgacgugaagccccugaagggcgaccaccugagcagagccaucggcagaaucgccggcaagggcggcaagaccaaguucaccaucgagaacgugaccagaaccagaaucgugcuggccgacgugaaggugcacauccugggcagcuuccagaacaucaagauggccagaaccgccaucugcaaccugauccugggcaacccccccagcaagguguacggcaacaucagagccguggccagcagaagcgccgacagauucuaa

SEQ ID NO: 21731 - RNA, 531 nt, Artificial Sequence
  PNOC__Homo_sapiens__NP_006219
augaaggugcugcugugcgaccugcugcugcugagccuguucagcagcguguucagcagcugccagagagacugccugaccugccaggagaagcugcaccccgcccuggacagcuucgaccuggaggugugcauccuggagugcgaggagaagguguuccccagcccccuguggacccccugcaccaaggugauggccagaagcagcuggcagcugagccccgccgcccccgagcacguggccgccgcccuguaccagcccagagccagcgagaugcagcaccugagaagaaugcccagagugagaagccuguuccaggagcaggaggagcccgagcccggcauggaggaggccggcgagauggagcagaagcagcugcagaagagauucggcggcuucaccggcgccagaaagagcgccagaaagcuggccaaccagaagagauucagcgaguucaugagacaguaccuggugcugagcaugcagagcagccagagaagaagaacccugcaccagaacggcaacguguaa

SEQ ID NO: 21732 - RNA, 870 nt, Artificial Sequence
  PNP__Homo_sapiens__NP_000261
auggagaacggcuacaccuacgaggacuacaagaacaccgccgaguggcugcugagccacaccaagcacagaccccagguggccaucaucugcggcagcggccugggcggccugaccgacaagcugacccaggcccagaucuucgacuacggcgagauccccaacuuccccagaagcaccgugcccggccacgccggcagacugguguucggcuuccugaacggcagagccugcgugaugaugcagggcagauuccacauguacgagggcuacccccuguggaaggugaccuuccccgugagaguguuccaccugcugggcguggacacccugguggugaccaacgccgccggcggccugaaccccaaguucgaggugggcgacaucaugcugaucagagaccacaucaaccugcccggcuucagcggccagaacccccugagaggccccaacgacgagagauucggcgacagauuccccgccaugagcgacgccuacgacagaaccaugagacagagagcccugagcaccuggaagcagaugggcgagcagagagagcugcaggagggcaccuacgugaugguggccggccccagcuucgagaccguggccgagugcagagugcugcagaagcugggcgccgacgccgugggcaugagcaccgugcccgaggugaucguggccagacacugcggccugagaguguucggcuucagccugaucaccaacaaggugaucauggacuacgagagccuggagaaggccaaccacgaggaggugcuggccgccggcaagcaggccgcccagaagcuggagcaguucgugagcauccugauggccagcaucccccugcccgacaaggccagcuaa

SEQ ID NO: 21733 - RNA, 1341 nt, Artificial Sequence
  PNPLA1__Homo_sapiens__NP_001139188
auggugcagaugaugagacaguuccuguacagagugcugcccgaggacagcuacaaggugaccaccggcaagcugcacgugagccugaccagacugaccgacggcgagaacgugguggugagcgaguucaccagcaaggaggagcugaucgaggcccuguacugcagcugcuucgugcccguguacugcggccugaucccccccaccuacagaggcgugugggccuuccugacccugcccccccagagauacaucgacggcggcuucaccggcaugcagcccugcgccuucuggaccgacgccaucaccaucagcaccuucagcggccagcaggacaucugccccagagacugccccgccaucuuccacgacuucagaauguucaacugcagcuuccaguucagccuggagaacaucgccagaaugacccacgcccuguucccccccgaccuggugauccugcacgacuacuacuacagaggcuacgaggacgccgugcuguaccugagaagacugaacgccguguaccugaacagcagcagcaagagagugaucuuccccagaguggagguguacugccagaucgagcuggcccugggcaacgagugccccgagagaagccagcccagccugagagccagacaggccagccuggagggcgccacccagccccacaaggagugggugcccaagggcgacggcagaggcagccacggcccccccgugagccagcccgugcagacccuggaguucaccugcgagagccccgugagcgcccccgugagcccccuggagcagccccccgcccagccccuggccagcagcaccccccugagccugagcggcaugccccccgugagcuuccccgccgugcacaagccccccagcagcacccccggcagcagccugcccacccccccccccggccugagcccccugagcccccagcagcaggugcagcccagcggcagccccgccagaagccugcacagccaggcccccaccagccccagacccagccugggccccagcaccgugggcgccccccagacccugcccagaagcagccugagcgccuuccccgcccagccccccguggaggagcugggccaggagcagccccaggccguggcccugcuggugagcagcaagcccaagagcgccgugccccuggugcacgugaaggagaccgugagcaagcccuacgugaccgagagccccgccgaggacagcaacugggugaacaagguguucaagaagaacaagcagaagaccagcggcaccagaaagggcuuccccagacacagcggcagcaagaagcccagcagcaaggugcaguaa

SEQ ID NO: 21734 - RNA, 1515 nt, Artificial Sequence
  PNPLA2__Homo_sapiens__NP_065109
auguuccccagagagaagaccuggaacaucagcuucgccggcugcggcuuccugggcguguacuacgugggcguggccagcugccugagagagcacgcccccuuccugguggccaacgccacccacaucuacggcgccagcgccggcgcccugaccgccaccgcccuggugaccggcgugugccugggcgaggccggcgccaaguucaucgaggugagcaaggaggccagaaagagauuccugggcccccugcaccccagcuucaaccuggugaagaucaucagaagcuuccugcugaaggugcugcccgccgacagccacgagcacgccagcggcagacugggcaucagccugaccagagugagcgacggcgagaacgugaucaucagccacuucaacagcaaggacgagcugauccaggccaacgugugcagcggcuucauccccguguacugcggccugaucccccccagccugcagggcgugagauacguggacggcggcaucagcgacaaccugccccuguacgagcugaagaacaccaucaccgugagccccuucagcggcgagagcgacaucugcccccaggacagcagcaccaacauccacgagcugagagugaccaacaccagcauccaguucaaccugagaaaccuguacagacugagcaaggcccuguucccccccgagccccuggugcugagagagaugugcaagcagggcuacagagacggccugagauuccugcagagaaacggccugcugaacagacccaacccccugcuggcccugccccccgccagaccccacggccccgaggacaaggaccaggccguggagagcgcccaggccgaggacuacagccagcugcccggcgaggaccacauccuggagcaccugcccgccagacugaacgaggcccugcuggaggccugcguggagcccaccgaccugcugaccacccugagcaacaugcugcccgugagacuggccaccgccaugauggugcccuacacccugccccuggagagcgcccugagcuucaccaucagacugcuggaguggcugcccgacgugcccgaggacaucagauggaugaaggagcagaccggcagcaucugccaguaccuggugaugagagccaagagaaagcugggcagacaccugcccagcagacugcccgagcagguggagcugagaagagugcagagccugcccagcgugccccugagcugcgccgccuacagagaggcccugcccggcuggaugagaaacaaccugagccugggcgacgcccuggccaagugggaggagugccagagacagcugcugcugggccuguucugcaccaacguggccuucccccccgaggcccugagaaugagagcccccgccgaccccgcccccgcccccgccgaccccgccagcccccagcaccagcuggccggccccgccccccugcugagcacccccgcccccgaggccagacccgugaucggcgcccugggccuguaa

SEQ ID NO: 21735 - RNA, 1446 nt, Artificial Sequence
  PNPLA3__Homo_sapiens__NP_079501
auguacgacgccgagagaggcuggagccugagcuucgccggcugcggcuuccugggcuucuaccacgugggcgccaccagaugccugagcgagcacgccccccaccugcugagagacgccagaaugcuguucggcgccagcgccggcgcccugcacugcgugggcgugcugagcggcaucccccuggagcagacccugcaggugcugagcgaccuggugagaaaggccagaagcagaaacaucggcaucuuccaccccagcuucaaccugagcaaguuccugagacagggccugugcaagugccugcccgccaacgugcaccagcugaucagcggcaagaucggcaucagccugaccagagugagcgacggcgagaacgugcuggugagcgacuucagaagcaaggacgaggugguggacgcccuggugugcagcugcuucauccccuucuacagcggccugaucccccccagcuucagaggcgugagauacguggacggcggcgugagcgacaacgugcccuucaucgacgccaagaccaccaucaccgugagccccuucuacggcgaguacgacaucugccccaaggugaagagcaccaacuuccugcacguggacaucaccaagcugagccugagacugugcaccggcaaccuguaccugcugagcagagccuucgugccccccgaccugaaggugcugggcgagaucugccugagaggcuaccuggacgccuucagauuccuggaggagaagggcaucugcaacagaccccagcccggccugaagagcagcagcgagggcauggaccccgagguggccaugcccagcugggccaacaugagccuggacagcagccccgagagcgccgcccuggccgugagacuggagggcgacgagcugcuggaccaccugagacugagcauccugcccugggacgagagcauccuggacacccugagccccagacuggccaccgcccugagcgaggagaugaaggacaagggcggcuacaugagcaagaucugcaaccugcugcccaucagaaucaugagcuacgugaugcugcccugcacccugcccguggagagcgccaucgccaucgugcagagacuggugaccuggcugcccgacaugcccgacgacgugcuguggcugcagugggugaccagccagguguucaccagagugcugaugugccugcugcccgccagcagaagccagaugcccgugagcagccagcaggccagccccugcacccccgagcaggacuggcccugcuggacccccugcagccccaagggcugccccgccgagaccaaggccgaggccacccccagaagcauccugagaagcagccugaacuucuuccugggcaacaaggugcccgccggcgccgagggccugagcaccuuccccagcuucagccuggagaagagccuguaa

SEQ ID NO: 21736 - RNA, 501 nt, Artificial Sequence
  PNPLA4__Homo_sapiens__NP_001166143
auggccagacugagaagcggcauggagagcauccugccccccagcgcccacgagcuggcccagaacagacugcacgugagcaucaccaacgccaagaccagagagaaccaccuggugagcaccuucagcagcagagaggaccugaucaaggugcugcuggccagcagcuucgugcccaucuacgccggccugaagcugguggaguacaagggccagaaguggguggacggcggccugaccaacgcccugcccauccugcccgugggcagaaccgugaccaucagccccuucagcggcagacuggacaucagcccccaggacaagggccagcuggaccuguacgugaacaucgccaagcaggacaucaugcugagccuggccaaccuggugagacugaaccaggcccuguucccccccagcaagagaaagauggagagccuguaccagugcggcuucgacgacaccgugaaguuccugcugaaggagaacugguucgaguaa

SEQ ID NO: 21737 - RNA, 948 nt, Artificial Sequence
  PNPLA5__Homo_sapiens__NP_001171146
augggcuuccuggaggaggagggcagauggaaccugagcuucagcggcgccggcuaccugggcgcccaccacgugggcgccaccgagugccugagacagagagcccccagacugcugcagggcgccagaagaaucuacggcagcagcagcggcgcccugaacgccgugagcaucgugugcggcaagagcguggacugccccagcaccaucaccgugagccccuuccacggcaccguggacaucugcccccagagcaccagccccaaccugcacgagcugaacguguucaacuucagcuuccagaucagcaccgagaacuucuuccugggccugaucugccugaucccccccagccuggaggugguggccgacaacugcagacagggcuaccuggacgcccugagauuccuggagagaagaggccugaccaaggagcccgugcuguggacccuggugagcaaggagccccccgcccccgccgacggcaacugggacgccggcugcgaccagagauggaagggcggccugagccugaacuggaaggugccccacgugcaggugaaggacgugcccaacuucgagcagcugagccccgagcuggaggccgcccugaagaaggccugcaccagagaccccagcagaugggccagauucuggcacagcggccccggccaggugcugaccuaccugcugcugcccugcacccugcccuucgaguacaucuacuucagaagcagaagacuggugguguggcugcccgacgugcccgccgaccugugguggaugcagggccugcugagaaacauggcccuggagguguucagcagaaccaaggcccagcugcugggccccaucagcccccccgccaccagagugcuggagaccagcccccugcagccccagaucgccccccacagagaggagcugggccccacccaccaggccuaa

SEQ ID NO: 21738 - RNA, 4128 nt, Artificial Sequence
  PNPLA6__Homo_sapiens__NP_001159583
auggaggccccccugcagaccggcaugaugggcaccagcagccacggccuggccaccaacagcagcggcgccaagguggccgagagagacggcuuccaggacgugcuggcccccggcgagggcagcgccggcagaaucugcggcgcccagcccgugcccuucgugccccaggugcugggcgugaugaucggcgccggcguggccgugguggugaccgccgugcugauccugcugguggugagaagacugagagugcccaagacccccgcccccgacggccccagauacagauucagaaagagagacaaggugcuguucuacggcagaaagaucaugagaaaggugagccagagcaccagcagccugguggacaccagcgugagcgccaccagcagacccagaaugagaaagaagcugaagaugcugaacaucgccaagaagauccugagaauccagaaggagacccccacccugcagagaaaggagcccccccccgccgugcuggaggccgaccugaccgagggcgaccuggccaacagccaccugcccagcgaggugcuguacaugcugaagaacgugagagugcugggccacuucgagaagccccuguuccuggagcugugcagacacaugguguuccagagacugggccagggcgacuacguguucagacccggccagcccgacgccagcaucuacguggugcaggacggccugcuggagcugugccugcccggccccgacggcaaggagugcguggugaaggagguggugcccggcgacagcgugaacagccugcugagcauccuggacgugaucaccggccaccagcacccccagagaaccgugagcgccagagccgccagagacagcaccgugcugagacugcccguggaggccuucagcgccguguucaccaaguaccccgagagccuggugagaguggugcagaucaucauggugagacugcagagagugaccuuccuggcccugcacaacuaccugggccugaccaacgagcuguucagccacgagauccagccccugagacuguuccccagccccggccugcccaccagaaccagccccgugagaggcagcaagagaauggugagcaccagcgccaccgacgagcccagagagacccccggcagaccccccgaccccaccggcgccccccugcccggccccaccggcgaccccgugaagcccaccagccuggagacccccagcgccccccugcugagcagaugcgugagcaugcccggcgacaucagcggccugcagggcggccccagaagcgacuucgacauggccuacgagagaggcagaaucagcgugagccugcaggaggaggccagcggcggcagccuggccgcccccgccagaacccccacccaggagcccagagagcagcccgccggcgccugcgaguacagcuacugcgaggacgagagcgccaccggcggcugccccuucggccccuaccagggcagacagaccagcagcaucuucgaggccgccaagcaggagcuggccaagcugaugagaaucgaggaccccagccugcugaacagcagagugcugcugcaccacgccaaggccggcaccaucaucgccagacagggcgaccaggacgugagccugcacuucgugcuguggggcugccugcacguguaccagagaaugaucgacaaggccgaggacgugugccuguucguggcccagcccggcgagcuggugggccagcuggccgugcugaccggcgagccccugaucuucacccugagagcccagagagacugcaccuuccugagaaucagcaagagcgacuucuacgagaucaugagagcccagcccagcguggugcugagcgccgcccacaccguggccgccagaaugagccccuucgugagacagauggacuucgccaucgacuggaccgccguggaggccggcagagcccuguacagacagggcgacagaagcgacugcaccuacaucgugcugaacggcagacugagaagcgugauccagagaggcagcggcaagaaggagcuggugggcgaguacggcagaggcgaccugaucggcgugguggaggcccugaccagacagcccagagccaccaccgugcacgccgugagagacaccgagcuggccaagcugcccgagggcacccugggccacaucaagagaagauacccccagguggugaccagacugauccaccugcugagccagaagauccugggcaaccugcagcagcugcagggccccuuccccgccggcagcggccugggcgugcccccccacagcgagcugaccaaccccgccagcaaccuggccaccguggccauccugcccgugugcgccgaggugcccaugguggccuucacccuggagcugcagcacgcccugcaggccaucggccccacccugcugcugaacagcgacaucaucagagccagacugggcgccagcgcccuggacagcauccaggaguucagacugagcggcuggcuggcccagcaggaggacgcccacagaaucgugcuguaccagaccgacgccagccugacccccuggaccgugagaugccugagacaggccgacugcauccugaucgugggccugggcgaccaggagcccacccugggccagcuggagcagaugcuggagaacaccgccgugagagcccugaagcagcuggugcugcugcacagagaggagggcgccggccccaccagaaccguggaguggcugaacaugagaagcuggugcagcggccaccugcaccugagaugccccagaagacuguucagcagaagaagccccgccaagcugcacgagcuguacgagaagguguucagcagaagagccgacagacacagcgacuucagcagacuggccagagugcugaccggcaacaccaucgcccuggugcugggcggcggcggcgccagaggcugcagccacaucggcgugcugaaggcccuggaggaggccggcgugcccguggaccuggugggcggcaccagcaucggcagcuucaucggcgcccuguacgccgaggagagaagcgccagcagaaccaagcagagagccagagagugggccaagagcaugaccagcgugcuggagcccgugcuggaccugaccuaccccgugaccagcauguucaccggcagcgccuucaacagaagcauccacagaguguuccaggacaagcagaucgaggaccuguggcugcccuacuucaacgugaccaccgacaucaccgccagcgccaugagagugcacaaggacggcagccuguggagauacgugagagccagcaugacccugagcggcuaccugcccccccugugcgaccccaaggacggccaccugcugauggacggcggcuacaucaacaaccugcccgccgacaucgccagaagcaugggcgccaagaccgugaucgccaucgacgugggcagccaggacgagaccgaccugagcaccuacggcgacagccugagcggcugguggcugcuguggaagagacugaaccccugggccgacaaggugaaggugcccgacauggccgagauccagagcagacuggccuacgugagcugcgugagacagcuggagguggugaagagcagcagcuacugcgaguaccugagaccccccaucgacugcuucaagaccauggacuucggcaaguucgaccagaucuacgacgugggcuaccaguacggcaaggccguguucggcggcuggagcagaggcaacgugaucgagaagaugcugaccgacagaagaagcaccgaccugaacgagagcagaagagccgacgugcuggccuuccccagcagcggcuucaccgaccuggccgagaucgugagcagaaucgagccccccaccagcuacgugagcgacggcugcgccgacggcgaggagagcgacugccugaccgaguacgaggaggacgccggccccgacugcagcagagacgagggcggcagccccgagggcgccagccccagcaccgccagcgagauggaggaggagaagagcauccugagacagagaagaugccugccccaggagccccccggcagcgccaccgacgccuaa

SEQ ID NO: 21739 - RNA, 2349 nt, Artificial Sequence
  PNPLA8__Homo_sapiens__NP_001242937
augagcaucaaccugaccguggacaucuacaucuaccugcugagcaacgccagaagcgugugcggcaagcagagaagcaagcagcuguacuuccuguucagccccaagcacuacuggagaaucagccacaucagccugcagagaggcuuccacaccaacaucaucagaugcaaguggaccaagagcgaggcccacagcugcagcaagcacugcuacagccccagcaaccacggccugcacaucggcauccugaagcugagcaccagcgcccccaagggccugaccaaggugaacaucugcaugagcagaaucaagagcacccugaacagcgugagcaaggccguguucggcaaccagaacgagaugaucagcagacuggcccaguucaagcccagcagccagauccugagaaaggugagcgacagcggcuggcugaagcagaagaacaucaagcaggccaucaagagccugaagaaguacagcgacaagagcgccgagaagagccccuuccccgaggagaagagccacaucaucgacaaggaggaggacaucggcaagagaagccuguuccacuacaccagcagcaucaccaccaaguucggcgacagcuucuacuuccugagcaaccacaucaacagcuacuucaagagaaaggagaagaugagccagcagaaggagaacgagcacuucagagacaagagcgagcuggaggacaagaagguggaggagggcaagcugagaagccccgaccccggcauccuggccuacaagcccggcagcgagagcgugcacaccguggacaagcccaccagccccagcgccauccccgacgugcugcaggugagcaccaagcagagcaucgccaacuuccugagcagacccaccgagggcgugcaggcccuggugggcggcuacaucggcggccuggugcccaagcugaaguacgacagcaagagccagagcgaggagcaggaggagcccgccaagaccgaccaggccgugagcaaggacagaaacgccgaggagaagaagagacugagccugcagagagagaagaucaucgccagagugagcaucgacaacagaaccagagcccuggugcaggcccugagaagaaccaccgaccccaagcugugcaucaccagaguggaggagcugaccuuccaccugcuggaguuccccgagggcaagggcguggccgugaaggagagaaucauccccuaccugcugagacugagacagaucaaggacgagacccugcaggccgccgugagagagauccuggcccugaucggcuacguggaccccgugaagggcagaggcaucagaauccugagcaucgacggcggcggcaccagaggcgugguggcccugcagacccugagaaagcugguggagcugacccagaagcccgugcaccagcuguucgacuacaucugcggcgugagcaccggcgccauccuggccuucaugcugggccuguuccacaugccccuggacgagugcgaggagcuguacagaaagcugggcagcgacguguucagccagaacgugaucgugggcaccgugaagaugagcuggagccacgccuucuacgacagccagaccugggagaacauccugaaggacagaaugggcagcgcccugaugaucgagaccgccagaaaccccaccugccccaagguggccgccgugagcaccaucgugaacagaggcaucacccccaaggccuucguguucagaaacuacggccacuuccccggcaucaacagccacuaccugggcggcugccaguacaagauguggcaggccaucagagccagcagcgccgcccccggcuacuucgccgaguacgcccugggcaacgaccugcaccaggacggcggccugcugcugaacaaccccagcgcccuggccaugcacgagugcaagugccuguggcccgacgugccccuggagugcaucgugagccugggcaccggcagauacgagagcgacgugagaaacaccgugaccuacaccagccugaagaccaagcugagcaacgugaucaacagcgccaccgacaccgaggaggugcacaucaugcuggacggccugcugccccccgacaccuacuucagauucaaccccgugaugugcgagaacaucccccuggacgagagcagaaacgagaagcuggaccagcugcagcuggagggccugaaguacaucgagagaaacgagcagaagaugaagaagguggccaagauccugagccaggagaagaccacccugcagaagaucaacgacuggaucaagcugaagaccgacauguacgagggccugcccuucuucagcaagcuguaa

SEQ ID NO: 21740 - RNA, 786 nt, Artificial Sequence
  PNPO__Homo_sapiens__NP_060599
augaccugcuggcugagaggcgugaccgccaccuucggcagacccgccgaguggcccggcuaccugagccaccugugcggcagaagcgccgccauggaccugggccccaugagaaagagcuacagaggcgacagagaggccuucgaggagacccaccugaccagccuggaccccgugaagcaguucgccgccugguucgaggaggccgugcagugccccgacaucggcgaggccaacgccaugugccuggccaccugcaccagagacggcaagcccagcgccagaaugcugcugcugaagggcuucggcaaggacggcuucagauucuucaccaacuucgagagcagaaagggcaaggagcuggacagcaaccccuucgccagccugguguucuacugggagccccugaacagacaggugagaguggagggccccgugaagaagcugcccgaggaggaggccgagugcuacuuccacagcagacccaagagcagccagaucggcgccguggugagccaccagagcagcgugauccccgacagagaguaccugagaaagaagaacgaggagcuggagcagcuguaccaggaccaggaggugcccaagcccaagagcuggggcggcuacgugcuguacccccaggugauggaguucuggcagggccagaccaacagacugcacgacagaaucguguucagaagaggccugcccaccggcgacagcccccugggccccaugacccacagaggcgaggaggacuggcuguacgagagacuggcccccuaa

SEQ ID NO: 21741 - RNA, 2352 nt, Artificial Sequence
  PNPT1__Homo_sapiens__NP_149100
auggccgccugcagauacugcugcagcugccugagacugagaccccugagcgacggccccuuccugcugcccagaagagacagagcccugacccagcugcaggugagagcccuguggagcagcgccggcagcagagccguggccguggaccugggcaacagaaagcuggagaucagcagcggcaagcuggccagauucgccgacggcagcgccguggugcagagcggcgacaccgccgugauggugaccgccgugagcaagaccaagcccagccccagccaguucaugccccuggugguggacuacagacagaaggccgccgccgccggcagaauccccaccaacuaccugagaagagagaucggcaccagcgacaaggagauccugaccagcagaaucaucgacagaagcaucagaccccuguuccccgccggcuacuucuacgacacccaggugcugugcaaccugcuggccguggacggcgugaacgagcccgacgugcuggccaucaacggcgccagcguggcccugagccugagcgacauccccuggaacggccccgugggcgccgugagaaucggcaucaucgacggcgaguacguggugaaccccaccagaaaggagaugagcagcagcacccugaaccuggugguggccggcgcccccaagagccagaucgugaugcuggaggccagcgccgagaacauccugcagcaggacuucugccacgccaucaaggugggcgugaaguacacccagcagaucauccagggcauccagcagcuggugaaggagaccggcgugaccaagagaaccccccagaagcuguucacccccagccccgagaucgugaaguacacccacaagcuggccauggagagacuguacgccguguucaccgacuacgagcacgacaaggugagcagagacgaggccgugaacaagaucagacuggacaccgaggagcagcugaaggagaaguuccccgaggccgaccccuacgagaucaucgagagcuucaacgugguggccaaggagguguucagaagcaucgugcugaacgaguacaagagaugcgacggcagagaccugaccagccugagaaacgugagcugcgagguggacauguucaagacccugcacggcagcgcccuguuccagagaggccagacccaggugcugugcaccgugaccuucgacagccuggagagcggcaucaagagcgaccaggugaucaccgccaucaacggcaucaaggacaagaacuucaugcugcacuacgaguucccccccuacgccaccaacgagaucggcaaggugaccggccugaacagaagagagcugggccacggcgcccuggccgagaaggcccuguaccccgugauccccagagacuuccccuucaccaucagagugaccagcgaggugcuggagagcaacggcagcagcagcauggccagcgccugcggcggcagccuggcccugauggacagcggcgugcccaucagcagcgccguggccggcguggccaucggccuggugaccaagaccgaccccgagaagggcgagaucgaggacuacagacugcugaccgacauccugggcaucgaggacuacaacggcgacauggacuucaagaucgccggcaccaacaagggcaucaccgcccugcaggccgacaucaagcugcccggcauccccaucaagaucgugauggaggccauccagcaggccagcguggccaagaaggagauccugcagaucaugaacaagaccaucagcaagcccagagccagcagaaaggagaacggccccgugguggagaccgugcaggugccccugagcaagagagccaaguucgugggccccggcggcuacaaccugaagaagcugcaggccgagaccggcgugaccaucagccagguggacgaggagaccuucagcguguucgcccccacccccagcgccaugcacgaggccagagacuucaucaccgagaucugcaaggacgaccaggagcagcagcuggaguucggcgccguguacaccgccaccaucaccgagaucagagacaccggcgugauggugaagcuguaccccaacaugaccgccgugcugcugcacaacacccagcuggaccagagaaagaucaagcaccccaccgcccugggccuggaggugggccaggagauccaggugaaguacuucggcagagaccccgccgacggcagaaugagacugagcagaaaggugcugcagagccccgccaccaccguggugagaacccugaacgacagaagcagcaucgugaugggcgagcccaucagccagagcagcagcaacagccaguaa

SEQ ID NO: 21742 - RNA, 984 nt, Artificial Sequence
  PNRC1__Homo_sapiens__NP_006804
augaccguggugagcgugccccagagagagccccuggugcugggcggcagacuggccccccugggcuucagcagcagaggcuacuucggcgcccugcccauggugaccaccgccccccccccccugcccagaauccccgaccccagagcccugccccccacccuguuccugccccacuuccugggcggcgacggccccugccugaccccccagcccagagcccccgccgcccugcccaacagaagccuggccguggccggcggcacccccagagccgcccccaagaagagaagaaagaagaaggugagagccagccccgccggccagcugcccagcagauuccaccaguaccagcagcacagacccagccuggagggcggcagaagccccgccaccggccccagcggcgcccaggaggugcccggccccgccgccgcccuggcccccagccccgccgccgccgccggcaccgagggcgccagccccgaccuggccccccugagacccgccgcccccggccagaccccccugagaaaggaggugcugaagagcaagaugggcaagagcgagaagaucgcccugccccacggccagcuggugcacggcauccaccuguacgagcagcccaagaucaacagacagaagagcaaguacaaccugccccugaccaagaucaccagcgccaagagaaacgagaacaacuucuggcaggacagcgugagcagcgacagaauccagaagcaggagaagaagcccuucaagaacaccgagaacaucaagaacagccaccugaagaagagcgccuuccugaccgaggugagccagaaggagaacuacgccggcgccaaguucagcgacccccccagccccagcgugcugcccaagccccccagccacuggaugggcagcaccguggagaacagcaaccagaacagagagcugauggccgugcaccugaagacccugcugaaggugcagaccuaa

SEQ ID NO: 21743 - RNA, 1080 nt, Artificial Sequence
  POC1A__Homo_sapiens__NP_001155052
auggccgcccccugcgccgaggaccccagccuggagagacacuucaagggccacagagacgccgugaccugcguggacuucagcaucaacaccaagcagcuggccagcggcagcauggacagcugccugaugguguggcacaugaagccccagagcagagccuacagauucaccggccacaaggacgccgugaccugcgugaacuucagccccagcggccaccugcuggccagcggcagcagagacaagaccgugagaaucugggugcccaacgugaagggcgagagcaccguguucagagcccacaccgccaccgugagaagcgugcacuucugcagcgacggccagagcuucgugaccgccagcgacgacaagaccgugaaggugugggccacccacagacagaaguuccuguucagccugagccagcacaucaacugggugagaugcgccaaguucagccccgacggcagacugaucgugagcgccagcgacgacaagaccgugaagcugugggacaagagcagcagagagugcgugcacagcuacugcgagcacggcggcuucgugaccuacguggacuuccaccccagcggcaccugcaucgccgccgccggcauggacaacaccgugaaggugugggacgugagaacccacagacugcugcagcacuaccagcugcacagcgccgccgugaacggccugagcuuccaccccagcggcaacuaccugaucaccgccagcagcgacagcacccugaagauccuggaccugauggagggcagacugcuguacacccugcacggccaccagggccccgccaccaccguggccuucagcagaaccggcgaguacuucgccagcggcggcagcgacgagcaggugaugguguggaagagcaacuucgacaucguggaccacggcgaggugaccaaggugcccagaccccccgccacccuggccagcagcaugggcaaccugaccgugagcauccuggagcagagacugacccugaccgaggacaagcugaagcagugccuggagaaccagcagcugaucaugcagagagccacccccuaa

SEQ ID NO: 21744 - RNA, 1311 nt, Artificial Sequence
  POC1B__Homo_sapiens__NP_001186706
augcuguggaacuucaagccccacgccagagccuacagauacgugggccacaaggacguggugaccagcgugcaguucagcccccacggcaaccugcuggccagcgccagcagagacagaaccgugagacuguggauccccgacaagagaggcaaguucagcgaguucaaggcccacaccgcccccgugagaagcguggacuucagcgccgacggccaguuccuggccaccgccagcgaggacaagagcaucaagguguggagcauguacagacagagauuccuguacagccuguacagacacacccacugggugagaugcgccaaguucagccccgacggcagacugaucgugagcugcagcgaggacaagaccaucaagaucugggacaccaccaacaagcagugcgugaacaacuucagcgacagcgugggcuucgccaacuucguggacuucaaccccagcggcaccugcaucgccagcgccggcagcgaccagaccgugaaggugugggacgugagagugaacaagcugcugcagcacuaccaggugcacagcggcggcgugaacugcaucagcuuccaccccagcggcaacuaccugaucaccgccagcagcgacggcacccugaagauccuggaccugcuggagggcagacugaucuacacccugcagggccacaccggccccguguucaccgugagcuucagcaagggcggcgagcuguucgccagcggcggcgccgacacccaggugcugcuguggagaaccaacuucgacgagcugcacugcaagggccugaccaagagaaaccugaagagacugcacuucgacagccccccccaccugcuggacaucuaccccagaaccccccacccccacgaggagaagguggagaccguggagaucaaccccaagcuggaggugaucgaccugcagaucagcaccccccccgugauggacauccugagcuucgacagcaccaccaccaccgagaccagcggcagaacccugcccgacaagggcgaggaggccugcggcuacuuccugaaccccagccugaugagccccgagugccugcccaccaccaccaagaagaagaccgaggacaugagcgaccugcccugcgagagccagagaagcaucccccuggccgugaccgacgcccuggagcacaucauggagcagcugaacgugcugacccagaccgugagcauccuggagcagagacugacccugaccgaggacaagcugaaggacugccuggagaaccagcagaagcuguucagcgccgugcagcagaagagcuaa

SEQ ID NO: 21745 - RNA, 1728 nt, Artificial Sequence
  POC5__Homo_sapiens__NP_001092741
augagcagcgacgaggagaaguacagccugcccguggugcagaacgacagcagcagaggcagcagcgugagcagcaaccugcaggaggaguacgaggagcugcugcacuacgccaucgugacccccaacaucgagcccugcgccagccagagcagccaccccaagggcgagcuggugcccgacgugagaaucagcaccauccacgacauccugcacagccagggcaacaacagcgaggugagagagaccgccaucgaggugggcaagggcugcgacuuccacaucagcagccacagcaagaccgacgagagcagccccgugcugagccccagaaagcccagccaccccgugauggacuucuucagcagccaccugcuggccgacagcagcagccccgccaccaacagcagccacaccgacgcccacgagauccuggugagcgacuuccuggugagcgacgagaaccugcagaagauggagaacgugcuggaccuguggagcagcggccugaagaccaacaucaucagcgagcugagcaaguggagacugaacuucaucgacuggcacagaauggagaugagaaaggagaaggagaagcacgccgcccaccugaagcagcugugcaaccagaucaacgagcugaaggagcugcagaagaccuucgagaucagcaucggcagaaaggacgaggugaucagcagccugagccacgccaucggcaagcagaaggagaagaucgagcugaugagaaccuucuuccacuggagaaucggccacgugagagccagacaggacguguacgagggcaagcuggccgaccaguacuaccagagaacccugcugaagaagguguggaagguguggagaagcguggugcagaagcaguggaaggacgugguggagagagccugccaggccagagccgaggaggugugcauccagaucagcaacgacuacgaggccaagguggccaugcugagcggcgcccuggagaacgccaaggccgagauccagagaaugcagcacgagaaggagcacuucgaggacagcaugaagaaggccuucaugagaggcgugugcgcccugaaccuggaggccaugaccaucuuccagaacagaaacgacgccggcaucgacagcaccaacaacaagaaggaggaguacggccccggcgugcagggcaaggagcacagcgcccaccuggaccccagcgccccccccaugccccugcccgugaccagcccccugcugcccagcccccccgccgccgugggcggcgccagcgccaccgccgugcccagcgccgccagcaugaccagcaccagagccgccagcgccagcagcgugcacgugcccgugagcgcccugggcgccggcagcgccgccaccgccgccagcgaggagauguacgugcccagaguggugaccagcgcccagcagaaggccggcagaaccaucaccgccagaaucaccggcagaugcgacuucgccagcaagaacagaaucagcagcagccuggccaucaugggcgugagcccccccaugagcagcguggugguggagaagcaccaccccgugaccgugcagaccaucccccaggccaccgccgccaaguaccccagaaccauccaccccgagagcagcaccagcgccagcagaagccugggcaccagaagcgcccacacccagagccugaccagcgugcacagcaucaaggugguggacuaa

SEQ ID NO: 21746 - RNA, 1677 nt, Artificial Sequence
  PODXL__Homo_sapiens__NP_001018121
augagaugcgcccuggcccugagcgcccugcugcugcugcugagcacccccccccugcugcccagcagccccagccccagccccagccccagccagaacgccacccagaccaccaccgacagcagcaacaagaccgcccccacccccgccagcagcgugaccaucauggccaccgacaccgcccagcagagcaccgugcccaccagcaaggccaacgagauccuggccagcgugaaggccaccacccugggcgugagcagcgacagccccggcaccaccacccuggcccagcaggugagcggccccgugaacaccaccguggccagaggcggcggcagcggcaaccccaccaccaccaucgagagccccaagagcaccaagagcgccgacaccaccaccguggccaccagcaccgccaccgccaagcccaacaccaccagcagccagaacggcgccgaggacaccaccaacagcggcggcaagagcagccacagcgugaccaccgaccugaccagcaccaaggccgagcaccugaccaccccccaccccaccagcccccugagccccagacagcccaccagcacccaccccguggccacccccaccagcagcggccacgaccaccugaugaagaucagcagcagcagcagcaccguggccauccccggcuacaccuucaccagccccggcaugaccaccacccugcuggagaccguguuccaccacgugagccaggccggccuggagcugcugaccagcggcgaccugcccacccuggccagccagagcgccggcaucaccgccagcagcgugaucagccagagaacccagcagaccagcagccagaugcccgccagcagcaccgcccccagcagccaggagaccgugcagcccaccagccccgccaccgcccugagaacccccacccugcccgagaccaugagcagcagccccaccgccgccagcaccacccacagauaccccaagacccccagccccaccguggcccacgagagcaacugggccaagugcgaggaccuggagacccagacccagagcgagaagcagcuggugcugaaccugaccggcaacacccugugcgccggcggcgccagcgacgagaagcugaucagccugaucugcagagccgugaaggccaccuucaaccccgcccaggacaagugcggcaucagacuggccagcgugcccggcagccagaccgugguggugaaggagaucaccauccacaccaagcugcccgccaaggacguguacgagagacugaaggacaagugggacgagcugaaggaggccggcgugagcgacaugaagcugggcgaccagggcccccccgaggaggccgaggacagauucagcaugccccugaucaucaccaucgugugcauggccagcuuccugcugcugguggccgcccuguacggcugcugccaccagagacugagccagagaaaggaccagcagagacugaccgaggagcugcagaccguggagaacggcuaccacgacaaccccacccuggaggugauggagaccagcagcgagaugcaggagaagaagguggugagccugaacggcgagcugggcgacagcuggaucgugccccuggacaaccugaccaaggacgaccuggacgaggaggaggacacccaccuguaa

SEQ ID NO: 21747 - RNA, 1770 nt, Artificial Sequence
  POF1B__Homo_sapiens__NP_079197
augagcagcagcuacuggagcgagaccagcagcagcagcugcggcacccagcagcugcccgaggugcugcagugccagccccagcacuaccacugcuaccaccagagcagccaggcccagcagccccccgagaagaacgugguguacgagagagugagaaccuacagcggccccaugaacaagguggugcaggcccuggaccccuucaacagcagagaggugcugagcccccugaagaccaccagcagcuaccagaaccugguguggagcgaccacagccaggagcugcacagccccacccugaagaucagcaccugcgcccccagcacccugcacaucacccagaacaccgagcaggagcugcacagccccaccgugaagcugaccaccuacccccagaccaccaucagaaaguacguggugcagaaccccgagcaggagccccugagccaguuccugagaggcagccacuucuuccccggcaacaacgugaucuacgagaagaccaucagaaagguggagaagcugaacaccgaccagggcugccacccccaggcccagugccaccaccacaucauccagcagccccaggugauccacagcgcccacuggcagcagcccgacagcagccagcagauccaggccaucaccggcaacaaccccaucagcacccacaucggcaacgagcugugccacagcggcagcagccagaucugcgagcaggugaucauccaggacgacggccccgagaagcuggaccccagauacuucggcgagcugcuggccgaccugagcagaaagaacaccgaccuguaccacugccugcuggagcaccugcagagaaucggcggcagcaagcaggacuucgagagcaccgacgagagcgaggacaucgagagccugauccccaagggccugagcgaguucaccaagcagcagaucagauacauccugcagaugagaggcaugagcgacaagagccugagacuggugcugagcaccuucagcaacaucagagaggagcugggccaccugcagaacgacaugaccagccuggagaacgacaagaugagacuggagaaggaccugagcuucaaggacacccagcugaaggaguacgaggagcugcuggccagcgugagagccaacaaccaccagcagcagcagggccugcaggacagcagcagcaagugccaggcccuggaggagaacaaccugagccugagacacacccugagcgacauggaguacagacugaaggagcuggaguacugcaagagaaaccuggagcaggagaaccagaaccugagaaugcaggugagcgagaccugcaccggccccaugcugcaggccaagauggacgagaucggcaaccacuacaccgagauggugaagaaccugagaauggagaaggacagagagaucugcagacugagaagccagcugaaccaguaccacaaggacgugagcaagagagagggcagcugcagcgacuuccaguucaagcugcacgagcugaccagccugcuggaggagaaggacagccugaucaagagacagagcgaggagcugagcaagcugagacaggagaucuacagcagccacaaccagcccagcaccggcggcagaaccaccaucaccaccaagaaguacagaacccaguaccccauccugggccugcuguacgacgacuacgaguacaucccccccggcagcgagacccagaccaucgugaucgagaagaccgaggacaaguacaccugccccuaa

SEQ ID NO: 21748 - RNA, 1167 nt, Artificial Sequence
  POFUT1__Homo_sapiens__NP_056167
augggcgccgccgccugggccagaccccugagcgugagcuuccugcugcugcugcugccccugcccggcaugcccgccggcagcugggaccccgccggcuaccugcuguacugccccugcaugggcagauucggcaaccaggccgaccacuuccugggcagccuggccuucgccaagcugcugaacagaacccuggccgugccccccuggaucgaguaccagcaccacaagccccccuucaccaaccugcacgugagcuaccagaaguacuucaagcuggagccccugcaggccuaccacagagugaucagccuggaggacuucauggagaagcuggcccccacccacuggccccccgagaagagaguggccuacugcuucgagguggccgcccagagaagccccgacaagaagaccugccccaugaaggagggcaaccccuucggccccuucugggaccaguuccacgugagcuucaacaagagcgagcuguucaccggcaucagcuucagcgccagcuacagagagcaguggagccagagauucagccccaaggagcaccccgugcuggcccugcccggcgcccccgcccaguuccccgugcuggaggagcacagaccccugcagaaguacaugguguggagcgacgagauggugaagaccggcgaggcccagauccacgcccaccuggugagacccuacgugggcauccaccugagaaucggcagcgacuggaagaacgccugcgccaugcugaaggacggcaccgccggcagccacuucauggccagcccccagugcgugggcuacagcagaagcaccgccgccccccugaccaugaccaugugccugcccgaccugaaggagauccagagagccgugaagcugugggugagaagccuggacgcccagagcguguacguggccaccgacagcgagagcuacgugcccgagcugcagcagcuguucaagggcaaggugaagguggugagccugaagcccgagguggcccagguggaccuguacauccugggccaggccgaccacuucaucggcaacugcgugagcagcuucaccgccuucgugaagagagagagagaccugcagggcagacccagcagcuucuucggcauggacagaccccccaagcugagagacgaguucuaa

SEQ ID NO: 21749 - RNA, 1275 nt, Artificial Sequence
  POFUT2__Homo_sapiens__NP_056042
auggccacccugagcuucguguuccugcugcugggcgccgugagcuggccccccgccagcgccagcggccaggaguucuggcccggccagagcgccgccgacauccugagcggcgccgccagcagaagaagauaccugcuguacgacgugaacccccccgagggcuucaaccugagaagagacguguacaucagaaucgccagccugcugaagacccugcugaagaccgaggagugggugcuggugcugccccccuggggcagacuguaccacuggcagagccccgacauccaccaggugagaauccccuggagcgaguucuucgaccugcccagccugaacaagaacauccccgugaucgaguacgagcaguucaucgccgagagcggcggccccuucaucgaccagguguacgugcugcagagcuacgccgagggcuggaaggagggcaccugggaggagaagguggacgagagacccugcaucgaccagcugcuguacagccaggacaagcacgaguacuacagaggcugguucuggggcuacgaggagaccagaggccugaacgugagcugccugagcgugcagggcagcgccagcaucguggccccccugcugcugagaaacaccagcgccagaagcgugaugcuggacagagccgagaaccugcugcacgaccacuacggcggcaaggaguacugggacaccagaagaagcaugguguucgccagacaccugagagaggugggcgacgaguucagaagcagacaccugaacagcaccgacgacgccgacagaauccccuuccaggaggacuggaugaagaugaaggugaagcugggcagcgcccugggcggccccuaccugggcgugcaccugagaagaaaggacuucaucuggggccacagacaggacgugcccagccuggagggcgccgugagaaagaucagaagccugaugaagacccacagacuggacaagguguucguggccaccgacgccgugagaaaggaguacgaggagcugaagaagcugcugcccgagauggugagauucgagcccaccugggaggagcuggagcuguacaaggacggcggcguggccaucaucgaccaguggaucugcgcccacgccagaugccugcccaccagccugagcgccgagagcggcagcggcggcuuccagagauucuucugccccaaguacagcgugagcgagcagaugguggccugcgugcacagcggccacuuccacaccgugugccugcugguguaa

SEQ ID NO: 21750 - RNA, 1830 nt, Artificial Sequence
  POGK__Homo_sapiens__NP_060012
auggagagcaccgccuacccccugaaccugagccugaaggaggaggaggaggaggaggagauccagagcagagagcuggaggacggccccgccgacaugcagaaggugagaaucugcagcgagggcggcugggugcccgcccuguucgacgagguggccaucuacuucagcgacgaggagugggaggugcugaccgagcagcagaaggcccuguacagagaggugaugagaaugaacuacgagaccgugcugagccuggaguuccccuuccccaagcccgacaugaucaccagacuggagggcgaggaggagagccagaacagcgacgaguggcagcugcagggcggcaccagcgccgagaacgaggagagcgacgugaagccccccgacuggcccaaccccaugaacgccaccagccaguucccccagccccagcacuucgacagcuucggccugagacugcccagagacaucaccgagcugcccgaguggagcgagggcuaccccuucuacauggccaugggcuuccccggcuacgaccugagcgccgacgacaucgccggcaaguuccaguucagcagaggcaugagaagaagcuacgacgccggcuucaagcugauggugguggaguacgccgagagcaccaacaacugccaggccgccaagcaguucggcgugcuggagaagaacgugagagacuggagaaaggugaagccccagcugcagaacgcccacgccaugagaagagccuucagaggccccaagaacggcagauucgcccugguggaccagagaguggccgaguacgugagauacaugcaggccaagggcgaccccaucaccagagaggccaugcagcugaaggcccuggagaucgcccaggagaugaacauccccgagaagggcuucaaggccagccugggcuggugcagaagaaugaugagaagauacgaccugagccugagacacaaggugcccgugccccagcaccugcccgaggaccugaccgagaagcuggugaccuaccagagaagcgugcuggcccugagaagagcccacgacuacgagguggcccagaugggcaacgccgacgagacccccaucugccuggaggugcccagcagagugaccguggacaaccagggcgagaagcccgugcuggugaagacccccggcagagagaagcugaagaucaccgccaugcugggcgugcuggccgacggcagaaagcugccccccuacaucauccugagaggcaccuacaucccccccggcaaguuccccagcggcauggagaucagaugccacagauacggcuggaugaccgaggaccugaugcaggacuggcuggaggugguguggagaagaagaaccggcgccgugcccaagcagagaggcaugcugauccugaacggcuucagaggccacgccaccgacagcgugaagaacagcauggagagcaugaacaccgacauggugaucauccccggcggccugaccagccagcugcaggugcuggacguggugguguacaagccccugaacgacagcgugagagcccaguacagcaacuggcugcuggccggcaaccuggcccugagccccaccggcaacgccaagaagcccccccugggccuguuccuggagugggugaugguggccuggaacagcaucagcagcgagagcaucgugcagggcuucaagaagugccacaucagcagcaaccuggaggaggaggacgacgugcugugggagaucgagagcgagcugcccggcggcggcgagccccccaaggacugcgacaccgagagcauggccgagagcaacuaa

SEQ ID NO: 21751 - RNA, 1179 nt, Artificial Sequence
  POGLUT1__Homo_sapiens__NP_689518
auggaguggugggccagcagcccccugagacuguggcugcugcuguuccugcugcccagcgcccagggcagacagaaggagagcggcagcaaguggaagguguucaucgaccagaucaacagaagccuggagaacuacgagcccugcagcagccagaacugcagcugcuaccacggcgugaucgaggaggaccugacccccuucagaggcggcaucagcagaaagaugauggccgagguggugagaagaaagcugggcacccacuaccagaucaccaagaacagacuguacagagagaacgacugcauguuccccagcagaugcagcggcguggagcacuucauccuggaggugaucggcagacugcccgacauggagauggugaucaacgugagagacuacccccaggugcccaaguggauggagcccgccauccccguguucagcuucagcaagaccagcgaguaccacgacaucauguaccccgccuggaccuucugggagggcggccccgccguguggcccaucuaccccaccggccugggcagaugggaccuguucagagaggaccuggugagaagcgccgcccaguggcccuggaagaagaagaacagcaccgccuacuucagaggcagcagaaccagccccgagagagacccccugauccugcugagcagaaagaaccccaagcugguggacgccgaguacaccaagaaccaggccuggaagagcaugaaggacacccugggcaagcccgccgccaaggacgugcaccugguggaccacugcaaguacaaguaccuguucaacuucagaggcguggccgccagcuucagauucaagcaccuguuccugugcggcagccugguguuccacgugggcgacgaguggcuggaguucuucuacccccagcugaagcccugggugcacuacauccccgugaagaccgaccugagcaacgugcaggagcugcugcaguucgugaaggccaacgacgacguggcccaggagaucgccgagagaggcagccaguucaucagaaaccaccugcagauggacgacaucaccugcuacugggagaaccugcugagcgaguacagcaaguuccugagcuacaacgugaccagaagaaagggcuacgaccagaucauccccaagaugcugaagaccgagcuguaa

SEQ ID NO: 21752 - RNA, 4389 nt, Artificial Sequence
  POLA1__Homo_sapiens__NP_058633
auggcccccgugcacggcgacgacagccugagcgacagcggcagcuucgugagcagcagagccagaagagagaagaagagcaagaagggcagacaggaggcccuggagagacugaagaaggccaaggccggcgagaaguacaaguacgagguggaggacuucaccggcguguacgaggagguggacgaggagcaguacagcaagcuggugcaggccagacaggacgacgacuggaucguggacgacgacggcaucggcuacguggaggacggcagagagaucuucgacgacgaccuggaggacgacgcccuggacgccgacgagaagggcaaggacggcaaggccagaaacaaggacaagagaaacgugaagaagcuggccgugaccaagcccaacaacaucaagagcauguucaucgccugcgccggcaagaagaccgccgacaaggccguggaccugagcaaggacggccugcugggcgacauccugcaggaccugaacaccgagaccccccagaucacccccccccccgugaugauccugaagaagaagagaagcaucggcgccagccccaaccccuucagcgugcacaccgccaccgccgugcccagcggcaagaucgccagccccgugagcagaaaggagcccccccugacccccgugccccugaagagagccgaguucgccggcgacgacgugcagguggagagcaccgaggaggagcaggagagcggcgccauggaguucgaggacggcgacuucgacgagcccauggagguggaggagguggaccuggagcccauggccgccaaggccugggacaaggagagcgagcccgccgaggaggugaagcaggaggccgacagcggcaagggcaccgugagcuaccugggcagcuuccugcccgacgugagcugcugggacaucgaccaggagggcgacagcagcuucagcgugcaggaggugcagguggacagcagccaccugccccuggugaagggcgccgacgaggagcagguguuccacuucuacuggcuggacgccuacgaggaccaguacaaccagcccggcgugguguuccuguucggcaagguguggaucgagagcgccgagacccacgugagcugcugcgugauggugaagaacaucgagagaacccuguacuuccugcccagagagaugaagaucgaccugaacaccggcaaggagaccggcacccccaucagcaugaaggacguguacgaggaguucgacgagaagaucgccaccaaguacaagaucaugaaguucaagagcaagcccguggagaagaacuacgccuucgagauccccgacgugcccgagaagagcgaguaccuggaggugaaguacagcgccgagaugccccagcugccccaggaccugaagggcgagaccuucagccacguguucggcaccaacaccagcagccuggagcuguuccugaugaacagaaagaucaagggccccugcuggcuggaggugaagagcccccagcugcugaaccagcccgugagcuggugcaagguggaggccauggcccugaagcccgaccuggugaacgugaucaaggacgugagcccccccccccugguggugauggccuucagcaugaagaccaugcagaacgccaagaaccaccagaacgagaucaucgccauggccgcccuggugcaccacagcuucgcccuggacaaggccgcccccaagccccccuuccagagccacuucugcguggugagcaagcccaaggacugcaucuuccccuacgccuucaaggaggugaucgagaagaagaacgugaagguggagguggccgccaccgagagaacccugcugggcuucuuccuggccaaggugcacaagaucgaccccgacaucaucgugggccacaacaucuacggcuucgagcuggaggugcugcugcagagaaucaacgugugcaaggccccccacuggagcaagaucggcagacugaagagaagcaacaugcccaagcugggcggcagaagcggcuucggcgagagaaacgccaccugcggcagaaugaucugcgacguggagaucagcgccaaggagcugaucagaugcaagagcuaccaccugagcgagcuggugcagcagauccugaagaccgagagaguggugauccccauggagaacauccagaacauguacagcgagagcagccagcugcuguaccugcuggagcacaccuggaaggacgccaaguucauccugcagaucaugugcgagcugaacgugcugccccuggcccugcagaucaccaacaucgccggcaacaucaugagcagaacccugaugggcggcagaagcgagagaaacgaguuccugcugcugcacgccuucuacgagaacaacuacaucgugcccgacaagcagaucuucagaaagccccagcagaagcugggcgacgaggacgaggagaucgacggcgacaccaacaaguacaagaagggcagaaagaaggccgccuacgccggcggccuggugcuggaccccaaggugggcuucuacgacaaguucauccugcugcuggacuucaacagccuguaccccagcaucauccaggaguucaacaucugcuucaccaccgugcagagaguggccagcgaggcccagaaggugaccgaggacggcgagcaggagcagauccccgagcugcccgaccccagccuggagaugggcauccugcccagagagaucagaaagcugguggagagaagaaagcaggugaagcagcugaugaagcagcaggaccugaaccccgaccugauccugcaguacgacaucagacagaaggcccugaagcugaccgccaacagcauguacggcugccugggcuucagcuacagcagauucuacgccaagccccuggccgcccuggugaccuacaagggcagagagauccugaugcacaccaaggagauggugcagaagaugaaccuggaggugaucuacggcgacaccgacagcaucaugaucaacaccaacagcaccaaccuggaggagguguucaagcugggcaacaaggugaagagcgaggugaacaagcuguacaagcugcuggagaucgacaucgacggcguguucaagagccugcugcugcugaagaagaagaaguacgccgcccuggugguggagcccaccagcgacggcaacuacgugaccaagcaggagcugaagggccuggacaucgugagaagagacuggugcgaccuggccaaggacaccggcaacuucgugaucggccagauccugagcgaccagagcagagacaccaucguggagaacauccagaagagacugaucgagaucggcgagaacgugcugaacggcagcgugcccgugagccaguucgagaucaacaaggcccugaccaaggacccccaggacuaccccgacaagaagagccugccccacgugcacguggcccuguggaucaacagccagggcggcagaaaggugaaggccggcgacaccgugagcuacgugaucugccaggacggcagcaaccugaccgccagccagagagccuacgcccccgagcagcugcagaagcaggacaaccugaccaucgacacccaguacuaccuggcccagcagauccaccccgugguggccagaaucugcgagcccaucgacggcaucgacgccgugcugaucgccaccuggcugggccuggaccccacccaguucagagugcaccacuaccacaaggacgaggagaacgacgcccugcugggcggccccgcccagcugaccgacgaggagaaguacagagacugcgagagauucaagugccccugccccaccugcggcaccgagaacaucuacgacaacguguucgacggcagcggcaccgacauggagcccagccuguacagaugcagcaacaucgacugcaaggccagcccccugaccuucaccgugcagcugagcaacaagcugaucauggacaucagaagauucaucaagaaguacuacgacggcuggcugaucugcgaggagcccaccugcagaaacagaaccagacaccugccccugcaguucagcagaaccggcccccugugccccgccugcaugaaggccacccugcagcccgaguacagcgacaagagccuguacacccagcugugcuucuacagauacaucuucgacgccgagugcgcccuggagaagcugaccaccgaccacgagaaggacaagcugaagaagcaguucuucacccccaaggugcugcaggacuacagaaagcugaagaacaccgccgagcaguuccugagcagaagcggcuacagcgaggugaaccugagcaagcuguucgccggcugcgccgugaagagcuaa

SEQ ID NO: 21753 - RNA, 1797 nt, Artificial Sequence
  POLA2__Homo_sapiens__NP_002680
augagcgccagcgcccagcagcuggccgaggagcugcagaucuucggccuggacugcgaggaggcccugaucgagaagcugguggagcugugcgugcaguacggccagaacgaggagggcauggugggcgagcugaucgccuucugcaccagcacccacaaggugggccugaccagcgagauccugaacagcuucgagcacgaguuccugagcaagagacugagcaaggccagacacagcaccugcaaggacagcggccacgccggcgccagagacaucgugagcauccaggagcugaucgagguggaggaggaggaggagauccugcugaacagcuacaccacccccagcaagggcagccagaagagagccaucagcacccccgagaccccccugaccaagagaagcgugagcaccagaagcccccaccagcugcugagccccagcagcuucagccccagcgccacccccagccagaaguacaacagcagaagcaacagaggcgagguggugaccagcuucggccuggcccagggcgugagcuggagcggcagaggcggcgccggcaacaucagccugaaggugcugggcugccccgaggcccugaccggcagcuacaagagcauguuccagaagcugcccgacaucagagaggugcugaccugcaagaucgaggagcugggcagcgagcugaaggagcacuacaagaucgaggccuucaccccccugcuggcccccgcccaggagcccgugacccugcugggccagaucggcugcgacagcaacggcaagcugaacaacaagagcgugauccuggagggcgacagagagcacagcagcggcgcccagauccccguggaccugagcgagcugaaggaguacagccuguuccccggccagguggugaucauggagggcaucaacaccaccggcagaaagcugguggccaccaagcuguacgagggcgugccccugcccuucuaccagcccaccgaggaggacgccgacuucgagcagagcauggugcugguggccugcggccccuacaccaccagcgacagcaucaccuacgacccccugcuggaccugaucgccgugaucaaccacgacagacccgacgugugcauccuguucggccccuuccuggacgccaagcacgagcagguggagaacugccugcugaccagccccuucgaggacaucuucaagcagugccugagaaccaucaucgagggcaccagaagcagcggcagccaccugguguucgugcccagccugagagacgugcaccacgagcccguguacccccagccccccuucagcuacagcgaccugagcagagaggacaagaagcaggugcaguucgugagcgagcccugcagccugagcaucaacggcgugaucuucggccugaccagcaccgaccugcuguuccaccugggcgccgaggagaucagcagcagcagcggcaccagcgacagauucagcagaauccugaagcacauccugacccagagaagcuacuacccccuguaccccccccaggaggacauggccaucgacuacgagagcuucuacguguacgcccagcugcccgugacccccgacgugcugaucauccccagcgagcugagauacuucgugaaggacgugcugggcugcgugugcgugaaccccggcagacugaccaagggccaggugggcggcaccuucgccagacuguaccugagaagacccgccgccgacggcgccgagagacagagccccugcaucgccgugcagguggugagaaucuaa

SEQ ID NO: 21754 - RNA, 1008 nt, Artificial Sequence
  POLB__Homo_sapiens__NP_002681
augagcaagagaaaggccccccaggagacccugaacggcggcaucaccgacaugcugaccgagcuggccaacuucgagaagaacgugagccaggccauccacaaguacaacgccuacagaaaggccgccagcgugaucgccaaguacccccacaagaucaagagcggcgccgaggccaagaagcugcccggcgugggcaccaagaucgccgagaagaucgacgaguuccuggccaccggcaagcugagaaagcuggagaagaucagacaggacgacaccagcagcagcaucaacuuccugaccagagugagcggcaucggccccagcgccgccagaaaguucguggacgagggcaucaagacccuggaggaccugagaaagaacgaggacaagcugaaccaccaccagagaaucggccugaaguacuucggcgacuucgagaagagaauccccagagaggagaugcugcagaugcaggacaucgugcugaacgaggugaagaagguggacagcgaguacaucgccaccgugugcggcagcuucagaagaggcgccgagagcagcggcgacauggacgugcugcugacccaccccagcuucaccagcgagagcaccaagcagcccaagcugcugcaccaggugguggagcagcugcagaaggugcacuucaucaccgacacccugagcaagggcgagaccaaguucaugggcgugugccagcugcccagcaagaacgacgagaaggaguacccccacagaagaaucgacaucagacugauccccaaggaccaguacuacugcggcgugcuguacuucaccggcagcgacaucuucaacaagaacaugagagcccacgcccuggagaagggcuucaccaucaacgaguacaccaucagaccccugggcgugaccggcguggccggcgagccccugcccguggacagcgagaaggacaucuucgacuacauccaguggaaguacagagagcccaaggacagaagcgaguaa

SEQ ID NO: 21755 - RNA, 3324 nt, Artificial Sequence
  POLD1__Homo_sapiens__NP_001243778
auggacggcaagagaagacccggccccggccccggcgugccccccaagagagccagaggcggccugugggacgacgacgacgcccccagacccagccaguucgaggaggaccuggcccugauggaggagauggaggccgagcacagacugcaggagcaggaggaggaggagcugcagagcgugcuggagggcguggccgacggccaggugccccccagcgccaucgaccccagauggcugagacccaccccccccgcccuggacccccagaccgagccccugaucuuccagcagcuggagaucgaccacuacgugggccccgcccagcccgugcccggcggccccccccccagcagaggcagcgugcccgugcugagagccuucggcgugaccgacgagggcuucagcgugugcugccacauccacggcuucgcccccuacuucuacacccccgccccccccggcuucggccccgagcacaugggcgaccugcagagagagcugaaccuggccaucagcagagacagcagaggcggcagagagcugaccggccccgccgugcuggccguggagcugugcagcagagagagcauguucggcuaccacggccacggccccagccccuuccugagaaucaccguggcccugcccagacugguggcccccgccagaagacugcuggagcagggcaucagaguggccggccugggcacccccagcuucgcccccuacgaggccaacguggacuucgagaucagauucaugguggacaccgacaucgugggcugcaacuggcuggagcugcccgccggcaaguacgcccugagacugaaggagaaggccacccagugccagcuggaggccgacgugcuguggagcgacguggugagccacccccccgagggccccuggcagagaaucgccccccugagagugcugagcuucgacaucgagugcgccggcagaaagggcaucuuccccgagcccgagagagaccccgugauccagaucugcagccugggccugagauggggcgagcccgagcccuuccugagacuggcccugacccugagacccugcgcccccauccugggcgccaaggugcagagcuacgagaaggaggaggaccugcugcaggccuggagcaccuucaucagaaucauggaccccgacgugaucaccggcuacaacauccagaacuucgaccugcccuaccugaucagcagagcccagacccugaaggugcagaccuuccccuuccugggcagaguggccggccugugcagcaacaucagagacagcagcuuccagagcaagcagaccggcagaagagacaccaagguggugagcauggugggcagagugcagauggacaugcugcaggugcugcugagagaguacaagcugagaagcuacacccugaacgccgugagcuuccacuuccugggcgagcagaaggaggacgugcagcacagcaucaucaccgaccugcagaacggcaacgaccagaccagaagaagacuggccguguacugccugaaggacgccuaccugccccugagacugcuggagagacugauggugcuggugaacgccguggagauggccagagugaccggcgugccccugagcuaccugcugagcagaggccagcaggugaagguggugagccagcugcugagacaggccaugcacgagggccugcugaugcccguggugaagagcgagggcggcgaggacuacaccggcgccaccgugaucgagccccugaagggcuacuacgacgugcccaucgccacccuggacuucagcagccuguaccccagcaucaugauggcccacaaccugugcuacaccacccugcugagacccggcaccgcccagaagcugggccugaccgaggaccaguucaucagaacccccaccggcgacgaguucgugaagaccagcgugagaaagggccugcugccccagauccuggagaaccugcugagcgccagaaagagagccaaggccgagcuggccaaggagaccgacccccugagaagacaggugcuggacggcagacagcuggcccugaaggugagcgccaacagcguguacggcuucaccggcgcccaggugggcaagcugcccugccuggagaucagccagagcgugaccggcuucggcagacagaugaucgagaagaccaagcagcugguggagagcaaguacaccguggagaacggcuacagcaccagcgccaaggugguguacggcgacaccgacagcgugaugugcagauucggcgugagcagcguggccgaggccauggcccugggcagagaggccgccgacugggugagcggccacuuccccagccccaucagacuggaguucgagaagguguacuuccccuaccugcugaucagcaagaagagauacgccggccugcuguucagcagcagacccgacgcccacgacagaauggacugcaagggccuggaggccgugagaagagacaacugcccccugguggccaaccuggugaccgccagccugagaagacugcugaucgacagagaccccgagggcgccguggcccacgcccaggacgugaucagcgaccugcugugcaacagaaucgacaucagccagcuggugaucaccaaggagcugaccagagccgccagcgacuacgccggcaagcaggcccacguggagcuggccgagagaaugagaaagagagaccccggcagcgcccccagccugggcgacagagugcccuacgugaucaucagcgccgccaagggcguggccgccuacaugaagagcgaggacccccuguucgugcuggagcacagccugcccaucgacacccaguacuaccuggagcagcagcuggccaagccccugcugagaaucuucgagcccauccugggcgagggcagagccgaggccgugcugcugagaggcgaccacaccagaugcaagaccgugcugaccggcaaggugggcggccugcuggccuucgccaagagaagaaacugcugcaucggcugcagaaccgugcugagccaccagggcgccgugugcgaguucugccagcccagagagagcgagcuguaccagaaggaggugagccaccugaacgcccuggaggagagauucagcagacuguggacccagugccagagaugccagggcagccugcacgaggacgugaucugcaccagcagagacugccccaucuucuacaugagaaagaaggugagaaaggaccuggaggaccaggagcagcugcugagaagauucggcccccccggccccgaggccugguaa

SEQ ID NO: 21756 - RNA, 1410 nt, Artificial Sequence
  POLD2__Homo_sapiens__NP_001243808
auguucagcgagcaggccgcccagagagcccacacccugcugagcccccccagcgccaacaacgccaccuucgccagagugcccguggccaccuacaccaacagcagccagcccuucagacugggcgagagaagcuucagcagacaguacgcccacaucuacgccaccagacugauccagaugagacccuuccuggagaacagagcccagcagcacuggggcagcggcgugggcgugaagaagcugugcgagcugcagcccgaggagaagugcugcguggugggcacccuguucaaggccaugccccugcagcccagcauccugagagaggugagcgaggagcacaaccugcugccccagccccccagaagcaaguacauccaccccgacgacgagcuggugcuggaggacgagcugcagagaaucaagcugaagggcaccaucgacgugagcaagcuggugaccggcaccgugcuggccguguucggcagcgugagagacgacggcaaguuccugguggaggacuacugcuucgccgaccuggccccccagaagcccgcccccccccuggacaccgacagauucgugcugcuggugagcggccugggccugggcggcggcggcggcgagagccugcugggcacccagcugcugguggacguggugaccggccagcugggcgacgagggcgagcagugcagcgccgcccacgugagcagagugauccuggccggcaaccugcugagccacagcacccagagcagagacagcaucaacaaggccaaguaccugaccaagaagacccaggccgccagcguggaggccgugaagaugcuggacgagauccugcugcagcugagcgccagcgugcccguggacgugaugcccggcgaguucgaccccaccaacuacacccugccccagcagccccugcaccccugcauguucccccuggccaccgccuacagcacccugcagcuggugaccaaccccuaccaggccaccaucgacggcgugagauuccugggcaccagcggccagaacgugagcgacaucuucagauacagcagcauggaggaccaccuggagauccuggaguggacccugagagugagacacaucagccccaccgcccccgacacccugggcugcuaccccuucuacaagaccgaccccuucaucuuccccgagugcccccacguguacuucugcggcaacacccccagcuucggcagcaagaucaucagaggccccgaggaccagaccgugcugcuggugaccgugcccgacuucagcgccacccagaccgccugccuggugaaccugagaagccuggccugccagcccaucagcuucagcggcuucggcgccgaggacgacgaccugggcggccugggccugggccccuaa

SEQ ID NO: 21757 - RNA, 1401 nt, Artificial Sequence
  POLD3__Homo_sapiens__NP_006582
auggccgaccagcuguaccuggagaacaucgacgaguucgugaccgaccagaacaagaucgugaccuacaaguggcugagcuacacccugggcgugcacgugaaccaggccaagcagaugcuguacgacuacguggagagaaagagaaaggagaacagcggcgcccagcugcacgugaccuaccuggugagcggcagccugauccagaacggccacagcugccacaagguggccguggugagagaggacaagcuggaggccgugaagagcaagcuggccgugaccgccagcauccacguguacagcauccagaaggccaugcugaaggacagcggcccccuguucaacaccgacuacgacauccugaagagcaaccugcagaacugcagcaaguucagcgccauccagugcgccgccgccgugcccagagcccccgccgagagcagcagcagcagcaagaaguucgagcagagccaccugcacaugagcagcgagacccaggccaacaacgagcugaccaccaacggccacggcccccccgccagcaagcaggugagccagcagcccaagggcaucaugggcauguucgccagcaaggccgccgccaagacccaggagaccaacaaggagaccaagaccgaggccaaggaggugaccaacgccagcgccgccggcaacaaggcccccggcaagggcaacaugaugagcaacuucuucggcaaggccgccaugaacaaguucaaggugaaccuggacagcgagcaggccgugaaggaggagaagaucguggagcagcccaccgugagcgugaccgagcccaagcuggccacccccgccggccugaagaagagcagcaagaaggccgagcccgugaaggugcugcagaaggagaagaagagaggcaagagaguggcccugagcgacgacgagaccaaggagaccgagaacaugagaaagaagagaagaagaaucaagcugcccgagagcgacagcagcgaggacgagguguuccccgacagccccggcgccuacgaggccgagagccccagccccccccccccccccagccccccccuggagcccgugcccaagaccgagcccgagccccccagcgugaagagcagcagcggcgagaacaagagaaagagaaagagagugcugaagagcaagaccuaccuggacggcgagggcugcaucgugaccgagaagguguacgagagcgagagcugcaccgacagcgaggaggagcugaacaugaagaccagcagcgugcacagaccccccgccaugaccgugaagaaggagcccagagaggagagaaagggccccaagaagggcaccgccgcccugggcaaggccaacagacaggugagcaucaccggcuucuuccagagaaaguaa

SEQ ID NO: 21758 - RNA, 240 nt, Artificial Sequence
  POLD4__Homo_sapiens__NP_001243799
augggcagaaagagacugaucaccgacagcuaccccguggugaagagaagagagggccccgccggccacagcaagggcgagcuggcccccgagcugggcgaggagccccagcccagagacgaggaggaggccgagcuggagcugcugagacaguucgaccuggccuggcaguacggccccugcaccgugagcggcaucagcauccccuacgaggcccccagaaagaccagcugccccuaa

SEQ ID NO: 21759 - RNA, 1317 nt, Artificial Sequence
  POLDIP3__Homo_sapiens__NP_001265586
auggccgacaucagccuggacgagcugaucagaaagagaggcgccgccgccaagggcagacugaacgccagacccggcgugggcggcgugagaagcagagugggcauccagcagggccugcugagccagagcaccagaaccgccaccuuccagcagagauucgacgccagacagaagaucggccugagcgacgccagacugaagcugggcgugaaggacgccagagagaagcugcugcagaaggacgccagauucagaaucaagggcaaggugcaggacgccagagagaugcugaacagcagaaagcagcagaccaccgugccccagaagcccagacagguggccgacgccagagagaagaucagccugaagagaagcagccccgccgccuucaucaacccccccaucggcaccgugacccccgcccugaagcugaccaagaccauccagagaaugcacguggaccccgugggcuggauccugaccaccgagugcuuccaggugccccagcagaaggccauggccccccugcacccccaccccgccggcaugagaaucaacguggugaacaaccaccaggccaagcagaaccuguacgaccuggacgaggacgacgacggcaucgccagcgugcccaccaagcagaugaaguucgccgccagcggcggcuuccugcaccacauggccggccugagcagcagcaagcugagcaugagcaaggcccugccccugaccaagguggugcagaacgacgccuacaccgcccccgcccugcccagcagcaucagaaccaaggcccugaccaacaugagcagaacccuggugaacaaggaggagccccccaaggagcugcccgccgccgagcccgugcugagcccccuggagggcaccaagaugaccgugaacaaccugcaccccagagugaccgaggaggacaucguggagcuguucugcgugugcggcgcccugaagagagccagacuggugcaccccggcguggccgaggugguguucgugaagaaggacgacgccaucaccgccuacaagaaguacaacaacagaugccuggacggccagcccaugaagugcaaccugcacaugaacggcaacgugaucaccagcgaccagcccauccugcugagacugagcgacagccccagcaugaagaaggagagcgagcugcccagaagagugaacagcgccagcagcagcaacccccccgccgagguggaccccgacaccauccugaaggcccuguucaagagcagcggcgccagcgugaccacccagcccaccgaguucaagaucaagcuguaa

SEQ ID NO: 21760 - RNA, 1506 nt, Artificial Sequence
  POLE2__Homo_sapiens__NP_001184259
auggcccccgagagacugagaagcagagcccugagcgccuucaagcugagaggccugcugcugagaggcgaggccaucaaguaccugaccgaggcccugcagagcaucagcgagcuggagcuggaggacaagcuggagaagaucaucaacgccguggagaagcagccccugagcagcaacaugaucgagagaagcgugguggaggccgccgugcaggagugcagccagagcguggacgagaccauccugcugaugaccaaccaccccgcccccaaccuguucggcacccccagagacaaggccgagauguucagagagagauacaccauccugcaccagagaacccacagacacgagcuguucaccccccccgugaucggcagccaccccgacgagagcggcagcaaguuccagcugaagaccaucgagacccugcugggcagcaccaccaagaucggcgacgccaucgugcugggcaugaucacccagcugaaggagggcaaguucuuccuggaggaccccaccggcaccgugcagcuggaccugagcaaggcccaguuccacagcggccuguacaccgaggccugcuucgugcuggccgagggcugguucgaggaccagguguuccacgugaacgccuucggcuucccccccaccgagcccagcagcaccaccagagccuacuacggcaacaucaacuucuucggcggccccagcaacaccagcgugaagaccagcgccaagcugaagcagcuggaggaggagaacaaggacgccauguucguguuccugagcgacguguggcuggaccagguggaggugcuggagaagcugagaaucauguucgccggcuacagccccgccccccccaccugcuucauccugugcggcaacuucagcagcgcccccuacggcaagaaccaggugcaggcccugaaggacagccugaagacccuggccgacaucaucugcgaguaccccgacauccaccagagcagcagauucguguucgugcccggccccgaggaccccggcuucggcagcauccugcccagacccccccuggccgagagcaucaccaacgaguucagacagagagugcccuucagcguguucaccaccaaccccugcagaauccaguacugcacccaggagaucaccguguucagagaggaccuggugaacaagaugugcagaaacugcgugagauuccccagcagcaaccuggccauccccaaccacuucgugaagaccauccugagccagggccaccugaccccccugccccuguacgugugccccguguacugggccuacgacuacgcccugagaguguaccccgugcccgaccugcuggugaucgccgacaaguacgaccccuucaccaccaccaacaccgagugccugugcaucaaccccggcagcuuccccagaagcggcuucagcuucaagguguucuaccccagcaacaagaccguggaggacagcaagcugcagggcuucuaa

SEQ ID NO: 21761 - RNA, 444 nt, Artificial Sequence
  POLE3__Homo_sapiens__NP_059139
auggccgagagacccgaggaccugaaccugcccaacgccgugaucaccagaaucaucaaggaggcccugcccgacggcgugaacaucagcaaggaggccagaagcgccaucagcagagccgccagcguguucgugcuguacgccaccagcugcgccaacaacuucgccaugaagggcaagagaaagacccugaacgccagcgacgugcugagcgccauggaggagauggaguuccagagauucgugaccccccugaaggaggcccuggaggccuacagaagagagcagaagggcaagaaggaggccagcgagcagaagaagaaggacaaggacaagaagaccgacagcgaggagcaggacaagagcagagacgaggacaacgacgaggacgaggagagacuggaggaggaggagcagaacgaggaggaggagguggacaacuaa

SEQ ID NO: 21762 - RNA, 354 nt, Artificial Sequence
  POLE4__Homo_sapiens__NP_063949
auggccgccgccgccgccgccggcagcggcacccccagagaggaggagggccccgccggcgaggccgccgccagccagccccaggcccccaccagcgugcccggcgccagacugagcagacugccccuggccagagugaaggcccuggugaaggccgaccccgacgugacccuggccggccaggaggccaucuucauccuggccagagccgccgagcuguucguggagaccaucgccaaggacgccuacugcugcgcccagcagggcaagagaaagacccugcagagaagagaccuggacaacgccaucgaggccguggacgaguucgccuuccuggagggcacccuggacuaa

SEQ ID NO: 21763 - RNA, 6861 nt, Artificial Sequence
  POLE__Homo_sapiens__NP_006222
augagccugagaagcggcggcagaagaagagccgaccccggcgccgacggcgaggccagcagagacgacggcgccaccagcagcgugagcgcccugaagagacuggagagaagccaguggaccgacaagauggaccugagauucggcuucgagagacugaaggagcccggcgagaagaccggcuggcugaucaacaugcaccccaccgagauccuggacgaggacaagagacugggcagcgccguggacuacuacuucauccaggacgacggcagcagauucaagguggcccugcccuacaagcccuacuucuacaucgccaccagaaagggcugcgagagagaggugagcagcuuccugagcaagaaguuccagggcaagaucgccaagguggagaccgugcccaaggaggaccuggaccugcccaaccaccuggugggccugaagagaaacuacaucagacugagcuuccacaccguggaggaccuggugaaggugagaaaggagaucagccccgccgugaagaagaacagagagcaggaccacgccagcgacgccuacaccgcccugcugagcagcgugcugcagagaggcggcgugaucaccgacgaggaggagaccagcaagaagaucgccgaccagcuggacaacaucguggacaugagagaguacgacgugcccuaccacaucagacugagcaucgaccugaagauccacguggcccacugguacaacgugagauacagaggcaacgccuuccccguggagaucaccagaagagacgaccugguggagagacccgaccccguggugcuggccuucgacaucgagaccaccaagcugccccugaaguuccccgacgccgagaccgaccagaucaugaugaucagcuacaugaucgacggccagggcuaccugaucaccaacagagagaucgugagcgaggacaucgaggacuucgaguucacccccaagcccgaguacgagggccccuucugcguguucaacgagcccgacgaggcccaccugauccagagaugguucgagcacgugcaggagaccaagcccaccaucauggugaccuacaacggcgacuucuucgacuggcccuucguggaggccagagccgccgugcacggccugagcaugcagcaggagaucggcuuccagaaggacagccagggcgaguacaaggccccccagugcauccacauggacugccugagaugggugaagagagacagcuaccugcccgugggcagccacaaccugaaggccgccgccaaggccaagcugggcuacgaccccguggagcuggaccccgaggacaugugcagaauggccaccgagcagccccagacccuggccaccuacagcgugagcgacgccguggccaccuacuaccuguacaugaaguacgugcaccccuucaucuucgcccugugcaccaucauccccauggagcccgacgaggugcugagaaagggcagcggcacccugugcgaggcccugcugauggugcaggccuuccacgccaacaucaucuuccccaacaagcaggagcaggaguucaacaagcugaccgacgacggccacgugcuggacagcgagaccuacgugggcggccacguggaggcccuggagagcggcguguucagaagcgacauccccugcagauucagaaugaaccccgccgccuucgacuuccugcugcagagaguggagaagacccugagacacgcccuggaggaggaggagaaggugcccguggagcaggugaccaacuucgaggaggugugcgacgagaucaagagcaagcuggccagccugaaggacgugcccagcagaaucgagugcccccugaucuaccaccuggacgugggcgccauguaccccaacaucauccugaccaacagacugcagcccagcgccaugguggacgaggccaccugcgccgccugcgacuucaacaagcccggcgccaacugccagagaaagauggccuggcaguggagaggcgaguucaugcccgccagcagaagcgaguaccacagaauccagcaccagcuggagagcgagaaguuccccccccuguuccccgagggccccgccagagccuuccacgagcugagcagagaggagcaggccaaguacgagaagagaagacuggccgacuacugcagaaaggccuacaagaagauccacaucaccaagguggaggagagacugaccaccaucugccagagagagaacagcuucuacguggacaccgugagagccuucagagacagaagauacgaguucaagggccugcacaagguguggaagaagaagcugagcgccgccguggaggugggcgacgccgccgaggugaagagaugcaagaacauggaggugcuguacgacagccugcagcuggcccacaagugcauccugaacagcuucuacggcuacgugaugagaaagggcgccagaugguacagcauggagauggccggcaucgugugcuucaccggcgccaacaucaucacccaggccagagagcugaucgagcagaucggcagaccccuggagcuggacaccgacggcaucuggugcgugcugcccaacagcuuccccgagaacuucguguucaagaccaccaacgugaagaagcccaaggugaccaucagcuaccccggcgccaugcugaacaucauggugaaggagggcuucaccaacgaccaguaccaggagcuggccgagcccagcagccugaccuacgugaccagaagcgagaacagcaucuucuucgagguggacggccccuaccuggccaugauccugcccgccagcaaggaggagggcaagaagcugaagaagagauacgccguguucaacgaggacggcagccuggccgagcugaagggcuucgaggugaagagaagaggcgagcugcagcugaucaagaucuuccagagcagcguguucgaggccuuccugaagggcagcacccuggaggagguguacggcagcguggccaagguggccgacuacuggcuggacgugcuguacagcaaggccgccaacaugcccgacagcgagcuguucgagcugaucagcgagaacagaagcaugagcagaaagcuggaggacuacggcgagcagaagagcaccagcaucagcaccgccaagagacuggccgaguuccugggcgaccagauggugaaggacgccggccugagcugcagauacaucaucagcagaaagcccgagggcagccccgugaccgagagagccaucccccuggccaucuuccaggccgagcccaccgugagaaagcacuuccugagaaaguggcugaagagcagcagccugcaggacuucgacaucagagccauccuggacugggacuacuacaucgagagacugggcagcgccauccagaagaucaucaccauccccgccgcccugcagcaggugaagaaccccgugcccagagugaagcaccccgacuggcugcacaagaagcugcuggagaagaacgacguguacaagcagaagaagaucagcgagcuguucacccuggagggcagaagacaggugaccauggccgaggccagcgaggacagccccagacccagcgcccccgacauggaggacuucggccuggugaagcugccccaccccgccgcccccgugaccgugaagagaaagagagugcugugggagagccaggaggagagccaggaccugacccccaccgugcccuggcaggagauccugggccagccccccgcccugggcaccagccaggaggaguggcugguguggcugagauuccacaagaagaaguggcagcugcaggccagacagagacuggccagaagaaagagacagagacuggagagcgccgagggcgugcugagacccggcgccaucagagacggccccgccaccggccugggcagcuuccugagaagaaccgccagaagcauccuggaccugcccuggcagaucgugcagaucagcgagaccagccaggccggccuguucagacugugggcccuggugggcagcgaccugcacugcaucagacugagcauccccagaguguucuacgugaaccagagaguggccaaggccgaggagggcgccagcuacagaaaggugaacagagugcugcccagaagcaacaugguguacaaccuguacgaguacagcgugcccgaggacauguaccaggagcacaucaacgagaucaacgccgagcugagcgcccccgacaucgagggcguguacgagacccaggugccccugcuguucagagcccuggugcaccugggcugcgugugcguggugaacaagcagcuggugagacaccugagcggcugggaggccgagaccuucgcccuggagcaccuggagaugagaagccuggcccaguucagcuaccuggagcccggcagcaucagacacaucuaccuguaccaccacgcccaggcccacaaggcccuguucggcaucuucauccccagccagagaagagccagcguguucgugcuggacaccgugagaagcaaccagaugcccagccugggcgcccuguacagcgccgagcacggccugcugcuggagaaggugggccccgagcugcugcccccccccaagcacaccuucgaggugagagccgagaccgaccugaagaccaucugcagagccauccagagauuccugcuggccuacaaggaggagagaagaggccccacccugaucgccgugcagagcagcugggagcugaagagacuggccagcgagauccccgugcuggaggaguucccccuggugcccaucugcguggccgacaagaucaacuacggcgugcuggacuggcagagacacggcgccagaagaaugaucagacacuaccugaaccuggacaccugccugagccaggccuucgagaugagcagauacuuccacauccccaucggcaaccugcccgaggacaucagcaccuucggcagcgaccuguucuucgccagacaccugcagagacacaaccaccugcuguggcugagccccaccgccagacccgaccugggcggcaaggaggccgacgacaacugccuggugauggaguucgacgaccaggccaccguggagaucaacagcagcggcugcuacagcaccgugugcguggagcuggaccugcagaaccuggccgugaacaccauccugcagagccaccacgugaacgacauggagggcgccgacagcaugggcaucagcuucgacgugauccagcaggccagccuggaggacaugaucaccggcggccaggccgccagcgcccccgccagcuacgacgagaccgcccugugcagcaacaccuucagaauccugaagagcaugguggugggcugggugaaggagaucacccaguaccacaacaucuacgccgacaaccaggugaugcacuucuacagauggcugagaagccccagcagccugcugcacgaccccgcccugcacagaacccugcacaacaugaugaagaagcuguuccugcagcugaucgccgaguucaagagacugggcagcagcgugaucuacgccaacuucaacagaaucauccugugcaccaagaagagaagaguggaggacgccaucgccuacguggaguacaucaccagcagcauccacagcaaggagaccuuccacagccugaccaucagcuucagcagaugcugggaguuccugcuguggauggaccccagcaacuacggcggcaucaagggcaaggugagcagcagaauccacugcggccugcaggacagccagaaggccggcggcgccgaggacgagcaggagaacgaggacgacgaggaggagagagacggcgaggaggaggaggaggccgaggagagcaacguggaggaccugcuggagaacaacuggaacauccugcaguuccugccccaggccgccagcugccagaacuacuuccugaugaucgugagcgccuacaucguggccguguaccacugcaugaaggacggccugagaagaagcgcccccggcagcacccccgugagaagaagaggcgccagccagcugagccaggaggccgagggcgccgugggcgcccugcccggcaugaucaccuucagccaggacuacguggccaacgagcugacccagagcuucuucaccaucacccagaagauccagaagaaggugaccggcagcagaaacagcaccgagcugagcgagauguuccccgugcugcccggcagccaccugcugcugaacaaccccgcccuggaguucaucaaguacgugugcaaggugcugagccuggacaccaacaucaccaaccaggugaacaagcugaacagagaccugcugagacugguggacgugggcgaguucagcgaggaggcccaguucagagaccccugcagaagcuacgugcugcccgaggugaucugcagaagcugcaacuucugcagagaccuggaccugugcaaggacagcagcuucagcgaggacggcgccgugcugccccaguggcugugcagcaacugccaggcccccuacgacagcagcgccaucgagaugacccugguggaggugcugcagaagaagcugauggccuucacccugcaggaccuggugugccugaagugcagaggcgugaaggagaccagcaugcccguguacugcagcugcgccggcgacuucgcccugaccauccacacccagguguucauggagcagaucggcaucuucagaaacaucgcccagcacuacggcaugagcuaccugcuggagacccuggaguggcugcugcagaagaacccccagcugggccacuaa

SEQ ID NO: 21764 - RNA, 1458 nt, Artificial Sequence
  POLG2__Homo_sapiens__NP_009146
augagaagcagaguggccgugagagccugccacaaggugugcagaugccugcugagcggcuucggcggcagaguggacgccggccagcccgagcugcugaccgagagaagcagccccaagggcggccacgugaagagccacgccgagcuggagggcaacggcgagcaccccgaggcccccggcagcggcgagggcagcgaggcccugcuggagaucugccagagaagacacuuccugagcggcagcaagcagcagcugagcagagacagccugcugagcggcugccaccccggcuucggcccccugggcguggagcugagaaagaaccuggccgccgagugguggaccagcguggugguguucagagagcagguguuccccguggacgcccugcaccacaagcccggcccccugcugcccggcgacagcgccuucagacuggugagcgccgagacccugagagagauccugcaggacaaggagcugagcaaggagcagcugguggccuuccuggagaacgugcugaagaccagcggcaagcugagagagaaccugcugcacggcgcccuggagcacuacgugaacugccuggaccuggugaacaagagacugcccuacggccuggcccagaucggcgugugcuuccaccccguguucgacaccaagcagaucagaaacggcgugaagagcaucggcgagaagaccgaggccagccuggugugguucaccccccccagaaccagcaaccaguggcuggacuucuggcugagacacagacugcagugguggagaaaguucgccaugagccccagcaacuucagcagcagcgacugccaggacgaggagggcagaaagggcaacaagcuguacuacaacuuccccuggggcaaggagcugaucgagacccuguggaaccugggcgaccacgagcugcugcacauguaccccggcaacgugagcaagcugcacggcagagacggcagaaagaacguggugcccugcgugcugagcgugaacggcgaccuggacagaggcaugcuggccuaccuguacgacagcuuccagcugaccgagaacagcuucaccagaaagaagaaccugcacagaaaggugcugaagcugcaccccugccuggcccccaucaagguggcccuggacgugggcagaggccccacccuggagcugagacaggugugccagggccuguucaacgagcugcuggagaacggcaucagcguguggcccggcuaccuggagaccaugcagagcagccuggagcagcuguacagcaaguacgacgagaugagcauccuguucaccgugcuggugaccgagaccacccuggagaacggccugauccaccugagaagcagagacaccaccaugaaggagaugaugcacaucagcaagcugaaggacuuccugaucaaguacaucagcagcgccaagaacguguaa

SEQ ID NO: 21765 - RNA, 3720 nt, Artificial Sequence
  POLG__Homo_sapiens__NP_002684
augagcagacugcuguggagaaagguggccggcgccaccgugggccccggccccgugcccgcccccggcagaugggugagcagcagcgugcccgccagcgaccccagcgacggccagagaagaagacagcagcagcagcagcagcagcagcagcagcagcagcagccccagcagccccaggugcugagcagcgagggcggccagcugagacacaacccccuggacauccagaugcugagcagaggccugcacgagcagaucuucggccagggcggcgagaugcccggcgaggccgccgugagaagaagcguggagcaccugcagaagcacggccuguggggccagcccgccgugccccugcccgacguggagcugagacugcccccccuguacggcgacaaccuggaccagcacuucagacugcuggcccagaagcagagccugcccuaccuggaggccgccaaccugcugcugcaggcccagcugccccccaagccccccgccugggccugggccgagggcuggaccagauacggccccgagggcgaggccgugcccguggccauccccgaggagagagcccugguguucgacguggaggugugccuggccgagggcaccugccccacccuggccguggccaucagccccagcgccugguacagcuggugcagccagagacugguggaggagagauacagcuggaccagccagcugagccccgccgaccugaucccccuggaggugcccaccggcgccagcagccccacccagagagacuggcaggagcagcugguggugggccacaacgugagcuucgacagagcccacaucagagagcaguaccugauccagggcagcagaaugagauuccuggacaccaugagcaugcacauggccaucagcggccugagcagcuuccagagaagccuguggaucgccgccaagcagggcaagcacaaggugcagccccccaccaagcagggccagaagagccagagaaaggccagaagaggccccgccaucagcagcugggacuggcuggacaucagcagcgugaacagccuggccgaggugcacagacuguacgugggcggccccccccuggagaaggagcccagagagcuguucgugaagggcaccaugaaggacaucagagagaacuuccaggaccugaugcaguacugcgcccaggacgugugggccacccacgagguguuccagcagcagcugccccuguuccuggagagaugcccccaccccgugacccuggccggcaugcuggagaugggcgugagcuaccugcccgugaaccagaacugggagagauaccuggccgaggcccagggcaccuacgaggagcugcagagagagaugaagaagagccugauggaccuggccaacgacgccugccagcugcugagcggcgagagauacaaggaggaccccuggcugugggaccuggagugggaccugcaggaguucaagcagaagaaggccaagaaggugaagaaggagcccgccaccgccagcaagcugcccaucgagggcgccggcgcccccggcgaccccauggaccaggaggaccugggccccugcagcgaggaggaggaguuccagcaggacgugauggccagagccugccugcagaagcugaagggcaccaccgagcugcugcccaagagaccccagcaccugcccggccaccccggcugguacagaaagcugugccccagacuggacgaccccgccuggacccccggccccagccugcugagccugcagaugagagugacccccaagcugauggcccugaccugggacggcuucccccugcacuacagcgagagacacggcuggggcuaccuggugcccggcagaagagacaaccuggccaagcugcccaccggcaccacccuggagagcgccggcguggugugccccuacagagccaucgagagccuguacagaaagcacugccuggagcagggcaagcagcagcugaugccccaggaggccggccuggccgaggaguuccugcugaccgacaacagcgccaucuggcagaccguggaggagcuggacuaccuggagguggaggccgaggccaagauggagaaccugagagccgccgugcccggccagccccuggcccugaccgccagaggcggccccaaggacacccagcccagcuaccaccacggcaacggccccuacaacgacguggacauccccggcugcugguucuucaagcugccccacaaggacggcaacagcugcaacgugggcagccccuucgccaaggacuuccugcccaagauggaggacggcacccugcaggccggccccggcggcgccagcggccccagagcccuggagaucaacaagaugaucagcuucuggagaaacgcccacaagagaaucagcagccagauggugguguggcugcccagaagcgcccugcccagagccgugaucagacaccccgacuacgacgaggagggccuguacggcgccauccugccccagguggugaccgccggcaccaucaccagaagagccguggagcccaccuggcugaccgccagcaacgccagacccgacagagugggcagcgagcugaaggccauggugcaggccccccccggcuacacccuggugggcgccgacguggacagccaggagcuguggaucgccgccgugcugggcgacgcccacuucgccggcaugcacggcugcaccgccuucggcuggaugacccugcagggcagaaagagcagaggcaccgaccugcacagcaagaccgccaccaccgugggcaucagcagagagcacgccaagaucuucaacuacggcagaaucuacggcgccggccagcccuucgccgagagacugcugaugcaguucaaccacagacugacccagcaggaggccgccgagaaggcccagcagauguacgccgccaccaagggccugagaugguacagacugagcgacgagggcgaguggcuggugagagagcugaaccugcccguggacagaaccgagggcggcuggaucagccugcaggaccugagaaaggugcagagagagaccgccagaaagagccaguggaagaagugggaggugguggccgagagagccuggaagggcggcaccgagagcgagauguucaacaagcuggagagcaucgccaccagcgacauccccagaacccccgugcugggcugcugcaucagcagagcccuggagcccagcgccgugcaggaggaguucaugaccagcagagugaacuggguggugcagagcagcgccguggacuaccugcaccugaugcugguggccaugaaguggcuguucgaggaguucgccaucgacggcagauucugcaucagcauccacgacgaggugagauaccuggugagagaggaggacagauacagagccgcccuggcccugcagaucaccaaccugcugaccagaugcauguucgccuacaagcugggccugaacgaccugccccagagcguggccuucuucagcgccguggacaucgacagaugccugagaaaggaggugaccauggacugcaagacccccagcaaccccaccggcauggagagaagauacggcaucccccagggcgaggcccuggacaucuaccagaucaucgagcugaccaagggcagccuggagaagagaagccagcccggccccuaa

SEQ ID NO: 21766 - RNA, 1245 nt, Artificial Sequence
  POLH__Homo_sapiens__NP_001278899
auggccaccggccaggacagagugguggcccugguggacauggacugcuucuucgugcagguggagcagagacagaacccccaccugagaaacaagcccugcgccguggugcaguacaagagcuggaagggcggcggcaucaucgccgugagcuacgaggccagagccuucggcgugaccagaagcaugugggccgacgacgccaagaagcugugccccgaccugcugcuggcccaggugagagagagcagaggcaaggccaaccugaccaaguacagagaggccagcguggaggugauggagaucaugagcagauucgccgugaucgagagagccagcaucgacgaggccuacguggaccugaccagcgccgugcaggagagacugcagaagcugcagggccagcccaucagcgccgaccugcugcccagcaccuacaucgagggccugccccagggccccaccaccgccgaggagaccgugcagaaggagggcaugagaaagcagggccuguuccaguggcuggacagccugcagaucgacaaccugaccagccccgaccugcagcugaccgugggcgccgugaucguggaggagaugagagccgccaucgagagagagaccggcuuccagugcagcgccggcaucagccacaacaaggugcuggccaagcuggccugcggccugaacaagcccaacagacagacccuggugagccacggcagcgugccccagcuguucagccagaugcccaucagaaagaucagaagccugggcggcaagcugggcgccagcgugaucgagauccugggcaucgaguacaugggcgagcugacccaguucaccgagagccagcugcagagccacuucggcgagaagaacggcagcuggcuguacgccaugugcagaggcaucgagcacgaccccgugaagcccagacagcugcccaagaccaucggcugcagcaagaacuuccccggcaagaccgcccuggccaccagagagcaggugcagugguggcugcugcagcuggcccaggagcuggaggagagacugaccaaggacagaaacgacaacgacagaguggccacccagcugguggugagcaucagagugcagggcgacaagagacugagcagccugagaagaugcugcgcccugaccagauacgacgcccacaagaugagccacgacgccuucaccgugaucaagaacugcaacaccagcggcauccagaccgaguaa

SEQ ID NO: 21767 - RNA, 2223 nt, Artificial Sequence
  POLI__Homo_sapiens__NP_009126
auggagaagcugggcguggagcccgaggaggagggcggcggcgacgacgacgaggaggacgccgaggccugggccauggagcuggccgacgugggcgccgccgccagcagccagggcgugcacgaccaggugcugcccacccccaacgccagcagcagagugaucgugcacguggaccuggacugcuucuacgcccagguggagaugaucagcaaccccgagcugaaggacaagccccugggcgugcagcagaaguaccugguggugaccugcaacuacgaggccagaaagcugggcgugaagaagcugaugaacgugagagacgccaaggagaagugcccccagcuggugcuggugaacggcgaggaccugaccagauacagagagaugagcuacaaggugaccgagcugcuggaggaguucagccccgugguggagagacugggcuucgacgagaacuucguggaccugaccgagaugguggagaagagacugcagcagcugcagagcgacgagcugagcgccgugaccgugagcggccacguguacaacaaccagagcaucaaccugcuggacgugcugcacaucagacugcuggugggcagccagaucgccgccgagaugagagaggccauguacaaccagcugggccugaccggcugcgccggcguggccagcaacaagcugcuggccaagcuggugagcggcguguucaagcccaaccagcagaccgugcugcugcccgagagcugccagcaccugauccacagccugaaccacaucaaggagauccccggcaucggcuacaagaccgccaagugccuggaggcccugggcaucaacagcgugagagaccugcagaccuucagccccaagauccuggagaaggagcugggcaucagcguggcccagagaauccagaagcugagcuucggcgaggacaacagccccgugauccugagcggccccccccagagcuucagcgaggaggacagcuucaagaagugcagcagcgagguggaggccaagaacaagaucgaggagcugcuggccagccugcugaacagagugugccaggacggcagaaagccccacaccgugagacugaucaucagaagauacagcagcgagaagcacuacggcagagagagcagacagugccccauccccagccacgugauccagaagcugggcaccggcaacuacgacgugaugacccccaugguggacauccugaugaagcuguucagaaacauggugaacgugaagaugcccuuccaccugacccugcugagcgugugcuucugcaaccugaaggcccugaacaccgccaagaagggccugaucgacuacuaccugaugcccagccugagcaccaccagcagaagcggcaagcacagcuucaagaugaaggacacccacauggaggacuuccccaaggacaaggagaccaacagagacuuccugcccagcggcagaaucgagagcaccagaaccagagagagcccccuggacaccaccaacuucagcaaggagaaggacaucaacgaguucccccugugcagccugcccgagggcguggaccaggagguguucaagcagcugcccguggacauccaggaggagauccugagcggcaagagcagagagaaguuccagggcaagggcagcgugagcugcccccugcacgccagcagaggcgugcugagcuucuucagcaagaagcagaugcaggacauccccaucaaccccagagaccaccugagcagcagcaagcaggugagcagcgugagccccugcgagcccggcaccagcggcuucaacagcagcagcagcagcuacaugagcagccagaaggacuacagcuacuaccuggacaacagacugaaggacgagagaaucagccagggccccaaggagccccagggcuuccacuucaccaacagcaaccccgccgugagcgccuuccacagcuuccccaaccugcagagcgagcagcuguucagcagaaaccacaccaccgacagccacaagcagaccguggccaccgacagccacgagggccugaccgagaacagagagcccgacagcguggacgagaagaucaccuuccccagcgacaucgacccccagguguucuacgagcugcccgaggccgugcagaaggagcugcuggccgaguggaagagagccggcagcgacuuccacaucggccacaaguaa

SEQ ID NO: 21768 - RNA, 2613 nt, Artificial Sequence
  POLK__Homo_sapiens__NP_057302
auggacagcaccaaggagaagugcgacagcuacaaggacgaccugcugcugagaaugggccugaacgacaacaaggccggcauggagggccuggacaaggagaagaucaacaagaucaucauggaggccaccaagggcagcagauucuacggcaacgagcugaagaaggagaagcaggugaaccagagaaucgagaacaugaugcagcagaaggcccagaucaccagccagcagcugagaaaggcccagcugcagguggacagauucgccauggagcuggagcagagcagaaaccugagcaacaccaucgugcacaucgacauggacgccuucuacgccgccguggagaugagagacaaccccgagcugaaggacaagcccaucgccgugggcagcaugagcaugcugagcaccagcaacuaccacgccagaagauucggcgugagagccgccaugcccggcuucaucgccaagagacugugcccccagcugaucaucgugccccccaacuucgacaaguacagagccgugagcaaggaggugaaggagauccuggccgacuacgaccccaacuucauggccaugagccuggacgaggccuaccugaacaucaccaagcaccuggaggagagacagaacuggcccgaggacaagagaagauacuucaucaagaugggcagcagcguggagaacgacaaccccggcaaggaggugaacaagcugagcgagcacgagagaagcaucagcccccugcuguucgaggagagccccagcgacgugcagccccccggcgaccccuuccaggugaacuucgaggagcagaacaacccccagauccugcagaacagcgugguguucggcaccagcgcccaggagguggugaaggagaucagauucagaaucgagcagaagaccacccugaccgccagcgccggcaucgcccccaacaccaugcuggccaaggugugcagcgacaagaacaagcccaacggccaguaccagauccugcccaacagacaggccgugauggacuucaucaaggaccugcccaucagaaaggugagcggcaucggcaaggugaccgagaagaugcugaaggcccugggcaucaucaccugcaccgagcuguaccagcagagagcccugcugagccugcuguucagcgagaccagcuggcacuacuuccugcacaucagccugggccugggcagcacccaccugaccagagacggcgagagaaagagcaugagcguggagagaaccuucagcgagaucaacaaggccgaggagcaguacagccugugccaggagcugugcagcgagcuggcccaggaccugcagaaggagagacugaagggcagaaccgugaccaucaagcugaagaacgugaacuucgaggugaagaccagagccagcaccgugagcagcguggugagcaccgccgaggagaucuucgccaucgccaaggagcugcugaagaccgagaucgacgccgacuucccccacccccugagacugagacugaugggcgugagaaucagcagcuuccccaacgaggaggacagaaagcaccagcagagaagcaucaucggcuuccugcaggccggcaaccaggcccugagcgccaccgagugcacccuggagaagaccgacaaggacaaguucgugaagccccuggagaugagccacaagaagagcuucuucgacaagaagagaagcgagagaaaguggagccaccaggacaccuucaagugcgaggccgugaacaagcagagcuuccagaccagccagcccuuccaggugcugaagaagaagaugaacgagaaccuggagaucagcgagaacagcgacgacugccagauccugaccugccccgugugcuucagagcccagggcugcaucagccuggaggcccugaacaagcacguggacgagugccuggacggccccagcaucagcgagaacuucaagauguucagcugcagccacgugagcgccaccaaggugaacaagaaggagaacgugcccgccagcagccugugcgagaagcaggacuacgaggcccaccccaagaucaaggagaucagcagcguggacugcaucgcccugguggacaccaucgacaacagcagcaaggccgagagcaucgacgcccugagcaacaagcacagcaaggaggagugcagcagccugcccagcaagagcuucaacaucgagcacugccaccagaacagcagcagcaccgugagccuggagaacgaggacgugggcagcuucagacaggaguacagacagcccuaccugugcgaggugaagaccggccaggcccuggugugccccgugugcaacguggagcagaagaccagcgaccugacccuguucaacgugcacguggacgugugccugaacaagagcuucauccaggagcugagaaaggacaaguucaaccccgugaaccagcccaaggagagcagcagaagcaccggcagcagcagcggcgugcagaaggccgugaccagaaccaagagacccggccugaugaccaaguacagcaccagcaagaagaucaagcccaacaaccccaagcacacccuggacaucuucuucaaguaa

SEQ ID NO: 21769 - RNA, 1728 nt, Artificial Sequence
  POLL__Homo_sapiens__NP_001167555
auggaccccagaggcauccugaaggccuuccccaagagacagaagauccacgccgacgccagcagcaaggugcuggccaagauccccagaagagaggagggcgaggaggccgaggaguggcugagcagccugagagcccacguggugagaaccggcaucggcagagccagagccgagcuguucgagaagcagaucgugcagcacggcggccagcugugccccgcccagggccccggcgugacccacaucgugguggacgagggcauggacuacgagagagcccugagacugcugagacugccccagcugccccccggcgcccagcuggugaagagcgccuggcugagccugugccugcaggagagaagacugguggacguggccggcuucagcaucuucauccccagcagauaccuggaccacccccagcccagcaaggccgagcaggacgccagcaucccccccggcacccacgaggcccugcugcagaccgcccugagccccccccccccccccaccagacccgugagccccccccagaaggccaaggaggcccccaacacccaggcccagcccaucagcgacgacgaggccagcgacggcgaggagacccaggugagcgccgccgaccuggaggcccugaucagcggccacuaccccaccagccuggagggcgacugcgagcccagccccgcccccgccgugcuggacaagugggugugcgcccagcccagcagccagaaggccaccaaccacaaccugcacaucaccgagaagcuggaggugcuggccaaggccuacagcgugcagggcgacaaguggagagcccugggcuacgccaaggccaucaacgcccugaagagcuuccacaagcccgugaccagcuaccaggaggccugcagcauccccggcaucggcaagagaauggccgagaagaucaucgagauccuggagagcggccaccugagaaagcuggaccacaucagcgagagcgugcccgugcuggagcuguucagcaacaucuggggcgccggcaccaagaccgcccagaugugguaccagcagggcuucagaagccuggaggacaucagaagccaggccagccugaccacccagcaggccaucggccugaagcacuacagcgacuuccuggagagaaugcccagagaggaggccaccgagaucgagcagaccgugcagaaggccgcccaggccuucaacagcggccugcugugcguggccugcggcagcuacagaagaggcaaggccaccugcggcgacguggacgugcugaucacccaccccgacggcagaagccacagaggcaucuucagcagacugcuggacagccugagacaggagggcuuccugaccgacgaccuggugagccaggaggagaacggccagcagcagaaguaccugggcgugugcagacugcccggccccggcagaagacacagaagacuggacaucaucguggugcccuacagcgaguucgccugcgcccugcuguacuucaccggcagcgcccacuucaacagaagcaugagagcccuggccaagaccaagggcaugagccugagcgagcacgcccugagcaccgccguggugagaaacacccacggcugcaaggugggccccggcagagugcugcccacccccaccgagaaggacguguucagacugcugggccugcccuacagagagcccgccgagagagacugguaa

SEQ ID NO: 21770 - RNA, 1527 nt, Artificial Sequence
  POLM__Homo_sapiens__NP_001271259
augcugcccaagagaagaagagccagagugggcagccccagcggcgacgccgccagcagcaccccccccagcaccagauuccccggcguggccaucuaccugguggagcccagaaugggcagaagcagaagagccuuccugaccggccuggccagaagcaagggcuucagagugcuggacgccugcagcagcgaggccacccacguggugauggaggagaccagcgccgaggaggccgugagcuggcaggagagaagaauggccgccgccccccccggcugcaccccccccgcccugcuggacaucagcuggcugaccgagagccugggcgccggccagcccgugcccguggagugcagacacagacuggagguggccggccccagaaagggcccccugagccccgccuggaugcccgccuacgccugccagagacccaccccccugacccaccacaacaccggccugagcgaggcccuggagauccuggccgaggccgccggcuucgagggcagcgagggcagacugcugaccuucugcagagccgccagcgugcugaaggcccugcccagccccgugaccacccugagccagcugcagggccugccccacuucggcgagcacagcagcagaguggugcaggagcugcuggagcacggcgugugcgaggagguggagagagugagaagaagcgagagagcccccgccccccccggccccgagcaccccagccccgccgugagaugcagaugccccgccgccggcggcggcggcagcugcggcgccggccccgccuggggccacagacacgccgacagaagacugccccagggccugauccuguaccaccagcaccagcacagcugcugcgagagccccaccagacuggcccagcagagccacauggacgccuucgagagaagcuucugcaucuucagacugccccagccccccggcgccgccgugggcggcagcaccagacccugccccagcuggaaggccgugagaguggaccuggugguggcccccgugagccaguuccccuucgcccugcugggcuggaccggcagcaagcuguuccagagagagcugagaagauucagcagaaaggagaagggccuguggcugaacagccacggccuguucgaccccgagcagggcagcagcagcggcaagacccccagaagcagaaagagcugcuucugcugcagaagacacuucagcaagagacugcagagaaagaccagcagcgacaccugggcccugagcaccuuccugcagagcagagagacccccgagcccgccugcgugccccacuuccacagcggcaacugggccgcccccaaccuggccaccgagugccugcaggccgacaugcugccccccgacccccaccugcaccccagcccccccagacccggcagcagcggcggccagcugugccugcaggaccagcugagccccugcuggugcgccgccggcugcgacgaggugggcgcccugagcgccagccugaucaccguguaa

SEQ ID NO: 21771 - RNA, 2703 nt, Artificial Sequence
  POLN__Homo_sapiens__NP_861524
auggagaacuacgaggcccuggugggcuucgaccugugcaacaccccccugagcagcguggcccagaagaucaugagcgccaugcacagcggcgaccugguggacagcaagaccuggggcaagagcaccgagaccauggaggugaucaacaagagcagcgugaaguacagcgugcagcuggaggacagaaagacccagagccccgagaagaaggaccugaagagccugagaagccagaccagcagaggcagcgccaagcugagcccccagagcuucagcgugagacugaccgaccagcugagcgccgaccagaagcagaagagcaucagcagccugacccugagcagcugccugaucccccaguacaaccaggaggccagcgugcugcagaagaagggccacaagagaaagcacuuccugauggagaacaucaacaacgagaacaagggcagcaucaaccugaagagaaagcacaucaccuacaacaaccugagcgagaagaccagcaagcagauggcccuggaggaggacaccgacgacgccgagggcuaccugaacagcggcaacagcggcgcccugaagaagcacuucugcgacaucagacaccuggacgacugggccaagagccagcugaucgagaugcugaagcaggccgccgcccuggugaucaccgugauguacaccgacggcagcacccagcugggcgccgaccagacccccgugagcagcgugagaggcaucguggugcuggugaagagacaggccgagggcggccacggcugccccgacgcccccgccugcggccccgugcuggagggcuucgugagcgacgaccccugcaucuacauccagaucgagcacagcgccaucugggaccaggagcaggaggcccaccagcaguucgccagaaacgugcuguuccagaccaugaagugcaagugccccgugaucugcuucaacgccaaggacuucgugagaaucgugcugcaguucuucggcaacgacggcagcuggaagcacguggccgacuucaucggccuggaccccagaaucgccgccuggcugaucgaccccagcgacgccacccccagcuucgaggaccugguggagaaguacugcgagaagagcaucaccgugaaggugaacagcaccuacggcaacagcagcagaaacaucgugaaccagaacgugagagagaaccugaagacccuguacagacugaccauggaccugugcagcaagcugaaggacuacggccuguggcagcuguucagaacccuggagcugccccugauccccauccuggccgugauggagagccacgccauccaggugaacaaggaggagauggagaagaccagcgcccugcugggcgccagacugaaggagcuggagcaggaggcccacuucguggccggcgagagauuccugaucaccagcaacaaccagcugagagagauccuguucggcaagcugaagcugcaccugcugagccagagaaacagccugcccagaaccggccugcagaaguaccccagcaccagcgaggccgugcugaacgcccugagagaccugcacccccugcccaagaucauccuggaguacagacaggugcacaagaucaagagcaccuucguggacggccugcuggccugcaugaagaagggcagcaucagcagcaccuggaaccagaccggcaccgugaccggcagacugagcgccaagcaccccaacauccagggcaucagcaagcaccccauccagaucaccacccccaagaacuucaagggcaaggaggacaagauccugaccaucagccccagagccauguucgugagcagcaagggccacaccuuccuggccgccgacuucagccagaucgagcugagaauccugacccaccugagcggcgaccccgagcugcugaagcuguuccaggagagcgagagagacgacguguucagcacccugaccagccaguggaaggacgugcccguggagcaggugacccacgccgacagagagcagaccaagaaggugguguacgccgugguguacggcgccggcaaggagagacuggccgccugccugggcgugcccauccaggaggccgcccaguuccuggagagcuuccugcagaaguacaagaagaucaaggacuucgccagagccgccaucgcccagugccaccagaccggcugcguggugagcaucaugggcagaagaagaccccugcccagaauccacgcccacgaccagcagcugagagcccaggccgagagacaggccgugaacuucguggugcagggcagcgccgccgaccugugcaagcuggccaugauccacguguucaccgccguggccgccagccacacccugaccgccagacugguggcccagauccacgacgagcugcuguucgagguggaggacccccagauccccgagugcgccgcccuggugagaagaaccauggagagccuggagcaggugcaggcccuggagcugcagcugcaggugccccugaaggugagccugagcgccggcagaagcuggggccaccuggugccccugcaggaggccuggggccccccccccggccccugcagaaccgagagccccagcaacagccuggccgcccccggcagccccgccagcacccagccccccccccugcacuucagccccagcuucugccuguaa

SEQ ID NO: 21772 - RNA, 7773 nt, Artificial Sequence
  POLQ__Homo_sapiens__NP_955452
augaaccugcugagaagaagcggcaagagaagaagaagcgagagcggcagcgacagcuucagcggcagcggcggcgacagcagcgccagcccccaguuccugagcggcagcgugcugagccccccccccggccugggcagaugccugaaggccgccgccgccggcgagugcaagcccaccgugcccgacuacgagagagacaagcugcugcuggccaacuggggccugcccaaggccgugcuggagaaguaccacagcuucggcgugaagaagauguucgaguggcaggccgagugccugcugcugggccaggugcuggagggcaagaaccugguguacagcgcccccaccagcgccggcaagacccugguggccgagcugcugauccugaagagagugcuggagaugagaaagaaggcccuguucauccugcccuucgugagcguggccaaggagaagaaguacuaccugcagagccuguuccaggaggugggcaucaagguggacggcuacaugggcagcaccagccccagcagacacuucagcagccuggacaucgccgugugcaccaucgagagagccaacggccugaucaacagacugaucgaggagaacaagauggaccugcugggcaugguggugguggacgagcugcacaugcugggcgacagccacagaggcuaccugcuggagcugcugcugaccaagaucugcuacaucaccagaaagagcgccagcugccaggccgaccuggccagcagccugagcaacgccgugcagaucgugggcaugagcgccacccugcccaaccuggagcugguggccagcuggcugaacgccgagcuguaccacaccgacuucagacccgugccccugcuggagagcgugaaggugggcaacagcaucuacgacagcagcaugaagcuggugagagaguucgagcccaugcugcaggugaagggcgacgaggaccacguggugagccugugcuacgagaccaucugcgacaaccacagcgugcugcuguucugccccagcaagaaguggugcgagaagcuggccgacaucaucgccagagaguucuacaaccugcaccaccaggccgagggccuggugaagcccagcgagugcccccccgugauccuggagcagaaggagcugcuggaggugauggaccagcugagaagacugcccagcggccuggacagcgugcugcagaagaccgugcccuggggcguggccuuccaccacgccggccugaccuucgaggagagagacaucaucgagggcgccuucagacagggccugaucagagugcuggccgccaccagcacccugagcagcggcgugaaccugcccgccagaagagugaucaucagaacccccaucuucggcggcagaccccuggacauccugaccuacaagcagauggugggcagagccggcagaaagggcguggacaccgugggcgagagcauccugaucugcaagaacagcgagaagagcaagggcaucgcccugcugcagggcagccugaagcccgugagaagcugccugcagagaagagagggcgaggaggugaccggcagcaugaucagagccauccuggagaucaucgugggcggcguggccagcaccagccaggacaugcacaccuacgccgccugcaccuuccuggccgccagcaugaaggagggcaagcagggcauccagagaaaccaggagagcgugcagcugggcgccaucgaggccugcgugauguggcugcuggagaacgaguucauccagagcaccgaggccagcgacggcaccgagggcaagguguaccaccccacccaccugggcagcgccacccugagcagcagccugagccccgccgacacccuggacaucuucgccgaccugcagagagccaugaagggcuucgugcuggagaacgaccugcacauccuguaccuggugacccccauguucgaggacuggaccaccaucgacugguacagauucuucugccugugggagaagcugcccaccagcaugaagagaguggccgagcuggugggcguggaggagggcuuccuggccagaugcgugaagggcaaggugguggccagaaccgagagacagcacagacagauggccauccacaagagauucuucaccagccuggugcugcuggaccugaucagcgaggugccccugagagagaucaaccagaaguacggcugcaacagaggccagauccagagccugcagcagagcgccgccguguacgccggcaugaucaccguguucagcaacagacugggcuggcacaacauggagcugcugcugagccaguuccagaagagacugaccuucggcauccagagagagcugugcgaccuggugagagugagccugcugaacgcccagagagccagagugcuguacgccagcggcuuccacaccguggccgaccuggccagagccaacaucguggagguggaggugauccugaagaacgccgugcccuucaagagcgccagaaaggccguggacgaggaggaggaggccguggaggagagaagaaacaugagaaccaucugggugaccggcagaaagggccugaccgagagagaggccgccgcccugaucguggaggaggccagaaugauccugcagcaggaccugguggagaugggcgugcaguggaaccccugcgcccugcugcacagcagcaccugcagccugacccacagcgagagcgaggugaaggagcacaccuucaucagccagaccaagagcagcuacaagaagcugaccagcaagaacaagagcaacaccaucuucagcgacagcuacaucaagcacagccccaacaucgugcaggaccugaacaagagcagagagcacaccagcagcuucaacugcaacuuccagaacggcaaccaggagcaccagaccugcagcaucuucagagccagaaagagagccagccuggacaucaacaaggagaagcccggcgccagccagaacgagggcaagaccagcgacaagaagguggugcagaccuucagccagaagaccaagaaggccccccugaacuucaacagcgagaagaugagcagaagcuucagaagcuggaagagaagaaagcaccugaagagaagcagagacagcagcccccugaaggacagcggcgccugcagaauccaccugcagggccagacccugagcaaccccagccugugcgaggaccccuucacccuggacgagaagaagaccgaguucagaaacagcggccccuucgccaagaacgugagccugagcggcaaggagaaggacaacaagaccagcuucccccugcagaucaagcagaacugcagcuggaacaucacccugaccaacgacaacuucguggagcacaucgugaccggcagccagagcaagaacgugaccugccaggccaccagcguggugagcgagaagggcagaggcguggccguggaggccgagaagaucaacgaggugcugauccagaacggcagcaagaaccagaacguguacaugaagcaccacgacauccaccccaucaaccaguaccugagaaagcagagccacgagcagaccagcaccaucaccaagcagaagaacaucaucgagagacagaugcccugcgaggccgugagcagcuacaucaacagagacagcaacgugaccaucaacugcgagagaaucaagcugaacaccgaggagaacaagcccagccacuuccaggcccugggcgacgacaucagcagaaccgugauccccagcgaggugcugcccagcgccggcgccuucagcaagagcgagggccagcacgagaacuuccugaacaucagcagacugcaggagaagaccggcaccuacaccaccaacaagaccaagaacaaccacgugagcgaccugggccuggugcugugcgacuucgaggacagcuucuaccuggacacccagagcgagaagaucauccagcagauggccaccgagaacgccaagcugggcgccaaggacaccaaccuggccgccggcaucaugcagaagagccuggugcagcagaacagcaugaacagcuuccagaaggagugccacauccccuuccccgccgagcagcacccccugggcgccaccaagaucgaccaccuggaccugaagaccgugggcaccaugaagcagagcagcgacagccacggcguggacauccugacccccgagagccccaucuuccacagccccauccugcuggaggagaacggccuguuccugaagaagaacgaggugagcgugaccgacagccagcugaacagcuuccugcagggcuaccagacccaggagaccgugaagcccgugauccugcugaucccccagaagagaacccccaccggcguggagggcgagugccugcccgugcccgagaccagccugaacaugagcgacagccugcuguucgacagcuucagcgacgacuaccuggugaaggagcagcugcccgacaugcagaugaaggagccccugcccagcgaggugaccagcaaccacuucagcgacagccugugccugcaggaggaccugaucaagaagagcaacgugaacgagaaccaggacacccaccagcagcugaccugcagcaacgacgagagcaucaucuucagcgagauggacagcgugcagaugguggaggcccuggacaacguggacaucuuccccgugcaggagaagaaccacaccguggugagccccagagcccuggagcugagcgaccccgugcuggacgagcaccaccagggcgaccaggacggcggcgaccaggacgagagagccgagaagagcaagcugaccggcaccagacagaaccacagcuucaucuggagcggcgccagcuucgaccugagccccggccugcagagaauccuggacaaggugagcagcccccuggagaacgagaagcugaagagcaugaccaucaacuucagcagccugaacagaaagaacaccgagcugaacgaggagcaggaggugaucagcaaccuggagaccaagcaggugcagggcaucagcuucagcagcaacaacgaggugaagagcaagaucgagaugcuggagaacaacgccaaccacgacgagaccagcagccugcugcccagaaaggagagcaacaucguggacgacaacggccugaucccccccacccccauccccaccagcgccagcaagcugaccuuccccggcauccuggagacccccgugaaccccuggaagaccaacaacgugcugcagcccggcgagagcuaccuguucggcagccccagcgacaucaagaaccacgaccugagccccggcagcagaaacggcuucaaggacaacagccccaucagcgacaccagcuucagccugcagcugagccaggacggccugcagcugacccccgccagcagcagcagcgagagccugagcaucaucgacguggccagcgaccagaaccuguuccagaccuucaucaaggaguggagaugcaagaagagauucagcaucagccuggccugcgagaagaucagaagccugaccagcagcaagaccgccaccaucggcagcagauucaagcaggccagcagcccccaggagauccccaucagagacgacggcuuccccaucaagggcugcgacgacacccugguggugggccuggccgugugcuggggcggcagagacgccuacuacuucagccugcagaaggagcagaagcacagcgagaucagcgccagccuggugccccccagccuggaccccagccugacccugaaggacagaaugugguaccugcagagcugccugagaaaggagagcgacaaggagugcagcguggugaucuacgacuucauccagagcuacaagauccugcugcugagcugcggcaucagccuggagcagagcuacgaggaccccaagguggccugcuggcugcuggaccccgacagccaggagcccacccugcacagcaucgugaccagcuuccugccccacgagcugccccugcuggagggcauggagaccagccagggcauccagagccugggccugaacgccggcagcgagcacagcggcagauacagagccagcguggagagcauccugaucuucaacagcaugaaccagcugaacagccugcugcagaaggagaaccugcaggacguguucagaaagguggagaugcccagccaguacugccuggcccugcuggagcugaacggcaucggcuucagcaccgccgagugcgagagccagaagcacaucaugcaggccaagcuggacgccaucgagacccaggccuaccagcuggccggccacagcuucagcuucaccagcagcgacgacaucgccgaggugcuguuccuggagcugaagcugccccccaacagagagaugaagaaccagggcagcaagaagacccugggcagcaccagaagaggcaucgacaacggcagaaagcugagacugggcagacaguucagcaccagcaaggacgugcugaacaagcugaaggcccugcacccccugcccggccugauccuggaguggagaagaaucaccaacgccaucaccaaggugguguucccccugcagagagagaagugccugaaccccuuccugggcauggagagaaucuaccccgugagccagagccacaccgccaccggcagaaucaccuucaccgagcccaacauccagaacgugcccagagacuucgagaucaagaugcccacccuggugggcgagagcccccccagccaggccgugggcaagggccugcugcccaugggcagaggcaaguacaagaagggcuucagcgugaaccccagaugccaggcccagauggaggagagagccgccgacagaggcaugcccuucagcaucagcaugagacacgccuucgugcccuuccccggcggcagcauccuggccgccgacuacagccagcuggagcugagaauccuggcccaccugagccacgacagaagacugauccaggugcugaacaccggcgccgacguguucagaagcaucgccgccgaguggaagaugaucgagcccgagagcgugggcgacgaccugagacagcaggccaagcagaucugcuacggcaucaucuacggcaugggcgccaagagccugggcgagcagaugggcaucaaggagaacgacgccgccugcuacaucgacagcuucaagagcagauacaccggcaucaaccaguucaugaccgagaccgugaagaacugcaagagagacggcuucgugcagaccauccugggcagaagaagauaccugcccggcaucaaggacaacaaccccuacagaaaggcccacgccgagagacaggccaucaacaccaucgugcagggcagcgccgccgacaucgugaagaucgccaccgugaacauccagaagcagcuggagaccuuccacagcaccuucaagagccacggccacagagagggcaugcugcagagcgaccagaccggccugagcagaaagagaaagcugcagggcauguucugccccaucagaggcggcuucuucauccugcagcugcacgacgagcugcuguacgagguggccgaggaggacguggugcagguggcccagaucgugaagaacgagauggagagcgccgugaagcugagcgugaagcugaaggugaaggugaagaucggcgccagcuggggcgagcugaaggacuucgacguguaa

SEQ ID NO: 21773 - RNA, 5163 nt, Artificial Sequence
  POLR1A__Homo_sapiens__NP_056240
augcugaucagcaagaacaugcccuggagaagacugcagggcaucagcuucggcauguacagcgccgaggagcugaagaagcugagcgugaagagcaucaccaaccccagauaccuggacagccugggcaaccccagcgccaacggccuguacgaccuggcccugggccccgccgacagcaaggaggugugcagcaccugcgugcaggacuucagcaacugcagcggccaccugggccacaucgagcugccccugaccguguacaacccccugcuguucgacaagcuguaccugcugcugagaggcagcugccugaacugccacaugcugaccugccccagagccgugauccaccugcugcugugccagcugagagugcuggaggugggcgcccugcaggccguguacgagcuggagagaauccugaacagauuccuggaggagaaccccgaccccagcgccagcgagaucagagaggagcuggagcaguacaccaccgagaucgugcagaacaaccugcugggcagccagggcgcccacgugaagaacgugugcgagagcaagagcaagcugaucgcccuguucuggaaggcccacaugaacgccaagagaugcccccacugcaagaccggcagaagcguggugagaaaggagcacaacagcaagcugaccaucaccuuccccgccauggugcacagaaccgccggccagaaggacagcgagccccugggcaucgaggaggcccagaucggcaagagaggcuaccugacccccaccagcgccagagagcaccugagcgcccuguggaagaacgagggcuucuuccugaacuaccuguucagcggcauggacgacgacggcauggagagcagauucaaccccagcguguucuuccuggacuuccugguggugccccccagcagauacagacccgugagcagacugggcgaccagauguucaccaacggccagaccgugaaccugcaggccgugaugaaggacguggugcugaucagaaagcugcuggcccugauggcccaggagcagaagcugcccgaggagguggccacccccaccaccgacgaggagaaggacagccugaucgccaucgacagaagcuuccugagcacccugcccggccagagccugaucgacaagcuguacaacaucuggaucagacugcagagccacgugaacaucguguucgacagcgagauggacaagcugaugauggacaaguaccccggcaucagacagauccuggagaagaaggagggccuguucagaaagcacaugaugggcaagagaguggacuacgccgccagaagcgugaucugccccgacauguacaucaacaccaacgagaucggcauccccaugguguucgccaccaagcugaccuacccccagcccgugacccccuggaacgugcaggagcugagacaggccgugaucaacggccccaacgugcaccccggcgccagcauggugaucaacgaggacggcagcagaaccgcccugagcgccguggacaugacccagagagaggccguggccaagcagcugcugacccccgccaccggcgcccccaagccccagggcaccaagaucgugugcagacacgugaagaacggcgacauccugcugcugaacagacagcccacccugcacagacccagcauccaggcccacagagccagaauccugcccgaggagaaggugcugagacugcacuacgccaacugcaaggccuacaacgccgacuucgacggcgacgagaugaacgcccacuucccccagagcgagcugggcagagccgaggccuacgugcuggccugcaccgaccagcaguaccuggugcccaaggacggccagccccuggccggccugauccaggaccacauggugagcggcgccagcaugaccaccagaggcugcuucuucaccagagagcacuacauggagcugguguacagaggccugaccgacaaggugggcagagugaagcugcugagccccagcauccugaagcccuucccccuguggaccggcaagcagguggugagcacccugcugaucaacaucauccccgaggaccacaucccccugaaccugagcggcaaggccaagaucaccggcaaggccugggugaaggagacccccagaagcgugcccggcuucaaccccgacagcaugugcgagagccaggugaucaucagagagggcgagcugcugugcggcgugcuggacaaggcccacuacggcagcagcgccuacggccuggugcacugcugcuacgagaucuacggcggcgagaccagcggcaaggugcugaccugccuggccagacuguucaccgccuaccugcagcuguacagaggcuucacccugggcguggaggacauccuggugaagcccaaggccgacgugaagagacagagaaucaucgaggagagcacccacugcggcccccaggccgugagagccgcccugaaccugcccgaggccgccagcuacgacgaggugagaggcaaguggcaggacgcccaccugggcaaggaccagagagacuucaacaugaucgaccugaaguucaaggaggaggugaaccacuacagcaacgagaucaacaaggccugcaugcccuucggccugcacagacaguuccccgagaacagccugcagaugauggugcagagcggcgccaagggcagcaccgugaacaccaugcagaucagcugccugcugggccagaucgagcuggagggcagaagacccccccugauggccagcggcaagagccugcccugcuucgagcccuacgaguucacccccagagccggcggcuucgugaccggcagauuccugaccggcaucaagccccccgaguucuucuuccacugcauggccggcagagagggccugguggacaccgccgugaagaccagcagaagcggcuaccugcagagaugcaucaucaagcaccuggagggccugguggugcaguacgaccugaccgugagagacagcgacggcagcguggugcaguuccuguacggcgaggacggccuggacauccccaagacccaguuccugcagcccaagcaguuccccuuccuggccagcaacuacgaggugaucaugaagagccagcaccugcacgaggugcugagcagagccgaccccaagaaggcccugcaccacuucagagccaucaagaaguggcagagcaagcaccccaacacccugcugagaagaggcgccuuccugagcuacagccagaagauccaggaggccgugaaggcccugaagcuggagagcgagaacagaaacggcagaagccccggcacccaggagaugcugagaaugugguacgagcuggacgaggagagcagaagaaaguaccagaagaaggccgccgccugccccgaccccagccugagcguguggagacccgacaucuacuucgccagcgugagcgagaccuucgagaccaagguggacgacuacagccaggagugggccgcccagaccgagaagagcuacgagaagagcgagcugagccuggacagacugagaacccugcugcagcugaaguggcagagaagccugugcgagcccggcgaggccgugggccugcuggccgcccagagcaucggcgagcccagcacccagaugacccugaacaccuuccacuucgccggcagaggcgagaugaacgugacccugggcauccccagacugagagagauccugaugguggccagcgccaacaucaagacccccaugaugagcgugcccgugcugaacaccaagaaggcccugaagagagugaagagccugaagaagcagcugaccagagugugccugggcgaggugcugcagaagaucgacgugcaggagagcuucugcauggaggagaagcagaacaaguuccagguguaccagcugagauuccaguuccugccccacgccuacuaccagcaggagaagugccugagacccgaggacauccugagauucauggagaccagauucuucaagcugcugauggagagcaucaagaagaagaacaacaaggccagcgccuucagaaacgugaacaccagaagagccacccagagagaccuggacaacgccggcgagcugggcagaagcagaggcgagcaggagggcgacgaggaggaggagggccacaucguggacgccgaggccgaggagggcgacgccgacgccagcgacgccaagagaaaggagaagcaggaggaggagguggacuacgagagcgaggaggaggaggagagagagggcgaggagaacgacgacgaggacaugcaggaggagagaaacccccacagagagggcgccagaaagacccaggagcaggacgaggaggugggccugggcaccgaggaggaccccagccugcccgcccugcugacccagcccagaaagcccacccacagccaggagccccagggccccgaggccauggagagaagagugcaggccgugagagagauccaccccuucaucgacgacuaccaguacgacaccgaggagagccuguggugccaggugaccgugaagcugccccugaugaagaucaacuucgacaugagcagccugguggugagccuggcccacggcgccgugaucuacgccaccaagggcaucaccagaugccugcugaacgagaccaccaacaacaagaacgagaaggagcuggugcugaacaccgagggcaucaaccugcccgagcuguucaaguacgccgaggugcuggaccugagaagacuguacagcaacgacauccacgccaucgccaacaccuacggcaucgaggccgcccugagagugaucgagaaggagaucaaggacguguucgccguguacggcaucgccguggaccccagacaccugagccugguggccgacuacaugugcuucgagggcguguacaagccccugaacagauucggcaucagaagcaacagcagcccccugcagcagaugaccuucgagaccagcuuccaguuccugaagcaggccaccaugcugggcagccacgacgagcugagaagccccagcgccugccugguggugggcaagguggugagaggcggcaccggccuguucgagcugaagcagccccugagauaa

SEQ ID NO: 21774 - RNA, 3240 nt, Artificial Sequence
  POLR1B__Homo_sapiens__NP_001131076
auggaccccggcagcagauggagaaaccugcccagcggccccagccugaagcaccugaccgaccccagcuacggcauccccagagagcagcagaaggccgcccugcaggagcugaccagagcccacguggagagcuucaacuacgccgugcacgagggccugggccuggccgugcaggccgacaucaacugggccgugaacggcaucagcaagggcaucaucaagcaguuccugggcuacgugcccaucauggugaagagcaagcugugcaaccugagaaaccugcccccccaggcccugaucgagcaccacgaggaggccgaggagaugggcggcuacuucaucaucaacggcaucgagaaggugaucagaaugcugaucaugcccagaagaaacuuccccaucgccaugaucagacccaaguggaagaccagaggccccggcuacacccaguacggcgugagcaugcacugcgugagagaggagcacagcgccgugaacaugaaccugcacuaccuggagaacggcaccgugaugcugaacuucaucuacagaaaggagcuguucuuccugccccugggcuucgcccugaaggcccuggugagcuucagcgacuaccagaucuuccaggagcugaucaagggcaaggaggacgacagcuuccugagaaacagcgugagccagaugcugagaaucgugauggaggagggcugcagcacccagaagcaggugcugaacuaccugggcgagugcuucagagugaagcugaacgugcccgacugguaccccaacgagcaggccgccgaguuccuguucaaccagugcaucugcauccaccugaagagcaacaccgagaaguucuacaugcugugccugaugaccagaaagcuguucgcccuggccaagggcgagugcauggaggacaaccccgacagccuggugaaccaggaggugcugacccccggccagcuguuccugauguuccugaaggagaagcuggagggcuggcuggugagcaucaagaucgccuucgacaagaaggcccagaagaccagcgugagcaugaacaccgacaaccugaugagaaucuucaccaugggcaucgaccugaccaagcccuucgaguaccuguucgccaccggcaaccugagaagcaagaccggccugggccugcugcaggacagcggccugugcgugguggccgacaagcugaacuucaucagauaccugagccacuucagaugcgugcacagaggcgccgacuucgccaagaugagaaccaccaccgugagaagacugcugcccgagagcuggggcuuccugugccccgugcacacccccgacggcgagcccugcggccugaugaaccaccugaccgccgugugcgagguggugacccaguucguguacaccgccagcauccccgcccugcugugcaaccugggcgugacccccaucgacggcgccccccacagaagcuacagcgagugcuaccccgugcugcuggacggcgugauggugggcuggguggacaaggaccuggcccccggcaucgccgacagccugagacacuucaaggugcugagagagaagagaaucccccccuggauggagguggugcugauccccaugaccggcaagcccagccuguaccccggccuguuccuguucaccacccccugcagacuggugagacccgugcagaaccuggcccugggcaaggaggagcugaucggcaccauggagcagaucuucaugaacguggccaucuucgaggacgagguguucgccggcgugaccacccaccaggagcuguucccccacagccugcugagcgugaucgccaacuucauccccuucagcgaccacaaccagagccccagaaacauguaccagugccagaugggcaagcagaccaugggcuucccccugcugaccuaccaggacagaagcgacaacaagcuguacagacugcagaccccccagagcccccuggugagacccagcauguacgacuacuacgacauggacaacuaccccaucggcaccaacgccaucguggccgugaucagcuacaccggcuacgacauggaggacgccaugaucgugaacaaggccagcugggagagaggcuucgcccacggcagcguguacaagagcgaguucaucgaccugagcgagaagaucaagcagggcgacagcagccugguguucggcaucaagcccggcgaccccagagugcugcagaagcuggacgacgacggccugcccuucaucggcgccaagcugcaguacggcgaccccuacuacagcuaccugaaccugaacaccggcgagagcuucgugauguacuacaagagcaaggagaacugcgugguggacaacaucaaggugugcagcaacgacaccggcagcggcaaguucaagugcgugugcaucaccaugagagugcccagaaaccccaccaucggcgacaaguucgccagcagacacggccagaagggcauccugagcagacuguggcccgccgaggacaugcccuucaccgagagcggcauggugcccgacauccuguucaacccccacggcuuccccagcagaaugaccaucggcaugcugaucgagagcauggccggcaagagcgccgcccugcacggccugugccacgacgccacccccuucaucuucagcgaggagaacagcgcccuggaguacuucggcgagaugcugaaggccgccggcuacaacuucuacggcaccgagagacuguacagcggcaucagcggccuggagcuggaggccgacaucuucaucggcgugguguacuaccagagacugagacacauggugagcgacaaguuccaggugagaaccaccggcgccagagacagagugaccaaccagcccaucggcggcagaaacgugcagggcggcaucagauucggcgagauggagagagacgcccugcuggcccacggcaccagcuuccugcugcacgacagacuguucaacugcagcgacagaagcguggcccacgugugcgugaagugcggcagccugcugagcccccugcuggagaagcccccccccagcuggagcgccaugagaaacagaaaguacaacugcacccugugcagcagaagcgacaccaucgacaccgugagcgugcccuacguguucagauacuucguggccgagcuggccgccaugaacaucaaggugaagcuggacgugguguaa

SEQ ID NO: 21775 - RNA, 1041 nt, Artificial Sequence
  POLR1C__Homo_sapiens__NP_976035
auggccgccagccaggccguggaggagaugagaagcagaguggugcugggcgaguucggcgugagaaacgugcacaccaccgacuuccccggcaacuacagcggcuacgacgacgccugggaccaggacagauucgagaagaacuucagaguggacguggugcacauggacgagaacagccuggaguucgacauggugggcaucgacgccgccaucgccaacgccuucagaagaauccugcuggccgaggugcccaccauggccguggagaaggugcugguguacaacaacaccagcaucgugcaggacgagauccuggcccacagacugggccugauccccauccacgccgaccccagacuguucgaguacagaaaccagggcgacgaggagggcaccgagaucgacacccugcaguucagacugcaggugagaugcaccagaaacccccacgccgccaaggacagcagcgaccccaacgagcuguacgugaaccacaagguguacaccagacacaugaccuggaucccccugggcaaccaggccgaccuguuccccgagggcaccaucagacccgugcacgacgacauccugaucgcccagcugagacccggccaggagaucgaccugcugaugcacugcgugaagggcaucggcaaggaccacgccaaguucagccccguggccaccgccagcuacagacugcugcccgacaucacccugcuggagcccguggagggcgaggccgccgaggagcugagcagaugcuucagccccggcgugaucgaggugcaggaggugcagggcaagaagguggccagaguggccaaccccagacuggacaccuucagcagagagaucuucagaaacgagaagcugaagaagguggugagacuggccagagugagagaccacuacaucuucagcguggagagcaccggcgugcugccccccgacgugcuggugagcgaggccaucaaggugcugaugggcaagugcagaagauuccuggacgagcuggacgccgugcagauggacuaa

SEQ ID NO: 21776 - RNA, 402 nt, Artificial Sequence
  POLR1D__Homo_sapiens__NP_057056
auggaggaggaccaggagcuggagagaaagaucagcggccugaagaccagcauggccgagggcgagagaaagaccgcccuggagauggugcaggccgccggcaccgacagacacugcgugaccuucgugcugcacgaggaggaccacacccugggcaacagccugagauacaugaucaugaagaaccccgagguggaguucugcggcuacaccaccacccaccccagcgagagcaagaucaaccugagaauccagaccagaggcacccugcccgccguggagcccuuccagagaggccugaacgagcugaugaacgugugccagcacgugcuggacaaguucgaggccagcaucaaggacuacaaggaccagaaggccagcagaaacgagagcaccuucuaa

SEQ ID NO: 21777 - RNA, 5913 nt, Artificial Sequence
  POLR2A__Homo_sapiens__NP_000928
augcacggcggcggcccccccagcggcgacagcgccugcccccugagaaccaucaagagagugcaguucggcgugcugagccccgacgagcugaagagaaugagcgugaccgagggcggcaucaaguaccccgagaccaccgagggcggcagacccaagcugggcggccugauggaccccagacagggcgugaucgagagaaccggcagaugccagaccugcgccggcaacaugaccgagugccccggccacuucggccacaucgagcuggccaagcccguguuccacgugggcuuccuggugaagaccaugaaggugcugagaugcgugugcuucuucugcagcaagcugcugguggacagcaacaaccccaagaucaaggacauccuggccaagagcaagggccagcccaagaagagacugacccacguguacgaccugugcaagggcaagaacaucugcgagggcggcgaggagauggacaacaaguucggcguggagcagcccgagggcgacgaggaccugaccaaggagaagggccacggcggcugcggcagauaccagcccagaaucagaagaagcggccuggagcuguacgccgaguggaagcacgugaacgaggacagccaggagaagaagauccugcugagccccgagagagugcacgagaucuucaagagaaucagcgacgaggagugcuucgugcugggcauggagcccagauacgccagacccgaguggaugaucgugaccgugcugcccgugcccccccugagcgugagacccgccguggugaugcagggcagcgccagaaaccaggacgaccugacccacaagcuggccgacaucgugaagaucaacaaccagcugagaagaaacgagcagaacggcgccgccgcccacgugaucgccgaggacgugaagcugcugcaguuccacguggccaccaugguggacaacgagcugcccggccugcccagagccaugcagaagagcggcagaccccugaagagccugaagcagagacugaagggcaaggagggcagagugagaggcaaccugaugggcaagagaguggacuucagcgccagaaccgugaucacccccgaccccaaccugagcaucgaccaggugggcgugcccagaagcaucgccgccaacaugaccuucgccgagaucgugacccccuucaacaucgacagacugcaggagcuggugagaagaggcaacagccaguaccccggcgccaaguacaucaucagagacaacggcgacagaaucgaccugagauuccaccccaagcccagcgaccugcaccugcagaccggcuacaagguggagagacacaugugcgacggcgacaucgugaucuucaacagacagcccacccugcacaagaugagcaugaugggccacagagugagaauccugcccuggagcaccuucagacugaaccugagcgugaccacccccuacaacgccgacuucgacggcgacgagaugaaccugcaccugccccagagccuggagaccagagccgagauccaggagcuggccauggugcccagaaugaucgugaccccccagagcaacagacccgugaugggcaucgugcaggacacccugaccgccgugagaaaguucaccaagagagacguguuccuggagagaggcgaggugaugaaccugcugauguuccugagcaccugggacggcaaggugccccagcccgccauccugaagcccagaccccuguggaccggcaagcagaucuucagccugaucauccccggccacaucaacugcaucagaacccacagcacccaccccgacgacgaggacagcggccccuacaagcacaucagccccggcgacaccaagguggugguggagaacggcgagcugaucaugggcauccugugcaagaagagccugggcaccagcgccggcagccuggugcacaucagcuaccuggagaugggccacgacaucaccagacuguucuacagcaacauccagaccgugaucaacaacuggcugcugaucgagggccacaccaucggcaucggcgacagcaucgccgacagcaagaccuaccaggacauccagaacaccaucaagaaggccaagcaggacgugaucgaggugaucgagaaggcccacaacaacgagcuggagcccacccccggcaacacccugagacagaccuucgagaaccaggugaacagaauccugaacgacgccagagacaagaccggcagcagcgcccagaagagccugagcgaguacaacaacuucaagagcaugguggugagcggcgccaagggcagcaagaucaacaucagccaggugaucgccguggugggccagcagaacguggagggcaagagaauccccuucggcuucaagcacagaacccugccccacuucaucaaggacgacuacggccccgagagcagaggcuucguggagaacagcuaccuggccggccugacccccaccgaguucuucuuccacgccaugggcggcagagagggccugaucgacaccgccgugaagaccgccgagaccggcuacauccagagaagacugaucaagagcauggagagcgugauggugaaguacgacgccaccgugagaaacagcaucaaccagguggugcagcugagauacggcgaggacggccuggccggcgagagcguggaguuccagaaccuggccacccugaagcccagcaacaaggccuucgagaagaaguucagauucgacuacaccaacgagagagcccugagaagaacccugcaggaggaccuggugaaggacgugcugagcaacgcccacauccagaacgagcuggagagagaguucgagagaaugagagaggacagagaggugcugagagugaucuuccccaccggcgacagcaagguggugcugcccugcaaccugcugagaaugaucuggaacgcccagaagaucuuccacaucaaccccagacugcccagcgaccugcaccccaucaaggugguggagggcgugaaggagcugagcaagaagcuggugaucgugaacggcgacgacccccugagcagacaggcccaggagaacgccacccugcuguucaacauccaccugagaagcacccugugcagcagaagaauggccgaggaguucagacugagcggcgaggccuucgacuggcugcugggcgagaucgagagcaaguucaaccaggccaucgcccaccccggcgagauggugggcgcccuggccgcccagagccugggcgagcccgccacccagaugacccugaacaccuuccacuacgccggcgugagcgccaagaacgugacccugggcgugcccagacugaaggagcugaucaacaucagcaagaagcccaagacccccagccugaccguguuccugcugggccagagcgccagagacgccgagagagccaaggacauccugugcagacuggagcacaccacccugagaaaggugaccgccaacaccgccaucuacuacgaccccaacccccagagcaccgugguggccgaggaccaggagugggugaacguguacuacgagaugcccgacuucgacguggccagaaucagccccuggcugcugagaguggagcuggacagaaagcacaugaccgacagaaagcugaccauggagcagaucgccgagaagaucaacgccggcuucggcgacgaccugaacugcaucuucaacgacgacaacgccgagaagcuggugcugagaaucagaaucaugaacagcgacgagaacaagaugcaggaggaggaggaggugguggacaagauggacgacgacguguuccugagaugcaucgagagcaacaugcugaccgacaugacccugcagggcaucgagcagaucagcaagguguacaugcaccugccccagaccgacaacaagaagaagaucaucaucaccgaggacggcgaguucaaggcccugcaggaguggauccuggagaccgacggcgugagccugaugagagugcugagcgagaaggacguggaccccgugagaaccaccagcaacgacaucguggagaucuucaccgugcugggcaucgaggccgugagaaaggcccuggagagagagcuguaccacgugaucagcuucgacggcagcuacgugaacuacagacaccuggcccugcugugcgacaccaugaccugcagaggccaccugauggccaucaccagacacggcgugaacagacaggacaccggcccccugaugaagugcagcuucgaggagaccguggacgugcugauggaggccgccgcccacggcgagagcgaccccaugaagggcgugagcgagaacaucaugcugggccagcuggcccccgccggcaccggcugcuucgaccugcugcuggacgccgagaagugcaaguacggcauggagauccccaccaacauccccggccugggcgccgccggccccaccggcauguucuucggcagcgcccccagccccaugggcggcaucagccccgccaugacccccuggaaccagggcgccacccccgccuacggcgccuggagccccagcgugggcagcggcaugacccccggcgccgccggcuucagccccagcgccgccagcgacgccagcggcuucagccccggcuacagccccgccuggagccccacccccggcagccccggcagccccggccccagcagccccuacauccccagccccggcggcgccaugagccccagcuacagccccaccagccccgccuacgagcccagaagccccggcggcuacaccccccagagccccagcuacagccccaccagccccagcuacagccccaccagccccagcuacagccccaccagccccaacuacagccccaccagccccagcuacagccccaccagccccagcuacagccccaccagccccagcuacagccccaccagccccagcuacagccccaccagccccagcuacagccccaccagccccagcuacagccccaccagccccagcuacagccccaccagccccagcuacagccccaccagccccagcuacagccccaccagccccagcuacagccccaccagccccagcuacagccccaccagccccagcuacagccccaccagccccagcuacagccccaccagccccagcuacagccccaccagccccagcuacagccccaccagccccaacuacagccccaccagccccaacuacacccccaccagccccagcuacagccccaccagccccagcuacagccccaccagccccaacuacacccccaccagccccaacuacagccccaccagccccagcuacagccccaccagccccagcuacagccccaccagccccagcuacagccccagcagccccagauacaccccccagagccccaccuacacccccagcagccccagcuacagccccagcagccccagcuacagccccaccagccccaaguacacccccaccagccccagcuacagccccagcagccccgaguacacccccaccagccccaaguacagccccaccagccccaaguacagccccaccagccccaaguacagccccaccagccccaccuacagccccaccacccccaaguacagccccaccagccccaccuacagccccaccagccccguguacacccccaccagccccaaguacagccccaccagccccaccuacagccccaccagccccaaguacagccccaccagccccaccuacagccccaccagccccaagggcagcaccuacagccccaccagccccggcuacagccccaccagccccaccuacagccugaccagccccgccaucagccccgacgacagcgacgaggagaacuaa

SEQ ID NO: 21778 - RNA, 3525 nt, Artificial Sequence
  POLR2B__Homo_sapiens__NP_000929
auguacgacgccgacgaggacaugcaguacgacgaggacgacgacgagaucacccccgaccuguggcaggaggccugcuggaucgugaucagcagcuacuucgacgagaagggccuggugagacagcagcuggacagcuucgacgaguucauccagaugagcgugcagagaaucguggaggacgccccccccaucgaccugcaggccgaggcccagcacgccagcggcgagguggaggagccccccagauaccugcugaaguucgagcagaucuaccugagcaagcccacccacugggagagagacggcgcccccagccccaugaugcccaacgaggccagacugagaaaccugaccuacagcgccccccuguacguggacaucaccaagaccgugaucaaggagggcgaggagcagcugcagacccagcaccagaagaccuucaucggcaagauccccaucaugcugagaagcaccuacugccugcugaacggccugaccgacagagaccugugcgagcugaacgagugcccccuggaccccggcggcuacuucaucaucaacggcagcgagaaggugcugaucgcccaggagaagauggccaccaacaccguguacguguucgccaagaaggacagcaaguacgccuacaccggcgagugcagaagcugccuggagaacagcagcagacccaccagcaccaucugggugagcaugcuggccagaggcggccagggcgccaagaagagcgccaucggccagagaaucguggccacccugcccuacaucaagcaggaggugcccaucaucaucguguucagagcccugggcuucgugagcgacagagacauccuggagcacaucaucuacgacuucgaggaccccgagaugauggagauggugaagcccagccuggacgaggccuucgugauccaggagcagaacguggcccugaacuucaucggcagcagaggcgccaagcccggcgugaccaaggagaagagaaucaaguacgccaaggaggugcugcagaaggagaugcugccccacgugggcgugagcgacuucugcgagaccaagaaggccuacuuccugggcuacauggugcacagacugcugcuggccgcccugggcagaagagagcuggacgacagagaccacuacggcaacaagagacuggaccuggccggcccccugcuggccuuccuguucagaggcauguucaagaaccugcugaaggaggugagaaucuacgcccagaaguucaucgacagaggcaaggacuucaaccuggagcuggccaucaagaccagaaucaucagcgacggccugaaguacagccuggccaccggcaacuggggcgaccagaagaaggcccaccaggccagagccggcgugagccaggugcugaacagacugaccuucgccagcacccugagccaccugagaagacugaacagccccaucggcagagacggcaagcuggccaagcccagacagcugcacaacacccuguggggcauggugugccccgccgagacccccgagggccacgccgugggccuggugaagaaccuggcccugauggccuacaucagcgugggcagccagcccagccccauccuggaguuccuggaggaguggagcauggagaaccuggaggagaucagccccgccgccaucgccgacgccaccaagaucuucgugaacggcugcugggugggcauccacaaggaccccgagcagcugaugaacacccugagaaagcugagaagacagauggacaucaucgugagcgaggugagcaugaucagagacaucagagagagagagaucagaaucuacaccgacgccggcagaaucugcagaccccugcugaucguggagaagcagaagcugcugcugaagaagagacacaucgaccagcugaaggagagagaguacaacaacuacagcuggcaggaccugguggccagcggcgugguggaguacaucgacacccuggaggaggagaccgugaugcuggccaugacccccgacgaccugcaggagaaggagguggccuacugcagcaccuacacccacugcgagauccaccccagcaugauccugggcgugugcgccagcaucauccccuuccccgaccacaaccagagccccagaaacaccuaccagagcgccaugggcaagcaggccaugggcguguacaucaccaacuuccacgugagaauggacacccuggcccacgugcuguacuacccccagaagccccuggugaccaccagaagcauggaguaccugagauucagagagcugcccgccggcaucaacagcaucguggccaucgccagcuacaccggcuacaaccaggaggacagcgugaucaugaacagaagcgccguggacagaggcuucuucagaagcguguucuacagaagcuacaaggagcaggagagcaagaagggcuucgaccaggaggagguguucgagaagcccaccagagagaccugccagggcaugagacacgccaucuacgacaagcuggacgacgacggccugaucgcccccggcgugagagugagcggcgacgacgugaucaucggcaagaccgugacccugcccgagaacgaggacgagcuggagagcaccaacagaagauacaccaagagagacugcagcaccuuccugagaaccagcgagaccggcaucguggaccaggugauggugacccugaaccaggagggcuacaaguucugcaagaucagagugagaagcgugagaaucccccagaucggcgacaaguucgccagcagacacggccagaagggcaccugcggcauccaguacagacaggaggacaugcccuucaccugcgagggcaucacccccgacaucaucaucaacccccacgccauccccagcagaaugaccaucggccaccugaucgagugccugcagggcaaggugagcgccaacaagggcgagaucggcgacgccacccccuucaacgacgccgugaacgugcagaagaucagcaaccugcugagcgacuacggcuaccaccugagaggcaacgaggugcuguacaacggcuucaccggcagaaagaucaccagccagaucuucaucggccccaccuacuaccagagacugaagcacaugguggacgacaagauccacagcagagccagaggccccauccagauccugaacagacagcccauggagggcagaagcagagacggcggccugagauucggcgagauggagagagacugccagaucgcccacggcgccgcccaguuccugagagagagacuguucgaggccagcgaccccuaccaggugcacgugugcaaccugugcggcaucauggccaucgccaacaccagaacccacaccuacgagugcagaggcugcagaaacaagacccagaucagccuggugagaaugcccuacgccugcaagcugcuguuccaggagcugaugagcaugagcaucgcccccagaaugaugagcguguaa

SEQ ID NO: 21779 - RNA, 828 nt, Artificial Sequence
  POLR2C__Homo_sapiens__NP_116558
augcccuacgccaaccagcccaccgugagaaucaccgagcugaccgacgagaacgugaaguucaucaucgagaacaccgaccuggccguggccaacagcaucagaagaguguucaucgccgaggugcccaucaucgccaucgacugggugcagaucgacgccaacagcagcgugcugcacgacgaguucaucgcccacagacugggccugaucccccugaucagcgacgacaucguggacaagcugcaguacagcagagacugcaccugcgaggaguucugccccgagugcagcguggaguucacccuggacgugagaugcaacgaggaccagaccagacacgugaccagcagagaccugaucagcaacagccccagagugauccccgugaccagcagaaacagagacaacgaccccaacgacuacguggagcaggacgacauccugaucgugaagcugagaaagggccaggagcugagacugagagccuacgccaagaagggcuucggcaaggagcacgccaaguggaaccccaccgccggcguggccuucgaguacgaccccgacaacgcccugagacacaccguguaccccaagcccgaggaguggcccaagagcgaguacagcgagcuggacgaggacgagagccaggcccccuacgaccccaacggcaagcccgagagauucuacuacaacguggagagcugcggcagccugagacccgagaccaucgugcugagcgcccugagcggccugaagaagaagcugagcgaccugcagacccagcugagccacgagauccagagcgacgugcugaccaucaacuaa

SEQ ID NO: 21780 - RNA, 429 nt, Artificial Sequence
  POLR2D__Homo_sapiens__NP_004796
auggccgccggcggcagcgaccccagagccggcgacguggaggaggacgccagccagcugaucuuccccaaggaguucgagaccgccgagacccugcugaacagcgaggugcacaugcugcuggagcacagaaagcagcagaacgagagcgccgaggacgagcaggagcugagcgagguguucaugaagacccugaacuacaccgccagauucagcagauucaagaacagagagaccaucgccagcgugagaagccugcugcugcagaagaagcugcacaaguucgagcuggccugccuggccaaccugugccccgagaccgccgaggagagcaaggcccugauccccagccuggagggcagauucgaggacgaggagcugcagcagauccuggacgacauccagaccaagagaagcuuccaguacuaa

SEQ ID NO: 21781 - RNA, 633 nt, Artificial Sequence
  POLR2E__Homo_sapiens__NP_002686
auggacgacgaggaggagaccuacagacuguggaagaucagaaagaccaucaugcagcugugccacgacagaggcuaccuggugacccaggacgagcuggaccagacccuggaggaguucaaggcccaguucggcgacaagcccagcgagggcagacccagaagaaccgaccugaccgugcugguggcccacaacgacgaccccaccgaccagauguucguguucuuccccgaggagcccaaggugggcaucaagaccaucaagguguacugccagagaaugcaggaggagaacaucaccagagcccugaucguggugcagcagggcaugacccccagcgccaagcagagccugguggacauggcccccaaguacauccuggagcaguuccugcagcaggagcugcugaucaacaucaccgagcacgagcuggugcccgagcacguggugaugaccaaggaggaggugaccgagcugcuggccagauacaagcugagagagaaccagcugcccagaauccaggccggcgaccccguggccagauacuucggcaucaagagaggccagguggugaagaucaucagacccagcgagaccgccggcagauacaucaccuacagacuggugcaguaa

SEQ ID NO: 21782 - RNA, 357 nt, Artificial Sequence
  POLR2F__Homo_sapiens__NP_001288058
auggugagcaucagcugccuggugaucagaccccccagaccccccaaggugcugggccugcaggagggccaggagaacguggagauccugcccagcggcgagagaccccaggccaaccagaagagaaucaccacccccuacaugaccaaguacgagagagccagagugcugggcaccagagcccugcagaucgccaugugcgcccccgugaugguggagcuggagggcgagaccgacccccugcugaucgccaugaaggagcugaaggccagaaagauccccaucaucaucagaagauaccugcccgacggcagcuacgaggacuggggcguggacgagcugaucaucaccgacuaa

SEQ ID NO: 21783 - RNA, 519 nt, Artificial Sequence
  POLR2G__Homo_sapiens__NP_002687
auguucuaccacaucagccuggagcacgagauccugcugcaccccagauacuucggccccaaccugcugaacaccgugaagcagaagcuguucaccgagguggagggcaccugcaccggcaaguacggcuucgugaucgccgugaccaccaucgacaacaucggcgccggcgugauccagcccggcagaggcuucgugcuguaccccgugaaguacaaggccaucguguucagacccuucaagggcgaggugguggacgccguggugacccaggugaacaaggugggccuguucaccgagaucggccccaugagcugcuucaucagcagacacagcauccccagcgagauggaguucgaccccaacagcaacccccccugcuacaagaccauggacgaggacaucgugauccagcaggacgacgagaucagacugaagaucgugggcaccagaguggacaagaacgacaucuucgccaucggcagccugauggacgacuaccugggccuggugagcuaa

SEQ ID NO: 21784 - RNA, 369 nt, Artificial Sequence
  POLR2H__Homo_sapiens__NP_001265643
auggccggcauccuguucgaggacaucuucgacgugaaggacaucgaccccgagggcaagaaguucgacagagugagcagacugcacugcgagagcgagagcuucaagauggaccugauccuggacgugaacauccagaucuaccccguggaccugggcgacaaguucagacuggugaucgccagcacccuguacgaggacggcacccuggacgacggcgaguacaaccccaccgacgacagacccagcagcagcgccuacgugagcuacggcggccugcugaugagacugcagggcgacgccaacaaccugcacggcuucgagguggacagcagaguguaccugcugaugaagaagcuggccuucuaa

SEQ ID NO: 21785 - RNA, 354 nt, Artificial Sequence
  POLR2J__Homo_sapiens__NP_006225
augaacgccccccccgccuucgagagcuuccugcuguucgagggcgagaagaagaucaccaucaacaaggacaccaaggugcccaacgccugccuguucaccaucaacaaggaggaccacacccugggcaacaucaucaagagccagcugcugaaggacccccaggugcuguucgccggcuacaaggugccccacccccuggagcacaagaucaucaucagagugcagaccacccccgacuacagcccccaggaggccuucaccaacgccaucaccgaccugaucagcgagcugagccugcuggaggagagauucagaguggccaucaaggacaagcaggagggcaucgaguaa

SEQ ID NO: 21786 - RNA, 177 nt, Artificial Sequence
  POLR2K__Homo_sapiens__NP_005025
auggacacccagaaggacgugcagccccccaagcagcagcccaugaucuacaucugcggcgagugccacaccgagaacgagaucaagagcagagaccccaucagaugcagagagugcggcuacagaaucauguacaagaagagaaccaagagacuggugguguucgacgccagauaa

SEQ ID NO: 21787 - RNA, 636 nt, Artificial Sequence
  POLR2M__Homo_sapiens__NP_001018112
augugcagccugcccagaggcuucgagccccaggcccccgaggaccuggcccagagaagccugguggagcugagagagaugcugaagagacaggagagacugcugagaaacgagcugcagagaaucaccaucgccgaccagggcgagcagcagagcgaggagaacgccagcaccaagaaccugaccggccugagcagcggcaccgagaagaagccccacuacauggaggugcuggagaugagagccaagaaccccgugccccagcugagaaaguucaagaccaacgugcugcccuucagacagaacgacagcagcagccacugccagaagagcggcagccccaucagcagcgaggagagaagaagaagagacaagcagcaccuggacgacaucaccgccgccagacugcugccccugcaccacaugcccacccagcugcugagcaucgaggagagccuggcccugcagaagcagcagaagcagaacuacgaggagaugcaggccaagcuggccgcccagaagcuggccgagagacugaacaucaagaugagaagcuacaaccccgagggcgagagcagcggcagauacagagaggugagagacgaggacgacgacuggagcagcgacgaguucuaa

SEQ ID NO: 21788 - RNA, 4173 nt, Artificial Sequence
  POLR3A__Homo_sapiens__NP_008986
auggugaaggagcaguucagagagaccgacguggccaagaagaucagccacaucugcuucggcaugaagagccccgaggagaugagacagcaggcccacauccagguggugagcaagaaccuguacagccaggacaaccagcacgccccccugcuguacggcgugcuggaccacagaaugggcaccagcgagaaggacagacccugcgagaccugcggcaagaaccuggccgacugccugggccacuacggcuacaucgaccuggagcugcccugcuuccacgugggcuacuucagagccgugaucggcauccugcagaugaucugcaagaccugcugccacaucaugcugagccaggaggagaagaagcaguuccuggacuaccugaagagacccggccugaccuaccugcagaagagaggccugaagaagaagaucagcgacaagugcagaaagaagaacaucugccaccacugcggcgccuucaacggcaccgugaagaagugcggccugcugaagaucauccacgagaaguacaagaccaacaagaaggugguggaccccaucgugagcaacuuccugcagagcuucgagaccgccaucgagcacaacaaggagguggagccccugcugggcagagcccaggagaaccugaacccccugguggugcugaaccuguucaagagaauccccgccgaggacgugccccugcugcugaugaaccccgaggccggcaagcccagcgaccugauccugaccagacugcuggugcccccccugugcaucagacccagcguggugagcgaccugaagagcggcaccaacgaggacgaccugaccaugaagcugaccgagaucaucuuccugaacgacgugaucaagaagcacagaaucagcggcgccaagacccagaugaucauggaggacugggacuuccugcagcugcagugcgcccuguacaucaacagcgagcugagcggcaucccccugaacauggcccccaagaaguggaccagaggcuucgugcagagacugaagggcaagcagggcagauucagaggcaaccugagcggcaagagaguggacuucagcggcagaaccgugaucagccccgaccccaaccugagaaucgacgagguggccgugcccgugcacguggccaagauccugaccuuccccgagaaggugaacaaggccaacaucaacuuccugagaaagcuggugcagaacggccccgaggugcaccccggcgccaacuucauccagcagagacacacccagaugaagagauuccugaaguacggcaacagagagaagauggcccaggagcugaaguacggcgacaucguggagagacaccugaucgacggcgacguggugcuguucaacagacagcccagccugcacaagcugagcaucauggcccaccuggccagagugaagccccacagaaccuucagauucaacgagugcgugugcacccccuacaacgccgacuucgacggcgacgagaugaaccugcaccugccccagaccgaggaggccaaggccgaggcccuggugcugaugggcaccaaggccaaccuggugacccccagaaacggcgagccccugaucgccgccauccaggacuuccugaccggcgccuaccugcugacccugaaggacaccuucuucgacagagccaaggccugccagaucaucgccagcauccuggugggcaaggacgagaagaucaaggugagacugcccccccccaccauccugaagcccgugacccuguggaccggcaagcagaucuucagcgugauccugagacccagcgacgacaaccccgugagagccaaccugagaaccaagggcaagcaguacugcggcaagggcgaggaccugugcgccaacgacagcuacgugaccauccagaacagcgagcugaugagcggcagcauggacaagggcacccugggcagcggcagcaagaacaacaucuucuacauccugcugagagacuggggccagaacgaggccgccgacgccaugagcagacuggccagacuggcccccguguaccugagcaacagaggcuucagcaucggcaucggcgacgugacccccggccagggccugcugaaggccaaguacgagcugcugaacgccggcuacaagaagugcgacgaguacaucgaggcccugaacaccggcaagcugcagcagcagcccggcugcaccgccgaggagacccuggaggcccugauccugaaggagcugagcgugaucagagaccacgccggcagcgccugccugagagagcuggacaagagcaacagcccccugaccauggcccugugcggcagcaagggcagcuucaucaacaucagccagaugaucgccugcgugggccagcaggccaucagcggcagcagagugcccgacggcuucgagaacagaagccugccccacuucgagaagcacagcaagcugcccgccgccaagggcuucguggccaacagcuucuacagcggccugacccccaccgaguucuucuuccacaccauggccggcagagagggccugguggacaccgccgugaagaccgccgagaccggcuacaugcagagaagacuggugaagagccuggaggaccugugcagccaguacgaccugaccgugagaagcagcaccggcgacaucauccaguucaucuacggcggcgacggccuggaccccgccgccauggagggcaaggacgagccccuggaguucaagagagugcuggacaacaucaaggccguguuccccugccccagcgagcccgcccugagcaagaacgagcugauccugaccaccgagagcaucaugaagaagagcgaguuccugugcugccaggacagcuuccugcaggagaucaagaaguucaucaagggcgugagcgagaagaucaagaagaccagagacaaguacggcaucaacgacaacggcaccaccgagcccagagugcuguaccagcuggacagaaucacccccacccagguggagaaguuccuggagaccugcagagacaaguacaugagagcccagauggagcccggcagcgccgugggcgcccugugcgcccagagcaucggcgagcccggcacccagaugacccugaagaccuuccacuucgccggcguggccagcaugaacaucacccugggcgugcccagaaucaaggagaucaucaacgccagcaaggccaucagcacccccaucaucaccgcccagcuggacaaggacgacgacgccgacuacgccagacuggugaagggcagaaucgagaagacccugcugggcgagaucagcgaguacaucgaggagguguuccugcccgacgacugcuucauccuggugaagcugagccuggagagaaucagacugcugagacuggaggugaacgccgagaccgugagauacagcaucugcaccagcaagcugagagugaagcccggcgacguggccgugcacggcgaggccguggugugcgugacccccagagagaacagcaagagcagcauguacuacgugcugcaguuccugaaggaggaccugcccaaggugguggugcagggcauccccgaggugagcagagccgugauccacaucgacgagcagagcggcaaggagaaguacaagcugcugguggagggcgacaaccugagagccgugauggccacccacggcgugaagggcaccagaaccaccagcaacaacaccuacgagguggagaagacccugggcaucgaggccgccagaaccaccaucaucaacgagauccaguacaccauggugaaccacggcaugagcaucgacagaagacacgugaugcugcugagcgaccugaugaccuacaagggcgaggugcugggcaucaccagauucggccuggccaagaugaaggagagcgugcugaugcuggccagcuucgagaagaccgccgaccaccuguucgacgccgccuacuucggccagaaggacagcgugugcggcgugagcgagugcaucaucaugggcauccccaugaacaucggcaccggccuguucaagcugcugcacaaggccgacagagaccccaacccccccaagagaccccugaucuucgacaccaacgaguuccacaucccccuggugaccuaa

SEQ ID NO: 21789 - RNA, 3228 nt, Artificial Sequence
  POLR3B__Homo_sapiens__NP_001154180
augaaggccaacgagaaggugaccagcgacgccgaccccaugugguaccugaaguaccugaacaucuacgugggccugcccgacguggaggagagcuucaacgugaccagacccgugagcccccacgagugcagacugagagacaugaccuacagcgcccccaucaccguggacaucgaguacaccagaggcagccagagaaucaucagaaacgcccugcccaucggcagaaugcccaucaugcugagaagcagcaacugcgugcugaccggcaagacccccgccgaguucgccaagcugaacgagugcccccuggaccccggcggcuacuucaucgugaagggcguggagaaggugauccugauccaggagcagcugagcaagaacagaaucaucguggaggccgacagaaagggcgccgugggcgccagcgugaccagcagcacccacgagaagaagagcagaaccaacauggccgugaagcagggcagauucuaccugagacacaacacccugagcgaggacauccccaucgugaucaucuucaaggccaugggcguggagagcgaccaggagaucgugcagaugaucggcaccgaggagcacgugauggccgccuucggccccagccuggaggagugccagaaggcccagaucuucacccagaugcaggcccugaaguacaucggcaacaaggugagaagacagagaauguggggcggcggccccaagaagaccaagaucgaggaggccagagagcugcuggccagcaccauccugacccacgugcccgugaaggaguucaacuucagagccaagugcaucuacaccgccgugauggugagaagagugauccuggcccagggcgacaacaagguggacgacagagacuacuacggcaacaagagacuggagcuggccggccagcugcugagccugcuguucgaggaccuguucaagaaguucaacagcgagaugaagaagaucgccgaccaggugauccccaagcagagagccgcccaguucgacguggugaagcacaugagacaggaccagaucaccaacggcauggugaacgccaucagcaccggcaacuggagccugaagagauucaagauggacagacagggcgugacccaggugcugagcagacugagcuacaucagcgcccugggcaugaugaccagaaucagcagccaguucgagaagaccagaaaggugagcggccccagaagccugcagcccagccaguggggcaugcugugccccagcgacacccccgagggcgaggccugcggccuggugaagaaccuggcccugaugacccacaucaccaccgacauggaggacggccccaucgugaagcuggccagcaaccugggcguggaggacgugaaccugcugugcggcgaggagcugagcuaccccaacguguuccugguguuccugaacggcaacauccugggcgugaucagagaccacaagaagcuggugaacaccuucagacugaugagaagagccggcuacaucaacgaguucgugagcaucagcaccaaccugaccgacagaugcguguacaucagcagcgacggcggcagacugugcagacccuacaucaucgugaagaagcagaagcccgccgugaccaacaagcacauggaggagcuggcccagggcuacagaaacuucgaggacuuccugcacgagagccugguggaguaccuggacgugaacgaggagaacgacugcaacaucgcccuguacgagcacaccaucaacaaggacaccacccaccuggagaucgagcccuucacccugcugggcgugugcgccggccugauccccuacccccaccacaaccagagccccagaaacaccuaccagugcgccaugggcaagcaggccaugggcaccaucggcuacaaccagagaaacagaaucgacacccugauguaccugcuggccuacccccagaagcccauggugaagaccaagaccaucgagcugaucgaguucgagaagcugcccgccggccagaacgccaccguggccgugaugagcuacagcggcuacgacaucgaggacgcccuggugcugaacaaggccagccuggacagaggcuucggcagaugccugguguacaagaacgccaagugcacccugaagagauacaccaaccagaccuucgacaaggugaugggccccaugcuggacgccgccaccagaaagcccaucuggagacacgagauccuggacgccgacggcaucugcagccccggcgagaagguggagaacaagcaggugcuggugaacaagagcaugcccaccgugacccagaucccccuggagggcagcaacgugccccagcagccccaguacaaggacgugcccaucaccuacaagggcgccaccgacagcuacaucgagaaggugaugaucagcagcaacgccgaggacgccuuccugaucaagaugcugcugagacagaccagaagacccgagaucggcgacaaguucagcagcagacacggccagaagggcgugugcggccugaucgugccccaggaggacaugcccuucugcgacagcggcaucugccccgacaucaucaugaacccccacggcuuccccagcagaaugaccgugggcaagcugaucgagcugcuggccggcaaggccggcgugcuggacggcagauuccacuacggcaccgccuucggcggcagcaaggugaaggacgugugcgaggaccuggugagacacggcuacaacuaccugggcaaggacuacgugaccagcggcaucaccggcgagccccuggaggccuacaucuacuucggccccguguacuaccagaagcugaagcacauggugcuggacaagaugcacgccagagccagaggccccagagccgugcugaccagacagcccaccgagggcagaagcagagacggcggccugagacugggcgagauggagagagacugccugaucggcuacggcgccagcaugcugcugcuggagagacugaugaucagcagcgacgccuucgagguggacgugugcggccagugcggccugcugggcuacagcggcuggugccacuacugcaagagcagcugccacgugagcagccugagaauccccuacgccugcaagcugcuguuccaggagcugcagagcaugaacaucauccccagacugaagcugagcaaguacaacgaguaa

SEQ ID NO: 21790 - RNA, 2064 nt, Artificial Sequence
  POLR3E__Homo_sapiens__NP_001244962
auggccaacgaggaggacgaccccguggugcaggagaucgacguguaccuggccaagagccuggccgagaagcuguaccuguuccaguaccccgugagacccgccagcaugaccuacgacgacaucccccaccugagcgccaagaucaagcccaagcagcagaagguggagcuggagauggccaucgacacccugaaccccaacuacugcagaagcaagggcgagcagaucgcccugaacguggacggcgccugcgccgacgagaccagcaccuacagcagcaagcugauggacaagcagaccuucugcagcagccagaccaccagcaacaccagcagauacgccgccgcccuguacagacagggcgagcugcaccugaccccccugcacggcauccugcagcugagacccagcuucagcuaccuggacaaggccgacgccaagcacagagagagagaggccgccaacgaggccggcgacagcagccaggacgaggccgaggacgacgugaagcagaucaccgugagauucagcagacccgagagcgagcaggccagacagagaagagugcagagcuacgaguuccugcagaagaagcacgccgaggagcccugggugcaccugcacuacuacggccugagagacagcagaagcgagcacgagagacaguaccugcugugccccggcagcagcggcguggagaacaccgagcuggugaagagccccagcgaguaccugaugaugcugaugccccccagccaggaggaggagaaggacaagcccguggcccccagcaacgugcugagcauggcccagcugagaacccugccccuggccgaccagaucaagauccugaugaagaacgugaaggugaugcccuucgccaaccugaugagccugcugggccccagcaucgacagcguggccgugcugagaggcauccagaagguggccaugcuggugcagggcaacuggguggugaagagcgacauccuguaccccaaggacagcagcagcccccacagcggcgugcccgccgaggugcugugcagaggcagagacuucgugauguggaaguucacccagagcagauggguggugagaaaggagguggccaccgugaccaagcugugcgccgaggacgugaaggacuuccuggagcacauggccguggugagaaucaacaagggcugggaguucauccugcccuacgacggcgaguucaucaagaagcaccccgacguggugcagagacagcacaugcuguggaccggcauccaggccaagcuggagaagguguacaaccuggugaaggagaccaugcccaagaagcccgacgcccagagcggccccgccggccuggugugcggcgaccagagaauccagguggccaagaccaaggcccagcagaaccacgcccugcuggagagagagcugcagagaagaaaggagcagcugagagugcccgccgugccccccggcgugagaaucaaggaggagcccgugagcgaggagggcgaggaggacgaggagcaggaggccgaggaggagcccauggacaccagccccagcggccugcacagcaagcuggccaacggccugccccugggcagagccgccggcaccgacagcuucaacggccaccccccccagggcugcgccagcacccccguggccagagagcugaaggccuucguggaggccaccuuccagagacaguucgugcugacccugagcgagcugaagagacuguucaaccugcaccuggccagccugccccccggccacacccuguucagcggcaucagcgacagaaugcugcaggacaccgugcuggccgccggcugcaagcagauccuggugcccuuccccccccagaccgccgccagccccgacgagcagaagguguucgcccugugggagagcggcgacaugagcgaccagagcagacugacccaggagugcggcgaggaccugagcaagcaggagguggacaaggugcugaaggacugcugcgugagcuacggcggcaugugguaccugaagggcaccgugcagagcuaa

SEQ ID NO: 21791 - RNA, 327 nt, Artificial Sequence
  POLR3K__Homo_sapiens__NP_057394
augcugcuguucugccccggcugcggcaacggccugaucguggaggagggccagagaugccacagauucgccugcaacaccugccccuacgugcacaacaucaccagaaaggugaccaacagaaaguaccccaagcugaaggagguggacgacgugcugggcggcgccgccgccugggagaacguggacagcaccgccgagagcugccccaagugcgagcaccccagagccuacuucaugcagcugcagaccagaagcgccgacgagcccaugaccaccuucuacaagugcugcaacgcccagugcggccacagauggagagacuaa

SEQ ID NO: 21792 - RNA, 3693 nt, Artificial Sequence
  POLRMT__Homo_sapiens__NP_005026
augagcgcccugugcuggggcagaggcgccgccggccugaagagagcccugagacccugcggcagacccggccugcccggcaaggagggcaccgccggcggcgugugcggccccagaagaagcagcagcgccagcccccaggagcaggaccaggacagaagaaaggacuggggccacguggagcugcuggaggugcugcaggccagagugagacagcugcaggccgagagcgugagcgaggugguggugaacagaguggacguggccagacugcccgagugcggcagcggcgacggcagccugcagccccccagaaaggugcagaugggcgccaaggacgccacccccgugcccugcggcagaugggccaagauccuggagaaggacaagagaacccagcagaugagaaugcagagacugaaggccaagcugcagaugcccuuccagagcggcgaguucaaggcccugaccagaagacugcagguggagcccagacugcugagcaagcagauggccggcugccuggaggacugcaccagacaggcccccgagagccccugggaggagcagcuggccagacugcugcaggaggcccccggcaagcugagccuggacguggagcaggcccccagcggccagcacagccaggcccagcugagcggccagcagcagagacugcuggccuucuucaagugcugccugcugaccgaccagcugccccuggcccaccaccugcugguggugcaccacggccagagacagaagagaaagcugcugacccuggacauguacaacgccgugaugcugggcugggccagacagggcgccuucaaggagcugguguacgugcuguucauggugaaggacgccggccugacccccgaccugcugagcuacgccgccgcccugcagugcaugggcagacaggaccaggacgccggcaccaucgagagaugccuggagcagaugagccaggagggccugaagcugcaggcccuguucaccgccgugcugcugagcgaggaggacagagccaccgugcugaaggccgugcacaaggugaagcccaccuucagccugcccccccagcugcccccccccgugaacaccagcaagcugcugagagacguguacgccaaggacggcagagugagcuaccccaagcugcaccugccccugaagacccugcagugccuguucgagaagcagcugcacauggagcuggccagcagagugugcguggugagcguggagaagcccacccugcccagcaaggaggugaagcacgccagaaagacccugaagacccugagagaccagugggagaaggcccugugcagagcccugagagagaccaagaacagacuggagagagagguguacgagggcagauucagccuguaccccuuccugugccugcuggacgagagagagguggugagaaugcugcugcaggugcugcaggcccugcccgcccagggcgagagcuucaccacccuggccagagagcugagcgccagaaccuucagcagacacguggugcagagacagagagugagcggccaggugcaggcccugcagaaccacuacagaaaguaccugugccugcuggccagcgacgccgaggugcccgagcccugccugcccagacaguacugggaggagcugggcgcccccgaggcccugagagagcagcccuggccccugcccgugcagauggagcugggcaagcugcuggccgagaugcuggugcaggccacccagaugcccugcagccuggacaagccccacagaagcagcagacuggugcccgugcuguaccacguguacagcuucagaaacgugcagcagaucggcauccugaagccccaccccgccuacgugcagcugcuggagaaggccgccgagcccacccugaccuucgaggccguggacgugcccaugcugugccccccccugcccuggaccagcccccacagcggcgccuuccugcugagccccaccaagcugaugagaaccguggagggcgccacccagcaccaggagcugcuggagaccugcccccccaccgcccugcacggcgcccuggacgcccugacccagcugggcaacugcgccuggagagugaacggcagagugcuggaccuggugcugcagcuguuccaggccaagggcugcccccagcugggcgugcccgccccccccagcgaggccccccagccccccgaggcccaccugccccacagcgccgcccccgccagaaaggccgagcugagaagagagcuggcccacugccagaagguggccagagagaugcacagccugagagccgaggcccuguacagacugagccuggcccagcaccugagagacagaguguucuggcugccccacaacauggacuucagaggcagaaccuaccccugccccccccacuucaaccaccugggcagcgacguggccagagcccugcuggaguucgcccagggcagaccccugggcccccacggccuggacuggcugaagauccaccuggugaaccugaccggccugaagaagagagagccccugagaaagagacuggccuucgccgaggaggugauggacgacauccuggacagcgccgaccagccccugaccggcagaaagugguggaugggcgccgaggagcccuggcagacccuggccugcugcauggagguggccaacgccgugagagccagcgaccccgccgccuacgugagccaccugcccgugcaccaggacggcagcugcaacggccugcagcacuacgccgcccugggcagagacagcgugggcgccgccagcgugaaccuggagcccagcgacgugccccaggacguguacagcggcguggccgcccagguggagguguucagaagacaggacgcccagagaggcaugagaguggcccaggugcuggagggcuucaucaccagaaagguggugaagcagaccgugaugaccgugguguacggcgugaccagauacggcggcagacugcagaucgagaagagacugagagagcugagcgacuucccccaggaguucgugugggaggccagccacuaccuggugagacagguguucaagagccugcaggagauguucagcggcaccagagccauccagcacuggcugaccgagagcgccagacugaucagccacaugggcagcgugguggagugggugaccccccugggcgugcccgugauccagcccuacagacuggacagcaaggugaagcagaucggcggcggcauccagagcaucaccuacacccacaacggcgacaucagcagaaagcccaacaccagaaagcagaagaacggcuucccccccaacuucauccacagccuggacagcagccacaugaugcugaccgcccugcacugcuacagaaagggccugaccuucgugagcgugcacgacugcuacuggacccacgccgccgacgugagcgugaugaaccaggugugcagagagcaguucgugagacugcacagcgagcccauccugcaggaccugagcagauuccuggugaagagauucugcagcgagccccagaagauccuggaggccagccagcugaaggagacccugcaggccgugcccaagcccggcgccuucgaccuggagcaggugaagagaagcaccuacuucuucagcuaa

SEQ ID NO: 21793 - RNA, 3000 nt, Artificial Sequence
  POM121__Homo_sapiens__NP_001244119
auggugugcagccccgugaccgugagaaucgccccccccgacagaagauucagcagaagcgccauccccgagcagaucaucagcagcacccugagcagccccagcagcaacgcccccgaccccugcgccaaggagaccgugcugagcgcccugaaggagaaggagaagaagagaaccguggaggaggaggaccagaucuuccuggacggccaggagaacaagagaagaagacacgacagcagcggcagcggccacagcgccuucgagccccugguggccaacggcgugcccgccagcuucgugcccaagcccggcagccugaagagaggccugaacagccagagcagcgacgaccaccugaacaagagaagcagaagcagcagcaugagcagccugaccggcgccuacgccagcggcauccccagcagcagcagaaacgccaucaccagcagcuacagcagcaccagaggcaucagccagcuguggaagagaaacggccccagcagcagccccuucagcagccccgccagcagcagaagccagacccccgagagacccgccaagaagaucagagaggaggagcugugccaccacagcagcagcagcaccccccuggccgccgacagagagagccagggcgagaaggccgccgacaccacccccagaaagaagcagaacagcaacagccagagcacccccggcagcagcggccagagaaagagaaaggugcagcugcugcccagcagaagaggcgagcagcugacccugcccccccccccccagcugggcuacagcaucaccgccgaggaccuggaccuggagaagaaggccagccugcagugguucaaccaggcccuggaggacaagagcgacgccgccagcaacagcgugaccgagaccccccccaucacccagcccagcuucaccuucacccugcccgccgccgcccccgccagcccccccaccagccugcuggcccccagcaccaacccccugcuggagagccugaagaagaugcagaccccccccagccugccccccugccccgagagcgccggcgccgccaccaccgaggcccugagcccccccaagacccccagccugcugcccccccugggccugagccagagcggcccccccggccugcugcccagccccagcuucgacagcaagccccccaccacccugcugggccugauccccgcccccagcauggugcccgccaccgacaccaaggccccccccacccugcaggccgagaccgccaccaagccccaggccaccagcgcccccagccccgcccccaagcagagcuuccuguucggcacccagaacaccagccccagcagccccgccgcccccgccgccagcagcgccccccccauguucaagcccaucuucaccgccccccccaagagcgagaaggagggccccaccccccccggccccagcgugaccgccaccgcccccagcagcagcagccugcccaccaccaccagcaccaccgcccccaccuuccagcccguguucagcagcaugggcccccccgccagcgugccccugcccgcccccuucuucaagcagaccaccacccccgccaccgcccccaccaccaccgccccccuguucaccggccuggccagcgccaccagcgccguggcccccaucaccagcgccagccccagcaccgacagcgccagcaagcccgccuucggcuucggcaucaacagcgugagcagcagcagcgugagcaccaccaccagcaccgccaccgccgccagccagcccuuccuguucggcgccccccaggccagcgccgccagcuucacccccgccaugggcagcaucuuccaguucggcaagccccccgcccugcccaccaccaccaccgugaccaccuucagccagagccugcacaccgccgugcccaccgccaccagcagcagcgccgccgacuucagcggcuucggcagcacccuggccaccagcgcccccgccaccagcagccagcccacccugaccuucagcaacaccagcacccccaccuucaacauccccuucggcagcagcgccaagagcccccugcccagcuaccccggcgccaacccccagcccgccuucggcgccgccgagggccagccccccggcgccgccaagcccgcccuggcccccagcuucggcagcagcuucaccuucggcaacagcgccgcccccgccgccgcccccacccccgccccccccagcaugaucaagguggugcccgccuacgugcccacccccauccaccccaucuucggcggcgccacccacagcgccuucggccugaaggccaccgccagcgccuucggcgcccccgccagcagccagcccgccuucggcggcagcaccgccguguucuucggcgccgccaccagcagcggcuucggcgccaccacccagaccgccagcagcggcagcagcagcagcguguucggcagcaccacccccagccccuucaccuucggcggcagcgccgcccccgccggcagcggcagcuucggcaucaacguggccacccccggcagcagcaccaccaccggcgccuucagcuucggcgccggccagagcggcagcaccgccaccagcacccccuucgccggcggccugggccagaacgcccugggcaccaccggccagagcacccccuucgccuucaacgugagcagcaccaccgagagcaagcccguguucggcggcaccgccacccccaccuucggccugaacacccccgcccccggcgugggcaccagcggcagcagccugagcuucggcgccagcagcgcccccgcccagggcuucgugggcguggcccccuucggcaacaccuucgcccaccagcaggagcacagccccagaaagggccccaacaaccugagcaagagaaagcugcugcccgccgugagagcccagggccugcccagaagaggccaggccagcagcuuccccaccagaaaggaguaa

SEQ ID NO: 21794 - RNA, 804 nt, Artificial Sequence
  POMC__Homo_sapiens__NP_001306134
augcccagaagcugcugcagcagaagcggcgcccugcugcuggcccugcugcugcaggccagcauggaggugagaggcuggugccuggagagcagccagugccaggaccugaccaccgagagcaaccugcuggagugcaucagagccugcaagcccgaccugagcgccgagacccccauguuccccggcaacggcgacgagcagccccugaccgagaaccccagaaaguacgugaugggccacuucagaugggacagauucggcagaagaaacagcagcagcagcggcagcagcggcgccggccagaagagagaggacgugagcgccggcgaggacugcggcccccugcccgagggcggccccgagcccagaagcgacggcgccaagcccggccccagagagggcaagagaagcuacagcauggagcacuucagauggggcaagcccgugggcaagaagagaagacccgugaagguguaccccaacggcgccgaggacgagagcgccgaggccuucccccuggaguucaagagagagcugaccggccagagacugagagagggcgacggccccgacggccccgccgacgacggcgccggcgcccaggccgaccuggagcacagccugcugguggccgccgagaagaaggacgagggccccuacagaauggagcacuucagauggggcagcccccccaaggacaagagauacggcggcuucaugaccagcgagaagagccagaccccccuggugacccuguucaagaacgccaucaucaagaacgccuacaagaagggcgaguaa

SEQ ID NO: 21795 - RNA, 1554 nt, Artificial Sequence
  POMGNT1__Homo_sapiens__NP_001277059
auggccaagagaguguucgacaccuacagcccccacgaggacgaggccauggugcuguuccugaacaugguggcccccggcagagugcugaucugcaccgugaaggacgagggcagcuuccaccugaaggacaccgccaaggcccugcugagaagccugggcagccaggccggccccgcccugggcuggagagacaccugggccuucgugggcagaaagggcggccccguguucggcgagaagcacagcaagagccccgcccugagcagcuggggcgaccccgugcugcugaagaccgacgugccccugagcagcgccgaggaggccgagugccacugggccgacaccgagcugaacagaagaagaagaagauucugcagcaagguggagggcuacggcagcgugugcagcugcaaggaccccacccccaucgaguucagccccgacccccugcccgacaacaaggugcugaacgugcccguggccgugaucgccggcaacagacccaacuaccuguacagaaugcugagaagccugcugagcgcccagggcgugagcccccagaugaucaccguguucaucgacggcuacuacgaggagcccauggacgugguggcccuguucggccugagaggcauccagcacacccccaucagcaucaagaacgccagagugagccagcacuacaaggccagccugaccgccaccuucaaccuguuccccgaggccaaguucgccguggugcuggaggaggaccuggacaucgccguggacuucuucagcuuccugagccagagcauccaccugcuggaggaggacgacagccuguacugcaucagcgccuggaacgaccagggcuacgagcacaccgccgaggaccccgcccugcuguacagaguggagaccaugcccggccugggcugggugcugagaagaagccuguacaaggaggagcuggagcccaaguggcccacccccgagaagcugugggacugggacauguggaugagaaugcccgagcagagaagaggcagagagugcaucauccccgacgugagcagaagcuaccacuucggcaucgugggccugaacaugaacggcuacuuccacgaggccuacuucaagaagcacaaguucaacaccgugcccggcgugcagcugagaaacguggacagccugaagaaggaggccuacgagguggaggugcacagacugcugagcgaggccgaggugcuggaccacagcaagaaccccugcgaggacagcuuccugcccgacaccgagggccacaccuacguggccuucaucagaauggagaaggacgacgacuucaccaccuggacccagcuggccaagugccugcacaucugggaccuggacgugagaggcaaccacagaggccuguggagacuguucagaaagaagaaccacuuccugguggugggcgugcccgccagccccuacagcgugaagaagccccccagcgugacccccaucuuccuggagcccccccccaaggaggagggcgcccccggcgcccccgagcagaccuaa

SEQ ID NO: 21796 - RNA, 1743 nt, Artificial Sequence
  POMGNT2__Homo_sapiens__NP_116195
augcaccugagcgccguguucaacgcccugcuggugagcgugcuggccgccgugcuguggaagcacgugagacugagagagcacgccgccacccuggaggaggagcuggcccugagcagacaggccaccgagcccgcccccgcccugagaaucgacuaccccaaggcccugcagauccugauggagggcggcacccacauggugugcaccggcagaacccacaccgacagaaucugcagauucaaguggcugugcuacagcaacgaggccgaggaguucaucuucuuccacggcaacaccagcgugaugcugcccaaccugggcagcagaagauuccagcccgcccugcuggaccugagcaccguggaggaccacaacacccaguacuucaacuucguggagcugcccgccgccgcccugagauucaugcccaagcccguguucgugcccgacguggcccugaucgccaacagauucaaccccgacaaccugaugcacguguuccacgacgaccugcugccccuguucuacacccugagacaguuccccggccuggcccacgaggccagacuguucuucauggagggcuggggcgagggcgcccacuucgaccuguacaagcugcugagccccaagcagccccugcugagagcccagcugaagacccugggcagacugcugugcuucagccacgccuucgugggccugagcaagaucaccaccugguaccaguacggcuucgugcagccccagggccccaaggccaacauccuggugagcggcaacgagaucagacaguucgccagauucaugaccgagaagcugaacgugagccacaccggcgugccccugggcgaggaguacauccugguguucagcagaacccagaacagacugauccugaacgaggccgagcugcugcuggcccuggcccaggaguuccagaugaagaccgugaccgugagccuggaggaccacaccuucgccgacguggugagacuggugagcaacgccagcaugcuggugagcaugcacggcgcccagcuggugaccacccuguuccugcccagaggcgccaccgugguggagcuguuccccuacgccgugaaccccgaccacuacacccccuacaagacccuggccaugcugcccggcauggaccugcaguacguggccuggagaaacaugaugcccgagaacaccgugacccaccccgagagacccugggaccagggcggcaucacccaccuggacagagccgagcaggccagaauccugcagagcagagaggugcccagacaccugugcugcagaaaccccgaguggcuguucagaaucuaccaggacaccaagguggacauccccagccugauccagaccaucagaagaguggugaagggcagacccggccccagaaagcagaaguggaccgugggccuguaccccggcaaggugagagaggccagaugccaggccagcgugcacggcgccagcgaggccagacugaccgugagcuggcagauccccuggaaccugaaguaccugaaggugagagaggugaaguacgagguguggcugcaggagcagggcgagaacaccuacgugcccuacauccuggcccugcagaaccacaccuucaccgagaacaucaagcccuucaccaccuaccuggugugggugagaugcaucuucaacaagauccugcugggccccuucgccgacgugcuggugugcaacaccuaa

SEQ ID NO: 21797 - RNA, 1053 nt, Artificial Sequence
  POMK__Homo_sapiens__NP_115613
auggagaagcagccccagaacagcagaagaggccuggcccccagagaggugccccccgccgugggccugcugcugaucauggcccugaugaacacccugcuguaccugugccuggaccacuucuucaucgcccccagacagagcaccguggaccccacccacugccccuacggccacuucagaaucggccagaugaagaacugcagccccuggcugagcugcgaggagcugagaaccgaggugagacagcugaagagagugggcgagggcgccgugaagagaguguuccugagcgaguggaaggagcacaagguggcccugagccagcugaccagccuggagaugaaggacgacuuccugcacggccugcagaugcugaagagccugcagggcacccacguggugacccugcugggcuacugcgaggacgacaacaccaugcugaccgaguaccacccccugggcagccugagcaaccuggaggagacccugaaccugagcaaguaccagaacgugaacaccuggcagcacagacuggagcuggccauggacuacgugagcaucaucaacuaccugcaccacagccccgugggcaccagagugaugugcgacagcaacgaccugcccaagacccugagccaguaccugcugaccagcaacuucagcauccuggccaacgaccuggacgcccugccccuggugaaccacagcagcggcaugcuggugaagugcggccacagagagcugcacggcgacuucguggcccccgagcagcuguggcccuacggcgaggacgugcccuuccacgacgaccugaugcccagcuacgacgagaagaucgacaucuggaagauccccgacaucagcagcuuccugcugggccacaucgagggcagcgacauggugagauuccaccuguucgacauccacaaggccugcaagagccagacccccagcgagagacccaccgcccaggacgugcuggagaccuaccagaaggugcuggacacccugagagacgccaugaugagccaggccagagagaugcuguaa

SEQ ID NO: 21798 - RNA, 426 nt, Artificial Sequence
  POMP__Homo_sapiens__NP_057016
augaacgccagaggccugggcagcgagcugaaggacagcauccccgugaccgagcugagcgccagcggccccuucgagagccacgaccugcugagaaagggcuucagcugcgugaagaacgagcugcugcccagccacccccuggagcugagcgagaagaacuuccagcugaaccaggacaagaugaacuucagcacccugagaaacauccagggccuguucgccccccugaagcugcagauggaguucaaggccgugcagcaggugcagagacugcccuuccugagcagcagcaaccugagccuggacgugcugagaggcaacgacgagaccaucggcuucgaggacauccugaacgaccccagccagagcgaggugaugggcgagccccaccugaugguggaguacaagcugggccugcuguaa

SEQ ID NO: 21799 - RNA, 2016 nt, Artificial Sequence
  POMT1__Homo_sapiens__NP_001070834
augaagcagaucuucuuccuggacgacagcggcccccccuucggccacauggugcuggcccugggcggcuaccugggcggcuucgacggcaacuuccuguggaacagaaucggcgccgaguacagcagcaacgugcccguguggagccugagacugcugcccgcccuggccggcgcccugagcgugcccauggccuaccagaucgugcuggagcugcacuucagccacugcgccgccaugggcgccgcccugcugaugcugaucgagaacgcccugaucacccagagcagacugaugcugcuggagagcgugcugaucuucuucaaccugcuggccgugcugagcuaccugaaguucuucaacugccagaagcacagccccuucagccugagcuggugguucuggcugacccugaccggcguggccugcagcugcgccgugggcaucaaguacaugggcguguucaccuacgugcuggugcugggcguggccgccgugcacgccuggcaccugcugggcgaccagacccugagcaacgugugcguguucugccaccugcuggccagagccguggcccugcuggugauccccguggugcuguaccugcuguucuucuacgugcaccugauccugguguucagaagcggcccccacgaccagaucaugagcagcgccuuccaggccagccuggagggcggccuggccagaaucacccagggccagccccuggagguggccuucggcagccaggugacccugagaaacguguucggcaagcccgugcccugcuggcugcacagccaccaggacaccuaccccaugaucuacgagaacggcagaggcagcagccaccagcagcaggugaccugcuaccccuucaaggacgugaacaacugguggaucgugaaggaccccagaagacaccagcugguggugagcagcccccccagacccgugagacacggcgacauggugcagcuggugcacggcaugaccaccagaagccugaacacccacgacguggccgccccccugagcccccacagccaggaggugagcugcuacaucgacuacaacaucagcaugcccgcccagaaccuguggagacuggagaucgugaacagaggcagcgacaccgacguguggaagaccauccugagcgaggugagauucgugcacgugaacaccagcgccgugcugaagcugagcggcgcccaccugcccgacuggggcuacagacagcuggagaucgugggcgagaagcugagcagaggcuaccacggcagcaccguguggaacguggaggagcacagauacggcgccagccaggagcagagagagagagagagagagcugcacagccccgcccagguggacgugagcagaaaccugagcuucauggccagauucagcgagcugcaguggagaaugcuggcccugagaagcgacgacagcgagcacaaguacagcagcagcccccuggagugggugacccuggacaccaacaucgccuacuggcugcaccccagaaccagcgcccagauccaccugcugggcaacaucgugaucugggugagcggcagccuggcccuggccaucuacgcccugcugagccugugguaccugcugagaagaagaagaaacgugcacgaccugccccaggacgccuggcugagaugggugcuggccggcgcccugugcgccggcggcugggccgugaacuaccugcccuucuuccugauggagaagacccuguuccuguaccacuaccugcccgcccugaccuuccagauccugcugcugcccguggugcugcagcacaucagcgaccaccugugcagaagccagcugcagagaagcaucuucagcgcccuggugguggccugguacagcagcgccugccacgugagcaacacccugagaccccugaccuacggcgacaagagccugagcccccacgagcugaaggcccugagauggaaggacagcugggacauccugaucagaaagcacuaa

SEQ ID NO: 21800 - RNA, 2253 nt, Artificial Sequence
  POMT2__Homo_sapiens__NP_037514
augccccccgccaccggcggcggccuggccgagagcgagcugagacccagaagaggcagaugcggcccccaggccgccagagccgccggcagagacguggccgccgaggccguggccagaagccccaagagacccgccuggggcagcagaagauucgaggccgugggcuggugggcccugcuggcccuggugacccugcugagcuucgccaccagauuccacagacuggacgagcccccccacaucugcugggacgagacccacuucggcaagaugggcagcuacuacaucaacagaaccuucuucuucgacgugcaccccccccugggcaagaugcugaucggccuggccggcuaccugagcggcuacgacggcaccuuccuguuccagaagcccggcgacaaguacgagcaccacagcuacaugggcaugagaggcuucugcgccuuccugggcagcuggcuggugcccuucgccuaccugaccgugcuggaccugagcaagagccugagcgccgcccugcugaccgccgcccugcugaccuucgacaccggcugccugacccugagccaguacauccugcuggaccccauccugauguucuucaucauggccgccaugcugagcauggugaaguacaacagcugcgccgacagacccuucagcgcccccuggugguucuggcugagccugaccggcgugagccuggccggcgcccugggcgugaaguucgugggccuguucaucauccugcaggugggccugaacaccaucgccgaccugugguaccuguucggcgaccugagccugagccuggugaccgugggcaagcaccugaccgccagagugcugugccugaucgugcugccccuggcccuguacaccgccaccuucgccgugcacuucauggugcugagcaagagcggccccggcgacggcuucuucagcagcgccuuccaggccagacugagcggcaacaaccugcacaacgccagcauccccgagcaccuggccuacggcagcgugaucaccgugaagaaccugagaauggccaucggcuaccugcacagccacagacaccuguaccccgagggcaucggcgccagacagcagcaggugaccaccuaccugcacaaggacuacaacaaccuguggaucaucaagaagcacaacaccaacagcgacccccuggaccccagcuuccccguggaguucgugagacacggcgacaucaucagacuggagcacaaggagaccagcagaaaccugcacagccacuaccacgaggcccccaugaccagaaagcacuaccaggugaccggcuacggcaucaacggcaccggcgacagcaacgacuucuggagaaucgagguggugaacagaaaguucggcaacagaaucaaggugcugagaagcagaaucagauucauccaccuggugaccggcugcgugcugggcagcagcggcaaggugcugcccaaguggggcugggagcagcuggaggugaccugcacccccuaccugaaggagacccugaacagcaucuggaacguggaggaccacaucaaccccaagcugcccaacaucagccuggacgugcugcagcccagcuuccccgagauccugcuggagagccacauggugaugaucagaggcaacagcggccugaagcccaaggacaacgaguucaccagcaagcccuggcacuggcccaucaacuaccagggccugagauucagcggcgugaacgacaccgacuucagaguguaccugcugggcaaccccguggugugguggcugaaccugcugagcaucgcccuguaccugcugagcggcagcaucaucgccguggccaugcagagaggcgccagacugcccgccgagguggccggccugagccaggugcugcugagaggcggcggccaggugcugcugggcuggacccugcacuacuuccccuucuuccugaugggcagagugcuguacuuccaccacuacuuccccgccaugcuguucagcagcaugcugaccggcauccugugggacacccugcugagacugugcgccuggggccuggccagcuggccccuggccagaggcauccacguggccggcauccugagccugcugcugggcaccgccuacagcuucuaccuguuccacccccuggccuacggcauggugggcccccuggcccaggacccccagagccccauggccggccugagauggcuggacagcugggacuucuaa

SEQ ID NO: 21801 - RNA, 564 nt, Artificial Sequence
  POMZP3__Homo_sapiens__NP_036362
auggugugcagccccgugacccugagaaucgccccccccgacagaagauucagcagaagcgccauccccgagcagaucaucagcagcacccugagcagccccagcagcaacgcccccgaccccugcgccaaggagaccgugcugagcgcccugaaggagaagaagaagaagagaaccguggaggaggaggaccagaucuuccuggacggccaggagaacaagagaagcugccugguggacggccugaccgacgccagcagcgccuucaaggugcccagacccggccccgacacccugcaguucaccguggacguguuccacuucgccaacgacagcagaaacaugaucuacaucaccugccaccugaaggugacccuggccgagcaggaccccgacgagcugaacaaggccugcagcuucagcaagcccagcaacagcugguuccccguggagggccuggccgacaucugccagugcugcaacaagggcgacugcggcacccccagccacagcagaagacagcccagaguggugagccaguggagcaccagcgccagccuguaa

SEQ ID NO: 21802 - RNA, 1068 nt, Artificial Sequence
  PON1__Homo_sapiens__NP_000437
auggccaagcugaucgcccugacccugcugggcaugggccuggcccuguucagaaaccaccagagcagcuaccagaccagacugaacgcccugagagaggugcagcccguggagcugcccaacugcaaccuggugaagggcaucgagaccggcagcgaggaccuggagauccugcccaacggccuggccuucaucagcagcggccugaaguaccccggcaucaagagcuucaaccccaacagccccggcaagauccugcugauggaccugaacgaggaggaccccaccgugcuggagcugggcaucaccggcagcaaguucgacgugagcagcuucaacccccacggcaucagcaccuucaccgacgaggacaacgccauguaccugcugguggugaaccaccccgacgccaagagcaccguggagcuguucaaguuccaggaggaggagaagagccugcugcaccugaagaccaucagacacaagcugcugcccaaccugaacgacaucguggccgugggccccgagcacuucuacggcaccaacgaccacuacuuccuggaccccuaccugcagagcugggagauguaccugggccuggccuggagcuacgugguguacuacagccccagcgaggugagagugguggccgagggcuucgacuucgccaacggcaucaacaucagccccgacggcaaguacguguacaucgccgagcugcuggcccacaagauccacguguacgagaagcacgccaacuggacccugaccccccugaagagccuggacuucaacacccugguggacaacaucagcguggaccccgagaccggcgaccugugggugggcugccaccccaacggcaugaagaucuucuucuacgacagcgagaacccccccgccagcgaggugcugagaauccagaacauccugaccgaggagcccaaggugacccagguguacgccgagaacggcaccgugcugcagggcagcaccguggccagcguguacaagggcaagcugcugaucggcaccguguuccacaaggcccuguacugcgagcuguaa

SEQ ID NO: 21803 - RNA, 1065 nt, Artificial Sequence
  PON2__Homo_sapiens__NP_000296
augggcagacugguggccgugggccugcugggcaucgcccuggcccugcugggcgagagacugcuggcccugagaaacagacugaaggccagcagagagguggagagcguggaccugccccacugccaccugaucaagggcaucgaggccggcagcgaggacaucgacauccugcccaacggccuggccuucuucagcgugggccugaaguuccccggccugcacagcuucgcccccgacaagcccggcggcauccugaugauggaccugaaggaggagaagcccagagccagagagcugagaaucagcagaggcuucgaccuggccagcuucaacccccacggcaucagcaccuucaucgacaacgacgacaccguguaccuguucguggugaaccaccccgaguucaagaacaccguggagaucuucaaguucgaggaggccgagaacagccugcugcaccugaagaccgugaagcacgagcugcugcccagcgugaacgacaucaccgccgugggccccgcccacuucuacgccaccaacgaccacuacuucagcgaccccuuccugaaguaccuggagaccuaccugaaccugcacugggccaacgugguguacuacagccccaacgaggugaaggugguggccgagggcuucgacagcgccaacggcaucaacaucagccccgacgacaaguacaucuacguggccgacauccuggcccacgagauccacgugcuggagaagcacaccaacaugaaccugacccagcugaaggugcuggagcuggacacccugguggacaaccugagcaucgaccccagcagcggcgacaucugggugggcugccaccccaacggccagaagcuguucguguacgaccccaacaacccccccagcagcgaggugcugagaauccagaacauccugagcgagaagcccaccgugaccaccguguacgccaacaacggcagcgugcugcagggcagcagcguggccagcguguacgacggcaagcugcugaucggcacccuguaccacagagcccuguacugcgagcuguaa

SEQ ID NO: 21804 - RNA, 1065 nt, Artificial Sequence
  PON3__Homo_sapiens__NP_000931
augggcaagcugguggcccuggugcugcugggcgugggccugagccuggugggcgagauguuccuggccuucagagagagagugaacgccagcagagagguggagcccguggagcccgagaacugccaccugaucgaggagcuggagagcggcagcgaggacaucgacauccugcccagcggccuggccuucaucagcagcggccugaaguaccccggcaugcccaacuucgcccccgacgagcccggcaagaucuuccugauggaccugaacgagcagaaccccagagcccaggcccuggagaucagcggcggcuucgacaaggagcuguucaacccccacggcaucagcaucuucaucgacaaggacaacaccguguaccuguacguggugaaccacccccacaugaagagcaccguggagaucuucaaguucgaggagcagcagagaagccugguguaccugaagaccaucaagcacgagcugcugaagagcgugaacgacaucguggugcugggccccgagcaguucuacgccaccagagaccacuacuucaccaacagccugcugagcuucuucgagaugauccuggaccugagauggaccuacgugcuguucuacagccccagagaggugaaggugguggccaagggcuucugcagcgccaacggcaucaccgugagcgccgaccagaaguacguguacguggccgacguggccgccaagaacauccacaucauggagaagcacgacaacugggaccugacccagcugaaggugauccagcugggcacccugguggacaaccugaccguggaccccgccaccggcgacauccuggccggcugccaccccaaccccaugaagcugcugaacuacaaccccgaggacccccccggcagcgaggugcugagaauccagaacgugcugagcgagaagcccagagugagcaccguguacgccaacaacggcagcgugcugcagggcaccagcguggccagcguguaccacggcaagauccugaucggcaccguguuccacaagacccuguacugcgagcuguaa

SEQ ID NO: 21805 - RNA, 3075 nt, Artificial Sequence
  POP1__Homo_sapiens__NP_001139332
augagcaacgccaaggagagaaagcacgccaagaagaugagaaaccagcccaccaacgugacccugagcagcggcuucguggccgacagaggcgugaagcaccacagcggcggcgagaagcccuuccaggcccagaagcaggagccccaccccggcaccagcagacagagacagaccagagugaacccccacagccugcccgaccccgaggugaacgagcagagcagcagcaagggcauguucagaaagaagggcggcuggaaggccggccccgagggcaccagccaggagauccccaaguacaucaccgccagcaccuucgcccaggccagagccgccgagaucagcgccaugcugaaggccgugacccagaagagcagcaacagccugguguuccagacccugcccagacacaugagaagaagagccaugagccacaacgugaagagacugcccagaagacugcaggagaucgcccagaaggaggccgagaaggccgugcaccagaagaaggagcacagcaagaacaagugccacaaggccagaagaugccacaugaacagaacccuggaguucaacagaagacagaagaagaacaucuggcuggagacccacaucuggcacgccaagagauuccacauggugaagaaguggggcuacugccugggcgagagacccaccgugaagagccacagagccugcuacagagccaugaccaacagaugccugcugcaggaccugagcuacuacugcugccuggagcugaagggcaaggaggaggagauccugaaggcccugagcggcaugugcaacaucgacaccggccugaccuucgccgccgugcacugccugagcggcaagagacagggcagccuggugcuguacagagugaacaaguaccccagagagaugcugggccccgugaccuucaucuggaagagccagagaacccccggcgaccccagcgagagcagacagcuguggaucuggcugcaccccacccugaagcaggacauccuggaggagaucaaggccgccugccagugcguggagcccaucaagagcgccgugugcaucgccgacccccugcccacccccagccaggagaagagccagaccgagcugcccgacgagaagaucggcaagaagagaaagagaaaggacgacggcgagaacgccaagcccaucaagaagaucaucggcgacggcaccagagaccccugccugcccuacagcuggaucagccccaccaccggcaucaucaucagcgaccugaccauggagaugaacagauucagacugaucggcccccugagccacagcauccugaccgaggccaucaaggccgccagcgugcacaccgugggcgaggacaccgaggagaccccccacagaugguggaucgagaccugcaagaagcccgacagcgugagccugcacugcagacaggaggccaucuucgagcugcugggcggcaucaccagccccgccgagauccccgccggcaccauccugggccugaccgugggcgaccccagaaucaaccugccccagaagaagagcaaggcccugcccaaccccgagaagugccaggacaacgagaaggugagacagcugcugcuggagggcgugcccguggagugcacccacagcuucaucuggaaccaggacaucugcaagagcgugaccgagaacaagaucagcgaccaggaccugaacagaaugagaagcgagcugcuggugcccggcagccagcugauccugggcccccacgagagcaagauccccauccugcugauccagcagcccggcaaggugaccggcgaggacagacugggcuggggcagcggcugggacgugcugcugcccaagggcuggggcauggccuucuggauccccuucaucuacagaggcgugagagugggcggccugaaggagagcgccgugcacagccaguacaagagaagccccaacgugcccggcgacuuccccgacugccccgccggcaugcuguucgccgaggagcaggccaagaaccugcuggagaaguacaagagaagaccccccgccaagagacccaacuacgugaagcugggcacccuggcccccuucugcugccccugggagcagcugacccaggacugggagagcagagugcaggccuacgaggagcccagcguggccagcagccccaacggcaaggagagcgaccugagaagaagcgaggugcccugcgcccccaugcccaagaagacccaccagcccagcgacgaggugggcaccagcaucgagcaccccagagaggccgaggaggugauggacgccggcugccaggagagcgccggccccgagagaaucaccgaccaggaggccagcgagaaccacguggccgccaccggcagccaccugugcgugcugagaagcagaaagcugcugaagcagcugagcgccuggugcggccccagcagcgaggacagcagaggcggcagaagagcccccggcagaggccagcagggccugaccagagaggccugccugagcauccugggccacuuccccagagcccuggugugggugagccugagccugcugagcaagggcagccccgagccccacaccaugaucugcgugcccgccaaggaggacuuccugcagcugcacgaggacuggcacuacugcggcccccaggagagcaagcacagcgaccccuucagaagcaagauccugaagcagaaggagaagaagaagagagagaagagacagaagcccggcagagccagcagcgacggccccgccggcgaggagcccguggccggccaggaggcccugacccugggccuguggagcggcccccugcccagagugacccugcacugcagcagaacccugcugggcuucgugacccagggcgacuucagcauggccgugggcugcggcgaggcccugggcuucgugagccugaccggccugcuggacaugcugagcagccagcccgccgcccagagaggccuggugcugcugagaccccccgccagccugcaguacagauucgccagaaucgccaucgagguguaa

SEQ ID NO: 21806 - RNA, 663 nt, Artificial Sequence
  POP4__Homo_sapiens__NP_006618
augaagagcgugaucuaccacgcccugagccagaaggaggccaacgacagcgacgugcagcccagcggcgcccagagagccgaggccuucgugagagccuuccugaagagaagcacccccagaaugagcccccaggccagagaggaccagcugcagagaaaggccguggugcuggaguacuucaccagacacaagagaaaggagaagaagaagaaggccaagggccugagcgccagacagagaagagagcugagacuguucgacaucaagcccgagcagcagagauacagccuguuccugccccugcacgagcuguggaagcaguacaucagagaccugugcagcggccugaagcccgacacccagccccagaugauccaggccaagcugcugaaggccgaccugcacggcgccaucaucagcgugaccaagagcaagugccccagcuacgugggcaucaccggcauccugcugcaggagaccaagcacaucuucaagaucaucaccaaggaggacagacugaaggugauccccaagcugaacugcguguucaccguggagaccgacggcuucaucagcuacaucuacggcagcaaguuccagcugagaagcagcgagagaagcgccaagaaguucaaggccaagggcaccaucgaccuguaa

SEQ ID NO: 21807 - RNA, 876 nt, Artificial Sequence
  POPDC3__Homo_sapiens__NP_071756
auggagagaaacagcagccuguggaagaaccugaucgacgagcaccccgugugcaccaccuggaagcaggaggccgagggcgccaucuaccaccuggccagcauccuguucguggugggcuucaugggcggcagcggcuucuucggccugcuguacguguucagccugcugggccugggcuuccugugcagcgccgugugggccuggguggacgugugcgccgccgacaucuucagcuggaacuucgugcuguucgugaucugcuucaugcaguucgugcacaucgccuaccaggugagaagcaucaccuucgccagagaguuccaggugcuguacagcagccuguuccagccccugggcaucagccugcccguguucagaaccaucgcccugagcagcgagguggugacccuggagaaggagcacugcuacgccaugcagggcaagaccagcaucgacaagcugagccugcuggugagcggcagaaucagagugaccguggacggcgaguuccugcacuacaucuucccccugcaguuccuggacagccccgagugggacagccugagacccaccgaggagggcaucuuccaggugacccugaccgccgagaccgacugcagauacgugagcuggagaagaaagaagcuguaccugcuguucgcccagcacagauacaucagcagacuguucagcgugcugaucggcagcgacaucgccgacaagcuguacgcccugaacgacagaguguacaucggcaagagauaccacuacgacaucagacugcccaacuucuaccagaugagcacccccgagaucagaagaagcccccugacccagcacuuccagaacagcagaagauacugcgacaaguaa

SEQ ID NO: 21808 - RNA, 1140 nt, Artificial Sequence
  PORCN__Homo_sapiens__NP_001269096
augguguggguggugcugcugagccugcugugcuaccuggugcuguuccugugcagacacagcagccacagaggcguguuccugagcgugaccauccugaucuaccugcugaugggcgagaugcacaugguggacaccgugaccuggcacaagaugagaggcgcccagaugaucguggccaugaaggccgugagccugggcuucgaccuggacagaggcgaggugggcaccgugcccagccccguggaguucaugggcuaccuguacuucgugggcaccaucguguucggccccuggaucagcuuccacagcuaccugcaggccgugcagggcagaccccugagcugcagauggcugcagaagguggccagaagccuggcccuggcccugcugugccuggugcugagcaccugcgugggccccuaccuguuccccuacuucaucccccugaacggcgacagacugcugagaaaguggcugagagccuacgagagcgccgugagcuuccacuucagcaacuacuucgugggcuuccugagcgaggccaccgccacccuggccggcgccggcuucaccgaggagaaggaccaccuggagugggaccugaccgugagcaagccccugaacguggagcugcccagaagcaugguggagguggugaccagcuggaaccugcccaugagcuacuggcugaacaacuacguguucaagaacgcccugagacugggcaccuucagcgccgugcuggugaccuacgccgccagcgcccugcugcacggcuucagcuuccaccuggccgccgugcugcugagccuggccuucaucaccuacguggagcacgugcugagaaagagacuggccagaauccugagcgccugcgugcugagcaagagaugcccccccgacugcagccaccagcacagacugggccugggcgugagagcccugaaccugcuguucggcgcccuggccaucuuccaccuggccuaccugggcagccuguucgacguggacguggacgacaccaccgaggagcagggcuacggcauggccuacaccgugcacaaguggagcgagcugagcugggccagccacugggugaccuucggcugcuggaucuucuacagacugaucggcuaa

SEQ ID NO: 21809 - RNA, 2043 nt, Artificial Sequence
  POR__Homo_sapiens__NP_000932
augaucaacaugggcgacagccacguggacaccagcagcaccgugagcgaggccguggccgaggaggugagccuguucagcaugaccgacaugauccuguucagccugaucgugggccugcugaccuacugguuccuguucagaaagaagaaggaggaggugcccgaguucaccaagauccagacccugaccagcagcgugagagagagcagcuucguggagaagaugaagaagaccggcagaaacaucaucguguucuacggcagccagaccggcaccgccgaggaguucgccaacagacugagcaaggacgcccacagauacggcaugagaggcaugagcgccgaccccgaggaguacgaccuggccgaccugagcagccugcccgagaucgacaacgcccuggugguguucugcauggccaccuacggcgagggcgaccccaccgacaacgcccaggacuucuacgacuggcugcaggagaccgacguggaccugagcggcgugaaguucgccguguucggccugggcaacaagaccuacgagcacuucaacgccaugggcaaguacguggacaagagacuggagcagcugggcgcccagagaaucuucgagcugggccugggcgacgacgacggcaaccuggaggaggacuucaucaccuggagagagcaguucuggcccgccgugugcgagcacuucggcguggaggccaccggcgaggagagcagcaucagacaguacgagcugguggugcacaccgacaucgacgccgccaagguguacaugggcgagaugggcagacugaagagcuacgagaaccagaagccccccuucgacgccaagaaccccuuccuggccgccgugaccaccaacagaaagcugaaccagggcaccgagagacaccugaugcaccuggagcuggacaucagcgacagcaagaucagauacgagagcggcgaccacguggccguguaccccgccaacgacagcgcccuggugaaccagcugggcaagauccugggcgccgaccuggacguggugaugagccugaacaaccuggacgaggagagcaacaagaagcaccccuuccccugccccaccagcuacagaaccgcccugaccuacuaccuggacaucaccaacccccccagaaccaacgugcuguacgagcuggcccaguacgccagcgagcccagcgagcaggagcugcugagaaagauggccagcagcagcggcgagggcaaggagcuguaccugagcugggugguggaggccagaagacacauccuggccauccugcaggacugccccagccugagaccccccaucgaccaccugugcgagcugcugcccagacugcaggccagauacuacagcaucgccagcagcagcaaggugcaccccaacagcgugcacaucugcgccguggugguggaguacgagaccaaggccggcagaaucaacaagggcguggccaccaacuggcugagagccaaggagcccgccggcgagaacggcggcagagcccuggugcccauguucgugagaaagagccaguucagacugcccuucaaggccaccacccccgugaucauggugggccccggcaccggcguggcccccuucaucggcuucauccaggagagagccuggcugagacagcagggcaaggaggugggcgagacccugcuguacuacggcugcagaagaagcgacgaggacuaccuguacagagaggagcuggcccaguuccacagagacggcgcccugacccagcugaacguggccuucagcagagagcagagccacaagguguacgugcagcaccugcugaagcaggacagagagcaccuguggaagcugaucgagggcggcgcccacaucuacgugugcggcgacgccagaaacauggccagagacgugcagaacaccuucuacgacaucguggccgagcugggcgccauggagcacgcccaggccguggacuacaucaagaagcugaugaccaagggcagauacagccuggacguguggagcuaa

SEQ ID NO: 21810 - RNA, 2340 nt, Artificial Sequence
  POSTN__Homo_sapiens__NP_001129406
augauccccuuccugcccauguucagccugcugcugcugcugaucgugaaccccaucaacgccaacaaccacuacgacaagauccuggcccacagcagaaucagaggcagagaccagggccccaacgugugcgcccugcagcagauccugggcaccaagaagaaguacuucagcaccugcaagaacugguacaagaagagcaucugcggccagaagaccaccgugcuguacgagugcugccccggcuacaugagaauggagggcaugaagggcugccccgccgugcugcccaucgaccacguguacggcacccugggcaucgugggcgccaccaccacccagagauacagcgacgccagcaagcugagagaggagaucgagggcaagggcagcuucaccuacuucgcccccagcaacgaggccugggacaaccuggacagcgacaucagaagaggccuggagagcaacgugaacguggagcugcugaacgcccugcacagccacaugaucaacaagagaaugcugaccaaggaccugaagaacggcaugaucauccccagcauguacaacaaccugggccuguucaucaaccacuaccccaacggcguggugaccgugaacugcgccagaaucauccacggcaaccagaucgccaccaacggcguggugcacgugaucgacagagugcugacccagaucggcaccagcauccaggacuucaucgaggccgaggacgaccugagcagcuucagagccgccgccaucaccagcgacauccuggaggcccugggcagagacggccacuucacccuguucgcccccaccaacgaggccuucgagaagcugcccagaggcgugcuggagagaaucaugggcgacaagguggccagcgaggcccugaugaaguaccacauccugaacacccugcagugcagcgagagcaucaugggcggcgccguguucgagacccuggagggcaacaccaucgagaucggcugcgacggcgacagcaucaccgugaacggcaucaagauggugaacaagaaggacaucgugaccaacaacggcgugauccaccugaucgaccaggugcugauccccgacagcgccaagcaggugaucgagcuggccggcaagcagcagaccaccuucaccgaccugguggcccagcugggccuggccagcgcccugagacccgacggcgaguacacccugcuggcccccgugaacaacgccuucagcgacgacacccugagcauggaccagagacugcugaagcugauccugcagaaccacauccugaaggugaaggugggccugaacgagcuguacaacggccagauccuggagaccaucggcggcaagcagcugagaguguucguguacagaaccgccgugugcaucgagaacagcugcauggagaagggcagcaagcagggcagaaacggcgccauccacaucuucagagagaucaucaagcccgccgagaagagccugcacgagaagcugaagcaggacaagagauucagcaccuuccugagccugcuggaggccgccgaccugaaggagcugcugacccagcccggcgacuggacccuguucgugcccaccaacgacgccuucaagggcaugaccagcgaggagaaggagauccugaucagagacaagaacgcccugcagaacaucauccuguaccaccugacccccggcguguucaucggcaagggcuucgagcccggcgugaccaacauccugaagaccacccagggcagcaagaucuuccugaaggaggugaacgacacccugcuggugaacgagcugaagagcaaggagagcgacaucaugaccaccaacggcgugauccacgugguggacaagcugcuguaccccgccgacacccccgugggcaacgaccagcugcuggagauccugaacaagcugaucaaguacauccagaucaaguucgugagaggcagcaccuucaaggagauccccgugaccguguacaagcccaucaucaagaaguacaccaagaucaucgacggcgugcccguggagaucaccgagaaggagaccagagaggagagaaucaucaccggccccgagaucaaguacaccagaaucagcaccggcggcggcgagaccgaggagacccugaagaagcugcugcaggaggaggugaccaaggugaccaaguucaucgagggcggcgacggccaccuguucgaggacgaggagaucaagagacugcugcagggcgacacccccgugagaaagcugcaggccaacaagaaggugcagggcagcagaagaagacugagagagggcagaagccaguaa

SEQ ID NO: 21811 - RNA, 1905 nt, Artificial Sequence
  POT1__Homo_sapiens__XP_006715980
augagccuggugcccgccaccaacuacaucuacaccccccugaaccagcugaagggcggcaccaucgugaacguguacggcguggugaaguucuucaagccccccuaccugagcaagggcaccgacuacugcagcguggugaccaucguggaccagaccaacgugaagcugaccugccugcuguucagcggcaacuacgaggcccugcccaucaucuacaagaacggcgacaucgugagauuccacagacugaagauccagguguacaagaaggagacccagggcaucaccagcagcggcuucgccagccugaccuucgagggcacccugggcgcccccaucauccccagaaccagcagcaaguacuucaacuucaccaccgaggaccacaagaugguggaggcccugagagugugggccagcacccacaugagccccagcuggacccugcugaagcugugcgacgugcagcccaugcaguacuucgaccugaccugccagcugcugggcaaggccgagguggacggcgccagcuuccugcugaaggugugggacggcaccagaacccccuuccccagcuggagagugcugauccaggaccuggugcuggagggcgaccugagccacauccacagacugcagaaccugaccaucgacauccugguguacgacaaccacgugcacguggccagaagccugaaggugggcagcuuccugagaaucuacagccugcacaccaagcugcagagcaugaacagcgagaaccagaccaugcugagccuggaguuccaccugcacggcggcaccagcuacggcagaggcaucagagugcugcccgagagcaacagcgacguggaccagcugaagaaggaccuggagagcgccaaccugaccgccaaccagcacagcgacgugaucugccagagcgagcccgacgacagcuuccccagcagcggcagcgugagccuguacgagguggagagaugccagcagcugagcgccaccauccugaccgaccaccaguaccuggagagaaccccccugugcgccauccugaagcagaaggccccccagcaguacagaaucagagccaagcugagaagcuacaagcccagaagacuguuccagagcgugaagcugcacugccccaagugccaccugcugcaggaggugccccacgagggcgaccuggacaucaucuuccaggacggcgccaccaagacccccgacgugaagcugcagaacaccagccuguacgacagcaagaucuggaccaccaagaaccagaagggcagaaagguggccgugcacuucgugaagaacaacggcauccugccccugagcaacgagugccugcugcugaucgagggcggcacccugagcgagaucugcaagcugagcaacaaguucaacagcgugauccccgugagaagcggccacgaggaccuggagcugcuggaccugagcgcccccuuccugauccagggcaccauccaccacuacggcugcaagcagugcagcagccugagaagcauccagaaccugaacagccugguggacaagaccagcuggauccccagcagcguggccgaggcccugggcaucgugccccugcaguacguguucgugaugaccuucacccuggacgacggcaccggcgugcuggaggccuaccugauggacagcgacaaguucuuccagauccccgccagcgaggugcugauggacgacgaccugcagaagagcguggacaugaucauggacauguucugcccccccggcaucaagaucgacgccuaccccuggcuggagugcuucaucaagagcuacaacgugaccaacggcaccgacaaccagaucugcuaccagaucuucgacaccaccguggccgaggacgugaucuaa

SEQ ID NO: 21812 - RNA, 1755 nt, Artificial Sequence
  POTED__Homo_sapiens__NP_778146
augguggccgaggugugcagcaugcccaccgccagcaccgugaagaagcccuucgaccugagaagcaagaugggcaaguggugccaccacagauuccccugcugcagaggcagcggcaagagcaacaugggcaccagcggcgaccacgacgacagcuucaugaagaugcugagaagcaagaugggcaagugcugcagacacugcuuccccugcugcagaggcagcggcaccagcaacgugggcaccagcggcgaccacgagaacagcuucaugaagaugcugagaagcaagaugggcaaguggugcugccacugcuuccccugcugcagaggcagcggcaagagcaacgugggcgccuggggcgacuacgaccacagcgccuucauggagcccagauaccacaucagaagagaggaccuggacaagcugcacagagccgccugguggggcaaggugcccagaaaggaccugaucgugaugcugagagacaccgacaugaacaagagagacaaggagaagagaaccgcccugcaccuggccagcgccaacggcaacagcgagguggugcagcugcugcuggacagaagaugccagcugaacgugcuggacaacaagaagagaaccgcccugaucaaggccauccagugccaggaggacgagugcgugcugaugcugcuggagcacggcgccgacagaaacauccccgacgaguacggcaacaccgcccugcacuacgccaucuacaacgaggacaagcugauggccaaggcccugcugcuguacggcgccgacaucgagagcaagaacaagugcggccugaccccccugcugcugggcgugcacgagcagaagcagcagguggugaaguuccugaucaagaagaaggccaaccugaacgugcuggacagauacggcagaaccgcccugauccuggccgugugcugcggcagcgccagcaucgugaaccugcugcuggagcagaacguggacgugagcagccaggaccugagcggccagaccgccagagaguacgccgugagcagccaccaccacgugaucugcgagcugcugagcgacuacaaggagaagcagaugcugaagaucagcagcgagaacagcaaccccgagcaggaccugaagcugaccagcgaggaggagagccagagacugaaggugagcgagaacagccagcccgagaagaugagccaggagcccgagaucaacaaggacugcgacagagagguggaggaggagaucaagaagcacggcagcaaccccgugggccugcccgagaaccugaccaacggcgccagcgccggcaacggcgacgacggccugaucccccagagaagaagcagaaagcccgagaaccagcaguuccccgacaccgagaacgaggaguaccacagcgacgagcagaacgacaccagaaagcagcugagcgaggagcagaacaccggcaucagccaggacgagauccugaccaacaagcagaagcagaucgagguggccgagcagaagaugaacagcgagcugagccugagccacaagaaggaggaggaccugcugagagagaacagcgugcugcaggaggagaucgccaugcugagacuggagcuggacgagaccaagcaccagaaccagcugagagagaacaagauccuggaggagaucgagagcgugaaggagaagaccgacaagcugcugagagccaugcagcugaacgaggaggcccugaccaagaccaacaucuaa

SEQ ID NO: 21813 - RNA, 3228 nt, Artificial Sequence
  POTEF__Homo_sapiens__NP_001093241
auggugguggagguggacagcaugcccgccgccagcagcgugaagaagcccuucggccugagaagcaagaugggcaaguggugcugcagaugcuuccccugcugcagagagagcggcaagagcaacgugggcaccagcggcgaccacgacgacagcgccaugaagacccugagaagcaagaugggcaaguggugcagacacugcuuccccugcugcagaggcagcggcaagagcaacgugggcgccagcggcgaccacgacgacagcgccaugaagacccugagaaacaagaugggcaaguggugcugccacugcuuccccugcugcagaggcagcagcaagagcaaggugggcgccuggggcgacuacgacgacagcgccuucauggagcccagauaccacgugagaggcgaggaccuggacaagcugcacagagccgccugguggggcaaggugcccagaaaggaccugaucgugaugcugagagacaccgacgugaacaagcaggacaagcagaagagaaccgcccugcaccuggccagcgccaacggcaacagcgagguggugaagcugcugcuggacagaagaugccagcugaacgugcuggacaacaagaagagaaccgcccugaucaaggccgugcagugccaggaggacgagugcgcccugaugcugcuggagcacggcaccgaccccaacauccccgacgaguacggcaacaccacccugcacuacgccaucuacaacgaggacaagcugauggccaaggcccugcugcuguacggcgccgacaucgagagcaagaacaagcacggccugaccccccugcugcugggcgugcacgagcagaagcagcagguggugaaguuccugaucaagaagaaggccaaccugaacgcccuggacagauacggcagaaccgcccugauccuggccgugugcugcggcagcgccagcaucgugagccugcugcuggagcagaacaucgacgugagcagccaggaccugagcggccagaccgccagagaguacgccgugagcagccaccaccacgugaucugccagcugcugagcgacuacaaggagaagcagaugcugaagaucagcagcgagaacagcaaccccgagcaggaccugaagcugaccagcgaggaggagagccagagauucaagggcagcgagaacagccagcccgagaagaugagccaggagcccgagaucaacaaggacggcgacagagagguggaggaggagaugaagaagcacgagagcaacaacgugggccugcuggagaaccugaccaacggcgugaccgccggcaacggcgacaacggccugaucccccagagaaagagcagaacccccgagaaccagcaguuccccgacaacgagagcgaggaguaccacagaaucugcgagcugcugagcgacuacaaggagaagcagaugcccaaguacagcagcgagaacagcaaccccgagcaggaccugaagcugaccagcgaggaggagagccagagacugaagggcagcgagaacggccagcccgagaagagaagccaggagcccgagaucaacaaggacggcgacagagagcuggagaacuucauggccaucgaggagaugaagaagcacagaagcacccacgugggcuuccccgagaaccugaccaacggcgccaccgccggcaacggcgacgacggccugaucccccccagaaagagcagaacccccgagagccagcaguuccccgacaccgagaacgaggaguaccacagcgacgagcagaacgacacccagaagcaguucugcgaggagcagaacaccggcauccugcacgacgagauccugauccacgaggagaagcagaucgaggugguggagaagaugaacagcgagcugagccugagcugcaagaaggagaaggacauccugcacgagaacagcacccugagagaggagaucgccaugcugagacuggagcuggacaccaugaagcaccagagccagcugagagagaagaaguaccuggaggacaucgagagcgugaagaagagaaacgacaaccugcugaaggcccugcagcugaacgagcugaccauggacgacgacaccgccgugcuggugaucgacaacggcagcggcaugugcaaggccggcuucgccggcgacgacgcccccagagccguguuccccagcaucgugggcagacccagacagcagggcaugaugggcggcaugcaccagaaggagagcuacgugggcaaggaggcccagagcaagagaggcauccugacccugaaguaccccauggagcacggcaucaucaccaacugggacgacauggagaagaucuggcaccacaccuucuacaacgagcugagaguggcccccgaggagcaccccgugcugcugaccgaggccacccugaaccccaaggccaacagagagaagaugacccagaucauguucgagaccuucaacacccccgccauguacguggccauccaggccgugcugagccuguacaccagcggcagaaccaccggcaucgugauggacagcggcgacggcgugacccacaccgugcccaucuacgagggcaacgcccugccccacgccacccugagacuggaccuggccggcagagagcugcccgacuaccugaugaagauccugaccgagcacggcuacagauucaccaccauggccgagagagagaucgugagagacaucaaggagaagcugugcuacguggcccuggacuucgagcaggagauggccaccguggccagcagcagcagccuggagaagagcuacgagcugcccgacggccaggugaucaccaucggcaacgagagauucagaugccccgaggcccuguuccagcccugcuuccugggcauggagagcugcggcauccacgagaccaccuucaacagcaucaugaagagcgacguggacaucagaaaggaccuguacaccaacaccgugcugagcggcggcaccaccauguaccccggcauggcccacagaaugcagaaggagaucgccgcccuggcccccagcaugaugaagaucagaaucaucgccccccccaagagaaaguacagcgugugggugggcggcagcauccuggccagccugagcaccuuccagcagauguggaucagcaagcaggaguacgacgagagcggccccagcaucgugcacagaaagugccuguaa

SEQ ID NO: 21814 - RNA, 1527 nt, Artificial Sequence
  POTEG__Homo_sapiens__NP_001005356
augguggccgaggccggcagcaugcccgccgccagcagcgugaagaagcccuucggccugagaagcaagaugggcaaguggugcagacacugcuuccccuggugcagaggcagcggcaagagcaacgugggcaccagcggcgaccacgacgacagcgccaugaagacccugagaagcaagaugggcaaguggugcagacacugcuuccccuggugcagaggcagcagcaagagcaacgugggcaccagcggcgaccacgacgacagcgccaugaagacccugagaagcaagaugggcaaguggugcugccacugcuuccccugcugcagaggcagcggcaagagcaaggugggccccuggggcgacuacgacgacagcgccuucauggagcccagauaccacgugagaagagaggaccuggacaagcugcacagagccgccugguggggcaaggugcccagaaaggaccugaucgugaugcugaaggacaccgacaugaacaagaaggacaagcagaagagaaccgcccugcaccuggccagcgccaacggcaacagcgagguggugaagcugcugcuggacagaagaugccagcugaacauccuggacaacaagaagagaaccgcccugaccaaggccgugcagugcagagaggacgagugcgcccugaugcugcuggagcacggcaccgaccccaacauccccgacgaguacggcaacaccgcccugcacuacgccaucuacaacgaggacaagcugauggccaaggcccugcugcuguacggcgccgacaucgagagcaagaacaagcacggccugaccccccugcugcugggcgugcacgagcagaagcagcagguggugaaguuccugaucaagaagaaggccaaccugaacgcccuggacagauacggcagaaccgcccugauccuggccgugugcugcggcagcgccagcaucgugagccugcugcuggagcagaacaucgacgugagcagccaggaccugagcggccagaccgccagagaguacgccgugagcagccaccacaacgugaucugccagcugcugagcgacuacaaggagaagcagaugcugaaggugagcagcgagaacagcaaccccgagcaggaccugaagcugaccagcgaggaggagagccagagacugaagggcagcgagaacagccagcccgaggagaugagccaggagcccgagaucaacaagggcggcgacagaaagguggaggaggagaugaagaagcacggcagcacccacaugggcuuccccgagaaccugcccaacggcgccaccgccgacaacggcgacgacggccugaucccccccagaaagagcagaacccccgagagccagcaguuccccgacaccgagaacgagcaguaccacagcgacgagcagaacgacacccagaagcagcugagcgaggagcagaacaccggcauccugcaggacgagauccugauccacgaggagaagcagaucgagguggccgagaacgaguucuaa

SEQ ID NO: 21815 - RNA, 1638 nt, Artificial Sequence
  POTEH__Homo_sapiens__NP_001129685
augguggccgaggccggcagcaugcccgccgccagcagcgugaagaagcccuucggccugagaagcaagaugggcaaguggugcagacacugcuucgccuggugcagaggcagcggcaagagcaacgugggcaccagcggcgaccacgacgacagcgccaugaagacccugagaagcaagaugggcaaguggugcugccacugcuuccccuggugcagaggcagcggcaagagcaacgugggcaccagcggcgaccacgacgacagcgccaugaagacccugagaagcaagaugggcaaguggugcugccacugcuuccccugcugcagaggcagcggcaagagcaacgugggcaccagcggcgaccacgacgacagcgccaugaagacccugagaagcaagaugggcaaguggugcugccacugcuuccccugcugcagaggcagcggcaagaacaaggugggccccuggggcgacuacgacgacagcgccuucauggagcccagauaccacgugagaagagaggaccuggacaagcugcacagagccgccugguggggcaaggugcccagaaaggaccugaucgugaugcugaaggacaccgacaugaacaagaaggacaagcagaagagaaccgcccugcaccuggccagcgccaacggcaacagcgagguggugaagcugcugcuggacagaagaugccagcugaacauccuggacaacaagaagagaaccgcccugaccaaggccgugcagugccaggaggacgagugcgcccugaugcugcuggagcacggcaccgaccccaacauccccgacgaguacggcaacaccgcccugcacuacgccaucuacaacgaggacaagcugauggccaaggcccugcugcuguacggcgccgacaucgagagcaagaacaagcacggccugaccccccugcugcugggcgugcacgagcagaagcagcagguggugaaguuccugaucaagaagaaggccaaccugaacgcccuggacagauacggcagaaccgcccugauccuggccgugugcugcggcagcgccagcaucgugagccugcugcuggagcagaacaucgacgugagcagccaggaccugagcggccagaccgccagagaguacgccgugagcagcagacacaacgugaucugccagcugcugagcgacuacaaggagaagcagauccugaaggugagcagcgagaacagcaaccccgagcaggaccugaagcugaccagcgaggaggagagccagagacugaagggcagcgagaacagccagcccgaggagaugagccaggagcccgagaucaacaagggcggcgacagaaagguggaggaggagaugaagaagcacggcagcacccacaugggcuuccccgagaaccugaccaacggcgccaccgccgacaacggcgacgacggccugaucccccccagaaagagcagaacccccgagagccagcaguuccccgacaccgagaacgagcaguaccacagcgacgagcagaacgacacccagaagcagcugagcgaggagcagaacaccggcauccugcaggacgagauccugauccacgaggagaagcagaucgagguggccgagaacgaguucuaa

SEQ ID NO: 21816 - RNA, 1527 nt, Artificial Sequence
  POTEM__Homo_sapiens__NP_001138914
augguggccgaggccggcagcaugcccgccgccagcagcgugaagaagcccuucggccugagaagcaagaugggcaaguggugcagacacugcuuccccuggugcagaggcagcggcaagagcaacgugggcaccagcggcgaccacgacgacagcgccaugaagacccugagaagcaagaugggcaaguggugcagacacugcuuccccuggugcagaggcagcggcaagagcaacgugggcaccagcggcgaccacgacgacagcgccaugaagacccugagaagcaagaugggcaaguggugcugccacugcuuccccugcugcagaggcagcggcaagagcaaggugggccccuggggcgacuacgacgacagcgccuucauggagcccagauaccacgugagaagagaggaccuggacaagcugcacagagccgccugguggggcaaggugcccagaaaggaccugaucgugaugcugaaggacaccgacaugaacaagaaggacaagcagaagagaaccgcccugcaccuggccagcgccaacggcaacagcgagguggugaagcugcugcuggacagaagaugccagcugaacauccuggacaacaagaagagaaccgcccugaccaaggccgugcagugccaggaggacgagugcgcccugaugcugcuggagcacggcaccgaccccaacauccccgacgaguacggcaacaccgcccugcacuacgccaucuacaacgaggacaagcugauggccaaggcccugcugcuguacggcgccgacaucgagagcaagaacaagcacggccugaccccccugcugcugggcgugcacgagcagaagcagcagguggugaaguuccugaucaagaagaaggccaaccugaacgcccuggacagauacggcagaaccgugcugauccuggccgugugcugcggcagcgccagcaucgugagccugcugcuggagcagaacaucgacgugagcagccaggaccugagcggccagaccgccagagaguacgccgugagcagcagacacaacgugaucugccagcugcugagcgacuacaaggagaagcagauccugaaggugagcagcgagaacagcaaccccgagcaggaccugaagcugaccagcgaggaggagagccagagacugaagggcagcgagaacagccagcccgaggagaugagccaggagcccgagaucaacaagggcggcgacagaaagguggaggaggagaugaagaagcacggcagcacccacaugggcuuccccgagaaccugcccaacggcgccaccgccgacaacggcgacgacggccugaucccccccagaaagagcagaacccccgagagccagcaguuccccgacaccgagaacgagcaguaccacagcgacgagcagaacgacacccagaagcagcugagcgaggagcagaacaccggcauccugcaggacgagauccugauccacgaggagaagcagaucgagguggccgagaacgaguucuaa

SEQ ID NO: 21817 - RNA, 876 nt, Artificial Sequence
  POU1F1__Homo_sapiens__NP_000297
augagcugccaggccuucaccagcgccgacaccuucaucccccugaacagcgacgccagcgccacccugccccugaucaugcaccacagcgccgccgagugccugcccgugagcaaccacgccaccaacgugaugagcaccgccaccggccugcacuacagcgugcccagcugccacuacggcaaccagcccagcaccuacggcgugauggccggcagccugacccccugccuguacaaguuccccgaccacacccugagccacggcuucccccccauccaccagccccugcuggccgaggaccccaccgccgccgacuucaagcaggagcugagaagaaagagcaagcugguggaggagcccaucgacauggacagccccgagaucagagagcuggagaaguucgccaacgaguucaaggugagaagaaucaagcugggcuacacccagaccaacgugggcgaggcccuggccgccgugcacggcagcgaguucagccagaccaccaucugcagauucgagaaccugcagcugagcuucaagaacgccugcaagcugaaggccauccugagcaaguggcuggaggaggccgagcaggugggcgcccuguacaacgagaaggugggcgccaacgagagaaagagaaagagaagaaccaccaucagcaucgccgccaaggacgcccuggagagacacuucggcgagcagaacaagcccagcagccaggagaucaugagaauggccgaggagcugaaccuggagaaggagguggugagagugugguucugcaacagaagacagagagagaagagagugaagaccagccugaaccagagccuguucagcaucagcaaggagcaccuggagugcagauaa

SEQ ID NO: 21818 - RNA, 771 nt, Artificial Sequence
  POU2AF1__Homo_sapiens__NP_006226
augcuguggcagaagcccaccgcccccgagcaggcccccgcccccgccagacccuaccagggcgugagagugaaggagcccgugaaggagcugcugagaagaaagagaggccacgccagcagcggcgccgcccccgcccccaccgccguggugcugccccaccagccccuggccaccuacaccaccgugggccccagcugccuggacauggagggcagcgugagcgccgugaccgaggaggccgcccugugcgccggcuggcugagccagcccacccccgccacccugcagccccuggcccccuggacccccuacaccgaguacgugccccacgaggccgugagcugccccuacagcgccgacauguacgugcagcccgugugccccagcuacaccguggugggccccagcagcgugcugaccuacgccagccccccccugaucaccaacgugaccaccagaagcagcgccacccccgccgugggccccccccuggagggccccgagcaccaggccccccugaccuacuuccccuggccccagccccugagcacccugcccaccagcacccugcaguaccagccccccgcccccgcccugcccggcccccaguucgugcagcugcccaucagcauccccgagcccgugcugcaggacauggaggaccccagaagagccgccagcagccugaccaucgacaagcugcugcuggaggaggaggacagcgacgccuacgcccugaaccacacccugagcguggagggcuucuaa

SEQ ID NO: 21819 - RNA, 2268 nt, Artificial Sequence
  POU2F1__Homo_sapiens__NP_001185712
augcuggacugcagcgacuacgugcuggacagcagaaugaacaaccccagcgagaccagcaagcccagcauggagagcggcgacggcaacaccggcacccagaccaacggccuggacuuccagaagcagcccgugcccgugggcggcgccaucagcaccgcccaggcccaggccuuccugggccaccugcaccaggugcagcuggccggcaccagccugcaggccgccgcccagagccugaacgugcagagcaagagcaacgaggagagcggcgacagccagcagcccagccagcccagccagcagcccagcgugcaggccgccaucccccagacccagcugaugcuggccggcggccagaucaccggccugacccugacccccgcccagcagcagcugcugcugcagcaggcccaggcccaggcccagcugcuggccgccgccgugcagcagcacagcgccagccagcagcacagcgccgccggcgccaccaucagcgccagcgccgccacccccaugacccagaucccccugagccagcccauccagaucgcccaggaccugcagcagcugcagcagcugcagcagcagaaccugaaccugcagcaguucgugcuggugcaccccaccaccaaccugcagcccgcccaguucaucaucagccagaccccccagggccagcagggccugcugcaggcccagaaccugcugacccagcugccccagcagagccaggccaaccugcugcagagccagcccagcaucacccugaccagccagcccgccacccccaccagaaccaucgccgccacccccauccagacccugccccagagccagagcacccccaagagaaucgacacccccagccuggaggagcccagcgaccuggaggagcuggagcaguucgccaagaccuucaagcagagaagaaucaagcugggcuucacccagggcgacgugggccuggccaugggcaagcuguacggcaacgacuucagccagaccaccaucagcagauucgaggcccugaaccugagcuucaagaacaugugcaagcugaagccccugcuggagaaguggcugaacgacgccgagaaccugagcagcgacagcagccugagcagccccagcgcccugaacagccccggcaucgagggccugagcagaagaagaaagaagagaaccagcaucgagaccaacaucagaguggcccuggagaagagcuuccuggagaaccagaagcccaccagcgaggagaucaccaugaucgccgaccagcugaacauggagaaggaggugaucagagugugguucugcaacagaagacagaaggagaagagaaucaacccccccagcagcggcggcaccagcagcagccccaucaaggccaucuuccccagccccaccagccugguggccaccacccccagccuggugaccagcagcgccgccaccacccugaccgugagccccgugcugccccugaccagcgccgccgugaccaaccugagcgugaccggcaccagcgacaccaccagcaacaacaccgccaccgugaucagcaccgccccccccgccagcagcgccgugaccagccccagccugagccccagccccagcgccagcgccagcaccagcgaggccagcagcgccagcgagaccagcaccacccagaccaccagcaccccccugagcagcccccugggcaccagccaggugauggugaccgccagcggccugcagaccgccgccgccgccgcccugcagggcgccgcccagcugcccgccaacgccagccuggccgccauggccgccgccgccggccugaaccccagccugauggcccccagccaguucgccgccggcggcgcccugcugagccugaaccccggcacccugagcggcgcccugagccccgcccugaugagcaacagcacccuggccaccauccaggcccuggccagcggcggcagccugcccaucaccagccuggacgccaccggcaaccugguguucgccaacgccggcggcgcccccaacaucgugaccgccccccuguuccugaacccccagaaccugagccugcugaccagcaaccccgugagccuggugagcgccgccgccgccagcgccggcaacagcgcccccguggccagccugcacgccaccagcaccagcgccgagagcauccagaacagccuguucaccguggccagcgccagcggcgccgccagcaccaccaccaccgccagcaaggcccaguaa

SEQ ID NO: 21820 - RNA, 1440 nt, Artificial Sequence
  POU2F2__Homo_sapiens__NP_001193954
auggugcacagcagcaugggcgcccccgagaucagaaugagcaagccccuggaggccgagaagcagggccuggacagccccagcgagcacaccgacaccgagagaaacggccccgacaccaaccaccagaacccccagaacaagaccagccccuucagcgugagccccaccggccccagcaccaagaucaaggccgaggaccccagcggcgacagcgcccccgccgccccccugcccccccagcccgcccagccccaccugccccaggcccagcugaugcugaccggcagccagcuggccggcgacauccagcagcugcugcagcugcagcagcuggugcuggugcccggccaccaccugcagccccccgcccaguuccugcugccccaggcccagcagagccagcccggccugcugcccacccccaaccuguuccagcugccccagcagacccagggcgcccugcugaccagccagcccagagccggccugcccacccaggccgugaccagacccacccugcccgacccccaccugagccacccccagccccccaagugccuggagccccccagccaccccgaggagcccagcgaccuggaggagcuggagcaguucgccagaaccuucaagcagagaagaaucaagcugggcuucacccagggcgacgugggccuggccaugggcaagcuguacggcaacgacuucagccagaccaccaucagcagauucgaggcccugaaccugagcuucaagaacaugugcaagcugaagccccugcuggagaaguggcugaacgacgccgagaccaugagcguggacagcagccugcccagccccaaccagcugagcagccccagccugggcuucgacggccugcccggcagaagaagaaagaagagaaccagcaucgagaccaacgugagauucgcccuggagaagagcuuccuggccaaccagaagcccaccagcgaggagauccugcugaucgccgagcagcugcacauggagaaggaggugaucagagugugguucugcaacagaagacagaaggagaagagaaucaaccccugcagcgccgcccccaugcugcccagccccggcaagcccgccagcuacagcccccacauggugaccccccagggcggcgccggcacccugccccugagccaggccagcagcagccugagcaccaccgugaccacccugagcagcgccgugggcacccugcaccccagcagaaccgccggcggcggcggcggcggcggcggcgccgcccccccccugaacagcauccccagcgugaccccccccccccccgccaccaccaacagcaccaaccccagcccccagggcagccacagcgccaucggccugagcggccugaaccccagcaccggccccggccugugguggaaccccgcccccuaccagcccuaa

SEQ ID NO: 21821 - RNA, 1317 nt, Artificial Sequence
  POU2F3__Homo_sapiens__NP_001231611
auggagagccccagaaccgccaagggcggcagagacaucaagaugagcggcgacguggccgacagcaccgacgccagaagcacccugagccagguggagcccggcaacgacagaaacggccuggacuucaacagacagaucaagaccgaggaccugagcgacagccugcagcagacccugagccacagacccugccaccugagccagggccccgccaugaugagcggcaaccagaugagcggccugaacgccagccccugccaggacauggccagccugcacccccugcagcagcuggugcuggugcccggccaccugcagagcgugagccaguuccugcugagccagacccagcccggccagcagggccugcagcccaaccugcugcccuucccccagcagcagagcggccugcugcugccccagaccggccccggccuggccagccaggccuucggccaccccggccugcccggcagcagccuggagccccaccuggaggccagccagcaccugcccgugcccaagcaccugcccagcagcggcggcgccgacgagcccagcgaccuggaggagcuggagaaguucgccaagaccuucaagcagagaagaaucaagcugggcuucacccagggcgacgugggccuggccaugggcaagcuguacggcaacgacuucagccagaccaccaucagcagauucgaggcccugaaccugagcuucaagaacaugugcaagcugaagccccugcuggagaaguggcugaacgacgccgagagcagccccagcgaccccagcgugagcacccccagcagcuaccccagccugagcgagguguucggcagaaagagaaagaagagaaccagcaucgagaccaacaucagacugacccuggagaagagauuccaggacaaccccaagcccagcagcgaggagaucagcaugaucgccgagcagcugagcauggagaaggagguggugagagugugguucugcaacagaagacagaaggagaagagaaucaacugccccguggccacccccaucaagccccccguguacaacagcagacuggugagccccagcggcagccugggcccccugagcgugccccccgugcacagcaccaugcccggcaccgugaccagcagcugcagccccggcaacaacagcagacccagcagccccggcagcggccugcacgccagcagccccaccgccagccagaacaacagcaaggccgccgugaacagcgccagcagcuucaacagcagcggcagcugguacagauggaaccacagcaccuaccugcacuaa

SEQ ID NO: 21822 - RNA, 1332 nt, Artificial Sequence
  POU3F2__Homo_sapiens__NP_005595
auggccaccgccgccagcaaccacuacagccugcugaccagcagcgccagcaucgugcacgccgagccccccggcggcaugcagcagggcgccggcggcuacagagaggcccagagccuggugcagggcgacuacggcgcccugcagagcaacggccacccccugagccacgcccaccaguggaucaccgcccugagccacggcggcggcggcggcggcggcggcggcggcggcggcggcggcggcggcggcggcggcggcggcgacggcagccccuggagcaccagcccccugggccagcccgacaucaagcccagcgugguggugcagcagggcggcagaggcgacgagcugcacggccccggcgcccugcagcagcagcaccagcagcagcagcagcagcagcagcagcagcagcagcagcagcagcagcagcagcagcagcagagacccccccaccuggugcaccacgccgccaaccaccaccccggccccggcgccuggagaagcgccgccgccgccgcccaccugccccccagcaugggcgccagcaacggcggccugcuguacagccagcccagcuucaccgugaacggcaugcugggcgccggcggccagcccgccggccugcaccaccacggccugagagacgcccacgacgagccccaccacgccgaccaccacccccacccccacagccacccccaccagcagccccccccccccccccccccccagggcccccccggccaccccggcgcccaccacgacccccacagcgacgaggacacccccaccagcgacgaccuggagcaguucgccaagcaguucaagcagagaagaaucaagcugggcuucacccaggccgacgugggccuggcccugggcacccuguacggcaacguguucagccagaccaccaucugcagauucgaggcccugcagcugagcuucaagaacaugugcaagcugaagccccugcugaacaaguggcuggaggaggccgacagcagcagcggcagccccaccagcaucgacaagaucgccgcccagggcagaaagagaaagaagagaaccagcaucgaggugagcgugaagggcgcccuggagagccacuuccugaagugccccaagcccagcgcccaggagaucaccagccuggccgacagccugcagcuggagaaggagguggugagagugugguucugcaacagaagacagaaggagaagagaaugaccccccccggcggcacccugcccggcgccgaggacguguacggcggcagcagagacacccccccccaccacggcgugcagacccccgugcaguaa

SEQ ID NO: 21823 - RNA, 1503 nt, Artificial Sequence
  POU3F3__Homo_sapiens__NP_006227
auggccaccgccgccagcaaccccuaccugcccggcaacagccugcuggccgccggcagcaucgugcacagcgacgccgccggcgccggcggcggcggcggcggcggcggcggcggcggcggcggcggcgccggcggcggcggcggcggcaugcagcccggcagcgccgccgugaccagcggcgccuacagaggcgaccccagcagcgugaagauggugcagagcgacuucaugcagggcgccauggccgccagcaacggcggccacaugcugagccacgcccaccagugggugaccgcccugccccacgccgccgccgccgccgccgccgccgccgccgccgccguggaggccagcagccccuggagcggcagcgccgugggcauggccggcagcccccagcagcccccccagcccccccccccccccccccagggccccgacgugaagggcggcgccggcagagacgaccugcacgccggcaccgcccugcaccacagaggccccccccaccugggccccccccccccccccccccaccagggccaccccggcggcuggggcgccgccgccgccgccgccgccgccgccgccgccgccgccgccgccgcccaccugcccagcauggccggcggccagcagccccccccccagagccugcuguacagccagcccggcggcuucaccgugaacggcaugcugagcgccccccccggccccggcggcggcggcggcggcgccggcggcggcgcccagagccuggugcaccccggccuggugagaggcgacacccccgagcuggccgagcaccaccaccaccaccaccaccacgcccacccccaccccccccacccccaccacgcccagggccccccccaccacggcggcggcggcggcggcgccggccccggccugaacagccacgacccccacagcgacgaggacacccccaccagcgacgaccuggagcaguucgccaagcaguucaagcagagaagaaucaagcugggcuucacccaggccgacgugggccuggcccugggcacccuguacggcaacguguucagccagaccaccaucugcagauucgaggcccugcagcugagcuucaagaacaugugcaagcugaagccccugcugaacaaguggcuggaggaggccgacagcagcaccggcagccccaccagcaucgacaagaucgccgcccagggcagaaagagaaagaagagaaccagcaucgaggugagcgugaagggcgcccuggagagccacuuccugaagugccccaagcccagcgcccaggagaucaccaaccuggccgacagccugcagcuggagaaggagguggugagagugugguucugcaacagaagacagaaggagaagagaaugaccccccccggcauccagcagcagacccccgacgacguguacagccaggugggcaccgugagcgccgacaccccccccccccaccacggccugcagaccagcgugcaguaa

SEQ ID NO: 21824 - RNA, 1086 nt, Artificial Sequence
  POU3F4__Homo_sapiens__NP_000298
auggccaccgccgccagcaaccccuacagcauccugagcagcaccagccuggugcacgccgacagcgccggcaugcagcagggcagccccuucagaaacccccagaagcugcugcagagcgacuaccugcagggcgugcccagcaacggccacccccugggccaccacugggugaccagccugagcgacggcggccccuggagcagcacccuggccaccagcccccuggaccagcaggacgugaagcccggcagagaggaccugcagcugggcgccaucauccaccacagaagcccccacguggcccaccacagcccccacaccaaccaccccaacgccuggggcgccagccccgcccccaaccccagcaucaccagcagcggccagccccugaacguguacagccagcccggcuucaccgugagcggcaugcuggagcacggcggccugacccccccccccgccgccgccagcgcccagagccugcaccccgugcugagagagccccccgaccacggcgagcugggcagccaccacugccaggaccacagcgacgaggagacccccaccagcgacgagcuggagcaguucgccaagcaguucaagcagagaagaaucaagcugggcuucacccaggccgacgugggccuggcccugggcacccuguacggcaacguguucagccagaccaccaucugcagauucgaggcccugcagcugagcuucaagaacaugugcaagcugaagccccugcugaacaaguggcuggaggaggccgacagcagcaccggcagccccaccagcaucgacaagaucgccgcccagggcagaaagagaaagaagagaaccagcaucgaggugagcgugaagggcgugcuggagacccacuuccugaagugccccaagcccgccgcccaggagaucagcagccuggccgacagccugcagcuggagaaggagguggugagagugugguucugcaacagaagacagaaggagaagagaaugaccccccccggcgaccagcagccccacgagguguacagccacaccgugaagaccgacaccagcugccacgaccuguaa

SEQ ID NO: 21825 - RNA, 1260 nt, Artificial Sequence
  POU4F1__Homo_sapiens__NP_006228
augaugagcaugaacagcaagcagccccacuucgccaugcaccccacccugcccgagcacaaguaccccagccugcacagcagcagcgaggccaucagaagagccugccugcccacccccccccugcagagcaaccuguucgccagccuggacgagacccugcuggccagagccgaggcccuggccgccguggacaucgccgugagccagggcaagagccaccccuucaagcccgacgccaccuaccacaccaugaacagcgugcccugcaccagcaccagcaccgugccccuggcccaccaccaccaccaccaccaccaccaccaggcccuggagcccggcgaccugcuggaccacaucagcagccccagccuggcccugauggccggcgccggcggcgccggcgccgccgccggcggcggcggcgcccacgacggccccggcggcggcggcggccccggcggcggcggcggccccggcggcggccccggcggcggcggcggcggcggccccggcggcggcggcggcggccccggcggcggccugcugggcggcagcgcccacccccacccccacaugcacagccugggccaccugagccaccccgccgccgccgccgccaugaacaugcccagcggccugccccaccccggccugguggccgccgccgcccaccacggcgccgccgccgccgccgccgccgccgccgccggccagguggccgccgccagcgccgccgccgccguggugggcgccgccggccuggccagcaucugcgacagcgacaccgaccccagagagcuggaggccuucgccgagagauucaagcagagaagaaucaagcugggcgugacccaggccgacgugggcagcgcccuggccaaccugaagauccccggcgugggcagccugagccagagcaccaucugcagauucgagagccugacccugagccacaacaacaugaucgcccugaagcccauccugcaggccuggcuggaggaggccgagggcgcccagagagagaagaugaacaagcccgagcuguucaacggcggcgagaagaagagaaagagaaccagcaucgccgcccccgagaagagaagccuggaggccuacuucgccgugcagcccagacccagcagcgagaagaucgccgccaucgccgagaagcuggaccugaagaagaacguggugagagugugguucugcaaccagagacagaagcagaagagaaugaaguucagcgccaccuacuaa

SEQ ID NO: 21826 - RNA, 1230 nt, Artificial Sequence
  POU4F2__Homo_sapiens__NP_004566
augaugaugaugagccugaacagcaagcaggccuucagcaugccccacggcggcagccugcacguggagcccaaguacagcgcccugcacagcaccagccccggcagcagcgcccccaucgcccccagcgccagcagccccagcagcagcagcaacgccggcggcggcggcggcggcggcggcggcggcggcggcggcggcggcagaagcagcagcagcagcagcagcggcagcagcggcggcggcggcagcgaggccaugagaagagccugccugcccaccccccccagcaacaucuucggcggccuggacgagagccugcuggccagagccgaggcccuggccgccguggacaucgugagccagagcaagagccaccaccaccaccccccccaccacagccccuucaagcccgacgccaccuaccacaccaugaacaccauccccugcaccagcgccgccagcagcagcagcgugcccaucagccaccccagcgcccuggccggcacccaccaccaccaccaccaccaccaccaccaccaccaccagccccaccaggcccuggagggcgagcugcuggagcaccugagccccggccuggcccugggcgccauggccggccccgacggcgccguggugagcacccccgcccacgccccccacauggccaccaugaaccccaugcaccaggccgcccugagcauggcccacgcccacggccugcccagccacaugggcugcaugagcgacguggacgccgaccccagagaccuggaggccuucgccgagagauucaagcagagaagaaucaagcugggcgugacccaggccgacgugggcagcgcccuggccaaccugaagauccccggcgugggcagccugagccagagcaccaucugcagauucgagagccugacccugagccacaacaacaugaucgcccugaagcccauccugcaggccuggcuggaggaggccgagaagagccacagagagaagcugaccaagcccgagcuguucaacggcgccgagaagaagagaaagagaaccagcaucgccgcccccgagaagagaagccuggaggccuacuucgccauccagcccagacccagcagcgagaagaucgccgccaucgccgagaagcuggaccugaagaagaacguggugagagugugguucugcaaccagagacagaagcagaagagaaugaaguacagcgccggcaucuaa

SEQ ID NO: 21827 - RNA, 1017 nt, Artificial Sequence
  POU4F3__Homo_sapiens__NP_002691
augauggccaugaacagcaagcagcccuucggcaugcaccccgugcugcaggagcccaaguucagcagccugcacagcggcagcgaggccaugagaagagugugccugcccgccccccagcugcagggcaacaucuucggcagcuucgacgagagccugcuggccagagccgaggcccuggccgccguggacaucgugagccacggcaagaaccaccccuucaagcccgacgccaccuaccacaccaugagcagcgugcccugcaccagcaccagcagcaccgugcccaucagccaccccgccgcccugaccagccacccccaccacgccgugcaccagggccuggagggcgaccugcuggagcacaucagccccacccugagcgugagcggccugggcgcccccgagcacagcgugaugcccgcccagauccacccccaccaccugggcgccaugggccaccugcaccaggccaugggcaugagccacccccacaccguggccccccacagcgccaugcccgccugccugagcgacguggagagcgaccccagagagcuggaggccuucgccgagagauucaagcagagaagaaucaagcugggcgugacccaggccgacgugggcgccgcccuggccaaccugaagauccccggcgugggcagccugagccagagcaccaucugcagauucgagagccugacccugagccacaacaacaugaucgcccugaagcccgugcugcaggccuggcuggaggaggccgaggccgccuacagagagaagaacagcaagcccgagcuguucaacggcagcgagagaaagagaaagagaaccagcaucgccgcccccgagaagagaagccuggaggccuacuucgccauccagcccagacccagcagcgagaagaucgccgccaucgccgagaagcuggaccugaagaagaacguggugagagugugguucugcaaccagagacagaagcagaagagaaugaaguacagcgccgugcacuaa

SEQ ID NO: 21828 - RNA, 1080 nt, Artificial Sequence
  POU5F1B__Homo_sapiens__NP_001153014
auggccggccaccuggccagcgacuucgccuucagccccccccccggcggcggcggcgacggccccuggggcgccgagcccggcuggguggacccccugaccuggcugagcuuccagggcccccccggcggccccggcaucggccccggcgugggccccggcagcgagguguggggcaucccccccugccccccccccuacgagcugugcggcggcauggccuacugcggcccccaggugggcgugggccuggugccccagggcggccuggagaccagccagcccgagagcgaggccggcgugggcguggagagcaacagcaacggcgccagccccgagcccugcaccgugccccccggcgccgugaagcuggagaaggagaagcuggagcagaaccccgagaagagccaggacaucaaggcccugcagaaggagcuggagcaguucgccaagcugcugaagcagaagagaaucacccugggcuacacccaggccgacgugggccugauccugggcgugcuguucggcaagguguucagccagaagaccaucugcagauucgaggcccugcagcugagcuucaagaacaugugcaagcugagaccccugcugcagaaguggguggaggaggccgacaacaacgagaaccugcaggagaucugcaaggccgagacccugaugcaggccagaaagagaaagagaaccagcaucgagaacagagugagaggcaaccuggagaaccuguuccugcagugccccaagcccacccugcagaucagccacaucgcccagcagcugggccuggagaaggacguggugagagugugguucugcaacagaagacagaagggcaagagaagcagcagcgacuacgcccagagagaggacuucgaggccgccggcagccccuucagcggcggccccgugagcuucccccccgcccccggcccccacuucggcacccccggcuacggcagcccccacuucaccgcccuguacagcagcgugcccuuccccgagggcgagguguucccccccgugagcgugaucacccugggcagccccaugcacagcaacuaa

SEQ ID NO: 21829 - RNA, 495 nt, Artificial Sequence
  POU5F1__Homo_sapiens__NP_001272915
augugcaagcugagaccccugcugcagaaguggguggaggaggccgacaacaacgagaaccugcaggagaucugcaaggccgagacccuggugcaggccagaaagagaaagagaaccagcaucgagaacagagugagaggcaaccuggagaaccuguuccugcagugccccaagcccacccugcagcagaucagccacaucgcccagcagcugggccuggagaaggacguggugagagugugguucugcaacagaagacagaagggcaagagaagcagcagcgacuacgcccagagagaggacuucgaggccgccggcagccccuucagcggcggccccgugagcuucccccuggcccccggcccccacuucggcacccccggcuacggcagcccccacuucaccgcccuguacagcagcgugcccuuccccgagggcgaggccuucccccccgugagcgugaccacccugggcagccccaugcacagcaacuaa

SEQ ID NO: 21830 - RNA, 906 nt, Artificial Sequence
  POU6F1__Homo_sapiens__NP_002693
augcccggcaucagcagccagauccugaccaacgcccagggccaggugaucggcacccugcccuggguggugaacagcgccagcguggccgcccccgcccccgcccagagccugcaggugcaggccgugaccccccagcugcugcugaacgcccagggccaggugaucgccacccuggccagcagcccccugcccccccccguggccgugagaaagcccagcacccccgagagccccgccaagagcgaggugcagcccauccagcccacccccaccgugccccagcccgccguggugaucgccagccccgcccccgccgccaagcccagcgccagcgcccccauccccaucaccugcagcgagacccccaccgugagccagcuggugagcaagccccacacccccagccuggacgaggacggcaucaaccuggaggagaucagagaguucgccaagaacuucaagaucagaagacugagccugggccugacccagacccaggugggccaggcccugaccgccaccgagggccccgccuacagccagagcgccaucugcagauucgagaagcuggacaucacccccaagagcgcccagaagcugaagcccgugcuggagaaguggcugaacgaggccgagcugagaaaccaggagggccagcagaaccugauggaguucgugggcggcgagcccagcaagaagagaaagagaagaaccagcuucaccccccaggccaucgaggcccugaacgccuacuucgagaagaacccccugcccaccggccaggagaucaccgagaucgccaaggagcugaacuacgacagagagguggugagagugugguucugcaacagaagacagacccugaagaacaccagcaagcugaacguguuccagauccccuaa

SEQ ID NO: 21831 - RNA, 1968 nt, Artificial Sequence
  POU6F2__Homo_sapiens__NP_001159490
augagcgcccugcugcaggaccccaugaucgccggccaggugagcaagccccugcugagcgugagaagcgagaugaacgccgagcugagaggcgaggacaaggccgccaccagcgacagcgagcugaacgagccccugcuggcccccguggagagcaacgacagcgaggacacccccagcaagcuguucggcgccagaggcaaccccgcccugagcgaccccggcacccccgaccagcaccaggccagccagacccacccccccuuccccgugggcccccagccccugcugaccgcccagcagcuggccagcgccguggccggcgugaugcccggcggcccccccgcccugaaccagcccauccugauccccuucaacauggccggccagcugggcggccagcagggccuggugcugacccugcccaccgccaaccugaccaacauccagggccugguggccgccgccgccgccggcggcaucaugacccugccccugcagaaccugcaggccaccagcagccugaacagccagcugcagcagcugcagcugcagcugcagcagcagcagcagcagcagcagcagcagcccccccccagcaccaaccagcacccccagcccgccccccaggcccccagccagagccagcagcagccccugcagcccacccccccccagcagcccccccccgccagccagcagccccccgcccccaccagccagcugcagcaggccccccagccccagcagcaccagccccacagccacagccagaaccagaaccagcccagccccacccagcagagcagcagccccccccagaagcccagccagagccccggccacggccugcccagcccccugaccccccccaacccccugcagcuggugaacaacccccuggccagccaggccgccgccgccgccgccgccaugagcagcaucgccagcagccaggccuucggcaacgcccugagcagccugcagggcgugaccggccagcuggugaccaacgcccagggccagaucaucggcaccaucccccugaugcccaaccccggccccagcagccaggccgccagcggcacccagggccugcaggugcagcccaucaccccccagcugcugaccaacgcccagggccagaucaucgccaccgugaucggcaaccagauccugcccgugaucaacacccagggcaucacccugagccccaucaagcccggccagcagcugcaccagcccagccagaccagcgugggccaggccgccagccagggcaaccugcugcaccuggcccacagccaggccagcaugagccagagccccgugagacaggccagcagcagcagcagcagcagcagcagcagcagcgcccugagcgugggccagcuggugagcaacccccagaccgccgccggcgagguggacggcgugaaccuggaggagaucagagaguucgccaaggccuucaagaucagaagacugagccugggccugacccagacccaggugggccaggcccugagcgccaccgagggccccgccuacagccagagcgccaucugcagauucgagaagcuggacaucacccccaagagcgcccagaagaucaagcccgugcuggagagauggauggccgaggccgaggccagacacagagccggcaugcagaaccugaccgaguucaucggcagcgagcccagcaagaagagaaagagaagaaccagcuucaccccccaggcccuggagauccugaacgcccacuucgagaagaacacccaccccagcggccaggagaugaccgagaucgccgagaagcugaacuacgacagagagguggugagagugugguucugcaacaagagacaggcccugaagaacaccaucaagagacugaagcagcacgagcccgccaccgccgugccccuggagccccugaccgacagccuggaggagaacagcuaa

SEQ ID NO: 21832 - RNA, 870 nt, Artificial Sequence
  PPA1__Homo_sapiens__NP_066952
augagcggcuucagcaccgaggagagagccgcccccuucagccuggaguacagaguguuccugaagaacgagaagggccaguacaucagccccuuccacgacauccccaucuacgccgacaaggacguguuccacauggugguggaggugcccagauggagcaacgccaagauggagaucgccaccaaggacccccugaaccccaucaagcaggacgugaagaagggcaagcugagauacguggccaaccuguuccccuacaagggcuacaucuggaacuacggcgccaucccccagaccugggaggaccccggccacaacgacaagcacaccggcugcugcggcgacaacgaccccaucgacgugugcgagaucggcagcaaggugugcgccagaggcgagaucaucggcgugaaggugcugggcauccuggccaugaucgacgagggcgagaccgacuggaaggugaucgccaucaacguggacgaccccgacgccgccaacuacaacgacaucaacgacgugaagagacugaagcccggcuaccuggaggccaccguggacugguucagaagauacaaggugcccgacggcaagcccgagaacgaguucgccuucaacgccgaguucaaggacaaggacuucgccaucgacaucaucaagagcacccacgaccacuggaaggcccuggugaccaagaagaccaacggcaagggcaucagcugcaugaacaccacccugagcgagagccccuucaagugcgaccccgacgccgccagagccaucguggacgcccugcccccccccugcgagagcgccugcaccgugcccaccgacguggacaagugguuccaccaccagaagaacuaa

SEQ ID NO: 21833 - RNA, 918 nt, Artificial Sequence
  PPA2__Homo_sapiens__NP_008834
augagcgcccugcugagacugcugagaaccggcgcccccgccgccgccugccugagacugggcaccagcgccggcaccggcagcagaagagccauggcccuguaccacaccgaggagagaggccagcccugcagccagaacuacagacuguucuucaagaacgugaccggccacuacaucagccccuuccacgacaucccccugaaggugaacagcaaggaggagaacggcauccccaugaagaaggccagaaacgacgaguacgagaaccuguucaacaugaucguggagauccccagauggaccaacgccaagauggagaucgccaccaaggagcccaugaaccccaucaagcaguacgugaaggacggcaagcugagauacguggccaacaucuuccccuacaagggcuacaucuggaacuacggcacccugccccagauccugagcugcggcgaggugauccacgugaagauccugggcauccuggcccugaucgacgagggcgagaccgacuggaagcugaucgccaucaacgccaacgaccccgaggccagcaaguuccacgacaucgacgacgugaagaaguucaagcccggcuaccuggaggccacccugaacugguucagacuguacaaggugcccgacggcaagcccgagaaccaguucgccuucaacggcgaguucaagaacaaggccuucgcccuggaggugaucaagagcacccaccagugcuggaaggcccugcugaugaagaagugcaacggcggcgccaucaacugcaccaacgugcagaucagcgacagccccuucagaugcacccaggaggaggccagaagccugguggagagcgugagcagcagccccaacaaggagagcaacgaggaggagcagguguggcacuuccugggcaaguaa

SEQ ID NO: 21834 - RNA, 855 nt, Artificial Sequence
  PPAP2A__Homo_sapiens__NP_003702
auguucgacaagaccagacugcccuacguggcccuggacgugcugugcgugcugcuggccggccugcccuucgccauccugaccagcagacacacccccuuccagagaggcguguucugcaacgacgagagcaucaaguaccccuacaaggaggacaccauccccuacgcccugcugggcggcaucaucauccccuucagcaucaucgugaucauccugggcgagacccugagcguguacugcaaccugcugcacagcaacagcuucaucagaaacaacuacaucgccaccaucuacaaggccaucggcaccuuccuguucggcgccgccgccagccagagccugaccgacaucgccaaguacagcaucggcagacugagaccccacuuccuggacgugugcgaccccgacuggagcaagaucaacugcagcgacggcuacaucgaguacuacaucugcagaggcaacgccgagagagugaaggagggcagacugagcuucuacagcggccacagcagcuucagcauguacugcaugcuguucguggcccuguaccugcaggccagaaugaagggcgacugggccagacugcugagacccacccugcaguucggccugguggccgugagcaucuacgugggccugagcagagugagcgacuacaagcaccacuggagcgacgugcugaccggccugauccagggcgcccugguggccauccugguggccguguacgugagcgacuucuucaaggagagaaccagcuucaaggagagaaaggaggaggacagccacaccacccugcacgagacccccaccaccggcaaccacuaccccagcaaccaccagcccuaa

SEQ ID NO: 21835 - RNA, 867 nt, Artificial Sequence
  PPAP2C__Homo_sapiens__NP_003703
augcagagaagauggguguucgugcugcuggacgugcugugccugcugguggccagccugcccuucgccauccugacccuggugaacgcccccuacaagagaggcuucuacugcggcgacgacagcaucagauaccccuacagacccgacaccaucacccacggccugauggccggcgugaccaucaccgccaccgugauccuggugagcgccggcgaggccuaccugguguacaccgacagacuguacagcagaagcgacuucaacaacuacguggccgccguguacaaggugcugggcaccuuccuguucggcgccgccgugagccagagccugaccgaccuggccaaguacaugaucggcagacugagacccaacuuccuggccgugugcgaccccgacuggagcagagugaacugcagcguguacgugcagcuggagaaggugugcagaggcaaccccgccgacgugaccgaggccagacugagcuucuacagcggccacagcagcuucggcauguacugcaugguguuccuggcccuguacgugcaggccagacugugcuggaagugggccagacugcugagacccaccgugcaguucuuccugguggccuucgcccuguacgugggcuacaccagagugagcgacuacaagcaccacuggagcgacgugcuggugggccugcugcagggcgcccugguggccgcccugaccgugugcuacaucagcgacuucuucaaggccagacccccccagcacugccugaaggaggaggagcuggagagaaagcccagccugagccugacccugacccugggcgaggccgaccacaaccacuacggcuacccccacagcagcagcuaa

SEQ ID NO: 21836 - RNA, 795 nt, Artificial Sequence
  PPAPDC1B__Homo_sapiens__NP_001096029
augggcaaggccgccgccgccguggccuucggcgccgaggugggcgugagacuggcccuguucgccgccuuccuggugaccgagcugcugccccccuuccagagacugauccagcccgaggagauguggcuguacagaaaccccuacguggaggccgaguacuuccccaccaagcccauguucgugaucgccuuccugagcccccugagccugaucuuccuggccaaguuccugaagaaggccgacaccagagacagcagacaggccugccuggccgccagccuggcccuggcccugaacggcguguucaccaacaccaucaagcugaucgugggcagacccagacccgacuucuucuacagaugcuuccccgacggccuggcccacagcgaccugaugugcaccggcgacaaggacguggugaacgagggcagaaagagcuuccccagcggccacagcagcuucgccuucgccggccuggccuucgccagcuucuaccuggccggcaagcugcacugcuucaccccccagggcagaggcaagagcuggagauucugcgccuuccugagcccccugcuguucgccgccgugaucgcccugagcagaaccugcgacuacaagcaccacuggcaggacgugcuggugggcagcaugaucggcaugaccuucgccuacgugugcuacagacaguacuaccccccccugaccgacgccgagugccacaagcccuuccaggacaagcuggugcugagcaccgcccagaagcccggcgacagcuacugcuucgacaucuaa

SEQ ID NO: 21837 - RNA, 888 nt, Artificial Sequence
  PPAPDC2__Homo_sapiens__NP_982278
augcccagccccagaagaagcauggagggcagaccccugggcgugagcgccagcagcagcagcagcagccccggcagccccgcccacggcggcggcggcggcggcagcagauucgaguuccagagccugcugagcagcagagccaccgccguggaccccaccugcgccagacugagagccagcgagagccccgugcacagaagaggcagcuucccccuggccgccgccggccccagccagagccccgcccccccccugcccgaggaggacagaauggaccugaaccccagcuuccugggcaucgcccugagaagccugcuggccaucgaccuguggcugagcaagaagcugggcgugugcgccggcgagagcagcagcuggggcagcgugagaccccugaugaagcugcuggagaucagcggccacggcauccccuggcugcugggcacccuguacugccugugcagaagcgacagcugggccggcagagaggugcugaugaaccugcuguucgcccugcugcuggaccugcugcugguggcccugaucaagggccuggugagaagaagaagacccgcccacaaccagauggacauguucgugacccugagcguggacaaguacagcuuccccagcggccacgccaccagagccgcccugaugagcagauucauccugaaccaccuggugcuggccaucccccugagagugcugguggugcugugggccuucgugcugggccugagcagagugaugcugggcagacacaacgugaccgacguggccuucggcuucuuccugggcuacaugcaguacagcaucguggacuacugcuggcugagcccccacaacgcccccgugcuguuccugcuguggagccagagauaa

SEQ ID NO: 21838 - RNA, 816 nt, Artificial Sequence
  PPAPDC3__Homo_sapiens__NP_116117
augcccgccagccagagcagagccagagccagagacagaaacaacgugcugaacagagccgaguuccugagccugaaccagccccccaagggcggccccgagcccagaagcagcggcagaaaggccagcggccccagcgcccagcccccccccgccggcgacggcgccagagagagaagacagagccagcagcugcccgaggaggacugcaugcagcugaaccccagcuucaagggcaucgccuucaacagccugcuggccaucgacaucugcaugagcaagagacugggcgugugcgccggcagagccgccagcugggccagcgccagaagcauggugaagcugaucggcaucaccggccacggcauccccuggaucggcggcaccauccugugccuggugaagagcagcacccuggccggccaggaggugcugaugaaccugcugcuggcccugcugcuggacaucaugaccguggccggcgugcagaagcugaucaagagaagaggccccuacgagaccagccccagccugcuggacuaccugaccauggacaucuacgccuuccccgccggccacgccagcagagccgccauggugagcaaguucuuccugagccaccuggugcuggccgugccccugagagugcugcuggugcugugggcccugugcgugggccugagcagagugaugaucggcagacaccacgugaccgacgugcugagcggcuucgugaucggcuaccugcaguucagacugguggagcugguguggaugcccagcagcaccugccagaugcugaucagcgccugguaa

SEQ ID NO: 21839 - RNA, 1407 nt, Artificial Sequence
  PPARA__Homo_sapiens__XP_011528545
augguggacaccgagagcccccugugcccccugagcccccuggaggccggcgaccuggagagcccccugagcgaggaguuccugcaggagaugggcaacauccaggagaucagccagagcaucggcgaggacagcagcggcagcuucggcuucaccgaguaccaguaccugggcagcugccccggcagcgacggcagcgugaucaccgacacccugagccccgccagcagccccagcagcgugaccuaccccguggugcccggcagcguggacgagagccccagcggcgcccugaacaucgagugcagaaucugcggcgacaaggccagcggcuaccacuacggcgugcacgccugcgagggcugcaagggcuucuucagaagaaccaucagacugaagcugguguacgacaagugcgacagaagcugcaagauccagaagaagaacagaaacaagugccaguacugcagauuccacaagugccugagcgugggcaugagccacaacgccaucagauucggcagaaugcccagaagcgagaaggccaagcugaaggccgagauccugaccugcgagcacgacaucgaggacagcgagaccgccgaccugaagagccuggccaagagaaucuacgaggccuaccugaagaacuucaacaugaacaaggugaaggccagagugauccugagcggcaaggccagcaacaacccccccuucgugauccacgacauggagacccugugcauggccgagaagacccugguggccaagcugguggccaacggcauccagaacaaggaggccgaggugagaaucuuccacugcugccagugcaccagcguggagaccgugaccgagcugaccgaguucgccaaggccauccccggcuucgccaaccuggaccugaacgaccaggugacccugcugaaguacggcguguacgaggccaucuucgccaugcugagcagcgugaugaacaaggacggcaugcugguggccuacggcaacggcuucaucaccagagaguuccugaagagccugagaaagcccuucugcgacaucauggagcccaaguucgacuucgccaugaaguucaacgcccuggagcuggacgacagcgacaucagccuguucguggccgccaucaucugcugcggcgacagacccggccugcugaacgugggccacaucgagaagaugcaggagggcaucgugcacgugcugagacugcaccugcagagcaaccaccccgacgacaucuuccuguuccccaagcugcugcagaagauggccgaccugagacagcuggugaccgagcacgcccagcuggugcagaucaucaagaagaccgagagcgacgccgcccugcacccccugcugcaggagaucuacagagacauguacuaa

SEQ ID NO: 21840 - RNA, 1209 nt, Artificial Sequence
  PPARD__Homo_sapiens__NP_001165290
augcaccagagagaccugagcagaagcagcagcccccccagccugcuggaccagcugcagaugggcugcgacggcgccagcugcggcagccugaacauggagugcagagugugcggcgacaaggccagcggcuuccacuacggcgugcacgccugcgagggcugcaagggcuucuucagaagaaccaucagaaugaagcuggaguacgagaagugcgagagaagcugcaagauccagaagaagaacagaaacaagugccaguacugcagauuccagaagugccuggcccugggcaugagccacaacgccaucagauucggcagaaugcccgaggccgagaagagaaagcugguggccggccugaccgccaacgagggcagccaguacaacccccagguggccgaccugaaggccuucagcaagcacaucuacaacgccuaccugaagaacuucaacaugaccaagaagaaggccagaagcauccugaccggcaaggccagccacaccgcccccuucgugauccacgacaucgagacccuguggcaggccgagaagggccugguguggaagcagcuggugaacggccugccccccuacaaggagaucagcgugcacguguucuacagaugccagugcaccaccguggagaccgugagagagcugaccgaguucgccaagagcauccccagcuucagcagccuguuccugaacgaccaggugacccugcugaaguacggcgugcacgaggccaucuucgccaugcuggccagcaucgugaacaaggacggccugcugguggccaacggcagcggcuucgugaccagagaguuccugagaagccugagaaagcccuucagcgacaucaucgagcccaaguucgaguucgccgugaaguucaacgcccuggagcuggacgacagcgaccuggcccuguucaucgccgccaucauccugugcggcgacagacccggccugaugaacgugcccagaguggaggccauccaggacaccauccugagagcccuggaguuccaccugcaggccaaccaccccgacgcccaguaccuguuccccaagcugcugcagaagauggccgaccugagacagcuggugaccgagcacgcccagaugaugcagagaaucaagaagaccgagaccgagaccagccugcacccccugcugcaggagaucuacaaggacauguacuaa

SEQ ID NO: 21841 - RNA, 2397 nt, Artificial Sequence
  PPARGC1A__Homo_sapiens__NP_037393
auggccugggacaugugcaaccaggacagcgagagcguguggagcgacaucgagugcgccgcccuggugggcgaggaccagccccugugccccgaccugcccgagcuggaccugagcgagcuggacgugaacgaccuggacaccgacagcuuccugggcggccugaaguggugcagcgaccagagcgagaucaucagcaaccaguacaacaacgagcccagcaacaucuucgagaagaucgacgaggagaacgaggccaaccugcuggccgugcugaccgagacccuggacagccugcccguggacgaggacggccugcccagcuucgacgcccugaccgacggcgacgugaccaccgacaacgaggccagccccagcagcaugcccgacggcaccccccccccccaggaggccgaggagcccagccugcugaagaagcugcugcuggcccccgccaacacccagcugagcuacaacgagugcagcggccugagcacccagaaccacgccaaccacaaccacagaaucagaaccaaccccgccaucgugaagaccgagaacagcuggagcaacaaggccaagagcaucugccagcagcagaagccccagagaagacccugcagcgagcugcugaaguaccugaccaccaacgacgaccccccccacaccaagcccaccgagaacagaaacagcagcagagacaagugcaccagcaagaagaagagccacacccagagccagagccagcaccugcaggccaagcccaccacccugagccugccccugacccccgagagccccaacgaccccaagggcagccccuucgagaacaagaccaucgagagaacccugagcguggagcugagcggcaccgccggccugaccccccccaccacccccccccacaaggccaaccaggacaaccccuucagagccagccccaagcugaagagcagcugcaagaccguggugcccccccccagcaagaagcccagauacagcgagagcagcggcacccagggcaacaacagcaccaagaagggccccgagcagagcgagcuguacgcccagcugagcaagagcagcgugcugaccggcggccacgaggagagaaagaccaagagacccagccugagacuguucggcgaccacgacuacugccagagcaucaacagcaagaccgagauccugaucaacaucagccaggagcugcaggacagcagacagcuggagaacaaggacgugagcagcgacuggcagggccagaucugcagcagcaccgacagcgaccagugcuaccugagagagacccuggaggccagcaagcaggugagccccugcagcaccagaaagcagcugcaggaccaggagaucagagccgagcugaacaagcacuucggccaccccagccaggccguguucgacgacgaggccgacaagaccggcgagcugagagacagcgacuucagcaacgagcaguucagcaagcugcccauguucaucaacagcggccuggccauggacggccuguucgacgacagcgaggacgagagcgacaagcugagcuaccccugggacggcacccagagcuacagccuguucaacgugagccccagcugcagcagcuucaacagccccugcagagacagcgugagcccccccaagagccuguucagccagagaccccagagaaugagaagcagaagcagaagcuucagcagacacagaagcugcagcagaagccccuacagcagaagcagaagcagaagccccggcagcagaagcagcagcagaagcugcuacuacuacgagagcagccacuacagacacagaacccacagaaacagcccccuguacgugagaagcagaagcagaagccccuacagcagaagacccagauacgacagcuacgaggaguaccagcacgagagacugaagagagaggaguacagaagagaguacgagaagagagagagcgagagagccaagcagagagagagacagagacagaaggccaucgaggagagaagagugaucuacgugggcaagaucagacccgacaccaccagaaccgagcugagagacagauucgagguguucggcgagaucgaggagugcaccgugaaccugagagacgacggcgacagcuacggcuucaucaccuacagauacaccugcgacgccuucgccgcccuggagaacggcuacacccugagaagaagcaacgagaccgacuucgagcuguacuucugcggcagaaagcaguucuucaagagcaacuacgccgaccuggacagcaacagcgacgacuucgaccccgccagcaccaagagcaaguacgacagccuggacuucgacagccugcugaaggaggcccagagaagccugagaagauaa

SEQ ID NO: 21842 - RNA, 2955 nt, Artificial Sequence
  PPARGC1B__Homo_sapiens__NP_001166169
auggccggcaacgacugcggcgcccugcuggacgaggagcugagcagcuucuuccugaacuaccuggccgacacccagggcggcggcagcggcgaggagcagcuguacgccgacuuccccgagcuggaccugagccagcuggacgccagcgacuucgacagcgccaccugcuucggcgagcugcaguggugccccgagaacagcgagaccgagcccaaccaguacagccccgacgacagcgagcuguuccagaucgacagcgagaacgaggcccugcuggccgagcugaccaagacccuggacgacauccccgaggacgacgugggccuggccgccuuccccgcccuggacggcggcgacgcccugagcugcaccagcgccagccccgcccccagcagcgccccccccagccccgcccccgagaagcccagcgcccccgcccccgagguggacgagcugagccuggccgacagcacccaggacaagaaggcccccaugaugcagagccagagcagaagcugcaccgagcugcacaagcaccugaccagcgcccagugcugccugcaggacagaggccugcagccccccugccugcagagccccagacugcccgccaaggaggacaaggagcccggcgaggacugccccagcccccagcccgcccccgccagccccagagacagccuggcccugggcagagccgaccccggcgcccccgugagccaggaggacaugcaggccauggugcagcugaucagauacaugcacaccuacugccugccccagagaaagcugcccccccagacccccgagccccugcccaaggccugcagcaaccccagccagcaggugagaagcagacccuggagcagacaccacagcaaggccagcugggccgaguucagcauccugagagagcugcuggcccaggacgugcugugcgacgugagcaagcccuacagacuggccacccccguguacgccagccugacccccagaagcagacccagaccccccaaggacagccaggccagccccggcagacccagcagcguggaggaggugagaaucgccgccagccccaagagcaccggccccagacccagccugagaccccugagacuggaggugaagagagaggugagaagacccgccagacugcagcagcaggaggaggaggacgaggaggaggaggaggaggaggaggaggaggagaaggaggaggaggaggaguggggcagaaagagacccggcagaggccugcccuggaccaagcugggcagaaagcuggagagcagcgugugccccgugagaagaagcagaagacugaaccccgagcugggccccuggcugaccuucgccgacgagccccuggugcccagcgagccccagggcgcccugcccagccugugccuggcccccaaggccuacgacguggagagagagcugggcagccccaccgacgaggacagcggccaggaccagcagcugcugagaggcccccagauccccgcccuggagagccccugcgagagcggcugcggcgacauggacgaggaccccagcugcccccagcugccccccagagacagccccagaugccugaugcuggcccugagccagagcgaccccaccuucggcaagaagagcuucgagcagacccugaccguggagcugugcggcaccgccggccugaccccccccaccaccccccccuacaagcccaccgaggaggaccccuucaagcccgacaucaagcacagccugggcaaggagaucgcccugagccugcccagccccgagggccugagccugaaggccacccccggcgccgcccacaagcugcccaagaagcaccccgagagaagcgagcugcugagccaccugagacacgccaccgcccagcccgccagccaggccggccagaagagacccuucagcugcagcuucggcgaccacgacuacugccaggugcugagacccgagggcgugcugcagagaaaggugcugagaagcugggagcccagcggcgugcaccuggaggacuggccccagcagggcgcccccugggccgaggcccaggcccccggcagagaggaggacagaagcugcgacgccggcgccccccccaaggacagcacccugcugagagaccacgagaucagagccagccugaccaagcacuucggccugcuggagaccgcccuggaggaggaggaccuggccagcugcaagagccccgaguacgacaccguguucgaggacagcagcagcagcagcggcgagagcagcuuccugcccgaggaggaggaggaggagggcgaggaggaggaggaggacgacgaggaggaggacagcggcgugagccccaccugcagcgaccacugccccuaccagagcccccccagcaaggccaacagacagcugugcagcagaagcagaagcagcagcggcagcagccccugccacagcuggagccccgccaccagaagaaacuucagaugcgagagcagaggccccugcagcgacagaacccccagcaucagacacgccagaaagagaagagagaaggccaucggcgagggcagagugguguacauccagaaccugagcagcgacaugagcagcagagagcugaagagaagauucgagguguucggcgagaucgaggagugcgaggugcugaccagaaacagaagaggcgagaaguacggcuucaucaccuacagaugcagcgagcacgccgcccugagccugaccaagggcgccgcccugagaaagagaaacgagcccagcuuccagcugagcuacggcggccugagacacuucugcuggcccagauacaccgacuacgacagcaacagcgaggaggcccugcccgccagcggcaagagcaaguacgaggccauggacuucgacagccugcugaaggaggcccagcagagccugcacuaa

SEQ ID NO: 21843 - RNA, 1434 nt, Artificial Sequence
  PPARG__Homo_sapiens__NP_005028
augaccaugguggacaccgagaugcccuucuggcccaccaacuucggcaucagcagcguggaccugagcgugauggaggaccacagccacagcuucgacaucaagcccuucaccaccguggacuucagcagcaucagcaccccccacuacgaggacauccccuucaccagaaccgaccccgugguggccgacuacaaguacgaccugaagcugcaggaguaccagagcgccaucaagguggagcccgccagcccccccuacuacagcgagaagacccagcuguacaacaagccccacgaggagcccagcaacagccugauggccaucgagugcagagugugcggcgacaaggccagcggcuuccacuacggcgugcacgccugcgagggcugcaagggcuucuucagaagaaccaucagacugaagcugaucuacgacagaugcgaccugaacugcagaauccacaagaagagcagaaacaagugccaguacugcagauuccagaagugccuggccgugggcaugagccacaacgccaucagauucggcagaaugccccaggccgagaaggagaagcugcuggccgagaucagcagcgacaucgaccagcugaaccccgagagcgccgaccugagagcccuggccaagcaccuguacgacagcuacaucaagagcuucccccugaccaaggccaaggccagagccauccugaccggcaagaccaccgacaagagccccuucgugaucuacgacaugaacagccugaugaugggcgaggacaagaucaaguucaagcacaucaccccccugcaggagcagagcaaggagguggccaucagaaucuuccagggcugccaguucagaagcguggaggccgugcaggagaucaccgaguacgccaagagcauccccggcuucgugaaccuggaccugaacgaccaggugacccugcugaaguacggcgugcacgagaucaucuacaccaugcuggccagccugaugaacaaggacggcgugcugaucagcgagggccagggcuucaugaccagagaguuccugaagagccugagaaagcccuucggcgacuucauggagcccaaguucgaguucgccgugaaguucaacgcccuggagcuggacgacagcgaccuggccaucuucaucgccgugaucauccugagcggcgacagacccggccugcugaacgugaagcccaucgaggacauccaggacaaccugcugcaggcccuggagcugcagcugaagcugaaccaccccgagagcagccagcuguucgccaagcugcugcagaagaugaccgaccugagacagaucgugaccgagcacgugcagcugcugcaggugaucaagaagaccgagaccgacaugagccugcacccccugcugcaggagaucuacaaggaccuguacuaa

SEQ ID NO: 21844 - RNA, 1554 nt, Artificial Sequence
  PPAT__Homo_sapiens__NP_002694
auggagcuggaggagcugggcaucagagaggagugcggcguguucggcugcaucgccagcggcgaguggcccacccagcuggacgugccccacgugaucacccugggccuggugggccugcagcacagaggccaggagagcgccggcaucgugaccagcgacggcagcagcgugcccaccuucaagagccacaagggcaugggccuggugaaccacguguucaccgaggacaaccugaagaagcuguacgugagcaaccugggcaucggccacaccagauacgccaccaccggcaagugcgagcuggagaacugccagcccuucgugguggagacccugcacggcaagaucgccguggcccacaacggcgagcuggugaacgccgccagacugagaaagaagcugcugagacacggcaucggccugagcaccagcagcgacagcgagaugaucacccagcugcuggccuacacccccccccaggagcaggacgacacccccgacuggguggccagaaucaagaaccugaugaaggaggcccccaccgccuacagccugcugaucaugcacagagacgugaucuacgccgugagagaccccuacggcaacagaccccugugcaucggcagacugauccccgugagcgacaucaacgacaaggagaagaagaccagcgagaccgagggcuggguggugagcagcgagagcugcagcuuccugagcaucggcgccagauacuacagagaggugcugcccggcgagaucguggagaucagcagacacaacgugcagacccuggacaucaucagcagaagcgagggcaaccccguggccuucugcaucuucgaguacguguacuucgccagacccgacagcauguucgaggaccagaugguguacaccgugagauacagaugcggccagcagcuggccaucgaggcccccguggacgccgaccuggugagcaccgugcccgagagcgccacccccgccgcccuggccuacgccggcaagugcggccugcccuacguggaggugcugugcaagaacagauacgugggcagaaccuucauccagcccaacaugagacugagacagcugggcguggccaagaaguucggcgugcugagcgacaacuucaagggcaagagaaucgugcugguggacgacagcaucgugagaggcaacaccaucagccccaucaucaagcugcugaaggagagcggcgccaaggaggugcacaucagaguggccagcccccccaucaaguaccccugcuucaugggcaucaacauccccaccaaggaggagcugaucgccaacaagcccgaguucgaccaccuggccgaguaccugggcgccaacagcgugguguaccugagcguggagggccuggugagcagcgugcaggagggcaucaaguucaagaagcagaaggagaagaagcacgacaucaugauccaggagaacggcaacggccuggagugcuucgagaagagcggccacugcaccgccugccugaccggcaaguaccccguggagcuggagugguaa

SEQ ID NO: 21845 - RNA, 387 nt, Artificial Sequence
  PPBP__Homo_sapiens__NP_002695
augagccugagacuggacaccacccccagcugcaacagcgccagaccccugcacgcccugcaggugcugcugcugcugagccugcugcugaccgcccuggccagcagcaccaagggccagaccaagagaaaccuggccaagggcaaggaggagagccuggacagcgaccuguacgccgagcugagaugcaugugcaucaagaccaccagcggcauccaccccaagaacauccagagccuggaggugaucggcaagggcacccacugcaaccagguggaggugaucgccacccugaaggacggcagaaagaucugccuggaccccgacgcccccagaaucaagaagaucgugcagaagaagcuggccggcgacgagagcgccgacuaa

SEQ ID NO: 21846 - RNA, 246 nt, Artificial Sequence
  PPCDC__Homo_sapiens__NP_001288034
augagagccugggacagaagcaagccccugcuguucugccccgccaugaacaccgccaugugggagcaccccaucaccgcccagcagguggaccagcugaaggccuucggcuacguggagauccccugcguggccaagaagcuggugugcggcgacgagggccugggcgccauggccgaggugggcaccaucguggacaaggugaaggaggugcuguuccagcacagcggcuuccagcagagcuaa

SEQ ID NO: 21847 - RNA, 1776 nt, Artificial Sequence
  PPEF1__Homo_sapiens__NP_689412
augggcugcagcagcagcagcaccaagaccagaagaagcgacaccagccugagagccgcccugaucauccagaacugguacagaggcuacaaggccagacugaaggccagacagcacuacgcccugaccaucuuccagagcaucgaguacgccgacgagcagggccagaugcagcugagcaccuucuucagcuucaugcuggagaacuacacccacauccacaaggaggagcuggagcugagaaaccagagccuggagagcgagcaggacaugagagacagaugggacuacguggacagcaucgacgugcccgacagcuacaacggccccagacugcaguucccccugaccugcaccgacaucgaccugcugcuggaggccuucaaggagcagcagauccugcacgcccacuacgugcuggaggugcuguucgagaccaagaaggugcugaagcagaugcccaacuucacccacauccagaccagccccagcaaggaggugaccaucugcggcgaccugcacggcaagcuggacgaccuguuccugaucuucuacaagaacggccugcccagcgagagaaaccccuacguguucaacggcgacuucguggacagaggcaagaacagcaucgagauccugaugauccugugcgugagcuuccugguguaccccaacgaccugcaccugaacagaggcaaccacgaggacuucaugaugaaccugagauacggcuucaccaaggagauccugcacaaguacaagcugcacggcaagagaauccugcagauccuggaggaguucuacgccuggcugcccaucggcaccaucguggacaacgagauccuggugauccacggcggcaucagcgagaccaccgaccugaaccugcugcacagaguggagagaaacaagaugaagagcgugcugaucccccccaccgagaccaacagagaccacgacaccgacagcaagcacaacaaggugggcgugaccuucaacgcccacggcagaaucaagaccaacggcagccccaccgagcaccugaccgagcacgagugggagcagguggugaccaucuucagcgccagcaacuacuacgaggagggcagcaacagaggcgccuacaucaagcugugcagcggcaccacccccagauucuuccaguaccaggugaccaaggccaccugcuuccagccccugagacagagaguggacaccauggagaacagcgccaucaagauccugagagagagagugaucagcagaaagagcgaccugaccagagccuuccagcugcaggaccacagaaagagcggcaagcugagcgugagccagugggccuucugcauggagaacauccugggccugaaccugcccuggagaagccugagcagcaaccuggugaacaucgaccagaacggcaacguggaguacaugagcagcuuccagaacaucagaaucgagaagcccgugcaggaggcccacagcacccugguggagacccuguacagauacagaagcgaccuggagaucaucuucaacgccaucgacaccgaccacagcggccugaucagcguggaggaguucagagccauguggaagcuguucagcagccacuacaacgugcacaucgacgacagccaggugaacaagcuggccaacaucauggaccugaacaaggacggcagcaucgacuucaacgaguuccugaaggccuucuacguggugcacagauacgaggaccugaugaagcccgacgugaccaaccugggcuaa

SEQ ID NO: 21848 - RNA, 2262 nt, Artificial Sequence
  PPEF2__Homo_sapiens__XP_011530341
augggcagcggcaccagcacccagcaccacuucgccuuccagaacgccgagagagccuucaaggccgccgcccugauccagagaugguacagaagauacguggccagacuggagaugagaagaagaugcaccuggagcaucuuccagagcaucgaguacgccggccagcaggaccaggugaagcugcacgacuucuucagcuaccugauggaccacuucauccccagcagccacaacgacagagacuuccugaccagaaucuucaccgaggacagauucgcccaggacagcgagaugaagaagugcagcgacuacgagagcaucgaggugcccgacagcuacaccggccccagacugagcuucccccugcugcccgaccacgccaccgcccugguggaggccuucagacugaagcagcagcugcacgccagauacgugcugaaccugcuguacgagaccaagaagcaccuggugcagcugcccaacaucaacagagugagcaccugcuacagcgaggagaucaccgugugcggcgaccugcacggccagcuggacgaccugaucuucaucuucuacaagaacggccugcccagccccgagagaagcuacguguucaacggcgacuucguggacagaggcaaggacagcguggagauccugaugauccuguucgccuucaugcugguguaccccaaggaguuccaccugaacagaggcaaccacgaggaccacauggugaaccugagauacggcuucaccaaggaggugaugaacaaguacaaggugcacggcaaggagauccugagaacccugcaggacguguucugcuggcugccccuggccacccugaucgacgagaaggugcugauccugcacggcggcgugagcgacaucaccgaccuggagcugcuggacaagaucgagagaagcaagaucgugagcaccaugagaugcaagaccagacagaagagcgagaagcagauggaggagaagagaagagccaaccagaagagcagcgcccagggccccauccccugguuccugcccgagagcagaagccugcccagcagcccccugagacugggcagcuacaaggcccagaagaccagcagaagcagcagcauccccugcagcggcagccuggacggcagagagcugagcagacaggugagaagcagcguggagcuggagcuggagagaugcagacagcaggccggccugcuggugaccggcgagaaggaggagcccagcagaagcgccagcgaggccgacagcgaggccggcgagcugagaaagcccacccaggaggaguggagacaggugguggacauccuguggagcgaccccauggcccaggagggcugcaaggccaacaccaucagaggcggcggcugcuacuucggccccgacgugacccagcagcugcugcagaaguacaacaugcaguuccugaucagaagccacgagugcaagcccgagggcuacgaguucugccacaacagaaaggugcugaccaucuucagcgccagcaacuacuacgaggugggcagcaacagaggcgccuacgugaagcugggccccgcccugaccccccacaucgugcaguaccaggccaacaaggugacccacacccugaccaugagacagagaaucagcagaguggaggagagcgcccugagagcccugagagagaagcuguucgcccacagcagcgaccugcugagcgaguucaagaagcacgacgccgacaaggugggccugaucacccugagcgacugggccgccgccguggagagcgugcugcaccugggccugcccuggagaaugcugagaccccagcuggugaacagcagcgccgacaacaugcuggaguacaagagcuggcugaagaaccuggccaaggagcagcugagcagagagaacauccagagcagccugcuggagacccuguacagaaacagaagcaaccuggagaccaucuucagaaucaucgacagcgaccacagcggcuucaucagccuggacgaguucagacagaccuggaagcuguucagcagccacaugaacaucgacaucaccgacgacugcaucugcgaccuggccagaagcaucgacuucaacaaggacggccacaucgacaucaacgaguuccuggaggccuucagacugguggagaagagcugccccgagggcgacgccagcgagugcccccaggccaccaacgccaaggacagcggcugcagcagccccggcgcccacuaa

SEQ ID NO: 21849 - RNA, 3609 nt, Artificial Sequence
  PPFIA1__Homo_sapiens__NP_003617
augaugugcgaggugaugcccaccaucagcgaggccgagggcccccccggcggcggcggcggccacggcagcggcagccccagccagcccgacgccgacagccacuucgagcagcugauggugagcaugcuggaggagagagacagacugcuggacacccugagagagacccaggagacccuggcccugacccagggcaagcugcacgaggugggccacgagagagacagccugcagagacagcugaacaccgcccugccccaggaguucgccgcccugaccaaggagcugaacgugugcagagagcagcugcuggagagagaggaggagaucgccgagcugaaggccgagagaaacaacaccagacugcugcuggagcaccuggagugccuggugagcagacacgagagaagccugagaaugaccguggugaagagacaggcccagagccccgccggcgugagcagcgagguggaggugcugaaggcccugaagagccuguucgagcaccacaaggcccuggacgagaaggugagagagagacugagaguggcccuggagagaugcagccugcuggaggaggagcugggcgccacccacaaggagcugaugauccugaaggagcagaacaaccagaagaagacccugaccgacggcgugcuggacaucaaccacgagcaggagaacacccccagcaccagcggcaagagaagcagcgacggcagccugagccacgaggaggaccuggccaaggugaucgagcugcaggagaucaucagcaagcagagcagagagcagagccagaugaaggagagacuggccagccugagcagccacgugaccgagcuggaggaggaccuggacaccgccagaaaggaccugaucaagagcgaggagaugaacaccaagcugcagagagacgugagagaggccauggcccagaaggaggacauggaggagagaaucaccacccuggagaagagauaccuggccgcccagagagaggccaccagcgugcacgaccugaacgacaagcuggagaacgagaucgccaacaaggacagcaugcacagacagaccgaggacaagaacagacagcugcaggagagacuggagcuggccgagcagaagcugcagcagacccugagaaaggccgagacccugcccgagguggaggccgagcuggcccagagaguggccgcccugagcaaggccgaggagagacacggcaacaucgaggagagacugagacagauggaggcccagcuggaggagaagaaccaggagcugcagagagccagacagagagagaagaugaacgaggagcacaacaagagacugagcgacaccguggacaagcugcugagcgagagcaacgagagacugcagcugcaccugaaggagagaauggccgcccuggaggacaagaacagccugcugagagagguggagagcgccaagaagcagcuggaggagacccagcacgacaaggaccagcuggugcugaacaucgaggcccugagagccgagcuggaccacaugagacugagaggcgccagccugcaccacggcagaccccaccugggcagcgugcccgacuucagauuccccauggccgacggccacaccgacagcuacagcaccagcgccgugcugagaagaccccagaagggcagacuggccgcccugagagacgagcccagcaaggugcagacccugaacgagcaggacugggagagagcccagcaggccagcgugcuggccaacguggcccaggccuucgagagcgacgccgacgugagcgacggcgaggacgacagagacacccugcugagcagcguggaccugcugagccccagcggccaggccgacgcccacacccuggccaugaugcugcaggagcagcuggacgccaucaacaaggagaucagacugauccaggaggagaaggagaacaccgagcagagagccgaggagaucgagagcagagugggcagcggcagccuggacaaccugggcagauucagaagcaugagcagcaucccccccuaccccgccagcagccuggccagcagcagcccccccggcagcggcagaagcacccccagaagaaucccccacagccccgccagagagguggacagacugggcgugaugacccugcugccccccagcagagaggaggugagagacgacaagaccaccaucaagugcgagaccagcccccccagcagccccagagcccugagacuggacagacugcacaagggcgcccugcacaccgugagccacgaggacaucagagacaucagaaacagcaccggcagccaggacggccccgugagcaaccccagcagcagcaacagcagccaggacagccugcacaaggcccccaagaagaagggcaucaagagcagcaucggcagacuguucggcaagaaggagaagggcagacccggccagaccggcaaggaggcccugggccaggccggcgugagcgagaccgacaacagcagccaggacgcccugggccugagcaagcugggcggccaggccgagaagaacagaaagcugcagaagaagcacgagcugcuggaggaggccagaagacagggccugcccuucgcccagugggacggccccaccguggugguguggcuggagcugugggugggcaugcccgccugguacguggccgccugcagagccaacgugaagagcggcgccaucaugagcgcccugagcgacaccgagauccagagagagaucggcaucagcaacccccugcacagacugaagcugagacuggccauccaggagaucaugagccugaccagccccagcgccccccccaccagcagaaccacccuggccuacggcgacaugaaccacgaguggaucggcaacgaguggcugcccagccugggccugccccaguacagaagcuacuucauggagugccugguggacgccagaaugcuggaccaccugaccaagaaggaccugagaggccagcugaagaugguggacagcuuccacagaaacagcuuccagugcggcaucaugugccugagaagacugaacuacgacagaaaggagcuggagagaaagagagaggagagccagagcgagaucaaggacgugcugguguggagcaacgacagagugaucagauggauccugagcaucggccugaaggaguacgccaacaaccugaucgagagcggcgugcacggcgcccugcuggcccuggacgagaccuucgacuucagcgcccuggcccugcugcugcagauccccacccagaacacccaggccagagccgugcuggagagagaguucaacaaccugcuggugaugggcaccgacagaagauucgacgaggacgacgacaagagcuucagaagagcccccagcuggagaaagaaguucagacccaaggacaucagaggccuggccgccggcagcgccgagacccugcccgccaacuucagagugaccagcagcaugagcagccccagcaugcagcccaagaagaugcagauggacggcaacgugagcggcacccagagacuggacagcgccaccgugagaaccuacagcugcuaa

SEQ ID NO: 21850 - RNA, 3744 nt, Artificial Sequence
  PPFIA2__Homo_sapiens__NP_001207402
augaugugcgaggugaugcccaccaucaacgaggacacccccaugagccagagaggcagccagagcagcggcagcgacagcgacagccacuucgagcagcugauggugaacaugcuggacgagagagacagacugcuggacacccugagagagacccaggagagccugagccuggcccagcagagacugcaggacgugaucuacgacagagacagccugcagagacagcugaacagcgcccugccccaggacaucgagagccugaccggcggccuggccggcagcaagggcgccgacccccccgaguucgccgcccugaccaaggagcugaacgccugcagagagcagcugcuggagaaggaggaggagaucagcgagcugaaggccgagagaaacaacaccagacugcugcuggagcaccuggagugccuggugagcagacacgagagaagccugagaaugaccguggugaagagacaggcccagagccccagcggcgugagcagcgagguggaggugcugaaggcccugaagagccuguucgagcaccacaaggcccuggacgagaaggugagagagagacugagagugagccuggagagagugagcgcccuggaggaggagcuggccgccgccaaccaggagaucguggcccugagagagcagaacgugcacauccagagaaagauggccagcagcgagggcagcaccgagagcgagcaccuggagggcauggagcccggccagaaggugcacgagaagagacugagcaacggcagcaucgacagcaccgacgagaccagccagaucguggagcugcaggagcugcuggagaagcagaacuacgagauggcccagaugaaggagagacuggccgcccugagcagcagagugggcgagguggagcaggaggccgagaccgccagaaaggaccugaucaagaccgaggagaugaacaccaaguaccagagagacaucagagaggccauggcccagaaggaggacauggaggagagaaucaccacccuggagaagagauaccugagcgcccagagagagagcaccagcauccacgacaugaacgacaagcuggagaacgagcuggccaacaaggaggccauccugagacagauggaggagaagaacagacagcugcaggagagacuggagcuggccgagcagaagcugcagcagaccaugagaaaggccgagacccugcccgagguggaggccgagcuggcccagagaaucgccgcccugaccaaggccgaggagagacacggcaacaucgaggagagaaugagacaccuggagggccagcuggaggagaagaaccaggagcugcagagagccagacagagagagaagaugaacgaggagcacaacaagagacugagcgacaccguggacagacugcugaccgagagcaacgagagacugcagcugcaccugaaggagagaauggccgcccuggaggagaagaacgugcugauccaggagagcgagaccuucagaaagaaccuggaggagagccugcacgacaaggagagacuggccgaggagaucgagaagcugagaagcgagcuggaccagcugaagaugagaaccggcagccugaucgagcccaccauccccagaacccaccuggacaccagcgccgagcugagauacagcgugggcagccugguggacagccagagcgacuacagaaccaccaaggugaucagaagacccagaagaggcagaaugggcgugagaagagacgagcccaaggugaagagccugggcgaccacgaguggaacagaacccagcagaucggcgugcugagcagccaccccuucgagagcgacaccgagaugagcgacaucgacgacgacgacagagagaccaucuucagcagcauggaccugcugagccccagcggccacagcgacgcccagacccuggccaugaugcugcaggagcagcuggacgccaucaacaaggagaucagacugauccaggaggagaaggagagcaccgagcugagagccgaggagaucgagaacagaguggccagcgugagccuggagggccugaaccuggccagagugcaccccggcaccagcaucaccgccagcgugaccgccagcagccuggccagcagcagcccccccagcggccacagcacccccaagcugacccccagaagccccgccagagagauggacagaaugggcgugaugacccugcccagcgaccugagaaagcacagaagaaagaucgccgugguggaggaggacggcagagaggacaaggccaccaucaagugcgagaccagccccccccccacccccagagcccugagaaugacccacacccugcccagcagcuaccacaacgacgccagaagcagccugagcgugagccuggagcccgagagccugggccugggcagcgccaacagcagccaggacagccugcacaaggcccccaagaagaagggcaucaagagcagcaucggcagacuguucggcaagaaggagaaggccagacugggccagcugagaggcuucauggagaccgaggccgccgcccaggagagccugggccugggcaagcugggcacccaggccgagaaggacagaagacugaagaagaagcacgagcugcuggaggaggccagaagaaagggccugcccuucgcccagugggacggccccaccgugguggccuggcuggagcuguggcugggcaugcccgccugguacguggccgccugcagagccaacgugaagagcggcgccaucaugagcgcccugagcgacaccgagauccagagagagaucggcaucagcaacccccugcacagacugaagcugagacuggccauccaggagauggugagccugaccagccccagcgccccccccaccagcagaacccccagcggcaacgugugggugacccacgaggagauggagaaccuggccgcccccgccaagaccaaggagagcgaggagggcagcugggcccagugccccguguuccugcagacccuggccuacggcgacaugaaccacgaguggaucggcaacgaguggcugcccagccugggccugccccaguacagaagcuacuucauggagugccugguggacgccagaaugcuggaccaccugaccaagaaggaccugagagugcaccugaagaugguggacagcuuccacagaaccagccugcaguacggcaucaugugccugaagagacugaacuacgacagaaaggagcuggagagaagaagagaggccagccagcacgagaucaaggacgugcugguguggagcaacgacagagugaucagauggauccaggccaucggccugagagaguacgccaacaacauccuggagagcggcgugcacggcagccugaucgcccuggacgagaacuucgacuacagcagccuggcccugcugcugcagauccccacccagaacacccaggccagacagauccuggagagagaguacaacaaccugcuggcccugggcaccgagagaagacuggacgagagcgacgacaagaacuucagaagaggcagcaccuggagaagacaguucccccccagagaggugcacggcaucagcaugaugcccggcagcagcgagacccugcccgccggcuucagacugaccaccaccagcggccagagcagaaagaugaccaccgacgacggcguguucagcguguacagcaccuaa

SEQ ID NO: 21851 - RNA, 3624 nt, Artificial Sequence
  PPFIA4__Homo_sapiens__NP_001291260
augugcgaggugaugcccaccaucaacgagggcgacagacugggccccccccacggcgccgacgccgacgccaacuucgagcagcugauggugaacaugcuggacgagagagagaagcugcuggagagccugagagagagccaggagacccuggccgccacccagagcagacugcaggacgccauccacgagagagaccagcugcagagacaccugaacagcgcccugccccaggaguucgccacccugaccagagagcugagcaugugcagagagcagcugcuggagagagaggaggagaucagcgagcugaaggccgagagaaacaacaccagacugcugcuggagcaccuggagugccuggugagcagacacgagagaagccugagaaugaccguggugaagagacaggcccagagccccagcggcgugagcagcgagguggaggugcugaaggcccugaagagccuguucgagcaccacaaggcccuggacgagaaggugagagagagacugagagccgcccuggagagagugaccacccuggaggagcagcuggccggcgcccaccagcaggugagcgcccugcagcagggcgccggcgugagagacggcgccgccgaggaggagggcaccguggagcugggccccaagagacuguggaaggaggacaccggcagaguggaggagcugcaggagcugcuggagaagcagaacuucgagcugagccaggccagagagagacuggugacccugaccaccaccgugaccgagcuggaggaggaccugggcaccgccagaagagaccugaucaagagcgaggagcugagcagcaagcaccagagagaccugagagaggcccuggcccagaaggaggacauggaggagagaaucaccacccuggagaagagauaccuggccgcccagagagaggccaccagcauccacgaccugaacgacaagcuggagaacgagcuggccaacaaggagagccugcacagacagugcgaggagaaggccagacaccugcaggagcugcuggagguggccgagcagaagcugcagcagaccaugagaaaggccgagacccugcccgagguggaggccgagcuggcccagagaaucgccgcccugaccaaggccgaggagagacacggcaacaucgaggagcaccugagacagcuggagggccagcuggaggagaagaaccaggagcuggccagagugagacagagagagaagaugaacgaggaccacaacaagagacugagcgacaccguggacagacugcugagcgagagcaacgagagacugcagcugcaccugaaggagagaauggccgcccuggaggagaagaacacccugauccaggagcuggagagcagccagagacagaucgaggagcagcaccaccacaagggcagacugagcgaggagaucgagaagcugagacaggagguggaccagcugaagggcagaggcggccccuucguggacggcgugcacagcagaagccacaugggcagcgccgccgacgugagauucagccugggcaccaccacccacgccccccccggcgugcacagaagauacagcgcccugagagaggagagcgccaaggacugggagaccagcccccugcccggcaugcuggcccccgccgccggccccgccuucgacagcgaccccgagaucagcgacguggacgaggacgagcccggcggccuggugggcagcgccgacguggugagccccagcggccacagcgacgcccagacccuggccaugaugcugcaggagcagcuggacgccaucaacgaggagaucagaaugauccaggaggagaaggagagcaccgagcugagagccgaggagaucgagaccagagugaccagcggcagcauggaggcccugaaccugaagcagcugagaaagagaggcagcauccccaccagccugaccgcccugagccuggccagcgccagccccccccugagcggcagaagcacccccaagcugaccagcagaagcgccgcccaggaccuggacagaaugggcgugaugacccugcccagcgaccugagaaagcacagaagaaagcugcugagccccgugagcagagaggagaacagagaggacaaggccaccaucaagugcgagaccagcccccccagcagccccagaacccugagacuggagaagcugggccaccccgcccugagccaggaggagggcaagagcgcccuggaggaccagggcagcaaccccagcagcagcaacagcagccaggacagccugcacaagggcgccaagagaaagggcaucaagagcagcaucggcagacuguucggcaagaaggagaagggcagacugauccagcugagcagagacggcgccaccggccacgugcugcugaccgacagcgaguucagcaugcaggagcccauggugcccgccaagcugggcacccaggccgagaaggacagaagacugaagaagaagcaccagcugcuggaggacgccagaagaaagggcaugcccuucgcccagugggacggccccaccguggugagcuggcuggagcugugggugggcaugcccgccugguacguggccgccugcagagccaacgugaagagcggcgccaucaugagcgcccugagcgacaccgagauccagagagagaucggcaucagcaacgcccugcacagacugaagcugagacuggccauccaggagauggugagccugaccagccccagcgccccccccaccagcagaaccagcagcggcaacgugugggugacccacgaggagauggagacccuggagaccagcaccaagaccgacagcgaggagggcagcugggcccagacccuggccuacggcgacaugaaccacgaguggaucggcaacgaguggcugcccagccugggccugccccaguacagaagcuacuucauggagugccugguggacgccagaaugcuggaccaccugaccaagaaggaccugagagugcaccugaagaugguggacagcuuccacagaaccagccugcaguacggcaucaugugccugaagagacugaacuacgacagaaaggagcuggagaagagaagagaggagagccagcacgagaucaaggacgugcugguguggaccaacgaccagguggugcacugggugcagagcaucggccugagagacuacgccggcaaccugcacgagagcggcgugcacggcgcccugcuggcccuggacgagaacuucgaccacaacacccuggcccugauccugcagauccccacccagaacacccaggccagacaggugauggagagagaguucaacaaccugcuggcccugggcaccgacagaaagcuggacgacggcgacgacaagguguucagaagagcccccagcuggagaaagagauucagacccagagagcaccacggcagaggcggcaugcugagcgccagcgccgagacccugcccgccggcuucagagugagcacccugggcacccugcagcccccccccgccccccccaagaagaucaugcccgaggcccacagccacuaccuguacggccacaugcugagcgccuucagagacuaa

SEQ ID NO: 21852 - RNA, 2577 nt, Artificial Sequence
  PPFIBP1__Homo_sapiens__NP_001185844
augcugcagcaggagcugcugagcagaaccagccuggagacccagaagcuggaccugauggccgagaucagcaaccugaagcugaagcugaccgccguggagaaggacagacuggacuacgaggacaaguucagagacaccgagggccugauccaggagaucaacgaccugagacugaaggugagcgagauggacagcgagagacugcaguacgagaagaagcugaagagcaccaagagccugauggccaagcugagcagcaugaagaucaaggugggccagaugcaguacgagaagcagagaauggagcagaagugggagagccugaaggacgagcuggccagccugaaggagcagcuggaggagaaggagagcgaggugaagagacugcaggagaagcuggugugcaagaugaagggcgagggcguggagaucguggacagagacaucgaggugcagaagaugaagaaggccguggagagccugauggccgccaacgaggagaaggacagaaagaucgaggaccugagacagugccugaacagauacaagaagaugcaggacaccguggugcuggcccagggcaaggacggcgaguacgaggagcugcugaacagcagcagcaucagcagccugcuggacgcccagggcuucagcgaccuggagaagagccccagccccacccccgugaugggcagccccagcugcgaccccuucaacaccagcgugcccgaggaguuccacaccaccauccugcaggugagcauccccagccugcugcccgccaccgugagcauggagaccagcgagaagagcaagcugacccccaagcccgagaccagcuucgaggagaacgacggcaacaucauccugggcgccaccguggacacccagcugugcgacaagcugcugaccagcagccugcagaagagcagcagccugggcaaccugaagaaggagaccagcgacggcgagaaggagaccauccagaagaccagcgaggacagagcccccgccgagagcagacccuucggcacccugccccccagaccccccggccaggacaccagcauggacgacaaccccuucggcaccagaaaggugagaagcagcuucggcagaggcuucuucaagaucaagagcaacaagagaaccgccagcgcccccaaccuggccgagaccgagaaggagaccgccgagcaccuggaccuggccggcgccagcagcagacccaaggacagccagagaaacagccccuuccagauccccccccccagccccgacagcaagaagaagagcagaggcaucaugaagcuguucggcaagcugagaagaagccagagcaccaccuucaaccccgacgacaugagcgagcccgaguucaagagaggcggcaccagagccaccgccggccccagacugggcuggagcagagaccugggccagagcaacagcgaccuggacaugcccuucgccaaguggaccaaggagcaggugugcaacuggcugauggagcagggccugggcagcuaccugaacagcggcaagcacuggaucgccagcggccagacccugcugcaggccagccagcaggaccuggagaaggagcugggcaucaagcacagccugcacagaaagaagcugcagcuggcccugcaggcccugggcagcgaggaggagaccaaccacggcaagcuggacuucaacugggugaccagauggcuggacgacaucggccugccccaguacaagacccaguucgacgagggcagaguggacggcagaaugcugcacuacaugaccguggacgaccugcugagccugaagguggugagcgugcugcaccaccugagcaucaagagagccauccaggugcugagaaucaacaacuucgagcccaacugccugagaagaagacccagcgacgagaacaccaucgcccccagcgaggugcagaaguggaccaaccacagagugauggaguggcugagaagcguggaccuggccgaguacgcccccaaccugagaggcagcggcgugcacggcggccugauggugcuggagcccagauucaacguggagaccauggcccagcugcugaacaucccccccaacaagacccugcugagaagacaccuggccacccacuucaaccugcugaucggcgccgaggcccagcaccagaagagagacgccauggagcugcccgacuacgugcugcugaccgccaccgccaaggugaagcccaagaagcuggccuucagcaacuucggcaaccugagaaagaagaagcaggaggacggcgaggaguacgugugccccauggagcugggccaggccagcggcagcgccagcaagaagggcuucaagcccggccuggacaugagacuguacgaggaggacgaccuggacagacuggagcagauggaggacagcgagggcaccgugagacagaucggcgccuucagcgagggcaucaacaaccugacccacaugcugaaggaggacgacauguucaaggacuucgccgccagaagccccagcgccagcaucaccgacgaggacagcaacguguaa

SEQ ID NO: 21853 - RNA, 2295 nt, Artificial Sequence
  PPFIBP2__Homo_sapiens__NP_001243497
augagcagcgagcaguggcccagacugcccggcaaggugagcgugcugaccgaccagguggaggcccagggcgagaagaucagagaccuggaggugugccuggagggccaccaggugaagcugaacgccgccgaggagaugcugcagcaggagcugcugagcagaaccagccuggagacccagaagcuggaccugaugaccgaggugagcgagcugaagcugaagcuggugggcauggagaaggagcagagagagcaggaggagaagcagagaaaggccgaggagcugcugcaggagcugagacaccugaagaucaagguggaggagcuggagaacgagagaaaccaguacgaguggaagcugaaggccaccaaggccgagguggcccagcugcaggagcagguggcccugaaggacgccgagaucgagagacugcacagccagcugagcagaaccgccgcccugcacagcgagagccacaccgagagagaccaggagauccagagacugaagaugggcauggagacccugcugcuggccaacgaggacaaggacagaagaaucgaggagcugaccggccugcugaaccaguacagaaaggugaaggagaucgugauggugacccagggccccagcgagagaacccugagcaucaacgaggaggagcccgagggcggcuucagcaaguggaacgccaccaacaaggaccccgaggagcuguucaagcaggagaugccccccagaugcagcagccccaccgugggcccccccccccugccccagaagagccuggagaccagagcccagaagaagcugagcugcagccuggaggaccugagaagcgagagcguggacaagugcauggacggcaaccagcccuuccccgugcuggagcccaaggacagccccuuccuggccgagcacaaguaccccacccugcccggcaagcugagcggcgccacccccaacggcgaggccgccaagagcccccccaccaucugccagcccgacgccaccggcagcagccugcugagacugagagacaccgagagcggcugggacgacaccgccguggugaacgaccugagcagcaccagcagcggcaccgagagcggcccccagagcccccugacccccgacggcaagagaaaccccaagggcaucaagaaguucuggggcaagaucagaagaacccagagcggcaacuucuacaccgacacccugggcauggccgaguucagaagaggcggccugagagccaccgccggccccagacugagcagaaccagagacagcaagggccagaagagcgacgccaacgcccccuucgcccaguggagcaccgagagagugugcgccuggcuggaggacuucggccuggcccaguacgugaucuucgccagacagugggugagcagcggccacacccugcugaccgccaccccccaggacauggagaaggagcugggcaucaagcacccccugcacagaaagaagcuggugcuggccgugaaggccaucaacaccaagcaggaggagaagagcgcccugcuggaccacaucugggugaccagauggcuggacgacaucggccugccccaguacaaggaccaguuccacgagagcagaguggacggcagaaugcugcaguaccugaccgugaacgaccugcuguuccugaaggugaccagccagcugcaccaccugagcaucaagugcgccauccacgugcugcacgugaacaaguucaacccccacugccugcacagaagacccgccgacgagagcaaccugagccccagcgagguggugcaguggagcaaccacagagugauggaguggcugagaagcguggaccuggccgaguacgcccccaaccugagaggcagcggcgugcacggcggccugaucauccuggagcccagauucaccggcgacacccuggccaugcugcugaacauccccccccagaagacccugcugagaagacaccugaccaccaaguucaacgcccugaucggccccgaggccgagcaggagaagagagagaagauggccagccccgccuacaccccccugaccaccaccgccaaggugagacccagaaagcugggcuucagccacuucggcaacaucagaaagaagaaguucgacgagagcaccgacuacaucugccccauggagcccagcgacggcgugagcgacagccacagaguguacagcggcuacagaggccugagcccccuggacgcccccgagcuggacggccuggaccaggugggccagaucagcuaa

SEQ ID NO: 21854 - RNA, 318 nt, Artificial Sequence
  PPIA__Homo_sapiens__NP_001287910
augugccagggcggcgacuucaccagacacaacggcaccggcggcaagagcaucuacggcgagaaguucgaggacgagaacuucauccugaagcacaccggccccggcauccugagcauggccaacgccggccccaacaccaacggcagccaguucuucaucugcaccgccaagaccgaguggcuggacggcaagcacgugguguucggcaaggugaaggagggcaugaacaucguggaggccauggagagauucggcagcagaaacggcaagaccagcaagaagaucaccaucgccgacugcggccagcuggaguaa

SEQ ID NO: 21855 - RNA, 651 nt, Artificial Sequence
  PPIB__Homo_sapiens__NP_000933
augcugagacugagcgagagaaacaugaaggugcugcuggccgccgcccugaucgccggcagcguguucuuccugcugcugcccggccccagcgccgccgacgagaagaagaagggccccaaggugaccgugaagguguacuucgaccugagaaucggcgacgaggacgugggcagagugaucuucggccuguucggcaagaccgugcccaagaccguggacaacuucguggcccuggccaccggcgagaagggcuucggcuacaagaacagcaaguuccacagagugaucaaggacuucaugauccagggcggcgacuucaccagaggcgacggcaccggcggcaagagcaucuacggcgagagauuccccgacgagaacuucaagcugaagcacuacggccccggcugggugagcauggccaacgccggcaaggacaccaacggcagccaguucuucaucaccaccgugaagaccgccuggcuggacggcaagcacgugguguucggcaaggugcuggagggcauggagguggugagaaagguggagagcaccaagaccgacagcagagacaagccccugaaggacgugaucaucgccgacugcggcaagaucgagguggagaagcccuucgccaucgccaaggaguaa

SEQ ID NO: 21856 - RNA, 639 nt, Artificial Sequence
  PPIC__Homo_sapiens__NP_000934
augggccccggccccagacugcugcugccccuggugcugugcgugggccugggcgcccugguguucagcagcggcgccgagggcuucagaaagagaggccccagcgugaccgccaagguguucuucgacgugagaaucggcgacaaggacgugggcagaaucgugaucggccuguucggcaagguggugcccaagaccguggagaacuucguggcccuggccaccggcgagaagggcuacggcuacaagggcagcaaguuccacagagugaucaaggacuucaugauccagggcggcgacaucaccaccggcgacggcaccggcggcgugagcaucuacggcgagaccuuccccgacgagaacuucaagcugaagcacuacggcaucggcugggugagcauggccaacgccggccccgacaccaacggcagccaguucuucaucacccugaccaagcccaccuggcuggacggcaagcacgugguguucggcaaggugaucgacggcaugaccguggugcacagcaucgagcugcaggccaccgacggccacgacagaccccugaccaacugcagcaucaucaacagcggcaagaucgacgugaagacccccuucgugguggagaucgccgacugguaa

SEQ ID NO: 21857 - RNA, 1113 nt, Artificial Sequence
  PPID__Homo_sapiens__NP_005029
augagccaccccagcccccaggccaagcccagcaaccccagcaaccccagaguguucuucgacguggacaucggcggcgagagagugggcagaaucgugcuggagcuguucgccgacaucgugcccaagaccgccgagaacuucagagcccugugcaccggcgagaagggcaucggccacaccaccggcaagccccugcacuucaagggcugccccuuccacagaaucaucaagaaguucaugauccagggcggcgacuucagcaaccagaacggcaccggcggcgagagcaucuacggcgagaaguucgaggacgagaacuuccacuacaagcacgacagagagggccugcugagcauggccaacgccggcagaaacaccaacggcagccaguucuucaucaccaccgugcccaccccccaccuggacggcaagcacgugguguucggccaggugaucaagggcaucggcguggccagaauccuggagaacguggaggugaagggcgagaagcccgccaagcugugcgugaucgccgagugcggcgagcugaaggagggcgacgacggcggcaucuuccccaaggacggcagcggcgacagccaccccgacuuccccgaggacgccgacaucgaccugaaggacguggacaagauccugcugaucaccgaggaccugaagaacaucggcaacaccuucuucaagagccagaacugggagauggccaucaagaaguacgccgaggugcugagauacguggacagcagcaaggccgugaucgagaccgccgacagagccaagcugcagcccaucgcccugagcugcgugcugaacaucggcgccugcaagcugaagaugagcaacuggcagggcgccaucgacagcugccuggaggcccuggagcuggaccccagcaacaccaaggcccuguacagaagagcccagggcuggcagggccugaaggaguacgaccaggcccuggccgaccugaagaaggcccagggcaucgcccccgaggacaaggccauccaggccgagcugcugaaggugaagcagaagaucaaggcccagaaggacaaggagaaggccguguacgccaagauguucgccuaa

SEQ ID NO: 21858 - RNA, 624 nt, Artificial Sequence
  PPIF__Homo_sapiens__NP_005720
augcuggcccugagaugcggcagcagauggcugggccugcugagcgugcccagaagcgugccccugagacugcccgccgccagagccugcagcaagggcagcggcgaccccagcagcagcagcagcagcggcaacccccugguguaccuggacguggacgccaacggcaagccccugggcagaguggugcuggagcugaaggccgacguggugcccaagaccgccgagaacuucagagcccugugcaccggcgagaagggcuucggcuacaagggcagcaccuuccacagagugauccccagcuucaugugccaggccggcgacuucaccaaccacaacggcaccggcggcaagagcaucuacggcagcagauuccccgacgagaacuucacccugaagcacgugggccccggcgugcugagcauggccaacgccggccccaacaccaacggcagccaguucuucaucugcaccaucaagaccgacuggcuggacggcaagcacgugguguucggccacgugaaggagggcauggacguggugaagaagaucgagagcuucggcagcaagagcggcagaaccagcaagaagaucgugaucaccgacugcggccagcugagcuaa

SEQ ID NO: 21859 - RNA, 2265 nt, Artificial Sequence
  PPIG__Homo_sapiens__NP_004783
augggcaucaaggugcagagacccagaugcuucuucgacaucgccaucaacaaccagcccgccggcagagugguguucgagcuguucagcgacgugugccccaagaccugcgagaacuucagaugccugugcaccggcgagaagggcaccggcaagagcacccagaagccccugcacuacaagagcugccuguuccacagaguggugaaggacuucauggugcagggcggcgacuucagcgagggcaacggcagaggcggcgagagcaucuacggcggcuucuucgaggacgagagcuucgccgugaagcacaacaaggaguuccugcugagcauggccaacagaggcaaggacaccaacggcagccaguucuucaucaccaccaagcccaccccccaccuggacggccaccacgugguguucggccaggugaucagcggccaggagguggugagagagaucgagaaccagaagaccgacgccgccagcaagcccuucgccgaggugagaauccugagcugcggcgagcugauccccaagagcaaggugaagaaggaggagaagaagagacacaagagcagcagcagcagcagcagcagcagcagcgacagcgacagcagcagcgacagccagagcagcagcgacagcagcgacagcgagagcgccaccgaggagaagagcaagaagagaaagaagaagcacagaaagaacagcagaaagcacaagaaggagaagaagaagagaaagaagagcaagaagagcgccagcagcgagagcgaggccgagaaccuggaggcccagccccagagcaccgugagacccgaggagaucccccccauccccgagaacagauuccugaugagaaagagcccccccaaggccgacgagaaggagagaaagaacagagagagagagagagagagagagugcaacccccccaacagccagcccgccagcuaccagagaagacugcuggugaccagaagcggcagaaagaucaagggcagaggccccagaagauacagaacccccagcagaagcagaagcagagacagauucagaagaagcgagacccccccccacuggagacaggagaugcagagagcccagagaaugagagugagcagcggcgagagauggaucaagggcgacaagagcgagcugaacgagaucaaggagaaccagagaagccccgugagagugaaggagagaaagaucaccgaccacagaaacgugagcgagagccccaacagaaagaacgagaaggagaagaaggugaaggaccacaagagcaacagcaaggagagagacaucagaagaaacagcgagaaggacgacaaguacaagaacaaggugaagaagagagccaagagcaagagcagaagcaagagcaaggagaagagcaagagcaaggagagagacagcaagcacaacagaaacgaggagaagagaaugagaagcagaagcaagggcagagaccacgagaacgugaaggagaaggagaagcagagcgacagcaagggcaaggaccaggagagaagcagaagcaaggagaagagcaagcagcuggagagcaagagcaacgagcacgaccacagcaagagcaaggagaaggacagaagagcccagagcagaagcagagagugcgacaucaccaagggcaagcacagcuacaacagcagaaccagagagagaagcagaagcagagacagaagcagaagagugagaagcagaacccacgacagagacagaagcagaagcaaggaguaccacagauacagagagcaggaguacagaagaagaggcagaagcagaagcagagagagaagaaccccccccggcagaagcagaagcaaggacagaagaagaagaagaagagacagcagaagcagcgagagagaggagagccagagcagaaacaaggacaaguacagaaaccaggagagcaagagcagccacagaaaggagaacagcgagagcgagaagagaauguacagcaagagcagagaccacaacagcagcaacaacagcagagagaagaaggccgacagagaccagagccccuucagcaagaucaagcagagcagccaggacaacgagcugaagagcagcaugcugaagaacaaggaggacgagaagaucagaagcagcguggagaaggagaaccagaagagcaagggccaggagaacgaccacgugcacgagaagaacaagaaguucgaccacgagagcagccccggcaccgacgaggacaagagcggcuaa

SEQ ID NO: 21860 - RNA, 501 nt, Artificial Sequence
  PPIL1__Homo_sapiens__NP_057143
auggccgccaucccccccgacagcuggcagccccccaacguguaccuggagaccagcaugggcaucaucgugcuggagcuguacuggaagcacgcccccaagaccugcaagaacuucgccgagcuggccagaagaggcuacuacaacggcaccaaguuccacagaaucaucaaggacuucaugauccagggcggcgaccccaccggcaccggcagaggcggcgccagcaucuacggcaagcaguucgaggacgagcugcaccccgaccugaaguucaccggcgccggcauccuggccauggccaacgccggccccgacaccaacggcagccaguucuucgugacccuggcccccacccaguggcuggacggcaagcacaccaucuucggcagagugugccagggcaucggcauggugaacagagugggcaugguggagaccaacagccaggacagacccguggacgacgugaagaucaucaaggccuaccccagcggcuaa

SEQ ID NO: 21861 - RNA, 1563 nt, Artificial Sequence
  PPIL2__Homo_sapiens__NP_680480
augggcaagagacagcaccagaaggacaagauguacaucaccugcgccgaguacacccacuucuacggcggcaagaagcccgaccugccccagaccaacuucagaagacugcccuucgaccacugcagccugagccugcagcccuucguguaccccgugugcacccccgacggcaucguguucgaccugcugaacaucgugcccuggcugaagaaguacggcaccaaccccagcaacggcgagaagcuggacggcagaagccugaucaagcugaacuucagcaagaacagcgagggcaaguaccacugccccgugcuguucaccguguucaccaacaacacccacaucguggccgugagaaccaccggcaacguguacgccuacgaggccguggagcagcugaacaucaaggccaagaacuucagagaccugcugaccgacgagcccuucagcagacaggacaucaucacccugcaggaccccaccaaccuggacaaguucaacgugagcaacuucuaccacgugaagaacaacaugaagaucaucgaccccgacgaggagaaggccaagcaggaccccagcuacuaccugaagaacaccaacgccgagaccagagagacccugcaggagcuguacaaggaguucaagggcgacgagauccuggccgccaccaugaaggcccccgagaagaagaagguggacaagcugaacgccgcccacuacagcaccggcaaggugagcgccagcuucaccagcaccgccauggugcccgagaccacccacgaggccgccgccaucgacgaggacgugcugagauaccaguucgugaagaagaagggcuacgugagacugcacaccaacaagggcgaccugaaccuggagcugcacugcgaccugacccccaagaccugcgagaacuucaucagacugugcaagaagcacuacuacgacggcaccaucuuccacagaagcaucagaaacuucgugauccagggcggcgaccccaccggcaccggcaccggcggcgagagcuacuggggcaagcccuucaaggacgaguucagacccaaccugagccacaccggcagaggcauccugagcauggccaacagcggccccaacagcaacagaagccaguucuucaucaccuucagaagcugcgccuaccuggacaagaagcacaccaucuucggcagaguggugggcggcuucgacgugcugaccgccauggagaacguggagagcgaccccaagaccgacagacccaaggaggagaucagaaucgacgccaccaccguguucguggaccccuacgaggaggccgacgcccagaucgcccaggagagaaagacccagcugaagguggcccccgagaccaaggugaagagcagccagccccaggccggcagccagggcccccagaccuucagacagggcgugggcaaguacaucaaccccgccgccaccaagagagccgccgaggaggagcccagcaccagcgccaccgugcccaugagcaagaagaagcccagcagaggcuucggcgacuucagcagcugguaa

SEQ ID NO: 21862 - RNA, 498 nt, Artificial Sequence
  PPIL3__Homo_sapiens__NP_115861
augagcgugacccugcacaccgacgugggcgacaucaagaucgagguguucugcgagagaacccccaagaccugcgagauggagagcagaugcgugccccaggccggcgugcaguggagagaccugggcagccugcagccccccccccccggcuucaagcagguguucugccugagccugcccagaaccggcagaggcggcaacagcaucuggggcaagaaguucgaggacgaguacagcgaguaccugaagcacaacgugagaggcguggugagcauggccaacaacggccccaacaccaacggcagccaguucuucaucaccuacggcaagcagccccaccuggacaugaaguacaccguguucggcaaggugaucgacggccuggagacccuggacgagcuggagaagcugcccgugaacgagaagaccuacagaccccugaacgacgugcacaucaaggacaucaccauccacgccaaccccuucgcccaguaa

SEQ ID NO: 21863 - RNA, 4302 nt, Artificial Sequence
  PPIP5K1__Homo_sapiens__NP_001124330
auguggagccugaccgccagcgagggcgagagcaccaccgcccacuucuuccugggcgccggcgacgagggccugggcaccagaggcaucggcaugagacccgaggagagcgacagcgagcugcuggaggacgaggaggacgaggugccccccgagccccagaucaucgugggcaucugcgccaugaccaagaagagcaagagcaagcccaugacccagauccuggagagacugugcagauucgacuaccugaccguggugauccugggcgaggacgugauccugaacgagcccguggagaacuggcccagcugccacugccugaucagcuuccacagcaagggcuucccccuggacaaggccguggccuacagcaagcugagaaaccccuuccugaucaacgaccuggccaugcaguacuacauccaggacagaagagagguguacagaauccugcaggaggagggcaucgaccugcccagauacgccgugcugaacagagaccccgccagacccgaggagugcaaccugaucgagggcgaggaccagguggaggugaacggcgccguguuccccaagcccuucguggagaagcccgugagcgccgaggaccacaacguguacaucuacuaccccagcagcgccggcggcggcagccagagacuguucagaaagaucggcagcagaagcagcguguacagccccgagagcagcgugagaaagaccggcagcuacaucuacgaggaguucaugcccaccgacggcaccgacgugaagguguacaccgugggccccgacuacgcccacgccgaggccagaaagagccccgcccuggacggcaagguggagagagacagcgagggcaaggagaucagauaccccgugaugcugaccgccauggagaagcugguggccagaaaggugugcguggccuucaagcagaccgugugcggcuucgaccugcugagagccaacggccacagcuucgugugcgacgugaacggcuucagcuucgugaagaacagcaugaaguacuacgacgacugcgccaagauccugggcaacaccaucaugagagagcuggccccccaguuccagauccccuggagcauccccaccgaggccgaggacauccccaucgugcccaccaccagcggcaccaugauggagcugagaugcgugaucgccaucaucagacacggcgacagaacccccaagcagaagaugaagauggaggugaagcaccccagauucuucgcccuguucgagaagcacggcggcuacaagaccggcaagcugaagcugaagagacccgagcagcugcaggaggugcuggacaucaccagacugcugcuggccgagcuggagaaggagcccggcggcgagaucgaggagaagaccggcaagcuggagcagcugaagagcgugcuggagauguacggccacuucagcggcaucaacagaaaggugcagcugaccuacuacccccacggcgugaaggccagcaacgagggccaggacccccagagagagacccuggcccccagccugcugcuggugcugaaguggggcggcgagcugacccccgccggcagagugcaggccgaggagcugggcagagccuucagaugcauguaccccggcggccagggcgacuacgccggcuuccccggcugcggccugcugagacugcacagcaccuucagacacgaccugaagaucuacgccagcgacgagggcagagugcagaugaccgccgccgccuucgccaagggccugcuggcccuggagggcgagcugacccccauccuggugcagauggugaagagcgccaacaugaacggccugcuggacagcgacggcgacagccugagcagcugccagcacagagugaaggccagacugcaccacauccugcagcaggacgcccccuucggccccgaggacuacgaccagcuggcccccaccagaagcaccagccugcugaacagcaugaccaucauccagaaccccgugaaggugugcgaccagguguucgcccugaucgagaaccugacccaccagaucagagagagaaugcaggaccccagaagcguggaccugcagcuguaccacagcgagacccuggagcugaugcugcagagauggagcaagcuggagagagacuucagacagaagagcggcagauacgacaucagcaagauccccgacaucuacgacugcgugaaguacgacgugcagcacaacggcagccugggccugcagggcaccgccgagcugcugagacugagcaaggcccuggccgacguggugaucccccaggaguacggcaucagcagagaggagaagcuggagaucgccgugggcuucugccugccccugcugagaaagauccugcuggaccugcagagaacccacgaggacgagagcgugaacaagcugcacccccugugcuaccugagauacagcagaggcgugcugagccccggcagacacgugagaaccagacuguacuucaccagcgagagccacgugcacagccugcugagcguguucagauacggcggccugcuggacgagacccaggacgcccaguggcagagagcccuggacuaccugagcgccaucagcgagcugaacuacaugacccagaucgugaucaugcuguacgaggacaacacccaggacccccugagcgaggagagauuccacguggagcugcacuucagccccggcgugaagggcguggaggaggagggcagcgcccccgccggcugcggcuucagacccgccagcagcgagaacgaggagaugaagaccaaccagggcagcauggagaaccugugccccggcaaggccagcgacgagcccgacagagcccugcagaccagcccccagccccccgagggccccggccugcccagaagaagcccccugaucagaaacagaaaggccggcagcauggaggugcugagcgagaccagcagcagcagacccggcggcuacagacuguucagcagcagcagaccccccaccgagaugaagcagagcggccugggcagccagugcaccggccuguucagcaccaccgugcugggcggcagcagcagcgcccccaaccugcaggacuacgccagaagccacggcaagaagcugccccccgccagccugaagcacagagacgagcugcuguucgugcccgccgugaagagauucagcgugagcuucgccaagcaccccaccaacggcuucgagggcugcagcauggugcccaccaucuacccccuggagacccugcacaacgcccugagccugagacaggugagcgaguuccugagcagagugugccagagacacaccgacgcccaggcccaggccagcgccgcccuguucgacagcaugcacagcagccaggccagcgacaaccccuucagcccccccagaacccugcacagccccccccugcagcugcagcagagaagcgagaagccccccugguacagcagcggccccagcagcaccgugagcagcgccggccccagcagccccaccaccguggacggcaacagccaguucggcuucagcgaccagcccagccugaacagccacguggccgaggagcaccagggccugggccugcugcaggagacccccggcagcggcgcccaggagcugagcaucgagggcgagcaggagcuguucgagcccaaccagagcccccaggugccccccauggagaccagccagcccuacgaggaggugagccagcccugccaggaggugcccgacaucagccagcccugccaggacaucagcgaggcccugagccagcccugccagaaggugcccgacaucagccagcagugccaggagaaccacgacaacggcaaccacaccugccaggaggugccccacaucagccagcccugccagaagagcagccagcugugccagaaggugagcgaggaggugugccagcugugccuggagaacagcgaggaggugagccagcccugccagggcgugagcguggaggugggcaagcuggugcacaaguuccacgugggcgugggcagccuggugcaggagacccugguggaggugggcagccccgccgaggagauccccgaggaggugauccagcccuaccaggaguucagcguggaggugggcagacuggcccaggagaccagcgccaucaaccugcugagccagggcauccccgagaucgacaagcccagccaggaguuccccgaggagaucgaccugcaggcccaggaggugcccgaggagaucaacuaa

SEQ ID NO: 21864 - RNA, 5271 nt, Artificial Sequence
  PPL__Homo_sapiens__NP_002696
augaacagccuguucagaaagagaaacaagggcaaguacagccccaccgugcagaccagaagcaucagcaacaaggagcugagcgagcugaucgagcagcugcagaagaacgccgaccagguggagaagaacaucguggacaccgaggccaagaugcagagcgaccuggccagacugcaggagggcagacagcccgagcacagagacgugacccugcagaaggugcuggacagcgagaagcugcuguacgugcuggaggccgacgccgccaucgccaagcacaugaagcacccccagggcgacaugaucgccgaggacaucagacagcugaaggagagagugaccaaccugagaggcaagcacaagcagaucuacagacuggccgugaaggagguggacccccaggugaacugggccgcccugguggaggagaagcuggacaagcugaacaaccagagcuucggcaccgaccugccccugguggaccaccagguggaggagcacaacaucuuccacaacgaggugaaggccaucggcccccaccuggccaaggacggcgacaaggagcagaacagcgagcugagagccaaguaccagaagcugcuggccgccagccaggccagacagcagcaccugagcagccugcaggacuacaugcagagaugcaccaacgagcuguacuggcuggaccagcaggccaagggcagaaugcaguacgacuggagcgacagaaaccuggacuaccccagcagaagaagacaguacgagaacuucaucaacagaaaccuggaggccaaggaggagagaaucaacaagcugcacagcgagggcgaccagcugcuggccgccgagcaccccggcagaaacagcaucgaggcccacauggaggccgugcacgccgacuggaaggaguaccugaaccugcugaucugcgaggagagccaccugaaguacauggaggacuaccaccaguuccacgaggacgugaaggacgcccaggagcugcugagaaagguggacagcgaccugaaccagaaguacggccccgacuucaaggacagauaccagaucgagcugcugcugagagagcuggacgaccaggagaaggugcuggacaaguacgaggacguggugcagggccugcagaagagaggccagcagguggugccccugaaguacagaagagagaccccccugaagcccauccccguggaggcccugugcgacuucgagggcgagcagggccugaucagcagaggcuacagcuacacccugcagaagaacaacggcgagagcugggagcugauggacagcgccggcaacaagcugaucgcccccgccgugugcuucgugaucccccccaccgaccccgaggcccuggcccuggccgacagccugggcagccaguacagaagcgugagacagaaggccgccggcagcaagagaacccugcagcagagauacgaggugcugaagaccgagaaccccggcgacgccagcgaccugcagggcagacagcugcuggccggccuggacaagguggccagcgaccuggacagacaggagaaggccaucaccggcauccugagacccccccuggagcagggcagagccgugcaggacagcgccgagagagccaaggaccugaagaacaucaccaacgagcugcugagaaucgagcccgagaagaccagaagcaccgccgagggcgaggccuucauccaggcccugcccggcagcggcaccaccccccugcugagaaccagaguggaggacaccaacagaaaguacgagcaccugcugcagcugcuggaccuggcccaggagaagguggacguggccaacagacuggagaagagccugcagcagagcugggagcugcuggccacccacgagaaccaccugaaccaggacgacaccgugcccgagagcagcagagugcuggacagcaagggccaggagcuggccgccauggccugcgagcugcaggcccagaagagccugcugggcgagguggagcagaaccugcaggccgccaagcagugcagcagcacccuggccagcagauuccaggagcacugccccgaccuggagagacaggaggccgaggugcacaagcugggccagagauucaacaaccugagacagcagguggagagaagagcccagagccugcagagcgccaaggccgccuacgagcacuuccacagaggccacgaccacgugcugcaguuccuggugagcauccccagcuacgagccccaggagaccgacagccugagccagauggagaccaagcugaagaaccagaagaaccugcuggacgagaucgccagcagagagcaggaggugcagaagaucugcgccaacagccagcaguaccagcaggccgugaaggacuacgagcuggaggccgagaagcugagaagccugcuggaccuggagaacggcagaagcagccacgugagcaagagagccagacugcagagccccgccaccaaggugaaggaggaggaggccgcccuggccgccaaguucaccgagguguacgccaucaacagacagagacugcagaaccuggaguucgcccugaaccugcugagacagcagcccgagguggaggugacccacgagacccugcagagaaacagacccgacagcggcguggaggaggccuggaagaucagaaaggagcuggacgaggagaccgagagaagaagacagcuggagaacgaggugaagagcacccaggaggagaucuggacccugagaaaccagggcccccaggagagcguggugagaaaggaggugcugaagaaggugcccgaccccgugcuggaggagagcuuccagcagcugcagagaacccuggccgaggagcagcacaagaaccagcugcugcaggaggagcuggaggcccugcagcugcagcugagagcccuggagcaggagaccagagacggcggccaggaguacguggugaaggaggugcugagaaucgagcccgacagagcccaggccgacgaggugcugcagcugagagaggagcuggaggcccugagaagacagaagggcgccagagaggccgaggugcugcugcugcagcagagaguggccgcccuggccgaggagaagagcagagcccaggagaaggugaccgagaaggagguggugaagcugcagaacgacccccagcuggaggccgaguaccagcagcugcaggaggaccaccagagacaggaccagcugagagagaagcaggaggaggagcugagcuuccugcaggacaagcugaagagacuggagaaggagagagccauggccgagggcaagaucaccgugaaggaggugcugaagguggagaaggacgccgccaccgagagagaggugagcgaccugaccagacaguacgaggacgaggccgccaaggccagagccagccagagagagaagaccgagcugcugagaaagaucugggcccuggaggaggagaacgccaaggugguggugcaggagaaggugagagagaucgugagacccgaccccaaggccgagagcgagguggccaaccugagacuggagcugguggagcaggagagaaaguacagaggcgccgaggagcagcugagaagcuaccagagcgagcuggaggcccugagaagaagaggcccccagguggaggugaaggaggugaccaaggaggugaucaaguacaagaccgaccccgagauggagaaggagcugcagagacugagagaggagaucguggacaagaccagacugaucgagagaugcgaccuggagaucuaccagcugaagaaggagauccaggcccugaaggacaccaagccccaggugcagaccaaggagguggugcaggagauccugcaguuccaggaggacccccagaccaaggaggagguggccagccugagagccaagcugagcgaggagcagaagaagcagguggaccuggagagagagagagccagccaggaggagcagaucgccagaaaggaggaggagcugagcagagugaaggagagaguggugcagcaggagguggugagauacgaggaggagcccggccugagagccgaggccagcgccuucgccgagagcaucgacguggagcugagacagaucgacaagcugagagccgagcugagaagacugcagagaagaagaaccgagcuggagagacagcuggaggagcuggagagagagagacaggccagaagagaggccgagagagaggugcagagacugcagcagagacuggccgcccuggagcaggaggaggccgaggccagagagaaggugacccacacccagaagguggugcugcagcaggacccccagcaggccagagagcacgcccugcugagacugcagcuggaggaggagcagcacagaagacagcugcuggagggcgagcuggagacccugagaagaaagcuggccgcccuggagaaggccgaggugaaggagaagguggugcugagcgagagcgugcagguggagaagggcgacaccgagcaggagauccagagacugaagagcagccuggaggaggagagcagaagcaagagagagcuggacguggaggugagcagacuggaggccagacugagcgagcuggaguuccacaacagcaagagcagcaaggagcuggacuuccugagagaggagaaccacaagcugcagcuggagagacagaaccugcagcuggagaccagaagacugcagagcgagaucaacauggccgccaccgagaccagagaccugagaaacaugaccguggccgacagcggcaccaaccacgacagcagacuguggagccuggagagagagcuggacgaccugaagagacugagcaaggacaaggaccuggagaucgacgagcugcagaagagacugggcagcguggccgugaagagagagcagagagagaaccaccugagaagaagcaucguggugauccaccccgacaccggcagagagcugagccccgaggaggcccacagagccggccugaucgacuggaacauguucgugaagcugagaagccaggagugcgacugggaggagaucagcgugaagggccccaacggcgagagcagcgugauccacgacagaaagagcggcaagaaguucagcaucgaggaggcccugcagagcggcagacugacccccgcccaguacgacagauacgugaacaaggacaugagcauccaggagcuggccgugcuggugagcggccagaaguaa

SEQ ID NO: 21865 - RNA, 1149 nt, Artificial Sequence
  PPM1A__Homo_sapiens__NP_066283
augggcgccuuccuggacaagcccaagauggagaagcacaacgcccagggccagggcaacggccugagauacggccugagcagcaugcagggcuggagaguggagauggaggacgcccacaccgccgugaucggccugcccagcggccuggagagcuggagcuucuucgccguguacgacggccacgccggcagccagguggccaaguacugcugcgagcaccugcuggaccacaucaccaacaaccaggacuucaagggcagcgccggcgcccccagcguggagaacgugaagaacggcaucagaaccggcuuccuggagaucgacgagcacaugagagugaugagcgagaagaagcacggcgccgacagaagcggcagcaccgccgugggcgugcugaucagcccccagcacaccuacuucaucaacugcggcgacagcagaggccugcugugcagaaacagaaaggugcacuucuucacccaggaccacaagcccagcaacccccuggagaaggagagaauccagaacgccggcggcagcgugaugauccagagagugaacggcagccuggccgugagcagagcccugggcgacuucgacuacaagugcgugcacggcaagggccccaccgagcagcuggugagccccgagcccgaggugcacgacaucgagagaagcgaggaggacgaccaguucaucauccuggccugcgacggcaucugggacgugaugggcaacgaggagcugugcgacuucgugagaagcagacuggaggugaccgacgaccuggagaaggugugcaacgaggugguggacaccugccuguacaagggcagcagagacaacaugagcgugauccugaucugcuuccccaacgcccccaaggugagccccgaggccgugaagaaggaggccgagcuggacaaguaccuggagugcagaguggaggagaucaucaagaagcagggcgagggcgugcccgaccuggugcacgugaugagaacccuggccagcgagaacauccccagccugccccccggcggcgagcuggccagcaagagaaacgugaucgaggccguguacaacagacugaaccccuacaagaacgacgacaccgacagcaccagcaccgacgacaugugguaa

SEQ ID NO: 21866 - RNA, 1143 nt, Artificial Sequence
  PPM1B__Homo_sapiens__NP_001028729
augggcgccuuccuggacaagcccaagaccgagaagcacaacgcccacggcgccggcaacggccugagauacggccugagcagcaugcagggcuggagaguggagauggaggacgcccacaccgccguggugggcaucccccacggccuggaggacuggagcuucuucgccguguacgacggccacgccggcagcagaguggccaacuacugcagcacccaccugcuggagcacaucaccaccaacgaggacuucagagccgccggcaagagcggcagcgcccuggagcugagcguggagaacgugaagaacggcaucagaaccggcuuccugaagaucgacgaguacaugagaaacuucagcgaccugagaaacggcauggacagaagcggcagcaccgccgugggcgugaugaucagccccaagcacaucuacuucaucaacugcggcgacagcagagccgugcuguacagaaacggccaggugugcuucagcacccaggaccacaagcccugcaaccccagagagaaggagagaauccagaacgccggcggcagcgugaugauccagagagugaacggcagccuggccgugagcagagcccugggcgacuacgacuacaagugcguggacggcaagggccccaccgagcagcuggugagccccgagcccgagguguacgagauccugagagccgaggaggacgaguucaucauccuggccugcgacggcaucugggacgugaugagcaacgaggagcugugcgaguacgugaagagcagacuggaggugagcgacgaccuggagaacgugugcaacugggugguggacaccugccugcacaagggcagcagagacaacaugagcaucgugcuggugugcuucagcaacgcccccaaggugagcgacgaggccgugaagaaggacagcgagcuggacaagcaccuggagagcagaguggaggagaucauggagaagagcggcgaggagggcaugcccgaccuggcccacgugaugagaauccugagcgccgagaacauccccaaccugccccccggcggcggccuggccggcaagagaaacgugaucgaggccguguacagcagacugaacccccacagagagagcgacggccagaaguaa

SEQ ID NO: 21867 - RNA, 1818 nt, Artificial Sequence
  PPM1D__Homo_sapiens__NP_003611
auggccggccuguacagccugggcgugagcguguucagcgaccagggcggcagaaaguacauggaggacgugacccagaucgugguggagcccgagcccaccgccgaggagaagcccagccccagaagaagccugagccagccccugccccccagacccagccccgccgcccugcccggcggcgaggugagcggcaagggccccgccguggccgccagagaggccagagacccccugcccgacgccggcgccagccccgcccccagcagaugcugcagaagaagaagcagcguggccuucuucgccgugugcgacggccacggcggcagagaggccgcccaguucgccagagagcaccuguggggcuucaucaagaagcagaagggcuucaccagcagcgagcccgccaaggugugcgccgccaucagaaagggcuuccuggccugccaccuggccauguggaagaagcuggccgaguggcccaagaccaugaccggccugcccagcaccagcggcaccaccgccagcguggugaucaucagaggcaugaagauguacguggcccacgugggcgacagcggcguggugcugggcauccaggacgaccccaaggacgacuucgugagagccguggaggugacccaggaccacaagcccgagcugcccaaggagagagagagaaucgagggccugggcggcagcgugaugaacaagagcggcgugaacagagugguguggaagagacccagacugacccacaacggccccgugagaagaagcaccgugaucgaccagauccccuuccuggccguggccagagcccugggcgaccuguggagcuacgacuucuucagcggcgaguucguggugagccccgagcccgacaccagcgugcacacccuggacccccagaagcacaaguacaucauccugggcagcgacggccuguggaacaugauccccccccaggacgccaucagcaugugccaggaccaggaggagaagaaguaccugaugggcgagcacggccagagcugcgccaagaugcuggugaacagagcccugggcagauggagacagagaaugcugagagccgacaacaccagcgccaucgugaucugcaucagccccgagguggacaaccagggcaacuucaccaacgaggacgagcuguaccugaaccugaccgacagccccagcuacaacagccaggagaccugcgugaugacccccagccccugcagcaccccccccgugaagagccuggaggaggaccccuggcccagagugaacagcaaggaccacauccccgcccuggugagaagcaacgccuucagcgagaacuuccuggaggugagcgccgagaucgccagagagaacgugcagggcguggugauccccagcaaggaccccgagccccuggaggagaacugcgccaaggcccugacccugagaauccacgacagccugaacaacagccugcccaucggccuggugcccaccaacagcaccaacaccgugauggaccagaagaaccugaagaugagcacccccggccagaugaaggcccaggagaucgagagaaccccccccaccaacuucaagagaacccuggaggagagcaacagcggcccccugaugaagaagcacagaagaaacggccugagcagaagcagcggcgcccagcccgccagccugcccaccaccagccagagaaagaacagcgugaagcugaccaugagaagaagacugagaggccagaagaagaucggcaacccccugcugcaccagcacagaaagaccgugugcgugugcuaa

SEQ ID NO: 21868 - RNA, 2268 nt, Artificial Sequence
  PPM1E__Homo_sapiens__NP_055721
auggccggcugcauccccgaggagaagaccuacagaagauuccuggagcuguuccugggcgaguucagaggccccugcggcggcggcgagcccgagcccgagcccgagcccgagcccgagcccgagcccgagagcgagcccgagcccgagcccgagcugguggaggccgaggccgccgaggccagcguggaggagcccggcgaggaggccgccaccguggccgccaccgaggagggcgaccaggagcaggaccccgagcccgaggaggaggccgccguggagggcgaggaggaggaggagggcgccgccaccgccgccgccgcccccggccacagcgccgugccccccccccccccccagcugcccccccugcccccccugcccagaccccugagcgagagaaucaccagagaggagguggagggcgagagccuggaccugugccugcagcagcuguacaaguacaacugccccagcuuccuggccgccgcccuggccagagccaccagcgacgaggugcugcagagcgaccugagcgcccacuacauccccaaggagaccgacggcaccgagggcaccguggagaucgagaccgugaagcuggccagaagcguguucagcaagcugcacgagaucugcugcagcugggugaaggacuucccccugagaagaagaccccagcuguacuacgagaccagcauccacgccaucaagaacaugagaagaaagauggaggacaagcacgugugcauccccgacuucaacaugcuguucaaccuggaggaccaggaggagcaggccuacuucgccguguucgacggccacggcggcguggacgccgccaucuacgccagcauccaccugcacgugaaccuggugagacaggagauguucccccacgaccccgccgaggcccugugcagagccuucagagugaccgacgagagauucgugcagaaggccgccagagagagccugagaugcggcaccaccggcguggugaccuucaucagaggcaacaugcugcacguggccugggugggcgacagccaggugaugcuggugagaaagggccaggccguggagcugaugaagccccacaagcccgacagagaggacgagaagcagagaaucgaggcccugggcggcugcguggugugguucggcgccuggagagugaacggcagccugagcgugagcagagccaucggcgacgccgagcacaagcccuacaucugcggcgacgccgacagcgccagcaccgugcuggacggcaccgaggacuaccugauccuggccugcgacggcuucuacgacaccgugaaccccgacgaggccgugaagguggugagcgaccaccugaaggagaacaacggcgacagcagcaugguggcccacaagcugguggccagcgccagagacgccggcagcagcgacaacaucaccgugaucgugguguuccugagagacaugaacaaggccgugaacgugagcgaggagagcgacuggaccgagaacagcuuccagggcggccaggaggacggcggcgacgacaaggagaaccacggcgagugcaagagacccuggccccagcaccagugcagcgcccccgccgaccugggcuacgacggcagaguggacagcuucaccgacagaaccagccugagccccggcagccagaucaacgugcuggaggaccccggcuaccuggaccugacccagaucgaggccagcaagccccacagcgcccaguuccugcugcccguggagauguucggccccggcgcccccaagaaggccaaccugaucaacgagcugaugauggagaagaagagcgugcagagcagccugcccgaguggagcggcgccggcgaguuccccaccgccuucaaccugggcagcaccggcgagcagaucuacagaaugcagagccugagccccgugugcagcggccuggagaacgagcaguucaagagccccggcaacagagugagcagacugagccaccugagacaccacuacagcaagaaguggcacagauucagauucaaccccaaguucuacagcuuccugagcgcccaggagcccagccacaagaucggcaccagccugagcagccugaccggcagcggcaagagaaacagaaucagaagcagccugcccuggagacagaacagcuggaagggcuacagcgagaacaugagaaagcugagaaagacccacgacauccccugccccgaccugcccuggagcuacaagaucgaguaa

SEQ ID NO: 21869 - RNA, 1365 nt, Artificial Sequence
  PPM1F__Homo_sapiens__NP_055449
augagcagcggcgccccccagaagagcagccccauggccagcggcgccgaggagacccccggcuuccuggacacccugcugcaggacuuccccgcccugcugaaccccgaggacccccugcccuggaaggcccccggcaccgugcugagccaggaggagguggagggcgagcuggccgagcuggccaugggcuuccugggcagcagaaaggccccccccccccuggccgccgcccuggcccacgaggccgugagccagcugcugcagaccgaccugagcgaguucagaaagcugcccagagaggaggaggaggaggaggaggacgacgacgaggaggagaaggcccccgugacccugcuggacgcccagagccuggcccagagcuucuucaacagacugugggagguggccggccaguggcagaagcaggugccccuggccgccagagccagccagagacaguggcuggugagcauccacgccaucagaaacaccagaagaaagauggaggacagacacgugagccugcccagcuucaaccagcuguucggccugagcgaccccgugaacagagccuacuucgccguguucgacggccacggcggcguggacgccgccagauacgccgccgugcacgugcacaccaacgccgccagacagcccgagcugcccaccgaccccgagggcgcccugagagaggccuucagaagaaccgaccagauguuccugagaaaggccaagagagagagacugcagagcggcaccaccggcgugugcgcccugaucgccggcgccacccugcacguggccuggcugggcgacagccaggugauccuggugcagcagggccagguggugaagcugauggagccccacagacccgagagacaggacgagaaggccagaaucgaggcccugggcggcuucgugagccacauggacugcuggagagugaacggcacccuggccgugagcagagccaucggcgacguguuccagaagcccuacgugagcggcgaggccgacgccgccagcagagcccugaccggcagcgaggacuaccugcugcuggccugcgacggcuucuucgacguggugccccaccaggagguggugggccuggugcagagccaccugaccagacagcagggcagcggccugagaguggccgaggagcugguggccgccgccagagagagaggcagccacgacaacaucaccgugauggugguguuccugagagacccccaggagcugcuggagggcggcaaccagggcgagggcgacccccaggccgagggcagaagacaggaccugcccagcagccugcccgagcccgagacccaggccccccccagaagcuaa

SEQ ID NO: 21870 - RNA, 1641 nt, Artificial Sequence
  PPM1G__Homo_sapiens__NP_817092
augggcgccuaccugagccagcccaacaccgugaagugcagcggcgacggcgugggcgcccccagacugccccugcccuacggcuucagcgccaugcagggcuggagagugagcauggaggacgcccacaacugcauccccgagcuggacagcgagaccgccauguucagcguguacgacggccacggcggcgaggagguggcccuguacugcgccaaguaccugcccgacaucaucaaggaccagaaggccuacaaggagggcaagcugcagaaggcccuggaggacgccuuccuggccaucgacgccaagcugaccaccgaggaggugaucaaggagcuggcccagaucgccggcagacccaccgaggacgaggacgagaaggagaagguggccgacgaggacgacguggacaacgaggaggccgcccugcugcacgaggaggccaccaugaccaucgaggagcugcugaccagauacggccagaacugccacaagggccccccccacagcaagagcggcggcggcaccggcgaggagcccggcagccagggccugaacggcgaggccggccccgaggacagcaccagagagacccccagccaggagaacggccccaccgccaaggccuacaccggcuucagcagcaacagcgagagaggcaccgaggccggccaggugggcgagcccggcauccccaccggcgaggccggccccagcugcagcagcgccagcgacaagcugcccagaguggccaagagcaaguucuucgaggacagcgaggacgagagcgacgaggccgaggaggaggaggaggacagcgaggagugcagcgaggaggaggacggcuacagcagcgaggaggccgagaacgaggaggacgaggacgacaccgaggaggccgaggaggacgacgaggaggaggaggaggagaugauggugcccggcauggagggcaaggaggagcccggcagcgacagcggcaccaccgccgugguggcccugaucagaggcaagcagcugaucguggccaacgccggcgacagcagaugcguggugagcgaggccggcaaggcccuggacaugagcuacgaccacaagcccgaggacgagguggagcuggccagaaucaagaacgccggcggcaaggugaccauggacggcagagugaacggcggccugaaccugagcagagccaucggcgaccacuucuacaagagaaacaagaaccugccccccgaggagcagaugaucagcgcccugcccgacaucaaggugcugacccugaccgacgaccacgaguucauggugaucgccugcgacggcaucuggaacgugaugagcagccaggaggugguggacuucauccagagcaagaucagccagagagacgagaacggcgagcugagacugcugagcagcaucguggaggagcugcuggaccagugccuggcccccgacaccagcggcgacggcaccggcugcgacaacaugaccugcaucaucaucugcuucaagcccagaaacaccgccgagcugcagcccgagagcggcaagagaaagcuggaggaggugcugagcaccgagggcgccgaggagaacggcaacagcgacaagaagaagaaggccaagagagacuaa

SEQ ID NO: 21871 - RNA, 1545 nt, Artificial Sequence
  PPM1H__Homo_sapiens__NP_065751
augcugaccagagugaagagcgccguggccaacuucaugggcggcaucauggccggcagcagcggcagcgagcacggcggcggcagcugcggcggcagcgaccugccccugagauuccccuacggcagacccgaguuccugggccugagccaggacgagguggagugcagcgccgaccacaucgccagacccauccugauccugaaggagaccagaagacugcccugggccaccggcuacgccgaggugaucaacgccggcaagagcacccacaacgaggaccaggccagcugcgaggugcugaccgugaagaagaaggccggcgccgugaccagcacccccaacagaaacagcagcaagagaagaagcagccugcccaacggcgagggccugcagcugaaggagaacagcgagagcgagggcgugagcugccacuacuggagccuguucgacggccacgccggcagcggcgccgccgugguggccagcagacugcugcagcaccacaucaccgagcagcugcaggacaucguggacauccugaagaacagcgccgugcugccccccaccugccugggcgaggagcccgagaacacccccgccaacagcagaacccugaccagagccgccagccugagaggcggcgugggcgcccccggcagccccagcaccccccccaccagauucuucaccgagaagaagaucccccacgagugccuggugaucggcgcccuggagagcgccuucaaggagauggaccugcagaucgagagagagagaagcagcuacaacaucagcggcggcugcaccgcccugaucgugaucugccugcugggcaagcuguacguggccaacgccggcgacagcagagccaucaucaucagaaacggcgagaucauccccaugagcagcgaguucacccccgagaccgagagacagagacugcaguaccuggccuucaugcagccccaccugcugggcaacgaguucacccaccuggaguuccccagaagagugcagagaaaggagcugggcaagaagaugcuguacagagacuucaacaugaccggcugggccuacaagaccaucgaggacgaggaccugaaguucccccugaucuacggcgagggcaagaaggccagagugauggccaccaucggcgugaccagaggccugggcgaccacgaccugaaggugcacgacagcaacaucuacaucaagcccuuccugagcagcgcccccgaggugagaaucuacgaccugagcaaguacgaccacggcagcgacgacgugcugauccuggccaccgacggccugugggacgugcugagcaacgaggagguggccgaggccaucacccaguuccugcccaacugcgaccccgacgacccccacagauacacccuggccgcccaggaccuggugaugagagccagaggcgugcugaaggacagaggcuggagaaucagcaacgacagacugggcagcggcgacgacaucagcguguacgugaucccccugauccacggcaacaagcugagcuaa

SEQ ID NO: 21872 - RNA, 1119 nt, Artificial Sequence
  PPM1K__Homo_sapiens__NP_689755
augagcaccgccgcccugaucacccuggugagaagcggcggcaaccaggugagaagaagagugcugcugagcagcagacugcugcaggacgacagaagagugacccccaccugccacagcagcaccagcgagcccagaugcagcagauucgaccccgacggcagcggcagccccgccaccugggacaacuucggcaucugggacaacagaaucgacgagcccauccugcugccccccagcaucaaguacggcaagcccauccccaagaucagccuggagaacgugggcugcgccagccagaucggcaagagaaaggagaacgaggacagauucgacuucgcccagcugaccgacgaggugcuguacuucgccguguacgacggccacggcggccccgccgccgccgacuucugccacacccacauggagaagugcaucauggaccugcugcccaaggagaagaaccuggagacccugcugacccuggccuuccuggagaucgacaaggccuucagcagccacgccagacugagcgccgacgccacccugcugaccagcggcaccaccgccaccguggcccugcugagagacggcaucgagcuggugguggccagcgugggcgacagcagagccauccugugcagaaagggcaagcccaugaagcugaccaucgaccacacccccgagagaaaggacgagaaggagagaaucaagaagugcggcggcuucguggccuggaacagccugggccagccccacgugaacggcagacuggccaugaccagaagcaucggcgaccuggaccugaagaccagcggcgugaucgccgagcccgagaccaagagaaucaagcugcaccacgccgacgacagcuuccuggugcugaccaccgacggcaucaacuucauggugaacagccaggagaucugcgacuucgugaaccagugccacgaccccaacgaggccgcccacgccgugaccgagcaggccauccaguacggcaccgaggacaacagcaccgccgugguggugcccuucggcgccuggggcaaguacaagaacagcgagaucaacuucagcuucagcagaagcuucgccagcagcggcagaugggccuaa

SEQ ID NO: 21873 - RNA, 1083 nt, Artificial Sequence
  PPM1L__Homo_sapiens__NP_640338
augaucgaggacaccaugacccugcugagccugcugggcagaaucaugagauacuuccugcugagacccgagacccuguuccugcugugcaucagccuggcccuguggagcuacuucuuccacaccgacgaggugaagaccaucgugaagagcagcagagacgccgugaagauggugaagggcaagguggccgagaucaugcagaacgacagacugggcggccuggacgugcuggaggccgaguucagcaagaccugggaguucaagaaccacaacguggccguguacagcauccagggcagaagagaccacauggaggacagauucgaggugcugaccgaccuggccaacaagacccaccccagcaucuucggcaucuucgacggccacggcggcgagaccgccgccgaguacgugaagagcagacugcccgaggcccugaagcagcaccugcaggacuacgagaaggacaaggagaacagcgugcugagcuaccagaccauccuggagcagcagauccugagcaucgacagagagaugcuggagaagcugaccgugagcuacgacgaggccggcaccaccugccugaucgcccugcugagcgacaaggaccugaccguggccaacgugggcgacagcagaggcgugcugugcgacaaggacggcaacgccaucccccugagccacgaccacaagcccuaccagcugaaggagagaaagagaaucaagagagccggcggcuucaucagcuucaacggcagcuggagagugcagggcauccuggccaugagcagaagccugggcgacuacccccugaagaaccugaacguggugauccccgaccccgacauccugaccuucgaccuggacaagcugcagcccgaguucaugauccuggccagcgacggccugugggacgccuucagcaacgaggaggccgugagauucaucaaggagagacuggacgagccccacuucggcgccaagagcaucgugcugcagagcuucuacagaggcugccccgacaacaucaccgugaugguggugaaguucagaaacagcagcaagaccgaggagcaguaa

SEQ ID NO: 21874 - RNA, 744 nt, Artificial Sequence
  PPM1M__Homo_sapiens__NP_001116342
augggcggcugcaccgcccugguggccgugagccugcagggcaagcuguacauggccaacgccggcgacagcagagccauccuggugagaagagacgagaucagaccccugagcuucgaguucacccccgagaccgagagacagagaauccagcagcuggccuucguguaccccgagcugcuggccggcgaguucaccagacuggaguuccccagaagacugaagggcgacgaccugggccagaaggugcuguucagagaccaccacaugagcggcuggagcuacaagagaguggagaagagcgaccugaaguacccccugauccacggccagggcagacaggccagacugcugggcacccuggccgugagcagaggccugggcgaccaccagcugagagugcuggacaccaacauccagcugaagcccuuccugcugagcgugccccaggugaccgugcuggacguggaccagcuggagcugcaggaggacgacgugguggugauggccaccgacggccugugggacgugcugagcaacgagcagguggccuggcuggugagaagcuuccugcccggcaaccaggaggacccccacagauucagcaagcuggcccagaugcugauccacagcacccagggcaaggaggacagccugaccgaggagggccaggugagcuacgacgacgugagcguguucgugaucccccugcacagccagggccaggagagcagcgaccacuaa

SEQ ID NO: 21875 - RNA, 1203 nt, Artificial Sequence
  PPME1__Homo_sapiens__NP_001258522
augagcgcccuggagaagagcaugcaccugggcagacugcccagcagacccccccugcccggcagcggcggcagccagagcggcgccaagaugagaaugggccccggcagaaagagagacuucagccccgugcccuggagccaguacuucgagagcauggaggacguggagguggagaacgagaccggcaaggacaccuucagaguguacaagagcggcagcgagggccccgugcugcugcugcugcacggcggcggccacagcgcccugagcugggccguguucaccgccgccaucaucagcagagugcagugcagaaucguggcccuggaccugagaagccacggcgagaccaaggugaagaaccccgaggaccugagcgccgagaccauggccaaggacgugggcaacgugguggaggccauguacggcgaccugcccccccccaucaugcugaucggccacagcaugggcggcgccaucgccgugcacaccgccagcagcaaccuggugcccagccugcugggccugugcaugaucgacgugguggagggcaccgccauggacgcccugaacagcaugcagaacuuccugagaggcagacccaagaccuucaagagccuggagaacgccaucgaguggagcgugaagagcggccagaucagaaaccuggagagcgccagagugagcauggugggccaggugaagcagugcgagggcaucaccagccccgagggcagcaagagcaucguggagggcaucaucgaggaggaggaggaggacgaggagggcagcgagagcaucagcaagagaaagaaggaggacgacauggagggccugcccagcgagacccagaaccugcugcuguuccugcagaccaagaaggaccaccccuacaccuggagaaucgagcuggccaagaccgagaaguacugggacggcugguucagaggccugagcaaccuguuccugagcugccccauccccaagcugcugcugcuggccggcguggacagacuggacaaggaccugaccaucggccagaugcagggcaaguuccagaugcaggugcugccccagugcggccacgccgugcacgaggacgcccccgacaagguggccgaggccguggccaccuuccugaucagacacagauucgccgagcccaucggcggcuuccagugcguguuccccggcugcuaa

SEQ ID NO: 21876 - RNA, 1434 nt, Artificial Sequence
  PPOX__Homo_sapiens__NP_001116236
augggcagaaccgugguggugcugggcggcggcaucagcggccuggccgccagcuaccaccugagcagagcccccugcccccccaagguggugcugguggagagcagcgagagacugggcggcuggaucagaagcgugagaggccccaacggcgccaucuucgagcugggccccagaggcaucagacccgccggcgcccugggcgccagaacccugcugcuggugagcgagcugggccuggacagcgaggugcugcccgugagaggcgaccaccccgccgcccagaacagauuccuguacgugggcggcgcccugcacgcccugcccaccggccugagaggccugcugagacccagcccccccuucagcaagccccuguucugggccggccugagagagcugaccaagcccagaggcaaggagcccgacgagaccgugcacagcuucgcccagagaagacugggccccgagguggccagccuggccauggacagccugugcagaggcguguucgccggcaacagcagagagcugagcaucagaagcugcuuccccagccuguuccaggccgagcagacccacagaagcauccugcugggccugcugcugggcgccggcagaaccccccagcccgacagcgcccugaucagacaggcccuggccgagagauggagccaguggagccugagaggcggccuggagaugcugccccaggcccuggagacccaccugaccagcagaggcgugagcgugcugagaggccagcccgugugcggccugagccugcaggccgagggcagauggaaggugagccugagagacagcagccuggaggccgaccacgugaucagcgccauccccgccagcgugcugagcgagcugcugcccgccgaggccgccccccuggccagagcccugagcgccaucaccgccgugagcguggccguggugaaccugcaguaccagggcgcccaccugcccgugcagggcuucggccaccuggugcccagcagcgaggaccccggcgugcugggcaucguguacgacagcguggccuuccccgagcaggacggcagcccccccggccugagagugaccgugaugcugggcggcagcuggcugcagacccuggaggccagcggcugcgugcugagccaggagcuguuccagcagagagcccaggaggccgccgccacccagcugggccugaaggagaugcccagccacugccuggugcaccugcacaagaacugcaucccccaguacacccugggccacuggcagaagcuggagagcgccagacaguuccugaccgcccacagacugccccugacccuggccggcgccagcuacgagggcguggccgugaacgacugcaucgagagcggcagacaggccgccgugagcgugcugggcaccgagcccaacagcuaa

SEQ ID NO: 21877 - RNA, 1026 nt, Artificial Sequence
  PPP1CA__Homo_sapiens__NP_001008709
augagcgacagcgagaagcugaaccuggacagcaucaucggcagacugcuggagggcagcagagugcugaccccccacugcgcccccgugcagggcagcagacccggcaagaacgugcagcugaccgagaacgagaucagaggccugugccugaagagcagagagaucuuccugagccagcccauccugcuggagcuggaggccccccugaagaucugcggcgacauccacggccaguacuacgaccugcugagacuguucgaguacggcggcuucccccccgagagcaacuaccuguuccugggcgacuacguggacagaggcaagcagagccuggagaccaucugccugcugcuggccuacaagaucaaguaccccgagaacuucuuccugcugagaggcaaccacgagugcgccagcaucaacagaaucuacggcuucuacgacgagugcaagagaagauacaacaucaagcuguggaagaccuucaccgacugcuucaacugccugcccaucgccgccaucguggacgagaagaucuucugcugccacggcggccugagccccgaccugcagagcauggagcagaucagaagaaucaugagacccaccgacgugcccgaccagggccugcugugcgaccugcuguggagcgaccccgacaaggacgugcagggcuggggcgagaacgacagaggcgugagcuucaccuucggcgccgaggugguggccaaguuccugcacaagcacgaccuggaccugaucugcagagcccaccaggugguggaggacggcuacgaguucuucgccaagagacagcuggugacccuguucagcgcccccaacuacugcggcgaguucgacaacgccggcgccaugaugagcguggacgagacccugaugugcagcuuccagauccugaagcccgccgacaagaacaagggcaaguacggccaguucagcggccugaaccccggcggcagacccaucaccccccccagaaacagcgccaaggccaagaaguaa

SEQ ID NO: 21878 - RNA, 1014 nt, Artificial Sequence
  PPP1CC__Homo_sapiens__NP_001231903
auggccgaccuggacaagcugaacaucgacagcaucauccagagacugcuggaggugagaggcagcaagcccggcaagaacgugcagcugcaggagaacgagaucagaggccugugccugaagagcagagagaucuuccugagccagcccauccugcuggagcuggaggccccccugaagaucugcggcgacauccacggccaguacuacgaccugcugagacuguucgaguacggcggcuucccccccgagagcaacuaccuguuccugggcgacuacguggacagaggcaagcagagccuggagaccaucugccugcugcuggccuacaagaucaaguaccccgagaacuucuuccugcugagaggcaaccacgagugcgccagcaucaacagaaucuacggcuucuacgacgagugcaagagaagauacaacaucaagcuguggaagaccuucaccgacugcuucaacugccugcccaucgccgccaucguggacgagaagaucuucugcugccacggcggccugagccccgaccugcagagcauggagcagaucagaagaaucaugagacccaccgacgugcccgaccagggccugcugugcgaccugcuguggagcgaccccgacaaggacgugcugggcuggggcgagaacgacagaggcgugagcuucaccuucggcgccgaggugguggccaaguuccugcacaagcacgaccuggaccugaucugcagagcccaccaggugguggaggacggcuacgaguucuucgccaagagacagcuggugacccuguucagcgcccccaacuacugcggcgaguucgacaacgccggcgccaugaugagcguggacgagacccugaugugcagcuuccagauccugaagcccgccgagaagaagaagcccaacgccaccagacccgugaccccccccagaguggccagcggccugaaccccagcauccagaaggccagcaacuacagaaacaacaccgugcuguacgaguaa

SEQ ID NO: 21879 - RNA, 2823 nt, Artificial Sequence
  PPP1R10__Homo_sapiens__NP_002705
augggcagcggccccaucgaccccaaggagcugcugaagggccuggacagcuuccugaacagagacggcgaggugaagagcguggacggcaucagcaagaucuucagccugaugaaggaggccagaaagauggugagcagaugcaccuaccugaacauccugcugcagaccagaagccccgagauccuggugaaguucaucgacgugggcggcuacaagcugcugaacaacuggcugaccuacagcaagaccaccaacaacaucccccugcugcagcagauccugcugacccugcagcaccugccccugaccguggaccaccugaagcagaacaacaccgccaagcuggugaagcagcugagcaagagcagcgaggacgaggagcugagaaagcuggccagcgugcuggugagcgacuggauggccgugaucagaagccagagcagcacccagcccgccgagaaggacaagaagaagagaaaggacgagggcaagagcagaaccacccugcccgagagaccccugaccgaggugaaggccgagaccagagccgaggaggcccccgagaagaagagagagaagcccaagagccugagaaccaccgcccccagccacgccaaguucagaagcaccggccuggagcuggagacccccagccuggugcccgugaagaagaacgccagcaccgugguggugagcgacaaguacaaccugaagcccaucccccugaagagacagagcaacguggccgcccccggcgacgccaccccccccgccgagaagaaguacaagccccugaacaccacccccaacgccaccaaggagaucaaggugaagaucauccccccccagcccauggagggccugggcuuccuggacgcccugaacagcgcccccgugcccggcaucaagaucaagaagaagaagaaggugcugagccccaccgccgccaagcccagccccuucgagggcaagaccagcaccgagcccagcaccgccaagcccagcagccccgagcccgccccccccagcgaggccauggacgccgacagacccggcacccccgugccccccguggaggugcccgagcugauggacaccgccagccuggagcccggcgcccuggacgccaagcccguggagagccccggcgaccccaaccagcugaccagaaagggcagaaagagaaagagcgugaccuggcccgaggagggcaagcugagagaguacuucuacuucgagcuggacgagaccgagagagugaacgugaacaagaucaaggacuucggcgaggccgccaagagagagauccugagcgacagacacgccuucgagaccgccagaagacugagccacgacaacauggaggagaaggugcccugggugugccccagaccccuggugcugcccagcccccuggugacccccggcagcaacagccaggagagauacauccaggccgagagagagaagggcauccugcaggagcuguuccugaacaaggagagcccccacgagcccgaccccgagcccuacgagcccaucccccccaagcugaucccccuggacgaggagugcagcauggacgagacccccuacguggagacccuggagcccggcggcagcggcggcagccccgacggcgccggcggcagcaagcugccccccgugcuggccaaccugaugggcagcaugggcgccggcaagggcccccagggccccggcggcggcggcaucaacgugcaggagauccugaccagcaucaugggcagccccaacagccaccccagcgaggagcugcugaagcagcccgacuacagcgacaagaucaagcagaugcuggugccccacggccugcugggccccggccccaucgccaacggcuucccccccggcggccccggcggccccaagggcaugcagcacuucccccccggccccggcggccccaugcccggcccccacggcggccccggcggccccgugggccccagacugcugggccccccccccccccccagaggcggcgaccccuucugggacggccccggcgaccccaugagaggcggccccaugagaggcggccccggccccggccccggccccuaccacagaggcagaggcggcagaggcggcaacgagcccccccccccccccccccccuucagaggcgccagaggcggcagaagcggcggcggcccccccaacggcagaggcggccccggcggcggcauggugggcggcggcggccacagaccccacgagggccccggcggcggcaugggcaacagcagcggccacagaccccacgagggccccggcggcggcaugggcagcggccacagaccccacgagggccccggcggcagcaugggcggcggcggcggccacagaccccacgagggccccggcggcggcaucagcggcggcagcggccacagaccccacgagggccccggcggcggcaugggcgccggcggcggccacagaccccacgagggccccggcggcagcaugggcggcagcggcggccacagaccccacgagggccccggccacggcggcccccacggccacagaccccacgacgugcccggccacagaggccacgaccacagaggcccccccccccacgagcacagaggccacgacggccccggccacggcggcggcggccacagaggccacgacggcggccacagccacggcggcgacaugagcaacagacccgugugcagacacuucaugaugaagggcaacugcagauacgagaacaacugcgccuucuaccaccccggcgugaacggccccccccugcccuaa

SEQ ID NO: 21880 - RNA, 381 nt, Artificial Sequence
  PPP1R11__Homo_sapiens__NP_068778
auggccgaggccggcgccggccugagcgagaccgugaccgagaccaccgugaccgugaccaccgagcccgagaacagaagccugaccaucaagcugagaaagagaaagcccgagaagaagguggaguggaccagcgacaccguggacaacgagcacaugggcagaagaagcagcaagugcugcugcaucuacgagaagcccagagccuucggcgagagcagcaccgagagcgacgaggaggaggaggagggcugcggccacacccacugcgugagaggccacagaaagggcagaagaagagccacccugggccccacccccaccacccccccccagccccccgaccccagccagcccccccccggccccaugcagcacuaa

SEQ ID NO: 21881 - RNA, 3093 nt, Artificial Sequence
  PPP1R12A__Homo_sapiens__NP_001137357
augaagauggccgacgccaagcagaagagaaacgagcagcugaagagauggaucggcagcgagaccgaccuggagccccccguggugaagagacagaagaccaaggugaaguucgacgacggcgccguguuccuggccgccugcagcagcggcgacaccgacgaggugcugaagcugcugcacagaggcgccgacaucaacuacgccaacguggacggccugaccgcccugcaccaggccugcaucgacgacaacguggacauggugaaguuccugguggagaacggcgccaacaucaaccagcccgacaacgagggcuggaucccccugcacgccgccgccagcugcggcuaccuggacaucgccgaguuccugaucggccagggcgcccacgugggcgccgugaacagcgagggcgacaccccccuggacaucgccgaggaggaggccauggaggagcugcugcagaacgaggugaacagacagggcguggacaucgaggccgccagaaaggaggaggagagaaucaugcugagagacgccagacaguggcugaacagcggccacaucaacgacgugagacacgccaagagcggcggcaccgcccugcacguggccgccgccaagggcuacaccgaggugcugaagcugcugauccaggccggcuacgacgugaacaucaaggacuacgacggcuggaccccccugcacgccgccgcccacuggggcaaggaggaggccugcagaauccugguggacaaccugugcgacauggagauggugaacaaggugggccagaccgccuucgacguggccgacgaggacauccugggcuaccuggaggagcugcagaagaagcagaaccugcugcacagcgagaagagagacaagaagagcccccugaucgagagcaccgccaacauggacaacaaccagagccagaagaccuucaagaacaaggagacccugaucaucgagcccgagaagaacgccagcagaaucgagagccuggagcaggagaagguggacgaggaggaggagggcaagaaggacgagagcagcugcagcagcgaggaggacgaggaggacgacagcgagagcgaggccgagaccgacaagaccaagccccuggccagcgugaccaacgccaacaccagcagcacccaggccgcccccguggccgugaccacccccaccgugagcagcggccaggccacccccaccagccccaucaagaaguuccccaccaccgccaccaagaucagccccaaggaggaggagagaaaggacgagagccccgccaccuggagacugggccugagaaagaccggcagcuacggcgcccuggccgagaucaccgccagcaaggagggccagaaggagaaggacaccgccggcgugaccagaagcgccagcagccccagacugagcagcagccuggacaacaaggagaaggagaaggacagcaagggcaccagacuggccuacguggcccccaccauccccagaagacuggccagcaccagcgacaucgaggagaaggagaacagagacagcagcagccugagaaccagcagcagcuacaccagaagaaagugggaggacgaccugaagaagaacagcagcgugaacgagggcagcaccuaccacaagagcugcagcuucggcagaagacaggacgaccugaucagcagcagcgugcccagcaccaccagcacccccaccgugaccagcgccgccggccugcagaagagccugcugagcagcaccagcaccaccaccaagaucaccaccggcagcagcagcgccggcacccagagcagcaccagcaacagacugugggccgaggacagcaccgagaaggagaaggacagcgugcccaccgccgugaccauccccguggcccccaccguggugaacgccgccgccagcaccaccacccugaccaccaccaccgccggcaccgugagcagcaccaccgaggugagagagagaagaagaagcuaccugacccccgugagagacgaggagagcgagagccagagaaaggccagaagcagacaggccagacagagcagaagaagcacccagggcgugacccugaccgaccugcaggaggccgagaagaccaucggcagaagcagaagcaccagaaccagagagcaggagaacgaggagaaggagaaggaggagaaggagaagcaggacaaggagaagcaggaggagaagaaggagagcgagaccagcagagaggacgaguacaagcagaaguacagcagaaccuacgacgagaccuaccagagauacagacccgugagcaccagcagcagcaccacccccagcagcagccugagcaccaugagcagcagccuguacgccagcagccagcugaacagacccaacagccuggugggcaucaccagcgccuacagcagaggcaucaccaaggagaacgagagagagggcgagaagagagaggaggagaaggagggcgaggacaagagccagcccaagagcaucagagagagaagaagacccagagagaagagaagaagcaccggcgugagcuucuggacccaggacagcgacgagaacgagcaggagcagcagagcgacaccgaggagggcagcaacaagaaggagacccagaccgacagcaucagcagauacgagaccagcagcaccagcgccggcgacagauacgacagccugcugggcagaagcggcagcuacagcuaccuggaggagagaaagcccuacagcagcagacuggagaaggacgacagcaccgacuucaagaagcuguacgagcagauccuggccgagaacgagaagcugaaggcccagcugcacgacaccaacauggagcugaccgaccugaagcugcagcuggagaaggccacccagagacaggagagauucgccgacagaagccugcuggagauggagaagagagagagaagagcccuggagagaagaaucagcgagauggaggaggagcugaagaugcugcccgaccugaaggccgacaaccagagacugaaggacgagaacggcgcccugaucagagugaucagcaagcugagcaaguaa

SEQ ID NO: 21882 - RNA, 1548 nt, Artificial Sequence
  PPP1R12B__Homo_sapiens__NP_001161329
auggccgagcuggagcaccugggcggcaagagagccgagagcgccagaaugagaagagccgagcagcugagaagauggagaggcagccugaccgagcaggagcccgccgagagaagaggcgccggcagacagccccugaccagaagaggcagccccagagugagauucgaggacggcgccguguuccuggccgccugcagcagcggcgacaccgacgaggugagaaagcugcuggccagaggcgccgacaucaacaccgugaacguggacggccugaccgcccugcaccaggccugcaucgacgagaaccuggacauggugaaguuccugguggagaacagagccaacgugaaccagcaggacaacgagggcuggaccccccugcacgccgccgccagcugcggcuaccugaacaucgccgaguacuucaucaaccacggcgccagcgugggcaucgugaacagcgagggcgaggugcccagcgaccuggccgaggagcccgccaugaaggaccugcugcuggagcaggugaagaagcagggcguggaccuggagcagagcagaaaggaggaggagcagcagaugcugcaggacgccagacaguggcugaacagcggcaagaucgaggacgugagacaggccagaagcggcgccaccgcccugcacguggccgccgccaagggcuacagcgaggugcugagacugcugauccaggccggcuacgagcugaacgugcaggacuacgacggcuggaccccccugcacgccgccgcccacuggggcgugaaggaggccugcagcauccuggccgaggcccugugcgacauggacaucagaaacaagcugggccagacccccuucgacguggccgacgagggccugguggagcaccuggagcugcugcagaagaagcagaacgugcugagaagcgagaaggagaccagaaacaagcugaucgagagcgaccugaacagcaagauccagagcggcuucuucaagaacaaggagaagaugcuguacgaggaggagacccccaagagccaggagauggaggaggagaacaaggagagcagcagcagcagcagcgaggaggaggagggcgaggacgaggccagcgagagcgagaccgagaaggaggccgacaagaagcccgaggccuucgugaaccacagcaacagcgagagcaagagcagcaucaccgagcagauccccgcccccgcccagaacaccuucagcgccagcagcgccagaagauucagcagcggccuguucaacaagcccgaggagcccaaggacgagagccccagcagcuggagacugggccugagaaagaccggcagccacaacaugcugagcgagguggccaacagcagagagcccaucagagacagaggcagcagcaucuacagaagcagcagcagccccagaaucagcgcccugcuggacaacaaggacaaggugcaguucggcagaguguggggcaacagcaaggccguguucuucuuccacgagaacagcauccugggcaccaacgagaacaucuucuaa

SEQ ID NO: 21883 - RNA, 2349 nt, Artificial Sequence
  PPP1R12C__Homo_sapiens__NP_060077
augagcggcgaggacggccccgccgccggccccggcgccgccgccgccgccgccagagagagaagaagagagcagcugagacaguggggcgccagagccggcgccgagcccggccccggcgagagaagagccagaaccgugagauucgagagagccgccgaguuccuggccgccugcgccggcggcgaccuggacgaggccagacugaugcugagagccgccgaccccggccccggcgccgagcuggaccccgccgcccccccccccgccagagccgugcuggacagcaccaacgccgacggcaucagcgcccugcaccaggccugcaucgacgagaaccuggagguggugagauuccugguggagcagggcgccaccgugaaccaggccgacaacgagggcuggaccccccugcacguggccgccagcugcggcuaccuggacaucgccagauaccugcugagccacggcgccaacaucgccgccgugaacagcgacggcgaccugccccuggaccuggccgagagcgacgccauggagggccugcugaaggccgagaucgccagaagaggcguggacguggaggccgccaagagagccgaggaggagcugcugcugcacgacaccagaugcuggcugaacggcggcgccaugcccgaggccagacaccccagaaccggcgccagcgcccugcacguggccgccgccaagggcuacaucgaggugaugagacugcugcugcaggccggcuacgaccccgagcugagagacggcgacggcuggaccccccugcacgccgccgcccacuggggcguggaggacgccugcagacugcuggccgagcacggcggcggcauggacagccugacccacgccggccagagacccugcgaccuggccgacgaggaggugcugagccugcuggaggagcuggccagaaagcaggaggaccugagaaaccagaaggaggccagccagagcagaggccaggagccccaggcccccagcagcagcaagcacagaagaagcagcgugugcagacugagcagcagagagaagaucagccugcaggaccugagcaaggagagaagacccggcggcgccggcggcccccccauccaggacgaggacgagggcgaggagggccccaccgagcccccccccgccgagcccagaacccugaacggcgugagcagccccccccaccccagccccaagagccccgugcagcuggaggaggcccccuucagcagaagauucggccugcugaagaccggcagcagcggcgcccugggcccccccgagagaagaaccgccgagggcgcccccggcgccggccugcagagaagcgccagcagcagcuggcuggagggcaccagcacccaggccaaggagcugagacuggccagaaucacccccacccccagccccaagcugcccgagcccagcgugcugagcgaggugaccaagcccccccccugccuggagaacagcagcccccccagcagaauccccgagcccgagagccccgccaagcccaacgugcccaccgccagcaccgccccccccgccgacagcagagacagaagaagaagcuaccagaugcccgugagagacgaggagagcgagagccagagaaaggccagaagcagacugaugagacagagcagaagaagcacccagggcgugacccugaccgaccugaaggaggccgagaaggccgccggcaaggcccccgagagcgagaagcccgcccagagccuggaccccagcagaagacccagagugcccggcguggagaacagcgacagccccgcccagagagccgaggcccccgacggccagggccccggcccccaggccgccagagagcacagaaaggugggcaaggaguggagaggccccgccgagggcgaggaggccgagcccgccgacagaagccaggagagcagcacccuggagggcggccccagcgccagaagacagagauggcagagagaccugaaccccgagcccgagcccgagagcgaggagcccgacggcggcuucagaacccuguacgccgagcugagaagagagaacgagagacugagagaggcccugaccgagaccacccugagacuggcccagcugaagguggagcuggagagagccacccagagacaggagagauucgccgagagacccgcccugcuggagcuggagagauucgagagaagagcccuggagagaaaggccgccgagcuggaggaggagcugaaggcccugagcgaccugagagccgacaaccagagacugaaggacgagaacgccgcccugaucagagugaucagcaagcugagcaaguaa

SEQ ID NO: 21884 - RNA, 3273 nt, Artificial Sequence
  PPP1R13B__Homo_sapiens__NP_056131
augaugcccaugauccugaccguguuccugagcaacaacgagcagauccugaccgaggugcccaucacccccgagaccaccugcagagacgugguggaguucugcaaggagcccggcgagggcagcugccaccuggccgagguguggagaggcaacgagagacccauccccuucgaccacaugauguacgagcaccugcagaaguggggccccagaagagaggaggugaaguucuuccugagacacgaggacagccccaccgagaacagcgagcagggcggcagacagacccaggagcagagaacccagagaaacgugaucaacgugcccggcgagaagagaaccgagaacggcgugggcaaccccagaguggagcugacccugagcgagcugcaggacauggccgccagacagcagcagcagaucgagaaccagcagcagaugcugguggccaaggagcagagacugcacuuccugaagcagcaggagagaagacagcagcagagcaucagcgagaacgagaagcugcagaagcugaaggagagaguggaggcccaggagaacaagcugaagaagaucagagccaugagaggccagguggacuacagcaagaucaugaacggcaaccugagcgccgagaucgagagauucagcgccauguuccaggagaagaagcaggaggugcagaccgccauccugagaguggaccagcugagccagcagcuggaggaccugaagaagggcaagcugaacggcuuccagagcuacaacggcaagcugaccggccccgccgccguggagcugaagagacuguaccaggagcugcagaucagaaaccagcugaaccaggagcagaacagcaagcugcagcagcagaaggagcugcugaacaagagaaacauggagguggccaugauggacaagagaaucagcgagcugagagagagacuguacggcaagaagauccagcugaacagagugaacggcaccagcagcccccagagcccccugagcaccagcggcagaguggccgccgugggccccuacauccaggugcccagcgccggcagcuuccccgugcugggcgaccccaucaagccccagagccugagcaucgccagcaacgccgcccacggcagaagcaagagcgccaacgacggcaacuggcccacccugaagcagaacagcagcagcagcgugaagcccgugcagguggccggcgccgacuggaaggaccccagcguggagggcagcgugaagcagggcaccgugagcagccagcccgugcccuucagcgcccugggccccaccgagaagcccggcaucgagaucggcaaggugcccccccccauccccggcgugggcaagcagcugccccccagcuacggcaccuaccccagccccaccccccugggccccggcagcaccagcagccuggagagaagaaaggagggcagccugcccagacccagcgccggccugcccagcagacagagacccacccugcugcccgccaccggcagcaccccccagcccggcagcagccagcagauccagcagagaaucagcgugccccccagccccaccuacccccccgccggcccccccgccuuccccgccggcgacagcaagcccgagcugccccugaccguggccaucagacccuuccuggccgacaagggcagcagaccccagagccccagaaagggcccccagaccgugaacagcagcagcaucuacagcauguaccugcagcaggccaccccccccaagaacuaccagcccgccgcccacagcgcccugaacaagagcgugaaggccguguacggcaagcccgugcugcccagcggcagcaccagccccagcccccugcccuuccugcacggcagccugagcaccggcaccccccagccccagccccccagcgagagcaccgagaaggagcccgagcaggacggccccgccgcccccgccgacggcagcaccguggagagccugcccagaccccugagccccaccaagcugacccccaucgugcacagcccccugagauaccagagcgacgccgaccuggaggcccugagaagaaagcuggccaacgcccccagaccccugaagaagagaagcagcaucaccgagcccgagggccccggcggccccaacauccagaagcugcuguaccagagauucaacacccuggccggcggcauggagggcacccccuucuaccagcccagccccagccaggacuucaugggcacccuggccgacguggacaacggcaacaccaacgccaacggcaaccuggaggagcugccccccgcccagcccaccgccccccugcccgccgagcccgcccccagcagcgacgccaacgacaacgagcugcccagccccgagcccgaggagcugaucugcccccagaccacccaccagaccgccgagcccgccgaggacaacaacaacaacguggccaccgugcccaccaccgagcagauccccagccccguggccgaggcccccagccccggcgaggagcaggugccccccgccccccugccccccgccagccacccccccgccaccagcaccaacaagagaaccaaccugaagaagcccaacagcgagagaaccggccacggccugagagugagauucaacccccuggcccugcugcuggacgccagccuggagggcgaguucgaccuggugcagagaaucaucuacgagguggaggaccccagcaagcccaacgacgagggcaucaccccccugcacaacgccgugugcgccggccaccaccacaucgugaaguuccugcuggacuucggcgugaacgugaacgccgccgacagcgacggcuggaccccccugcacugcgccgccagcugcaacagcgugcaccugugcaagcagcugguggagagcggcgccgccaucuucgccagcaccaucagcgacaucgagaccgccgccgacaagugcgaggagauggaggagggcuacauccagugcagccaguuccuguacggcgugcaggagaagcugggcgugaugaacaagggcguggccuacgcccugugggacuacgaggcccagaacagcgacgagcugagcuuccacgagggcgacgcccugaccauccugagaagaaaggacgagagcgagaccgagugguggugggccagacugggcgacagagagggcuacgugcccaagaaccugcugggccuguaccccagaaucaagcccagacagagaacccuggccuaa

SEQ ID NO: 21885 - RNA, 2487 nt, Artificial Sequence
  PPP1R13L__Homo_sapiens__NP_001135974
auggacagcgaggccuuccagagcgccagagacuuccuggacaugaacuuccagagccuggccaugaagcacauggaccugaagcagauggagcuggacaccgccgccgccaagguggacgagcugaccaagcagcuggagagccuguggagcgacagccccgccccccccggcccccaggccggcccccccagcagaccccccagauacagcagcagcagcauccccgagcccuucggcagcagaggcagccccagaaaggccgccaccgacggcgccgacacccccuucggcagaagcgagagcgcccccacccugcaccccuacagcccccugagccccaagggcagacccagcagccccagaaccccccuguaccugcagcccgacgccuacggcagccuggacagagccaccagccccagacccagagccuucgacggcgccggcagcagccugggcagagcccccagccccagacccggccccggcccccugagacagcagggcccccccacccccuucgacuuccugggcagagccggcagccccagaggcagcccccuggccgagggcccccaggccuucuuccccgagagaggccccagccccagaccccccgccaccgccuacgacgcccccgccagcgccuucggcagcagccugcugggcagcggcggcagcgccuucgcccccccccugagagcccaggacgaccugacccugagaagaagaccccccaaggccuggaacgagagcgaccuggacguggccuacgagaagaagcccagccagaccgccagcuacgagagacuggacguguucgccagacccgccagccccagccugcagcugcugcccuggagagagagcagccuggacggccugggcggcaccggcaaggacaaccugaccagcgccacccugcccagaaacuacaaggugagcccccuggccagcgacagaagaagcgacgccggcagcuacagaagaagccugggcagcgccggccccagcggcacccugcccagaagcuggcagcccgugagcagaauccccaugccccccagcagcccccagcccagaggcgcccccagacagagacccaucccccugagcaugaucuucaagcugcagaacgccuucugggagcacggcgccagcagagccaugcugcccggcagcccccuguucaccagagcccccccccccaagcugcagccccagccccagccccagccccagccccagagccagccccagccccagcugcccccccagccccagacccagccccagacccccacccccgccccccagcacccccagcagaccuggccccccgugaacgagggcccccccaagccccccaccgagcuggagcccgagcccgagaucgagggccugcugacccccgugcuggaggccggcgacguggacgagggccccguggccagaccccugagccccaccagacugcagcccgcccugccccccgaggcccagagcgugcccgagcuggaggagguggccagagugcuggccgagauccccagaccccugaagagaagaggcagcauggagcaggcccccgccguggcccugccccccacccacaagaagcaguaccagcagaucaucagcagacuguuccacagacacggcggccccggccccggcggccccgagcccgagcugagccccaucaccgagggcagcgaggccagagccggcccccccgcccccgccccccccgcccccauccccccccccgcccccagccagagcagcccccccgagcagccccagagcauggagaugagaagcgugcugagaaaggccggcagccccagaaaggccagaagagccagacugaacccccuggugcugcugcuggacgccgcccugaccggcgagcuggagguggugcagcaggccgugaaggagaugaacgaccccagccagcccaacgaggagggcaucaccgcccugcacaacgccaucugcggcgccaacuacagcaucguggacuuccugaucaccgccggcgccaacgugaacagccccgacagccacggcuggaccccccugcacugcgccgccagcugcaacgacaccgugaucugcauggcccuggugcagcacggcgccgccaucuucgccaccacccugagcgacggcgccaccgccuucgagaagugcgaccccuacagagagggcuacgccgacugcgccaccuaccuggccgacguggagcagagcaugggccugaugaacagcggcgccguguacgcccugugggacuacagcgccgaguucggcgacgagcugagcuucagagagggcgagagcgugaccgugcugagaagagacggccccgaggagaccgacugguggugggccgcccugcacggccaggagggcuacgugcccagaaacuacuucggccuguuccccagagugaagccccagagaagcaagguguaa

SEQ ID NO: 21886 - RNA, 363 nt, Artificial Sequence
  PPP1R14A__Homo_sapiens__NP_001230876
auggccgcccagagacugggcaagagagugcugagcaagcugcagagccccagcagagccagaggccccggcggcagccccggcggccugcagaagagacacgccagagugaccgugaaguacgacagaagagagcugcagagaagacuggacguggagaaguggaucgacggcagacuggaggagcuguacagaggcaugggccugcugaagagcugcggcaagcccguggaggacuucauccaggagcugcuggccaagcugcagggccugcacagacagcccggccugagacagcccagccccagccacgacggcagccugagcccccugcaggacagagccagaaccgcccaccccuaa

SEQ ID NO: 21887 - RNA, 444 nt, Artificial Sequence
  PPP1R14B__Homo_sapiens__NP_619634
auggccgacagcggcaccgccggcggcgccgcccuggccgcccccgcccccggccccggcagcggcggccccggccccagaguguacuuccagagcccccccggcgccgccggcgagggccccggcggcgccgacgacgagggccccgugagaagacagggcaaggugaccgugaaguacgacagaaaggagcugagaaagagacugaaccuggaggaguggauccuggagcagcugaccagacuguacgacugccaggaggaggagauccccgagcuggagaucgacguggacgagcugcuggacauggagagcgacgacgccagagccgccagagugaaggagcugcugguggacugcuacaagcccaccgaggccuucaucagcggccugcuggacaagaucagaggcaugcagaagcugagcaccccccagaagaaguaa

SEQ ID NO: 21888 - RNA, 498 nt, Artificial Sequence
  PPP1R14C__Homo_sapiens__NP_112211
augagcguggccaccggcagcagcgagaccgccggcggcgccagcggcggcggcgccagaguguucuuccagagccccagaggcggcgccggcggcagccccggcagcagcagcggcagcggcagcagcagagaggacagcgcccccguggccaccgccgccgccgccggccaggugcagcagcagcagcagagaagacaccagcagggcaaggugaccgugaaguacgacagaaaggagcugagaaagagacuggugcuggaggaguggaucguggagcagcugggccagcuguacggcugcgaggaggaggagaugcccgagguggagaucgacaucgacgaccugcuggacgccgacagcgacgaggagagagccagcaagcugcaggaggcccugguggacugcuacaagcccaccgaggaguucaucaaggagcugcugagcagaaucagaggcaugagaaagcugagccccccccagaagaagagcguguaa

SEQ ID NO: 21889 - RNA, 2025 nt, Artificial Sequence
  PPP1R15A__Homo_sapiens__NP_055145
auggcccccggccaggccccccaccaggccacccccuggagagacgcccaccccuucuuccugcugagccccgugaugggccugcugagcagagccuggagcagacugagaggccugggcccccuggagcccuggcugguggaggccgugaagggcgccgcccugguggaggccggccuggagggcgaggccagaaccccccuggccaucccccacacccccuggggcagaagacccgaggaggaggccgaggacagcggcggccccggcgaggacagagagacccugggccugaagaccagcagcagccugcccgaggccuggggccugcuggacgacgacgacggcauguacggcgagagagaggccaccagcgugcccagaggccagggcagccaguucgccgacggccagagagccccccugagccccagccugcugaucagaacccugcagggcagcgacaagaaccccggcgaggagaaggccgaggaggagggcguggccgaggaggagggcgugaacaaguucagcuacccccccagccacagagagugcugccccgccguggaggaggaggacgacgaggaggccgugaagaaggaggcccacagaaccagcaccagcgcccugagccccggcagcaagcccagcaccugggugagcugccccggcgaggaggagaaccaggccaccgaggacaagagaaccgagagaagcaagggcgccagaaagaccagcgugagccccagaagcagcggcagcgaccccagaagcugggaguacagaagcggcgaggccagcgaggagaaggaggagaaggcccacaaggagaccggcaagggcgaggccgcccccggcccccagagcagcgcccccgcccagagaccccagcugaagagcugguggugccagcccagcgacgaggaggagggcgaggugaaggcccugggcgccgccgagaaggacggcgaggccgagugcccccccugcauccccccccccagcgccuuccugaaggccuggguguacuggcccggcgaggacaccgaggaggaggaggacgaggaggaggacgaggacagcgacagcggcagcgacgaggaggagggcgaggccgaggccagcagcagcacccccgccaccggcguguuccugaagagcuggguguaccagcccggcgaggacaccgaggaggaggaggacgaggacagcgacaccggcagcgccgaggacgagagagaggccgagaccagcgccagcaccccccccgccagcgccuuccugaaggccuggguguacagacccggcgaggacaccgaggaggaggaggacgaggacguggacagcgaggacaaggaggacgacagcgaggccgcccugggcgaggccgagagcgacccccaccccagccaccccgaccagagagcccacuucagaggcuggggcuacagacccggcaaggagaccgaggaggaggaggccgccgaggacuggggcgaggccgagcccugccccuucagaguggccaucuacgugcccggcgagaagccccccccccccugggccccccccagacugccccugagacugcagagaagacugaagagacccgagacccccacccacgaccccgaccccgagaccccccugaaggccagaaaggugagauucagcgagaaggugaccgugcacuuccuggccgugugggccggccccgcccaggccgccagacagggccccugggagcagcuggccagagacagaagcagauucgccagaagaaucacccaggcccaggaggagcugagccccugccugacccccgccgccagagccagagccugggccagacugagaaaccccccccuggcccccauccccgcccugacccagacccugcccagcagcagcgugcccagcagccccgugcagaccaccccccugagccaggccguggccacccccagcagaagcagcgccgccgccgccgccgcccuggaccugagcggcagaagaggcuaa

SEQ ID NO: 21890 - RNA, 2142 nt, Artificial Sequence
  PPP1R15B__Homo_sapiens__NP_116222
auggagcccggcaccggcggcagcagaaagagacugggccccagagccggcuucagauucuggccccccuucuuccccagaagaagccaggccggcagcagcaaguuccccaccccccugggccccgagaacagcggcaaccccacccugcugagcagcgcccagcccgagaccagagugagcuacuggaccaagcugcugagccagcugcuggccccccugcccggccugcugcagaaggugcugaucuggagccagcuguucggcggcauguuccccaccagauggcuggacuucgccggcguguacagcgcccugagagcccugaagggcagagagaagcccgccgcccccaccgcccagaagagccugagcagccugcagcuggacagcagcgaccccagcgugaccagcccccuggacuggcuggaggagggcauccacuggcaguacagcccccccgaccugaagcuggagcugaaggccaagggcagcgcccuggaccccgccgcccaggccuuccugcuggagcagcagcuguggggcguggagcugcugcccagcagccugcagagcagacuguacagcaacagagagcugggcagcagccccagcggcccccugaacauccagagaaucgacaacuucagcguggugagcuaccugcugaaccccagcuaccuggacugcuuccccagacuggaggugagcuaccagaacagcgacggcaacagcgagguggugggcuuccagacccugacccccgagagcagcugccugagagaggaccacugccacccccagccccugagcgccgagcugauccccgccagcuggcagggcugccccccccugagcaccgagggccugcccgagauccaccaccugagaaugaagagacuggaguuccugcagcaggccagcaagggccaggaccugcccacccccgaccaggacaacggcuaccacagccuggaggaggagcacagccugcugagaauggaccccaagcacugcagagacaaccccacccaguucgugcccgccgccggcgacauccccggcaacacccaggagagcaccgaggagaagaucgagcugcugaccaccgaggugccccuggcccuggaggaggagagccccagcgagggcugccccagcagcgagauccccauggagaaggagcccggcgagggcagaaucagcgugguggacuacagcuaccuggagggcgaccugcccaucagcgccagacccgccugcagcaacaagcugaucgacuacauccugggcggcgccagcagcgaccuggagaccagcagcgaccccgagggcgaggacugggacgaggaggccgaggacgacggcuucgacagcgacagcagccugagcgacagcgaccuggagcaggaccccgagggccugcaccuguggaacagcuucugcagcguggaccccuacaacccccagaacuucaccgccaccauccagaccgccgccagaaucgugcccgaggagcccagcgacagcgagaaggaccugagcggcaagagcgaccuggagaacagcagccagagcggcagccugcccgagacccccgagcacagcagcggcgaggaggacgacugggagagcagcgccgacgaggccgagagccugaagcuguggaacagcuucugcaacagcgacgaccccuacaacccccugaacuucaaggcccccuuccagaccagcggcgagaacgagaagggcugcagagacagcaagacccccagcgagagcaucguggccaucagcgagugccacacccugcugagcugcaaggugcagcugcugggcagccaggagagcgagugccccgacagcgugcagagagacgugcugagcggcggcagacacacccacgugaagagaaagaaggugaccuuccuggaggaggugaccgaguacuacaucagcggcgacgaggacagaaagggccccugggaggaguucgccagagacggcugcagauuccagaagagaauccaggagaccgaggacgccaucggcuacugccugaccuucgagcacagagagagaauguucaacagacugcagggcaccugcuucaagggccugaacgugcugaagcagugcuaa

SEQ ID NO: 21891 - RNA, 315 nt, Artificial Sequence
  PPP1R17__Homo_sapiens__NP_001138595
augaugagcaccgagcagaugcagccccuggagcugagcgaggacagacuggacaagcuggaccccagaugcagccaccugggcguguucagcgagcaccugaucaagagauacgacgugcaggagagacaccccaagggcaagaugauccccgugcugcacaacaccgaccuggagcagaagaagcccagaagaaaggacacccccgcccugcacaugagccccuucgccgccggcgugacccugcugagagacgagagacccaaggccaucguggaggacgacgagaaggacggcgacaagaucgccaucuaa

SEQ ID NO: 21892 - RNA, 1842 nt, Artificial Sequence
  PPP1R18__Homo_sapiens__NP_001128342
auggccaccauccccgacuggaagcugcagcugcuggccagaagaagacaggaggaggccagcgugagaggcagagagaaggccgagagagagagacugagccagaugcccgccuggaagagaggccugcuggagagaagaagagccaagcugggccugagccccggcgagcccagccccgugcugggcaccguggaggccggcccccccgaccccgacgagagcgccgugcugcuggaggccaucggccccgugcaccagaacagauucaucagacaggagagacagcagcagcagcagcagcagcagagaagcgaggagcugcuggccgagagaaagcccggcccccuggaggccagagagagaagacccagccccggcgagaugagagaccagagccccaagggcagagagagcagagaggagagacugagccccagagagaccagagagagaagacugggcaucggcggcgcccaggagcugagccugagaccccuggaggccagagacuggagacagagccccggcgaggugggcgacagaagcagcagacugagcgaggccuggaaguggagacugagccccggcgagacccccgagagaagccugagacuggccgagagcagagagcagagccccagaagaaaggagguggagagcagacugagccccggcgagagcgccuaccagaagcugggccugaccgaggcccacaaguggagacccgacagcagagagagccaggagcagagccuggugcagcuggaggccaccgaguggagacugagaagcggcgaggagagacaggacuacagcgaggagugcggcagaaaggaggaguggcccgugcccggcguggcccccaaggagaccgccgagcugagcgagacccugaccagagaggcccagggcaacagcagcgccggcguggaggccgccgagcagagacccguggaggacggcgagagaggcaugaagcccaccgagggcuggaaguggacccugaacagcggcaaggccagagaguggacccccagagacaucgaggcccagacccagaagcccgagccccccgagagcgccgagaagcugcuggagagccccggcguggaggccggcgagggcgaggccgagaaggaggaggccggcgcccagggcagaccccugagagcccugcagaacugcugcagcgugcccagcccccugccccccgaggacgccggcaccggcggccugagacagcaggaggaggaggccguggagcugcagccccccccccccgccccccugagcccccccccccccgcccccaccgccccccagccccccggcgacccccugaugagcagacuguucuacggcgugaaggccggccccggcgugggcgcccccagaagaagcggccacaccuucaccgugaaccccagaagaagcgugccccccgccacccccgccacccccaccagccccgccaccguggacgccgccgugcccggcgccggcaagaagagauaccccaccgccgaggagauccuggugcugggcggcuaccugagacugagcagaagcugccuggccaagggcagccccgagagacaccacaagcagcugaagaucagcuucagcgagaccgcccuggagaccaccuaccaguaccccagcgagagcagcgugcuggaggagcugggccccgagcccgaggugcccagcgcccccaacccccccgccgcccagcccgacgacgaggaggacgaggaggagcugcugcugcugcagcccgagcugcagggcggccugagaaccaaggcccugaucguggacgagagcugcagaagauaa

SEQ ID NO: 21893 - RNA, 516 nt, Artificial Sequence
  PPP1R1A__Homo_sapiens__NP_006732
auggagcaggacaacagccccagaaagauccaguucaccgugccccugcuggagccccaccuggaccccgaggccgccgagcagaucagaagaagaagacccacccccgccacccuggugcugaccagcgaccagagcagccccgagaucgacgaggacagaauccccaacccccaccugaagagcacccuggccaugagccccagacagagaaagaagaugaccagaaucacccccaccaugaaggagcugcagaugaugguggagcaccaccugggccagcagcagcagggcgaggagcccgagggcgccgccgagagcaccggcacccaggagagcagaccccccggcauccccgacaccgagguggagagcagacugggcaccagcggcaccgccaagaagaccgccgagugcauccccaagacccacgagagaggcagcaaggagcccagcaccaaggagcccagcacccacauccccccccuggacagcaagggcgccaacagcguguaa

SEQ ID NO: 21894 - RNA, 615 nt, Artificial Sequence
  PPP1R1B__Homo_sapiens__NP_115568
auggaccccaaggacagaaagaagauccaguucagcgugcccgccccccccagccagcuggaccccagacagguggagaugaucagaagaagaagacccacccccgccaugcuguucagacugagcgagcacagcagccccgaggaggaggccagcccccaccagagagccagcggcgagggccaccaccugaagagcaagagacccaaccccugcgccuacaccccccccagccugaaggccgugcagagaaucgccgagagccaccugcagagcaucagcaaccugaacgagaaccaggccagcgaggaggaggacgagcugggcgagcugagagagcugggcuaccccagagaggaggacgaggaggaggaggaggacgacgaggaggaggaggaggaggaggacagccaggccgaggugcugaaggugaucagacagagcgccggccagaagaccaccugcggccagggccuggagggccccugggagagaccccccccccuggacgagagcgagagagacggcggcagcgaggaccagguggaggaccccgcccugagcgagcccggcgaggagccccagagacccagccccagcgagcccggcaccuaa

SEQ ID NO: 21895 - RNA, 618 nt, Artificial Sequence
  PPP1R2__Homo_sapiens__NP_006232
auggccgccagcaccgccagccacagacccaucaagggcauccugaagaacaagaccagcaccaccagcagcaugguggccagcgccgagcagcccagaggcaacguggacgaggagcugagcaagaagagccagaagugggacgagaugaacauccuggccaccuaccaccccgccgacaaggacuacggccugaugaagaucgacgagcccagcacccccuaccacagcaugaugggcgacgacgaggacgccugcagcgacaccgaggccaccgaggccauggcccccgacauccuggccagaaagcuggccgccgccgagggccuggagcccaaguacagaauccaggagcaggagagcagcggcgaggaggacagcgaccugagccccgaggagagagagaagaagagacaguucgagaugaagagaaagcugcacuacaacgagggccugaacaucaagcuggccagacagcugaucagcaaggaccugcacgacgacgacgaggacgaggagaugcuggagaccgccgacggcgagagcaugaacaccgaggagagcaaccagggcagcacccccagcgaccagcagcagaacaagcugagaagcagcuaa

SEQ ID NO: 21896 - RNA, 3369 nt, Artificial Sequence
  PPP1R3A__Homo_sapiens__NP_002702
auggagcccagcgaggugcccagccagaucagcaaggacaacuuccuggaggugcccaaccugagcgacagccugugcgaggacgaggaggugaccuuccagcccggcuucagcccccagcccagcagaagaggcagcgacagcagcgaggacaucuaccuggacacccccagcagcggcaccagaagagugagcuucgccgacagcuucggcuucaaccuggugagcgugaaggaguucgacugcugggagcugcccagcgccagcaccaccuucgaccugggcaccgacaucuuccacaccgaggaguacgugcuggccccccuguucgaccugcccagcagcaaggaggaccugaugcagcagcugcagauccagaaggccauccuggagagcaccgagagccugcugggcagcaccagcaucaagggcaucaucagagugcugaacgugagcuucgagaagcugguguacgugagaaugagccuggacgacuggcagacccacuacgacauccuggccgaguacgugcccaacagcugcgacggcgagaccgaccaguucagcuucaagaucgugcuggugccccccuaccagaaggacggcagcaagguggaguucugcaucagauacgagaccagcgugggcaccuucuggagcaacaacaacggcaccaacuacaccuucaucugccagaagaaggagcaggagcccgagcccgugaagcccuggaaggaggugcccaacagacagaucaagggcugccugaaggugaagagcagcaaggaggagagcagcgugaccagcgaggagaacaacuucgagaaccccaagaacaccgacaccuacauccccaccaucaucugcagccacgaggacaaggaggaccuggaggccagcaacagaaacgugaaggacgugaacagagagcacgacgagcacaacgagaaggagcuggagcugaugaucaaccagcaccugaucagaaccagaagcaccgccagcagagacgagagaaacaccuucagcaccgaccccgugaacuuccccaacaaggccgagggccuggagaagaagcagauccacggcgagaucugcaccgaccuguuccagagaagccugagccccagcagcagcgccgagagcagcgugaagggcgacuucuacugcaacgagaaguacagcagcggcgacgacugcacccaccagcccagcgaggagaccaccagcaacaugggcgagaucaagcccagccugggcgacaccagcagcgacgagcuggugcagcugcacaccggcagcaaggaggugcuggacgacaacgccaaccccgcccacggcaacggcaccgugcagauccccugccccagcagcgaccagcugauggccggcaaccugaacaagaagcacgagggcggcgccaagaacaucgaggugaaggaccugggcugccugagaagagacuuccacagcgacaccagcgccugccugaaggagagcaccgaggagggcagcagcaaggaggacuacuacggcaacggcaaggacgacgaggagcagagaaucuaccugggcgugaacgagaagcagagaaagaacuuccagaccauccugcacgaccaggagagaaagaugggcaaccccaagaucagcguggccggcaucggcgccagcaacagagaccuggccacccugcugagcgagcacaccgccauccccaccagagccaucaccgccgacgugagccacagccccagaaccaaccugagcugggaggaggccgugcugacccccgagcaccaccaccugaccagcgagggcagcgcccugggcggcaucaccggccaggugugcagcagcagaaccggcaacgugcugagaaacgacuaccuguuccagguggaggagaagagcggcggcaucaacagcgaggaccaggacaacagcccccagcacaagcagagcuggaacgugcuggagagccagggcaagagcagagagaacaagaccaacaucaccgagcacaucaagggccagaccgacugcgaggacguguggggcaagagagacaacaccagaagccugaaggccaccaccgaggagcuguucaccugccaggagaccgugugcugcgagcugagcagccuggccgaccacggcaucaccgagaaggccgaggccggcaccgccuacaucaucaagaccaccagcgagagcacccccgagagcaugagcgccagagagaaggccaucaucgccaagcugccccaggagaccgccagaagcgacagacccaucgaggugaaggagaccgccuucgacccccacgagggcagaaacgacgacagccacuacacccugugccagagagacaccgugggcgugaucuacgacaacgacuucgagaaggagagcagacugggcaucugcaacgugagaguggacgagauggagaaggaggagaccaugagcauguacaaccccagaaagacccacgacagagagaagugcggcaccggcaacaucaccagcguggaggagagcagcugggugaucaccgaguaccagaaggccaccagcaagcuggaccugcagcugggcaugcugcccaccgacaagaccguguucagcgagaacagagaccugagacaggugcaggagcugagcaagaagaccgacagcgacgccaucgugcacagcgccuucaacagcgacaccaacagagccccccagaacagcagccccuucagcaagcaccacaccgagaucagcgugagcaccaacgagcaggccaucgccguggagaacgccgugaccaccauggccagccagcccaucagcaccaagagcgagaacaucugcaacagcaccagagagauccagggcaucgagaagcaccccuaccccgagagcaagcccgaggaggugagcagaagcagcggcaucgugaccagcggcagcagaaaggagagaugcaucggccagaucuuccagaccgaggaguacagcguggagaagagccugggccccaugauccugaucaacaagccccuggagaacauggaggaggccagacacgagaacgagggccuggugagcagcggccagagccuguacaccagcggcgagaaggagagcgacagcagcgccagcaccagccugcccguggaggagagccaggcccagggcaacgagagccuguucagcaaguacaccaacagcaagauccccuacuuccugcuguuccugaucuuccugaucaccguguaccacuacgaccugaugaucggccugaccuucuacgugcugagccugagcuggcugagcugggaggagggcagacagaaggagagcgugaagaagaaguaa

SEQ ID NO: 21897 - RNA, 858 nt, Artificial Sequence
  PPP1R3B__Homo_sapiens__NP_078883
augauggccguggacaucgaguacagauacaacugcauggcccccagccugagacaggagagauucgccuucaagaucagccccaagcccagcaagccccugagacccugcauccagcugagcagcaagaacgaggccagcggcaugguggcccccgccgugcaggagaagaaggugaagaagagagugagcuucgccgacaaccagggccuggcccugaccauggugaagguguucagcgaguucgacgacccccuggacaugcccuucaacaucaccgagcugcuggacaacaucgugagccugaccaccgccgagagcgagagcuucgugcuggacuucagccagcccagcgccgacuaccuggacuucagaaacagacugcaggccgaccacgugugccuggagaacugcgugcugaaggacaaggccaucgccggcaccgugaaggugcagaaccuggccuucgagaagaccgugaagaucagaaugaccuucgacaccuggaagagcuacaccgacuuccccugccaguacgugaaggacaccuacgccggcagcgacagagacaccuucagcuucgacaucagccugcccgagaagauccagagcuacgagagaauggaguucgccguguacuacgagugcaacggccagaccuacugggacagcaacagaggcaagaacuacagaaucaucagagccgagcugaagagcacccagggcaugaccaagccccacagcggccccgaccugggcaucagcuucgaccaguucggcagccccagaugcagcuacggccuguuccccgaguggcccagcuaccugggcuacgagaagcugggccccuacuacuaa

SEQ ID NO: 21898 - RNA, 954 nt, Artificial Sequence
  PPP1R3C__Homo_sapiens__NP_005389
augagcugcaccagaaugauccaggugcuggaccccagaccccugaccagcagcgugaugcccguggacguggccaugagacugugccuggcccacagcccccccgugaagagcuuccugggccccuacgacgaguuccagagaagacacuucgugaacaagcugaagccccugaagagcugccugaacaucaagcacaaggccaagagccagaacgacuggaagugcagccacaaccaggccaagaagagagugguguucgccgacagcaagggccugagccugaccgccauccacguguucagcgaccugcccgaggagcccgccugggaccugcaguucgaccugcuggaccugaacgacaucagcagcgcccugaagcaccacgaggagaagaaccugauccuggacuucccccagcccagcaccgacuaccugagcuucagaagccacuuccagaagaacuucgugugccuggagaacugcagccugcaggagagaaccgugaccggcaccgugaaggugaagaacgugagcuucgagaagaaggugcagaucagaaucaccuucgacagcuggaagaacuacaccgacguggacugcguguacaugaagaacguguacggcggcaccgacagcgacaccuucagcuucgccaucgaccugccccccgugauccccaccgagcagaagaucgaguucugcaucagcuaccacgccaacggccagguguucugggacaacaacgacggccagaacuacagaaucgugcacgugcaguggaagcccgacggcgugcagacccagauggccccccaggacugcgccuuccaccagaccagccccaagaccgagcuggagagcaccaucuucggcagccccagacuggccagcggccuguuccccgaguggcagagcuggggcagaauggagaaccuggccagcuacagauaa

SEQ ID NO: 21899 - RNA, 687 nt, Artificial Sequence
  PPP1R42__Homo_sapiens__NP_001013648
auggugagacugacccuggaccugaucgccagaaacagcaaccugaagcccagaaaggaggagaccaucagccagugccugaagaagaucacccacaucaacuucagcgacaagaacaucgacgccaucgaggaccugagccugugcaagaaccugagcgugcuguaccuguacgacaacugcaucagccagaucaccaaccugaacuacgccaccaaccugacccaccuguaccugcagaacaacugcaucagcugcaucgagaaccugagaagccugaagaagcuggagaagcuguaccugggcggcaacuacaucgccgugaucgagggccuggagggccugggcgagcugagagagcugcacguggagaaccagagacugccccugggcgagaagcugcuguucgaccccagaacccugcacagccuggccaagagccugugcauccugaacaucagcaacaacaacaucgacgacaucaccgaccuggagcugcuggagaaccugaaccagcugaucgccguggacaaccagcugcugcacgugaaggaccuggaguuccugcugaacaagcugaugaagcuguggaagaucgaccugaacggcaaccccgugugccugaagcccaaguacagagacagacugauccuggugagcaagagccugggcaccuaccuguacuaa

SEQ ID NO: 21900 - RNA, 954 nt, Artificial Sequence
  PPP1R7__Homo_sapiens__NP_001269338
auggccgccgagagaggcgccggccagcagcagagccaggagaugauggaggaggagcacgagcugcccguggacauggagaccaucaaccuggacagagacgccgaggacguggaccugaaccacuacagaaucggcaagaucgagggcuucgaggugcugaagaaggugaagacccugugccugagacagaaccugaucaagugcaucgagaaccuggaggagcugcagagccugagagagcuggaccuguacgacaaccagaucaagaagaucgagaaccuggaggcccugaccgagcuggagauccuggacaucagcuucaaccugcugagaaacaucgagggcguggacaagcugaccagacugaagaagcuguuccuggugaacaacaagaucagcaagaucgagaaccugagcaaccugcaccagcugcagaugcuggagcugggcagcaacagaaucagagccaucgagaacaucgacacccugaccaaccuggagagccuguuccugggcaagaacaagaucaccaagcugcagaaccuggacgcccugaccaaccugaccgugcugagcaugcagagcaacagacugaccaagaucgagggccugcagaaccuggugaaccugagagagcuguaccugagccacaacggcaucgaggugaucgagggccuggagaacaacaacaagcugaccaugcuggacaucgccagcaacagaaucaagaagaucgagaacaucagccaccugaccgagcugcaggaguucuggaugaacgacaaccugcuggagagcuggagcgaccuggacgagcugaagggcgccagaagccuggagaccguguaccuggagagaaacccccugcagaaggacccccaguacagaagaaaggugaugcuggcccugcccagcgugagacagaucgacgccaccuucgugagauucuaa

SEQ ID NO: 21901 - RNA, 4125 nt, Artificial Sequence
  PPP1R9A__Homo_sapiens__NP_001159632
augcugaagaccgagagcagcggcgagagaaccacccugagaagcgccagcccccacagaaacgccuacagaaccgaguuccaggcccugaagagcaccuucgacaagcccaagagcgacggcgagcagaagaccaaggagggcgagggcagccagcagagcagaggcagaaaguacggcagcaacgugaacagaaucaagaaccuguucaugcagaugggcauggagcccaacgagaacgccgccgugaucgccaagaccagaggcaagggcggccacagcagcccccagagaagaaugaagcccaaggaguuccuggagaagaccgacggcagcguggugaagcuggagagcagcgugagcgagagaaucagcagauucgacaccauguacgacggccccagcuacagcaaguucaccgagaccagaaagauguucgagagaagcgugcacgagagcggccagaacaacagauacagccccaagaaggagaaggccggcggcagcgagccccaggacgaguggggcggcagcaagagcaacagaggcagcaccgacagccuggacagccugagcagcagaaccgaggccgugagccccaccgugagccagcugagcgccguguucgagaacaccgacagccccagcgccaucaucagcgagaaggccgagaacaacgaguacagcgugaccggccacuacccccugaaccugcccagcgugaccgugaccaaccuggacaccuucggccaccugaaggacagcaacagcuggccccccagcaacaagagaggcguggacaccgaggacgcccacaagagcaacgccacccccgugcccgagguggccagcaagagcaccagccuggccagcauccccggcgaggagauccagcagagcaaggagcccgaggacagcaccagcaaccagcagacccccgacagcaucgacaaggacggccccgaggagcccugcgccgagagcaaggccaugcccaagagcgagauccccagcccccagagccagcugcuggaggacgccgaggccaaccuggugggcagagaggccgccaagcagcagagaaaggagcuggccggcggcgacuucaccagccccgacgccagcgccagcagcugcggcaaggaggugcccgaggacagcaacaacuucgacggcagccacguguacaugcacagcgacuacaacguguacagagugagaagcagauacaacagcgacuggggcgagaccggcaccgagcaggacgaggaggaggacagcgacgagaacagcuacuaccagcccgacauggaguacagcgagaucgugggccugcccgaggaggaggagauccccgccaacagaaagaucaaguucagcagcgcccccaucaagguguucaacaccuacagcaacgaggacuacgacagaagaaacgacgagguggaccccguggccgccagcgccgaguacgagcuggagaagagaguggagaagcuggagcuguuccccguggagcuggagaaggacgaggacggccugggcaucagcaucaucggcaugggcgugggcgccgacgccggccuggagaagcugggcaucuucgugaagaccgugaccgagggcggcgccgcccagagagacggcagaauccaggugaacgaccagaucguggagguggacggcaucagccuggugggcgugacccagaacuucgccgccaccgugcugagaaacaccaagggcaacgugagauucgugaucggcagagagaagcccggccaggugagcgagguggcccagcugaucagccagacccuggagcaggagagaagacagagagagcugcuggagcagcacuacgcccaguacgacgccgacgacgacgagaacaccguggccgagcugcagggcaugagcggcaacugcaacaacaacaacaacuacuuccugaagaccggcgaguacgccaccgacgaggaggaggacgaggugggccccgugcugcccggcagcgacauggccaucgagguguucgagcugcccgagaacgaggacauguucagccccagcgagcuggacaccagcaagcugagccacaaguucaaggagcugcagaucaagcacgccgugaccgaggccgagauccagaagcugaagaccaagcugcaggccgccgagaacgagaaggugagaugggagcuggagaagacccagcugcagcagaacaucgaggagaacaaggagagaaugcugaagcuggagagcuacuggaucgaggcccagacccugugccacaccgugaacgagcaccugaaggagacccagagccaguaccaggcccuggagaagaaguacaacaaggccaagaagcugaucaaggacuuccagcagaaggagcuggacuucaucaagagacaggaggccgagagaaagaagaucgaggaccuggagaaggcccaccugguggaggugcagggccugcaggugagaaucagagaccuggaggccgagguguucagacugcugaagcagaacggcacccaggugaacaacaacaacaacaucuucgagagaagaaccagccugggcgaggugagcaagggcgacaccauggagaaccuggacggcaagcagaccagcugccaggacggccugagccaggaccugaacgaggccgugcccgagaccgagagacuggacagcaaggcccugaagaccagagcccagcugagcgugaagaacagaagacagagacccagcagaaccagacuguacgacagcgugagcagcaccgacggcgaggacagccuggagagaaagcccagcaacagcuucuacaaccacaugcacaucaccaagcugcugccccccaagggccugagaaccagcagccccgagagcgacagcggcgugcccccccugacccccguggacagcaacgugcccuucagcagcgaccacaucgccgaguuccaggaggagccccuggaccccgagaugggcccccugagcagcauguggggcgacaccagccuguucagcaccagcaagagcgaccacgacguggaggagagccccugccaccaccagaccaccaacaagaagauccugagagagaaggacgacgccaaggaccccaagagccugagagccagcagcagccuggccgugcagggcggcaagaucaagagaaaguucguggaccugggcgccccccugagaagaaacagcagcaagggcaagaaguggaaggagaaggagaaggaggccagcagauucagcgccggcagcagaaucuucagaggcagacuggagaacuggacccccaagcccugcagcaccgcccagaccagcaccagaagccccugcaugcccuucagcugguucaacgacagcagaaagggcagcuacagcuucagaaaccugcccgcccccaccagcagccugcagcccagccccgagacccugaucagcgacaagaagggcagcaagguggagaacaccuggaucaccaaggccaacaagagaaaccccaaccccagcagcagcagcaucuucggcagacacagccagcugaugagcgugguguggauccaggagaccaacaacuucaccuucaacgacgacuucagccccagcagcaccagcagcgccgaccugagcggccugggcgccgagcccaagacccccggccugagccagagccuggcccugagcagcgacgagauccuggacgacggccagagccccaagcacagccagugccagaacagagccgugcaggaguggagcgugcagcaggugagccacuggcugaugagccugaaccuggagcaguacgugagcgaguucagcgcccagaacaucaccggcgagcagcugcugcagcuggacggcaacaagcugaaggcccugggcaugaccgccagccaggacagagccguggugaagaagaagcugaaggagaugaagaugagccuggagaaggccagaaaggcccaggagaagauggagaagcagagagagaagcugagaagaaaggagcaggagcagaugcagagaaagagcaagaagaccgagaagaugaccagcaccaccgccgagggcgccggcgagcaguaa

SEQ ID NO: 21902 - RNA, 930 nt, Artificial Sequence
  PPP2CA__Homo_sapiens__NP_002706
auggacgagaagguguucaccaaggagcuggaccaguggaucgagcagcugaacgagugcaagcagcugagcgagagccaggugaagagccugugcgagaaggccaaggagauccugaccaaggagagcaacgugcaggaggugagaugccccgugaccgugugcggcgacgugcacggccaguuccacgaccugauggagcuguucagaaucggcggcaagagccccgacaccaacuaccuguucaugggcgacuacguggacagaggcuacuacagcguggagaccgugacccugcugguggcccugaaggugagauacagagagagaaucaccauccugagaggcaaccacgagagcagacagaucacccagguguacggcuucuacgacgagugccugagaaaguacggcaacgccaacguguggaaguacuucaccgaccuguucgacuaccugccccugaccgcccugguggacggccagaucuucugccugcacggcggccugagccccagcaucgacacccuggaccacaucagagcccuggacagacugcaggaggugccccacgagggccccaugugcgaccugcuguggagcgaccccgacgacagaggcggcuggggcaucagccccagaggcgccggcuacaccuucggccaggacaucagcgagaccuucaaccacgccaacggccugacccuggugagcagagcccaccagcuggugauggagggcuacaacuggugccacgacagaaacguggugaccaucuucagcgcccccaacuacugcuacagaugcggcaaccaggccgccaucauggagcuggacgacacccugaaguacagcuuccugcaguucgaccccgcccccagaagaggcgagccccacgugaccagaagaacccccgacuacuuccuguaa

SEQ ID NO: 21903 - RNA, 930 nt, Artificial Sequence
  PPP2CB__Homo_sapiens__NP_001009552
auggacgacaaggccuucaccaaggagcuggaccaguggguggagcagcugaacgagugcaagcagcugaacgagaaccaggugagaacccugugcgagaaggccaaggagauccugaccaaggagagcaacgugcaggaggugagaugccccgugaccgugugcggcgacgugcacggccaguuccacgaccugauggagcuguucagaaucggcggcaagagccccgacaccaacuaccuguucaugggcgacuacguggacagaggcuacuacagcguggagaccgugacccugcugguggcccugaaggugagauaccccgagagaaucaccauccugagaggcaaccacgagagcagacagaucacccagguguacggcuucuacgacgagugccugagaaaguacggcaacgccaacguguggaaguacuucaccgaccuguucgacuaccugccccugaccgcccugguggacggccagaucuucugccugcacggcggccugagccccagcaucgacacccuggaccacaucagagcccuggacagacugcaggaggugccccacgagggccccaugugcgaccugcuguggagcgaccccgacgacagaggcggcuggggcaucagccccagaggcgccggcuacaccuucggccaggacaucagcgagaccuucaaccacgccaacggccugacccuggugagcagagcccaccagcuggugauggagggcuacaacuggugccacgacagaaacguggugaccaucuucagcgcccccaacuacugcuacagaugcggcaaccaggccgccaucauggagcuggacgacacccugaaguacagcuuccugcaguucgaccccgcccccagaagaggcgagccccacgugaccagaagaacccccgacuacuuccuguaa

SEQ ID NO: 21904 - RNA, 1770 nt, Artificial Sequence
  PPP2R1A__Homo_sapiens__NP_055040
auggccgccgccgacggcgacgacagccuguaccccaucgccgugcugaucgacgagcugagaaacgaggacgugcagcugagacugaacagcaucaagaagcugagcaccaucgcccuggcccugggcguggagagaaccagaagcgagcugcugcccuuccugaccgacaccaucuacgacgaggacgaggugcugcuggcccuggccgagcagcugggcaccuucaccacccuggugggcggccccgaguacgugcacugccugcugcccccccuggagagccuggccaccguggaggagaccguggugagagacaaggccguggagagccugagagccaucagccacgagcacagccccagcgaccuggaggcccacuucgugccccuggugaagagacuggccggcggcgacugguucaccagcagaaccagcgccugcggccuguucagcgugugcuaccccagagugagcagcgccgugaaggccgagcugagacaguacuucagaaaccugugcagcgacgacacccccauggugagaagagccgccgccagcaagcugggcgaguucgccaaggugcuggagcuggacaacgugaagagcgagaucauccccauguucagcaaccuggccagcgacgagcaggacagcgugagacugcuggccguggaggccugcgugaacaucgcccagcugcugccccaggaggaccuggaggcccuggugaugcccacccugagacaggccgccgaggacaagagcuggagagugagauacaugguggccgacaaguucaccgagcugcagaaggccgugggccccgagaucaccaagaccgaccuggugcccgccuuccagaaccugaugaaggacugcgaggccgaggugagagccgccgccagccacaaggugaaggaguucugcgagaaccugagcgccgacugcagagagaacgugaucaugagccagauccugcccugcaucaaggagcuggugagcgacgccaaccagcacgugaagagcgcccuggccagcgugaucaugggccugagccccauccugggcaaggacaacaccaucgagcaccugcugccccuguuccuggcccagcugaaggacgagugccccgaggugagacugaacaucaucagcaaccuggacugcgugaacgaggugaucggcaucagacagcugagccagagccugcugcccgccaucguggagcuggccgaggacgccaaguggagagugagacuggccaucaucgaguacaugccccugcuggccggccagcugggcguggaguucuucgacgagaagcugaacagccugugcauggccuggcugguggaccacguguacgccaucagagaggccgccaccagcaaccugaagaagcugguggagaaguucggcaaggagugggcccacgccaccaucauccccaaggugcuggccaugagcggcgaccccaacuaccugcacagaaugaccacccuguucugcaucaacgugcugagcgaggugugcggccaggacaucaccaccaagcacaugcugcccaccgugcugagaauggccggcgaccccguggccaacgugagauucaacguggccaagagccugcagaagaucggccccauccuggacaacagcacccugcagagcgaggugaagcccauccuggagaagcugacccaggaccaggacguggacgugaaguacuucgcccaggaggcccugaccgugcugagccuggccuaa

SEQ ID NO: 21905 - RNA, 1671 nt, Artificial Sequence
  PPP2R1B__Homo_sapiens__NP_001171033
auggccggcgccagcgagcugggcaccggccccggcgccgccggcggcgacggcgacgacagccuguaccccaucgccgugcugaucgacgagcugagaaacgaggacgugcagcugagacugaacagcaucaagaagcugagcaccaucgcccuggcccugggcguggagagaaccagaagcgagcugcugcccuuccugaccgacaccaucuacgacgaggacgaggugcugcuggcccuggccgagcagcugggcaacuucaccggccuggugggcggccccgacuucgcccacugccugcugcccccccuggagaaccuggccaccguggaggagaccguggugagagacaaggccguggagagccugagacagaucagccaggagcacacccccguggcccuggaggccuacuucgugccccuggugaagagacuggccagcggcgacugguucaccagcagaaccagcgccugcggccuguucagcgugugcuaccccagagccagcaacgccgugaaggccgagaucagacagcaguucagaagccugugcagcgacgacacccccauggugagaagagccgccgccagcaagcugggcgaguucgccaaggugcuggagcuggacagcgugaagagcgagaucgugccccuguucaccagccuggccagcgacgagcaggacagcgugagacugcuggccguggaggccugcgugagcaucgcccagcugcugagccaggacgaccuggagacccuggugaugcccacccugagacaggccgccgaggacaagagcuggagagugagauacaugguggccgacagauucagcgagcugcagaaggccaugggccccaagaucacccugaacgaccugauccccgccuuccagaaccugcugaaggacugcgaggccgaggugagagccgccgccgcccacaaggugaaggagcugggcgagaaccugcccaucgaggacagagagaccaucaucaugaaccagauccugcccuacaucaagugccccgacgugagacugaacaucaucagcaaccuggacugcgugaacgaggugaucggcaucagacagcugagccagagccugcugcccgccaucguggagcuggccgaggacgccaaguggagagugagacuggccaucaucgaguacaugccccugcuggccggccagcugggcguggaguucuucgacgagaagcugaacagccugugcauggccuggcugguggaccacguguacgccaucagagaggccgccaccaacaaccugaugaagcuggugcagaaguucggcaccgagugggcccagaacaccaucgugcccaaggugcuggugauggccaacgaccccaacuaccugcacagaaugaccacccuguucugcaucaacgcccugagcgaggccugcggccaggagaucaccaccaagcagaugcugcccaucgugcugaagauggccggcgaccagguggccaacgugagauucaacguggccaagagccugcagaagaucggccccauccuggacaccaacgcccugcagggcgaggugaagcccgugcugcagaagcugggccaggacgaggacauggacgugaaguacuucgcccaggaggccaucagcgugcuggcccuggccuaa

SEQ ID NO: 21906 - RNA, 1374 nt, Artificial Sequence
  PPP2R2A__Homo_sapiens__NP_001171062
auguuccccaaguucagccugagaagcauguuccacggcgccggcggcggcaacgacauccaguggugcuucagccaggugaagggcgccguggacgacgacguggccgaggccgacaucaucagcaccguggaguucaaccacagcggcgagcugcuggccaccggcgacaagggcggcagaguggugaucuuccagcaggagcaggagaacaagauccagagccacagcagaggcgaguacaacguguacagcaccuuccagagccacgagcccgaguucgacuaccugaagagccuggagaucgaggagaagaucaacaagaucagauggcugccccagaagaacgccgcccaguuccugcugagcaccaacgacaagaccaucaagcuguggaagaucagcgagagagacaagagacccgagggcuacaaccugaaggaggaggacggcagauacagagaccccaccaccgugaccacccugagagugcccguguucagacccauggaccugaugguggaggccagccccagaagaaucuucgccaacgcccacaccuaccacaucaacagcaucagcaucaacagcgacuacgagaccuaccugagcgccgacgaccugagaaucaaccuguggcaccuggagaucaccgacagaagcuucaacaucguggacaucaagcccgccaacauggaggagcugaccgaggugaucaccgccgccgaguuccaccccaacagcugcaacaccuucguguacagcagcagcaagggcaccaucagacugugcgacaugagagccagcgcccugugcgacagacacagcaagcuguucgaggagcccgaggaccccagcaacagaagcuucuucagcgagaucaucagcagcaucagcgacgugaaguucagccacagcggcagauacaugaugaccagagacuaccugagcgugaagaucugggaccugaacauggagaacagacccguggagaccuaccaggugcacgaguaccugagaagcaagcugugcagccuguacgagaacgacugcaucuucgacaaguucgagugcugcuggaacggcagcgacagcguggugaugaccggcagcuacaacaacuucuucagaauguucgacagaaacaccaagagagacaucacccuggaggccagcagagagaacaacaagcccagaaccgugcugaagcccagaaaggugugcgccagcggcaagagaaagaaggacgagaucagcguggacagccuggacuucaacaagaagauccugcacaccgccuggcaccccaaggagaacaucaucgccguggccaccaccaacaaccuguacaucuuccaggacaaggugaacuaa

SEQ ID NO: 21907 - RNA, 1350 nt, Artificial Sequence
  PPP2R2B__Homo_sapiens__NP_001258828
augauccccggcaucggcacccugacccaggacacccuguggugcuucagccaggugaagggcaccaucgagaucggcaccaccgaggccgacaucaucagcaccguggaguucaaccacaccggcgagcugcuggccaccggcgacaagggcggcagaguggugaucuuccagagagagcaggagagcaagaaccaggugcacagaagaggcgaguacaacguguacagcaccuuccagagccacgagcccgaguucgacuaccugaagagccuggagaucgaggagaagaucaacaagaucagauggcugccccagcagaacgccgccuacuuccugcugagcaccaacgacaagaccgugaagcuguggaaggugagcgagagagacaagagacccgagggcuacaaccugaaggacgaggagggcagacugagagaccccgccaccaucaccacccugagagugcccgugcugagacccauggaccugaugguggaggccacccccagaagaguguucgccaacgcccacaccuaccacaucaacagcaucagcgugaacagcgacuacgagaccuacaugagcgccgacgaccugagaaucaaccuguggaacuucgagaucaccaaccagagcuucaacaucguggacaucaagcccgccaacauggaggagcugaccgaggugaucaccgccgccgaguuccacccccaccacugcaacaccuucguguacagcagcagcaagggcaccaucagacugugcgacaugagagccagcgcccugugcgacagacacaccaaguucuucgaggagcccgaggaccccagcaacagaagcuucuucagcgagaucaucagcagcaucagcgacgugaaguucagccacagcggcagauacaucaugaccagagacuaccugaccgugaaggugugggaccugaacauggagaacagacccaucgagaccuaccaggugcacgacuaccugagaagcaagcugugcagccuguacgagaacgacugcaucuucgacaaguucgagugcguguggaacggcagcgacagcgugaucaugaccggcagcuacaacaacuucuucagaauguucgacagaaacaccaagagagacgugacccuggaggccagcagagagaacagcaagcccagagccauccugaagcccagaaaggugugcgugggcggcaagagaagaaaggacgagaucagcguggacagccuggacuucagcaagaagauccugcacaccgccuggcaccccagcgagaacaucaucgccguggccgccaccaacaaccuguacaucuuccaggacaaggugaacuaa

SEQ ID NO: 21908 - RNA, 1323 nt, Artificial Sequence
  PPP2R2C__Homo_sapiens__NP_001193924
augagagaggccgacacccugagacccccccagcugauggaggugagcgccgacaucaucagcaccguggaguucaaccacaccggcgagcugcuggccaccggcgacaagggcggcagaguggugaucuuccagagagagcccgagagcaagaacgccccccacagccagggcgaguacgacguguacagcaccuuccagagccacgagcccgaguucgacuaccugaagagccuggagaucgaggagaagaucaacaagaucaaguggcugccccagcagaacgccgcccacagccugcugagcaccaacgacaagaccaucaagcuguggaagaucaccgagagagacaagagacccgagggcuacaaccugaaggacgaggagggcaagcugaaggaccugagcaccgugaccagccugcaggugcccgugcugaagcccauggaccugaugguggaggugagccccagaagaaucuucgccaacggccacaccuaccacaucaacagcaucagcgugaacagcgacugcgagaccuacaugagcgccgacgaccugagaaucaaccuguggcaccuggccaucaccgacagaagcuucaacaucguggacaucaagcccgccaacauggaggaccugaccgaggugaucaccgccagcgaguuccacccccaccacugcaaccuguucguguacagcagcagcaagggcagccugagacugugcgacaugagagccgccgcccugugcgacaagcacagcaagcuguucgaggagcccgaggaccccagcaacagaagcuucuucagcgagaucaucagcagcgugagcgacgugaaguucagccacagcggcagauacaugcugaccagagacuaccugaccgugaaggugugggaccugaacauggaggccagacccaucgagaccuaccaggugcacgacuaccugagaagcaagcugugcagccuguacgagaacgacugcaucuucgacaaguucgagugcgccuggaacggcagcgacagcgugaucaugaccggcgccuacaacaacuucuucagaauguucgacagaaacaccaagagagacgugacccuggaggccagcagagagagcagcaagcccagagccgugcugaagcccagaagagugugcgugggcggcaagagaagaagagacgacaucagcguggacagccuggacuucaccaagaagauccugcacaccgccuggcaccccgccgagaacaucaucgccaucgccgccaccaacaaccuguacaucuuccaggacaaggugaacagcgacaugcacuaa

SEQ ID NO: 21909 - RNA, 1245 nt, Artificial Sequence
  PPP2R3A__Homo_sapiens__NP_001177376
auggacaucgaggagcagaaggccgacaucuacgagaugggcaagaucgccaaggugugcggcugcccccuguacuggaaggcccccauguucagagccgccggcggcgagaagaccggcuucgugaccgcccagagcuucaucgccauguggagaaagcugcugaacaaccaccacgacgacgccagcaaguucaucugccugcuggccaagcccaacugcagcagccuggagcaggaggacuucaucccccugcugcaggacgugguggacacccaccccggccugaccuuccugaaggacgcccccgaguuccacagcagauacaucaccaccgugauccagagaaucuucuacaccgugaacagaagcuggagcggcaagaucaccagcaccgagaucagaaagagcaacuuccugcagacccuggcccugcuggaggaggaggaggacaucaaccagaucaccgacuacuucagcuacgagcacuucuacgugaucuacugcaaguucugggagcuggacaccgaccacgaccuguacaucagccaggccgaccugagcagauacaacgaccaggccagcagcagcagaaucaucgagagaaucuucagcggcgccgugaccagaggcaagaccauccagaaggagggcagaaugagcuacgccgacuucgugugguuccugaucagcgaggaggacaagagaaaccccaccagcaucgaguacugguucagaugcauggacguggacggcgacggcgugcugagcauguacgagcuggaguacuucuacgaggagcagugcgagagaauggaggccaugggcaucgagccccugcccuuccacgaccugcugugccagaugcuggaccuggugaagcccgccguggacggcaagaucacccugagagaccugaagagaugcagaauggcccacaucuucuacgacaccuucuucaaccuggagaaguaccuggaccacgagcagagagaccccuucgccgugcagaaggacguggagaacgacggccccgagcccagcgacugggacagauucgccgccgaggaguacgagacccugguggccgaggagagcgcccaggcccaguuccaggagggcuucgaggacuacgagaccgacgagcccgccagccccagcgaguucggcaacaagagcaacaagauccugagcgccagccugcccgagaagugcggcaagcugcagagcguggacgaggaguaa

SEQ ID NO: 21910 - RNA, 1728 nt, Artificial Sequence
  PPP2R3B__Homo_sapiens__NP_037371
augccccccggcaaggugcugcagcccgugcugaagaugaagguggacgagcuguuccuguacuggcugagcgaggccagcacccagagaaugcugcaggacugccugagaagaaucaaggcccccggcagagaccagcccacccccggcgacggcgagcagcccggcgccuggcccaccgccccccuggccgcccccagacccagcggccuggagccccccggcacccccggccccggccccgcccugccccugggcgccgccagcagccccagaaacgccccccacgugagaggcaccagaagaagcgccggcaccagaguggugcagaccagaaaggaggagccccugccccccgccaccagccagagcauccccaccuucuacuuccccagaggcagaccccaggacagcgugaacguggacgccgugaucagcaagaucgagagcaccuucgccagauucccccacgagagagccaccauggacgacaugggccugguggccaaggccugcggcugcccccuguacuggaagggcccccuguucuacggcgccggcggcgagagaaccggcagcgugagcgugcacaaguucguggccauguggagaaagauccugcagaacugccacgacgacgccgccaaguucgugcaccugcugaugagccccggcugcaacuaccuggugcaggaggacuucgugcccuuccugcaggacguggugaacacccaccccggccugagcuuccugaaggaggccagcgaguuccacagcagauacaucaccaccgugauccagagaaucuucuacgccgugaacagaagcuggagcggcagaaucaccugcgccgagcugagaagaagcagcuuccugcagaacguggcccugcuggaggaggaggccgacaucaaccagcugaccgaguucuucagcuacgagcacuucuacgugaucuacugcaaguucugggagcuggacaccgaccacgaccugcugaucgacgccgacgaccuggccagacacaacgaccacgcccugagcaccaagaugaucgacagaaucuucagcggcgccgugaccagaggcagaaaggugcagaaggagggcaagaucagcuacgccgacuucgugugguuccugaucagcgaggaggacaagaagacccccaccagcaucgaguacugguucagaugcauggaccuggacggcgacggcgcccugagcauguucgagcuggaguacuucuacgaggagcagugcagaagacuggacagcauggccaucgaggcccugcccuuccaggacugccugugccagaugcuggaccuggugaagcccagaaccgagggcaagaucacccugcaggaccugaagagaugcaagcuggccaacguguucuucgacaccuucuucaacaucgagaaguaccuggaccacgagcagaaggagcagaucagccugcugagagacggcgacagcggcggccccgagcugagcgacugggagaaguacgccgccgaggaguacgacauccugguggccgaggagaccgccggcgagcccugggaggacggcuucgaggccgagcugagccccguggagcagaagcugagcgcccugagaagcccccuggcccagagacccuucuucgaggcccccagcccccugggcgccguggaccuguacgaguacgccugcggcgacgaggaccuggagccccuguaa

SEQ ID NO: 21911 - RNA, 867 nt, Artificial Sequence
  PPP2R4__Homo_sapiens__NP_001180326
augggcaaguggaagagaagccaggccuacgccgacuacaucggcuucauccugacccugaacgagggcgugaagggcaagaagcugaccuucgaguacagagugagcgaggccaucgagaagcugguggcccugcugaacacccuggacagauggaucgacgagaccccccccguggaccagcccagcagauucggcaacaaggccuacagaaccugguacgccaagcuggacgaggaggccgagaaccugguggccaccguggugcccacccaccuggccgccgccgugcccgagguggccguguaccugaaggagagcgugggcaacagcaccagaaucgacuacggcaccggccacgaggccgccuucgccgccuuccugugcugccugugcaagaucggcgugcugagaguggacgaccagaucgccaucguguucaagguguucaacagauaccuggaggugaugagaaagcugcagaagaccuacagaauggagcccgccggcagccagggcguguggggccuggacgacuuccaguuccugcccuucaucuggggcagcagccagcugaucgaccaccccuaccuggagcccagacacuucguggacgagaaggccgugaacgagaaccacaaggacuacauguuccuggagugcauccuguucaucaccgagaugaagaccggccccuucgccgagcacagcaaccagcuguggaacaucagcgccgugcccagcuggagcaaggugaaccagggccugaucagaauguacaaggccgagugccuggagaaguuccccgugauccagcacuucaaguucggcagccugcugcccauccaccccgugaccagcggcuaa

SEQ ID NO: 21912 - RNA, 1290 nt, Artificial Sequence
  PPP2R5A__Homo_sapiens__NP_001186685
augaucaugaacgccaccagcaacgagcagcaggagcuguucugccagaagcugcagcagugcugcauccuguucgacuucauggacagcgugagcgaccugaagagcaaggagaucaagagagccacccugaacgagcugguggaguacgugagcaccaacagaggcgugaucguggagagcgccuacagcgacaucgugaagaugaucagcgccaacaucuucagaacccugccccccagcgacaaccccgacuucgaccccgaggaggacgagcccacccuggaggccagcuggccccacauccagcugguguacgaguucuuccugagauuccuggagagccccgacuuccagcccagcaucgccaagagauacaucgaccagaaguucgugcagcagcugcuggagcuguucgacagcgaggaccccagagagagagacuuccugaagaccgugcugcacagaaucuacggcaaguuccugggccugagagccuucaucagaaagcagaucaacaacaucuuccugagauucaucuacgagaccgagcacuucaacggcguggccgagcugcuggagauccugggcagcaucaucaacggcuucgcccugccccugaaggccgagcacaagcaguuccugaugaaggugcugauccccaugcacaccgccaagggccuggcccuguuccacgcccagcuggccuacugcguggugcaguuccuggagaaggacaccacccugaccgagcccgugaucagaggccugcugaaguucuggcccaagaccugcagccagaaggaggugauguuccugggcgagaucgaggagauccuggacgugaucgagcccacccaguucaagaagaucgaggagccccuguucaagcagaucagcaagugcgugagcagcagccacuuccagguggccgagagagcccuguacuucuggaacaacgaguacauccugagccugaucgaggagaacaucgacaagauccugcccaucauguucgccagccuguacaagaucagcaaggagcacuggaaccccaccaucguggcccugguguacaacgugcugaagacccugauggagaugaacggcaagcuguucgacgaccugaccagcagcuacaaggccgagagacagagagagaagaagaaggagcuggagagagaggagcuguggaagaagcuggaggagcugaagcugaagaaggcccuggagaagcagaacagcgccuacaacaugcacagcauccugagcaacaccagcgccgaguaa

SEQ ID NO: 21913 - RNA, 1494 nt, Artificial Sequence
  PPP2R5B__Homo_sapiens__NP_006235
auggagaccaagcugccccccgccagcacccccaccagccccagcagccccggccugagccccgugcccccccccgacaagguggacggcuucagcagaagaagccugagaagagccagacccagaagaagccacagcagcagccaguucagauaccagagcaaccagcaggagcugaccccccugccccugcugaaggacgugcccgccagcgagcugcacgagcugcugagcagaaagcuggcccagugcggcgugauguucgacuuccuggacugcguggccgaccugaagggcaaggaggugaagagagccgcccugaacgagcugguggagugcgugggcagcaccagaggcgugcugaucgagcccguguaccccgacaucaucagaaugaucagcgugaacaucuucagaacccugccccccagcgagaaccccgaguucgaccccgaggaggacgagcccaaccuggagcccagcuggccccaccugcagcugguguacgaguucuuccugagauuccuggagagccccgacuuccagcccagcguggccaagagauacguggaccagaaguucgugcugaugcugcuggagcuguucgacagcgaggaccccagagagagagaguaccugaagaccauccugcacagaguguacggcaaguuccugggccugagagccuacaucagaaagcagugcaaccacaucuuccugagauucaucuacgaguucgagcacuucaacggcguggccgagcugcuggagauccugggcagcaucaucaacggcuucgcccugccccugaagaccgagcacaagcaguuccuggugagagugcugaucccccugcacagcgugaagagccugagcguguuccacgcccagcuggccuacugcguggugcaguuccuggagaaggacgccacccugaccgagcacgugaucagaggccugcugaaguacuggcccaagaccugcacccagaaggaggugauguuccugggcgagauggaggagauccuggacgugaucgagcccagccaguucgugaagauccaggagccccuguucaagcagguggccagaugcgugagcagcccccacuuccagguggccgagagagcccuguacuucuggaacaacgaguacauccugagccugaucgaggacaacugccacaccgugcugcccgccguguucggcacccuguaccaggugagcaaggagcacuggaaccagaccaucgugagccugaucuacaacgugcugaagaccuucauggagaugaacggcaagcuguucgacgagcugaccgccagcuacaagcuggagaagcagcaggagcagcagaaggcccaggagagacaggagcuguggcagggccuggaggagcugagacugagaagacugcagggcacccagggcgccaaggaggccccccugcagagacugaccccccagguggccgccagcggcggccagagcuaa

SEQ ID NO: 21914 - RNA, 1668 nt, Artificial Sequence
  PPP2R5C__Homo_sapiens__NP_001155197
augcccaacaagaacaagaaggagaaggagagccccaaggccggcaagagcggcaagagcagcaaggagggccaggacaccguggagagcgagggcaccagccccgaggagcccagcagccccaaggugccccccccccugcugcccgagcugcuggugcugaucuucggcggccugcagggcagagacgugccccccgccgaccaggagaagcuguucauccagaagcugagacagugcugcgugcuguucgacuucgugagcgacccccugagcgaccugaaguggaaggaggugaagagagccgcccugagcgagaugguggaguacaucacccacaacagaaacgugaucaccgagcccaucuaccccgagguggugcacauguucgccgugaacauguucagaacccugccccccagcagcaaccccaccggcgccgaguucgaccccgaggaggacgagcccacccuggaggccgccuggccccaccugcagcugguguacgaguucuuccugagauuccuggagagccccgacuuccagcccaacaucgccaagaaguacaucgaccagaaguucgugcugcagcugcuggagcuguucgacagcgaggaccccagagagagagacuuccugaagaccacccugcacagaaucuacggcaaguuccugggccugagagccuacaucagaaagcagaucaacaacaucuucuacagauucaucuacgagaccgagcaccacaacggcaucgccgagcugcuggagauccugggcagcaucaucaacggcuucgcccugccccugaaggaggagcacaagaucuuccugcugaaggugcugcugccccugcacaaggugaagagccugagcguguaccacccccagcuggccuacugcguggugcaguuccuggagaaggacagcacccugaccgagcccguggugauggcccugcugaaguacuggcccaagacccacagccccaaggaggugauguuccugaacgagcuggaggagauccuggacgugaucgagcccagcgaguucgugaagaucauggagccccuguucagacagcuggccaagugcgugagcagcccccacuuccagguggccgagagagcccuguacuacuggaacaacgaguacaucaugagccugaucagcgacaacgccgccaagauccugcccaucauguuccccagccuguacagaaacagcaagacccacuggaacaagaccauccacggccugaucuacaacgcccugaagcuguucauggagaugaaccagaagcuguucgacgacugcacccagcaguucaaggccgagaagcugaaggagaagcugaagaugaaggagagagaggaggccugggugaagaucgagaaccuggccaaggccaacccccaguacaccguguacagccaggccagcaccaugagcauccccguggccauggagaccgacggcccccuguucgaggacgugcagaugcugagaaagaccgugaaggacgaggcccaccaggcccagaaggaccccaagaaggacagaccccuggccagaagaaagagcgagcugccccaggacccccacaccaagaaggcccuggaggcccacugcagagccgacgagcuggccagccaggacggcagauaa

SEQ ID NO: 21915 - RNA, 1809 nt, Artificial Sequence
  PPP2R5D__Homo_sapiens__NP_006236
augcccuacaagcugaagaaggagaaggagccccccaagguggccaagugcaccgccaagcccagcagcagcggcaaggacggcggcggcgagaacaccgaggaggcccagccccagccccagccccagccccagccccaggcccagagccagccccccagcagcaacaagagacccagcaacagcacccccccccccacccagcugagcaagaucaaguacagcggcggcccccagaucgugaagaaggagagaagacagagcagcagcagauucaaccugagcaagaacagagagcugcagaagcugcccgcccugaaggacagccccacccaggagagagaggagcuguucauccagaagcugagacagugcugcgugcuguucgacuucgugagcgacccccugagcgaccugaaguucaaggaggugaagagagccggccugaacgagaugguggaguacaucacccacagcagagacguggugaccgaggccaucuaccccgaggccgugaccauguucagcgugaaccuguucagaacccugccccccagcagcaaccccaccggcgccgaguucgaccccgaggaggacgagcccacccuggaggccgccuggccccaccugcagcugguguacgaguucuuccugagauuccuggagagccccgacuuccagcccaacaucgccaagaaguacaucgaccagaaguucgugcuggcccugcuggaccuguucgacagcgaggaccccagagagagagacuuccugaagaccauccugcacagaaucuacggcaaguuccugggccugagagccuacaucagaagacagaucaaccacaucuucuacagauucaucuacgagaccgagcaccacaacggcaucgccgagcugcuggagauccugggcagcaucaucaacggcuucgcccugccccugaaggaggagcacaagauguuccugaucagagugcugcugccccugcacaaggugaagagccugagcguguaccacccccagcuggccuacugcguggugcaguuccuggagaaggagagcagccugaccgagcccgugaucgugggccugcugaaguucuggcccaagacccacagccccaaggaggugauguuccugaacgagcuggaggagauccuggacgugaucgagcccagcgaguucagcaaggugauggagccccuguucagacagcuggccaagugcgugagcagcccccacuuccagguggccgagagagcccuguacuacuggaacaacgaguacaucaugagccugaucagcgacaacgccgccagagugcugcccaucauguuccccgcccuguacagaaacagcaagagccacuggaacaagaccauccacggccugaucuacaacgcccugaagcuguucauggagaugaaccagaagcuguucgacgacugcacccagcaguacaaggccgagaagcagaagggcagauucagaaugaaggagagagaggagauguggcagaagaucgaggagcuggccagacugaacccccaguaccccauguucagagccccccccccccugccccccguguacagcauggagaccgagacccccaccgccgaggacauccagcugcugaagagaaccguggagaccgaggccgugcagaugcugaaggacaucaagaaggagaaggugcugcugagaagaaagagcgagcugccccaggacguguacaccaucaaggcccuggaggcccacaagagagccgaggaguuccugaccgccagccaggaggcccuguaa

SEQ ID NO: 21916 - RNA, 1389 nt, Artificial Sequence
  PPP2R5E__Homo_sapiens__NP_001269109
augagcagcgcccccaccaccccccccagcguggacaagguggacggcuucagcagaaagagcgugagaaaggccagacagaagagaagccagagcagcagccaguucagaagccagggcaagcccaucgagcugaccccccugccccugcugaaggacgugcccagcagcgagcagcccgagcuguuccugaagaagcugcagcagugcugcgugaucuucgacuucauggacacccugagcgaccugaagaugaaggaguacaagagaagcacccugaacgagcugguggacuacaucaccaucagcagaggcugccugaccgagcagaccuaccccgagguggugagaauggugagcugcaacaucuucagaacccugccccccagcgacagcaacgaguucgaccccgaggaggacgagcccacccuggaggccagcuggccccaccugcagcugguguacgaguucuucaucagauuccuggagagccaggaguuccagcccagcaucgccaagaaguacaucgaccagaaguucgugcugcagcugcuggagcuguucgacagcgaggaccccagagagagagacuaccugaagaccgugcugcacagaaucuacggcaaguuccugggccugagagccuucaucagaaagcagaucaacaacaucuuccugagauucguguacgagaccgagcacuucaacggcguggccgagcugcuggagauccugggcagcaucaucaacggcuucgcccugccccugaaggccgagcacaagcaguuccuggugaaggugcugaucccccugcacaccgugagaagccugagccuguuccacgcccagcuggccuacugcaucgugcaguuccuggagaaggaccccagccugaccgagcccgugaucagaggccugaugaaguucuggcccaagaccugcagccagaaggaggugauguuccugggcgagcuggaggagauccuggacgugaucgagcccagccaguucgugaagauccaggagccccuguucaagcagaucgccaagugcgugagcagcccccacuuccagguggccgagagagcccuguacuacuggaacaacgaguacaucaugagccugaucgaggagaacagcaacgugauccugcccaucauguucagcagccuguacagaaucagcaaggagcacuggaaccccgccaucguggcccugguguacaacgugcugaaggccuucauggagaugaacagcaccauguucgacgagcugaccgccaccuacaacgagaagaagaaggagaaggagagagaggagcuguggaagaagcuggaggaccuggagcugaagagaggccugagaagagacggcaucauccccaccuaa

SEQ ID NO: 21917 - RNA, 1566 nt, Artificial Sequence
  PPP3CA__Homo_sapiens__NP_000935
augagcgagcccaaggccaucgaccccaagcugagcaccaccgacagaguggugaaggccgugcccuucccccccagccacagacugaccgccaaggagguguucgacaacgacggcaagcccagaguggacauccugaaggcccaccugaugaaggagggcagacuggaggagagcguggcccugagaaucaucaccgagggcgccagcauccugagacaggagaagaaccugcuggacaucgacgcccccgugaccgugugcggcgacauccacggccaguucuucgaccugaugaagcuguucgaggugggcggcagccccgccaacaccagauaccuguuccugggcgacuacguggacagaggcuacuucagcaucgagugcgugcuguaccugugggcccugaagauccuguaccccaagacccuguuccugcugagaggcaaccacgagugcagacaccugaccgaguacuucaccuucaagcaggagugcaagaucaaguacagcgagagaguguacgacgccugcauggacgccuucgacugccugccccuggccgcccugaugaaccagcaguuccugugcgugcacggcggccugagccccgagaucaacacccuggacgacaucagaaagcuggacagauucaaggagccccccgccuacggccccaugugcgacauccuguggagcgacccccuggaggacuucggcaacgagaagacccaggagcacuucacccacaacaccgugagaggcugcagcuacuucuacagcuaccccgccgugugcgaguuccugcagcacaacaaccugcugagcauccugagagcccacgaggcccaggacgccggcuacagaauguacagaaagagccagaccaccggcuuccccagccugaucaccaucuucagcgcccccaacuaccuggacguguacaacaacaaggccgccgugcugaaguacgagaacaacgugaugaacaucagacaguucaacugcagcccccaccccuacuggcugcccaacuucauggacguguucaccuggagccugcccuucgugggcgagaaggugaccgagaugcuggugaacgugcugaacaucugcagcgacgacgagcugggcagcgaggaggacggcuucgacggcgccaccgccgccgccagaaaggaggugaucagaaacaagaucagagccaucggcaagauggccagaguguucagcgugcugagagaggagagcgagagcgugcugacccugaagggccugacccccaccggcaugcugcccagcggcgugcugagcggcggcaagcagacccugcagagcgccaccguggaggccaucgaggccgacgaggccaucaagggcuucagcccccagcacaagaucaccagcuucgaggaggccaagggccuggacagaaucaacgagagaaugccccccagaagagacgccaugcccagcgacgccaaccugaacagcaucaacaaggcccugaccagcgagaccaacggcaccgacagcaacggcagcaacagcagcaacauccaguaa

SEQ ID NO: 21918 - RNA, 1578 nt, Artificial Sequence
  PPP3CB__Homo_sapiens__NP_001135825
auggccgcccccgagcccgccagagccgcccccccccccccccccccccccccccccccccccggcgccgacagaguggugaaggccgugcccuucccccccacccacagacugaccagcgaggagguguucgaccuggacggcauccccagaguggacgugcugaagaaccaccuggugaaggagggcagaguggacgaggagaucgcccugagaaucaucaacgagggcgccgccauccugagaagagagaagaccaugaucgagguggaggcccccaucaccgugugcggcgacauccacggccaguucuucgaccugaugaagcuguucgaggugggcggcagccccgccaacaccagauaccuguuccugggcgacuacguggacagaggcuacuucagcaucgagugcgugcuguaccugugggugcugaagauccuguaccccagcacccuguuccugcugagaggcaaccacgagugcagacaccugaccgaguacuucaccuucaagcaggagugcaagaucaaguacagcgagagaguguacgaggccugcauggaggccuucgacagccugccccuggccgcccugcugaaccagcaguuccugugcgugcacggcggccugagccccgagauccacacccuggacgacaucagaagacuggacagauucaaggagccccccgccuucggccccaugugcgaccugcuguggagcgaccccagcgaggacuucggcaacgagaagagccaggagcacuucagccacaacaccgugagaggcugcagcuacuucuacaacuaccccgccgugugcgaguuccugcagaacaacaaccugcugagcaucaucagagcccacgaggcccaggacgccggcuacagaauguacagaaagagccagaccaccggcuuccccagccugaucaccaucuucagcgcccccaacuaccuggacguguacaacaacaaggccgccgugcugaaguacgagaacaacgugaugaacaucagacaguucaacugcagcccccaccccuacuggcugcccaacuucauggacguguucaccuggagccugcccuucgugggcgagaaggugaccgagaugcuggugaacgugcugagcaucugcagcgacgacgagcugaugaccgagggcgaggaccaguucgacgugggcagcgccgccgccagaaaggagaucaucagaaacaagaucagagccaucggcaagauggccagaguguucagcgugcugagagaggagagcgagagcgugcugacccugaagggccugacccccaccggcaugcugcccagcggcgugcuggccggcggcagacagacccugcagagcgccaccguggaggccaucgaggccgagaaggccaucagaggcuucagccccccccacagaaucugcagcuucgaggaggccaagggccuggacagaaucaacgagagaaugccccccagaaaggacgccgugcagcaggacggcuucaacagccugaacaccgcccacgccaccgagaaccacggcaccggcaaccacaccgcccaguaa

SEQ ID NO: 21919 - RNA, 1566 nt, Artificial Sequence
  PPP3CC__Homo_sapiens__NP_001230903
augagcggcagaagauuccaccugagcaccaccgacagagugaucaaggccgugcccuucccccccacccagagacugaccuucaaggagguguucgagaacggcaagcccaagguggacgugcugaagaaccaccuggugaaggagggcagacuggaggaggagguggcccugaagaucaucaacgacggcgccgccauccugagacaggagaagaccaugaucgagguggacgcccccaucaccgugugcggcgacauccacggccaguucuucgaccugaugaagcuguucgaggugggcggcagccccagcaacaccagauaccuguuccugggcgacuacguggacagaggcuacuucagcaucgagugcgugcuguaccuguggagccugaagaucaaccaccccaagacccuguuccugcugagaggcaaccacgagugcagacaccugaccgacuacuucaccuucaagcaggagugcagaaucaaguacagcgagcagguguacgacgccugcauggagaccuucgacugccugccccuggccgcccugcugaaccagcaguuccugugcgugcacggcggcaugagccccgagaucaccagccuggacgacaucagaaagcuggacagauucaccgagccccccgccuucggccccgugugcgaccugcuguggagcgaccccagcgaggacuacggcaacgagaagacccuggagcacuacacccacaacaccgugagaggcugcagcuacuucuacagcuaccccgccgugugcgaguuccugcagaacaacaaccugcugagcaucaucagagcccacgaggcccaggacgccggcuacagaauguacagaaagagccaggccaccggcuuccccagccugaucaccaucuucagcgcccccaacuaccuggacguguacaacaacaaggccgccgugcugaaguacgagaacaacgugaugaacaucagacaguucaacugcagcccccaccccuacuggcugcccaacuucauggacguguucaccuggagccugcccuucgugggcgagaaggugaccgagaugcuggugaacgugcugaacaucugcagcgacgacgagcugaucagcgacgacgaggccgaggaccacuacauccccagcuaccagaagggcagcaccaccgugagaaaggagaucaucagaaacaagaucagagccaucggcaagauggccagaguguucagcauccugagacaggagagcgagagcgugcugacccugaagggccugacccccaccggcacccugccccugggcgugcugagcggcggcaagcagaccaucgagaccgccaccguggaggccguggaggccagagaggccaucagaggcuucagccugcagcacaagaucagaagcuucgaggaggccagaggccuggacagaaucaacgagagaaugccccccagaaaggacagcauccacgccggcggccccaugaagagcgugaccagcgcccacagccacgccgcccacagaagcgaccagggcaagaaggcccacagcuaa

SEQ ID NO: 21920 - RNA, 513 nt, Artificial Sequence
  PPP3R1__Homo_sapiens__NP_000936
augggcaacgaggccagcuacccccuggagaugugcagccacuucgacgccgacgagaucaagagacugggcaagagauucaagaagcuggaccuggacaacagcggcagccugagcguggaggaguucaugagccugcccgagcugcagcagaacccccuggugcagagagugaucgacaucuucgacaccgacggcaacggcgagguggacuucaaggaguucaucgagggcgugagccaguucagcgugaagggcgacaaggagcagaagcugagauucgccuucagaaucuacgacauggacaaggacggcuacaucagcaacggcgagcuguuccaggugcugaagaugauggugggcaacaaccugaaggacacccagcugcagcagaucguggacaagaccaucaucaacgccgacaaggacggcgacggcagaaucagcuucgaggaguucugcgccguggugggcggccuggacauccacaagaagauggugguggacguguaa

SEQ ID NO: 21921 - RNA, 522 nt, Artificial Sequence
  PPP3R2__Homo_sapiens__NP_671709
augagcaccaugggcaacgaggccagcuaccccgccgagaugugcagccacuucgacaacgacgagaucaagagacugggcagaagauucaagaagcuggaccuggacaagagcggcagccugagcguggaggaguucaugagccugcccgagcugagacacaacccccuggugagaagagugaucgacguguucgacaccgacggcgacggcgagguggacuucaaggaguucauccugggcaccagccaguucagcgugaagggcgacgaggagcagaagcugagauucgccuucagcaucuacgacauggacaaggacggcuacaucagcaacggcgagcuguuccaggugcugaagaugauggugggcaacaaccugaccgacuggcagcugcagcagcugguggacaagaccaucaucauccuggacaaggacggcgacggcaagaucagcuucgaggaguucagcgccguggugagagaccuggagauccacaagaagcuggugcugaucguguaa

SEQ ID NO: 21922 - RNA, 924 nt, Artificial Sequence
  PPP4C__Homo_sapiens__NP_002711
auggccgagaucagcgaccuggacagacagaucgagcagcugagaagaugcgagcugaucaaggagagcgaggugaaggcccugugcgccaaggccagagagauccugguggaggagagcaacgugcagagaguggacagccccgugaccgugugcggcgacauccacggccaguucuacgaccugaaggagcuguucagagugggcggcgacgugcccgagaccaacuaccuguucaugggcgacuucguggacagaggcuucuacagcguggagaccuuccugcugcugcuggcccugaaggugagauaccccgacagaaucacccugaucagaggcaaccacgagagcagacagaucacccagguguacggcuucuacgacgagugccugagaaaguacggcagcgugaccguguggagauacugcaccgagaucuucgacuaccugagccugagcgccaucaucgacggcaagaucuucugcgugcacggcggccugagccccagcauccagacccuggaccagaucagaaccaucgacagaaagcaggaggugccccacgacggccccaugugcgaccugcuguggagcgaccccgaggacaccaccggcuggggcgugagccccagaggcgccggcuaccuguucggcagcgacgugguggcccaguucaacgccgccaacgacaucgacaugaucugcagagcccaccagcuggugauggagggcuacaaguggcacuucaacgagaccgugcugaccguguggagcgcccccaacuacugcuacagaugcggcaacguggccgccauccuggagcuggacgagcaccugcagaaggacuucaucaucuucgaggccgccccccaggagaccagaggcauccccagcaagaagcccguggccgacuacuuccuguaa

SEQ ID NO: 21923 - RNA, 2853 nt, Artificial Sequence
  PPP4R1__Homo_sapiens__NP_001035847
auggccgaccugagccugcugcaggaggaccugcaggaggacgccgacggcuucggcguggacgacuacagcagcgagagcgacgugaucaucauccccagcgcccuggacuucgugagccaggacgagaugcugaccccccugggcagacuggacaaguacgccgccagcgagaacaucuucaacagacagaugguggccagaagccugcuggacacccugagagaggugugcgacgacgagagagacugcaucgccgugcuggagagaaucagcagacuggccgacgacagcgagcccaccgugagagccgagcugauggagcaggugccccacaucgcccuguucugccaggagaacagacccagcauccccuacgccuucagcaaguuccugcugcccaucguggugagauaccuggccgaccagaacaaccaggugagaaagaccagccaggccgcccugcuggcccugcuggagcaggagcugaucgagagauucgacguggagaccaaggugugccccgugcugaucgagcugaccgcccccgacagcaacgacgacgugaagaccgaggccguggccaucaugugcaagauggcccccauggugggcaaggacaucaccgagagacugauccugcccagauucugcgagaugugcugcgacugcagaauguuccacgugagaaaggugugcgccgccaacuucggcgacaucugcagcguggugggccagcaggccaccgaggagaugcugcugcccagauucuuccagcugugcagcgacaacguguggggcgugagaaaggccugcgccgagugcuucauggccgugagcugcgccaccugccaggagaucagaagaaccaagcugagcgcccuguucaucaaccugaucagcgaccccagcagaugggugagacaggccgccuuccagagccugggccccuucaucagcaccuucgccaaccccagcagcagcggccaguacuucaaggaggagagcaagagcagcgaggagaugagcguggagaacaagaacagaaccagagaccaggaggcccccgaggacgugcaggugagacccgaggacacccccagcgaccugagcgugagcaacagcagcgugauccuggagaacaccauggaggaccacgccgccgaggccagcggcaagccccugggcgagaucagcgugccccuggacagcagccugcugugcacccugagcagcgagagccaccaggaggccgccagcaacgagaacgacaagaagcccggcaacuacaagagcaugcugagacccgaggugggcaccaccagccaggacagcgcccugcuggaccaggagcuguacaacagcuuccacuucuggagaaccccccugcccgagaucgaccuggacaucgagcuggagcagaacagcggcggcaagcccagccccgagggccccgaggaggagagcgagggccccgugcccagcagccccaacaucaccauggccaccagaaaggagcuggaggagaugaucgagaaccuggagccccacaucgacgaccccgacgugaaggcccagguggaggugcugagcgccgcccugagagccagcagccuggacgcccacgaggagaccaucagcaucgagaagagaagcgaccugcaggacgagcuggacaucaacgagcugcccaacugcaagaucaaccaggaggacagcgugccccugaucagcgacgccguggagaacauggacagcacccugcacuacauccacagcgacagcgaccugagcaacaacagcagcuucagccccgacgaggagagaagaaccaaggugcaggacguggugccccaggcccugcuggaccaguaccugagcaugaccgaccccagcagagcccagaccguggacaccgagaucgccaagcacugcgccuacagccugcccggcguggcccugacccugggcagacagaacuggcacugccugagagagaccuacgagacccuggccagcgacaugcaguggaaggugagaagaacccuggccuucagcauccacgagcuggccgugauccugggcgaccagcugaccgccgccgaccuggugcccaucuucaacggcuuccugaaggaccuggacgaggugagaaucggcgugcugaagcaccugcacgacuuccugaagcugcugcacaucgacaagagaagagaguaccuguaccagcugcaggaguuccuggugaccgacaacagcagaaacuggagauucagagccgagcuggccgagcagcugauccugcugcuggagcuguacagccccagagacguguacgacuaccugagacccaucgcccugaaccugugcgccgacaaggugagcagcgugagauggaucagcuacaagcuggugagcgagauggugaagaagcugcacgccgccaccccccccaccuucggcguggaccugaucaacgagcugguggagaacuucggcagaugccccaaguggagcggcagacaggccuucguguucgugugccagaccgugaucgaggacgacugccugcccauggaccaguucgccgugcaccugaugccccaccugcugacccuggccaacgacagagugcccaacgugagagugcugcuggccaagacccugagacagacccugcuggagaaggacuacuuccuggccagcgccagcugccaccaggaggccguggagcagaccaucauggcccugcagauggacagagacagcgacgugaaguacuucgccagcauccaccccgccagcaccaagaucagcgaggacgccaugagcaccgccagcagcaccuacuaa

SEQ ID NO: 21924 - RNA, 1434 nt, Artificial Sequence
  PPP5C__Homo_sapiens__NP_001191213
auggccauggccgagggcgagagaaccgagugcgccgagccccccagagacgagccccccgccgacggcgcccugaagagagccgaggagcugaagacccaggccaacgacuacuucaaggccaaggacuacgagaacgccaucaaguucuacagccaggccaucgagcugaaccccagcaacgccaucuacuacggcaacagaagccuggccuaccugagaaccgagugcuacggcuacgcccugggcgacgccaccagagccaucgagcuggacaagaaguacaucaagggcuacuacagaagagccgccagcaacauggcccugggcaaguucagagccgcccugagagacuacgagaccguggugaaggugaagccccacgacaaggacgccaagaugaaguaccaggagugcaacaagaucgugaagcagaaggccuucgagagagccaucgccggcgacgagcacaagagaagcgugguggacagccuggacaucgagagcaugaccaucgaggacgaguacagcggccccaagcuggaggacggcaaggugaccaucagcuucaugaaggagcugaugcagugguacaaggaccagaagaagcugcacagaaagugcgccuaccagaccgagaagaucaccgugugcggcgacacccacggccaguucuacgaccugcugaacaucuucgagcugaacggccugcccagcgagaccaaccccuacaucuucaacggcgacuucguggacagaggcagcuucagcguggaggugauccugacccuguucggcuucaagcugcuguaccccgaccacuuccaccugcugagaggcaaccacgagaccgacaacaugaaccagaucuacggcuucgagggcgaggugaaggccaaguacaccgcccagauguacgagcuguucagcgagguguucgaguggcugccccuggcccagugcaucaacggcaaggugcugaucaugcacggcggccuguucagcgaggacggcgugacccuggacgacaucagaaagaucgagagaaacagacagccccccgacagcggccccaugugcgaccugcuguggagcgacccccagccccagaacggcagaagcaucagcaagagaggcgugagcugccaguucggccccgacgugaccaaggccuuccuggaggagaacaaccuggacuacaucaucagaagccacgaggugaaggccgagggcuacgagguggcccacggcggcagaugcgugaccguguucagcgcccccaacuacugcgaccagaugggcaacaaggccagcuacauccaccugcagggcagcgaccugagaccccaguuccaccaguucaccgccgugccccaccccaacgugaagcccauggccuacgccaacacccugcugcagcugggcaugauguaa

SEQ ID NO: 21925 - RNA, 1029 nt, Artificial Sequence
  PPP6C__Homo_sapiens__NP_001116827
auggccccccuggaccuggacaaguacguggagaucgccagacugugcaaguaccugcccgagaacgaccugaaggugagccccaucugcggccuggcccccagcggcugcggcgcccccgccggcagacccuuccugagccccggccccccccccguguuccacuuccugagauuccugaaggagagacugugcgacuacgugugcgaccugcugcuggaggagagcaacgugcagcccgugagcacccccgugaccgugugcggcgacauccacggccaguucuacgaccugugcgagcuguucagaaccggcggccaggugcccgacaccaacuacaucuucaugggcgacuucguggacagaggcuacuacagccuggagaccuucaccuaccugcuggcccugaaggccaaguggcccgacagaaucacccugcugagaggcaaccacgagagcagacagaucacccagguguacggcuucuacgacgagugccagaccaaguacggcaacgccaacgccuggagauacugcaccaagguguucgacaugcugaccguggccgcccugaucgacgagcagauccugugcgugcacggcggccugagccccgacaucaagacccuggaccagaucagaaccaucgagagaaaccaggagaucccccacaagggcgccuucugcgaccugguguggagcgaccccgaggacguggacaccugggccaucagccccagaggcgccggcuggcuguucggcgccaaggugaccaacgaguucgugcacaucaacaaccugaagcugaucugcagagcccaccagcuggugcacgagggcuacaaguucauguucgacgagaagcuggugaccguguggagcgcccccaacuacugcuacagaugcggcaacaucgccagcaucaugguguucaaggacgugaacaccagagagcccaagcuguucagagccgugcccgacagcgagagagugaucccccccagaaccaccacccccuacuuccuguaa

SEQ ID NO: 21926 - RNA, 2802 nt, Artificial Sequence
  PPP6R2__Homo_sapiens__NP_001229828
auguucuggaaguucgaccugaacaccaccagccacguggacaagcugcuggacaaggagcacgugacccugcaggagcugauggacgaggacgacauccugcaggagugcaaggcccagaaccagaagcugcuggacuuccugugcagacagcagugcauggaggagcuggugagccugaucacccaggaccccccccuggacauggaggagaaggugagauucaaguaccccaacaccgccugcgagcugcugaccugcgacgugccccagaucagcgacagacugggcggcgacgagagccugcugagccugcuguacgacuuccuggaccacgagcccccccugaacccccugcuggccagcuucuucagcaagaccaucggcaaccugaucgccagaaagaccgagcaggugaucaccuuccugaagaagaaggacaaguucaucagccuggugcugaagcacaucggcaccagcgcccugauggaccugcugcugagacuggugagcugcguggagcccgccggccugagacaggacgugcugcacuggcugaacgaggagaaggugauccagagacugguggagcugauccaccccagccaggacgaggacagacagagcaacgccagccagacccugugcgacaucgugagacugggcagagaccagggcagccagcugcaggaggcccuggagcccgacccccugcugaccgcccuggagagcagacaggacugcguggagcagcugcugaagaacauguucgacggcgacagaaccgagagcugccuggugagcggcacccaggugcugcugacccugcuggagaccagaagagugggcaccgagggccugguggacagcuucagccagggccuggagagaagcuacgccgugagcagcagcgugcugcacggcaucgagcccagacugaaggacuuccaccagcugcugcugaacccccccaagaagaaggccauccugaccaccaucggcgugcuggaggagccccugggcaacgccagacugcacggcgccagacugauggccgcccugcugcacaccaacacccccagcaucaaccaggagcugugcagacugaacaccauggaccugcugcuggaccuguucuucaaguacaccuggaacaacuuccugcacuuccagguggagcugugcaucgccgccauccugagccacgccgccagagaggagagaaccgaggccagcggcagcgagagcagaguggagcccccccacgagaacggcaacagaagccuggagaccccccagcccgccgccagccugcccgacaacaccauggugacccaccuguuccagaagugcugccuggugcagagaauccuggaggccugggaggccaacgaccacacccaggccgccggcggcaugagaagaggcaacaugggccaccugaccagaaucgccaacgccguggugcagaaccuggagagaggccccgugcagacccacaucagcgaggugaucagaggccugcccgccgacugcagaggcagaugggagagcuucguggaggagacccugaccgagaccaacagaagaaacaccguggaccuggccuucagcgacuaccagauccagcagaugaccgccaacuucguggaccaguucggcuucaacgacgaggaguucgccgaccaggacgacaacaucaacgcccccuucgacagaaucgccgagaucaacuucaacaucgacgccgacgaggacagccccagcgccgcccuguucgaggccugcugcagcgacagaauccagcccuucgacgacgacgaggacgaggacaucugggaggacagcgacaccagaugcgccgccagagugauggccagacccagauucggcgccccccacgccagcgagagcugcagcaagaacggccccgagagaggcggccaggacggcaaggccagccuggaggcccacagagacgcccccggcgccggcgccccccccgcccccggcaagaaggaggccccccccguggagggcgacagcgagggcgccauguggaccgccguguucgacgagcccgccaacagcacccccaccgcccccggcguggugagagacgugggcagcagcgugugggccgccggcaccagcgcccccgaggagaagggcugggccaaguucaccgacuuccagcccuucugcugcagcgagagcggccccagaugcagcagccccguggacaccgagugcagccacgccgagggcagcagaagccagggccccgagaaggccuucagccccgccagccccugcgccuggaacgugugcgugaccagaaaggccccccugcuggccagcgacagcagcagcagcggcggcagccacagcgaggacggcgaccagaaggccgccagcgccauggacgccgugagcagaggccccggcagagaggcccccccccugcccaccguggccagaaccgaggaggccgugggcagagugggcugcgccgacagcagacugcugagccccgccugccccgcccccaaggaggugaccgccgcccccgccguggccgugccccccgaggccaccguggccaucaccaccgcccugagcaaggccggccccgccauccccacccccgccgugagcagcgcccuggccguggccgugccccugggccccaucauggccgugaccgccgcccccgccaugguggccacccugggcaccgugaccaaggacggcaagaccgacgccccccccgagggcgccgcccugaacggccccguguaa

SEQ ID NO: 21927 - RNA, 2640 nt, Artificial Sequence
  PPP6R3__Homo_sapiens__NP_001157632
auguucuggaaguucgaccugcacagcagcagccacaucgacacccugcuggagagagaggacgugacccugaaggagcugauggacgaggaggacgugcugcaggagugcaaggcccagaacagaaagcugaucgaguuccugcugaaggccgagugccuggaggaccuggugagcuucaucaucgaggagcccccccaggacauggacgagaagaucagauacaaguaccccaacaucagcugcgagcugcugaccagcgacgugagccagaugaacgacagacugggcgaggacgagagccugcugaugaagcuguacagcuuccugcugaacgacagcccccugaacccccugcuggccagcuucuucagcaaggugcugagcauccugaucagcagaaagcccgagcagaucguggacuuccugaagaagaagcacgacuucguggaccugaucaucaagcacaucggcaccagcgccaucauggaccugcugcugagacugcugaccugcaucgagcccccccagcccagacaggacgugcugaacuggcugaacgaggagaagaucauccagagacugguggagaucgugcaccccagccaggaggaggacagacacagcaacgccagccagagccugugcgagaucgugagacugagcagagaccagaugcugcagauccagaacagcaccgagcccgacccccugcuggccacccuggagaagcaggagaucaucgagcagcugcugagcaacaucuuccacaaggagaagaacgagagcgccaucgugagcgccauccagauccugcugacccugcuggagaccagaagacccaccuucgagggccacaucgagaucugcccccccggcaugagccacagcgccugcagcgugaacaagagcgugcuggaggccaucagaggcagacugggcagcuuccacgagcugcugcuggagccccccaagaagagcgugaugaagaccaccuggggcgugcuggacccccccgugggcaacaccagacugaacgugaucagacugaucagcagccugcugcagaccaacaccagcagcaucaacggcgaccugauggagcugaacagcaucggcgugauccugaacauguucuucaaguacaccuggaacaacuuccugcacacccagguggagaucugcaucgcccugauccuggccagccccuucgagaacaccgagaacgccaccaucaccgaccaggacagcaccggcgacaaccugcugcugaagcaccuguuccagaagugccagcugaucgagagaauccuggaggccugggagaugaacgagaagaagcaggccgagggcggcagaagacacggcuacaugggccaccugaccagaaucgccaacugcaucgugcacagcaccgacaagggccccaacagcgcccuggugcagcagcugaucaaggaccugcccgacgaggugagagagagaugggagaccuucugcaccagcagccugggcgagaccaacaagagaaacaccguggaccuggugaccaccugccacauccacagcagcagcgacgacgagaucgacuucaaggagaccggcuucagccaggacagcagccugcagcaggccuucagcgacuaccagaugcagcagaugaccagcaacuucaucgaccaguucggcuucaacgacgagaaguucgccgaccaggacgacaucggcaacgugagcuucgacagagugagcgacaucaacuucacccugaacaccaacgagagcggcaacaucgcccuguucgaggccugcugcaaggagagaauccagcaguucgacgacggcggcagcgacgaggaggacaucugggaggagaagcacaucgccuucacccccgagagccagagaagaagcagcagcggcagcaccgacagcgaggagagcaccgacagcgaggaggaggacggcgccaagcaggaccuguucgagcccagcagcgccaacaccgaggacaagauggagguggaccugagcgagccccccaacuggagcgccaacuucgacgugcccauggagaccacccacggcgccccccuggacagcgugggcagcgacguguggagcaccgaggagcccaugcccaccaaggagaccggcugggccagcuucagcgaguucaccagcagccugagcaccaaggacagccugagaagcaacagccccguggagauggagaccagcaccgagcccauggacccccugacccccagcgccgccgcccuggccgugcagcccgaggccgccggcagcguggccauggaggccagcagcgacggcgaggaggacgccgagagcaccgacaaggugaccgagaccgugaugaacggcggcaugaaggagacccugagccugaccguggacgccaagaccgagaccgccguguucaagagagugcugaagagcuacagagaggagggcaagcugagcaccagccaggacgccgccugcaaggacgccgaggagugccccgagaccgccgaggccaagugcgccgcccccagaccccccagcagcagccccgagcagagaaccggccagcccagcgcccccggcgacaccagcgugaacggccccguguaa

SEQ ID NO: 21928 - RNA, 4203 nt, Artificial Sequence
  PPRC1__Homo_sapiens__NP_001275656
auggccgccagaagaggcagaagagacggcguggcccccccccccagcggcggccccggccccgaccccggcggcggcgccagaggcagcggcuggggcagcagaagccaggcccccuacggcacccugggcgccgugagcggcggcgagcaggugcugcugcacgaggaggccggcgacagcggcuucgugagccugagcagacugggccccagccugagagacaaggaccuggagauggaggagcugaugcugcaggacgagacccugcugggcaccaugcagagcuacauggacgccagccugaucagccugaucgaggacuucggcagccugggcgagagcagacugagccuggaggaccagaacgaggugagccugcugaccgcccugaccgagauccuggacaacgccgacagcgagaaccugagccccuucgacagcauccccgacagcgagcugcuggugagccccagagagggcagcagccugcacaagcugcugacccugagcagaaccccccccgagagagaccugaucacccccguggacccccugggccccagcaccggcagcagcagaggcagcggcguggagaugagccugcccgaccccagcugggacuucagcccccccagcuuccuggagaccagcagccccaagcugcccagcuggagaccccccagaagcagacccagauggggccagagcccccccccccagcagagaagcgacggcgaggaggaggaggagguggccagcuucagcggccagauccuggccggcgagcuggacaacugcgugagcagcauccccgacuuccccaugcaccuggccugccccgaggaggaggacaaggccaccgccgccgagauggccgugcccgccgccggcgacgagagcaucagcagccugagcgagcuggugagagccaugcaccccuacugccugcccaaccugacccaccuggccagccuggaggacgagcugcaggagcagcccgacgaccugacccugcccgagggcugcguggugcuggagaucgugggccaggccgccaccgccggcgacgaccuggagauccccgugguggugagacaggugagccccggccccagacccgugcugcuggacgacagccuggagaccagcagcgcccugcagcugcugaugcccacccuggagagcgagaccgaggccgccgugcccaaggugacccugugcagcgagaaggagggccugagccugaacagcgaggagaagcuggacagcgccugccugcugaagcccagagaggugguggagcccguggugcccaaggagccccagaacccccccgccaacgccgcccccggcagccagagagccagaaagggcagaaagaagaagagcaaggagcagcccgccgccugcguggagggcuacgccagaagacugagaagcagcagcagaggccagagcaccgugggcaccgaggugaccagccagguggacaaccugcagaagcagccccaggaggagcugcagaaggagagcggcccccugcagggcaagggcaagcccagagccugggccagagccugggccgccgcccuggagaacagcagccccaagaaccuggagagaagcgccggccagagcagccccgccaaggagggcccccuggaccuguaccccaagcuggccgacaccauccagaccaaccccauccccacccaccugagccugguggacagcgcccaggccagccccaugcccguggacagcguggaggccgaccccaccgccgugggccccgugcuggccggccccgugcccguggaccccggccugguggaccuggccagcaccagcagcgagcugguggagccccugcccgccgagcccgugcugaucaaccccgugcuggccgacagcgccgccguggaccccgccguggugcccaucagcgacaaccugccccccguggacgccgugcccagcggccccgcccccguggaccuggcccugguggaccccgugcccaacgaccugacccccguggaccccgugcuggugaagagcagacccaccgaccccagaagaggcgccgugagcagcgcccugggcggcagcgccccccagcugcugguggagagcgagagccuggacccccccaagaccaucauccccgaggugaaggaggugguggacagccugaagaucgagagcggcaccagcgccaccacccacgaggccagacccagaccccugagccugagcgaguacagaagaagaagacagcagagacaggccgagaccgaggagagaagcccccagccccccaccggcaaguggcccagccugcccgagacccccaccggccuggccgacauccccugccuggugaucccccccgcccccgccaagaagaccgcccugcagagaagccccgagaccccccuggagaucugccuggugcccgugggccccagccccgccagccccagccccgagccccccgugagcaagcccguggccagcagccccaccgagcaggugcccagccaggagaugccccugcuggccagacccagcccccccgugcagagcgugagccccgccgugcccaccccccccagcaugagcgccgcccugcccuuccccgccggcggccugggcaugccccccagccugcccccccccccccugcagccccccagccugccccugagcaugggccccgugcugcccgaccccuucacccacuacgccccccugcccagcuggcccugcuacccccacgugagccccagcggcuaccccugccugccccccccccccaccgugccccuggugagcggcacccccggcgccuacgccgugccccccaccugcagcgugcccugggcccccccccccgcccccgugagccccuacagcagcaccugcaccuacggcccccugggcuggggccccggcccccagcacgcccccuucuggagcaccgugcccccccccccccugccccccgccagcaucggcagagccgugccccagcccaagauggagagcagaggcacccccgccggcccccccgagaacgugcugccccugagcauggcccccccccugagccugggccugcccggccacggcgccccccagaccgagcccaccaagguggaggugaagcccgugcccgccagcccccaccccaagcacaaggugagcgcccuggugcagagcccccagaugaaggcccuggccugcgugagcgccgagggcgugaccguggaggagcccgccagcgagagacugaagcccgagacccaggagaccagacccagagagaagcccccccugcccgccaccaaggccgugcccacccccagacagagcaccgugcccaagcugcccgccgugcaccccgccagacugagaaagcugagcuuccugcccacccccagaacccagggcagcgaggacguggugcaggccuucaucagcgagaucggcaucgaggccagcgaccugagcagccugcuggagcaguucgagaagagcgaggccaagaaggagugccccccccccgcccccgccgacagccuggccgugggcaacagcggcagcagcugcagcagcagcggcagaagcagaagaugcagcagcagcagcagcagcagcagcagcagcagcagcagcagcagcagcagcagcagcagcagaagcagaagcagaagccccagccccagaagaagaagcgacagaagaagaagauacagcagcuacagaagccacgaccacuaccagagacagagagugcugcagaaggagagagccaucgaggagagaagagugguguucaucggcaagauccccggcagaaugaccagaagcgagcugaagcagagauucagcguguucggcgagaucgaggagugcaccauccacuucagagugcagggcgacaacuacggcuucgugaccuacagauacgccgaggaggccuucgccgccaucgagagcggccacaagcugagacaggccgacgagcagcccuucgaccugugcuucggcggcagaagacaguucugcaagagaagcuacagcgaccuggacagcaacagagaggacuucgaccccgcccccgugaagagcaaguucgacagccuggacuucgacacccugcugaagcaggcccagaagaaccugagaagauaa

SEQ ID NO: 21929 - RNA, 909 nt, Artificial Sequence
  PPT2__Homo_sapiens__NP_001191032
augcugggccugugcggccagagacugcccgccgccugggugcugcugcugcugcccuuccugccccugcugcugcuggccgcccccgccccccacagagccagcuacaagcccgugaucguggugcacggccuguucgacagcagcuacagcuucagacaccugcuggaguacaucaacgagacccaccccggcaccguggugaccgugcuggaccuguucgacggcagagagagccugagaccccugugggagcaggugcagggcuucagagaggccguggugcccaucauggccaaggccccccagggcgugcaccugaucugcuacagccagggcggccuggugugcagagcccugcugagcgugauggacgaccacaacguggacagcuucaucagccugagcagcccccagaugggccaguacggcgacaccgacuaccugaaguggcuguuccccaccagcaugagaagcaaccuguacagaaucugcuacagccccuggggccaggaguucagcaucugcaacuacuggcacgacccccaccacgacgaccuguaccugaacgccagcagcuuccuggcccugaucaacggcgagagagaccaccccaacgccaccguguggagaaagaacuuccugagagugggccaccuggugcugaucggcggccccgacgacggcgugaucacccccuggcagagcagcuucuucggcuucuacgacgccaacgagaccgugcuggagauggaggagcagcugguguaccugagagacagcuucggccugaagacccugcuggccagaggcgccaucgugagaugccccauggccggcaucagccacaccgccuggcacagcaacagaacccuguacgagaccugcaucgagcccuggcugagcuaa

SEQ ID NO: 21930 - RNA, 288 nt, Artificial Sequence
  PPY__Homo_sapiens__NP_002713
auggccgccgccagacugugccugagccugcugcugcugagcaccugcguggcccugcugcugcagccccugcugggcgcccagggcgccccccuggagcccguguaccccggcgacaacgccacccccgagcagauggcccaguacgccgccgaccugagaagauacaucaacaugcugaccagacccagauacggcaagagacacaaggaggacacccuggccuucagcgaguggggcagcccccacgccgccgugcccagagagcugagcccccuggaccuguaa

SEQ ID NO: 21931 - RNA, 498 nt, Artificial Sequence
  PQBP1__Homo_sapiens__NP_001161464
augccccugcccguggcccugcagaccagacuggccaagagaggcauccugaagcaccuggagcccgagcccgaggaggagaucaucgccgaggacuacgacgacgaccccguggacuacgaggccaccagacuggagggccugccccccagcugguacaagguguucgaccccagcugcggccugcccuacuacuggaacgccgacagagaggagggcaaggagagaagacaccacagaagagaggagcuggcccccuaccccaagagcaagaaggccgugagcagaaaggacgaggagcuggaccccauggaccccagcagcuacagcgacgcccccagaggcaccuggagcaccggccugcccaagagaaacgaggccaagaccggcgccgacaccaccgccgccggcccccuguuccagcagagacccuaccccagccccggcgccgugcugagagccaacgccgaggccagcagaaccaagcagcaggacuaa

SEQ ID NO: 21932 - RNA, 567 nt, Artificial Sequence
  PQLC3__Homo_sapiens__NP_001269639
auggaggccgcccugcugggccugugcaacuggagcacccugggcgugugcgccgcccugaagcugccccagaucagcgccgugcuggccgccagaagcgccagaggccugagccugcccagccugcugcuggagcuggccggcuuccugguguuccugagauaccagugcuacuacggcuaccccccccugaccuaccuggaguaccccauccugaucgcccaggacgugauccugcugcugugcaucuuccacuucaacggcaacgugaagcaggccacccccuacaucgccgugcuggugagcagcugguucauccuggcccugcagaaguggaucaucgaccuggccaugaaccugugcaccuucaucagcgccgccagcaaguucgcccagcugcagugccuguggaagaccagagacagcggcaccgugagcgcccugaccuggagccugagcagcuacaccugcgccauccugcugagauucgugaucaugcuggcccugaacaucugggugaccgugaccgugcugagauacagaaagaccgccaucaaggccgaguaa

SEQ ID NO: 21933 - RNA, 174 nt, Artificial Sequence
  PRAC1__Homo_sapiens__NP_115767
augcugugcgcccacuucagcgaccagggccccgcccaccugaccaccagcaagagcgccuuccugagcaacaagaagaccagcacccugaagcaccugcugggcgagaccagaagcgacggcagcgccugcaacagcggcaucagcggcggcagaggcagaaagauccccuaa

SEQ ID NO: 21934 - RNA, 273 nt, Artificial Sequence
  PRAC2__Homo_sapiens__XP_011523050
auggacagaagaagaauggcccugagacccggcagcagaagacccaccgccuucuucuuccacagcagauggcuggugcccaaccugcuggccuucuuccugggccugagcggcgccggccccauccaccugcccaugcccuggcccaacggcagaagacacagagugcuggacccccacacccagcugagcacccacgaggcccccggcagauggaagcccguggcccccagaaccaugaaggccugcccccaggugcugcuggagugguaa

SEQ ID NO: 21935 - RNA, 567 nt, Artificial Sequence
  PRADC1__Homo_sapiens__NP_115695
auggugcccggcgccgccggcuggugcugccuggugcuguggcugcccgccugcguggccgcccacggcuucagaauccacgacuaccuguacuuccaggugcugagccccggcgacaucagauacaucuucaccgccacccccgccaaggacuucggcggcaucuuccacaccagauacgagcagauccaccuggugcccgccgagccccccgaggccugcggcgagcugagcaacggcuucuucauccaggaccagaucgcccugguggagagaggcggcugcagcuuccugagcaagaccagaguggugcaggagcacggcggcagagccgugaucaucagcgacaacgccguggacaacgacagcuucuacguggagaugauccaggacagcacccagagaaccgccgacauccccgcccuguuccugcugggcagagacggcuacaugaucagaagaagccuggagcagcacggccugcccugggccaucaucagcauccccgugaacgugaccagcauccccaccuucgagcugcugcagccccccuggaccuucugguaa

SEQ ID NO: 21936 - RNA, 537 nt, Artificial Sequence
  PRAF2__Homo_sapiens__NP_009144
augagcgaggugagacugcccccccugagagcccuggacgacuucgugcugggcagcgccagacuggccgcccccgaccccugcgacccccagagauggugccacagagugaucaacaaccugcuguacuaccagaccaacuaccugcugugcuucggcaucggccuggcccuggccggcuacgugagaccccugcacacccugcugagcgcccuggugguggccguggcccugggcgugcuggugugggccgccgagaccagagccgccgugagaagaugcagaagaagccaccccgccgccugccuggccgccgugcuggccgugggccugcuggugcuguggguggccggcggcgccugcaccuuccuguucagcaucgccggccccgugcugcugauccuggugcacgccagccugagacugagaaaccugaagaacaagaucgagaacaagaucgagagcaucggccugaagagaacccccaugggccugcugcuggaggcccugggccaggagcaggaggccggcagcuaa

SEQ ID NO: 21937 - RNA, 2013 nt, Artificial Sequence
  PRAM1__Homo_sapiens__NP_115528
auggcccaccaccugcccgccgccauggagagccaccaggacuucagaagcaucaaggccaaguuccaggccagccagcccgagcccagcgaccugcccaagaagccccccaagcccgaguucggcaagcugaagaaguucagccagcccgagcugagcgagcaccccaagaaggccccccugcccgaguucggcgccgugagccugaagccccccccccccgaggugaccgaccugcccaagaagccccccccccccgaggugaccgaccugcccaagaagccccccccccccgaggugaccgaccugcccaagaagccccccccccccgaggugaccgaccugcccaagaagcccagcaagcuggagcugagcgaccugagcaagaaguucccccagcugggcgccacccccuuccccagaaagccccugcagcccgaggugggcgaggccccccugaaggccagccugcccgagcccggcgcccccgccagaaagccccugcagcccgacgagcugagccaccccgccagaccccccagcgagcccaagagcggcgccuuccccagaaagcuguggcagcccgaggccggcgaggccacccccagaagcccccagcccgagcugagcaccuuccccaagaagcccgcccagcccgaguucaacguguaccccaagaagcccccccagccccaggugggcggccugcccaagaagagcgugccccagcccgaguucagcgaggccgcccagaccccccuguggaagccccagagcagcgagcccaagagagacagcagcgccuuccccaagaaggccagccagcccccccugagcgacuuccccaagaagcccccccagcccgagcugggcgaccugaccagaaccagcagcgagcccgaggugagcgugcugcccaagagacccagacccgccgaguucaaggcccugagcaagaagcccccccagcccgagcugggcggccugcccagaaccagcagcgagcccgaguucaacagccugcccagaaagcugcugcagcccgagagaagaggcccccccagaaaguucagccagcccgagcccagcgccgugcugaagagacacccccagcccgaguucuucggcgaccugcccagaaagcccccccugcccagcagcgccagcgagagcagccugcccgccgccguggccggcuucagcagcagacacccccugagccccggcuucggcgccgccggcacccccagauggagaagcggcggccuggugcacagcggcggcgccagacccggccugagacccagccacccccccagaagaagaccccugccccccgccagcagccugggccacccccccgccaagcccccccugccccccggccccguggacaugcagagcuucagaagacccagcgccgccagcaucgaccugagaagaaccagaagcgccgccggccugcacuuccaggacagacagcccgaggacaucccccaggugcccgacgagaucuacgagcuguacgacgacguggagcccagagacgacagcagccccagccccaagggcagagacgaggcccccagcgugcagcaggccgccagaagacccccccaggaccccgcccugagaaaggagaaggacccccagccccagcagcugccccccauggaccccaagcugcugaagcagcugagaaaggccgagaaggccgagagagaguucagaaagaaguucaaguucgagggcgagaucguggugcacaccaagaugaugaucgaccccaacgccaagaccagaagaggcggcggcaagcaccugggcaucagaagaggcgagauccuggaggugaucgaguucaccagcaacgaggagaugcugugcagagaccccaagggcaaguacggcuacgugcccagaaccgcccugcugccccuggagaccgagguguacgacgacguggacuucugcgacccccuggagaaccagccccugccccugggcagauaa

SEQ ID NO: 21938 - RNA, 1530 nt, Artificial Sequence
  PRAME__Homo_sapiens__NP_996837
auggagagaagaagacuguggggcagcauccagagcagauacaucagcaugagcguguggaccagccccagaagacugguggagcuggccggccagagccugcugaaggacgaggcccuggccaucgccgcccuggagcugcugcccagagagcuguuccccccccuguucauggccgccuucgacggcagacacagccagacccugaaggccauggugcaggccuggcccuucaccugccugccccugggcgugcugaugaagggccagcaccugcaccuggagaccuucaaggccgugcuggacggccuggacgugcugcuggcccaggaggugagacccagaagauggaagcugcaggugcuggaccugagaaagaacagccaccaggacuucuggaccguguggagcggcaacagagccagccuguacagcuuccccgagcccgaggccgcccagcccaugaccaagaagagaaagguggacggccugagcaccgaggccgagcagcccuucauccccguggaggugcugguggaccuguuccugaaggagggcgccugcgacgagcuguucagcuaccugaucgagaaggugaagagaaagaagaacgugcugagacugugcugcaagaagcugaagaucuucgccaugcccaugcaggacaucaagaugauccugaagauggugcagcuggacagcaucgaggaccuggaggugaccugcaccuggaagcugcccacccuggccaaguucagccccuaccugggccagaugaucaaccugagaagacugcugcugagccacauccacgccagcagcuacaucagccccgagaaggaggagcaguacaucgcccaguucaccagccaguuccugagccugcagugccugcaggcccuguacguggacagccuguucuuccugagaggcagacuggaccagcugcugagacacgugaugaacccccuggagacccugagcaucaccaacugcagacugagcgagggcgacgugaugcaccugagccagagccccagcgugagccagcugagcgugcugagccugagcggcgugaugcugaccgacgugagccccgagccccugcaggcccugcuggagagagccagcgccacccugcaggaccugguguucgacgagugcggcaucaccgacgaccagcugcuggcccugcugcccagccugagccacugcagccagcugaccacccugagcuucuacggcaacagcaucagcaucagcgcccugcagagccugcugcagcaccugaucggccugagcaaccugacccacgugcuguaccccgugccccuggagagcuacgaggacauccacggcacccugcaccuggagagacuggccuaccugcacgccagacugagagagcugcugugcgagcugggcagacccagcaugguguggcugagcgccaaccccugcccccacugcggcgacagaaccuucuacgaccccgagcccauccugugccccugcuucaugcccaacuaa

SEQ ID NO: 21939 - RNA, 429 nt, Artificial Sequence
  PRAP1__Homo_sapiens__NP_001138673
augagaagacugcugcuggugaccagccuggugguggugcugcugugggaggccggcgccgugcccgcccccaaggugcccaucaagaugcaggugaagcacuggcccagcgagcaggaccccgagaaggccuggggcgccagagugguggagccccccgagaaggacgaccagcugguggugcuguuccccgugcagaagcccaagcugcugaccaccgaggagaagcccagaggcaccaaggccuggauggagaccgaggacacccugggccacgugcugagccccgagcccgaccacgacagccuguaccaccccccccccgaggaggaccagggcgaggagagacccagacugugggugaugcccaaccaccaggugcugcugggccccgaggaggaccaggaccacaucuaccacccccaguaa

SEQ ID NO: 21940 - RNA, 996 nt, Artificial Sequence
  PRB1__Homo_sapiens__NP_005030
augcugcugauccugcugagcguggcccugcuggcccugagcagcgcccagaaccugaacgaggacgugagccaggaggagagccccagccugaucgccggcaacccccagggccccagcccccagggcggcaacaagccccagggccccccccccccccccggcaagccccagggcccccccccccagggcggcaacaagccccagggcccccccccccccggcaagccccagggcccccccccccagggcgacaagagcagaagccccagaagcccccccggcaagccccagggcccccccccccagggcggcaaccagccccagggccccccccccccccccggcaagccccagggcccccccccccagggcggcaacagaccccagggcccccccccccccggcaagccccagggcccccccccccagggcgacaagagcagaagccccagaagcccccccggcaagccccagggcccccccccccagggcggcaaccagccccagggccccccccccccccccggcaagccccagggcccccccccccagggcggcaagaagccccagggcccccccccccccggcaagccccagggcccccccccccagggcgacaagagcagaagcagccagagcccccccggcaagccccagggcccccccccccagggcggcaaccagccccagggccccccccccccccccggcaagccccagggcccccccccccagggcggcaacaagccccagggcccccccccccccggcaagccccagggcccccccgcccagggcggcagcaagagccagagcgccagaagcccccccggcaagccccagggccccccccagcaggagggcaacaacccccagggcccccccccccccgccggcggcaacccccagcagccccaggccccccccgccggccagccccagggcccccccagacccccccagggcggcagacccagcagacccccccaguaa

SEQ ID NO: 21941 - RNA, 1251 nt, Artificial Sequence
  PRB2__Homo_sapiens__NP_006239
augcugcugauccugcugagcguggcccugcuggcccugagcagcgcccagaaccugaacgaggacgugagccaggaggagagccccagccugaucgccggcaacccccagggcgcccccccccagggcggcaacaagccccagggcccccccagcccccccggcaagccccagggcccccccccccagggcggcaaccagccccagggccccccccccccccccggcaagccccagggcccccccccccagggcggcaacaagccccagggcccccccccccccggcaagccccagggcccccccccccagggcgacaagagcagaagccccagaagcccccccggcaagccccagggcccccccccccagggcggcaaccagccccagggccccccccccccccccggcaagccccagggcccccccccccagggcggcaacaagccccagggcccccccccccccggcaagccccagggcccccccccccagggcgacaacaagagcagaagcagcagaagcccccccggcaagccccagggcccccccccccagggcggcaaccagccccagggccccccccccccccccggcaagccccagggcccccccccccagggcggcaacaagccccagggcccccccccccccggcaagccccagggcccccccccccagggcgacaacaagagccagagcgccagaagcccccccggcaagccccagggcccccccccccagggcggcaaccagccccagggccccccccccccccccggcaagccccagggcccccccccccagggcggcaacaagccccagggcccccccccccccggcaagccccagggcccccccccccagggcggcagcaagagcagaagcagcagaagcccccccggcaagccccagggcccccccccccagggcggcaaccagccccagggccccccccccccccccggcaagccccagggcccccccccccagggcggcaacaagccccagggcccccccccccccggcaagccccagggcccccccccccagggcggcagcaagagcagaagcgccagaagcccccccggcaagccccagggccccccccagcaggagggcaacaacccccagggcccccccccccccgccggcggcaacccccagcagccccaggccccccccgccggccagccccagggcccccccagacccccccagggcggcagacccagcagacccccccaguaa

SEQ ID NO: 21942 - RNA, 930 nt, Artificial Sequence
  PRB3__Homo_sapiens__NP_006240
augcugcugauccugcugagcguggcccugcuggcccugagcagcgcccagagccugaacgaggacgugagccaggaggagagccccagcgugaucagcggcaagcccgagggcagaagaccccagggcggcaaccagccccagagaaccccccccccccccggcaagcccgagggcagacccccccagggcggcaaccagagccagggccccccccccagacccggcaagcccgagggcccccccccccagggcggcaaccagagccagggccccccccccagacccggcaagcccgagggccagcccccccagggcggcaaccagagccagggccccccccccagacccggcaagcccgagggcccccccccccagggcggcaaccagagccagggccccccccccagacccggcaagcccgagggcccccccccccagggcggcaaccagagccagggccccccccccagacccggcaagcccgagggcccccccccccagggcggcaaccagagccagggcccccccccccaccccggcaagcccgagggcccccccccccagggcggcaaccagagccagggccccccccccagacccggcaagcccgagggcccccccccccagggcggcaaccagagccagggccccccccccagacccggcaagcccgagggcccccccagccagggcggcaacaagccccagggcccccccccccaccccggcaagccccagggcccccccccccaggagggcaacaagccccagagaccccccccccccggcagaccccagggcccccccccccccggcggcaacccccagcagccccugcccccccccgccggcaagccccagggcccccccccccccccccagggcggcagaccccacagacccccccagggccagcccccccaguaa

SEQ ID NO: 21943 - RNA, 537 nt, Artificial Sequence
  PRB4__Homo_sapiens__NP_001248328
augcugcugauccugcugagcguggcccugcuggcccugagcagcgccgagagcagcagcgaggacgugagccaggaggagagccuguuccugaucagcggcaagcccgagggcagaagaccccagggcggcaaccagccccagagacccccccccccccccggcaagccccagggcccccccccccagggcggcaaccagagccagggccccccccccccccccggcaagcccgagggcagacccccccagggcggcaaccagagccagggcccccccccccaccccggcaagcccgagagaccccccccccagggcggcaaccagagccagggcaagccccagggccccccccagcaggagggcaacaagccccagggcccccccccccccggcaagccccagggccccccccccgccggcggcaacccccagcagccccaggccccccccgccggcaagccccagggcccccccccccccccccagggcggcagaccccccagacccgcccagggccagcagcccccccaguaa

SEQ ID NO: 21944 - RNA, 1578 nt, Artificial Sequence
  PRC1__Homo_sapiens__NP_001254509
augagaagaagcgaggugcuggccgaggagagcaucgugugccugcagaaggcccugaaccaccugagagagaucugggagcugaucggcauccccgaggaccagagacugcagagaaccgagguggugaagaagcacaucaaggaggagggcgagaccaccauccugcagcuggagaaggaccugagaacccagguggagcugaugagaaagcagaagaaggagagaaagcaggagcugaagcugcugcaggagcaggaccaggagcugugcgagauccugugcaugccccacuacgacaucgacagcgccagcgugcccagccuggaggagcugaaccaguucagacagcacgugaccacccugagagagaccaaggccagcagaagagaggaguucgugagcaucaagagacagaucauccugugcauggaggagcuggaccacacccccgacaccagcuucgagagagacguggugugcgaggacgaggacgccuucugccugagccuggagaacaucgccacccugcagaagcugcugagacagcuggagaugcagaagagccagaacgaggccgugugcgagggccugagaacccagaucagagagcugugggacagacugcagauccccgaggaggagagagaggccguggccaccaucaugagcggcagcaaggccaaggugagaaaggcccugcagcuggagguggacagacuggaggagcugaagaugcagaacaugaagaaggugaucgaggccaucagaguggagcuggugcaguacugggaccagugcuucuacagccaggagcagagacaggccuucgcccccuucugcgccgaggacuacaccgagagccugcugcagcugcacgacgccgagaucgugagacugaagaacuacuacgaggugcacaaggagcuguucgagggcgugcagaagugggaggagaccuggagacuguuccuggaguucgagagaaaggccagcgaccccaacagauucaccaacagaggcggcaaccugcugaaggaggagaagcagagagccaagcugcagaagaugcugcccaagcuggaggaggagcugaaggccagaaucgagcugugggagcaggagcacagcaaggccuucauggugaacggccagaaguucauggaguacguggccgagcagugggagaugcacagacuggagaaggagagagccaagcaggagagacagcugaagaacaagaagcagaccgagaccgagaugcuguacggcagcgcccccagaacccccagcaagagaagaggccuggcccccaacacccccggcaaggccagaaagcugaacaccaccaccaugagcaacgccaccgccaacagcagcaucagacccaucuucggcggcaccguguaccacagccccgugagcagacugccccccagcggcagcaagcccguggccgccagcaccugcagcggcaagaagacccccagaaccggcagacacggcgccaacaaggagaaccuggagcugaacggcagcauccugagcgccagaaccuucaagggcuuccagaucuaa

SEQ ID NO: 21945 - RNA, 1476 nt, Artificial Sequence
  PRCC__Homo_sapiens__NP_005964
augagccugguggccuacgccagcagcgacgagagcgagcccgacgaggccgagcccgagcccgaggaggaggaggccguggcccccaccagcggccccgcccugggcggccuguucgccagccugcccgcccccaagggccccgcccugcugcccccccccccccagaugcuggcccccgccuucccccccccccugcugcugcccccccccaccggcgaccccagacugcagcccccccccccccugcccuucggccugggcggcuucccccccccccccggcgugagccccgccgaggccgccggcgugggcgagggccugggccugggccugcccagccccagaggccccggccugaaccugcccccccccaucggcggcgccggccccccccugggccugcccaagcccaagaagagaaaggagcccgugaagaucgccgcccccgagcugcacaagggcgacagcgacagcgaggaggacgagcccaccaagaagaagaccauccugcagggcagcagcgagggcaccggccugagcgcccugcugccccagcccaagaaccugaccgugaaggagaccaacagacugcugcugccccacgccuucagcagaaagcccagcgacggcagccccgacaccaagcccagcagacuggccagcaagaccaagaccagcagccuggcccccguggugggcaccaccaccaccacccccagccccagcgccaucaaggccgccgccaagagcgccgcccugcaggugaccaagcagaucacccaggaggaggacgacagcgacgaggagguggcccccgagaacuucuucagccugcccgagaaggccgagccccccggcguggagcccuaccccuaccccauccccaccgugcccgaggagcugccccccggcaccgagcccgagcccgccuuccaggacgacgccgccaacgccccccuggaguucaagauggccgccggcagcagcggcgcccccuggaugcccaagcccggcgacgacuacagcuacaaccaguucagcaccuacggcgacgccaacgccgccggcgccuacuaccaggacuacuacagcggcggcuacuaccccgcccaggaccccgcccuggugcccccccaggagaucgcccccgacgccagcuucaucgacgacgaggccuucaagagacugcagggcaagagaaacagaggcagagaggagaucaacuucguggagaucaagggcgacgaccagcugagcggcgcccagcaguggaugaccaagagccugaccgaggagaagaccaugaagagcuucagcaagaagaagggcgagcagcccaccggccagcagagaagaaagcaccagaucaccuaccugauccaccaggccaaggagagagagcuggagcugaagaacaccuggagcgagaacaagcugagcagaagacagacccaggccaaguacggcuucuaa

SEQ ID NO: 21946 - RNA, 165 nt, Artificial Sequence
  PRCD__Homo_sapiens__NP_001071088
augugcaccacccuguuccugcugagcacccuggccaugcuguggagaagaagauucgccaacagagugcagcccgagcccagcgacguggacggcgccgccagaggcagcagccuggacgccgacccccagagcagcggcagagagaaggagccccugaaguaa

SEQ ID NO: 21947 - RNA, 1491 nt, Artificial Sequence
  PRCP__Homo_sapiens__NP_005031
augggcagaagagcccugcugcugcugcugcugagcuuccuggcccccugggccaccaucgcccugagacccgcccugagagcccugggcagccugcaccugcccaccaaccccaccagccugcccgccguggccaagaacuacagcgugcuguacuuccagcagaagguggaccacuucggcuucaacaccgugaagaccuucaaccagagauaccugguggccgacaaguacuggaagaagaacggcggcagcauccuguucuacaccggcaacgagggcgacaucaucugguucugcaacaacaccggcuucaugugggacguggccgaggagcugaaggccaugcugguguucgccgagcacagauacuacggcgagagccugcccuucggcgacaacagcuucaaggacagcagacaccugaacuuccugaccagcgagcaggcccuggccgacuucgccgagcugaucaagcaccugaagagaaccauccccggcgccgagaaccagcccgugaucgccaucggcggcagcuacggcggcaugcuggccgccugguucagaaugaaguacccccacaugguggugggcgcccuggccgccagcgcccccaucuggcaguucgaggaccuggugcccugcggcguguucaugaagaucgugaccaccgacuucagaaagagcggcccccacugcagcgagagcauccacagaagcugggacgccaucaacagacugagcaacaccggcagcggccugcaguggcugaccggcgcccugcaccugugcagcccccugaccagccaggacauccagcaccugaaggacuggaucagcgagaccugggugaaccuggccaugguggacuaccccuacgccagcaacuuccugcagccccugcccgccuggcccaucaagguggugugccaguaccugaagaaccccaacgugagcgacagccugcugcugcagaacaucuuccaggcccugaacguguacuacaacuacagcggccaggugaagugccugaacaucagcgagaccgccaccagcagccugggcacccugggcuggagcuaccaggccugcaccgagguggugaugcccuucugcaccaacggcguggacgacauguucgagccccacagcuggaaccugaaggagcugagcgacgacugcuuccagcaguggggcgugagacccagacccagcuggaucaccaccauguacggcggcaagaacaucagcagccacaccaacaucguguucagcaacggcgagcuggaccccuggagcggcggcggcgugaccaaggacaucaccgacacccugguggccgugaccaucagcgagggcgcccaccaccuggaccugagaaccaagaacgcccuggaccccaugagcgugcugcuggccagaagccuggaggugagacacaugaagaacuggaucagagacuucuacgacagcgccggcaagcagcacuaa

SEQ ID NO: 21948 - RNA, 3483 nt, Artificial Sequence
  PRDM10__Homo_sapiens__NP_064613
auggacagcaaggacgagagcagccacguguggcccaccagcgccgagcacgagcagaacgccgcccaggugcacuucgugcccgacaccggcaccguggcccagaucguguacaccgacgaccaggugagacccccccagcaggugguguacaccgccgacggcgccagcuacaccagcguggacggccccgagcacacccugguguacauccaccccguggaggccgcccagacccuguucaccgaccccggccagguggccuacgugcagcaggacgccaccgcccagcaggccagccugcccgugcacaaccaggugcugcccagcaucgagagcguggacggcagcgacccccuggccacccugcagaccccccugggcagacuggaggccaaggaggaggaggacgaggacgaggacgaggacaccgaggaggacgaggaggaggacggcgaggacaccgaccuggacgacugggagcccgacccccccagacccuucgacccccacgaccuguggugcgaggagugcaacaacgcccacgccagcgugugccccaagcacggcccccugcaccccauccccaacagacccgugcugaccagagccagagccagccugccccuggugcuguacaucgacagauuccugggcggcguguucagcaagagaagaauccccaagagaacccaguucggccccguggagggcccccuggugagaggcagcgagcugaaggacugcuacauccaccugaaggugagccuggacaagggcgacagaaaggagagagaccugcacgaggaccugugguucgagcugagcgacgagacccugugcaacuggaugauguucgugagacccgcccagaaccaccuggagcagaaccugguggccuaccaguacggccaccacguguacuacaccaccaucaagaacguggagcccaagcaggagcugaaggugugguacgccgccagcuacgccgaguucgugaaccagaagauccacgacaucagcgaggaggagagaaaggugcugagagagcaggagaagaacuggcccugcuacgagugcaacagaagauucaucagcagcgagcagcugcagcagcaccugaacagccacgacgagaagcuggacguguucagcagaaccagaggcagaggcagaggcagaggcaagagaagauucggccccggcagaagacccggcagaccccccaaguucaucagacuggagaucaccagcgagaacggcgagaagagcgacgacggcacccaggaccugcugcacuuccccaccaaggagcaguucgacgaggccgagcccgccacccugaacggccuggaccagcccgagcagaccaccauccccaucccccagcugccccaggagacccagagcagccuggagcacgagcccgagacccacacccugcaccugcagccccagcacgaggagagcguggugcccacccagagcacccugaccgccgacgacaugagaagagccaagagaaucagacuggagcugcagaacgccgcccugcagcaccuguucaucagaaagagcuucagacccuucaagugccugcagugcggcaaggccuucagagagaaggacaagcuggaccagcaccugagauuccacggcagagagggcaacugcccccugaccugcgaccugugcaacaagggcuucaucagcagcaccagccuggagagccacaugaagcugcacagcgaccagaagaccuacagcugcaucuucugccccgagagcuucgacagacuggaccugcugaaggaccacguggccauccacaucaacgacggcuacuucaccugccccaccugcaagaagagauuccccgacuucauccaggugaagaagcacgugagaagcuuccacagcgagaagaucuaccagugcaccgagugcgacaaggccuucugcagacccgacaagcugagacugcacaugcugagacacagcgacagaaaggacuuccugugcagcaccugcggcaagcaguucaagagaaaggacaagcugagagagcacaugcagagaaugcacaaccccgagagagaggccaagaaggccgacagaaucagcagaagcaagaccuucaagcccagaaucaccagcaccgacuacgacagcuucaccuucaagugcagacugugcaugaugggcuucagaagaagaggcaugcuggugaaccaccugagcaagagacaccccgacaugaagaucgaggaggugcccgagcugacccugcccaucaucaagcccaacagagacuacuucugccaguacugcgacaagguguacaagagcgccagcaagagaaaggcccacauccugaagaaccaccccggcgccgagcugccccccagcaucagaaagcugagacccgccggccccggcgagcccgaccccaugcugagcacccacacccagcugaccggcaccaucgccaccccccccgugugcugcccccacugcagcaagcaguacagcagcaagaccaagauggugcagcacaucagaaagaagcaccccgaguucgcccagcugagcaacaccauccacaccccccugaccaccgccgugaucagcgccacccccgccgugcugaccaccgacagcgccaccggcgagaccguggugaccaccgaccugcugacccaggccaugaccgagcugagccagacccugaccaccgacuacagaaccccccagggcgacuaccagagaauccaguacauccccgugagccagagcgccagcggccugcagcagccccagcacauccagcugcagguggugcagguggccagcgccaccagcccccaccagagccagcagagcaccguggacgugggccagcugcacgacccccagcccuacccccagcacgccauccaggugcagcacauccaggugagcgagcccaccgccagcgcccccagcagcgcccaggugagcggccagccccugagccccagcgcccagcaggcccagcagggccugagccccagccacauccagggcagcagcagcacccagggccaggcccugcagcagcagcagcagcagcagcagaacagcagcgugcagcacaccuaccugcccagcgccuggaacagcuucagaggcuacagcagcgagauccagaugaugacccugccccccggccaguucgugaucaccgacagcggcguggccacccccgugaccaccggccaggugaaggccgugaccagcggccacuacgugcugagcgagagccagagcgagcuggaggagaagcagaccagcgcccugagcggcggcgugcagguggagccccccgcccacagcgacagccuggacccccagaccaacagccagcagcagaccacccaguacaucaucaccaccaccaccaacggcaacggcagcagcgaggugcacaucaccaagcccuaa

SEQ ID NO: 21949 - RNA, 1434 nt, Artificial Sequence
  PRDM11__Homo_sapiens__NP_001243625
augaccgagaacaugaaggagugccuggcccagaccaacgccgccgugggcgacauggugaccguggugaagaccgaggugugcagcccccugagagaccaggaguacggccagcccugcagcagaagacccgacagcagcgccauggagguggagcccaagaagcugaagggcaagagagaccugaucgugcccaagagcuuccagcagguggacuucugguucugcgagagcugccaggaguacuucguggacgagugccccaaccacggcccccccguguucgugagcgacacccccgugcccgugggcauccccgacagagccgcccugaccaucccccagggcauggagguggugaaggacaccagcggcgagagcgacgugagaugcgugaacgaggugauccccaagggccacaucuucggccccuacgagggccagaucagcacccaggacaagagcgccggcuucuucagcuggcugaucguggacaagaacaacagauacaagagcaucgacggcagcgacgagaccaaggccaacuggaugagauacguggugaucagcagagaggagagagagcagaaccugcuggccuuccagcacagcgagagaaucuacuucagagccugcagagacaucagacccggcgaguggcugagagugugguacagcgaggacuacaugaagagacugcacagcaugagccaggagaccauccacagaaaccuggccagaggcgagaagagacugcagagagagaagagcgagcaggugcuggacaaccccgaggaccugagaggccccauccaccugagcgugcugagacagggcaagagccccuacaagagaggcuucgacgagggcgacgugcacccccaggccaagaagaagaagaucgaccugaucuucaaggacgugcuggaggccagccuggagagcgccaagguggaggcccaccagcuggcccugagcaccagccuggugaucagaaaggugcccaaguaccaggacgacgccuacagccagugcgccaccaccaugacccacggcgugcagaacaucggccagacccagggcgagggcgacuggaaggugccccagggcgugagcaaggagcccggccagcuggaggacgaggaggaggagcccagcagcuucaaggccgacagccccgccgaggccagccuggccagcgacccccacgagcugcccaccaccagcuucugccccaacugcaucagacugaagaagaaggugagagagcugcaggccgagcuggacaugcugaagagcggcaagcugcccgagccccccgugcugcccccccaggugcuggagcugcccgaguucagcgaccccgccggcaagcugguguggaugagacugcugagcgagggcagagugagaagcggccugugcggcggcuaa

SEQ ID NO: 21950 - RNA, 2124 nt, Artificial Sequence
  PRDM13__Homo_sapiens__NP_067633
augcacggcgccgccagagcccccgccaccagcgugagcgccgacugcugcauccccgccggccugagacugggccccgugcccggcaccuucaagcugggcaaguaccugagcgacagaagagagcccggccccaagaagaaggugagaauggugagaggcgagcugguggacgagagcggcggcagcccccuggaguggaucggccugaucagagccgccagaaacagccaggagcagacccuggaggccaucgccgaccugcccggcggccagaucuucuacagagcccugagagacgugcagcccggcgaggagcugaccgugugguacagcaacagccuggcccagugguucgacauccccaccaccgccacccccacccacgacgagaagggcgaggagagauacaucugcugguacugcuggagaaccuucagauaccccaacagccugaaggcccaccugagauuccacugcguguucagcggcggcggcggcggcgccuuccugcaccacgagcacgccgccagacagggcgccgugcccgccgccgacggccugggccugagccccaagccccccgcccccgacuucgccgcccccagccaggccggcacccugagaccccacccccugggccccccccccgugcaggccugcggcgccagagagggcaucaagagagaggccagcagcgcccccagcgccaccagccccacccccggcaaguggggccagcccaagaagggcaaggagcagcuggacagagcccuggacaugagcggcgccgccagaggccagggccacuuccugggcaucgugggcggcagcagcgccggcgugggcagccuggccuucuaccccggcgugagaagcgccuucaagcccgccggccuggccagagccgccgccgccgcccacggcgaccccuacagagaggagagcagcagcaagcagggcgccggccuggcccugggcagacugcugggcggcggcagagccugcggcagacccggcagcggcgagaacagcgccgccggcggcgccggccaccaccaccaccaccacgcccaccaccaccaccaccccaagugccugcuggccggcgaccccccccccccccccccccccggccugcccugcagcggcgcccugagaggcuucccccugcugagcgugccccccgaggaggccagcgccuucaagcacguggagagagccccccccgccgccgccgcccugcccggcgccagauacgcccagcugccccccgcccccggccugccccuggagagaugcgcccugcccccccuggaccccggcggccugaaggccuaccccggcggcgagugcagccaccugcccgccgugaugcccgccuucaccguguacaacggcgagcugcuguacggcagccccgccaccaccgccuacuacccccugaagcugcacuucggcggccugcugaaguaccccgagagcaucagcuacuucagcggccccgccgccgccgcccugagccccgccgagcugggcagccuggccagcaucgacagagagaucgccaugcacaaccagcagcugagcgagauggccgccggcaagggcagaggcagacuggacagcggcacccugccccccgccguggccgccgccggcggcaccggcggcggcggcagcggcggcagcggcgccggcaagcccaagaccggccaccugugccuguacugcggcaagcuguacagcagaaaguacggccugaagauccacaugagaacccacaccggcuacaagccccugaagugcaaggugugccugagacccuucggcgaccccagcaaccugaacaagcacaucagacugcacgccgagggcaacacccccuacagaugcgaguucugcggcaaggugcuggugagaagaagagaccuggagagacacgugaagagcagacaccccggccagagccugcuggccaaggccggcgacggccccggcgccgagcccggcuacccccccgagcccggcgaccccaagagcgacgacagcgacguggacgugugcuucaccgacgaccagagcgaccccgaggugggcggcggcggcgagagagaccuguaa

SEQ ID NO: 21951 - RNA, 1716 nt, Artificial Sequence
  PRDM14__Homo_sapiens__NP_078780
auggcccugcccagacccagcgaggccgugccccaggacaaggugugcuacccccccgagagcagcccccagaaccuggccgccuacuacacccccuuccccagcuacggccacuacagaaacagccuggccaccguggaggaggacuuccagcccuucagacagcuggaggccgccgccagcgccgcccccgccaugccccccuuccccuucagaauggcccccccccugcugagccccggccugggccugcagagagagccccuguacgaccugcccugguacagcaagcugccccccugguaccccaucccccacgugcccagagaggugccccccuuccugagcagcagccacgaguacgccggcgccagcagcgaggaccugggccaccagaucaucggcggcgacaacgagagcggccccugcugcggccccgacacccugaucccccccccccccgccgacgccagccugcugcccgagggccugagaaccagccagcugcugcccugcagccccagcaagcagagcgaggacggccccaagcccagcaaccaggagggcaagagccccgccagauuccaguucaccgaggaggaccugcacuucgugcuguacggcgugacccccagccuggagcaccccgccagccugcaccacgccaucagcggccugcuggugccccccgacagcagcggcagcgacagccugccccagacccuggacaaggacagccugcagcugcccgagggccugugccugaugcagaccguguucggcgaggugccccacuucggcguguucugcagcagcuucaucgccaagggcgugagauucggccccuuccagggcaagguggugaacgccagcgaggugaagaccuacggcgacaacagcgugaugugggagaucuucgaggacggccaccugagccacuucaucgacggcaagggcggcaccggcaacuggaugagcuacgugaacugcgccagauuccccaaggagcagaaccugguggccgugcagugccagggccacaucuucuacgagagcugcaaggagauccaccagaaccaggagcugcuggugugguacggcgacugcuacgagaaguuccuggacauccccgugagccugcaggugaccgagcccggcaagcagcccagcggccccagcgaggagagcgccgagggcuacagaugcgagagaugcggcaagguguucaccuacaaguacuacagagacaagcaccugaaguacacccccugcguggacaagggcgacagaaaguuccccugcagccugugcaagagaagcuucgagaagagagacagacugagaauccacauccugcacgugcacgagaagcacagaccccacaagugcagcaccugcggcaagugcuucagccagagcagcagccugaacaagcacaugagagugcacagcggcgacagacccuaccagugcguguacugcaccaagagauucaccgccagcagcauccugagaacccacaucagacagcacagcggcgagaagcccuucaagugcaaguacugcggcaagagcuucgccagccacgccgcccacgacagccacgugagaagaagccacaaggaggacgacggcugcagcugcagcaucugcggcaagaucuucagcgaccaggagaccuucuacagccacaugaaguuccacgaggacuacuaa

SEQ ID NO: 21952 - RNA, 2478 nt, Artificial Sequence
  PRDM1__Homo_sapiens__NP_001189
augcuggacaucugccuggagaagagagugggcaccacccuggccgcccccaagugcaacagcagcaccgugagauuccagggccuggccgagggcaccaagggcaccaugaagauggacauggaggacgccgacaugacccuguggaccgaggccgaguucgaggagaagugcaccuacaucgugaacgaccaccccugggacagcggcgccgacggcggcaccagcgugcaggccgaggccagccugcccagaaaccugcuguucaaguacgccaccaacagcgaggaggugaucggcgugaugagcaaggaguacauccccaagggcaccagauucggcccccugaucggcgagaucuacaccaacgacaccgugcccaagaacgccaacagaaaguacuucuggagaaucuacagcagaggcgagcugcaccacuucaucgacggcuucaacgaggagaagagcaacuggaugagauacgugaaccccgcccacagccccagagagcagaaccuggccgccugccagaacggcaugaacaucuacuucuacaccaucaagcccauccccgccaaccaggagcugcuggugugguacugcagagacuucgccgagagacugcacuaccccuaccccggcgagcugaccaugaugaaccugacccagacccagagcagccugaagcagcccagcaccgagaagaacgagcugugccccaagaacgugcccaagagagaguacagcgugaaggagauccugaagcuggacagcaaccccagcaagggcaaggaccuguacagaagcaacaucagcccccugaccagcgagaaggaccuggacgacuucagaagaagaggcagccccgagaugcccuucuaccccagagugguguaccccaucagagccccccugcccgaggacuuccugaaggccagccuggccuacggcaucgagagacccaccuacaucaccagaagccccauccccagcagcaccacccccagccccagcgccagaagcagccccgaccagagccugaagagcagcagcccccacagcagccccggcaacaccgugagccccgugggccccggcagccaggagcacagagacagcuacgccuaccugaacgccagcuacggcaccgagggccugggcagcuaccccggcuacgccccccugccccaccugccccccgccuucauccccagcuacaacgcccacuaccccaaguuccugcugccccccuacggcaugaacugcaacggccugagcgccgugagcagcaugaacggcaucaacaacuucggccuguuccccagacugugccccguguacagcaaccugcugggcggcggcagccugccccaccccaugcugaaccccaccagccugcccagcagccugcccagcgacggcgccagaagacugcugcagcccgagcaccccagagaggugcuggugcccgccccccacagcgccuucagcuucaccggcgccgccgccagcaugaaggacaaggccugcagccccaccagcggcagccccaccgccggcaccgccgccaccgccgagcacguggugcagcccaaggccaccagcgccgccauggccgcccccagcagcgacgaggccaugaaccugaucaagaacaagagaaacaugaccggcuacaagacccugcccuacccccugaagaagcagaacggcaagaucaaguacgagugcaacgugugcgccaagaccuucggccagcugagcaaccugaaggugcaccugagagugcacagcggcgagagacccuucaagugccagaccugcaacaagggcuucacccagcuggcccaccugcagaagcacuaccuggugcacaccggcgagaagccccacgagugccaggugugccacaagagauucagcagcaccagcaaccugaagacccaccugagacugcacagcggcgagaagcccuaccagugcaaggugugccccgccaaguucacccaguucgugcaccugaagcugcacaagagacugcacaccagagagagaccccacaagugcagccagugccacaagaacuacauccaccugugcagccugaaggugcaccugaagggcaacugcgccgccgcccccgcccccggccugccccuggaggaccugaccagaaucaacgaggagaucgagaaguucgacaucagcgacaacgccgacagacuggaggacguggaggacgacaucagcgugaucagcgugguggagaaggagauccuggccguggugagaaaggagaaggaggagaccggccugaaggugagccugcagagaaacaugggcaacggccugcugagcagcggcugcagccuguacgagagcagcgaccugccccugaugaagcugccccccagcaacccccugccccuggugcccgugaaggugaagcaggagaccguggagcccauggaccccuaa

SEQ ID NO: 21953 - RNA, 2406 nt, Artificial Sequence
  PRDM4__Homo_sapiens__NP_036538
augcaccacagaaugaacgagaugaaccugagccccgugggcauggagcagcugaccagcagcagcgugagcaacgcccugcccgugagcggcagccaccugggccuggccgccagccccacccacagcgccauccccgcccccggccugcccguggccauccccaaccugggccccagccugagcagccugcccagcgcccugagccugaugcugcccaugggcaucggcgacagaggcgugaugugcggccugcccgagagaaacuacacccugccccccccccccuacccccaccuggagagcagcuacuucagaaccauccugcccggcauccugagcuaccuggccgacagaccccccccccaguacauccaccccaacagcaucaacguggacggcaacaccgcccugagcaucaccaacaaccccagcgcccuggaccccuaccagagcaacggcaacgugggccuggagcccggcaucgugagcaucgacagcagaagcgugaacacccacggcgcccagagccugcaccccagcgacggccacgagguggcccuggacaccgccaucaccauggagaacgugagcagagugaccagccccaucagcaccgacggcauggccgaggagcugaccauggacggcguggccggcgagcacagccagauccccaacggcagcagaagccacgagccccugagcguggacagcgugagcaacaaccuggccgccgacgccgugggccacggcggcgugauccccaugcacggcaacggccuggagcugcccguggugauggagaccgaccacaucgccagcagagugaacggcaugagcgacagcgcccugagcgacagcauccacaccguggccaugagcaccaacagcgugagcguggcccugagcaccagccacaaccuggccagccuggagagcgugagccugcacgaggugggccugagccuggagcccguggccgugagcagcaucacccaggagguggccaugggcaccggccacguggacgugagcagcgacagccugagcuucgugagccccagccugcagauggaggacagcaacagcaacaaggagaacauggccacccuguucaccaucuggugcacccugugcgacagagccuaccccagcgacugccccgagcacggccccgugaccuucgugcccgacacccccaucgagagcagagccagacugagccugcccaagcagcuggugcugagacagagcaucgugggcgccgaggugggcguguggaccggcgagaccauccccgugagaaccugcuucggcccccugaucggccagcagagccacagcauggagguggccgaguggaccgacaaggccgugaaccacaucuggaagaucuaccacaacggcgugcuggaguucugcaucaucaccaccgacgagaacgagugcaacuggaugauguucgugagaaaggccagaaacagagaggagcagaaccugguggccuacccccacgacggcaagaucuucuucugcaccagccaggacaucccccccgagaacgagcugcuguucuacuacagcagagacuacgcccagcagaucggcgugcccgagcaccccgacgugcaccugugcaacugcggcaaggagugcaacagcuacaccgaguucaaggcccaccugaccagccacauccacaaccaccugcccacccagggccacagcggcagccacggccccagccacagcaaggagagaaaguggaagugcagcaugugcccccaggccuucaucagccccagcaagcugcacgugcacuucaugggccacaugggcaugaagccccacaagugcgacuucugcagcaaggccuucagcgaccccagcaaccugagaacccaccugaagauccacaccggccagaagaacuacagaugcacccugugcgacaagagcuucacccagaaggcccaccuggagagccacauggugauccacaccggcgagaagaaccugaagugcgacuacugcgacaagcuguucaugagaagacaggaccugaagcagcacgugcugauccacacccaggagagacagaucaagugccccaagugcgacaagcuguuccugagaaccaaccaccugaagaagcaccugaacagccacgagggcaagagagacuacgugugcgagaagugcaccaaggccuaccugaccaaguaccaccugaccagacaccugaagaccugcaagggccccaccagcagcagcagcgcccccgaggaggaggaggaggacgacagcgaggaggaggaccuggccgacagcgugggcaccgaggacugcagaaucaacagcgccguguacagcgccgacgagagccugagcgcccacaaguaa

SEQ ID NO: 21954 - RNA, 1800 nt, Artificial Sequence
  PRDM5__Homo_sapiens__NP_001287752
augcugggcauguacgugcccgacagauucagccugaagagcagcagagugcaggacggcaugggccuguacaccgccagaagagugagaaagggcgagaaguucggccccuucgccggcgagaagagaaugcccgaggaccuggacgagaacauggacuacagacugaugugggaggugagaggcagcaagggcgaggugcuguacauccuggacgccaccaaccccagacacagcaacuggcugagauucgugcacgaggcccccagccaggagcagaagaaccuggccgccauccaggagggcgagaacaucuucuaccuggccguggaggacaucgagaccgacaccgagcugcugaucggcuaccuggacagcgacauggaggccgaggaggaggagcagcagaucaugaccgugaucaaggagggcgagguggagaacagcagaagacagagcaccgccggcagaaaggacagacugggcugcaaggaggacuacgccugcccccagugcgagagcagcuucaccagcgaggacauccuggccgagcaccugcagacccugcaccagaagcccaccgaggagaaggaguucaagugcaagaacugcggcaagaaguuccccgugaagcaggcccugcagagacacuucgagcagcaccaggagaccugcagaggcgacgccagauucgugugcaaggccgacagcugcggcaagagacugaagagcaaggacgcccugaagagacaccaggagaacgugcacaccggcgaccccaagaagaagcugaucugcagcgugugcaacaagaagugcagcagcgccagcagccugcaggagcacagaaagauccacgagaucuucgacugccaggagugcaugaagaaguucaucagcgccaaccagcugaagagacacaugaucacccacagcgagaagagacccuacaacugcgagaucugcaacaagagcuucaagagacuggaccaggugggcgcccacaaggugauccacagcgaggacaagcccuacaagugcaagcugugcggcaagggcuucgcccacagaaacguguacaagaaccacaagaagacccacagcgaggagagacccuuccagugcgaggagugcaaggcccuguucagaacccccuucagccugcagagacaccugcugauccacaacagcgagagaaccuucaagugccaccacugcgacgccaccuucaagagaaaggacacccugaacgugcacgugcagguggugcacgagagacacaagaaguacagaugcgagcugugcaacaaggccuucgugacccccagcgugcugagaagccacaagaagacccacaccggcgagaaggagaagaucugccccuacugcggccagaaguucgccagcagcggcacccugagagugcacaucagaagccacaccggcgagagacccuaccagugccccuacugcgagaagggcuucagcaagaacgacggccugaagaugcacaucagaacccacaccagagagaagcccuacaagugcagcgagugcagcaaggccuucagccagaagagaggccuggacgagcacaagagaacccacaccggcgagaagcccuuccagugcgacgugugcgaccuggccuucagccugaagaagaugcugaucagacacaagaugacccacaaccccaacagaccccuggccgagugccaguucugccacaagaaguucaccagaaacgacuaccugaaggugcacauggacaacauccacggcguggccgacagcuaa

SEQ ID NO: 21955 - RNA, 1788 nt, Artificial Sequence
  PRDM6__Homo_sapiens__NP_001129711
augcugaagcccggcgaccccggcggcagcgccuuccugaagguggaccccgccuaccugcagcacuggcagcagcuguucccccacggcggcgccggcccccugaagggcagcggcgccgccggccugcugagcgccccccagccccugcagccccccccccccccccccccccccgagagagccgagcccccccccgacagccugagacccagacccgccagccugagcagcgccagcagcacccccgccagcagcagcaccagcgccagcagcgccagcagcugcgccgccgccgccgccgccgccgcccuggccggccugagcgcccugcccgugagccagcugcccguguucgccccccuggccgccgccgccguggccgccgagccccugccccccaaggagcugugccugggcgccaccagcggccccggccccgugaagugcggcggcggcggcggcggcggcggcgagggcagaggcgcccccagauucagaugcagcgccgaggagcuggacuacuaccuguacggccagcagagaauggagaucaucccccugaaccagcacaccagcgaccccaacaacagaugcgacaugugcgccgacaacagaaacggcgagugccccaugcacggcccccugcacagccugagaagacuggugggcaccagcagcgccgccgccgccgcccccccccccgagcugcccgaguggcugagagaccugcccagagaggugugccugugcaccagcaccgugcccggccuggccuacggcaucugcgccgcccagagaauccagcagggcaccuggaucggccccuuccagggcgugcugcugccccccgagaaggugcaggccggcgccgugagaaacacccagcaccugugggagaucuacgaccaggacggcacccugcagcacuucaucgacggcggcgagcccagcaagagcagcuggaugagauacaucagaugcgccagacacugcggcgagcagaaccugaccguggugcaguacagaagcaacaucuucuacagagccugcaucgacauccccagaggcaccgagcugcuggugugguacaacgacagcuacaccagcuucuucggcaucccccugcagugcaucgcccaggacgagaaccugaacgugcccagcaccgugauggaggccaugugcagacaggacgcccugcagcccuucaacaagagcagcaagcuggcccccaccacccagcagagaagcgugguguucccccagacccccugcagcagaaacuucagccugcuggacaagagcggccccaucgagagcggcuucaaccagaucaacgugaagaaccagagagugcuggccagccccaccagcaccagccagcugcacagcgaguucagcgacuggcaccuguggaagugcggccagugcuucaagaccuucacccagagaauccugcugcagaugcacgugugcacccagaaccccgacagacccuaccagugcggccacugcagccagagcuucagccagcccagcgagcugagaaaccacguggugacccacagcagcgacagacccuucaagugcggcuacugcggcagagccuucgccggcgccaccacccugaacaaccacaucagaacccacaccggcgagaagcccuucaagugcgagagaugcgagagaagcuucacccaggccacccagcugagcagacaccagagaaugcccaacgagugcaagcccaucaccgagagccccgagagcaucgagguggacuaa

SEQ ID NO: 21956 - RNA, 1479 nt, Artificial Sequence
  PRDM7__Homo_sapiens__NP_001091643
augagccccgagagaagccaggaggagagccccgagggcgacaccgagagaaccgagagaaagcccauggugaaggacgccuucaaggacaucagcaucuacuucaccaaggaggagugggccgagaugggcgacugggagaagaccagauacagaaacgugaagaugaacuacaacgcccugaucaccgugggccugagagccaccagacccgccuucaugugccacagaagacaggccaucaagcugcagguggacgacaccgaggacagcgacgaggaguggacccccagacagcaggugaagccccccuggauggccuucagaggcgagcagagcaagcaccagaagggcaugcccaaggccagcuucaacaacgagagcagccugagagagcugagcggcacccccaaccugcugaacaccagcgacagcgagcaggcccagaagcccgugagcccccccggcgaggccagcaccagcggccagcacagcagacugaagcuggagcugagaagaaaggagaccgagggcaagauguacagccugagagagagaaagggccacgccuacaaggagaucagcgagccccaggacgacgacuaccuguacugcgagaugugccagaacuucuucaucgacagcugcgccgcccacggcccccccaccuucgugaaggacagcgccguggacaagggccaccccaacagaagcgcccugagccugccccccggccugagaaucggccccagcggcaucccccaggccggccugggcguguggaacgaggccagcgaccugccccugggccugcacuucggccccuacgagggcagaaucaccgaggacgaggaggccgccaacagcggcuacagcuggcugaucaccaagggcagaaacugcuacgaguacguggacggcaaggacaagagcagcgccaacuggaugagauacgugaacugcgccagagacgacgaggagcagaaccugguggccuuccaguaccacagacagaucuucuacagaaccugcagagugaucagacccggcugcgagcugcugguguggagcggcgacgaguacggccaggagcugggcaucagaagcagcaucgagcccgccgagagccugggccaggccgugaacugcuggagcggcaugggcaugagcauggccagaaacugggccagcagcggcgccgccagcggcagaaagagcagcuggcagggcgagaaccagagccagagaagcauccacgugccccacgccguguggcccuuccaggugaagaacuucagcgugaacauguggaacgccaucaccccccugagaaccagccaggaccaccugcaggagaacuucagcaaccagagaauccccgcccagggcaucagaaucagaagcggcaacauccugauccacgccgccgugaugaccaagcccaaggugaagagaagcaagaagggccccaacagcuaa

SEQ ID NO: 21957 - RNA, 2070 nt, Artificial Sequence
  PRDM8__Homo_sapiens__NP_064611
auggaggacaccggcauccagagaggcaucugggacggcgacgccaaggccgugcagcagugccugaccgacaucuucaccagcguguacaccaccugcgacauccccgagaacgccaucuucggccccugcgugcugagccacaccagccuguacgacagcaucgccuucaucgcccugaagagcaccgacaagagaaccgugcccuacaucuucagaguggacaccagcgccgccaacggcagcagcgagggccugauguggcugagacuggugcagagcgccagagacaaggaggagcagaaccuggaggccuacaucaagaacggccagcuguucuacagaagccugagaagaaucgccaaggacgaggagcugcuggugugguacggcaaggagcugaccgagcugcugcugcugugccccagcagaagccacaacaagaugaacggcagcagccccuacaccugccuggagugcagccagagauuccaguucgaguuccccuacguggcccaccugagauucagaugccccaagagacugcacagcgccgacaucagcccccaggacgagcagggcggcggcgugggcaccaaggaccacggcggcggcggcggcggcggcaaggaccagcagcagcagcagcaggaggccccccugggccccggccccaaguucugcaaggccggcccccugcaccacuaccccagccccagccccgagagcagcaaccccagcgccgccgccggcggcagcagcgccaagcccagcaccgacuuccacaaccuggccagagagcuggagaacagcagaggcggcagcagcugcagccccgcccagagccugagcagcggcagcggcagcggcggcggcggcggccaccaggaggccgagcugagccccgacggcaucgccaccggcggcggcaagggcaagagaaaguuccccgaggaggccgccgagggcggcggcggcgccggccuggugggcggcagaggcagauucguggagagaccccugcccgccagcaaggaggaccuggugugcaccccccagcaguacagagccagcggcagcuacuucggccuggaggagaacggcagacuguucgccccccccagccccgagaccggcgaggccaagagaagcgccuucguggaggugaagaaggccgccagagccgccagccugcaggaggagggcaccgccgacggcgccggcguggccagcgaggaccaggacgccggcggcggcggcggcagcagcacccccgccgccgccagccccgugggcgccgagaagcugcuggcccccagacccggcggcccccugcccagcagacuggagggcggcagccccgccagaggcagcgccuucaccagcgugccccagcugggcagcgccggcagcaccagcggcggcggcggcaccggcgccggcgccgccggcggcgccggcggcggccagggcgccgccagcgacgagagaaagagcgccuucagccagcccgccagaagcuucagccagcugagcccccuggugcugggccagaagcugggcgcccuggagcccugccaccccgccgacggcgugggccccaccagacuguaccccgccgccgccgacccccuggccgugaagcugcagggcgccgccgaccugaacggcggcugcggcagccugcccagcggcggcggcggccugcccaagcagagccccuuccuguacgccaccgccuucuggcccaagagcagcgccgccgccgccgccgccgccgccgccgccgccgccggcccccugcagcugcagcugcccagcgcccugacccugcugccccccagcuucaccagccugugccugcccgcccagaacuggugcgccaagugcaacgccagcuucagaaugaccagcgaccugguguaccacaugagaagccaccacaagaaggaguacgccauggagccccuggugaagagaagaagagaggagaagcugaagugccccaucugcaacgagagcuucagagagagacaccaccugagcagacacaugaccagccacaacuaa

SEQ ID NO: 21958 - RNA, 2685 nt, Artificial Sequence
  PRDM9__Homo_sapiens__NP_064612
augagccccgagaagagccaggaggagagccccgaggaggacaccgagagaaccgagagaaagcccauggugaaggacgccuucaaggacaucagcaucuacuucaccaaggaggagugggccgagaugggcgacugggagaagaccagauacagaaacgugaagagaaacuacaacgcccugaucaccaucggccugagagccaccagacccgccuucaugugccacagaagacaggccaucaagcugcagguggacgacaccgaggacagcgacgaggaguggacccccagacagcaggugaagccccccuggauggcccugagaguggagcagagaaagcaccagaagggcaugcccaaggccagcuucagcaacgagagcagccugaaggagcugagcagaaccgccaaccugcugaacgccagcggcagcgagcaggcccagaagcccgugagccccagcggcgaggccagcaccagcggccagcacagcagacugaagcuggagcugagaaagaaggagaccgagagaaagauguacagccugagagagagaaagggccacgccuacaaggaggugagcgagccccaggacgacgacuaccuguacugcgagaugugccagaacuucuucaucgacagcugcgccgcccacggcccccccaccuucgugaaggacagcgccguggacaagggccaccccaacagaagcgcccugagccugccccccggccugagaaucggccccagcggcaucccccaggccggccugggcguguggaacgaggccagcgaccugccccugggccugcacuucggccccuacgagggcagaaucaccgaggacgaggaggccgccaacaacggcuacagcuggcugaucaccaagggcagaaacugcuacgaguacguggacggcaaggacaagagcugggccaacuggaugagauacgugaacugcgccagagacgacgaggagcagaaccugguggccuuccaguaccacagacagaucuucuacagaaccugcagagugaucagacccggcugcgagcugcuggugugguacggcgacgaguacggccaggagcugggcaucaaguggggcagcaaguggaagaaggagcugauggccggcagagagcccaagcccgagauccaccccugccccagcugcugccuggccuucagcagccagaaguuccugagccagcacguggagagaaaccacagcagccagaacuuccccggccccagcgccagaaagcugcugcagcccgagaaccccugccccggcgaccagaaccaggagcagcaguaccccgacccccacagcagaaacgacaagaccaagggccaggagaucaaggagagaagcaagcugcugaacaagagaaccuggcagagagagaucagcagagccuucagcagcccccccaagggccagaugggcagcugcagagugggcaagagaaucauggaggaggagagcagaaccggccagaaggugaaccccggcaacaccggcaagcuguucgugggcgugggcaucagcagaaucgccaaggugaaguacggcgagugcggccagggcuucagcgugaagagcgacgugaucacccaccagagaacccacaccggcgagaagcuguacgugugcagagagugcggcagaggcuucagcuggaagagccaccugcugauccaccagagaauccacaccggcgagaagcccuacgugugcagagagugcggcagaggcuucagcuggcagagcgugcugcugacccaccagagaacccacaccggcgagaagcccuacgugugcagagagugcggcagaggcuucagcagacagagcgugcugcugacccaccagagaagacacaccggcgagaagcccuacgugugcagagagugcggcagaggcuucagcagacagagcgugcugcugacccaccagagaagacacaccggcgagaagcccuacgugugcagagagugcggcagaggcuucagcuggcagagcgugcugcugacccaccagagaacccacaccggcgagaagcccuacgugugcagagagugcggcagaggcuucagcuggcagagcgugcugcugacccaccagagaacccacaccggcgagaagcccuacgugugcagagagugcggcagaggcuucagcaacaagagccaccugcugagacaccagagaacccacaccggcgagaagcccuacgugugcagagagugcggcagaggcuucagagacaagagccaccugcugagacaccagagaacccacaccggcgagaagcccuacgugugcagagagugcggcagaggcuucagagacaagagcaaccugcugagccaccagagaacccacaccggcgagaagcccuacgugugcagagagugcggcagaggcuucagcaacaagagccaccugcugagacaccagagaacccacaccggcgagaagcccuacgugugcagagagugcggcagaggcuucagaaacaagagccaccugcugagacaccagagaacccacaccggcgagaagcccuacgugugcagagagugcggcagaggcuucagcgacagaagcagccugugcuaccaccagagaacccacaccggcgagaagcccuacgugugcagagaggacgaguaa

SEQ ID NO: 21959 - RNA, 597 nt, Artificial Sequence
  PRDX2__Homo_sapiens__NP_005800
auggccagcggcaacgccagaaucggcaagcccgcccccgacuucaaggccaccgccgugguggacggcgccuucaaggaggugaagcugagcgacuacaagggcaaguacguggugcuguucuucuacccccuggacuucaccuucgugugccccaccgagaucaucgccuucagcaacagagccgaggacuucagaaagcugggcugcgaggugcugggcgugagcguggacagccaguucacccaccuggccuggaucaacacccccagaaaggagggcggccugggcccccugaacaucccccugcuggccgacgugaccagaagacugagcgaggacuacggcgugcugaagaccgacgagggcaucgccuacagaggccuguucaucaucgacggcaagggcgugcugagacagaucaccgugaacgaccugcccgugggcagaagcguggacgaggcccugagacuggugcaggccuuccaguacaccgacgagcacggcgaggugugccccgccggcuggaagcccggcagcgacaccaucaagcccaacguggacgacagcaaggaguacuucagcaagcacaacuaa

SEQ ID NO: 21960 - RNA, 771 nt, Artificial Sequence
  PRDX3__Homo_sapiens__NP_006784
auggccgccgccgugggcagacugcugagagccagcguggccagacacgugagcgccauccccuggggcaucagcgccaccgccgcccugagacccgccgccugcggcagaaccagccugaccaaccugcugugcagcggcagcagccaggccaagcuguucagcaccagcagcagcugccacgcccccgccgugacccagcacgcccccuacuucaagggcaccgccguggugaacggcgaguucaaggaccugagccuggacgacuucaagggcaaguaccuggugcuguucuucuacccccuggacuucaccuucgugugccccaccgagaucguggccuucagcgacaaggccaacgaguuccacgacgugaacugcgaggugguggccgugagcguggacagccacuucagccaccuggccuggaucaacacccccagaaagaacggcggccugggccacaugaacaucgcccugcugagcgaccugaccaagcagaucagcagagacuacggcgugcugcuggagggcagcggccuggcccugagaggccuguucaucaucgaccccaacggcgugaucaagcaccugagcgugaacgaccugcccgugggcagaagcguggaggagacccugagacuggugaaggccuuccaguacguggagacccacggcgaggugugccccgccaacuggacccccgacagccccaccaucaagcccagccccgccgccagcaaggaguacuuccagaaggugaaccaguaa

SEQ ID NO: 21961 - RNA, 816 nt, Artificial Sequence
  PRDX4__Homo_sapiens__NP_006397
auggaggcccugccccugcuggccgccaccacccccgaccacggcagacacagaagacugcugcugcugccccugcugcuguuccugcugcccgccggcgccgugcagggcugggagaccgaggagagacccagaaccagagaggaggagugccacuucuacgccggcggccagguguaccccggcgaggccagcagagugagcguggccgaccacagccugcaccugagcaaggccaagaucagcaagcccgcccccuacugggagggcaccgccgugaucgacggcgaguucaaggagcugaagcugaccgacuacagaggcaaguaccugguguucuucuucuacccccuggacuucaccuucgugugccccaccgagaucaucgccuucggcgacagacuggaggaguucagaagcaucaacaccgaggugguggccugcagcguggacagccaguucacccaccuggccuggaucaacacccccagaagacagggcggccugggccccaucagaaucccccugcugagcgaccugacccaccagaucagcaaggacuacggcguguaccuggaggacagcggccacacccugagaggccuguucaucaucgacgacaagggcauccugagacagaucacccugaacgaccugcccgugggcagaagcguggacgagacccugagacuggugcaggccuuccaguacaccgacaagcacggcgaggugugccccgccggcuggaagcccggcagcgagaccaucauccccgaccccgccggcaagcugaaguacuucgacaagcugaacuaa

SEQ ID NO: 21962 - RNA, 645 nt, Artificial Sequence
  PRDX5__Homo_sapiens__NP_036226
augggccuggccggcgugugcgcccugagaagaagcgccggcuacauccuggugggcggcgccggcggccagagcgccgccgccgccgccagaagaugcagcgagggcgagugggccagcggcggcgugagaagcuucagcagagccgccgccgccauggcccccaucaaggugggcgacgccauccccgccguggagguguucgagggcgagcccggcaacaaggugaaccuggccgagcuguucaagggcaagaagggcgugcuguucggcgugcccggcgccuucacccccggcugcagcaagacccaccugcccggcuucguggagcaggccgaggcccugaaggccaagggcgugcaggugguggccugccugagcgugaacgacgccuucgugaccggcgaguggggcagagcccacaaggccgagggcaaggugagacugcuggccgaccccaccggcgccuucggcaaggagaccgaccugcugcuggacgacagccuggugagcaucuucggcaacagaagacugaagagauucagcaugguggugcaggacggcaucgugaaggcccugaacguggagcccgacggcaccggccugaccugcagccuggcccccaacaucaucagccagcuguaa

SEQ ID NO: 21963 - RNA, 675 nt, Artificial Sequence
  PRDX6__Homo_sapiens__NP_004896
augcccggcggccugcugcugggcgacguggcccccaacuucgaggccaacaccaccgugggcagaaucagauuccacgacuuccugggcgacagcuggggcauccuguucagccaccccagagacuucacccccgugugcaccaccgagcugggcagagccgccaagcuggcccccgaguucgccaagagaaacgugaagcugaucgcccugagcaucgacagcguggaggaccaccuggccuggagcaaggacaucaacgccuacaacugcgaggagcccaccgagaagcugcccuuccccaucaucgacgacagaaacagagagcuggccauccugcugggcaugcuggaccccgccgagaaggacgagaagggcaugcccgugaccgccagagugguguucguguucggccccgacaagaagcugaagcugagcauccuguaccccgccaccaccggcagaaacuucgacgagauccugagaguggugaucagccugcagcugaccgccgagaagagaguggccacccccguggacuggaaggacggcgacagcgugauggugcugcccaccauccccgaggaggaggccaagaagcuguuccccaagggcguguucaccaaggagcugcccagcggcaagaaguaccugagauacaccccccagcccuaa

SEQ ID NO: 21964 - RNA, 1254 nt, Artificial Sequence
  PREB__Homo_sapiens__NP_037520
augggcagaagaagagcccccgagcuguacagagcccccuucccccuguacgcccugcagguggaccccagcaccggccugcugaucgccgccggcggcggcggcgccgccaagaccggcaucaagaacggcgugcacuuccugcagcuggagcugaucaacggcagacugagcgccagccugcugcacagccacgacaccgagaccagagccaccaugaaccuggcccuggccggcgacauccuggccgccggccaggacgcccacugccagcugcugagauuccaggcccaccagcagcagggcaacaaggccgagaaggccggcagcaaggagcagggccccagacagagaaagggcgccgcccccgccgagaagaagugcggcgccgagacccagcacgagggccuggagcugagaguggagaaccugcaggccgugcagaccgacuucagcagcgacccccugcagaagguggugugcuucaaccacgacaacacccugcuggccaccggcggcaccgacggcuacgugagaguguggaaggugcccagccuggagaaggugcuggaguucaaggcccacgagggcgagaucgaggaccuggcccugggccccgacggcaagcuggugaccgugggcagagaccugaaggccagcguguggcagaaggaccagcuggugacccagcugcacuggcaggagaacggccccaccuucagcagcacccccuacagauaccaggccugcagauucggccaggugcccgaccagcccgccggccugagacuguucaccgugcagaucccccacaagagacugagacagcccccccccugcuaccugaccgccugggacggcagcaacuuccugccccugagaaccaagagcugcggccacgagguggugagcugccuggacgugagcgagagcggcaccuuccugggccugggcaccgugaccggcagcguggccaucuacaucgccuucagccugcagugccuguacuacgugagagaggcccacggcaucguggugaccgacguggccuuccugcccgagaagggcagaggccccgagcugcugggcagccacgagaccgcccuguucagcguggccguggacagcagaugccagcugcaccugcugcccagcagaagaagcgugcccguguggcugcugcugcugcugugcgugggccugaucaucgugaccauccugcugcugcagagcgccuuccccggcuuccuguaa

SEQ ID NO: 21965 - RNA, 1149 nt, Artificial Sequence
  PRELP__Homo_sapiens__NP_958505
augagaagcccccugugcuggcugcugccccugcugauccuggccagcguggcccagggccagcccaccagaagacccagacccggcaccggccccggcagaagacccagacccagacccagacccacccccagcuucccccagcccgacgagcccgccgagcccaccgaccugccccccccccugccccccggcccccccagcaucuuccccgacugccccagagagugcuacugcccccccgacuuccccagcgcccuguacugcgacagcagaaaccugagaaaggugcccgugaucccccccagaauccacuaccuguaccugcagaacaacuucaucaccgagcugcccguggagagcuuccagaacgccaccggccugagauggaucaaccuggacaacaacagaaucagaaagaucgaccagagagugcuggagaagcugcccggccugguguuccuguacauggagaagaaccagcuggaggaggugcccagcgcccugcccagaaaccuggagcagcugagacugagccagaaccacaucagcagaaucccccccggcguguucagcaagcuggagaaccugcugcugcuggaccugcagcacaacagacugagcgacggcguguucaagcccgacaccuuccacggccugaagaaccugaugcagcugaaccuggcccacaacauccugagaaagaugccccccagagugcccaccgccauccaccagcuguaccuggacagcaacaagaucgagaccauccccaacggcuacuucaagagcuuccccaaccuggccuucaucagacugaacuacaacaagcugaccgacagaggccugcccaagaacagcuucaacaucagcaaccugcuggugcugcaccugagccacaacagaaucagcagcgugcccgccaucaacaacagacuggagcaccuguaccugaacaacaacagcaucgagaagaucaacggcacccagaucugccccaacgaccugguggccuuccacgacuucagcagcgaccuggagaacgugccccaccugagauaccugagacuggacggcaacuaccugaagccccccaucccccuggaccugaugaugugcuucagacugcugcagagcguggugaucuaa

SEQ ID NO: 21966 - RNA, 2133 nt, Artificial Sequence
  PREP__Homo_sapiens__NP_002717
augcugagccugcaguaccccgacguguacagagacgagaccgccgugcaggacuaccacggccacaagaucugcgaccccuacgccuggcuggaggaccccgacagcgagcagaccaaggccuucguggaggcccagaacaagaucaccgugcccuuccuggagcagugccccaucagaggccuguacaaggagagaaugaccgagcuguacgacuaccccaaguacagcugccacuucaagaagggcaagagauacuucuacuucuacaacaccggccugcagaaccagagagugcuguacgugcaggacagccuggagggcgaggccagaguguuccuggaccccaacauccugagcgacgacggcaccguggcccugagaggcuacgccuucagcgaggacggcgaguacuucgccuacggccugagcgccagcggcagcgacugggugaccaucaaguucaugaagguggacggcgccaaggagcugcccgacgugcuggagagagugaaguucagcugcauggccuggacccacgacggcaagggcauguucuacaacagcuacccccagcaggacggcaagagcgacggcaccgagaccagcaccaaccugcaccagaagcuguacuaccacgugcugggcaccgaccagagcgaggacauccugugcgccgaguuccccgacgagcccaaguggaugggcggcgccgagcugagcgacgacggcagauacgugcugcugagcaucagagagggcugcgaccccgugaacagacugugguacugcgaccugcagcaggagagcagcggcaucgccggcauccugaagugggugaagcugaucgacaacuucgagggcgaguacgacuacgugaccaacgagggcaccguguucaccuucaagaccaacagacagagccccaacuacagagugaucaacaucgacuucagagaccccgaggagagcaaguggaaggugcuggugcccgagcacgagaaggacgugcuggaguggaucgccugcgugagaagcaacuuccuggugcugugcuaccugcacgacgugaagaacauccugcagcugcacgaccugaccaccggcgcccugcugaagaccuucccccuggacgugggcagcaucgugggcuacagcggccagaagaaggacaccgagaucuucuaccaguucaccagcuuccugagccccggcaucaucuaccacugcgaccugaccaaggaggagcuggagcccagaguguucagagaggugaccgugaagggcaucgacgccagcgacuaccagaccgugcagaucuucuaccccagcaaggacggcaccaagauccccauguucaucgugcacaagaagggcaucaagcuggacggcagccaccccgccuuccuguacggcuacggcggcuucaacaucagcaucacccccaacuacagcgugagcagacugaucuucgugagacacaugggcggcauccuggccguggccaacaucagaggcggcggcgaguacggcgagaccuggcacaagggcggcauccuggccaacaagcagaacugcuucgacgacuuccagugcgccgccgaguaccugaucaaggagggcuacaccagccccaagagacugaccaucaacggcggcagcaacggcggccugcugguggccgccugcgccaaccagagacccgaccuguucggcugcgugaucgcccaggugggcgugauggacaugcugaaguuccacaaguacaccaucggccacgccuggaccaccgacuacggcugcagcgacagcaagcagcacuucgaguggcuggugaaguacagcccccugcacaacgugaagcugcccgaggccgacgacauccaguaccccagcaugcugcugcugaccgccgaccacgacgacagaguggugccccugcacagccugaaguucaucgccacccugcaguacaucgugggcagaagcagaaagcagagcaacccccugcugauccacguggacaccaaggccggccacggcgccggcaagcccaccgccaaggugaucgaggaggugagcgacauguucgccuucaucgccagaugccugaacguggacuggauccccuaa

SEQ ID NO: 21967 - RNA, 1998 nt, Artificial Sequence
  PREPL__Homo_sapiens__NP_001035844
augcagcagaagaccaagcuguuccugcaggcccugaaguacagcaucccccaccugggcaagugcaugcagaagcagcaccugaaccacuacaacuucgccgaccacugcuacaacagaaucaagcugaagaaguaccaccugaccaagugccugcagaacaagcccaagaucagcgagcuggccagaaacauccccagcagaagcuucagcugcaaggaccugcagcccgugaagcaggagaacgagaagccccugcccgagaacauggacgccuucgagaaggugagaaccaagcuggagacccagccccaggaggaguacgagaucaucaacguggaggugaagcacggcggcuucguguacuaccaggagggcugcugccuggugagaagcaaggacgaggaggccgacaacgacaacuacgaggugcuguucaaccuggaggagcugaagcuggaccagcccuucaucgacugcaucagaguggcccccgacgagaaguacguggccgccaagaucagaaccgaggacagcgaggccagcaccugcgugaucaucaagcugagcgaccagcccgugauggaggccagcuuccccaacgugagcagcuucgagugggugaaggacgaggaggacgaggacgugcuguucuacaccuuccagagaaaccugagaugccacgacguguacagagccaccuucggcgacaacaagagaaacgagagauucuacaccgagaaggaccccagcuacuucguguuccuguaccugaccaaggacagcagauuccugaccaucaacaucaugaacaagaccaccagcgagguguggcugaucgacggccugagccccugggacccccccgugcugauccagaagagaauccacggcgugcuguacuacguggagcacagagacgacgagcuguacauccugaccaacgugggcgagcccaccgaguucaagcugccccccugggccugcggcuucaucauggacaccaacagcgaccccaagaacugccccuuccagcugugcagccccaucagaccccccaaguacuacaccuacaaguucgccgagggcaagcuguucgaggagaccggccacgaggaccccaucaccaagaccagcagagugcugagacuggaggccaagagcaaggacggcaagcuggugcccaugaccguguuccacaagaccgacagcgaggaccugcagaagaagccccugcuggugcacguguacggcgccuacggcauggaccugaagaugaacuucagacccgagagaagagugcugguggacgacggcuggauccuggccuacugccacgugagaggcggcggcgagcugggccugcaguggcacgccgacggcagacugaccaagaagcugaacggccuggccgaccuggaggccugcaucaagacccugcacggccagggcuucagccagcccagccugaccacccugaccgccuucagcgccggcggcgugcuggccggcgcccugugcaacagcaaccccgagcuggugagagccgugacccuggaggcccccuuccuggacgugcugaacaccaugauggacaccacccugccccugacccuggaggagcuggaggaguggggcaaccccagcagcgacgagaagcacaagaacuacaucaagagauacugccccuaccagaacaucaagccccagcacuaccccagcauccacaucaccgccuacgagaacgacgagagagugccccugaagggcaucgugagcuacaccgagaagcugaaggaggccaucgccgagcacgccaaggacaccggcgagggcuaccagacccccaacaucauccuggacauccagcccggcggcaaccacgugaucgaggacagccacaagaagaucaccgcccagaucaaguuccuguacgaggagcugggccuggacagcaccagcguguucgaggaccugaagaaguaccugaaguucuaa

SEQ ID NO: 21968 - RNA, 4980 nt, Artificial Sequence
  PREX1__Homo_sapiens__NP_065871
auggaggcccccagcggcagcgagcccggcggcgacggcgccggcgacugcgcccaccccgaccccagagcccccggcgccgccgcccccagcagcggccccggccccugcgccgccgccagagagagcgagagacagcugagacugagacugugcgugcugaacgagauccugggcaccgagagagacuacgugggcacccugagauuccugcagagcgccuuccugcacagaaucagacagaacguggccgacagcguggagaagggccugaccgaggagaacgugaaggugcuguucagcaacaucgaggacauccuggaggugcacaaggacuuccuggccgcccuggaguacugccugcaccccgagccccagagccagcacgagcugggcaacguguuccugaaguucaaggacaaguucugcguguacgaggaguacugcagcaaccacgagaaggcccugagacugcugguggagcugaacaagauccccaccgugagagccuuccugcugagcugcaugcugcugggcggcagaaagaccaccgacaucccccuggagggcuaccugcugagccccauccagagaaucugcaaguacccccugcugcugaaggagcuggccaagagaacccccggcaagcaccccgaccaccccgccgugcagagcgcccugcaggccaugaagaccgugugcagcaacaucaacgagaccaagagacagauggagaagcuggaggcccuggagcagcugcagagccacaucgagggcugggagggcagcaaccugaccgacaucugcacccagcugcugcugcagggcacccugcugaagaucagcgccggcaacauccaggagagagccuucuuccuguucgacaaccugcugguguacugcaagagaaagagcagagugaccggcagcaagaagagcaccaagagaaccaagagcaucaacggcagccuguacaucuucagaggcagaaucaacaccgaggugauggagguggagaacguggaggacggcaccgccgacuaccacagcaacggcuacaccgugaccaacggcuggaagauccacaacaccgccaagaacaagugguucgugugcauggccaagaccgccgaggagaagcagaaguggcuggacgccaucaucagagagagagagcagagagagagccugaagcugggcauggagagagacgccuacgugaugaucgccgagaagggcgagaagcuguaccacaugaugaugaacaagaaggugaaccugaucaaggacagaagaagaaagcugagcaccgugcccaagugcuuccugggcaacgaguucguggccuggcugcuggagaucggcgagaucagcaagaccgaggagggcgugaaccugggccaggcccugcuggagaacggcaucauccaccacgugagcgacaagcaccaguucaagaacgagcaggugauguacagauucagauacgacgacggcaccuacaaggccagaagcgagcuggaggacaucaugagcaagggcgugagacuguacugcagacugcacagccuguacacccccgugaucaaggacagagacuaccaccugaagaccuacaagagcgugcugcccggcagcaagcugguggacuggcugcuggcccagggcgacugccagaccagagaggaggccguggcccugggcgugggccugugcaacaacggcuucaugcaccacgugcuggagaagagcgaguucagagacgagagccaguacuucagauuccacgccgacgaggagauggagggcaccagcagcaagaacaagcagcugagaaacgacuucaagcugguggagaacauccuggccaagagacugcugauccugccccaggaggaggacuacggcuucgacaucgaggagaagaacaaggccgugguggugaagagcgugcagagaggcagccuggccgagguggccggccugcaggugggcagaaagaucuacagcaucaacgaggaccugguguuccugagacccuucagcgagguggagagcauccugaaccagagcuucugcagcagaagaccccugagacugcugguggccaccaaggccaaggagaucaucaagauccccgaccagcccgacacccugugcuuccagaucagaggcgccgccccccccuacguguacgccgugggcagaggcagcgaggccauggccgccggccugugcgccggccagugcauccugaaggugaacggcagcaacgugaugaacgacggcgcccccgaggugcuggagcacuuccaggccuucagaagcagaagagaggaggcccugggccuguaccaguggaucuaccacacccacgaggacgcccaggaggccagagccagccaggaggccagcaccgaggaccccagcggcgagcaggcccaggaggaggaccaggccgacagcgccuucccccugcugagccugggccccagacugagccugugcgaggacagccccauggugacccugaccguggacaacgugcaccuggagcacggcgugguguacgaguacgugagcaccgccggcgugagaugccacgugcuggagaagaucguggagcccagaggcugcuucggccugaccgccaagauccuggaggccuucgccgccaacgacagcguguucguggagaacugcagaagacugauggcccugagcagcgccaucgugaccaugccccacuucgaguucagaaacaucugcgacaccaagcuggagagcaucggccagagaaucgccugcuaccaggaguucgccgcccagcugaagagcagagugagcccccccuucaagcaggccccccuggagccccacccccugugcggccuggacuucugccccaccaacugccacaucaaccugauggaggugagcuaccccaagaccacccccagcgugggcagaagcuucagcaucagauucggcagaaagcccagccugaucggccuggaccccgagcagggccaccugaaccccaugagcuacacccagcacugcaucaccaccauggccgcccccagcuggaagugccugcccgccgccgagggcgacccccagggccagggccugcacgacggcagcuucggccccgccagcggcacccugggccaggaggacagaggccugagcuuccugcugaagcaggaggacagagagauccaggacgccuaccugcagcuguucaccaagcuggacguggcccugaaggagaugaagcaguacgugacccagaucaacagacugcugagcaccaucaccgagcccaccagcggcggcagcugcgacgccagccuggccgaggaggccagcagccugccccuggugagcgaggagagcgagauggacagaagcgaccacggcggcaucaagaaggugugcuucaagguggccgaggaggaccaggaggacagcggccacgacaccaugagcuacagagacagcuacagcgagugcaacagcaacagagacagcgugcugagcuacaccagcgugagaagcaacagcagcuaccugggcagcgacgagaugggcagcggcgacgagcugcccugcgacaugagaauccccagcgacaagcaggacaagcugcacggcugccuggagcaccuguucaaccagguggacagcaucaacgcccugcugaagggccccgugaugagcagagccuucgaggagaccaagcacuuccccaugaaccacagccugcaggaguucaagcagaaggaggagugcaccaucagaggcagaagccugauccagaucagcauccaggaggaccccuggaaccugcccaacagcaucaagacccugguggacaacauccagagauacguggaggacggcaagaaccagcugcugcuggcccugcugaagugcaccgacaccgagcugcagcugagaagagacgccaucuucugccaggcccugguggccgccgugugcaccuucagcgagcagcugcuggccgcccugggcuacagauacaacaacaacggcgaguacgaggagagcagcagagacgccagcagaaaguggcuggagcagguggccgccaccggcgugcugcugcacugccagagccugcugagccccgccaccgugaaggaggagagaaccaugcuggaggacaucugggugacccugagcgagcuggacaacgugaccuucagcuucaagcagcuggacgagaacuacguggccaacaccaacguguucuaccacaucgagggcagcagacaggcccugaaggugaucuucuaccuggacagcuaccacuucagcaagcugcccagcagacuggagggcggcgccagccugagacugcacaccgcccuguucaccaaggugcuggagaacguggagggccugcccagccccggcagccaggccgccgaggaccugcagcaggacaucaacgcccagagccuggagaaggugcagcaguacuacagaaagcugagagccuucuaccuggagagaagcaaccugcccaccgacgccagcaccaccgccgugaagaucgaccagcugaucagacccaucaacgcccuggacgagcugugcagacugaugaagagcuucgugcaccccaagcccggcgccgccggcagcgugggcgccggccugauccccaucagcagcgagcugugcuacagacugggcgccugccagauggugaugugcggcaccggcaugcagagaagcacccugagcgugagccuggagcaggccgccauccuggccagaagccacggccugcugcccaagugcaucaugcaggccaccgacaucaugagaaagcagggccccagaguggagauccuggccaagaaccugagagugaaggaccagaugccccagggcgcccccagacuguacagacugugccagccccccguggacggcgaccuguaa

SEQ ID NO: 21969 - RNA, 4821 nt, Artificial Sequence
  PREX2__Homo_sapiens__NP_079146
augagcgaggacagcagaggcgacagcagagccgagagcgccaaggaccuggagaagcagcugagacugagagugugcgugcugagcgagcugcagaagaccgagagagacuacgugggcacccuggaguuccuggugagcgccuuccugcacagaaugaaccagugcgccgccagcaagguggacaagaacgugaccgaggagaccgugaagaugcuguucagcaacaucgaggacauccuggccgugcacaaggaguuccugaaggugguggaggagugccugcaccccgagcccaacgcccagcaggaggugggcaccugcuuccugcacuucaaggacaaguucagaaucuacgacgaguacugcagcaaccacgagaaggcccagaagcugcugcuggagcugaacaagaucagaaccaucagaaccuuccugcugaacugcaugcugcugggcggcagaaagaacaccgacgugccccuggagggcuaccuggugacccccauccagagaaucugcaaguacccccugauccugaaggagcugcugaagagaacccccagaaagcacagcgacuacgccgccgugauggaggcccugcaggccaugaaggccgugugcagcaacaucaacgaggccaagagacagauggagaagcuggaggugcuggaggaguggcagagccacaucgagggcugggagggcagcaacaucaccgacaccugcaccgagaugcugaugugcggcgugcugcugaagaucagcagcggcaacauccaggagagaguguucuuccuguucgacaaccugcugguguacugcaagagaaagcacagaagacugaagaacagcaaggccagcaccgacggccacagauaccuguucagaggcagaaucaacaccgaggugauggagguggagaacguggacgacggcaccgccgacuuccacagcagcggccacaucguggugaacggcuggaagauccacaacaccgccaagaacaagugguucgugugcauggccaagacccccgaggagaagcacgagugguucgaggccauccugaaggagagagagagaagaaagggccugaagcugggcauggagcaggacaccugggugaugaucagcgagcagggcgagaagcuguacaagaugaugugcagacagggcaaccugaucaaggacagaaagagaaagcugaccaccuuccccaagugcuuccugggcagcgaguucgugagcuggcugcuggagaucggcgagauccacagacccgaggagggcgugcaccugggccaggcccugcuggagaacggcaucauccaccacgugaccgacaagcaccaguucaagcccgagcagaugcuguacagauucagauacgacgacggcaccuucuaccccagaaacgagaugcaggacgugaucagcaagggcgugagacuguacugcagacugcacagccuguucacccccgugaucagagacaaggacuaccaccugagaaccuacaagagcguggugauggccaacaagcugaucgacuggcugaucgcccagggcgacugcagaaccagagaggaggccaugaucuucggcgugggccugugcgacaacggcuucaugcaccacgugcuggagaagagcgaguucaaggacgagccccugcuguucagauucuucagcgacgaggagauggagggcagcaacaugaagcacagacugaugaagcacgaccugaaggugguggagaacgugaucgccaagagccugcugaucaagagcaacgagggcagcuacggcuucggccuggaggacaagaacaaggugcccaucaucaagcugguggagaagggcagcaacgccgagauggccggcauggaggugggcaagaagaucuucgccaucaacggcgaccugguguucaugagacccuucaacgagguggacugcuuccugaagagcugccugaacagcagaaagccccugagagugcuggugagcaccaagcccagagagaccgugaagauccccgacagcgccgacggccugggcuuccagaucagaggcuucggccccagcguggugcacgccgugggcagaggcaccguggccgccgccgccggccugcaccccggccagugcaucaucaaggugaacggcaucaacgugagcaaggagacccacgccagcgugaucgcccacgugaccgccugcagaaaguacagaagacccaccaagcaggacagcauccaguggguguacaacagcaucgagagcgcccaggaggaccugcagaagagccacagcaagccccccggcgacgaggccggcgacgccuucgacugcaagguggaggaggugaucgacaaguucaacaccauggccaucaucgacggcaagaaggagcacgugagccugaccguggacaacgugcaccuggaguacggcgugguguacgaguacgacagcaccgccggcaucaagugcaacgugguggagaagaugaucgagcccaagggcuucuucagccugaccgccaagauccuggaggcccuggccaagagcgacgagcacuucgugcagaacugcaccagccugaacagccugaacgaggugauccccaccgaccugcagagcaaguucagcgcccugugcagcgagagaaucgagcaccugugccagagaaucagcagcuacaagaaguucagcagagugcugaagaacagagccuggcccaccuucaagcaggccaagagcaagaucagcccccugcacagcagcgacuucugccccaccaacugccacgugaacgugauggaggugagcuaccccaagaccagcaccagccugggcagcgccuucggcgugcagcuggacagcagaaagcacaacagccacgacaaggagaacaagagcagcgagcagggcaagcugagccccaugguguacauccagcacaccaucaccaccauggccgcccccagcggccugagccugggccagcaggacggccacggccugagauaccugcugaaggaggaggaccuggagacccaggacaucuaccagaagcugcugggcaagcugcagaccgcccugaaggagguggagaugugcgugugccagaucgacgaccugcugagcagcaucaccuacagccccaagcuggagagaaagaccagcgagggcaucauccccaccgacagcgacaacgagaagggcgagagaaacagcaagagagugugcuucaacguggccggcgacgagcaggaggacagcggccacgacaccaucagcaacagagacagcuacagcgacugcaacagcaacagaaacagcaucgccagcuucaccagcaucugcagcagccagugcagcagcuacuuccacagcgacgagauggacagcggcgacgagcugccccugagcgugagaaucagccacgacaagcaggacaagauccacagcugccuggagcaccuguucagccagguggacagcaucaccaaccugcugaagggccaggccguggugagagccuucgaccagaccaaguaccugacccccggcagaggccugcaggaguuccagcaggagauggagcccaagcugagcugccccaagagacugagacugcacaucaagcaggaccccuggaaccugcccagcagcgugagaacccuggcccagaacaucagaaaguucguggaggaggugaagugcagacugcugcuggcccugcuggaguacagcgacagcgagacccagcugagaagagacaugguguucugccagacccugguggccaccgugugcgccuucagcgagcagcugauggccgcccugaaccagauguucgacaacagcaaggagaacgagauggagaccugggaggccagcagaagauggcuggaccagaucgccaacgccggcgugcuguuccacuuccagagccugcugagccccaaccugaccgacgagcaggccaugcuggaggacacccugguggcccuguucgaccuggagaaggugagcuucuacuucaagcccagcgaggaggagccccugguggccaacgugccccugaccuaccaggccgagggcagcagacaggcccugaagguguacuucuacaucgacagcuaccacuucgagcagcugccccagagacugaagaacggcggcggcuucaagauccaccccgugcuguucgcccaggcccuggagagcauggagggcuacuacuacagagacaacgugagcguggaggaguuccaggcccagaucaacgccgccagccuggagaaggugaagcaguacaaccagaagcugagagccuucuaccuggacaagagcaacagcccccccaacagcaccagcaaggccgccuacguggacaagcugaugagaccccugaacgcccuggacgagcuguacagacugguggccagcuucaucagaagcaagagaaccgccgccugcgccaacaccgccugcagcgccagcggcgugggccugcugagcgugagcagcgagcugugcaacagacugggcgccugccacaucaucaugugcagcagcggcgugcacagaugcacccugagcgugacccuggagcaggccaucauccuggccagaagccacggccugccccccagauacaucaugcaggccaccgacgugaugagaaagcagggcgccagagugcagaacaccgccaagaaccugggcgugagagacagaaccccccagagcgcccccagacuguacaagcugugcgagccccccccccccgccggcgaggaguaa

SEQ ID NO: 21970 - RNA, 1668 nt, Artificial Sequence
  PRF1__Homo_sapiens__NP_001076585
auggccgccagacugcugcugcugggcauccugcugcugcugcugccccugcccgugcccgcccccugccacaccgccgccagaagcgagugcaagagaagccacaaguucgugcccggcgccuggcuggccggcgagggcguggacgugaccagccugagaagaagcggcagcuuccccguggacacccagagauuccugagacccgacggcaccugcacccugugcgagaacgcccugcaggagggcacccugcagagacugccccuggcccugaccaacuggagagcccagggcagcggcugccagagacacgugaccagagccaaggugagcagcaccgaggccguggccagagacgccgccagaagcaucagaaacgacuggaaggugggccuggacgugacccccaagcccaccagcaacgugcacgugagcguggccggcagccacagccaggccgccaacuucgccgcccagaagacccaccaggaccaguacagcuucagcaccgacaccguggagugcagauucuacagcuuccacguggugcacacccccccccugcaccccgacuucaagagagcccugggcgaccugccccaccacuucaacgccagcacccagcccgccuaccugagacugaucagcaacuacggcacccacuucaucagagccguggagcugggcggcagaaucagcgcccugaccgcccugagaaccugcgagcuggcccuggagggccugaccgacaacgagguggaggacugccugaccguggaggcccaggugaacaucggcauccacggcagcaucagcgccgaggccaaggccugcgaggagaagaagaagaagcacaagaugaccgccagcuuccaccagaccuacagagagagacacagcgagguggugggcggccaccacaccagcaucaacgaccugcuguucggcauccaggccggccccgagcaguacagcgccugggugaacagccugcccggcagccccggccugguggacuacacccuggagccccugcacgugcugcuggacagccaggaccccagaagagaggcccugagaagagcccugagccaguaccugaccgacagagccagauggagagacugcagcagacccugcccccccggcagacagaagagccccagagaccccugccagugcgugugccacggcagcgccgugaccacccaggacugcugccccagacagagaggccuggcccagcuggaggugaccuucauccaggccuggggccuguggggcgacugguucaccgccaccgacgccuacgugaagcuguucuucggcggccaggagcugagaaccagcaccgugugggacaacaacaaccccaucuggagcgugagacuggacuucggcgacgugcugcuggccaccggcggcccccugagacugcaggugugggaccaggacagcggcagagacgacgaccugcugggcaccugcgaccaggcccccaagagcggcagccacgaggugagaugcaaccugaaccacggccaccugaaguucagauaccacgccagaugccugccccaccugggcggcggcaccugccuggacuacgugccccagaugcugcugggcgagccccccggcaacagaagcggcgccgugugguaa

SEQ ID NO: 21971 - RNA, 636 nt, Artificial Sequence
  PRG2__Homo_sapiens__NP_001230174
augaagcugccccugcugcuggcccugcuguucggcgccgugagcgcccugcaccugagaagcgagaccagcaccuucgagaccccccugggcgccaagacccugcccgaggacgaggagacccccgagcaggagauggaggagacccccugcagagagcuggaggaggaggaggaguggggcagcggcagcgaggacgccagcaagaaggacggcgccguggagagcaucagcgugcccgacaugguggacaagaaccugaccugccccgaggaggaggacaccgugaagguggugggcauccccggcugccagaccugcagauaccugcuguucaccugcagaagaugcuacagaggcaaccuggugagcauccacaacuucaacaucaacuacagaauccagugcagcgugagcgcccugaaccagggccagguguggaucggcggcagaaucaccggcagcggcagaugcagaagauuccaguggguggacggcagcagauggaacuucgccuacugggccgcccaccagcccuggagcagaggcggccacugcguggcccugugcaccagaggcggccacuggagaagagcccacugccugagaagacugcccuucaucugcagcuacuaa

SEQ ID NO: 21972 - RNA, 4092 nt, Artificial Sequence
  PRG4__Homo_sapiens__NP_001121180
auggccuggaagacccugcccaucuaccugcugcugcugcugagcguguucgugauccagcaggugagcagccaggagcugagcugcaagggcagaugcuucgagagcuucgagagaggcagagagugcgacugcgacgcccagugcaagaaguacgacaagugcugccccgacuacgagagcuucugcgccgaggugcacaaccccaccagcccccccagcagcaagaaggcccccccccccagcggcgccagccagaccaucaagagcaccaccaagagaagccccaagccccccaacaagaagaagaccaagaaggugaucgagagcgaggagaucaccgaggagcacagcgugagcgagaaccaggagagcagcagcagcagcagcagcagcagcagcagcagcaccaucagaaagaucaagagcagcaagaacagcgccgccaacagagagcugcagaagaagcugaaggugaaggacaacaagaagaacagaaccaagaagaagcccacccccaagccccccgugguggacgaggccggcagcggccuggacaacggcgacuucaaggugaccacccccgacaccagcaccacccagcacaacaaggugagcaccagccccaagaucaccaccgccaagcccaucaaccccagacccagccugccccccaacagcgacaccagcaaggagaccagccugaccgugaacaaggagaccaccguggagaccaaggagaccaccaccaccaacaagcagaccagcaccgacggcaaggagaagaccaccagcgccaaggagacccagagcaucgagaagaccagcgccaaggaccuggcccccaccagcaaggugcuggccaagcccacccccaaggccgagaccaccaccaagggccccgcccugaccacccccaaggagcccacccccaccacccccaaggagcccgccagcaccacccccaaggagcccacccccaccaccaucaagagcgcccccaccacccccaaggagcccgcccccaccaccaccaagagcgcccccaccacccccaaggagcccgcccccaccaccaccaaggagcccgcccccaccacccccaaggagcccgcccccaccaccaccaaggagcccgcccccaccaccaccaagagcgcccccaccacccccaaggagcccgcccccaccacccccaagaagcccgcccccaccacccccaaggagcccgcccccaccacccccaaggagcccacccccaccacccccaaggagcccgcccccaccaccaaggagcccgcccccaccacccccaaggagcccgcccccaccgcccccaagaagcccgcccccaccacccccaaggagcccgcccccaccacccccaaggagcccgcccccaccaccaccaaggagcccagccccaccacccccaaggagcccgcccccaccaccaccaagagcgcccccaccaccaccaaggagcccgcccccaccaccaccaagagcgcccccaccacccccaaggagcccagccccaccaccaccaaggagcccgcccccaccacccccaaggagcccgcccccaccacccccaagaagcccgcccccaccacccccaaggagcccgcccccaccacccccaaggagcccgcccccaccaccaccaagaagcccgcccccaccacccccaaggagcccgcccccaccacccccaaggagaccgcccccaccacccccaagaagcugacccccaccacccccgagaagcuggcccccaccacccccgagaagcccgcccccaccacccccgaggagcuggcccccaccacccccgaggagcccacccccaccacccccgaggagcccgcccccaccacccccaaggccgccgcccccaacacccccaaggagcccgcccccaccacccccaaggagcccgcccccaccacccccaaggagcccgcccccaccacccccaaggagaccgcccccaccacccccaagggcaccgcccccaccacccugaaggagcccgcccccaccacccccaagaagcccgcccccaaggagcuggcccccaccaccaccaaggagcccaccagcaccaccagcgacaagcccgcccccaccacccccaagggcaccgcccccaccacccccaaggagcccgcccccaccacccccaaggagcccgcccccaccacccccaagggcaccgcccccaccacccugaaggagcccgcccccaccacccccaagaagcccgcccccaaggagcuggcccccaccaccaccaagggccccaccagcaccaccagcgacaagcccgcccccaccacccccaaggagaccgcccccaccacccccaaggagcccgcccccaccacccccaagaagcccgcccccaccacccccgagacccccccccccaccaccagcgaggugagcacccccaccaccaccaaggagcccaccaccauccacaagagccccgacgagagcacccccgagcugagcgccgagcccacccccaaggcccuggagaacagccccaaggagcccggcgugcccaccaccaagacccccgccgccaccaagcccgagaugaccaccaccgccaaggacaagaccaccgagagagaccugagaaccacccccgagaccaccaccgccgcccccaagaugaccaaggagaccgccaccaccaccgagaagaccaccgagagcaagaucaccgccaccaccacccaggugaccagcaccaccacccaggacaccacccccuucaagaucaccacccugaagaccaccacccuggcccccaaggugaccaccaccaagaagaccaucaccaccaccgagaucaugaacaagcccgaggagaccgccaagcccaaggacagagccaccaacagcaaggccaccacccccaagccccagaagcccaccaaggcccccaagaagcccaccagcaccaagaagcccaagaccaugcccagagugagaaagcccaagaccacccccacccccagaaagaugaccagcaccaugcccgagcugaaccccaccagcagaaucgccgaggccaugcugcagaccaccaccagacccaaccagacccccaacagcaagcugguggaggugaaccccaagagcgaggacgccggcggcgccgagggcgagaccccccacaugcugcugagaccccacguguucaugcccgaggugacccccgacauggacuaccugcccagagugcccaaccagggcaucaucaucaaccccaugcugagcgacgagaccaacaucugcaacggcaagcccguggacggccugaccacccugagaaacggcacccugguggccuucagaggccacuacuucuggaugcugagccccuucagcccccccagccccgccagaagaaucaccgagguguggggcauccccagccccaucgacaccguguucaccagaugcaacugcgagggcaagaccuucuucuucaaggacagccaguacuggagauucaccaacgacaucaaggacgccggcuaccccaagcccaucuucaagggcuucggcggccugaccggccagaucguggccgcccugagcaccgccaaguacaagaacuggcccgagagcguguacuucuucaagagaggcggcagcauccagcaguacaucuacaagcaggagcccgugcagaagugccccggcagaagacccgcccugaacuaccccguguacggcgagaccacccaggugagaagaagaagauucgagagagccaucggccccagccagacccacaccaucagaauccaguacagccccgccagacuggccuaccaggacaagggcgugcugcacaacgaggugaaggugagcauccuguggagaggccugcccaacguggugaccagcgccaucagccugcccaacaucagaaagcccgacggcuacgacuacuacgccuucagcaaggaccaguacuacaacaucgacgugcccagcagaaccgccagagccaucaccaccagaagcggccagacccugagcaaggugugguacaacugccccuaa

SEQ ID NO: 21973 - RNA, 564 nt, Artificial Sequence
  PRH1__Homo_sapiens__NP_001278243
augcugcugauccugcugagcguggcccugcuggccuucagcagcgcccaggaccugaacgaggacgugagccaggaggacgugccccuggugaucagcgacggcggcgacagcgagcaguuccuggacgaggagagacagggccccccccugggcggccagcagagccagcccagcgccggcgacggcaaccaggacgacggcccccagcagggccccccccagcagggcggccagcagcagcagggccccccccccccccagggcaagccccagggccccccccagcagggcggccagcagcagcagggccccccccccccccagggcaagccccagggccccccccagcagggcggccaccccccccccccccagggcagaccccagggccccccccagcagggcggccaccccagaccccccagaggcagaccccagggccccccccagcagggcggccaccagcagggcccccccccccccccccccggcaagccccagggcccccccccccagggcggcagaccccagggccccccccagggccagagcccccaguaa

SEQ ID NO: 21974 - RNA, 501 nt, Artificial Sequence
  PRH2__Homo_sapiens__NP_001103683
augcugcugauccugcugagcguggcccugcuggccuucagcagcgcccaggaccuggacgaggacgugagccaggaggacgugccccuggugaucagcgacggcggcgacagcgagcaguucaucgacgaggagagacagggccccccccugggcggccagcagagccagcccagcgccggcgacggcaaccagaacgacggcccccagcagggccccccccagcagggcggccagcagcagcagggccccccccccccccagggcaagccccagggccccccccagcagggcggccaccccccccccccccagggcagaccccagggccccccccagcagggcggccaccccagaccccccagaggcagaccccagggccccccccagcagggcggccaccagcagggcccccccccccccccccccggcaagccccagggcccccccccccagggcggcagaccccagggccccccccagggccagagcccccaguaa

SEQ ID NO: 21975 - RNA, 2496 nt, Artificial Sequence
  PRICKLE1__Homo_sapiens__NP_001138354
augccccuggagauggagcccaagaugagcaagcuggccuucggcugccagagaagcagcaccagcgacgacgacagcggcugcgcccuggaggaguacgccugggugccccccggccugagacccgagcagauccagcuguacuucgccugccugcccgaggagaaggugcccuacgugaacagccccggcgagaagcacagaaucaagcagcugcuguaccagcugcccccccacgacaacgaggugagauacugccagagccugagcgaggaggagaagaaggagcugcagguguucagcgcccagagaaagaaggaggcccugggcagaggcaccaucaagcugcugagcagagccgugaugcacgccgugugcgagcagugcggccugaagaucaacggcggcgagguggccguguucgccagcagagccggccccggcgugugcuggcaccccagcugcuucgugugcuucaccugcaacgagcugcugguggaccugaucuacuucuaccaggacggcaagauccacugcggcagacaccacgccgagcugcugaagcccagaugcagcgccugcgacgagaucaucuucgccgacgagugcaccgaggccgagggcagacacuggcacaugaagcacuucugcugccuggagugcgagaccgugcugggcggccagagauacaucaugaaggacggcagacccuucugcugcggcugcuucgagagccuguacgccgaguacugcgagaccugcggcgagcacaucggcguggaccacgcccagaugaccuacgacggccagcacuggcacgccaccgaggccugcuucagcugcgcccagugcaaggccagccugcugggcugccccuuccugcccaagcagggccagaucuacugcagcaagaccugcagccugggcgaggacgugcacgccagcgacagcagcgacagcgccuuccagagcgccagaagcagagacagcagaagaagcgugagaaugggcaagagcagcagaagcgccgaccagugcagacagagccugcugcugagccccgcccugaacuacaaguuccccggccugagcggcaacgccgacgacacccugagcagaaagcuggacgaccugagccugagcagacagggcaccagcuucgccagcgaggaguucuggaagggcagaguggagcaggagacccccgaggaccccgaggagugggccgaccacgaggacuacaugacccagcugcugcugaaguucggcgacaagagccuguuccagccccagcccaacgagauggacaucagagccagcgagcacuggaucagcgacaacauggugaagagcaagaccgagcugaagcagaacaaccagagccuggccagcaagaaguaccagagcgacauguacugggcccagagccaggacggccugggcgacagcgccuacggcagccaccccggccccgccagcagcagaagacugcaggagcuggagcuggaccacggcgccagcggcuacaaccacgacgagacccagugguacgaggacagccuggagugccugagcgaccugaagcccgagcagagcgugagagacagcauggacagccuggcccugagcaacaucaccggcgccagcguggacggcgagaacaagcccagacccagccuguacagccugcagaacuucgaggagauggagaccgaggacugcgagaagaugagcaacaugggcacccugaacagcagcaugcugcacagaagcgccgagagccugaagagccugagcagcgagcugugccccgagaagauccugcccgaggagaagcccgugcaccugcccgugcugagaagaagcaagagccagagcagaccccagcaggugaaguucagcgacgacgugaucgacaacggcaacuacgacaucgagaucagacagccccccaugagcgagagaaccagaagaagaguguacaacuucgaggagagaggcagcagaagccaccaccacagaagaagaagaagcagaaagagcagaagcgacaacgcccugaaccuggugaccgagagaaaguacagccccaaggacagacugagacuguacacccccgacaacuacgagaaguucauccagaacaagagcgccagagagauccaggccuacauccagaacgccgaccuguacggccaguacgcccacgccaccagcgacuacggccugcagaaccccggcaugaacagauuccugggccuguacggcgaggacgacgacagcuggugcagcagcagcagcagcagcagcgacagcgaggaggagggcuacuuccugggccagcccaucccccagcccagaccccagagauucgccuacuacaccgacgaccugagcagcccccccagcgcccugcccaccccccaguucggccagagaaccaccaagagcaagaagaagaagggccacaagggcaagaacugcaucaucagcuaa

SEQ ID NO: 21976 - RNA, 2535 nt, Artificial Sequence
  PRICKLE2__Homo_sapiens__NP_942559
auggugaccgugaugccccuggagauggagaagaccaucagcaagcugauguucgacuuccagagaaacagcaccagcgacgacgacagcggcugcgcccuggaggaguacgccugggugccccccggccugaagcccgagcaggugcaccaguacuacagcugccugcccgaggagaaggugcccuacgugaacagccccggcgagaagcugagaaucaagcagcugcugcaccagcugcccccccacgacaacgaggugagauacugcaacagccuggacgaggaggagaagagagagcugaagcuguucagcagccagagaaagagagagaaccugggcagaggcaacgugagacccuuccccgugaccaugaccggcgccaucugcgagcagugcggcggccagaucaacggcggcgacaucgccguguucgccagcagagccggccacggcgugugcuggcacccccccugcuucgugugcaccgugugcaacgagcugcugguggaccugaucuacuucuaccaggacggcaagaucuacugcggcagacaccacgccgagugccugaagcccagaugcgccgccugcgacgagaucaucuucgccgacgagugcaccgaggccgagggcagacacuggcacaugaagcacuucugcugcuucgagugcgagaccgugcugggcggccagagauacaucaugaaggagggcagacccuacugcugccacugcuucgagagccuguacgccgaguacugcgacaccugcgcccagcacaucggcaucgaccagggccagaugaccuacgacggccagcacuggcacgccaccgagaccugcuucugcugcgcccacugcaagaagagccugcugggcagacccuuccugcccaagcagggccagaucuucugcagcagagccugcagcgccggcgaggaccccaacggcagcgacagcagcgacagcgccuuccagaacgccagagccaaggagagcagaagaagcgccaagaucggcaagaacaagggcaagaccgaggagcccaugcugaaccagcacagccagcugcaggugagcagcaacagacugagcgccgacguggacccccugagccugcagauggacaugcugagccugagcagccagacccccagccugaacagagaccccaucuggagaagcagagaggagcccuaccacuacggcaacaagauggagcagaaccagacccagagcccccugcagcugcugagccagugcaacaucagaaccagcuacagccccggcggccagggcgccggcgcccagcccgagauguggggcaagcacuucagcaaccccaagagaagcagcagccuggccaugaccggccacgccggcagcuucaucaaggagugcagagaggacuacuaccccggcagacugagaagccaggagagcuacagcgacaugagcagccagagcuucagcgagaccagaggcagcauccaggugcccaaguacgaggaggaggaggaggaggagggcggccugagcacccagcagugcagaaccagacaccccaucagcagccugaaguacaccgaggacaugacccccaccgagcagacccccagaggcagcauggagagccuggcccugagcaacgccaccggccugagcgccgacggcggcgccaagagacaggagcaccugagcagauucagcaugcccgaccugagcaaggacagcggcaugaacgugagcgagaagcugagcaacaugggcacccugaacagcagcaugcaguucagaagcgccgagagcgugagaagccugcugagcgcccagcaguaccaggagauggagggcaaccugcaccagcugagcaaccccaucggcuacagagaccugcagagccacggcagaaugcaccagagcuucgacuucgacggcggcauggccggcagcaagcugcccggccaggagggcgugagaauccagcccaugagcgagagaaccagaagaagagccaccagcagagacgacaacagaagauucagaccccacagaagcagaagaagcagaagaagcagaagcgacaacgcccugcaccuggccagcgagagagaggccaucagcagacugaaggacagacccccccugagagccagagaggacuacgaccaguucaugagacagagaagcuuccaggagagcaugggccacggcagcagaagagaccuguacggccagugccccagaaccgugagcgaccuggcccugcagaacgccuucggcgacagauggggccccuacuucgccgaguacgacuggugcagcaccugcagcagcagcagcgagagcgacaacgagggcuacuuccugggcgagcccaucccccagcccgccagacugagauacgugaccagcgacgagcugcugcacaaguacagcagcuacggccugcccaagagcagcacccugggcggcagaggccagcugcacagcagaaagagacagaagagcaagaacugcaucaucagcuaa

SEQ ID NO: 21977 - RNA, 1155 nt, Artificial Sequence
  PRICKLE4__Homo_sapiens__NP_037529
augagcgugcagaacagcggcuggccccaccaggaggacagccccaagccccaggaccccggcccccccgccaacagcgacagcgacagcggccaccugcccggcgaggaccccgaggacacccacgcccagggccccgccgugcugagccugggcagccugugccuggacaccaaccaggcccccaacuggaccggccugcagacccugcugcagcagcugcccccccaggacaucgacgagagauacugccuggcccugggcgaggaggagagagccgagcugcagcuguucugcgccagaagaaagcaggaggcccugggccagggcguggccagacuggugcugcccaagcuggagggccacaccugcgagaagugcagagagcugcugaagcccggcgaguacggcguguucgccgccagagccggcgagcagagaugcuggcaccagcccugcuucgccugccaggccugcggccaggcccugaucaaccugaucuacuucuaccacgacggccagcuguacugcggcagacaccacgccgagcugcugagacccagaugccccgccugcgaccagcugaucuucagcuggagaugcaccgaggccgagggccagagauggcacgagaaccacuucugcugccaggacugcgccggcccccugggcggcggcagauacgcccugcccggcggcagccccugcugccccagcugcuucgagaacagauacagcgacgccggcagcagcugggccggcgcccuggagggccaggccuuccugggcgagaccggccuggacagaaccgagggcagagaccagaccagcgugaacagcgccacccugagcagaacccugcuggccgccgccggcggcagcagccugcagacccagagaggccugcccggcagcagcccccagcaggagaacagacccggcgacaaggccgaggcccccaagggccaggagcagugcagacuggagaccaucagagaccccaaggacacccccuucagcaccugcagcagcagcagcgacagcgagcccgagggcuucuuccugggcgagagacugccccagagcuggaagacccccggcagccugcaggccgaggacagcaacgccagcaagacccacugcaccaugugcuaa

SEQ ID NO: 21978 - RNA, 1263 nt, Artificial Sequence
  PRIM1__Homo_sapiens__NP_000937
auggagaccuucgaccccaccgagcugcccgagcugcugaagcuguacuacagaagacuguuccccuacagccaguacuacagauggcugaacuacggcggcgugaucaagaacuacuuccagcacagagaguucagcuucacccugaaggacgacaucuacaucagauaccagagcuucaacaaccagagcgaccuggagaaggagaugcagaagaugaaccccuacaagaucgacaucggcgccguguacagccacagacccaaccagcacaacaccgugaagcugggcgccuuccaggcccaggagaaggagcugguguucgacaucgacaugaccgacuacgacgacgugagaagaugcugcagcagcgccgacaucugccccaagugcuggacccugaugaccauggccaucagaaucaucgacagagcccugaaggaggacuucggcuucaagcacagacuguggguguacagcggcagaagaggcgugcacugcugggugugcgacgagagcgugagaaagcugagcagcgccgugagaagcggcaucguggaguaccugagccuggugaagggcggccaggacgugaagaagaaggugcaccugagcgagaagauccaccccuucaucagaaagagcaucaacaucaucaagaaguacuucgaggaguacgcccuggugaaccaggacauccuggagaacaaggagagcugggacaagauccuggcccuggugcccgagaccauccacgacgagcugcagcagagcuuccagaagagccacaacagccugcagagaugggagcaccugaagaagguggccagcagauaccagaacaacaucaagaacgacaaguacggccccuggcuggagugggagaucaugcugcaguacugcuuccccagacuggacaucaacgugagcaagggcaucaaccaccugcugaagagccccuucagcgugcaccccaagaccggcagaaucagcgugcccaucgaccugcagaagguggaccaguucgaccccuucaccgugcccaccaucagcuucaucugcagagagcuggacgccaucagcaccaacgaggaggagaaggaggagaacgaggccgagagcgacgugaagcacagaaccagagacuacaagaagaccagccuggcccccuacgugaagguguucgagcacuuccuggagaaccuggacaagagcagaaagggcgagcugcugaagaagagcgaccugcagaaggacuucuaa

SEQ ID NO: 21979 - RNA, 462 nt, Artificial Sequence
  PRIMA1__Homo_sapiens__XP_011544946
augcugcugagagaccuggugcugagaagaggcugcugcuggagcagccugcugcugcacugcgcccugcacccccuguggggcuucgugcaggugacccacggcgagccccagaagagcugcagcaaggugaccgacagcugcagacacgugugccagugcagacccccccccccccugccccccccccccccccccccccccccccccagacugcugagcgcccccgcccccaacagcaccagcugccccaccgaggagagcugguggagcggccuggugaucaucaucgccgugugcugcgccagccugguguuccugaccgugcuggugaucaucugcuacaaggccaucaagagaaagccccugagaaaggacgagaacggcaccagcguggccgaguaccccaugagcgccagccagagcaacaagggcguggacgugaacaacgccgugguguaa

SEQ ID NO: 21980 - RNA, 1683 nt, Artificial Sequence
  PRIMPOL__Homo_sapiens__NP_689896
augaacagaaagugggaggccaagcugaagcagaucgaggagagagccagccacuacgagagaaagccccugagcagcguguacagacccagacugagcaagcccgaggagccccccagcaucuggagacuguuccacagacaggcccaggccuucaacuucgugaagagcugcaaggaggacgugcacguguucgcccuggagugcaaggugggcgacggccagagaaucuaccuggugaccaccuacgccgaguucugguucuacuacaagagcagaaagaaccugcugcacugcuacgaggugauccccgagaacgccgugugcaagcuguacuucgaccuggaguucaacaagcccgccaaccccggcgccgacggcaagaagaugguggcccugcugaucgaguacgugugcaaggcccugcaggagcuguacggcgugaacugcagcgccgaggacgugcugaaccuggacagcagcaccgacgagaaguucagcagacaccugaucuuccagcugcacgacguggccuucaaggacaacauccacgugggcaacuuccugagaaagauccugcagcccgcccuggaccugcugggcagcgaggacgacgacagcgcccccgagaccaccggccacggcuucccccacuucagcgaggcccccgccagacagggcuucagcuucaacaagauguucaccgagaaggccaccgaggagagcuggaccagcaacagcaagaagcuggagagacugggcagcgccgagcagagcagccccgaccugagcuuccugguggugaagaacaacaugggcgagaagcaccuguucguggaccugggcguguacaccagaaacagaaacuucagacuguacaagagcagcaagaucggcaagagaguggcccuggaggugaccgaggacaacaaguucuuccccauccagagcaaggacgugagcgacgaguaccaguacuuccugagcagccuggugagcaacgugagauucagcgacacccugagaauccugaccugcgagcccagccagaacaagcagaagggcgugggcuacuucaacagcaucggcaccagcguggagaccaucgagggcuuccagugcagccccuaccccgagguggaccacuucgugcugagccuggugaacaaggacggcaucaagggcggcaucagaagauggaacuacuucuuccccgaggagcugcugguguacgacaucugcaaguacagauggugcgagaacaucggcagagcccacaagagcaacaacaucaugauccugguggaccugaagaacgaggugugguaccagaagugccacgaccccgugugcaaggccgagaacuucaagagcgacugcuucccccugcccgccgaggugugccugcuguuccuguucaaggaggaggaggaguucaccaccgacgaggccgacgagaccagaagcaacgagacccagaacccccacaagcccagccccagcagacugagcaccggcgccagcgccgacgccgugugggacaacggcaucgacgacgccuacuuccuggaggccaccgaggacgccgagcuggccgaggccgccgagaacagccugcugagcuacaacagcgagguggacgagauccccgacgagcugaucaucgaggugcugcaggaguaa

SEQ ID NO: 21981 - RNA, 1680 nt, Artificial Sequence
  PRKAA1__Homo_sapiens__NP_006242
augagaagacugagcagcuggagaaagauggccaccgccgagaagcagaagcacgacggcagagugaagaucggccacuacauccugggcgacacccugggcgugggcaccuucggcaaggugaaggugggcaagcacgagcugaccggccacaagguggccgugaagauccugaacagacagaagaucagaagccuggacguggugggcaagaucagaagagagauccagaaccugaagcuguucagacacccccacaucaucaagcuguaccaggugaucagcacccccagcgacaucuucauggugauggaguacgugagcggcggcgagcuguucgacuacaucugcaagaacggcagacuggacgagaaggagagcagaagacuguuccagcagauccugagcggcguggacuacugccacagacacaugguggugcacagagaccugaagcccgagaacgugcugcuggacgcccacaugaacgccaagaucgccgacuucggccugagcaacaugaugagcgacggcgaguuccugagaaccagcugcggcagccccaacuacgccgcccccgaggugaucagcggcagacuguacgccggccccgagguggacaucuggagcagcggcgugauccuguacgcccugcugugcggcacccugcccuucgacgacgaccacgugcccacccuguucaagaagaucugcgacggcaucuucuacaccccccaguaccugaaccccagcgugaucagccugcugaagcacaugcugcagguggaccccaugaagagagccaccaucaaggacaucagagagcacgagugguucaagcaggaccugcccaaguaccuguuccccgaggaccccagcuacagcagcaccaugaucgacgacgaggcccugaaggaggugugcgagaaguucgagugcagcgaggaggaggugcugagcugccuguacaacagaaaccaccaggacccccuggccguggccuaccaccugaucaucgacaacagaagaaucaugaacgaggccaaggacuucuaccuggccaccagcccccccgacagcuuccuggacgaccaccaccugaccagaccccaccccgagagagugcccuuccugguggccgagacccccagagccagacacacccuggacgagcugaacccccagaagagcaagcaccagggcgugagaaaggccaaguggcaccugggcaucagaagccagagcagacccaacgacaucauggccgaggugugcagagccaucaagcagcuggacuacgaguggaagguggugaaccccuacuaccugagagugagaagaaagaaccccgugaccagcaccuacagcaagaugagccugcagcuguaccagguggacagcagaaccuaccugcuggacuucagaagcaucgacgacgagaucaccgaggccaagagcggcaccgccaccccccagagaagcggcagcgugagcaacuacagaagcugccagagaagcgacagcgacgccgaggcccagggcaagagcagcgaggugagccugaccagcagcgugaccagccuggacagcagccccguggaccugacccccagacccggcagccacaccaucgaguucuucgagaugugcgccaaccugaucaagauccuggcccaguaa

SEQ ID NO: 21982 - RNA, 813 nt, Artificial Sequence
  PRKAB1__Homo_sapiens__XP_005253966
augggcaacaccagcagcgagagagccgcccuggagagacacggcggccacaagacccccagaagagacagcagcggcggcaccaaggacggcgacagacccaagauccugauggacagccccgaggacgccgaccuguuccacagcgaggagaucaaggcccccgagaaggaggaguuccuggccuggcagcacgaccuggaggugaacgacaaggcccccgcccaggccagacccaccguguucagauggaccggcggcggcaaggagguguaccugagcggcagcuucaacaacuggagcaagcugccccugaccagaagccacaacaacuucguggccauccuggaccugcccgagggcgagcaccaguacaaguucuucguggacggccaguggacccacgaccccagcgagcccaucgugaccagccagcugggcaccgugaacaacaucauccaggugaagaagaccgacuucgagguguucgacgcccugaugguggacagccagaagugcagcgacgugagcgagcugagcagcagcccccccggccccuaccaccaggagcccuacgugugcaagcccgaggagagauucagagccccccccauccugcccccccaccugcugcaggugauccugaacaaggacaccggcaucagcugcgaccccgcccugcugcccgagcccaaccacgugaugcugaaccaccuguacgcccugagcaucaaggacggcgugauggugcugagcgccacccacagauacaagaagaaguacgugaccacccugcuguacaagcccaucuaa

SEQ ID NO: 21983 - RNA, 1056 nt, Artificial Sequence
  PRKACA__Homo_sapiens__NP_002721
augggcaacgccgccgccgccaagaagggcagcgagcaggagagcgugaaggaguuccuggccaaggccaaggaggacuuccugaagaagugggagagccccgcccagaacaccgcccaccuggaccaguucgagagaaucaagacccugggcaccggcagcuucggcagagugaugcuggugaagcacaaggagaccggcaaccacuacgccaugaagauccuggacaagcagaagguggugaagcugaagcagaucgagcacacccugaacgagaagagaauccugcaggccgugaacuuccccuuccuggugaagcuggaguucagcuucaaggacaacagcaaccuguacauggugauggaguacgugcccggcggcgagauguucagccaccugagaagaaucggcagauucagcgagccccacgccagauucuacgccgcccagaucgugcugaccuucgaguaccugcacagccuggaccugaucuacagagaccugaagcccgagaaccugcugaucgaccagcagggcuacauccaggugaccgacuucggcuucgccaagagagugaagggcagaaccuggacccugugcggcacccccgaguaccuggcccccgagaucauccugagcaagggcuacaacaaggccguggacuggugggcccugggcgugcugaucuacgagauggccgccggcuacccccccuucuucgccgaccagcccauccagaucuacgagaagaucgugagcggcaaggugagauuccccagccacuucagcagcgaccugaaggaccugcugagaaaccugcugcagguggaccugaccaagagauucggcaaccugaagaacggcgugaacgacaucaagaaccacaagugguucgccaccaccgacuggaucgccaucuaccagagaaagguggaggcccccuucauccccaaguucaagggccccggcgacaccagcaacuucgacgacuacgaggaggaggagaucagagugagcaucaacgagaagugcggcaaggaguucagcgaguucuaa

SEQ ID NO: 21984 - RNA, 795 nt, Artificial Sequence
  PRKACB__Homo_sapiens__NP_001287844
augagcgccagaaagagcagcgacgccagcgccugcagcagcagcgagaucagcgacagcuucgugaaggaguuccuggccaaggccaaggaggacuuccugaagaagugggagaaccccacccagaacaacgccggccuggaggacuucgagagaaagaagacccugggcaccggcagcuucggcagagugaugcuggugaagcacaaggccaccgagcaguacuacgccaugaagauccuggacaagcagaagguggugaagcugaagcagaucgagcacacccugaacgagaagagaauccugcaggccgugaacuuccccuuccuggugagacuggaguacgccuucaaggacaacagcaaccuguacauggugauggaguacgugcccggcggcgagauguucagccaccugagaagaaucggcagauucagcgagccccacgccagauucuacgccgcccagaucgugcugaccuucgaguaccugcacagccuggaccugaucuacagagaccugaagcccgagaaccugcugaucgaccaccagggcuacauccaggugaccgacuucggcuucgccaagagagugaagggcagaaccuggacccugugcggcacccccgaguaccuggcccccgagaucauccugagcaagggcuacaacaaggccguggacuggugggcccugggcgugcugaucuacgagauggccgccggcuacccccccuucuucgccgaccagcccauccagaucuacgagaagaucgugagcggcaagcagaacuucuaa

SEQ ID NO: 21985 - RNA, 1056 nt, Artificial Sequence
  PRKACG__Homo_sapiens__NP_002723
augggcaacgcccccgccaagaaggacaccgagcaggaggagagcgugaacgaguuccuggccaaggccagaggcgacuuccuguacagauggggcaaccccgcccagaacaccgccagcagcgaccaguucgagagacugagaacccugggcaugggcagcuucggcagagugaugcuggugagacaccaggagaccggcggccacuacgccaugaagauccugaacaagcagaagguggugaagaugaagcagguggagcacauccugaacgagaagagaauccugcaggccaucgacuuccccuuccuggugaagcugcaguucagcuucaaggacaacagcuaccuguaccuggugauggaguacgugcccggcggcgagauguucagcagacugcagagagugggcagauucagcgagccccacgccugcuucuacgccgcccagguggugcuggccgugcaguaccugcacagccuggaccugauccacagagaccugaagcccgagaaccugcugaucgaccagcagggcuaccugcaggugaccgacuucggcuucgccaagagagugaagggcagaaccuggacccugugcggcacccccgaguaccuggcccccgagaucauccugagcaagggcuacaacaaggccguggacuggugggcccugggcgugcugaucuacgagauggccgugggcuucccccccuucuacgccgaccagcccauccagaucuacgagaagaucgugagcggcagagugagauuccccagcaagcugagcagcgaccugaagcaccugcugagaagccugcugcagguggaccugaccaagagauucggcaaccugagaaacggcgugggcgacaucaagaaccacaagugguucgccaccaccagcuggaucgccaucuacgagaagaagguggaggcccccuucauccccaaguacaccggccccggcgacgccagcaacuucgacgacuacgaggaggaggagcugagaaucagcaucaacgagaagugcgccaaggaguucagcgaguucuaa

SEQ ID NO: 21986 - RNA, 1023 nt, Artificial Sequence
  PRKAG1__Homo_sapiens__NP_001193638
auggagaccgugaucagcagcgacagcagccccgccguggagaacgagcacccccaggagacccccgagagcaacaacagcguguacaccagcuucaugaagagccacagaugcuacgaccugauccccaccagcagcaagcuggugguguucgacaccagccugcaggugaagaaggccuucuucgcccuggugaccaacggcgugagagccgccccccugugggacagcaagaagcagagcuucguggugcugagagcccugagcugcccccugggcaugcugaccaucaccgacuucaucaacauccugcacagauacuacaagagcgcccuggugcagaucuacgagcuggaggagcacaagaucgagaccuggagagagguguaccugcaggacagcuucaagccccuggugugcaucagccccaacgccagccuguucgacgccgugagcagccugaucagaaacaagauccacagacugcccgugaucgaccccgagagcggcaacacccuguacauccugacccacaagagaauccugaaguuccugaagcuguucaucaccgaguuccccaagcccgaguucaugagcaagagccuggaggagcugcagaucggcaccuacgccaacaucgccauggugagaaccaccacccccguguacguggcccugggcaucuucgugcagcacagagugagcgcccugcccgugguggacgagaagggcagagugguggacaucuacagcaaguucgacgugaucaaccuggccgccgagaagaccuacaacaaccuggacgugagcgugaccaaggcccugcagcacagaagccacuacuucgagggcgugcugaagugcuaccugcacgagacccuggagaccaucaucaacagacugguggaggccgaggugcacagacugguggugguggacgagaacgacguggugaagggcaucgugagccugagcgacauccugcaggcccuggugcugaccggcggcgagaagaagcccuaa

SEQ ID NO: 21987 - RNA, 1578 nt, Artificial Sequence
  PRKAG2__Homo_sapiens__NP_001035723
augccccugcuggacggcgaccuggagggcagcggcaagcacagcagcagaaagguggacagccccuucggccccggcagccccagcaagggcuucuucagcagaggcccccagcccagacccagcagccccaugagcgcccccgugagacccaagaccagccccggcagccccaagaccguguuccccuucagcuaccaggagagcccccccagaagccccagaagaaugagcuucagcggcaucuucagaagcagcagcaaggagagcagccccaacagcaaccccgccaccagccccggcggcaucagauucuucagcagaagcagaaagaccagcggccugagcagcagccccagcacccccacccaggugaccaagcagcacaccuucccccuggagagcuacaagcacgagcccgagagacuggagaacagaaucuacgccagcagcagcccccccgacaccggccagagauucugccccagcagcuuccagagccccaccagacccccccuggccagccccacccacuacgcccccagcaaggccgccgcccuggccgccgcccugggccccgccgaggccggcaugcuggagaagcuggaguucgaggacgaggccguggaggacagcgagagcggcguguacaugagauucaugagaagccacaagugcuacgacaucgugcccaccagcagcaagcuggugguguucgacaccacccugcaggugaagaaggccuucuucgcccugguggccaacggcgugagagccgccccccugugggagagcaagaagcagagcuucgugggcaugcugaccaucaccgacuucaucaacauccugcacagauacuacaagagccccauggugcagaucuacgagcuggaggagcacaagaucgagaccuggagagagcuguaccugcaggagaccuucaagccccuggugaacaucagccccgacgccagccuguucgacgccguguacagccugaucaagaacaagauccacagacugcccgugaucgaccccaucagcggcaacgcccuguacauccugacccacaagagaauccugaaguuccugcagcuguucaugagcgacaugcccaagcccgccuucaugaagcagaaccuggacgagcugggcaucggcaccuaccacaacaucgccuucauccaccccgacacccccaucaucaaggcccugaacaucuucguggagagaagaaucagcgcccugcccgugguggacgagagcggcaaggugguggacaucuacagcaaguucgacgugaucaaccuggccgccgagaagaccuacaacaaccuggacaucaccgugacccaggcccugcagcacagaagccaguacuucgagggcguggugaagugcaacaagcuggagauccuggagaccaucguggacagaaucgugagagccgaggugcacagacuggugguggugaacgaggccgacagcaucgugggcaucaucagccugagcgacauccugcaggcccugauccugacccccgccggcgccaagcagaaggagaccgagaccgaguaa

SEQ ID NO: 21988 - RNA, 1470 nt, Artificial Sequence
  PRKAG3__Homo_sapiens__NP_059127
auggagcccggccuggagcacgcccugagaagaacccccagcuggagcagccugggcggcagcgagcaccaggagaugagcuuccuggagcaggagaacagcagcagcuggcccagccccgccgugaccagcagcagcgagagaaucagaggcaagagaagagccaaggcccugagauggaccagacagaagagcguggaggagggcgagccccccggccagggcgagggccccagaagcagacccgccgccgagagcaccggccuggaggccaccuuccccaagaccaccccccuggcccaggccgaccccgccggcgugggcaccccccccaccggcugggacugccugcccagcgacugcaccgccagcgccgccggcagcagcaccgacgacguggagcuggccaccgaguuccccgccaccgaggccugggagugcgagcuggagggccugcuggaggagagacccgcccugugccugagcccccaggcccccuuccccaagcugggcugggacgacgagcugagaaagcccggcgcccagaucuacaugagauucaugcaggagcacaccugcuacgacgccauggccaccagcagcaagcuggugaucuucgacaccaugcuggagaucaagaaggccuucuucgcccugguggccaacggcgugagagccgccccccugugggacagcaagaagcagagcuucgugggcaugcugaccaucaccgacuucauccuggugcugcacagauacuacagaagcccccuggugcagaucuacgagaucgagcagcacaagaucgagaccuggagagagaucuaccugcagggcugcuucaagccccuggugagcaucagccccaacgacagccuguucgaggccguguacacccugaucaagaacagaauccacagacugcccgugcuggaccccgugagcggcaacgugcugcacauccugacccacaagagacugcugaaguuccugcacaucuucggcagccugcugcccagacccagcuuccuguacagaaccauccaggaccugggcaucggcaccuucagagaccuggccguggugcuggagaccgcccccauccugaccgcccuggacaucuucguggacagaagagugagcgcccugcccguggugaacgagugcggccagguggugggccuguacagcagauucgacgugauccaccuggccgcccagcagaccuacaaccaccuggacaugagcgugggcgaggcccugagacagagaacccugugccuggagggcgugcugagcugccagccccacgagagccugggcgaggugaucgacagaaucgccagagagcaggugcacagacuggugcugguggacgagacccagcaccugcugggcguggugagccugagcgacauccugcaggcccuggugcugagccccgccggcaucgacgcccugggcgccuaa

SEQ ID NO: 21989 - RNA, 1146 nt, Artificial Sequence
  PRKAR1A__Homo_sapiens__NP_001263218
auggagagcggcagcaccgccgccagcgaggaggccagaagccugagagagugcgagcuguacgugcagaagcacaacauccaggcccugcugaaggacagcaucgugcagcugugcaccgccagacccgagagacccauggccuuccugagagaguacuucgagagacuggagaaggaggaggccaagcagauccagaaccugcagaaggccggcaccagaaccgacagcagagaggacgagaucagcccccccccccccaaccccguggugaagggcagaagaagaagaggcgccaucagcgccgagguguacaccgaggaggacgccgccagcuacgugagaaaggugauccccaaggacuacaagaccauggccgcccuggccaaggccaucgagaagaacgugcuguucagccaccuggacgacaacgagagaagcgacaucuucgacgccauguucagcgugagcuucaucgccggcgagaccgugauccagcagggcgacgagggcgacaacuucuacgugaucgaccagggcgagaccgacguguacgugaacaacgagugggccaccagcgugggcgagggcggcagcuucggcgagcuggcccugaucuacggcacccccagagccgccaccgugaaggccaagaccaacgugaagcuguggggcaucgacagagacagcuacagaagaauccugaugggcagcacccugagaaagagaaagauguacgaggaguuccugagcaaggugagcauccuggagagccuggacaagugggagagacugaccguggccgacgcccuggagcccgugcaguucgaggacggccagaagaucguggugcagggcgagcccggcgacgaguucuucaucauccuggagggcagcgccgccgugcugcagagaagaagcgagaacgaggaguucguggaggugggcagacugggccccagcgacuacuucggcgagaucgcccugcugaugaacagacccagagccgccaccgugguggccagaggcccccugaagugcgugaagcuggacagacccagauucgagagagugcugggccccugcagcgacauccugaagagaaacauccagcaguacaacagcuucgugagccugagcguguaa

SEQ ID NO: 21990 - RNA, 1146 nt, Artificial Sequence
  PRKAR1B__Homo_sapiens__NP_002726
auggccagcccccccgccugccccagcgaggaggacgagagccugaagggcugcgagcuguacgugcagcugcacggcauccagcaggugcugaaggacugcaucgugcaccugugcaucagcaagcccgagagacccaugaaguuccugagagagcacuucgagaagcuggagaaggaggagaacagacagauccuggccagacagaagagcaacagccagagcgacagccacgacgaggaggugagccccaccccccccaaccccguggugaaggccagaagaagaagaggcggcgugagcgccgagguguacaccgaggaggacgccgugagcuacgugagaaaggugauccccaaggacuacaagaccaugaccgcccuggccaaggccaucagcaagaacgugcuguucgcccaccuggacgacaacgagagaagcgacaucuucgacgccauguuccccgugacccacaucgccggcgagaccgugauccagcagggcaacgagggcgacaacuucuacgugguggaccagggcgagguggacguguacgugaacggcgagugggugaccaacaucagcgagggcggcagcuucggcgagcuggcccugaucuacggcacccccagagccgccaccgugaaggccaagaccgaccugaagcuguggggcaucgacagagacagcuacagaagaauccugaugggcagcacccugagaaagagaaagauguacgaggaguuccugagcaaggugagcauccuggagagccuggagaagugggagagacugaccguggccgacgcccuggagcccgugcaguucgaggacggcgagaagaucguggugcagggcgagcccggcgacgacuucuacaucaucaccgagggcaccgccagcgugcugcagagaagaagccccaacgaggaguacguggaggugggcagacugggccccagcgacuacuucggcgagaucgcccugcugcugaacagacccagagccgccaccgugguggccagaggcccccugaagugcgugaagcuggacagacccagauucgagagagugcugggccccugcagcgagauccugaagagaaacauccagagauacaacagcuucaucagccugaccguguaa

SEQ ID NO: 21991 - RNA, 1215 nt, Artificial Sequence
  PRKAR2A__Homo_sapiens__NP_004148
augagccacauccagaucccccccggccugaccgagcugcugcagggcuacaccguggaggugcugagacagcagccccccgaccugguggaguucgccguggaguacuucaccagacugagagaggccagagcccccgccagcgugcugcccgccgccacccccagacagagccugggccaccccccccccgagcccggccccgacagaguggccgacgccaagggcgacagcgagagcgaggaggacgaggaccuggaggugcccgugcccagcagauucaacagaagagugagcgugugcgccgagaccuacaaccccgacgaggaggaggaggacaccgaccccagagugauccaccccaagaccgacgagcagagaugcagacugcaggaggccugcaaggacauccugcuguucaagaaccuggaccaggagcagcugagccaggugcuggacgccauguucgagagaaucgugaaggccgacgagcacgugaucgaccagggcgacgacggcgacaacuucuacgugaucgagagaggcaccuacgacauccuggugaccaaggacaaccagaccagaagcgugggccaguacgacaacagaggcagcuucggcgagcuggcccugauguacaacacccccagagccgccaccaucguggccaccagcgagggcagccuguggggccuggacagagugaccuucagaagaaucaucgugaagaacaacgccaagaagagaaagauguucgagagcuucaucgagagcgugccccugcugaagagccuggaggugagcgagagaaugaagaucguggacgugaucggcgagaagaucuacaaggacggcgagagaaucaucacccagggcgagaaggccgacagcuucuacaucaucgagagcggcgaggugagcauccugaucagaagcagaaccaagagcaacaaggacggcggcaaccaggagguggagaucgccagaugccacaagggccaguacuucggcgagcuggcccuggugaccaacaagcccagagccgccagcgccuacgccgugggcgacgugaagugccuggugauggacgugcaggccuucgagagacugcugggccccugcauggacaucaugaagagaaacaucagccacuacgaggagcagcuggugaagauguucggcagcagcguggaccugggcaaccugggccaguaa

SEQ ID NO: 21992 - RNA, 1257 nt, Artificial Sequence
  PRKAR2B__Homo_sapiens__NP_002727
augagcaucgagauccccgccggccugaccgagcugcugcagggcuucaccguggaggugcugagacaccagcccgccgaccugcuggaguucgcccugcagcacuucaccagacugcagcaggagaacgagagaaagggcaccgccagauucggccacgagggcagaaccuggggcgaccugggcgccgccgccggcggcggcacccccagcaagggcgugaacuucgccgaggagcccaugcagagcgacagcgaggacggcgaggaggaggaggccgcccccgccgacgccggcgccuucaacgcccccgugaucaacagauucaccagaagagccagcgugugcgccgaggccuacaaccccgacgaggaggaggacgacgccgagagcagaaucauccaccccaagaccgacgaccagagaaacagacugcaggaggccugcaaggacauccugcuguucaagaaccuggaccccgagcagaugagccaggugcuggacgccauguucgagaagcuggugaaggacggcgagcacgugaucgaccagggcgacgacggcgacaacuucuacgugaucgacagaggcaccuucgacaucuacgugaagugcgacggcgugggcagaugcgugggcaacuacgacaacagaggcagcuucggcgagcuggcccugauguacaacacccccagagccgccaccaucaccgccaccagccccggcgcccuguggggccuggacagagugaccuucagaagaaucaucgugaagaacaacgccaagaagagaaagauguacgagagcuucaucgagagccugcccuuccugaagagccuggaguucagcgagagacugaaggugguggacgugaucggcaccaagguguacaacgacggcgagcagaucaucgcccagggcgacagcgccgacagcuucuucaucguggagagcggcgaggugaagaucaccaugaagagaaagggcaagagcgagguggaggagaacggcgccguggagaucgccagaugcagcagaggccaguacuucggcgagcuggcccuggugaccaacaagcccagagccgccagcgcccacgccaucggcaccgugaagugccuggccauggacgugcaggccuucgagagacugcugggccccugcauggagaucaugaagagaaacaucgccaccuacgaggagcagcugguggcccuguucggcaccaacauggacaucguggagcccaccgccuaa

SEQ ID NO: 21993 - RNA, 2019 nt, Artificial Sequence
  PRKCA__Homo_sapiens__NP_002728
auggccgacguguuccccggcaacgacagcaccgccagccaggacguggccaacagauucgccagaaagggcgcccugagacagaagaacgugcacgaggugaaggaccacaaguucaucgccagauucuucaagcagcccaccuucugcagccacugcaccgacuucaucuggggcuucggcaagcagggcuuccagugccaggugugcugcuucguggugcacaagagaugccacgaguucgugaccuucagcugccccggcgccgacaagggccccgacaccgacgaccccagaagcaagcacaaguucaagauccacaccuacggcagccccaccuucugcgaccacugcggcagccugcuguacggccugauccaccagggcaugaagugcgacaccugcgacaugaacgugcacaagcagugcgugaucaacgugcccagccugugcggcauggaccacaccgagaagagaggcagaaucuaccugaaggccgagguggccgacgagaagcugcacgugaccgugagagacgccaagaaccugauccccauggaccccaacggccugagcgaccccuacgugaagcugaagcugauccccgaccccaagaacgagagcaagcagaagaccaagaccaucagaagcacccugaacccccaguggaacgagagcuucaccuucaagcugaagcccagcgacaaggacagaagacugagcguggagaucugggacugggacagaaccaccagaaacgacuucaugggcagccugagcuucggcgugagcgagcugaugaagaugcccgccagcggcugguacaagcugcugaaccaggaggagggcgaguacuacaacgugcccauccccgagggcgacgaggagggcaacauggagcugagacagaaguucgagaaggccaagcugggccccgccggcaacaaggugaucagccccagcgaggacagaaagcagcccagcaacaaccuggacagagugaagcugaccgacuucaacuuccugauggugcugggcaagggcagcuucggcaaggugaugcuggccgacagaaagggcaccgaggagcuguacgccaucaagauccugaagaaggacguggugauccaggacgacgacguggagugcaccaugguggagaagagagugcuggcccugcuggacaagccccccuuccugacccagcugcacagcugcuuccagaccguggacagacuguacuucgugauggaguacgugaacggcggcgaccugauguaccacauccagcaggugggcaaguucaaggagccccaggccguguucuacgccgccgagaucagcaucggccuguucuuccugcacaagagaggcaucaucuacagagaccugaagcuggacaacgugaugcuggacagcgagggccacaucaagaucgccgacuucggcaugugcaaggagcacaugauggacggcgugaccaccagaaccuucugcggcacccccgacuacaucgcccccgagaucaucgccuaccagcccuacggcaagagcguggacuggugggccuacggcgugcugcuguacgagaugcuggccggccagccccccuucgacggcgaggacgaggacgagcuguuccagagcaucauggagcacaacgugagcuaccccaagagccugagcaaggaggccgugagcaucugcaagggccugaugaccaagcaccccgccaagagacugggcugcggccccgagggcgagagagacgugagagagcacgccuucuucagaagaaucgacugggagaagcuggagaacagagagauccagccccccuucaagcccaaggugugcggcaagggcgccgagaacuucgacaaguucuucaccagaggccagcccgugcugaccccccccgaccagcuggugaucgccaacaucgaccagagcgacuucgagggcuucagcuacgugaacccccaguucgugcaccccauccugcagagcgccguguaa

SEQ ID NO: 21994 - RNA, 2022 nt, Artificial Sequence
  PRKCB__Homo_sapiens__NP_002729
auggccgaccccgccgccggccccccccccagcgagggcgaggagagcaccgugagauucgccagaaagggcgcccugagacagaagaacgugcacgaggugaagaaccacaaguucaccgccagauucuucaagcagcccaccuucugcagccacugcaccgacuucaucuggggcuucggcaagcagggcuuccagugccaggugugcugcuucguggugcacaagagaugccacgaguucgugaccuucagcugccccggcgccgacaagggccccgccagcgacgaccccagaagcaagcacaaguucaagauccacaccuacagcagccccaccuucugcgaccacugcggcagccugcuguacggccugauccaccagggcaugaagugcgacaccugcaugaugaacgugcacaagagaugcgugaugaacgugcccagccugugcggcaccgaccacaccgagagaagaggcagaaucuacauccaggcccacaucgacagagacgugcugaucgugcuggugagagacgccaagaaccuggugcccauggaccccaacggccugagcgaccccuacgugaagcugaagcugauccccgaccccaagagcgagagcaagcagaagaccaagaccaucaagugcagccugaaccccgaguggaacgagaccuucagauuccagcugaaggagagcgacaaggacagaagacugagcguggagaucugggacugggaccugaccagcagaaacgacuucaugggcagccugagcuucggcaucagcgagcugcagaaggccagcguggacggcugguucaagcugcugagccaggaggagggcgaguacuucaacgugcccgugccccccgagggcagcgaggccaacgaggagcugagacagaaguucgagagagccaagaucagccagggcaccaaggugcccgaggagaagaccaccaacaccgugagcaaguucgacaacaacggcaacagagacagaaugaagcugaccgacuucaacuuccugauggugcugggcaagggcagcuucggcaaggugaugcugagcgagagaaagggcaccgacgagcuguacgccgugaagauccugaagaaggacguggugauccaggacgacgacguggagugcaccaugguggagaagagagugcuggcccugcccggcaagccccccuuccugacccagcugcacagcugcuuccagaccauggacagacuguacuucgugauggaguacgugaacggcggcgaccugauguaccacauccagcaggugggcagauucaaggagccccacgccguguucuacgccgccgagaucgccaucggccuguucuuccugcagagcaagggcaucaucuacagagaccugaagcuggacaacgugaugcuggacagcgagggccacaucaagaucgccgacuucggcaugugcaaggagaacaucugggacggcgugaccaccaagaccuucugcggcacccccgacuacaucgcccccgagaucaucgccuaccagcccuacggcaagagcguggacuggugggccuucggcgugcugcuguacgagaugcuggccggccaggcccccuucgagggcgaggacgaggacgagcuguuccagagcaucauggagcacaacguggccuaccccaagagcaugagcaaggaggccguggccaucugcaagggccugaugaccaagcaccccggcaagagacugggcugcggccccgagggcgagagagacaucaaggagcacgccuucuucagauacaucgacugggagaagcuggagagaaaggagauccagccccccuacaagcccaaggccugcggcagaaacgccgagaacuucgacagauucuucaccagacacccccccgugcugaccccccccgaccaggaggugaucagaaacaucgaccagagcgaguucgagggcuucagcuucgugaacagcgaguuccugaagcccgaggugaagagcuaa

SEQ ID NO: 21995 - RNA, 786 nt, Artificial Sequence
  PRKCDBP__Homo_sapiens__NP_659477
augagagagagcgcccuggagagaggccccgugcccgaggcccccgccggcggccccgugcacgccgugaccguggugacccugcuggagaagcuggccagcaugcuggagacccugagagagagacagggcggccuggccagaagacagggcggccuggccggcagcgugagaagaauccagagcggccugggcgcccugagcagaagccacgacaccaccagcaacacccuggcccagcugcuggccaaggccgagagagugagcagccacgccaacgccgcccaggagagagccgugagaagagccgcccaggugcagagacuggaggccaaccacggccugcugguggccagaggcaagcugcacgugcugcuguucaaggaggagggcgaggugcccgccagcgccuuccagaaggcccccgagccccugggccccgccgaccagagcgagcugggccccgagcagcuggaggccgaggugggcgagagcagcgacgaggagcccguggagagcagagcccagagacugagaagaaccggccugcagaaggugcagagccugagaagagcccugagcggcagaaagggccccgccgcccccccccccacccccgugaagccccccagacugggccccggcagaagcgccgaggcccagcccgaggcccagcccgcccuggagcccacccuggagcccgagcccccccaggacaccgaggaggaccccggcagacccggcgccgccgaggaggcccugcugcagauggagagcguggccuaa

SEQ ID NO: 21996 - RNA, 2031 nt, Artificial Sequence
  PRKCD__Homo_sapiens__NP_997704
auggcccccuuccugagaaucgccuucaacagcuacgagcugggcagccugcaggccgaggacgaggccaaccagcccuucugcgccgugaagaugaaggaggcccugagcaccgagagaggcaagacccuggugcagaagaagcccaccauguaccccgaguggaagagcaccuucgacgcccacaucuacgagggcagagugauccagaucgugcugaugagagccgccgaggagcccgugagcgaggugaccgugggcgugagcgugcuggccgagagaugcaagaagaacaacggcaaggccgaguucuggcuggaccugcagccccaggccaaggugcugaugagcgugcaguacuuccuggaggacguggacugcaagcagagcaugagaagcgaggacgaggccaaguuccccaccaugaacagaagaggcgccaucaagcaggccaagauccacuacaucaagaaccacgaguucaucgccaccuucuucggccagcccaccuucugcagcgugugcaaggacuucguguggggccugaacaagcagggcuacaagugcagacagugcaacgccgccauccacaagaagugcaucgacaagaucaucggcagaugcaccggcaccgccgccaacagcagagacaccaucuuccagaaggagagauucaacaucgacaugccccacagauucaaggugcacaacuacaugagccccaccuucugcgaccacugcggcagccugcuguggggccuggugaagcagggccugaagugcgaggacugcggcaugaacgugcaccacaagugcagagagaagguggccaaccugugcggcaucaaccagaagcugcuggccgaggcccugaaccaggugacccagagagccagcagaagaagcgacagcgccagcagcgagcccgugggcaucuaccagggcuucgagaagaagaccggcguggccggcgaggacaugcaggacaacagcggcaccuacggcaagaucugggagggcagcagcaagugcaacaucaacaacuucaucuuccacaaggugcugggcaagggcagcuucggcaaggugcugcugggcgagcugaagggcagaggcgaguacuucgccaucaaggcccugaagaaggacguggugcugaucgacgacgacguggagugcaccaugguggagaagagagugcugacccuggccgccgagaaccccuuccugacccaccugaucugcaccuuccagaccaaggaccaccuguucuucgugauggaguuccugaacggcggcgaccugauguaccacauccaggacaagggcagauucgagcuguacagagccaccuucuacgccgccgagaucaugugcggccugcaguuccugcacagcaagggcaucaucuacagagaccugaagcuggacaacgugcugcuggacagagacggccacaucaagaucgccgacuucggcaugugcaaggagaacaucuucggcgagagcagagccagcaccuucugcggcacccccgacuacaucgcccccgagauccugcagggccugaaguacaccuucagcguggacugguggagcuucggcgugcugcuguacgagaugcugaucggccagagccccuuccacggcgacgacgaggacgagcuguucgagagcaucagaguggacaccccccacuaccccagauggaucaccaaggagagcaaggacauccuggagaagcuguucgagagagagcccaccaagagacugggcgugaccggcaacaucaagauccaccccuucuucaagaccaucaacuggacccugcuggagaagagaagacuggagccccccuucagacccaaggugaagagccccagagacuacagcaacuucgaccaggaguuccugaacgagaaggccagacugagcuacagcgacaagaaccugaucgacagcauggaccagagcgccuucgccggcuucagcuucgugaaccccaaguucgagcaccugcuggaggacuaa

SEQ ID NO: 21997 - RNA, 2214 nt, Artificial Sequence
  PRKCE__Homo_sapiens__XP_005264485
auggugguguucaacggccugcugaagaucaagaucugcgaggccgugagccugaagcccaccgccuggagccugagacacgccgugggccccagaccccagaccuuccugcuggaccccuacaucgcccugaacguggacgacagcagaaucggccagaccgccaccaagcagaagaccaacagccccgccuggcacgacgaguucgugaccgacgugugcaacggcagaaagaucgagcuggccguguuccacgacgcccccaucggcuacgacgacuucguggccaacugcaccauccaguucgaggagcugcugcagaacggcagcagacacuucgaggacuggaucgaccuggagcccgagggcagaguguacgugaucaucgaccugagcggcagcagcggcgaggcccccaaggacaacgaggagagaguguucagagagagaaugagacccagaaagagacagggcgccgugagaagaagagugcaccaggugaacggccacaaguucauggccaccuaccugagacagcccaccuacugcagccacugcagagacuucaucuggggcgugaucggcaagcagggcuaccagugccaggugugcaccugcguggugcacaagagaugccacgagcugaucaucaccaagugcgccggccugaagaagcaggagacccccgaccaggugggcagccagagauucagcgugaacaugccccacaaguucggcauccacaacuacaaggugcccaccuucugcgaccacugcggcagccugcuguggggccugcugagacagggccugcagugcaaggugugcaagaugaacgugcacagaagaugcgagaccaacguggcccccaacugcggcguggacgccagaggcaucgccaaggugcuggccgaccugggcgugacccccgacaagaucaccaacagcggccagagaagaaagaagcugaucgccggcgccgagagcccccagcccgccagcggcagcagccccagcgaggaggacagaagcaagagcgcccccaccagccccugcgaccaggagaucaaggagcuggagaacaacaucagaaaggcccugagcuucgacaacagaggcgaggagcacagagccgccagcagccccgacggccagcugaugagccccggcgagaacggcgaggugagacagggccaggccaagagacugggccuggacgaguucaacuucaucaaggugcugggcaagggcagcuucggcaaggugaugcuggccgagcugaagggcaaggacgagguguacgccgugaaggugcugaagaaggacgugauccugcaggacgacgacguggacugcaccaugaccgagaagagaauccuggcccuggccagaaagcaccccuaccugacccagcuguacugcugcuuccagaccaaggacagacuguucuucgugauggaguacgugaacggcggcgaccugauguuccagauccagagaagcagaaaguucgacgagcccagaagcagauucuacgccgccgaggugaccagcgcccugauguuccugcaccagcacggcgugaucuacagagaccugaagcuggacaacauccugcuggacgccgagggccacugcaagcuggccgacuucggcaugugcaaggagggcauccugaacggcgugaccaccaccaccuucugcggcacccccgacuacaucgcccccgagauccugcaggagcuggaguacggccccagcguggacuggugggcccugggcgugcugauguacgagaugauggccggccagccccccuucgaggccgacaacgaggacgaccuguucgagagcauccugcacgacgacgugcuguaccccguguggcugagcaaggaggccgugagcauccugaaggccuucaugaccaagaacccccacaagagacugggcugcguggccagccagaacggcgaggacgccaucaagcagcaccccuucuucaaggagaucgacugggugcugcuggagcagaagaagaucaagccccccuucaagcccagaaucaagaccaagagagacgugaacaacuucgaccaggacuucaccagagaggagcccgugcugacccugguggacgaggccaucgugaagcagaucaaccaggaggaguucaagggcuucagcuacuucggcgaggaccugaugcccuaa

SEQ ID NO: 21998 - RNA, 2094 nt, Artificial Sequence
  PRKCG__Homo_sapiens__NP_002730
auggccggccugggccccggcgugggcgacagcgagggcggccccagaccccuguucugcagaaagggcgcccugagacagaagguggugcacgaggugaagagccacaaguucaccgccagauucuucaagcagcccaccuucugcagccacugcaccgacuucaucuggggcaucggcaagcagggccugcagugccaggugugcagcuucguggugcacagaagaugccacgaguucgugaccuucgagugccccggcgccggcaagggcccccagaccgacgaccccagaaacaagcacaaguucagacugcacagcuacagcagccccaccuucugcgaccacugcggcagccugcuguacggccuggugcaccagggcaugaagugcagcugcugcgagaugaacgugcacagaagaugcgugagaagcgugcccagccugugcggcguggaccacaccgagagaagaggcagacugcagcuggagaucagagcccccaccgccgacgagauccacgugaccgugggcgaggccagaaaccugauccccauggaccccaacggccugagcgaccccuacgugaagcugaagcugauccccgaccccagaaaccugaccaagcagaagaccagaaccgugaaggccacccugaaccccguguggaacgagaccuucguguucaaccugaagcccggcgacguggagagaagacugagcguggaggugugggacugggacagaaccagcagaaacgacuucaugggcgccaugagcuucggcgugagcgagcugcugaaggcccccguggacggcugguacaagcugcugaaccaggaggagggcgaguacuacaacgugcccguggccgacgccgacaacugcagccugcugcagaaguucgaggccugcaacuacccccuggagcuguacgagagagugagaaugggccccagcagcagccccauccccagccccagccccagccccaccgaccccaagagaugcuucuucggcgccagccccggcagacugcacaucagcgacuucagcuuccugauggugcugggcaagggcagcuucggcaaggugaugcuggccgagagaagaggcagcgacgagcuguacgccaucaagauccugaagaaggacgugaucgugcaggacgacgacguggacugcacccugguggagaagagagugcuggcccugggcggcagaggccccggcggcagaccccacuuccugacccagcugcacagcaccuuccagacccccgacagacuguacuucgugauggaguacgugaccggcggcgaccugauguaccacauccagcagcugggcaaguucaaggagccccacgccgccuucuacgccgccgagaucgccaucggccuguucuuccugcacaaccagggcaucaucuacagagaccugaagcuggacaacgugaugcuggacgccgagggccacaucaagaucaccgacuucggcaugugcaaggagaacguguuccccggcaccaccaccagaaccuucugcggcacccccgacuacaucgcccccgagaucaucgccuaccagcccuacggcaagagcguggacugguggagcuucggcgugcugcuguacgagaugcuggccggccagccccccuucgacggcgaggacgaggaggagcuguuccaggccaucauggagcagaccgugaccuaccccaagagccugagcagagaggccguggccaucugcaagggcuuccugaccaagcaccccggcaagagacugggcagcggccccgacggcgagcccaccaucagagcccacggcuucuucagauggaucgacugggagagacuggagagacuggagauccccccccccuucagacccagacccugcggcagaagcggcgagaacuucgacaaguucuucaccagagccgcccccgcccugaccccccccgacagacuggugcuggccagcaucgaccaggccgacuuccagggcuucaccuacgugaaccccgacuucgugcaccccgacgccagaagccccaccagccccgugcccgugcccgugauguaa

SEQ ID NO: 21999 - RNA, 2052 nt, Artificial Sequence
  PRKCH__Homo_sapiens__NP_006246
augagcagcggcaccaugaaguucaacggcuaccugagagugagaaucggcgaggccgugggccugcagcccaccagauggagccugagacacagccuguucaagaagggccaccagcugcuggaccccuaccugaccgugagcguggaccaggugagagugggccagaccagcaccaagcagaagaccaacaagcccaccuacaacgaggaguucugcgccaacgugaccgacggcggccaccuggagcuggccguguuccacgagaccccccugggcuacgaccacuucguggccaacugcacccugcaguuccaggagcugcugagaaccaccggcgccagcgacaccuucgagggcuggguggaccuggagcccgagggcaagguguucguggugaucacccugaccggcagcuucaccgaggccacccugcagagagacagaaucuucaagcacuucaccagaaagagacagagagccaugagaagaagagugcaccagaucaacggccacaaguucauggccaccuaccugagacagcccaccuacugcagccacugcagagaguucaucuggggcguguucggcaagcagggcuaccagugccaggugugcaccugcguggugcacaagagaugccaccaccugaucgugaccgccugcaccugccagaacaacaucaacaagguggacagcaagaucgccgagcagagauucggcaucaacaucccccacaaguucagcauccacaacuacaaggugcccaccuucugcgaccacugcggcagccugcuguggggcaucaugagacagggccugcagugcaagaucugcaagaugaacgugcacaucagaugccaggccaacguggcccccaacugcggcgugaacgccguggagcuggccaagacccuggccggcaugggccugcagcccggcaacaucagccccaccagcaagcuggugagcagaagcacccugagaagacagggcaaggagagcagcaaggagggcaacggcaucggcgugaacagcagcaacagacugggcaucgacaacuucgaguucaucagagugcugggcaagggcagcuucggcaaggugaugcuggccagagugaaggagaccggcgaccuguacgccgugaaggugcugaagaaggacgugauccugcaggacgacgacguggagugcaccaugaccgagaagagaauccugagccuggccagaaaccaccccuuccugacccagcuguucugcugcuuccagacccccgacagacuguucuucgugauggaguucgugaacggcggcgaccugauguuccacauccagaagagcagaagauucgacgaggccagagccagauucuacgccgccgagaucaucagcgcccugauguuccugcacgacaagggcaucaucuacagagaccugaagcuggacaacgugcugcuggaccacgagggccacugcaagcuggccgacuucggcaugugcaaggagggcaucugcaacggcgugaccaccgccaccuucugcggcacccccgacuacaucgcccccgagauccugcaggagaugcuguacggccccgccguggacuggugggccaugggcgugcugcuguacgagaugcugugcggccacgcccccuucgaggccgagaacgaggacgaccuguucgaggccauccugaacgacgaggugguguaccccaccuggcugcacgaggacgccaccggcauccugaagagcuucaugaccaagaaccccaccaugagacugggcagccugacccagggcggcgagcacgccauccugagacaccccuucuucaaggagaucgacugggcccagcugaaccacagacagaucgagccccccuucagacccagaaucaagagcagagaggacgugagcaacuucgaccccgacuucaucaaggaggagcccgugcugacccccaucgacgagggccaccugcccaugaucaaccaggacgaguucagaaacuucagcuacgugagccccgagcugcagcccuaa

SEQ ID NO: 22000 - RNA, 1791 nt, Artificial Sequence
  PRKCI__Homo_sapiens__NP_002731
augcccacccagagagacagcagcaccaugagccacaccguggccggcggcggcagcggcgaccacagccaccaggugagagugaaggccuacuacagaggcgacaucaugaucacccacuucgagcccagcaucagcuucgagggccugugcaacgaggugagagacaugugcagcuucgacaacgagcagcuguucaccaugaaguggaucgacgaggagggcgaccccugcaccgugagcagccagcuggagcuggaggaggccuucagacuguacgagcugaacaaggacagcgagcugcugauccacguguuccccugcgugcccgagagacccggcaugcccugccccggcgaggacaagagcaucuacagaagaggcgccagaagauggagaaagcuguacugcgccaacggccacaccuuccaggccaagagauucaacagaagagcccacugcgccaucugcaccgacagaaucuggggccugggcagacagggcuacaagugcaucaacugcaagcugcuggugcacaagaagugccacaagcuggugaccaucgagugcggcagacacagccugccccaggagcccgugaugcccauggaccagagcagcaugcacagcgaccacgcccagaccgugauccccuacaaccccagcagccacgagagccuggaccaggugggcgaggagaaggaggccaugaacaccagagagagcggcaaggccagcagcagccugggccugcaggacuucgaccugcugagagugaucggcagaggcagcuacgccaaggugcugcuggugagacugaagaagaccgacagaaucuacgccaugaagguggugaagaaggagcuggugaacgacgacgaggacaucgacugggugcagaccgagaagcacguguucgagcaggccagcaaccaccccuuccuggugggccugcacagcugcuuccagaccgagagcagacuguucuucgugaucgaguacgugaacggcggcgaccugauguuccacaugcagagacagagaaagcugcccgaggagcacgccagauucuacagcgccgagaucagccuggcccugaacuaccugcacgagagaggcaucaucuacagagaccugaagcuggacaacgugcugcuggacagcgagggccacaucaagcugaccgacuacggcaugugcaaggagggccugagacccggcgacaccaccagcaccuucugcggcacccccaacuacaucgcccccgagauccugagaggcgaggacuacggcuucagcguggacuggugggcccugggcgugcugauguucgagaugauggccggcagaagccccuucgacaucgugggcagcagcgacaaccccgaccagaacaccgaggacuaccuguuccaggugauccuggagaagcagaucagaauccccagaagccugagcgugaaggccgccagcgugcugaagagcuuccugaacaaggaccccaaggagagacugggcugccacccccagaccggcuucgccgacauccagggccaccccuucuucagaaacguggacugggacaugauggagcagaagcagguggugccccccuucaagcccaacaucagcggcgaguucggccuggacaacuucgacagccaguucaccaacgagcccgugcagcugacccccgacgacgacgacaucgugagaaagaucgaccagagcgaguucgagggcuucgaguacaucaacccccugcugaugagcgccgaggagugcguguaa

SEQ ID NO: 22001 - RNA, 1932 nt, Artificial Sequence
  PRKCQ__Homo_sapiens__NP_001229342
augagccccuuccugagaaucggccugagcaacuucgacugcggcagcugccagagcugccagggcgaggccgugaaccccuacugcgccgugcuggugaaggaguacguggagagcgagaacggccagauguacauccagaagaagcccaccauguacccccccugggacagcaccuucgacgcccacaucaacaagggcagagugaugcagaucaucgugaagggcaagaacguggaccugaucagcgagaccaccguggagcuguacagccuggccgagagaugcagaaagaacaacggcaagaccgagaucuggcuggagcugaagccccagggcagaaugcugaugaacgccagauacuuccuggagaugagcgacaccaaggacaugaacgaguucgagaccgagggcuucuucgcccugcaccagagaagaggcgccaucaagcaggccaaggugcaccacgugaagugccacgaguucaccgccaccuucuucccccagcccaccuucugcagcgugugccacgaguucguguggggccugaacaagcagggcuaccagugcagacagugcaacgccgccauccacaagaagugcaucgacaaggugaucgccaagugcaccggcagcgccaucaacagcagagagaccauguuccacaaggagagauucaagaucgacaugccccacagauucaagguguacaacuacaagagccccaccuucugcgagcacugcggcacccugcuguggggccuggccagacagggccugaagugcgacgccugcggcaugaacgugcaccacagaugccagaccaagguggccaaccugugcggcaucaaccagaagcugauggccgaggcccuggccaugaucgagagcacccagcaggccagaugccugagagacaccgagcagaucuucagagagggccccguggagaucggccugcccugcagcaucaagaacgaggccagaccccccugccugcccacccccggcaagagagagccccagggcaucagcugggagagcccccuggacgagguggacaagaugugccaccugcccgagcccgagcugaacaaggagagacccagccugcagaucaagcugaagaucgaggacuucauccugcacaagaugcugggcaagggcagcuucggcaagguguuccuggccgaguucaagaagaccaaccaguucuucgccaucaaggcccugaagaaggacguggugcugauggacgacgacguggagugcaccaugguggagaagagagugcugagccuggccugggagcaccccuuccugacccacauguucugcaccuuccagaccaaggagaaccuguucuucgugauggaguaccugaacggcggcgaccugauguaccacauccagagcugccacaaguucgaccugagcagagccaccuucuacgccgccgagaucauccugggccugcaguuccugcacagcaagggcaucguguacagagaccugaagcuggacaacauccugcuggacaaggacggccacaucaagaucgccgacuucggcaugugcaaggagaacaugcugggcgacgccaagaccaacaccuucugcggcacccccgacuacaucgcccccgagcuguucgugagagagcccgagaagagacugggcgugagaggcgacaucagacagcacccccuguucagagagaucaacugggaggagcuggagagaaaggagaucgacccccccuucagacccaaggugaagagccccuucgacugcagcaacuucgacaaggaguuccugaacgagaagcccagacugagcuucgccgacagagcccugaucaacagcauggaccagaacauguucagaaacuucagcuucaugaaccccggcauggagagacugaucagcuaa

SEQ ID NO: 22002 - RNA, 1587 nt, Artificial Sequence
  PRKCSH__Homo_sapiens__XP_011526433
augcugcugccccugcugcugcugcugcccaugugcugggccguggaggugaagagacccagaggcgugagccugaccaaccaccacuucuacgacgagagcaagcccuucaccugccuggacggcagcgccaccauccccuucgaccaggugaacgacgacuacugcgacugcaaggacggcagcgacgagcccggcaccgccgccugccccaacggcagcuuccacugcaccaacaccggcuacaagccccuguacauccccagcaacagagugaacgacggcgugugcgacugcugcgacggcaccgacgaguacaacagcggcgugaucugcgagaacaccugcaaggagaagggcagaaaggagagagagagccugcagcagauggccgaggugaccagagagggcuucagacugaagaagauccugaucgaggacuggaagaaggccagagaggagaagcagaagaagcugaucgagcugcaggccggcaagaagagccuggaggaccagguggagaugcugagaaccgugaaggaggaggccgagaagcccgagagagaggccaaggagcagcaccagaagcugugggaggagcagcuggccgccgccaaggcccagcaggagcaggagcuggccgccgacgccuucaaggagcuggacgacgacauggacggcaccgugagcgugaccgagcugcagacccaccccgagcuggacaccgacggcgacggcgcccugagcgaggccgaggcccaggcccugcugagcggcgacacccagaccgacgccaccagcuucuacgacagagugugggccgccaucagagacaaguacagaagcgaggcccugcccaccgaccugcccgcccccagcgcccccgaccugaccgagcccaaggaggagcagccccccgugcccagcagccccaccgaggaggaggaggaggaggaggaggaggaggaggaggaggccgaggaggaggaggaggaggaggacagcgaggaggccccccccccccugagccccccccagcccgccagccccgccgaggaggacaagaugccccccuacgacgagcagacccaggccuucaucgacgccgcccaggaggccagaaacaaguucgaggaggccgagagaagccugaaggacauggaggagagcaucagaaaccuggagcaggagaucagcuucgacuucggccccaacggcgaguucgccuaccuguacagccagugcuacgagcugaccaccaacgaguacguguacagacugugccccuucaagcuggugagccagaagcccaagcugggcggcagccccaccagccugggcaccuggggcagcuggaucggccccgaccacgacaaguucagcgccaugaaguacgagcagggcaccggcugcuggcagggccccaacagaagcaccaccgugagacugcugugcggcaaggagaccauggugaccagcaccaccgagcccagcagaugcgaguaccugauggagcugaugacccccgccgccugccccgagcccccccccgaggcccccaccgaggacgaccacgacgagcuguaa

SEQ ID NO: 22003 - RNA, 1788 nt, Artificial Sequence
  PRKCZ__Homo_sapiens__XP_011540075
augcccagcagaaccggccccaagauggagggcagcggcggcagagugagacugaaggcccacuacggcggcgacaucuucaucaccagcguggacgccgccaccaccuucgaggagcugugcgaggaggugagagacaugugcagacugcaccagcagcacccccugacccugaaguggguggacagcgagggcgaccccugcaccgugagcagccagauggagcuggaggaggccuucagacuggccagacagugcagagacgagggccugaucauccacguguuccccagcacccccgagcagcccggccugcccugccccggcgaggacaagagcaucuacagaagaggcgccagaagauggagaaagcuguacagagccaacggccaccuguuccaggccaagagauucaacagaagagccuacugcggccagugcagcgagagaaucuggggccuggccagacagggcuacagaugcaucaacugcaagcugcuggugcacaagagaugccacggccuggugccccugaccugcagaaagcacauggacagcgugaugcccagccaggagccccccguggacgacaagaacgaggacgccgaccugcccagcgaggagaccgacggcaucgccuacaucagcagcagcagaaagcacgacagcaucaaggacgacagcgaggaccugaagcccgugaucgacggcauggacggcaucaagaucagccagggccugggccugcaggacuucgaccugaucagagugaucggcagaggcagcuacgccaaggugcugcuggugagacugaagaagaacgaccagaucuacgccaugaagguggugaagaaggagcuggugcacgacgacgaggacaucgacugggugcagaccgagaagcacguguucgagcaggccagcagcaaccccuuccuggugggccugcacagcugcuuccagaccaccagcagacuguuccuggugaucgaguacgugaacggcggcgaccugauguuccacaugcagagacagagaaagcugcccgaggagcacgccagauucuacgccgccgagaucugcaucgcccugaacuuccugcacgagagaggcaucaucuacagagaccugaagcuggacaacgugcugcuggacgccgacggccacaucaagcugaccgacuacggcaugugcaaggagggccugggccccggcgacaccaccagcaccuucugcggcacccccaacuacaucgcccccgagauccugagaggcgaggaguacggcuucagcguggacuggugggcccugggcgugcugauguucgagaugauggccggcagaagccccuucgacaucaucaccgacaaccccgacaugaacaccgaggacuaccuguuccaggugauccuggagaagcccaucagaauccccagauuccugagcgugaaggccagccacgugcugaagggcuuccugaacaaggaccccaaggagagacugggcugcagaccccagaccggcuucagcgacaucaagagccacgccuucuucagaagcaucgacugggaccugaugcacagacagcugagaugcaccgacgccagaaccaccuggacccccagaagaugcggcagaaccgacgacauggacgcccagaccauguggaugcacggcagaagaagacacaccgacgacagcagcaccgacgacagcgacgccagaacccccagaagaagaggcagaaccgacgacgccgacgcccagaugaccuggacccacagauaa

SEQ ID NO: 22004 - RNA, 2739 nt, Artificial Sequence
  PRKD1__Homo_sapiens__NP_002733
augagcgccccccccgugcugagaccccccagcccccugcugcccguggccgccgccgccgccgccgccgccgccgcccuggugcccggcagcggccccggccccgcccccuuccuggcccccguggccgcccccgugggcggcaucagcuuccaccugcagaucggccugagcagagagcccgugcugcugcugcaggacagcagcggcgacuacagccuggcccacgugagagagauggccugcagcaucguggaccagaaguuccccgagugcggcuucuacggcauguacgacaagauccugcuguucagacacgaccccaccagcgagaacauccugcagcuggugaaggccgccagcgacauccaggagggcgaccugaucgagguggugcugagcgccagcgccaccuucgaggacuuccagaucagaccccacgcccuguucgugcacagcuacagagcccccgccuucugcgaccacugcggcgagaugcuguggggccuggugagacagggccugaagugcgagggcugcggccugaacuaccacaagagaugcgccuucaagauccccaacaacugcagcggcgugagaagaagaagacugagcaacgugagccugaccggcgugagcaccaucagaaccagcagcgccgagcugagcaccagcgcccccgacgagccccugcugcagaagagccccagcgagagcuucaucggcagagagaagagaagcaacagccagagcuacaucggcagacccauccaccuggacaagauccugaugagcaaggugaaggugccccacaccuucgugauccacagcuacaccagacccaccgugugccaguacugcaagaagcugcugaagggccuguucagacagggccugcagugcaaggacugcagauucaacugccacaagagaugcgcccccaaggugcccaacaacugccugggcgaggugaccaucaacggcgaccugcugagccccggcgccgagagcgacguggugauggaggagggcagcgacgacaacgacagcgagagaaacagcggccugauggacgacauggaggaggccauggugcaggacgccgagauggccauggccgagugccagaacgacagcggcgagaugcaggaccccgaccccgaccacgaggacgccaacagaaccaucagccccagcaccagcaacaacaucccccugaugagaguggugcagagcgugaagcacaccaagagaaagagcagcaccgugaugaaggagggcuggauggugcacuacaccagcaaggacacccugagaaagagacacuacuggagacuggacagcaagugcaucacccuguuccagaacgacaccggcagcagauacuacaaggagaucccccugagcgagauccugagccuggagcccgugaagaccagcgcccugauccccaacggcgccaacccccacugcuucgagaucaccaccgccaacgugguguacuacgugggcgagaacguggugaaccccagcagccccagccccaacaacagcgugcugaccagcggcgugggcgccgacguggccagaaugugggagaucgccauccagcacgcccugaugcccgugauccccaagggcagcagcgugggcaccggcaccaaccugcacagagacaucagcgugagcaucagcgugagcaacugccagauccaggagaacguggacaucagcaccguguaccagaucuuccccgacgaggugcugggcagcggccaguucggcaucguguacggcggcaagcacagaaagaccggcagagacguggccaucaagaucaucgacaagcugagauuccccaccaagcaggagagccagcugagaaacgagguggccauccugcagaaccugcaccaccccggcguggugaaccuggagugcauguucgagacccccgagagaguguucguggugauggagaagcugcacggcgacaugcuggagaugauccugagcagcgagaagggcagacugcccgagcacaucaccaaguuccugaucacccagauccugguggcccugagacaccugcacuucaagaacaucgugcacugcgaccugaagcccgagaacgugcugcuggccagcgccgaccccuucccccaggugaagcugugcgacuucggcuucgccagaaucaucggcgagaagagcuucagaagaagcguggugggcacccccgccuaccuggcccccgaggugcugagaaacaagggcuacaacagaagccuggacauguggagcgugggcgugaucaucuacgugagccugagcggcaccuuccccuucaacgaggacgaggacauccacgaccagauccagaacgccgccuucauguacccccccaaccccuggaaggagaucagccacgaggccaucgaccugaucaacaaccugcugcaggugaagaugagaaagagauacagcguggacaagacccugagccaccccuggcugcaggacuaccagaccuggcuggaccugagagagcuggagugcaagaucggcgagagauacaucacccacgagagcgacgaccugagaugggagaaguacgccggcgagcagggccugcaguaccccacccaccugaucaaccccagcgccagccacagcgacacccccgagaccgaggagaccgagaugaaggcccugggcgagagagugagcauccuguaa

SEQ ID NO: 22005 - RNA, 2673 nt, Artificial Sequence
  PRKD3__Homo_sapiens__XP_005264294
augagcgccaacaacagcccccccagcgcccagaagagcgugcugcccaccgccauccccgccgugcugcccgccgccagccccugcagcagccccaagaccggccugagcgccagacugagcaacggcagcuucagcgcccccagccugaccaacagcagaggcagcgugcacaccgugagcuuccugcugcagaucggccugaccagagagagcgugaccaucgaggcccaggagcugagccugagcgccgugaaggaccuggugugcagcaucguguaccagaaguuccccgagugcggcuucuucggcauguacgacaagauccugcuguucagacacgacaugaacagcgagaacauccugcagcugaucaccagcgccgacgagauccacgagggcgaccugguggagguggugcugagcgcccuggccaccguggaggacuuccagaucagaccccacacccuguacgugcacagcuacaaggcccccaccuucugcgacuacugcggcgagaugcuguggggccuggugagacagggccugaagugcgagggcugcggccugaacuaccacaagagaugcgccuucaagauccccaacaacugcagcggcgugagaaagagaagacugagcaacgugagccugcccggccccggccugagcgugcccagaccccugcagcccgaguacguggcccugcccagcgaggagagccacgugcaccaggagcccagcaagagaauccccagcuggagcggcagacccaucuggauggagaagauggugaugugcagagugaaggugccccacaccuucgccgugcacagcuacaccagacccaccaucugccaguacugcaagagacugcugaagggccuguucagacagggcaugcagugcaaggacugcaaguucaacugccacaagagaugcgccagcaaggugcccagagacugccugggcgaggugaccuucaacggcgagcccagcagccugggcaccgacaccgacauccccauggacaucgacaacaacgacaucaacagcgacagcagcagaggccuggacgacaccgaggagcccagcccccccgaggacaagauguucuuccuggaccccagcgaccuggacguggagagagacgaggaggccgugaagaccaucagccccagcaccagcaacaacaucccccugaugagaguggugcagagcaucaagcacaccaagagaaagagcagcaccauggugaaggagggcuggauggugcacuacaccagcagagacaaccugagaaagagacacuacuggagacuggacagcaagugccugacccuguuccagaacgagagcggcagcaaguacuacaaggagaucccccugagcgagauccugagaaucagcagccccagagacuucaccaacaucagccagggcagcaacccccacugcuucgagaucaucaccgacaccaugguguacuucgugggcgagaacaacggcgacagcagccacaaccccgugcuggccgccaccggcgugggccuggacguggcccagagcugggagaaggccaucagacaggcccugaugcccgugaccccccaggccagcgugugcaccagccccggccagggcaaggaccacaaggaccugagcaccagcaucagcgugagcaacugccagauccaggagaacguggacaucagcaccguguaccagaucuucgccgacgaggugcugggcagcggccaguucggcaucguguacggcggcaagcacagaaagaccggcagagacguggccaucaaggugaucgacaagaugagauuccccaccaagcaggagagccagcugagaaacgagguggccauccugcagaaccugcaccaccccggcaucgugaaccuggagugcauguucgagacccccgagagaguguucguggugauggagaagcugcacggcgacaugcuggagaugauccugagcagcgagaagagcagacugcccgagagaaucaccaaguucauggugacccagauccugguggcccugagaaaccugcacuucaagaacaucgugcacugcgaccugaagcccgagaacgugcugcuggccagcgccgagcccuucccccaggugaagcugugcgacuucggcuucgccagaaucaucggcgagaagagcuucagaagaagcguggugggcacccccgccuaccuggcccccgaggugcugagaagcaagggcuacaacagaagccuggacauguggagcgugggcgugaucaucuacgugagccugagcggcaccuuccccuucaacgaggacgaggacaucaacgaccagauccagaacgccgccuucauguacccccccaaccccuggagagagaucagcggcgaggccaucgaccugaucaacaaccugcugcaggugaagaugagaaagagauacagcguggacaagagccugagccaccccuggcugcaggacuaccagaccuggcuggaccugagagaguucgagaccagaaucggcgagagauacaucacccacgagagcgacgacgccagaugggagauccacgccuacacccacaaccugguguaccccaagcacuucaucauggcccccaaccccgacgacauggaggaggaccccuaa

SEQ ID NO: 22006 - RNA, 12294 nt, Artificial Sequence
  PRKDC__Homo_sapiens__NP_001075109
auggccggcagcggcgccggcgugagaugcagccugcugagacugcaggagacccugagcgccgccgacagaugcggcgccgcccuggccggccaccagcugaucagaggccugggccaggagugcgugcugagcagcagccccgccgugcuggcccugcagaccagccugguguucagcagagacuucggccugcugguguucgugagaaagagccugaacagcaucgaguucagagagugcagagaggagauccugaaguuccugugcaucuuccuggagaagaugggccagaagaucgcccccuacagcguggagaucaagaacaccugcaccagcguguacaccaaggacagagccgccaagugcaagauccccgcccuggaccugcugaucaagcugcugcagaccuucagaagcagcagacugauggacgaguucaagaucggcgagcuguucagcaaguucuacggcgagcuggcccugaagaagaagauccccgacaccgugcuggagaagguguacgagcugcugggccugcugggcgaggugcaccccagcgagaugaucaacaacgccgagaaccuguucagagccuuccugggcgagcugaagacccagaugaccagcgccgugagagagcccaagcugcccgugcuggccggcugccugaagggccugagcagccugcugugcaacuucaccaagagcauggaggaggacccccagaccagcagagagaucuucaacuucgugcugaaggccaucagaccccagaucgaccugaagagauacgccgugcccagcgccggccugagacuguucgcccugcacgccagccaguucagcaccugccugcuggacaacuacgugagccuguucgaggugcugcugaaguggugcgcccacaccaacguggagcugaagaaggccgcccugagcgcccuggagagcuuccugaagcaggugagcaacaugguggccaagaacgccgagaugcacaagaacaagcugcaguacuucauggagcaguucuacggcaucaucagaaacguggacagcaacaacaaggagcugagcaucgccaucagaggcuacggccuguucgccggccccugcaaggugaucaacgccaaggacguggacuucauguacguggagcugauccagagaugcaagcagauguuccugacccagaccgacaccggcgacgacagaguguaccagaugcccagcuuccugcagagcguggccagcgugcugcuguaccuggacaccgugcccgagguguacacccccgugcuggagcaccugguggugaugcagaucgacagcuucccccaguacagccccaagaugcagcuggugugcugcagagccaucgugaagguguuccuggcccuggccgccaagggccccgugcugagaaacugcaucagcaccguggugcaccagggccugaucagaaucugcagcaagcccguggugcugcccaagggccccgagagcgagagcgaggaccacagagccagcggcgaggugagaaccggcaaguggaaggugcccaccuacaaggacuacguggaccuguucagacaccugcugagcagcgaccagaugauggacagcauccuggccgacgaggccuucuucagcgugaacagcagcagcgagagccugaaccaccugcuguacgacgaguucgugaagagcgugcugaagaucguggagaagcuggaccugacccuggagauccagaccgugggcgagcaggagaacggcgacgaggcccccggcguguggaugauccccaccagcgaccccgccgccaaccugcaccccgccaagcccaaggacuucagcgccuucaucaaccugguggaguucugcagagagauccugcccgagaagcaggccgaguucuucgagcccuggguguacagcuucagcuacgagcugauccugcagagcaccagacugccccugaucagcggcuucuacaagcugcugagcaucaccgugagaaacgccaagaagaucaaguacuucgagggcgugagccccaagagccugaagcacagccccgaggaccccgagaaguacagcugcuucgcccuguucgugaaguucggcaaggagguggccgugaagaugaagcaguacaaggacgagcugcuggccagcugccugaccuuccugcugagccugccccacaacaucaucgagcuggacgugagagccuacgugcccgcccugcagauggccuucaagcugggccugagcuacaccccccuggccgaggugggccugaacgcccuggaggaguggagcaucuacaucgacagacacgugaugcagcccuacuacaaggacauccugcccugccuggacggcuaccugaagaccagcgcccugagcgacgagaccaagaacaacugggaggugagcgcccugagcagagccgcccagaagggcuucaacaagguggugcugaagcaccugaagaagaccaagaaccugagcagcaacgaggccaucagccuggaggagaucagaaucagaguggugcagaugcugggcagccugggcggccagaucaacaagaaccugcugaccgugaccagcagcgacgagaugaugaagagcuacguggccugggacagagagaagagacugagcuucgccgugcccuucagagagaugaagcccgugaucuuccuggacguguuccugcccagagugaccgagcuggcccugaccgccagcgacagacagaccaagguggccgccugcgagcugcugcacagcauggugauguucaugcugggcaaggccacccagaugcccgagggcggccagggcgccccccccauguaccagcuguacaagagaaccuuccccgugcugcugagacuggccugcgacguggaccaggugaccagacagcuguacgagccccuggugaugcagcugauccacugguucaccaacaacaagaaguucgagagccaggacaccguggcccugcuggaggccauccuggacggcaucguggaccccguggacagcacccugagagacuucugcggcagaugcaucagagaguuccugaaguggagcaucaagcagaucaccccccagcagcaggagaagagccccgugaacaccaagagccuguucaagagacuguacagccuggcccugcaccccaacgccuucaagagacugggcgccagccuggccuucaacaacaucuacagagaguucagagaggaggagagccugguggagcaguucguguucgaggcccuggugaucuacauggagagccuggcccuggcccacgccgacgagaagagccugggcaccauccagcagugcugcgacgccaucgaccaccugugcagaaucaucgagaagaagcacgugagccugaacaaggccaagaagagaagacugcccagaggcuucccccccagcgccagccugugccugcuggaccuggugaaguggcugcuggcccacugcggcagaccccagaccgagugcagacacaagagcaucgagcuguucuacaaguucgugccccugcugcccggcaacagaagccccaaccuguggcugaaggacgugcugaaggaggagggcgugagcuuccugaucaacaccuucgagggcggcggcugcggccagcccagcggcauccuggcccagcccacccugcuguaccugagaggccccuucagccugcaggccacccugugcuggcuggaccugcugcuggccgcccuggagugcuacaacaccuucaucggcgagagaaccgugggcgcccugcaggugcugggcaccgaggcccagagcagccugcugaaggccguggccuucuuccuggagagcaucgccaugcacgacaucaucgccgccgagaagugcuucggcaccggcgccgccggcaacagaaccagcccccaggagggcgagagauacaacuacagcaagugcaccgugguggugagaaucauggaguucaccaccacccugcugaacaccagccccgagggcuggaagcugcugaagaaggaccugugcaacacccaccugaugagagugcuggugcagacccugugcgagcccgccagcaucggcuucaacaucggcgacgugcaggugauggcccaccugcccgacgugugcgugaaccugaugaaggcccugaagaugagccccuacaaggacauccuggagacccaccugagagagaagaucaccgcccagagcaucgaggagcugugcgccgugaaccuguacggccccgacgcccagguggacagaagcagacuggccgccguggugagcgccugcaagcagcugcacagagccggccugcugcacaacauccugcccagccagagcaccgaccugcaccacagcgugggcaccgagcugcugagccugguguacaagggcaucgcccccggcgacgagagacagugccugcccagccuggaccugagcugcaagcagcuggccagcggccugcuggagcuggccuucgccuucggcggccugugcgagagacuggugagccugcugcugaaccccgccgugcugagcaccgccagccugggcagcagccagggcagcgugauccacuucagccacggcgaguacuucuacagccuguucagcgagaccaucaacaccgagcugcugaagaaccuggaccuggccgugcuggagcugaugcagagcagcguggacaacaccaagauggugagcgccgugcugaacggcaugcuggaccagagcuucagagagagagccaaccagaagcaccagggccugaagcuggccaccaccauccugcagcacuggaagaagugcgacagcuggugggccaaggacagcccccuggagaccaagauggccgugcuggcccugcuggccaagauccugcagaucgacagcagcgugagcuucaacaccagccacggcagcuuccccgagguguucaccaccuacaucagccugcuggccgacaccaagcuggaccugcaccugaagggccaggccgugacccugcugcccuucuucaccagccugaccggcggcagccuggaggagcugagaagagugcuggagcagcugaucguggcccacuuccccaugcagagcagagaguucccccccggcacccccagauucaacaacuacguggacugcaugaagaaguuccuggacgcccuggagcugagccagagccccaugcugcuggagcugaugaccgaggugcugugcagagagcagcagcacgugauggaggagcuguuccagagcagcuucagaagaaucgccagaagaggcagcugcgugacccaggugggccugcuggagagcguguacgagauguucagaaaggacgaccccagacugagcuucaccagacagagcuucguggacagaagccugcugacccugcuguggcacugcagccuggacgcccugagagaguucuucagcaccaucgugguggacgccaucgacgugcugaagagcagauucaccaagcugaacgagagcaccuucgacacccagaucaccaagaagaugggcuacuacaagauccuggacgugauguacagcagacugcccaaggacgacgugcacgccaaggagagcaagaucaaccagguguuccacggcagcugcaucaccgagggcaacgagcugaccaagacccugaucaagcugugcuacgacgccuucaccgagaacauggccggcgagaaccagcugcuggagagaagaagacuguaccacugcgccgccuacaacugcgccaucagcgugaucugcugcguguucaacgagcugaaguucuaccagggcuuccuguucagcgagaagcccgagaagaaccugcugaucuucgagaaccugaucgaccugaagagaagauacaacuuccccguggagguggaggugcccauggagagaaagaagaaguacaucgagaucagaaaggaggccagagaggccgccaacggcgacagcgacggccccagcuacaugagcagccugagcuaccuggccgacagcacccugagcgaggagaugagccaguucgacuucagcaccggcgugcagagcuacagcuacagcagccaggaccccagacccgccaccggcagauucagaagaagagagcagagagaccccaccgugcacgacgacgugcuggagcuggagauggacgagcugaacagacacgagugcauggccccccugaccgcccuggugaagcacaugcacagaagccugggccccccccagggcgaggaggacagcgugcccagagaccugcccagcuggaugaaguuccugcacggcaagcugggcaaccccaucgugccccugaacaucagacuguuccuggccaagcuggugaucaacaccgaggagguguucagacccuacgccaagcacuggcugagcccccugcugcagcuggccgccagcgagaacaacggcggcgagggcauccacuacauggugguggagaucguggccaccauccugagcuggaccggccuggccacccccaccggcgugcccaaggacgaggugcuggccaacagacugcugaacuuccugaugaagcacguguuccaccccaagagagccguguucagacacaaccuggagaucaucaagacccugguggagugcuggaaggacugccugagcauccccuacagacugaucuucgagaaguucagcggcaaggaccccaacagcaaggacaacagcgugggcauccagcugcugggcaucgugauggccaacgaccugccccccuacgacccccagugcggcauccagagcagcgaguacuuccaggcccuggugaacaacaugagcuucgugagauacaaggagguguacgccgccgccgccgaggugcugggccugauccugagauacgugauggagagaaagaacauccuggaggagagccugugcgagcugguggccaagcagcugaagcagcaccagaacaccauggaggacaaguucaucgugugccugaacaaggugaccaagagcuuccccccccuggccgacagauucaugaacgccguguucuuccugcugcccaaguuccacggcgugcugaagacccugugccuggagguggugcugugcagaguggagggcaugaccgagcuguacuuccagcugaagagcaaggacuucgugcaggugaugagacacagagacgacgagagacagaaggugugccuggacaucaucuacaagaugaugcccaagcugaagcccguggagcugagagagcugcugaaccccgugguggaguucgugagccaccccagcaccaccugcagagagcagauguacaacauccugauguggauccacgacaacuacagagaccccgagagcgagaccgacaacgacagccaggagaucuucaagcuggccaaggacgugcugauccagggccugaucgacgagaaccccggccugcagcugaucaucagaaacuucuggagccacgagaccagacugcccagcaacacccuggacagacugcuggcccugaacagccuguacagccccaagaucgaggugcacuuccugagccuggccaccaacuuccugcuggagaugaccagcaugagccccgacuaccccaaccccauguucgagcacccccugagcgagugcgaguuccaggaguacaccaucgacagcgacuggagauucagaagcaccgugcugacccccauguucguggagacccaggccagccagggcacccugcagaccagaacccaggagggcagccugagcgccagauggcccguggccggccagaucagagccacccagcagcagcacgacuucacccugacccagaccgccgacggcagaagcagcuucgacuggcugaccggcagcagcaccgacccccugguggaccacaccagccccagcagcgacagccugcuguucgcccacaagagaagcgagagacugcagagagccccccugaagagcgugggccccgacuucggcaagaagagacugggccugcccggcgacgagguggacaacaaggugaagggcgccgccggcagaaccgaccugcugagacugagaagaagauucaugagagaccaggagaagcugagccugauguacgccagaaagggcguggccgagcagaagagagagaaggagaucaagagcgagcugaagaugaagcaggacgcccagguggugcuguacagaagcuacagacacggcgaccugcccgacauccagaucaagcacagcagccugaucaccccccugcaggccguggcccagagagaccccaucaucgccaagcagcuguucagcagccuguucagcggcauccugaaggagauggacaaguucaagacccugagcgagaagaacaacaucacccagaagcugcugcaggacuucaacagauuccugaacaccaccuucagcuucuucccccccuucgugagcugcauccaggacaucagcugccagcacgccgcccugcugagccuggaccccgccgccgugagcgccggcugccuggccagccugcagcagcccgugggcaucagacugcuggaggaggcccugcugagacugcugcccgccgagcugcccgccaagagagugagaggcaaggccagacugccccccgacgugcugagauggguggagcuggccaagcuguacagaagcaucggcgaguacgacgugcugagaggcaucuucaccagcgagaucggcaccaagcagaucacccagagcgcccugcuggccgaggccagaagcgacuacagcgaggccgccaagcaguacgacgaggcccugaacaagcaggacuggguggacggcgagcccaccgaggccgagaaggacuucugggagcuggccagccuggacugcuacaaccaccuggccgaguggaagagccuggaguacugcagcaccgccagcaucgacagcgagaacccccccgaccugaacaagaucuggagcgagcccuucuaccaggagaccuaccugcccuacaugaucagaagcaagcugaagcugcugcugcagggcgaggccgaccagagccugcugaccuucaucgacaaggccaugcacggcgagcugcagaaggccauccuggagcugcacuacagccaggagcugagccugcuguaccugcugcaggacgacguggacagagccaaguacuacauccagaacggcauccagagcuucaugcagaacuacagcagcaucgacgugcugcugcaccagagcagacugaccaagcugcagagcgugcaggcccugaccgagauccaggaguucaucagcuucaucagcaagcagggcaaccugagcagccaggugccccugaagagacugcugaacaccuggaccaacagauaccccgacgccaagauggaccccaugaacaucugggacgacaucaucaccaacagaugcuucuuccugagcaagaucgaggagaagcugaccccccugcccgaggacaacagcaugaacguggaccaggacggcgaccccagcgacagaauggaggugcaggagcaggaggaggacaucagcagccugaucagaagcugcaaguucagcaugaagaugaagaugaucgacagcgccagaaagcagaacaacuucagccuggccaugaagcugcugaaggagcugcacaaggagagcaagaccagagacgacuggcuggugagcugggugcagagcuacugcagacugagccacugcagaagcagaagccagggcugcagcgagcaggugcugaccgugcugaagaccgugagccugcuggacgagaacaacgugagcagcuaccugagcaagaacauccuggccuucagagaccagaacauccugcugggcaccaccuacagaaucaucgccaacgcccugagcagcgagcccgccugccuggccgagaucgaggaggacaaggccagaagaauccuggagcugagcggcagcagcagcgaggacagcgagaaggugaucgccggccuguaccagagagccuuccagcaccugagcgaggccgugcaggccgccgaggaggaggcccagccccccagcuggagcugcggccccgccgccggcgugaucgacgccuacaugacccuggccgacuucugcgaccagcagcugagaaaggaggaggagaacgccagcgugaucgacagcgccgagcugcaggccuaccccgcccuggugguggagaagaugcugaaggcccugaagcugaacagcaacgaggccagacugaaguuccccagacugcugcagaucaucgagagauaccccgaggagacccugagccugaugaccaaggagaucagcagcgugcccugcuggcaguucaucagcuggaucagccacaugguggcccugcuggacaaggaccaggccguggccgugcagcacagcguggaggagaucaccgacaacuacccccaggccaucguguaccccuucaucaucagcagcgagagcuacagcuucaaggacaccagcaccggccacaagaacaaggaguucguggccagaaucaagagcaagcuggaccagggcggcgugauccaggacuucaucaacgcccuggaccagcugagcaaccccgagcugcuguucaaggacuggagcaacgacgugagagccgagcuggccaagacccccgugaacaagaagaacaucgagaagauguacgagagaauguacgccgcccugggcgaccccaaggcccccggccugggcgccuucagaagaaaguucauccagaccuucggcaaggaguucgacaagcacuucggcaagggcggcagcaagcugcugagaaugaagcugagcgacuucaacgacaucaccaacaugcugcugcugaagaugaacaaggacagcaagccccccggcaaccugaaggagugcagccccuggaugagcgacuucaagguggaguuccugagaaacgagcuggagauccccggccaguacgacggcagaggcaagccccugcccgaguaccacgugagaaucgccggcuucgacgagagagugaccgugauggccagccugagaagacccaagagaaucaucaucagaggccacgacgagagagagcaccccuuccuggugaagggcggcgaggaccugagacaggaccagagaguggagcagcuguuccaggugaugaacggcauccuggcccaggacagcgccugcagccagagagcccugcagcugagaaccuacagcguggugcccaugaccagcagcgaccccagagccccccccugcgaguacaaggacuggcugaccaagaugagcggcaagcacgacgugggcgccuacaugcugauguacaagggcgccaacagaaccgagaccgugaccagcuucagaaagagagagagcaaggugcccgccgaccugcugaagagagccuucgugagaaugagcaccagccccgaggccuuccuggcccugagaagccacuucgccagcagccacgcccugaucugcaucagccacuggauccugggcaucggcgacagacaccugaacaacuucaugguggccauggagaccggcggcgugaucggcaucgacuucggccacgccuucggcagcgccacccaguuccugcccgugcccgagcugaugcccuucagacugaccagacaguucaucaaccugaugcugcccaugaaggagaccggccugauguacagcaucauggugcacgcccugagagccuucagaagcgaccccggccugcugaccaacaccauggacguguucgugaaggagcccagcuucgacuggaagaacuucgagcagaagaugcugaagaagggcggcagcuggauccaggagaucaacguggccgagaagaacugguaccccagacagaagaucugcuacgccaagagaaagcuggccggcgccaaccccgccgugaucaccugcgacgagcugcugcugggccacgagaaggcccccgccuucagagacuacguggccguggccagaggcagcaaggaccacaacaucagagcccaggagcccgagagcggccugagcgaggagacccaggugaagugccugauggaccaggccaccgaccccaacauccugggcagaaccugggagggcugggagcccuggauguaa

SEQ ID NO: 22007 - RNA, 2016 nt, Artificial Sequence
  PRKG1__Homo_sapiens__NP_001091982
augagcgagcuggaggaggacuucgccaagauccugaugcugaaggaggagagaaucaaggagcuggagaagagacugagcgagaaggaggaggagauccaggagcugaagagaaagcugcacaagugccagagcgugcugcccgugcccagcacccacaucggccccagaaccaccagagcccagggcaucagcgccgagccccagaccuacagaagcuuccacgaccugagacaggccuucagaaaguucaccaagagcgagagaagcaaggaccugaucaaggaggccauccuggacaacgacuucaugaagaaccuggagcugagccagauccaggagaucguggacugcauguaccccguggaguacggcaaggacagcugcaucaucaaggagggcgacgugggcagccugguguacgugauggaggacggcaagguggaggugaccaaggagggcgugaagcugugcaccaugggccccggcaagguguucggcgagcuggccauccuguacaacugcaccagaaccgccaccgugaagacccuggugaacgugaagcugugggccaucgacagacagugcuuccagaccaucaugaugagaaccggccugaucaagcacaccgaguacauggaguuccugaagagcgugcccaccuuccagagccugcccgaggagauccugagcaagcuggccgacgugcuggaggagacccacuacgagaacggcgaguacaucaucagacagggcgccagaggcgacaccuucuucaucaucagcaagggcaccgugaacgugaccagagaggacagccccagcgaggaccccguguuccugagaacccugggcaagggcgacugguucggcgagaaggcccugcagggcgaggacgugagaaccgccaacgugaucgccgccgaggccgugaccugccuggugaucgacagagacagcuucaagcaccugaucggcggccuggacgacgugagcaacaaggccuacgaggacgccgaggccaaggccaaguacgaggccgaggccgccuucuucgccaaccugaagcugagcgacuucaacaucaucgacacccugggcgugggcggcuucggcagaguggagcuggugcagcugaagagcgaggagagcaagaccuucgccaugaagauccugaagaagagacacaucguggacaccagacagcaggagcacaucagaagcgagaagcagaucaugcagggcgcccacagcgacuucaucgugagacuguacagaaccuucaaggacagcaaguaccuguacaugcugauggaggccugccugggcggcgagcuguggaccauccugagagacagaggcagcuucgaggacagcaccaccagauucuacaccgccugcgugguggaggccuucgccuaccugcacagcaagggcaucaucuacagagaccugaagcccgagaaccugauccuggaccacagaggcuacgccaagcugguggacuucggcuucgccaagaagaucggcuucggcaagaagaccuggaccuucugcggcacccccgaguacguggcccccgagaucauccugaacaagggccacgacaucagcgccgacuacuggagccugggcauccugauguacgagcugcugaccggcagcccccccuucagcggccccgaccccaugaagaccuacaacaucauccugagaggcaucgacaugaucgaguuccccaagaagaucgccaagaacgccgccaaccugaucaagaagcugugcagagacaaccccagcgagagacugggcaaccugaagaacggcgugaaggacauccagaagcacaagugguucgagggcuucaacugggagggccugagaaagggcacccugaccccccccaucauccccagcguggccagccccaccgacaccagcaacuucgacagcuuccccgaggacaacgacgagcccccccccgacgacaacagcggcugggacaucgacuucuaa

SEQ ID NO: 22008 - RNA, 1029 nt, Artificial Sequence
  PRKG2__Homo_sapiens__NP_001269410
augagcaacuggaagcugagcaaggcccugagccuggagaugauccagcugaaggagaagguggccagauucagcagcagcagccccuuccagaaccuggagaucaucgccacccugggcgugggcggcuucggcagaguggagcuggugaaggugaagaacgagaacguggccuucgccaugaagugcaucagaaagaagcacaucguggacaccaagcagcaggagcacguguacagcgagaagagaauccuggaggagcugugcagccccuucaucgugaagcuguacagaaccuucaaggacaacaaguacguguacaugcugcuggaggccugccugggcggcgagcuguggagcauccugagagacagaggcagcuucgacgagcccaccagcaaguucugcguggccugcgugaccgaggccuucgacuaccugcacagacugggcaucaucuacagagaccugaagcccgagaaccugauccuggacgccgagggcuaccugaagcugguggacuucggcuucgccaagaagaucggcagcggccagaagaccuggaccuucugcggcacccccgaguacguggcccccgaggugauccugaacaagggccacgacuucagcguggacuucuggagccugggcauccugguguacgagcugcugaccggcaacccccccuucagcggcguggaccagaugaugaccuacaaccugauccugaagggcaucgagaagauggacuuccccagaaagaucaccagaagacccgaggaccugaucagaagacugugcagacagaaccccaccgagagacugggcaaccugaagaacggcaucaacgacaucaagaagcacagauggcugaacggcuucaacugggagggccugaaggccagaagccugcccagcccccugcagagagagcugaagggccccaucgaccacagcuacuucgacaaguacccccccgagaagggcaugccccccgacgagcugagcggcugggacaaggacuucuaa

SEQ ID NO: 22009 - RNA, 909 nt, Artificial Sequence
  PRKRA__Homo_sapiens__NP_001132989
augcagagcacccccuucugcggcuucugcagccugggcaagaugaucaccgccaagcccggcaagacccccauccaggugcugcacgaguacggcaugaagaccaagaacauccccguguacgagugcgagagaagcgacgugcagauccacgugcccaccuucaccuucagagugaccgugggcgacaucaccugcaccggcgagggcaccagcaagaagcuggccaagcacagagccgccgaggccgccaucaacauccugaaggccaacgccagcaucugcuucgccgugcccgacccccugaugcccgaccccagcaagcagcccaagaaccagcugaaccccaucggcagccugcaggagcuggccauccaccacggcuggagacugcccgaguacacccugagccaggagggcggccccgcccacaagagagaguacaccaccaucugcagacuggagagcuucauggagaccggcaagggcgccagcaagaagcaggccaagagaaacgccgccgagaaguuccuggccaaguucagcaacaucagccccgagaaccacaucagccugaccaacguggugggccacagccugggcugcaccuggcacagccugagaaacagccccggcgagaagaucaaccugcugaagagaagccugcugagcauccccaacaccgacuacauccagcugcugagcgagaucgccaaggagcagggcuucaacaucaccuaccuggacaucgacgagcugagcgccaacggccaguaccagugccuggccgagcugagcaccagccccaucaccgugugccacggcagcggcaucagcugcggcaacgcccagagcgacgccgcccacaacgcccugcaguaccugaagaucaucgccgagagaaaguaa

SEQ ID NO: 22010 - RNA, 2286 nt, Artificial Sequence
  PRKRIR__Homo_sapiens__NP_004696
augcccaacuucugcgccgcccccaacugcaccagaaagagcacccagagcgaccuggccuucuucagauuccccagagaccccgccagaugccagaaguggguggagaacugcagaagagccgaccuggaggacaagacccccgaccagcugaacaagcacuacagacugugcgccaagcacuucgagaccagcaugaucugcagaaccagccccuacagaaccgugcugagagacaacgccauccccaccaucuucgaccugaccagccaccugaacaacccccacagcagacacagaaagagaaucaaggagcugagcgaggacgagaucagaacccugaagcagaagaagaucgacgagaccagcgagcaggagcagaagcacaaggagaccaacaacagcaacgcccagaaccccagcgaggaggagggcgagggccaggacgaggacauccugccccugacccuggaggagaaggagaacaaggaguaccugaagagccuguucgagauccugauccugaugggcaagcagaacaucccccuggacggccacgaggccgacgagauccccgagggccuguucacccccgacaacuuccaggcccugcuggagugcagaaucaacagcggcgaggaggugcugagaaagagauucgagaccaccgccgugaacacccuguucugcagcaagacccagcagagacagaugcuggagaucugcgagagcugcaucagagaggagacccugagagaggugagagacagccacuucuucagcaucaucaccgacgacgugguggacaucgccggcgaggagcaccugcccgugcuggugagauucguggacgagagccacaaccugagagaggaguucaucggcuuccugcccuacgaggccgacgccgagauccuggccgugaaguuccacaccaugaucaccgagaaguggggccugaacauggaguacugcagaggccaggccuacaucgugagcagcggcuucagcagcaagaugaaggugguggccagcagacugcuggagaaguacccccaggccaucuacacccugugcagcagcugcgcccugaacauguggcuggccaagagcgugcccgugaugggcgugagcguggcccugggcaccaucgaggaggugugcagcuucuuccacagaagcccccagcugcugcuggagcuggacaacgugaucagcgugcuguuccagaacagcaaggagagaggcaaggagcugaaggagaucugccacagccaguggaccggcagacacgacgccuucgagauccugguggagcugcugcaggcccuggugcugugccuggacggcaucaacagcgacaccaacaucagauggaacaacuacaucgccggcagagccuucgugcugugcagcgccgugagcgacuucgacuucaucgugaccaucguggugcugaagaacgugcugagcuucaccagagccuucggcaagaaccugcagggccagaccagcgacguguucuucgccgccggcagccugaccgccgugcugcacagccugaacgaggugauggagaacaucgagguguaccacgaguucugguucgaggaggccaccaaccuggccaccaagcuggacauccagaugaagcugcccggcaaguucagaagagcccaccagggcaaccuggagagccagcugaccagcgagagcuacuacaaggagacccugagcgugcccaccguggagcacaucauccaggagcugaaggacaucuucagcgagcagcaccugaaggcccugaagugccugagccuggugcccagcgugaugggccagcugaaguucaacaccagcgaggagcaccacgccgacauguacagaagcgaccugcccaaccccgacacccugagcgccgagcugcacugcuggagaaucaaguggaagcacagaggcaaggacaucgagcugcccagcaccaucuacgaggcccugcaccugcccgacaucaaguucuuccccaacguguacgcccugcugaaggugcugugcauccugcccgugaugaagguggagaacgagagauacgagaacggcagaaagagacugaaggccuaccugagaaacacccugaccgaccagagaagcagcaaccuggcccugcugaacaucaacuucgacaucaagcacgaccuggaccugaugguggacaccuacaucaagcuguacaccagcaagagcgagcugcccaccgacaacagcgagaccguggagaacaccuaa

SEQ ID NO: 22011 - RNA, 1077 nt, Artificial Sequence
  PRKX__Homo_sapiens__NP_005035
auggaggcccccggccuggcccaggccgccgccgccgagagcgacagcagaaagguggccgaggagacccccgacggcgcccccgcccugugccccagccccgaggcccugagccccgagccccccguguacagccugcaggacuucgacacccuggccaccgugggcaccggcaccuucggcagagugcaccuggugaaggagaagaccgccaagcacuucuucgcccugaaggugaugagcauccccgacgugaucagacugaagcaggagcagcacgugcacaacgagaagagcgugcugaaggaggugagccaccccuuccugaucagacuguucuggaccuggcacgacgagagauuccuguacaugcugauggaguacgugcccggcggcgagcuguucagcuaccugagaaacagaggcagauucagcagcaccaccggccuguucuacagcgccgagaucaucugcgccaucgaguaccugcacagcaaggagaucguguacagagaccugaagcccgagaacauccugcuggacagagacggccacaucaagcugaccgacuucggcuucgccaagaagcugguggacagaaccuggacccugugcggcacccccgaguaccuggcccccgaggugauccagagcaagggccacggcagagccguggacuggugggcccugggcauccugaucuucgagaugcugagcggcuucccccccuucuucgacgacaaccccuucggcaucuaccagaagauccuggccggcaagaucgacuuccccagacaccuggacuuccacgugaaggaccugaucaagaagcugcuggugguggacagaaccagaagacugggcaacaugaagaacggcgccaacgacgugaagcaccacagaugguucagaagcguggacugggaggccgugccccagagaaagcugaagccccccaucgugcccaagaucgccggcgacggcgacaccagcaacuucgagaccuaccccgagaacgacugggacaccgccgcccccgugccccagaaggaccuggagaucuucaagaacuucuaa

SEQ ID NO: 22012 - RNA, 264 nt, Artificial Sequence
  PRLH__Homo_sapiens__NP_056977
augaaggugcugagagccuggcugcugugccugcugaugcugggccuggcccugagaggcgccgccagcagaacccacagacacagcauggagaucagaacccccgacaucaaccccgccugguacgccagcagaggcaucagacccgugggcagauucggcagaagaagagccacccugggcgacgugcccaagcccggccugagacccagacugaccugcuucccccuggagggcggcgccaugagcagccaggacggcuaa

SEQ ID NO: 22013 - RNA, 684 nt, Artificial Sequence
  PRL__Homo_sapiens__NP_000939
augaacaucaagggcagccccuggaagggcagccugcugcugcugcuggugagcaaccugcugcugugccagagcguggccccccugcccaucugccccggcggcgccgccagaugccaggugacccugagagaccuguucgacagagccguggugcugagccacuacauccacaaccugagcagcgagauguucagcgaguucgacaagagauacacccacggcagaggcuucaucaccaaggccaucaacagcugccacaccagcagccuggccacccccgaggacaaggagcaggcccagcagaugaaccagaaggacuuccugagccugaucgugagcauccugagaagcuggaacgagccccuguaccaccuggugaccgaggugagaggcaugcaggaggcccccgaggccauccugagcaaggccguggagaucgaggagcagaccaagagacugcuggagggcauggagcugaucgugagccaggugcaccccgagaccaaggagaacgagaucuaccccguguggagcggccugcccagccugcagauggccgacgaggagagcagacugagcgccuacuacaaccugcugcacugccugagaagagacagccacaagaucgacaacuaccugaagcugcugaagugcagaaucauccacaacaacaacugcuaa

SEQ ID NO: 22014 - RNA, 1113 nt, Artificial Sequence
  PRLHR__Homo_sapiens__NP_004239
auggccagcagcaccaccagaggccccagagugagcgaccuguucagcggccugccccccgccgugaccacccccgccaaccagagcgccgaggccagcgccggcaacggcagcguggccggcgccgacgcccccgccgugacccccuuccagagccugcagcuggugcaccagcugaagggccugaucgugcugcuguacagcgugguggugguggugggccuggugggcaacugccugcuggugcuggugaucgccagagugagaagacugcacaacgugaccaacuuccugaucggcaaccuggcccugagcgacgugcugaugugcaccgccugcgugccccugacccuggccuacgccuucgagcccagaggcuggguguucggcggcggccugugccaccugguguucuuccugcagcccgugaccguguacgugagcguguucacccugaccaccaucgccguggacagauacguggugcuggugcacccccugagaagaagaaucagccugagacugagcgccuacgccgugcuggccaucugggcccugagcgccgugcuggcccugcccgccgccgugcacaccuaccacguggagcugaagccccacgacgugagacugugcgaggaguucuggggcagccaggagagacagagacagcuguacgccuggggccugcugcuggugaccuaccugcugccccugcuggugauccugcugagcuacgugagagugagcgugaagcugagaaacagaguggugcccggcugcgugacccagagccaggccgacugggacagagccagaagaagaagaaccuucugccugcuggugguggugguggugguguucgccgugugcuggcugccccugcacguguucaaccugcugagagaccuggacccccacgccaucgaccccuacgccuucggccuggugcagcugcugugccacuggcuggccaugagcagcgccugcuacaaccccuucaucuacgccuggcugcacgacagcuucagagaggagcugagaaagcugcugguggccuggcccagaaagaucgccccccacggccagaacaugaccgugagcguggugaucuaa

SEQ ID NO: 22015 - RNA, 1566 nt, Artificial Sequence
  PRLR__Homo_sapiens__NP_001191243
augaaggagaacguggccagcgccaccguguucacccugcugcuguuccugaacaccugccugcugaacgugcagcccgaccccccccuggagcuggccguggaggugaagcagcccgaggacagaaagcccuaccuguggaucaaguggagcccccccacccugaucgaccugaagaccggcugguucacccugcuguacgagaucagacugaagcccgagaaggccgccgagugggagauccacuucgccggccagcagaccgaguucaagauccugagccugcaccccggccagaaguaccuggugcaggugagaugcaagcccgaccacggcuacuggagcgccuggagccccgccaccuucauccagauccccagcgacuucaccaugaacgacaccaccguguggaucagcguggccgugcugagcgccgugaucugccugaucaucgugugggccguggcccugaagggcuacagcauggugaccugcaucuucccccccgugcccggccccaagaucaagggcuucgacgcccaccugcuggagaagggcaagagcgaggagcugcugagcgcccugggcugccaggacuucccccccaccagcgacuacgaggaccugcugguggaguaccuggagguggacgacagcgaggaccagcaccugaugagcgugcacagcaaggagcaccccagccagggcaugaagcccaccuaccuggaccccgacaccgacagcggcagaggcagcugcgacagccccagccugcugagcgagaagugcgaggagccccaggccaaccccagcaccuucuacgaccccgaggugaucgagaagcccgagaaccccgagaccacccacaccugggacccccagugcaucagcauggagggcaagauccccuacuuccacgccggcggcagcaagugcagcaccuggccccugccccagcccagccagcacaaccccagaagcagcuaccacaacaucaccgacgugugcgagcuggccgugggccccgccggcgcccccgccacccugcugaacgaggccggcaaggacgcccugaagagcagccagaccaucaagagcagagaggagggcaaggccacccagcagagagagguggagagcuuccacagcgagaccgaccaggacacccccuggcugcugccccaggagaagacccccuucggcagcgccaagccccuggacuacguggagauccacaaggugaacaaggacggcgcccugagccugcugcccaagcagagagagaacagcggcaagcccaagaagcccggcacccccgagaacaacaaggaguacgccaaggugagcggcgugauggacaacaacauccuggugcuggugcccgacccccacgccaagaacguggccugcuucgaggagagcgccaaggaggccccccccagccuggagcagaaccaggccgagaaggcccuggccaacuucaccgccaccagcagcaagugcagacugcagcugggcggccuggacuaccuggaccccgccugcuucacccacagcuuccacuaa

SEQ ID NO: 22016 - RNA, 156 nt, Artificial Sequence
  PRM1__Homo_sapiens__NP_002752
auggccagauacagaugcugcagaagccagagcagaagcagauacuacagacagagacagagaagcagaagaagaagaagaagaagcugccagaccagaagaagagccaugagaugcugcagacccagauacagacccagaugcagaagacacuaa

SEQ ID NO: 22017 - RNA, 423 nt, Artificial Sequence
  PRM2__Homo_sapiens__NP_001273285
auggugagauacagagugagaagccugagcgagagaagccacgagguguacagacagcagcugcacggccaggagcagggccaccacggccaggaggagcagggccugagccccgagcacguggagguguacgagagaacccacggccagagccacuacagaagaagacacugcagcagaagaagacugcacagaauccacagaagacagcacagaagcugcagaagaagaaagagaagaagcugcagacacagaagaagacacagaagagagagccugggcgacccccugaaccagaacuuccugagccagaaggccgccgagcccggcagagagcacgccgagggcaccaagcugcccggcccccugacccccagcuggaagcugagaaagagcagacccaagcaccaggugagacccuaa

SEQ ID NO: 22018 - RNA, 312 nt, Artificial Sequence
  PRM3__Homo_sapiens__NP_067070
augggcagcagaugcgccaagcugaacaccggccagagccccggccacagccccggccacagcaccggccacggcagaggccacgagagcagcaugaagaagcugauggccugcgugagccaggacaacuucagccugagcagcgccggcgaggaggaggaggaggaggaggaggagggcgaggaggaggagaaggaggagcugcccgugcagggcaagcugcugcugcuggagcccgagagacaggaggagggccacaaggacaacgccgaggcccagcagagccccgagcccaagagaacccccagcuaa

SEQ ID NO: 22019 - RNA, 1116 nt, Artificial Sequence
  PRMT1__Homo_sapiens__NP_001527
auggccgccgccgaggccgccaacugcaucauggagaacuucguggccacccuggccaacggcaugagccugcagcccccccuggaggaggugagcugcggccaggccgagagcagcgagaagcccaacgccgaggacaugaccagcaaggacuacuacuucgacagcuacgcccacuucggcauccacgaggagaugcugaaggacgaggugagaacccugaccuacagaaacagcauguuccacaacagacaccuguucaaggacaagguggugcuggacgugggcagcggcaccggcauccugugcauguucgccgccaaggccggcgccagaaaggugaucggcaucgagugcagcagcaucagcgacuacgccgugaagaucgugaaggccaacaagcuggaccacguggugaccaucaucaagggcaagguggaggagguggagcugcccguggagaagguggacaucaucaucagcgaguggaugggcuacugccuguucuacgagagcaugcugaacaccgugcuguacgccagagacaaguggcuggcccccgacggccugaucuuccccgacagagccacccuguacgugaccgccaucgaggacagacaguacaaggacuacaagauccacuggugggagaacguguacggcuucgacaugagcugcaucaaggacguggccaucaaggagccccugguggacgugguggaccccaagcagcuggugaccaacgccugccugaucaaggagguggacaucuacaccgugaagguggaggaccugaccuucaccagccccuucugccugcaggugaagagaaacgacuacgugcacgcccugguggccuacuucaacaucgaguucaccagaugccacaagagaaccggcuucagcaccagccccgagagccccuacacccacuggaagcagaccguguucuacauggaggacuaccugaccgugaagaccggcgaggagaucuucggcaccaucggcaugagacccaacgccaagaacaacagagaccuggacuucaccaucgaccuggacuucaagggccagcugugcgagcugagcugcagcaccgacuacagaaugagauaa

SEQ ID NO: 22020 - RNA, 996 nt, Artificial Sequence
  PRMT2__Homo_sapiens__NP_001229793
auggccaccagcggcgacugccccagaagcgagagccagggcgaggagcccgccgagugcagcgaggccggccugcugcaggagggcgugcagcccgaggaguucguggccaucgccgacuacgccgccaccgacgagacccagcugagcuuccugagaggcgagaagauccugauccugagacagaccaccgccgacuggugguggggcgagagagccggcugcugcggcuacauccccgccaaccacgugggcaagcacguggacgaguacgaccccgaggacaccuggcaggacgaggaguacuucggcagcuacggcacccugaagcugcaccuggagaugcuggccgaccagcccagaaccaccaaguaccacagcgugauccugcagaacaaggagagccugaccgacaaggugauccuggacgugggcugcggcaccggcaucaucagccuguucugcgcccacuacgccagacccagagccguguacgccguggaggccagcgagauggcccagcacaccggccagcuggugcugcagaacggcuucgccgacaucaucaccguguaccagcagaagguggaggacguggugcugcccgagaagguggacgugcuggugagcgaguggaugggcaccugccugcugacccugagaggcgagcugagauucgacaucagaaaggccggcacccugcacggcuucaccgccugguucagcgugcacuuccagagccugcaggagggccagcccccccaggugcugagcaccggccccuuccaccccaccacccacuggaagcagacccuguucaugauggacgaccccgugcccgugcacaccggcgacguggugaccggcagcguggugcugcagagaaaccccguguggagaagacacaugagcguggcccugagcugggccgugaccagcagacaggaccccaccagccagaaggugggcgagaagguguuccccaucuggagauaa

SEQ ID NO: 22021 - RNA, 1410 nt, Artificial Sequence
  PRMT3__Homo_sapiens__NP_001138638
augugcagccuggccagcggcgccaccggcuacagccaccugcugaagaagcacuuccacaccgugagccugagcaucagccugauccugaccgccugguucaucaacaugaaccccaccguggaguacaugaacagcaucuacaaccccgugcccugggagaaggaggaguaccugaagcccgugcuggaggacgaccugcugcugcaguucgacguggaggaccuguacgagcccgugagcgugcccuucagcuaccccaacggccugagcgagaacaccagcgugguggagaagcugaagcacauggaggccagagcccugagcgccgaggccgcccuggccagagccagagaggaccugcagaagaugaagcaguucgcccaggacuucgugaugcacaccgacgugagaaccugcagcagcagcaccagcgugaucgccgaccugcaggaggacgaggacggcguguacuucagcagcuacggccacuacggcauccacgaggagaugcugaaggacaagaucagaaccgagagcuacagagacuucaucuaccagaacccccacaucuucaaggacaagguggugcuggacgugggcugcggcaccggcauccugagcauguucgccgccaaggccggcgccaagaaggugcugggcguggaccagagcgagauccuguaccaggccauggacaucaucagacugaacaagcuggaggacaccaucacccugaucaagggcaagaucgaggaggugcaccugcccguggagaagguggacgugaucaucagcgaguggaugggcuacuuccugcuguucgagagcaugcuggacagcgugcuguacgccaagaacaaguaccuggccaagggcggcagcguguaccccgacaucugcaccaucagccugguggccgugagcgacgugaacaagcacgccgacagaaucgccuucugggacgacguguacggcuucaagaugagcugcaugaagaaggccgugauccccgaggccgugguggaggugcuggaccccaagacccugaucagcgagcccugcggcaucaagcacaucgacugccacaccaccagcaucagcgaccuggaguucagcagcgacuucacccugaagaucaccagaaccagcaugugcaccgccaucgccggcuacuucgacaucuacuucgagaagaacugccacaacagagugguguucagcaccggcccccagagcaccaagacccacuggaagcagaccguguuccugcuggagaagcccuucagcgugaaggccggcgaggcccugaagggcaaggugaccgugcacaagaacaagaaggaccccagaagccugaccgugacccugacccugaacaacagcacccagaccuacggccugcaguaa

SEQ ID NO: 22022 - RNA, 1863 nt, Artificial Sequence
  PRMT5__Homo_sapiens__NP_001034708
augagaggccccaacagcggcaccgagaagggcagacuggugauccccgagaagcagggcuucgacuuccugugcaugcccguguuccaccccagauucaagagagaguucauccaggagcccgccaagaacagacccggcccccagaccagaagcgaccugcugcugagcggcagagacuggaacacccugaucgugggcaagcugagccccuggaucagacccgacagcaagguggagaagaucagaagaaacagcgaggccgccaugcugcaggagcugaacuucggcgccuaccugggccugcccgccuuccugcugccccugaaccaggaggacaacaccaaccuggccagagugcugaccaaccacauccacaccggccaccacagcagcauguucuggaugagagugccccugguggcccccgaggaccugagagacgacaucaucgagaacgcccccaccacccacaccgaggaguacagcggcgaggagaagaccuggaugugguggcacaacuucagaacccugugcgacuacagcaagagaaucgccguggcccuggagaucggcgccgaccugcccagcaaccacgugaucgacagauggcugggcgagcccaucaaggccgccauccugcccaccagcaucuuccugaccaacaagaagggcuuccccgugcugagcaagaugcaccagagacugaucuucagacugcugaagcuggaggugcaguucaucaucaccggcaccaaccaccacagcgagaaggaguucugcagcuaccugcaguaccuggaguaccugagccagaacagacccccccccaacgccuacgagcuguucgccaagggcuacgaggacuaccugcagagcccccugcagccccugauggacaaccuggagagccagaccuacgagguguucgagaaggaccccaucaaguacagccaguaccagcaggccaucuacaagugccugcuggacagagugcccgaggaggagaaggacaccaacgugcaggugcugauggugcugggcgccggcagaggcccccuggugaacgccagccugagagccgccaagcaggccgacagaagaaucaagcuguacgccguggagaagaaccccaacgccguggugacccuggagaacuggcaguucgaggaguggggcagccaggugaccguggugagcagcgacaugagagaguggguggcccccgagaaggccgacaucaucgugagcgagcugcugggcagcuucgccgacaacgagcugagccccgagugccuggacggcgcccagcacuuccugaaggacgacggcgugagcauccccggcgaguacaccagcuuccuggcccccaucagcagcagcaagcuguacaacgaggugagagccugcagagagaaggacagagaccccgaggcccaguucgagaugcccuacguggugagacugcacaacuuccaccagcugagcgccccccagcccugcuucaccuucagccaccccaacagagaccccaugaucgacaacaacagauacugcacccuggaguuccccguggaggugaacaccgugcugcacggcuucgccggcuacuucgagaccgugcuguaccaggacaucacccugagcaucagacccgagacccacagccccggcauguucagcugguuccccauccuguuccccaucaagcagcccaucaccgugagagagggccagaccaucugcgugagauucuggagaugcagcaacagcaagaaggugugguacgagugggccgugaccgcccccgugugcagcgccauccacaaccccaccggcagaagcuacaccaucggccuguaa

SEQ ID NO: 22023 - RNA, 1158 nt, Artificial Sequence
  PRMT8__Homo_sapiens__NP_001243465
auggagagccuggccagcgacggcuucaagcugaaggaggugagcagcgugaacagcccccccagccagcccccccagcccguggugcccgccaagcccgugcagugcgugcaccacgugagcacccagcccagcugccccggcagaggcaagaugagcaagcugcugaaccccgaggagaugaccagcagagacuacuacuucgacagcuacgcccacuucggcauccacgaggagaugcugaaggacgaggugagaacccugaccuacagaaacagcauguaccacaacaagcacguguucaaggacaagguggugcuggacgugggcagcggcaccggcauccugagcauguucgccgccaaggccggcgccaagaagguguucggcaucgagugcagcagcaucagcgacuacagcgagaagaucaucaaggccaaccaccuggacaacaucaucaccaucuucaagggcaagguggaggagguggagcugcccguggagaagguggacaucaucaucagcgaguggaugggcuacugccuguucuacgagagcaugcugaacaccgugaucuucgccagagacaaguggcugaagcccggcggccugauguuccccgacagagccgcccuguacgugguggccaucgaggacagacaguacaaggacuucaagauccacuggugggagaacguguacggcuucgacaugaccugcaucagagacguggccaugaaggagccccugguggacaucguggaccccaagcagguggugaccaacgccugccugaucaaggagguggacaucuacaccgugaagaccgaggagcugagcuucaccagcgccuucugccugcagauccagagaaacgacuacgugcacgcccuggugaccuacuucaacaucgaguucaccaagugccacaagaagaugggcuucagcaccgcccccgacgcccccuacacccacuggaagcagaccguguucuaccuggaggacuaccugaccgugagaagaggcgaggagaucuacggcaccaucagcaugaagcccaacgccaagaacgugagagaccuggacuucaccguggaccuggacuucaagggccagcugugcgagaccagcgugagcaacgacuacaagaugagauaa

SEQ ID NO: 22024 - RNA, 531 nt, Artificial Sequence
  PRND__Homo_sapiens__NP_036541
augagaaagcaccugagcuggugguggcuggccaccgugugcaugcugcuguucagccaccugagcgccgugcagaccagaggcaucaagcacagaaucaaguggaacagaaaggcccugcccagcaccgcccagaucaccgaggcccagguggccgagaacagacccggcgccuucaucaagcagggcagaaagcuggacaucgacuucggcgccgagggcaacagauacuacgaggccaacuacuggcaguuccccgacggcauccacuacaacggcugcagcgaggccaacgugaccaaggaggccuucgugaccggcugcaucaacgccacccaggccgccaaccagggcgaguuccagaagcccgacaacaagcugcaccagcaggugcuguggagacuggugcaggagcugugcagccugaagcacugcgaguucuggcuggagagaggcgccggccugagagugaccaugcaccagcccgugcugcugugccugcuggcccugaucuggcugaccgugaaguaa

SEQ ID NO: 22025 - RNA, 762 nt, Artificial Sequence
  PRNP__Homo_sapiens__NP_001073592
auggccaaccugggcugcuggaugcuggugcuguucguggccaccuggagcgaccugggccugugcaagaagagacccaagcccggcggcuggaacaccggcggcagcagauaccccggccagggcagccccggcggcaacagauaccccccccagggcggcggcggcuggggccagccccacggcggcggcuggggccagccccacggcggcggcuggggccagccccacggcggcggcuggggccagccccacggcggcggcuggggccagggcggcggcacccacagccaguggaacaagcccagcaagcccaagaccaacaugaagcacauggccggcgccgccgccgccggcgccguggugggcggccugggcggcuacaugcugggcagcgccaugagcagacccaucauccacuucggcagcgacuacgaggacagauacuacagagagaacaugcacagauaccccaaccagguguacuacagacccauggacgaguacagcaaccagaacaacuucgugcacgacugcgugaacaucaccaucaagcagcacaccgugaccaccaccaccaagggcgagaacuucaccgagaccgacgugaagaugauggagagagugguggagcagaugugcaucacccaguacgagagagagagccaggccuacuaccagagaggcagcagcauggugcuguucagcagcccccccgugauccugcugaucagcuuccugaucuuccugaucgugggcuaa

SEQ ID NO: 22026 - RNA, 1386 nt, Artificial Sequence
  PROC__Homo_sapiens__NP_000303
auguggcagcugaccagccugcugcuguucguggccaccuggggcaucagcggcacccccgccccccuggacagcguguucagcagcagcgagagagcccaccaggugcugagaaucagaaagagagccaacagcuuccuggaggagcugagacacagcagccuggagagagagugcaucgaggagaucugcgacuucgaggaggccaaggagaucuuccagaacguggacgacacccuggccuucuggagcaagcacguggacggcgaccagugccuggugcugccccuggagcaccccugcgccagccugugcugcggccacggcaccugcaucgacggcaucggcagcuucagcugcgacugcagaagcggcugggagggcagauucugccagagagaggugagcuuccugaacugcagccuggacaacggcggcugcacccacuacugccuggaggaggugggcuggagaagaugcagcugcgcccccggcuacaagcugggcgacgaccugcugcagugccaccccgccgugaaguuccccugcggcagacccuggaagagaauggagaagaagagaagccaccugaagagagacaccgaggaccaggaggaccagguggaccccagacugaucgacggcaagaugaccagaagaggcgacagccccuggcagguggugcugcuggacagcaagaagaagcuggccugcggcgccgugcugauccaccccagcugggugcugaccgccgcccacugcauggacgagagcaagaagcugcuggugagacugggcgaguacgaccugagaagaugggagaagugggagcuggaccuggacaucaaggagguguucgugcaccccaacuacagcaagagcaccaccgacaacgacaucgcccugcugcaccuggcccagcccgccacccugagccagaccaucgugcccaucugccugcccgacagcggccuggccgagagagagcugaaccaggccggccaggagacccuggugaccggcuggggcuaccacagcagcagagagaaggaggccaagagaaacagaaccuucgugcugaacuucaucaagauccccguggugccccacaacgagugcagcgaggugaugagcaacauggugagcgagaacaugcugugcgccggcauccugggcgacagacaggacgccugcgagggcgacagcggcggccccaugguggccagcuuccacggcaccugguuccuggugggccuggugagcuggggcgagggcugcggccugcugcacaacuacggcguguacaccaaggugagcagauaccuggacuggauccacggccacaucagagacaaggaggccccccagaagagcugggcccccuaa

SEQ ID NO: 22027 - RNA, 717 nt, Artificial Sequence
  PROCR__Homo_sapiens__NP_006395
augcugaccacccugcugcccauccugcugcugagcggcugggccuucugcagccaggacgccagcgacggccugcagagacugcacaugcugcagaucagcuacuucagagaccccuaccacgugugguaccagggcaacgccagccugggcggccaccugacccacgugcuggagggccccgacaccaacaccaccaucauccagcugcagccccugcaggagcccgagagcugggccagaacccagagcggccugcagagcuaccugcugcaguuccacggccuggugagacuggugcaccaggagagaacccuggccuucccccugaccaucagaugcuuccugggcugcgagcugccccccgagggcagcagagcccacguguucuucgagguggccgugaacggcagcagcuucgugagcuucagacccgagagagcccuguggcaggccgacacccaggugaccagcggcguggugaccuucacccugcagcagcugaacgccuacaacagaaccagauacgagcugagagaguuccuggaggacaccugcgugcaguacgugcagaagcacaucagcgccgagaacaccaagggcagccagaccagcagaagcuacaccagccuggugcugggcgugcuggugggcagcuucaucaucgccggcguggccgugggcaucuuccugugcaccggcggcagaagaugcuaa

SEQ ID NO: 22028 - RNA, 1230 nt, Artificial Sequence
  PRODH__Homo_sapiens__XP_011528580
auggccguggccagaaucagcggcaccagcaacaccagacccaccggccccagcggcaccgccggcauggugagcagcgugcccgcccccaccagcacccccaugagacccagcgccaccgccaccuggagacacagcugcgccgccagcaagccccagcugcaguucagcgaggugcuggccaaguggagaugcuucuuccaccagauggccguggagcagggccaggccggccuggccgccauggacaccaagcuggagguggccgugcugcaggagagcguggccaagcugggcaucgccagcagagccgagaucgaggacugguucaccgccgagacccugggcgugagcggcaccauggaccugcuggacuggagcagccugaucgacagcagaaccaagcugagcaagcaccugguggugcccaacgcccagaccggccagcuggagccccugcugagcagauucaccgaggaggaggagcugcagaugaccagaaugcugcagagaauggacgugcuggccaagaaggccaccgagaugggcgugagacugaugguggacgccgagcagaccuacuuccagcccgccaucagcagacugacccuggagaugcagagaaaguucaacguggagaagccccugaucuucaacaccuaccagugcuaccugaaggacgccuacgacaacgugacccuggacguggagcuggccagaagagagggcuggugcuucggcgccaagcuggugagaggcgccuaccuggcccaggagagagccagagccgccgagaucggcuacgaggaccccaucaaccccaccuacgaggccaccaacgccauguaccacagaugccuggacuacgugcuggaggagcugaagcacaacgccaaggccaaggugaugguggccagccacaacgaggacaccgugagauucgcccugagaagaauggaggagcugggccugcaccccgccgaccacagaguguacuucggccagcugcugggcaugugcgaccagaucagcuucccccugggccaggccggcuaccccguguacaaguacgugcccuacggccccgugauggaggugcugcccuaccugagcagaagagcccuggagaacagcagccugaugaagggcacccacagagagagacagcugcuguggcuggagcugcugagaagacugagaaccggcaaccuguuccacagacccgccuaa

SEQ ID NO: 22029 - RNA, 390 nt, Artificial Sequence
  PROK2__Homo_sapiens__NP_001119600
augagaagccugugcugcgccccccugcugcugcugcugcugcugcccccccugcugcugacccccagagccggcgacgccgccgugaucaccggcgccugcgacaaggacagccagugcggcggcggcaugugcugcgccgugagcaucugggugaagagcaucagaaucugcacccccaugggcaagcugggcgacagcugccacccccugaccagaaagaacaacuucggcaacggcagacaggagagaagaaagagaaagagaagcaagagaaagaaggaggugcccuucuucggcagaagaaugcaccacaccugccccugccugcccggccuggccugccugagaaccagcuucaacagauucaucugccuggcccagaaguaa

SEQ ID NO: 22030 - RNA, 1182 nt, Artificial Sequence
  PROKR1__Homo_sapiens__NP_620414
auggagaccaccaugggcuucauggacgacaacgccaccaacaccagcaccagcuuccugagcgugcugaacccccacggcgcccacgccaccagcuuccccuucaacuucagcuacagcgacuacgacaugccccuggacgaggacgaggacgugaccaacagcagaaccuucuucgccgccaagaucgugaucggcauggcccuggugggcaucaugcuggugugcggcaucggcaacuucaucuucaucgccgcccuggugagauacaagaagcugagaaaccugaccaaccugcugaucgccaaccuggccaucagcgacuuccugguggccaucgugugcugccccuucgagauggacuacuacguggugagacagcugagcugggagcacggccacgugcugugcaccagcgugaacuaccugagaaccgugagccuguacgugagcaccaacgcccugcuggccaucgccaucgacagauaccuggccaucgugcacccccugagacccagaaugaagugccagaccgccaccggccugaucgcccugguguggaccgugagcauccugaucgccauccccagcgccuacuucaccaccgagaccgugcuggugaucgugaagagccaggagaagaucuucugcggccagaucuggcccguggaccagcagcuguacuacaagagcuacuuccuguucaucuucggcaucgaguucgugggccccguggugaccaugacccugugcuacgccagaaucagcagagagcugugguucaaggccgugcccggcuuccagaccgagcagaucagaaagagacugagaugcagaagaaagaccgugcuggugcugaugugcauccugaccgccuacgugcugugcugggcccccuucuacggcuucaccaucgugagagacuucuuccccaccguguucgugaaggagaagcacuaccugaccgccuucuacaucguggagugcaucgccaugagcaacagcaugaucaacacccugugcuucgugaccgugaagaacgacaccgugaaguacuucaagaagaucaugcugcugcacuggaaggccagcuacaacggcggcaagagcagcgccgaccuggaccugaagaccaucggcaugcccgccaccgaggagguggacugcaucagacugaaguaa

SEQ ID NO: 22031 - RNA, 1155 nt, Artificial Sequence
  PROKR2__Homo_sapiens__NP_658986
auggccgcccagaacggcaacaccagcuucacccccaacuucaaccccccccaggaccacgccagcagccugagcuucaacuucagcuacggcgacuacgaccugcccauggacgaggacgaggacaugaccaagaccagaaccuucuucgccgccaagaucgugaucggcaucgcccuggccggcaucaugcuggugugcggcaucggcaacuucguguucaucgccgcccugaccagauacaagaagcugagaaaccugaccaaccugcugaucgccaaccuggccaucagcgacuuccugguggccaucaucugcugccccuucgagauggacuacuacguggugagacagcugagcugggagcacggccacgugcugugcgccagcgugaacuaccugagaaccgugagccuguacgugagcaccaacgcccugcuggccaucgccaucgacagauaccuggccaucgugcacccccugaagcccagaaugaacuaccagaccgccagcuuccugaucgcccugguguggauggugagcauccugaucgccauccccagcgccuacuucgccaccgagaccgugcuguucaucgugaagagccaggagaagaucuucugcggccagaucuggcccguggaccagcagcuguacuacaagagcuacuuccuguucaucuucggcguggaguucgugggccccguggugaccaugacccugugcuacgccagaaucagcagagagcugugguucaaggccgugcccggcuuccagaccgagcagaucagaaagagacugagaugcagaagaaagaccgugcuggugcugaugugcauccugaccgccuacgugcugugcugggcccccuucuacggcuucaccaucgugagagacuucuuccccaccguguucgugaaggagaagcacuaccugaccgccuucuacgugguggagugcaucgccaugagcaacagcaugaucaacaccgugugcuucgugaccgugaagaacaacaccaugaaguacuucaagaagaugaugcugcugcacuggagacccagccagagaggcagcaagagcagcgccgaccuggaccugagaaccaacggcgugcccaccaccgaggagguggacugcaucagacugaaguaa

SEQ ID NO: 22032 - RNA, 747 nt, Artificial Sequence
  PROL1__Homo_sapiens__NP_067048
augaagcugaccuucuuccugggccugcuggcccugaucagcugcuucacccccagcgagagccagagauucagcagaagacccuaccugcccggccagcugcccccccccccccuguacagacccagaugggugccccccagcccccccccccccuacgacagcagacugaacagcccccugagccugcccuucgugcccggcagagugccccccagcagcuucagcagauucagccaggccgugauccugagccagcuguucccccuggagagcaucagacagcccagacuguuccccggcuaccccaaccugcacuucccccugagacccuacuacgugggccccaucagaauccugaagccccccuucccccccauccccuucuuccuggccaucuaccugcccaucagcaaccccgagccccagaucaacaucaccaccgccgacaccaccaucaccaccaacccccccaccaccgccaccgccaccaccagcaccagcaccaagcccaccaugaccaucagcagcagcaccgugcccaucagcagcacccccgagcccgccaccagcaucagcgccgccacccccgccgccagcaccgagaacaccacccagauccuggccaacagaccccacaccgugcugcugaacgccaccgugcaggugaccaccagcaaccagaccauccugagcagccccgccuucaagagcuucuggcagaagcuguucgccaucuucggcuaa

SEQ ID NO: 22033 - RNA, 2571 nt, Artificial Sequence
  PROM1__Homo_sapiens__NP_001139319
auggcccuggugcugggcagccugcugcugcugggccugugcggcaacagcuucagcggcggccagcccagcagcaccgacgcccccaaggccuggaacuacgagcugcccgccaccaacuacgagacccaggacagccacaaggccggccccaucggcauccuguucgagcuggugcacaucuuccuguacguggugcagcccagagacuuccccgaggacacccugagaaaguuccugcagaaggccuacgagagcaagaucgacuacgacaagaucguguacuacgaggccggcaucauccugugcugcgugcugggccugcuguucaucauccugaugccccuggugggcuacuucuucugcaugugcagaugcugcaacaagugcggcggcgagaugcaccagagacagaaggagaacggccccuuccugagaaagugcuucgccaucagccugcuggugaucugcaucaucaucagcaucggcaucuucuacggcuucguggccaaccaccaggugagaaccagaaucaagagaagcagaaagcuggccgacagcaacuucaaggaccugagaacccugcugaacgagacccccgagcagaucaaguacauccuggcccaguacaacaccaccaaggacaaggccuucaccgaccugaacagcaucaacagcgugcugggcggcggcauccuggacagacugagacccaacaucauccccgugcuggacgagaucaagagcauggccaccgccaucaaggagaccaaggaggcccuggagaacaugaacagcacccugaagagccugcaccagcagagcacccagcugagcagcagccugaccagcgugaagaccagccugagaagcagccugaacgacccccugugccuggugcaccccagcagcgagaccugcaacagcaucagacugagccugagccagcugaacagcaaccccgagcugagacagcugccccccguggacgccgagcuggacaacgugaacaacgugcugagaaccgaccuggacggccuggugcagcagggcuaccagagccugaacgacauccccgacagagugcagagacagaccaccaccgugguggccggcaucaagagagugcugaacagcaucggcagcgacaucgacaacgugacccagagacugcccauccaggacauccugagcgccuucagcguguacgugaacaacaccgagagcuacauccacagaaaccugcccacccuggaggaguacgacagcuacugguggcugggcggccuggugaucugcagccugcugacccugaucgugaucuucuacuaccugggccugcugugcggcgugugcggcuacgacagacacgccacccccaccaccagaggcugcgugagcaacaccggcggcguguuccugauggugggcgugggccugagcuuccuguucugcuggauccugaugaucaucguggugcugaccuucguguucggcgccaacguggagaagcugaucugcgagcccuacaccagcaaggagcuguucagagugcuggacacccccuaccugcugaacgaggacugggaguacuaccugagcggcaagcuguucaacaagagcaagaugaagcugaccuucgagcagguguacagcgacugcaagaagaacagaggcaccuacggcacccugcaccugcagaacagcuucaacaucagcgagcaccugaacaucaacgagcacaccggcagcaucagcagcgagcuggagagccugaaggugaaccugaacaucuuccugcugggcgccgccggcagaaagaaccugcaggacuucgccgccugcggcaucgacagaaugaacuacgacagcuaccuggcccagaccggcaagagccccgccggcgugaaccugcugagcuucgccuacgaccuggaggccaaggccaacagccugccccccggcaaccugagaaacagccugaagagagacgcccagaccaucaagaccauccaccagcagagagugcugcccaucgagcagagccugagcacccuguaccagagcgugaagauccugcagagaaccggcaacggccugcuggagagagugaccagaauccuggccagccuggacuucgcccagaacuucaucaccaacaacaccagcagcgugaucaucgaggagaccaagaaguacggcagaaccaucaucggcuacuucgagcacuaccugcaguggaucgaguucagcaucagcgagaagguggccagcugcaagcccguggccaccgcccuggacaccgccguggacguguuccugugcagcuacaucaucgacccccugaaccuguucugguucggcaucggcaaggccaccguguuccugcugcccgcccugaucuucgccgugaagcuggccaaguacuacagaagaauggacagcgaggacguguacgacgacguggagaccauccccaugaagaacauggagaacggcaacaacggcuaccacaaggaccacguguacggcauccacaaccccgugaugaccagccccagccagcacuaa

SEQ ID NO: 22034 - RNA, 2505 nt, Artificial Sequence
  PROM2__Homo_sapiens__NP_001159449
augaagcacacccuggcccugcuggccccccugcugggccugggccugggccuggcccugagccagcuggccgccggcgccaccgacugcaaguuccugggccccgccgagcaccugaccuucacccccgccgccagagccagauggcuggcccccagagugagagcccccggccugcuggacagccuguacggcaccgugagaagauuccugagcguggugcagcugaaccccuuccccagcgagcuggugaaggcccugcugaacgagcuggccagcgugaaggugaacgagguggugagauacgaggccggcuacguggugugcgccgugaucgccggccuguaccugcugcuggugcccaccgccggccugugcuucugcugcugcagaugccacagaagaugcggcggcagagugaagaccgagcacaaggcccuggccugcgagagagccgcccugaugguguuccugcugcugaccacccugcugcugcugaucggcguggugugcgccuucgugaccaaccagagaacccacgagcagaugggccccagcaucgaggccaugcccgagacccugcugagccuguggggccuggugagcgacgugccccaggagcugcaggccguggcccagcaguucagccugccccaggagcaggugagcgaggagcuggacggcgugggcgugagcaucggcagcgccauccacacccagcugagaagcagcguguacccccugcuggccgccgugggcagccugggccaggugcugcaggugagcgugcaccaccugcagacccugaacgccaccgugguggagcugcaggccggccagcaggaccuggagcccgccaucagagagcacagagacagacugcuggagcugcugcaggaggccagaugccagggcgacugcgccggcgcccugagcugggccagaacccuggagcugggcgccgacuucagccaggugcccagcguggaccacgugcugcaccagcugaagggcgugcccgaggccaacuucagcagcauggugcaggaggagaacagcaccuucaacgcccugcccgcccuggccgccaugcagaccagcagcguggugcaggagcugaagaaggccguggcccagcagcccgagggcgugagaacccuggccgagggcuuccccggccuggaggccgccagcagaugggcccaggcccugcaggagguggaggagagcagcagacccuaccugcaggaggugcagagauacgagaccuacagauggaucgugggcugcgugcugugcagcguggugcuguucguggugcugugcaaccugcugggccugaaccugggcaucuggggccugagcgccagagacgaccccagccaccccgaggccaagggcgaggccggcgccagauuccugauggccggcgugggccugagcuuccuguucgccgccccccugauccugcugguguucgccaccuuccuggugggcggcaacgugcagacccuggugugccagagcugggagaacggcgagcuguucgaguucgccgacacccccggcaaccugccccccagcaugaaccugagccagcugcugggccugagaaagaacaucagcauccaccaggccuaccagcagugcaaggagggcgccgcccuguggaccgugcugcagcugaacgacagcuacgaccuggaggagcaccuggacaucaaccaguacaccaacaagcugagacaggagcugcagagccugaagguggacacccagagccuggaccugcugagcagcgccgccagaagagaccuggaggcccugcagagcagcggccugcagagaauccacuaccccgacuuccuggugcagauccagagacccguggugaagaccagcauggagcagcuggcccaggagcugcagggccuggcccaggcccaggacaacagcgugcugggccagagacugcaggaggaggcccagggccugagaaaccugcaccaggagaagguggugccccagcagagccugguggccaagcugaaccugagcgugagagcccuggagagcagcgcccccaaccugcagcuggagaccagcgacgugcuggccaacgugaccuaccugaagggcgagcugcccgccugggccgccagaauccugagaaacgugagcgagugcuuccuggccagagagaugggcuacuucagccaguacguggccugggugagagaggaggugacccagagaaucgccaccugccagccccugagcggcgcccuggacaacagcagagugauccugugcgacaugauggccgaccccuggaacgccuucugguucugccuggccuggugcaccuucuuccugauccccagcaucaucuucgccgugaagaccagcaaguacuucagacccaucagaaagagacugagcagcaccagcagcgaggagacccagcuguuccacauccccagagugaccagccugaagcuguaa

SEQ ID NO: 22035 - RNA, 681 nt, Artificial Sequence
  PROP1__Homo_sapiens__NP_006252
auggaggccgagagaagaagacaggccgagaagcccaagaagggcagagugggcagcagccugcugcccgagagacaccccgccaccggcacccccaccaccaccguggacagcagcgccccccccugcagaagacugcccggcgccggcggcggcagaagcagauucagcccccagggcggccagagaggcagaccccacagcagaagaagacacagaaccaccuucagccccgugcagcuggagcagcuggagagcgccuucggcagaaaccaguaccccgacaucugggccagagagagccuggccagagacaccggccugagcgaggccagaauccaggugugguuccagaacagaagagccaagcagagaaagcaggagagaagccugcugcagccccuggcccaccugagccccgccgccuucagcagcuuccugcccgagagcaccgccugccccuacagcuacgccgccccccccccccccgugaccugcuucccccaccccuacagccacgcccugcccagccagcccagcaccggcggcgccuucgcccugagccaccagagcgaggacugguaccccacccugcaccccgcccccgccggccaccugcccugccccccccccccccccaugcugccccugagccuggagcccagcaagagcuggaacuaa

SEQ ID NO: 22036 - RNA, 2031 nt, Artificial Sequence
  PROS1__Homo_sapiens__NP_000304
augagagugcugggcggcagaugcggcgcccugcuggccugccugcugcuggugcugcccgugagcgaggccaacuuccugagcaagcagcaggccagccaggugcuggugagaaagagaagagccaacagccugcuggaggagaccaagcagggcaaccuggagagagagugcaucgaggagcugugcaacaaggaggaggccagagagguguucgagaacgaccccgagaccgacuacuucuaccccaaguaccuggugugccugagaagcuuccagaccggccuguucaccgccgccagacagagcaccaacgccuaccccgaccugagaagcugcgugaacgccauccccgaccagugcagcccccugcccugcaacgaggacggcuacaugagcugcaaggacggcaaggccagcuucaccugcaccugcaagcccggcuggcagggcgagaagugcgaguucgacaucaacgagugcaaggaccccagcaacaucaacggcggcugcagccagaucugcgacaacacccccggcagcuaccacugcagcugcaagaacggcuucgugaugcugagcaacaagaaggacugcaaggacguggacgagugcagccugaagcccagcaucugcggcaccgccgugugcaagaacauccccggcgacuucgagugcgagugccccgagggcuacagauacaaccugaagagcaagagcugcgaggacaucgacgagugcagcgagaacaugugcgcccagcugugcgugaacuaccccggcggcuacaccugcuacugcgacggcaagaagggcuucaagcuggcccaggaccagaagagcugcgagguggugagcgugugccugccccugaaccuggacaccaaguacgagcugcuguaccuggccgagcaguucgccggcguggugcuguaccugaaguucagacugcccgagaucagcagauucagcgccgaguucgacuucagaaccuacgacagcgagggcgugauccuguacgccgagagcaucgaccacagcgccuggcugcugaucgcccugagaggcggcaagaucgaggugcagcugaagaacgagcacaccagcaagaucaccaccggcggcgacgugaucaacaacggccuguggaacauggugagcguggaggagcuggagcacagcaucagcaucaagaucgccaaggaggccgugauggacaucaacaagcccggcccccuguucaagcccgagaacggccugcuggagaccaagguguacuucgccggcuuccccagaaagguggagagcgagcugaucaagcccaucaaccccagacuggacggcugcaucagaagcuggaaccugaugaagcagggcgccagcggcaucaaggagaucauccaggagaagcagaacaagcacugccuggugaccguggagaagggcagcuacuaccccggcagcggcaucgcccaguuccacaucgacuacaacaacgugagcagcgccgagggcuggcacgugaacgugacccugaacaucagacccagcaccggcaccggcgugaugcuggcccuggugagcggcaacaacaccgugcccuucgccgugagccugguggacagcaccagcgagaagagccaggacauccugcugagcguggagaacaccgugaucuacagaauccaggcccugagccugugcagcgaccagcagagccaccuggaguucagagugaacagaaacaaccuggagcugagcaccccccugaagaucgagaccaucagccacgaggaccugcagagacagcuggccgugcuggacaaggccaugaaggccaagguggccaccuaccugggcggccugcccgacgugcccuucagcgccacccccgugaacgccuucuacaacggcugcauggaggugaacaucaacggcgugcagcuggaccuggacgaggccaucagcaagcacaacgacaucagagcccacagcugccccagcguguggaagaagaccaagaacagcuaa

SEQ ID NO: 22037 - RNA, 2835 nt, Artificial Sequence
  PROSER1__Homo_sapiens__NP_079414
auggacaagaagagcuucgagauggugcuggacgagaucagaaaggccgugcugaccgaguacaagcugaaggccaucgaguacgugcacggcuacuucagcagcgagcaggugguggaccugcugagauacuucagcugggccgagccccagcugaaggccaugaaggcccugcagcacaagaugguggccgugcagcccaccgagguggugaacauccugaacugcuucaccuucagcaaggacaagcugguggcccuggagcugcuggccagcaacaucaucgacgcccagaacagcagacccaucgaggaccuguucagagugaacaugagcgagaagaagagaugcaagagaauccuggagcaggccuucaagggcggcugcaaggccccccacgccaugaucagcagcugcggcaccauccccggcaaccccuaccccaagggcagacccagcagaaucaacggcaucuuccccggcaccccccugaagaaggacggcgaggagugcaccaacgagggcaagggcaucgccgccagaauccugggccccagcaagcccccccccagcaccuacaacccccacaagcccgugcccuaccccaucccccccugcagaccccacgccaccaucgcccccagcgccuacaacaacgccggccuggugccccuggccaacgugaucgcccccccccccccccccuacacccccaaccccgugggcaccgagaacgaggaccugagcaaccccagcaagcccauccagaaccagaccuucagcacccccgccagccagcuguucagcccccacggcagcaaccccagcacccccgccgccacccccgugcccaccgccagccccgugaaggccaucaaccaccccagcgccagcgccgccgccaccgugagcggcaugaaccugcugaacaccgugcugcccguguuccccggccaggugagcagcgccgugcacaccccccagcccagcauccccaaccccaccgugaucagaacccccagccugcccaccgcccccgugaccagcauccacagcaccaccaccacccccgugcccagcaucuucagcggccuggugagccugcccggccccagcgccacccccaccgccgccacccccacccccggccccacccccagaagcacccugggcagcagcgaggccuucgccagcaccagcgcccccuucaccagccugcccuucagcaccagcagcagcgccgccagcaccagcaaccccaacagcgccagccugagcagcguguucgccggccugccccugccccugccccccaccagccagggccugagcaaccccacccccgugaucgccggcggcagcacccccagcguggccggcccccugggcgugaacagcccccugcugagcgcccugaagggcuuccugaccagcaacgacaccaaccugaucaacagcagcgcccugagcagcgccgugaccagcggccuggccagccugagcagccugacccugcagaacagcgacagcagcgccagcgcccccaacaagugcuacgcccccagcgccauccccaccccccagagaaccagcacccccggccuggcccuguuccccggccugcccagccccguggccaacagcaccagcaccccccugacccugcccgugcagagcccccuggccaccgccgccagcgccagcaccagcgugcccgugagcugcggcagcagcgccagccugcugagaggcccccaccccggcaccagcgaccugcacaucagcagcacccccgccgccaccacccugcccgugaugaucaagaccgagcccaccagccccacccccagcgccuucaagggccccagccacagcggcaaccccagccacggcacccugggccugagcggcacccugggcagagccuacaccagcaccagcgugcccaucagccugagcgccugccugaaccccgcccugagcggccugagcagccugagcaccccccugaacggcagcaacccccugagcagcaucagccugcccccccacggcagcagcacccccaucgcccccguguucaccgcccugcccagcuucaccagccugaccaacaacuucccccugaccggcaaccccagccugaaccccagcgugagccugcccggcagccugaucgccaccagcagcaccgccgccaccagcaccagccugccccaccccagcagcaccgccgccgugcugagcggccugagcgccagcgcccccgugagcgccgcccccuucccccugaaccugagcaccgccgugcccagccuguucagcgugacccagggcccccugagcagcagcaaccccagcuaccccggcuucagcgugagcaacacccccagcgugacccccgcccugcccagcuuccccggccugcaggcccccagcaccguggccgccgugaccccccugcccguggccgccaccgcccccagccccgcccccgugcugcccggcuucgccagcgccuucagcagcaacuucaacagcgcccugguggcccaggccggccugagcagcggccugcaggccgccggcagcagcguguuccccggccugcugagccugcccggcauccccggcuucccccagaaccccagccagagcagccugcaggagcugcagcacaacgccgccgcccagagcgcccugcugcagcaggugcacagcgccagcgcccuggagagcuaccccgcccagcccgacggcuuccccagcuaccccagcgcccccggcacccccuucagccugcagcccagccugagccagagcggcuggcaguaa

SEQ ID NO: 22038 - RNA, 2217 nt, Artificial Sequence
  PROX1__Homo_sapiens__XP_011508075
augcccgaccacgacagcaccgcccugcugagcagacagaccaagagaagaagaguggacaucggcgugaagagaaccgugggcaccgccagcgccuucuucgccaaggccagagccaccuucuucagcgccaugaacccccagggcagcgagcaggacguggaguacagcguggugcagcacgccgacggcgagaagagcaacgugcugagaaagcugcugaagagagccaacagcuacgaggacgccaugaugcccuuccccggcgccaccaucaucagccagcugcugaagaacaacaugaacaagaacggcggcaccgagcccagcuuccaggccagcggccugagcagcaccggcagcgaggugcaccaggaggacaucugcagcaacagcagcagagacagcccccccgagugccugagccccuucggcagacccaccaugagccaguucgacauggacagacugugcgacgagcaccugagagccaagagagccagaguggagaacaucaucagaggcaugagccacagccccagcguggcccugagaggcaacgagaacgagagagagauggccccccagagcgugagccccagagagagcuacagagagaacaagagaaagcagaagcugccccagcagcagcagcagagcuuccagcagcuggugagcgccagaaaggagcagaagagagaggagagaagacagcugaagcagcagcuggaggacaugcagaagcagcugagacagcugcaggagaaguucuaccagaucuacgacagcaccgacagcgagaacgacgaggacggcaaccugagcgaggacagcaugagaagcgagauccuggacgccagagcccaggacagcgugggcagaagcgacaacgagaugugcgagcuggaccccggccaguucaucgacagagccagagcccugaucagagagcaggagauggccgagaacaagcccaagagagagggcaacaacaaggagagagaccacggccccaacagccugcagcccgagggcaagcaccuggccgagacccugaagcaggagcugaacaccgccaugagccaggugguggacaccguggugaagguguucagcgccaagcccagcagacaggugccccagguguuccccccccugcagaucccccaggccagauucgccgugaacggcgagaaccacaacuuccacaccgccaaccagagacugcagugcuucggcgacgugaucauccccaacccccuggacaccuucggcaacgugcagauggccagcagcaccgaccagaccgaggcccugccccugguggugagaaagaacagcagcgaccagagcgccagcggccccgccgccggcggccaccaccagccccugcaccagagcccccugagcgccaccaccggcuucaccaccagcaccuucagacaccccuucccccugccccugauggccuaccccuuccagagcccccugggcgcccccagcggcagcuucagcggcaaggacagagccagccccgagagccuggaccugaccagagacaccaccagccugagaaccaagaugagcagccaccaccugagccaccaccccugcagccccgcccacccccccagcaccgccgagggccugagccugagccugaucaagagcgagugcggcgaccugcaggacaugagcgagaucagccccuacagcggcagcgccaugcaggagggccugagccccaaccaccugaagaaggccaagcugauguucuucuacaccagauaccccagcagcaacaugcugaagaccuacuucagcgacgugaaguucaacagaugcaucaccagccagcugaucaagugguucagcaacuucagagaguucuacuacauccagauggagaaguacgccagacaggccaucaacgacggcgugaccagcaccgaggagcugagcaucaccagagacugcgagcuguacagagcccugaacaugcacuacaacaaggccaacgacuucgagcaggugcccgagagauuccuggagguggcccagaucacccugagagaguucuucaacgccaucaucgccggcaaggacguggaccccagcuggaagaaggccaucuacaaggugaucugcaagcuggacagcgaggugcccgagaucuucaagagccccaacugccugcaggagcugcugcacgaguaa

SEQ ID NO: 22039 - RNA, 1269 nt, Artificial Sequence
  PROZ__Homo_sapiens__NP_001243063
auggccggcugcgugccccugcugcagggccuggugcuggugcuggcccugcacagaguggagcccagcgccaccagccugaaggagagacacggccugcacagcgacagcgccugcaccggcgugcaggagagccuguuccugcccgccagcaaggccaacgacgugcuggugagauggaagagagccggcagcuaccugcuggaggagcuguucgagggcaaccuggagaaggagugcuacgaggagaucugcguguacgaggaggccagagagguguucgagaacgagguggugaccgacgaguucuggagaagauacaagggcggcagccccugcaucagccagcccugccugcacaacggcagcugccaggacagcaucuggggcuacaccugcaccugcagccccggcuacgagggcagcaacugcgagcuggccaagaacgagugccaccccgagagaaccgacggcugccagcacuucugccugcccggccaggagagcuacaccugcagcugcgcccagggcuacagacugggcgaggaccacaagcagugcgugccccacgaccagugcgccugcggcgugcugaccagcgagaagagagcccccgaccugcaggaccugcccuggcaggugaagcugaccaacagcgagggcaaggacuucugcggcggcgugaucaucagagagaacuucgugcugaccaccgccaagugcagccugcugcacagaaacaucaccgugaagaccuacuucaacagaaccagccaggacccccugaugaucaagaucacccacgugcacgugcacaugagauacgacgccgacgccggcgagaacgaccugagccugcuggagcuggaguggcccauccagugccccggcgccggccugcccgugugcacccccgagaaggacuucgccgagcaccugcugauccccagaaccagaggccugcugagcggcugggccagaaacggcaccgaccugggcaacagccugaccaccagacccgugacccugguggagggcgaggagugcggccaggugcugaacgugaccgugaccaccagaaccuacugcgagagaagcagcguggccgccaugcacuggauggacggcagcguggugaccagagagcacagaggcagcugguuccugaccggcgugcugggcagccagcccgugggcggccaggcccacauggugcuggugaccaaggugagcagauacagccugugguucaagcagaucaugaacuaa

SEQ ID NO: 22040 - RNA, 1515 nt, Artificial Sequence
  PRPF19__Homo_sapiens__NP_055317
augagccugaucugcagcaucagcaacgaggugcccgagcaccccugcgugagccccgugagcaaccacguguacgagagaagacugaucgagaaguacaucgccgagaacggcaccgaccccaucaacaaccagccccugagcgaggagcagcugaucgacaucaagguggcccaccccaucagacccaagccccccagcgccaccagcauccccgccauccugaaggcccugcaggacgagugggacgccgugaugcugcacagcuucacccugagacagcagcugcagaccaccagacaggagcugagccacgcccuguaccagcacgacgccgccugcagagugaucgccagacugaccaaggaggugaccgccgccagagaggcccuggccacccugaagccccaggccggccugaucgugccccaggccgugcccagcagccagcccagcguggugggcgccggcgagcccauggaccugggcgagcuggugggcaugacccccgagaucauccagaagcugcaggacaaggccaccgugcugaccaccgagagaaagaagagaggcaagaccgugcccgaggagcuggugaagcccgaggagcugagcaaguacagacagguggccagccacgugggccugcacagcgccagcauccccggcauccuggcccuggaccugugccccagcgacaccaacaagauccugaccggcggcgccgacaagaacguggugguguucgacaagagcagcgagcagauccuggccacccugaagggccacaccaagaaggugaccagcgugguguuccaccccagccaggaccugguguucagcgccagccccgacgccaccaucagaaucuggagcgugcccaacgccagcugcgugcagguggugagagcccacgagagcgccgugaccggccugagccugcacgccaccggcgacuaccugcugagcagcagcgacgaccaguacugggccuucagcgacauccagaccggcagagugcugaccaaggugaccgacgagaccagcggcugcagccugaccugcgcccaguuccaccccgacggccugaucuucggcaccggcaccauggacagccagaucaagaucugggaccugaaggagagaaccaacguggccaacuuccccggccacagcggccccaucaccagcaucgccuucagcgagaacggcuacuaccuggccaccgccgccgacgacagcagcgugaagcugugggaccugagaaagcugaagaacuucaagacccugcagcuggacaacaacuucgaggugaagagccugaucuucgaccagagcggcaccuaccuggcccugggcggcaccgacgugcagaucuacaucugcaagcaguggaccgagauccugcacuucaccgagcacagcggccugaccaccggcguggccuucggccaccacgccaaguucaucgccagcaccggcauggacagaagccugaaguucuacagccuguaa

SEQ ID NO: 22041 - RNA, 1500 nt, Artificial Sequence
  PRPF31__Homo_sapiens__XP_006726118
augagccuggccgacgagcugcuggccgaccuggaggaggccgccgaggaggaggagggcggcagcuacggcgaggaggaggaggagcccgccaucgaggacgugcaggaggagacccagcuggaccugagcggcgacagcgugaagaccaucgccaagcugugggacagcaagauguucgccgagaucaugaugaagaucgaggaguacaucagcaagcaggccaaggccagcgaggugaugggccccguggaggccgcccccgaguacagagugaucguggacgccaacaaccugaccguggagaucgagaacgagcugaacaucauccacaaguucaucagagacaaguacagcaagagauuccccgagcuggagagccuggugcccaacgcccuggacuacaucagaaccgugaaggagcugggcaacagccuggacaagugcaagaacaacgagaaccugcagcagauccugaccaacgccaccaucaugguggugagcgugaccgccagcaccacccagggccagcagcugagcgaggaggagcuggagagacuggaggaggccugcgacauggcccuggagcugaacgccagcaagcacagaaucuacgaguacguggagagcagaaugagcuucaucgcccccaaccugagcaucaucaucggcgccagcaccgccgccaagaucaugggcguggccggcggccugaccaaccugagcaagaugcccgccugcaacaucaugcugcugggcgcccagagaaagacccugagcggcuucagcagcaccagcgugcugccccacaccggcuacaucuaccacagcgacaucgugcagagccugccccccgaccugagaagaaaggccgccagacugguggccgccaagugcacccuggccgccagaguggacagcuuccacgagagcaccgagggcaaggugggcuacgagcugaaggacgagaucgagagaaaguucgacaaguggcaggagcccccccccgugaagcaggugaagccccugcccgccccccuggacggccagagaaagaagagaggcggcagaagauacagaaagaugaaggagagacugggccugaccgagaucagaaagcaggccaacagaaugagcuucggcgagaucgaggaggacgccuaccaggaggaccugggcuucagccugggccaccugggcaagagcggcagcggcagagugagacagacccaggugaacgaggccaccaaggccagaaucagcaagacccugcagagaacccugcagaagcagagcgugguguacggcggcaagagcaccaucagagacagaagcagcggcaccgccagcagcguggccuucaccccccugcagggccuggagaucgugaacccccaggccgccgagaagaagguggccgaggccaaccagaaguacuucagcagcauggccgaguuccugaaggugaagggcgagaagagcggccugaugagcaccuaa

SEQ ID NO: 22042 - RNA, 1050 nt, Artificial Sequence
  PRPF38B__Homo_sapiens__XP_011539987
augaccaucggcgagaugcugagaagcuuccugaccaagcuggagugguucagcacccuguuccccagaauccccgugcccgugcagaagaacaucgaccagcagaucaagaccagacccagaaagaucaagaaggacggcaaggagggcgccgaggagaucgacagacacguggagagaagaagaagcagaagccccagaagaagccugagccccagaagaagccccagaagaagcagaagcagaagccaccacagagagggccacggcagcagcagcuucgacagagagcuggagagagagaaggagagacagagacuggagagagaggccaaggagagagagaaggagagaagaagaagcagaagcaucgacagaggccuggagagaagaagaagcagaagcagagagagacacagaagcagaagcagaagcagagacagaaagggcgacagaagagacagagacagagagagagagaaggagaacgagagaggcagaagaagagacagagacuacgacaaggagagaggcaacgagagagagaaggagagagagagaagcagagagagaagcaaggagcagagaagcagaggcgagguggaggagaagaagcacaaggaggacaaggacgacagaagacacagagacgacaagagagacagcaagaaggagaagaagcacagcagaagcagaagcagagagagaaagcacagaagcagaagcagaagcagaaacgccggcaagagaagcagaagcagaagcaaggagaagagcagcaagcacaagaacgagagcaaggagaagagcaacaagagaagcagaagcggcagccagggcagaaccgacagcguggagaagagcaagaagagagagcacagccccagcaaggagaagagcagaaagagaagcagaagcaaggagagaagccacaagagagaccacagcgacagcaaggaccagagcgacaagcacgacagaagaagaagccagagcaucgagcaggagagccaggagaagcagcacaagaacaaggacgagaccguguaa

SEQ ID NO: 22043 - RNA, 1251 nt, Artificial Sequence
  PRPF3__Homo_sapiens__XP_011508434
auggcccugagcaagagagagcuggacgagcugaagcccuggaucgagaagaccgugaagagagugcugggcuucagcgagcccaccguggugaccgccgcccugaacugcgugggcaagggcauggacaagaagaaggccgccgaccaccugaagcccuuccuggacgacagcacccugagauucguggacaagcuguucgaggccguggaggagggcagaagcagcagacacagcaagagcagcagcgacagaagcagaaagagagagcugaaggagguguucggcgacgacagcgagaucagcaaggagagcagcggcgugaagaagagaagaauccccagauucgaggagguggaggaggagcccgaggugauccccggcccccccagcgagagccccggcaugcugaccaagcugcagaucaagcagaugauggaggccgccaccagacagaucgaggagagaaagaagcagcugagcuucaucagcccccccaccccccagcccaagacccccagcagcagccagcccgagagacugcccaucggcaacaccauccagcccagccaggccgccaccuucaugaacgacgccaucgagaaggccagaaaggccgccgagcugcaggccagaauccaggcccagcuggcccugaagcccggccugaucggcaacgccaacauggugggccuggccaaccugcacgccaugggcaucgccccccccaagguggagcugaaggaccagaccaagcccaccccccugauccuggacgagcagggcagaaccguggacgccaccggcaaggagaucgagcugacccacagaaugcccacccugaaggccaacaucagagccgugaagagagagcaguucaagcagcagcugaaggagaagcccagcgaggacauggagagcaacaccuucuucgaccccagagugagcaucgcccccagccagagacagagaagaaccuucaaguuccacgacaagggcaaguucgagaagaucgcccagagacugagaaccaaggcccagcuggagaagcugcaggccgagaucagccaggccgccagaaagaccggcauccacaccagcaccagacuggcccugaucgcccccaagaaggagcugaaggagggcgacauccccgagaucgaguggugggacagcuacaucauccccaacggcuucgaccugggcaagagccaggagagaagacuguucuggaaccacaagagcugcuaa

SEQ ID NO: 22044 - RNA, 2793 nt, Artificial Sequence
  PRPF40A__Homo_sapiens__NP_060362
augugcagcggcagcggcagaagaagaagcagccugagccccaccaugagacccggcaccggcgccgagagaggcggccugaugaugggccaccccggcaugcacuacgcccccaugggcaugcaccccaugggccagagagccaacaugccccccgugccccacggcaugaugccccagaugaugccccccaugggcggcccccccaugggccagaugcccggcaugaugagcagcgugaugcccggcaugaugaugagccacaugagccaggccagcaugcagcccgcccugccccccggcgugaacagcauggacguggccgccggcaccgccagcggcgccaagagcauguggaccgagcacaagagccccgacggcagaaccuacuacuacaacaccgagaccaagcagagcaccugggagaagcccgacgaccugaagacccccgccgagcagcugcugagcaagugccccuggaaggaguacaagagcgacagcggcaagcccuacuacuacaacagccagaccaaggagagcagaugggccaagcccaaggagcuggaggaccuggagggcuaccagaacaccaucguggccggcagccugaucaccaagagcaaccugcacgccaugaucaaggccgaggagagcagcaagcaggaggagugcaccaccaccagcaccgcccccgugcccaccaccgagauccccaccaccaugagcaccauggccgccgccgaggccgccgccgccgugguggccgccgccgccgccgccgccgccgccgccgccgccgccaacgccaacgccagcaccagcgccagcaacaccgugagcggcaccgugcccguggugcccgagcccgaggugaccagcaucguggccaccgugguggacaacgagaacaccgugaccaucagcaccgaggagcaggcccagcugaccagcacccccgccauccaggaccagagcguggaggugagcagcaacaccggcgaggagaccagcaagcaggagaccguggccgacuucacccccaagaaggaggaggaggagagccagcccgccaagaagaccuacaccuggaacaccaaggaggaggccaagcaggccuucaaggagcugcugaaggagaagagagugcccagcaacgccagcugggagcaggccaugaagaugaucaucaacgaccccagauacagcgcccuggccaagcugagcgagaagaagcaggccuucaacgccuacaaggugcagaccgagaaggaggagaaggaggaggccagaagcaaguacaaggaggccaaggagagcuuccagagauuccuggagaaccacgagaagaugaccagcaccaccagauacaagaaggccgagcagauguucggcgagauggagguguggaacgccaucagcgagagagacagacuggagaucuacgaggacgugcuguucuuccugagcaagaaggagaaggagcaggccaagcagcugagaaagagaaacugggaggcccugaagaacauccuggacaacauggccaacgugaccuacagcaccaccuggagcgaggcccagcaguaccugauggacaaccccaccuucgccgaggacgaggagcugcagaacauggacaaggaggacgcccugaucugcuucgaggagcacaucagagcccuggagaaggaggaggaggaggagaagcagaagagccugcugagagagagaagaagacagagaaagaacagagagagcuuccagaucuuccuggacgagcugcacgagcacggccagcugcacagcaugagcagcuggauggagcuguaccccaccaucagcagcgacaucagauucaccaacaugcugggccagcccggcagcaccgcccuggaccuguucaaguucuacguggaggaccugaaggccagauaccacgacgagaagaagaucaucaaggacauccugaaggacaagggcuucgugguggaggugaacaccaccuucgaggacuucguggccaucaucagcagcaccaagagaagcaccacccuggacgccggcaacaucaagcuggccuucaacagccugcuggagaaggccgaggccagagagagagagagagagaaggaggaggccagaaagaugaagagaaaggagagcgccuucaagagcaugcugaagcaggccgccccccccaucgagcuggacgccgugugggaggacaucagagagagauucgugaaggagcccgccuucgaggacaucacccuggagagcgagagaaagagaaucuucaaggacuucaugcacgugcuggagcacgagugccagcaccaccacagcaagaacaagaagcacagcaagaagagcaagaagcaccacagaaagagaagcagaagcagaagcggcagcgacagcgacgacgacgacagccacagcaagaagaagagacagagaagcgagagcagaagcgccagcgagcacagcagcagcgccgagagcgagagaagcuacaagaagagcaagaagcacaagaagaagagcaagaagagaagacacaagagcgacagccccgagagcgacgccgagagagagaaggacaagaaggagaaggacagagagagcgagaaggacagaaccagacagagaagcgagagcaagcacaagagccccaagaagaagaccggcaaggacagcggcaacugggacaccagcggcagcgagcugagcgagggcgagcuggagaagagaagaagaacccugcuggagcagcuggacgacgaccaguaa

SEQ ID NO: 22045 - RNA, 3024 nt, Artificial Sequence
  PRPF4B__Homo_sapiens__NP_003904
auggccgccgccgagacccagagccugagagagcagcccgagauggaggacgccaacagcgagaagagcaucaacgaggagaacggcgaggugagcgaggaccagagccagaacaagcacagcagacacaagaagaagaagcacaagcacagaagcaagcacaagaagcacaagcacagcagcgaggaggacaaggacaagaagcacaagcacaagcacaagcacaagaagcacaagagaaaggagaucaucgacgccagcgacaaggagggcaugagccccgccaagagaaccaagcuggacgaccuggcccugcuggaggaccuggagaagcagagagcccugaucaaggccgagcuggacaacgagcugauggagggcaaggugcagagcggcaugggccugauccugcagggcuacgagagcggcagcgaggaggagggcgagauccacgagaaggccagaaacggcaacagaagcagcaccagaagcagcagcaccaagggcaagcuggagcugguggacaacaagaucaccaccaagaagagaagcaagagcagaagcaaggagagaaccagacacagaagcgacaagaagaagagcaagggcggcaucgagaucgugaaggagaagaccaccagaagcaagagcaaggagagaaagaagagcaagagccccagcaagagaagcaagagccaggaccaggccagaaagagcaagagccccacccugagaagaagaagccaggagaagaucggcaaggccagaagccccaccgacgacaaggugaagaucgaggacaagagcaagagcaaggacagaaagaagagccccaucaucaacgagagcagaagcagagacagaggcaagaagagcagaagccccguggaccugagaggcaagagcaaggacagaagaagcagaagcaaggagagaaagagcaagagaagcgagaccgacaaggagaagaagcccaucaagagccccagcaaggacgccagcagcggcaaggagaacagaagccccagcagaagacccggcagaagccccaagagaagaagccugagccccaagcccagagacaagagcagaagaagcagaagcccccugcugaacgacagaagaagcaagcagagcaagagccccagcagaacccugagccccggcagaagagccaagagcagaagccuggagagaaagagaagagagcccgagagaagaagacugagcagccccagaaccagacccagagacgacauccugagcagaagagagagaagcaaggacgccagccccaucaacagauggagccccaccagaagaagaagcagaagccccaucagaagaagaagcagaagcccccugagaagaagcagaagccccagaagaagaagcagaagccccagaagaagagacagaggcagaagaagcagaagcagacugagaagaagaagcagaagcagaggcggcagaagaagaagaagcagaagcaaggugaaggaggacaaguucaagggcagccugagcgagggcaugaagguggagcaggagagcagcagcgacgacaaccuggaggacuucgacguggaggaggaggacgaggaggcccugaucgagcagagaagaauccagagacaggccaucgugcagaaguacaaguaccuggccgaggacagcaacaugagcgugcccagcgagcccagcagcccccagagcagcaccagaaccagaagccccagccccgacgacauccuggagagaguggccgccgacgugaaggaguacgagagagagaacguggacaccuucgaggccagcgugaaggccaagcacaaccugaugaccguggagcagaacaacggcagcagccagaagaagcugcuggcccccgacauguucaccgagagcgacgacauguucgccgccuacuucgacagcgccagacugagagccgccggcaucggcaaggacuucaaggagaaccccaaccugagagacaacuggaccgacgccgagggcuacuacagagugaacaucggcgaggugcuggacaagagauacaacguguacggcuacaccggccagggcguguucagcaacguggugagagccagagacaacgccagagccaaccaggagguggccgugaagaucaucagaaacaacgagcugaugcagaagaccggccugaaggagcuggaguuccugaagaagcugaacgacgccgaccccgacgacaaguuccacugccugagacuguucagacacuucuaccacaagcagcaccugugccugguguucgagccccugagcaugaaccugagagaggugcugaagaaguacggcaaggacgugggccugcacaucaaggccgugagaagcuacagccagcagcuguuccuggcccugaagcugcugaagagaugcaacauccugcacgccgacaucaagcccgacaacauccuggugaacgagagcaagaccauccugaagcugugcgacuucggcagcgccagccacguggccgacaacgacaucacccccuaccuggugagcagauucuacagagcccccgagaucaucaucggcaagagcuacgacuacggcaucgacauguggagcgugggcugcacccuguacgagcuguacaccggcaagauccuguuccccggcaagaccaacaaccacaugcugaagcuggccauggaccugaagggcaagaugcccaacaagaugaucagaaagggcguguucaaggaccagcacuucgaccagaaccugaacuucauguacaucgagguggacaaggugaccgagagagagaaggugaccgugaugagcaccaucaaccccaccaaggaccugcuggccgaccugaucggcugccagagacugcccgaggaccagagaaagaaggugcaccagcugaaggaccugcuggaccagauccugaugcuggaccccgccaagagaaucagcaucaaccaggcccugcagcacgccuucauccaggagaagaucuaa

SEQ ID NO: 22046 - RNA, 1566 nt, Artificial Sequence
  PRPF4__Homo_sapiens__NP_001231855
auggccagcagcagagccagcagcaccgccaccaagaccaaggcccccgacgaccugguggcccccguggugaagaagccccacaucuacuacggcagccuggaggagaaggagagagagagacuggccaagggcgagagcggcauccugggcaaggacggccugaaggccggcaucgaggccggcaacaucaacaucaccagcggcgagguguucgagaucgaggagcacaucagcgagagacaggccgaggugcuggccgaguucgagagaagaaagagagccagacagaucaacgugagcaccgacgacagcgaggugaaggccugccugagagcccugggcgagcccaucacccuguucggcgagggccccgccgagagaagagagagacugagaaacauccugagcguggugggcaccgacgcccugaagaagaccaagaaggacgacgagaagagcaagaagagcaaggaggaguaccagcagaccugguaccacgagggccccaacagccugaagguggccagacuguggaucgccaacuacagccugcccagagccaugaagagacuggaggaggccagacugcacaaggagauccccgagaccaccagaaccagccagaugcaggagcugcacaagagccugagaagccugaacaacuucugcagccagaucggcgacgacagacccaucagcuacugccacuucagccccaacagcaagaugcuggccaccgccugcuggagcggccugugcaagcuguggagcgugcccgacugcaaccugcugcacacccugagaggccacaacaccaacgugggcgccaucguguuccaccccaagagcaccgugagccuggaccccaaggacgugaaccuggccagcugcgccgccgacggcagcgugaagcuguggagccuggacagcgacgagcccguggccgacaucgagggccacaccgugagaguggccagagugauguggcaccccagcggcagauuccugggcaccaccugcuacgacagaagcuggagacugugggaccuggaggcccaggaggagauccugcaccaggagggccacagcaugggcguguacgacaucgccuuccaccaggacggcagccuggccggcaccggcggccuggacgccuucggcagagugugggaccugagaaccggcagaugcaucauguuccuggagggccaccugaaggagaucuacggcaucaacuucagccccaacggcuaccacaucgccaccggcagcggcgacaacaccugcaaggugugggaccugagacagagaagaugcguguacaccauccccgcccaccagaaccuggugaccggcgugaaguucgagcccauccacggcaacuuccugcugaccggcgccuacgacaacaccgccaagaucuggacccaccccggcuggagcccccugaagacccuggccggccacgagggcaaggugaugggccuggacaucagcagcgacggccagcugaucgccaccugcagcuacgacagaaccuucaagcuguggauggccgaguaa

SEQ ID NO: 22047 - RNA, 2826 nt, Artificial Sequence
  PRPF6__Homo_sapiens__NP_036601
augaacaagaagaagaagcccuuccugggcaugcccgccccccugggcuacgugcccggccugggcagaggcgccaccggcuucaccaccagaagcgacaucggccccgccagagacgccaacgaccccguggacgacagacacgccccccccggcaagagaaccgugggcgaccagaugaagaagaaccaggccgccgacgacgacgacgaggaccugaacgacaccaacuacgacgaguucaacggcuacgccggcagccuguucagcagcggccccuacgagaaggacgacgaggaggccgacgccaucuacgccgcccuggacaagagaauggacgagagaagaaaggagagaagagagcagagagagaaggaggagaucgagaaguacagaauggagagacccaagauccagcagcaguucagcgaccugaagagaaagcuggccgaggugaccgaggaggaguggcugagcauccccgaggugggcgacgccagaaacaagagacagagaaaccccagauacgagaagcugacccccgugcccgacagcuucuucgccaagcaccugcagaccggcgagaaccacaccagcguggaccccagacagacccaguucggcggccugaacacccccuaccccggcggccugaacacccccuaccccggcggcaugacccccggccugaugacccccggcaccggcgagcuggacaugagaaagaucggccaggccagaaacacccugauggacaugagacugagccaggugagcgacagcgugagcggccagaccgugguggaccccaagggcuaccugaccgaccugaacagcaugauccccacccacggcggcgacaucaacgacaucaagaaggccagacugcugcugaagagcgugagagagaccaacccccaccacccccccgccuggaucgccagcgccagacuggaggaggugaccggcaagcugcagguggccagaaaccugaucaugaagggcaccgagaugugccccaagagcgaggacguguggcuggaggccgccagacugcagcccggcgacaccgccaaggccgugguggcccaggccgugagacaccugccccagagcgugagaaucuacaucagagccgccgagcuggagaccgacaucagagccaagaagagagugcugagaaaggcccuggagcacgugcccaacagcgugagacuguggaaggccgccguggagcuggaggagcccgaggacgccagaaucaugcugagcagagccguggagugcugccccaccagcguggagcuguggcuggcccuggccagacuggagaccuacgagaacgccagaaaggugcugaacaaggccagagagaacauccccaccgacagacacaucuggaucaccgccgccaagcuggaggaggccaacggcaacacccagaugguggagaagaucaucgacagagccaucaccagccugagagccaacggcguggagaucaacagagagcaguggauccaggacgccgaggagugcgacagagccggcagcguggccaccugccaggccgugaugagagccgugaucggcaucggcaucgaggaggaggacagaaagcacaccuggauggaggacgccgacagcugcguggcccacaacgcccuggagugcgccagagccaucuacgccuacgcccugcagguguuccccagcaagaagagcguguggcugagagccgccuacuucgagaagaaccacggcaccagagagagccuggaggcccugcugcagagagccguggcccacugccccaaggccgaggugcuguggcugaugggcgccaagagcaaguggcuggccggcgacgugcccgccgccagaagcauccuggcccuggccuuccaggccaaccccaacagcgaggagaucuggcuggccgccgugaagcuggagagcgagaacgacgaguacgagagagccagaagacugcuggccaaggccagaagcagcgcccccaccgccagaguguucaugaagagcgugaagcuggagugggugcaggacaacaucagagccgcccaggaccugugcgaggaggcccugagacacuacgaggacuuccccaagcuguggaugaugaagggccagaucgaggagcagaaggagaugauggagaaggccagagaggccuacaaccagggccugaagaagugcccccacagcaccccccuguggcugcugcugagcagacuggaggagaagaucggccagcugaccagagccagagccauccuggagaagagcagacugaagaaccccaagaaccccggccuguggcuggagagcgugagacuggaguacagagccggccugaagaacaucgccaacacccugauggccaaggcccugcaggagugccccaacagcggcauccuguggagcgaggccaucuuccuggaggccagaccccagagaagaaccaagagcguggacgcccugaagaagugcgagcacgacccccacgugcugcuggccguggccaagcuguucuggagccagagaaagaucaccaaggccagagagugguuccacagaaccgugaagaucgacagcgaccugggcgacgccugggccuucuucuacaaguucgagcugcagcacggcaccgaggagcagcaggaggaggugagaaagagaugcgagagcgccgagcccagacacggcgagcuguggugcgccgugagcaaggacaucgccaacuggcagaagaagaucggcgacauccugagacugguggccggcagaaucaagaacaccuucuaa

SEQ ID NO: 22048 - RNA, 7008 nt, Artificial Sequence
  PRPF8__Homo_sapiens__NP_006436
auggccggcguguuccccuacagaggccccggcaaccccgugcccggcccccuggccccccugcccgacuacaugagcgaggagaagcugcaggagaaggccagaaaguggcagcagcugcaggccaagagauacgccgagaagagaaaguucggcuucguggacgcccagaaggaggacaugccccccgagcacgugagaaagaucaucagagaccacggcgacaugaccaacagaaaguucagacacgacaagagaguguaccugggcgcccugaaguacaugccccacgccgugcugaagcugcuggagaacaugcccaugcccugggagcagaucagagacgugcccgugcuguaccacaucaccggcgccaucagcuucgugaacgagauccccugggugaucgagcccguguacaucagccaguggggcagcauguggaucaugaugagaagagagaagagagacagaagacacuucaagagaaugagauucccccccuucgacgacgaggagcccccccuggacuacgccgacaacauccuggacguggagccccuggaggccauccagcuggagcuggaccccgaggaggacgcccccgugcuggacugguucuacgaccaccagccccugagagacagcagaaaguacgugaacggcagcaccuaccagagauggcaguucacccugcccaugaugagcacccuguacagacuggccaaccagcugcugaccgaccugguggacgacaacuacuucuaccuguucgaccugaaggccuucuucaccagcaaggcccugaacauggccauccccggcggccccaaguucgagccccuggugagagacaucaaccugcaggacgaggacuggaacgaguucaacgacaucaacaagaucaucaucagacagcccaucagaaccgaguacaagaucgccuuccccuaccuguacaacaaccugccccaccacgugcaccugaccugguaccacacccccaacgugguguucaucaagaccgaggaccccgaccugcccgccuucuacuucgacccccugaucaaccccaucagccacagacacagcgugaagagccaggagccccugcccgacgacgacgaggaguucgagcugcccgaguucguggagcccuuccugaaggacaccccccuguacaccgacaacaccgccaacggcaucgcccugcugugggcccccagacccuucaaccugagaagcggcagaaccagaagagcccuggacaucccccuggugaagaacugguacagagagcacugccccgccggccagcccgugaaggugagagugagcuaccagaagcugcugaaguacuacgugcugaacgcccugaagcacagaccccccaaggcccagaagaagagauaccuguucagaagcuucaaggccaccaaguucuuccagagcaccaagcuggacuggguggaggugggccugcaggugugcagacagggcuacaacaugcugaaccugcugauccacagaaagaaccugaacuaccugcaccuggacuacaacuucaaccugaagcccgugaagacccugaccaccaaggagagaaagaagagcagauucggcaacgccuuccaccugugcagagaggugcugagacugaccaagcuggugguggacagccacgugcaguacagacugggcaacguggacgccuuccagcuggccgacggccugcaguacaucuucgcccacgugggccagcugaccggcauguacagauacaaguacaagcugaugagacagaucagaaugugcaaggaccugaagcaccugaucuacuacagauucaacaccggccccgugggcaagggccccggcugcggcuucugggccgccggcuggagaguguggcuguucuucaugagaggcaucaccccccugcuggagagauggcugggcaaccugcuggccagacaguucgagggcagacacagcaagggcguggccaagaccgugaccaagcagagaguggagagccacuucgaccuggagcugagagccgccgugaugcacgacauccuggacaugaugcccgagggcaucaagcagaacaaggccagaaccauccugcagcaccugagcgaggccuggagaugcuggaaggccaacauccccuggaaggugcccggccugcccacccccaucgagaacaugauccugagauacgugaaggccaaggccgacugguggaccaacaccgcccacuacaacagagagagaaucagaagaggcgccaccguggacaagaccgugugcaagaagaaccugggcagacugaccagacuguaccugaaggccgagcaggagagacagcacaacuaccugaaggacggccccuacaucaccgccgaggaggccguggccguguacaccaccaccgugcacuggcuggagagcagaagauucagccccauccccuuccccccccugagcuacaagcacgacaccaagcugcugauccuggcccuggagagacugaaggaggccuacagcgugaagagcagacugaaccagagccagagagaggagcugggccugaucgagcaggccuacgacaacccccacgaggcccugagcagaaucaagagacaccugcugacccagagagccuucaaggaggugggcaucgaguucauggaccuguacagccaccuggugcccguguacgacguggagccccuggagaagaucaccgacgccuaccuggaccaguaccugugguacgaggccgacaagagaagacuguucccccccuggaucaagcccgccgacaccgagccccccccccugcugguguacaaguggugccagggcaucaacaaccugcaggacgugugggagaccagcgagggcgagugcaacgugaugcuggagagcagauucgagaagauguacgagaagaucgaccugacccugcugaacagacugcugagacugaucguggaccacaacaucgccgacuacaugaccgccaagaacaacguggugaucaacuacaaggacaugaaccacaccaacagcuacggcaucaucagaggccugcaguucgccagcuucaucgugcaguacuacggccuggugauggaccugcuggugcugggccugcacagagccagcgagauggccggccccccccagaugcccaacgacuuccugagcuuccaggacaucgccaccgaggccgcccaccccaucagacuguucugcagauacaucgacagaauccacaucuucuucagauucaccgccgacgaggccagagaccugauccagagauaccugaccgagcaccccgaccccaacaacgagaacaucgugggcuacaacaacaagaagugcuggcccagagacgccagaaugagacugaugaagcacgacgugaaccugggcagagccguguucugggacaucaagaacagacugcccagaagcgugaccaccgugcagugggagaacagcuucgugagcguguacagcaaggacaaccccaaccugcuguucaacaugugcggcuucgagugcagaauccugcccaagugcagaaccagcuacgaggaguucacccacaaggacggcguguggaaccugcagaacgaggugaccaaggagagaaccgcccagugcuuccugagaguggacgacgagagcaugcagagauuccacaacagagugagacagauccugauggccagcggcagcaccaccuucaccaagaucgugaacaaguggaacaccgcccugaucggccugaugaccuacuucagagaggccguggugaacacccaggagcugcuggaccugcuggugaagugcgagaacaagauccagaccagaaucaagaucggccugaacagcaagaugcccagcagauucccccccgugguguucuacacccccaaggagcugggcggccugggcaugcugagcaugggccacgugcugaucccccagagcgaccugagauggagcaagcagaccgacgugggcaucacccacuucagaagcggcaugagccacgaggaggaccagcugauccccaaccuguacagauacauccagcccugggagagcgaguucaucgacagccagagagugugggccgaguacgcccugaagagacaggaggccaucgcccagaacagaagacugacccuggaggaccuggaggacagcugggacagaggcauccccagaaucaacacccuguuccagaaggacagacacacccuggccuacgacaagggcuggagagugagaaccgacuucaagcaguaccaggugcugaagcagaaccccuucugguggacccaccagagacacgacggcaagcuguggaaccugaacaacuacagaaccgacaugauccaggcccugggcggcguggagggcauccuggagcacacccuguucaagggcaccuacuuccccaccugggagggccuguucugggagaaggccagcggcuucgaggagagcaugaaguggaagaagcugaccaacgcccagagaagcggccugaaccagauccccaacagaagauucacccugugguggagccccaccaucaacagagccaacguguacgugggcuuccaggugcagcuggaccugaccggcaucuucaugcacggcaagauccccacccugaagaucagccugauccagaucuucagagcccaccuguggcagaagauccacgagagcaucgugauggaccugugccagguguucgaccaggagcuggacgcccuggagaucgagaccgugcagaaggagaccauccaccccagaaagagcuacaagaugaacagcagcugcgccgacauccugcuguucgccagcuacaaguggaacgugagcagacccagccugcuggccgacagcaaggacgugauggacagcaccaccacccagaaguacuggaucgacauccagcugagauggggcgacuacgacagccacgacaucgagagauacgccagagccaaguuccuggacuacaccaccgacaacaugagcaucuaccccagccccaccggcgugcugaucgccaucgaccuggccuacaaccugcacagcgccuacggcaacugguuccccggcagcaagccccugauccagcaggccauggccaagaucaugaaggccaaccccgcccuguacgugcugagagagagaaucagaaagggccugcagcuguacagcagcgagcccaccgagcccuaccugagcagccagaacuacggcgagcuguucagcaaccagaucaucugguucguggacgacaccaacguguacagagugaccauccacaagaccuucgagggcaaccugaccaccaagcccaucaacggcgccaucuucaucuucaaccccagaaccggccagcuguuccugaagaucauccacaccagcgugugggccggccagaagagacugggccagcuggccaaguggaagaccgccgaggagguggccgcccugaucagaagccugcccguggaggagcagcccaagcagaucaucgugaccagaaagggcaugcuggacccccuggaggugcaccugcuggacuuccccaacaucgugaucaagggcagcgagcugcagcugcccuuccaggccugccugaagguggagaaguucggcgaccugauccugaaggccaccgagccccagauggugcuguucaaccuguacgacgacuggcugaagaccaucagcagcuacaccgccuucagcagacugauccugauccugagagcccugcacgugaacaacgacagagccaaggugauccugaagcccgacaagaccaccaucaccgagccccaccacaucuggcccacccugaccgacgaggaguggaucaagguggaggugcagcugaaggaccugauccuggccgacuacggcaagaagaacaacgugaacguggccagccugacccagagcgagaucagagacaucauccugggcauggagaucagcgcccccagccagcagagacagcagaucgccgagaucgagaagcagaccaaggagcagagccagcugaccgccacccagaccagaaccgugaacaagcacggcgacgagaucaucaccagcaccaccagcaacuacgagacccagaccuucagcagcaagaccgaguggagagugagagccaucagcgccgccaaccugcaccugagaaccaaccacaucuacgugagcagcgacgacaucaaggagaccggcuacaccuacauccugcccaagaacgugcugaagaaguucaucugcaucagcgaccugagagcccagaucgccggcuaccuguacggcgugagcccccccgacaacccccaggugaaggagaucagaugcaucgugauggugccccaguggggcacccaccagaccgugcaccugcccggccagcugccccagcacgaguaccugaaggagauggagccccugggcuggauccacacccagcccaacgagagcccccagcugagcccccaggacgugaccacccacgccaagaucauggccgacaaccccagcugggacggcgagaagaccaucaucaucaccugcagcuucacccccggcagcugcacccugaccgccuacaagcugacccccagcggcuacgaguggggcagacagaacaccgacaagggcaacaaccccaagggcuaccugcccagccacuacgagagagugcagaugcugcugagcgacagauuccugggcuucuucauggugcccgcccagagcagcuggaacuacaacuucaugggcgugagacacgaccccaacaugaaguacgagcugcagcuggccaaccccaaggaguucuaccacgaggugcacagacccagccacuuccugaacuucgcccugcugcaggagggcgagguguacagcgccgacagagaggaccuguacgccuaa

SEQ ID NO: 22049 - RNA, 1041 nt, Artificial Sequence
  PRPH2__Homo_sapiens__NP_000313
auggcccugcugaaggugaaguucgaccagaagaagagagugaagcuggcccagggccuguggcugaugaacugguucagcgugcuggccggcaucaucaucuucagccugggccuguuccugaagaucgagcugagaaagagaagcgacgugaugaacaacagcgagagccacuucgugcccaacagccugaucggcaugggcgugcugagcugcguguucaacagccuggccggcaagaucugcuacgacgcccuggaccccgccaaguacgccagauggaagcccuggcugaagcccuaccuggccaucugcgugcuguucaacaucauccuguuccugguggcccugugcugcuuccugcugagaggcagccuggagaacacccugggccagggccugaagaacggcaugaaguacuacagagacaccgacacccccggcagaugcuucaugaagaagaccaucgacaugcugcagaucgaguucaagugcugcggcaacaacggcuucagagacugguucgagauccaguggaucagcaacagauaccuggacuucagcagcaaggaggugaaggacagaaucaagagcaacguggacggcagauaccugguggacggcgugcccuucagcugcugcaaccccagcagccccagacccugcauccaguaccagaucaccaacaacagcgcccacuacagcuacgaccaccagaccgaggagcugaaccugugggugagaggcugcagagccgcccugcugagcuacuacagcagccugaugaacagcaugggcguggugacccugcugaucuggcuguucgaggugaccaucaccaucggccugagauaccugcagaccagccuggacggcgugagcaaccccgaggagagcgagagcgagagccagggcuggcugcuggagagaagcgugcccgagaccuggaaggccuuccuggagagcgugaagaagcugggcaagggcaaccagguggaggccgagggcgccgacgccggccaggcccccgaggccggcuaa

SEQ ID NO: 22050 - RNA, 1413 nt, Artificial Sequence
  PRPH__Homo_sapiens__NP_006253
augagccaccaccccagcggccugagagccggcuucagcagcaccagcuacagaagaaccuucggccccccccccagccugagccccggcgccuucagcuacagcagcagcagcagauucagcagcagcagacugcugggcagcgccagccccagcagcagcgugagacugggcagcuucagaagccccagagccggcgccggcgcccugcugagacugcccagcgagagacuggacuucagcauggccgaggcccugaaccaggaguuccuggccaccagaagcaacgagaagcaggagcugcaggagcugaacgacagauucgccaacuucaucgagaaggugagauuccuggagcagcagaacgccgcccugagaggcgagcugagccaggccagaggccaggagcccgccagagccgaccagcugugccagcaggagcugagagagcugagaagagagcuggagcugcugggcagagagagagacagagugcagguggagagagacggccuggccgaggaccuggccgcccugaagcagagacuggaggaggagaccagaaagagagaggacgccgagcacaaccuggugcuguucagaaaggacguggacgacgccacccugagcagacuggagcuggagagaaagaucgagagccugauggacgagaucgaguuccugaagaagcugcacgaggaggagcugagagaccugcaggugagcguggagagccagcaggugcagcagguggagguggaggccaccgugaagcccgagcugaccgccgcccugagagacaucagagcccaguacgagagcaucgccgccaagaaccugcaggaggccgaggagugguacaagagcaaguacgccgaccugagcgacgccgccaacagaaaccacgaggcccugagacaggccaagcaggagaugaacgagagcagaagacagauccagagccugaccugcgagguggacggccugagaggcaccaacgaggcccugcugagacagcugagagagcuggaggagcaguucgcccuggaggccggcggcuaccaggccggcgccgccagacuggaggaggagcugagacagcugaaggaggagauggccagacaccugagagaguaccaggagcugcugaacgugaagauggcccuggacaucgagaucgccaccuacagaaagcugcuggagggcgaggagagcagaaucagcgugcccgugcacagcuucgccagccugaacaucaagaccaccgugcccgagguggagcccccccaggacagccacagcagaaagaccgugcugaucaagaccaucgagaccagaaacggcgagguggugaccgagagccagaaggagcagagaagcgagcuggacaagagcagcgcccacagcuacuaa

SEQ ID NO: 22051 - RNA, 957 nt, Artificial Sequence
  PRPS1__Homo_sapiens__NP_002755
augcccaacaucaagaucuucagcggcagcagccaccaggaccugagccagaagaucgccgacagacugggccuggagcugggcaagguggugaccaagaaguucagcaaccaggagaccugcguggagaucggcgagagcgugagaggcgaggacguguacaucgugcagagcggcugcggcgagaucaacgacaaccugauggagcugcugaucaugaucaacgccugcaagaucgccagcgccagcagagugaccgccgugauccccugcuuccccuacgccagacaggacaagaaggacaagagcagagcccccaucagcgccaagcugguggccaacaugcugagcguggccggcgccgaccacaucaucaccauggaccugcacgccagccagauccagggcuucuucgacauccccguggacaaccuguacgccgagcccgccgugcugaaguggaucagagagaacaucagcgaguggagaaacugcaccaucgugagccccgacgccggcggcgccaagagagugaccagcaucgccgacagacugaacguggacuucgcccugauccacaaggagagaaagaaggccaacgagguggacagaauggugcuggugggcgacgugaaggacagaguggccauccugguggacgacauggccgacaccugcggcaccaucugccacgccgccgacaagcugcugagcgccggcgccaccagaguguacgccauccugacccacggcaucuucagcggccccgccaucagcagaaucaacaacgccugcuucgaggccgugguggugaccaacaccaucccccaggaggacaagaugaagcacugcagcaagauccaggugaucgacaucagcaugauccuggccgaggccaucagaagaacccacaacggcgagagcgugagcuaccuguucagccacgugccccuguaa

SEQ ID NO: 22052 - RNA, 957 nt, Artificial Sequence
  PRPS1L1__Homo_sapiens__NP_787082
augcccaacaucaagaucuucagcggcagcagccaccaggaccugagccagaagaucgccgacagacugggccuggagcugggcaagguggugaccaagaaguucagcaaccaggagaccugcguggagaucgacgagagcgugagaggcgaggacguguacaucgugcagagcggcugcggcgagaucaacgacagccugauggagcugcugaucaugaucaacgccugcaagaucgccagcgccagcagagugaccgccgugauccccugcuuccccuacgccagacaggacaagaaggacaagagcagaagccccaucagcgccaagcugguggccaacaugcugagcaucgccggcgccgaccacaucaucaccauggaccugcacgccagccagauccagggcuucuucgacauccccguggacaaccuguacgccgagcccaccgugcugaaguggaucagagagaacauccccgaguggaagaacugcaucaucgugagccccgacgccggcggcgccaagagagugaccagcaucgccgaccagcugaacguggacuucgcccugauccacaaggagagaaagaaggccaacgagguggacugcaucgugcuggugggcgacgugaacgacagaguggccauccugguggacgacauggccgacaccugcgugaccaucugccuggccgccgacaagcugcugagcgccggcgccaccagaguguacgccauccugacccacggcaucuucagcggccccgccaucagcagaaucaacaccgccugcuucgaggccgugguggugaccaacaccaucccccaggacgagaagaugaagcacugcagcaagaucagagugaucgacaucagcaugauccuggccgaggccaucagaagaacccacaacggcgagagcgugagcuaccuguucagccacgugccccuguaa

SEQ ID NO: 22053 - RNA, 966 nt, Artificial Sequence
  PRPS2__Homo_sapiens__NP_001034180
augcccaacaucgugcuguucagcggcagcagccaccaggaccugagccagagaguggccgacagacugggccuggagcugggcaagguggugaccaagaaguucagcaaccaggagaccagcguggagaucggcgagagcgugagaggcgaggacguguacaucauccagagcggcugcggcgagaucaacgacaaccugauggagcugcugaucaugaucaacgccugcaagaucgccagcagcagcagagugaccgccgugauccccugcuuccccuacgccagacaggacaagaaggacaaggugggcgagagcagagcccccaucagcgccaagcugguggccaacaugcugagcguggccggcgccgaccacaucaucaccauggaccugcacgccagccagauccagggcuucuucgacauccccguggacaaccuguacgccgagcccgccgugcugcaguggaucagagagaacaucgccgaguggaagaacugcaucaucgugagccccgacgccggcggcgccaagagagugaccagcaucgccgacagacugaacguggaguucgcccugauccacaaggagagaaagaaggccaacgagguggacagaauggugcuggugggcgacgugaaggacagaguggccauccugguggacgacauggccgacaccugcggcaccaucugccacgccgccgacaagcugcugagcgccggcgccaccaagguguacgccauccugacccacggcaucuucagcggccccgccaucagcagaaucaacaacgccgccuucgaggccgugguggugaccaacaccaucccccaggaggacaagaugaagcacugcaccaagauccaggugaucgacaucagcaugauccuggccgaggccaucagaagaacccacaacggcgagagcgugagcuaccuguucagccacgugccccuguaa

SEQ ID NO: 22054 - RNA, 1158 nt, Artificial Sequence
  PRPSAP1__Homo_sapiens__NP_002757
augcccaagaagcugcugcugcugcccccccccagcgccagcagcgccuucagagugcccagagccagacccgugcccccccccgccaugaacgccgccagaaccggcuacagaguguucagcgccaacagcaccgccgccugcaccgagcuggccaagagaaucaccgagagacugggcgccgagcugggcaagagcgugguguaccaggagaccaacggcgagaccagaguggagaucaaggagagcgugagaggccaggacaucuucaucauccagaccauccccagagacgugaacaccgccgugauggagcugcugaucauggccuacgcccugaagaccgccugcgccagaaacaucaucggcgugauccccuacuuccccuacagcaagcagagcaagaugagaaagagaggcagcaucgugugcaagcugcuggccagcaugcuggccaaggccggccugacccacaucaucaccauggaccugcaccagaaggagauccagggcuucuucagcuuccccguggacaaccugagagccagccccuuccugcugcaguacauccaggaggagauccccaacuacagaaacgccgugaucguggccaagagccccgacgccgccaagagagcccagagcuacgccgagagacugagacugggccuggccgugauccacggcgaggcccagugcaccgagcuggacauggacgacggcagacacagcccccccauggugaagaacgccaccgugcaccccggccuggagcugccccugaugauggccaaggagaagccccccaucaccguggugggcgacgugggcggcagaaucgccaucaucguggacgacaucaucgacgacguggagagcuucguggccgccgccgagauccugaaggagagaggcgccuacaagaucuacgugauggccacccacggcauccugagcgccgaggcccccagacugaucgaggagagcagcguggacgaggugguggugaccaacaccgugccccacgaggugcagaagcugcagugccccaagaucaagaccguggacaucagccugauccugagcgaggccaucagaagaauccacaacggcgagagcauggccuaccuguucagaaacaucaccguggacgacuaa

SEQ ID NO: 22055 - RNA, 990 nt, Artificial Sequence
  PRPSAP2__Homo_sapiens__NP_001230865
auguucugcgugaccccccccgagcuggagaccaagaugaacaucaccaagggcggccuggugcuguucagcgccaacagcaacagcagcugcauggagcugagcaagaagaucgccgaggacgugaacaccaccaucauggagcugcugaucaugguguacgccugcaagaccagcugcgccaagagcaucaucggcgugauccccuacuuccccuacagcaagcagugcaagaugagaaagagaggcagcaucgugagcaagcugcuggccagcaugaugugcaaggccggccugacccaccugaucaccauggaccugcaccagaaggagauccagggcuucuucaacauccccguggacaaccugagagccagccccuuccugcugcaguacauccaggaggagauccccgacuacagaaacgccgugaucguggccaagagccccgccagcgccaagagagcccagagcuucgccgagagacugagacugggcaucgccgugauccacggcgaggcccaggacgccgagagcgaccugguggacggcagacacagcccccccauggugagaagcguggccgccauccaccccagccuggagauccccaugcugauccccaaggagaagccccccaucaccguggugggcgacgugggcggcagaaucgccaucaucguggacgacaucaucgacgacguggacagcuuccuggccgccgccgagacccugaaggagagaggcgccuacaagaucuucgugauggccacccacggccugcugagcagcgacgcccccagaagaaucgaggagagcgccaucgacgaggugguggugaccaacaccaucccccacgaggugcagaagcugcagugccccaagaucaagaccguggacaucagcaugauccugagcgaggccaucagaagaauccacaacggcgagagcaugagcuaccuguucagaaacaucggccuggacgacuaa

SEQ ID NO: 22056 - RNA, 1083 nt, Artificial Sequence
  PRR11__Homo_sapiens__NP_060774
augcccaaguucaagcagagaagaagaaagcugaaggccaaggccgagagacuguucaagaagaaggaggccagccacuuccagagcaagcugaucaccccccccccccccccccccagccccgagagagugggcaucagcagcaucgacaucagccagagcagaagcuggcugaccagcagcuggaacuucaacuuccccaacaucagagacgccaucaagcuguggaccaacagaguguggagcaucuacagcuggugccagaacugcaucacccagagccuggaggugcugaaggacaccaucuuccccagcagaaucugccacagagagcuguacagcgugaagcagcaguucugcauccuggagagcaagcugugcaagcugcaggaggcccugaagaccaucagcgagagcagcagcugccccagcugcggccagaccugccacaugagcggcaagcugaccaacgugcccgccugcgugcugaucacccccggcgacagcaaggccgugcugccccccacccugccccagcccgccagccacuuccccccccccccccccccccccccccugcccccccccccccccccccuggcccccgugcugcugagaaagcccagccuggccaaggcccugcaggccggcccccugaagaaggacggccccaugcagaucaccgugaaggaccugcugaccgugaagcugaagaagacccagagccuggacgagaagagaaagcugauccccagccccaaggccagaaacccccuggugaccgugagcgaccugcagcacgugacccugaagcccaacagcaaggugcugagcaccagagugaccaacgugcugaucacccccggcaagagccagauggaccugagaaagcugcugagaaagguggacguggagagaagccccggcggcaccccccugaccaacaaggagaacauggagaccggcaccggccugacccccgugaugacccaggcccugagaagaaaguuccagcuggcccaccccagaagccccacccccacccugccccugagcaccagcagcuucgacgagcagaacuaa

SEQ ID NO: 22057 - RNA, 297 nt, Artificial Sequence
  PRR13__Homo_sapiens__NP_001005354
auguggaaccccaacgccggcggccccccccaccccgugccccagcccggcuaccccggcugccagccccugggccccuaccccccccccuaccccccccccgcccccggcaucccccccgugaacccccuggcccccggcauggugggccccgccgugaucguggacaagaagaugcagaagaagaugaagaaggcccacaagaagaugcacaagcaccagaagcaccacaaguaccacaagcacggcaagcacagcagcagcagcagcagcagcagcagcagcgacagcgacuaa

SEQ ID NO: 22058 - RNA, 390 nt, Artificial Sequence
  PRR15__Homo_sapiens__XP_011513501
auggccgacagcggcgacgccggcagcagcggccccugguggaagagccugaccaacagcagaaagaagagcaaggaggccgccgugggcgugcccccccccgcccagcccgcccccggcgagcccaccccccccgccccccccagccccgacuggaccagcagcagcagagagaaccagcaccccaaccugcugggcggcgccggcgagccccccaagcccgacaagcuguacggcgacaagagcggcagcagcagaagaaaccugaagaucagcagaagcggcagauucaaggagaagagaaaggugagagccacccugcugcccgaggccggcagaagccccgaggaggccggcuuccccggcgacccccacgaggacaagcaguaa

SEQ ID NO: 22059 - RNA, 915 nt, Artificial Sequence
  PRR16__Homo_sapiens__NP_001287712
augagcgccaagagcaagggcaaccccagcagcagcugccccgccgagggcccccccgccgccagcaagaccaaggugaaggagcagaucaagaucaucguggaggaccuggagcuggugcugggcgaccugaaggacguggccaaggagcugaaggaggugguggaccagaucgacacccugaccagcgaccugcagcuggaggacgagaugaccgacagcagcaagaccgacacccugaacagcagcagcagcggcaccaccgccagcagccuggagaagaucaaggugcaggccaacgccccccugaucaagccccccgcccaccccagcgccauccugaccgugcugagaaagcccaacccccccccccccccccccagacugacccccgugaagugcgaggaccccaagagaguggugcccaccgccaaccccgugaagaccaacggcacccugcugagaaacggcggccugcccggcggccccaacaagauccccaacggcgacaucugcugcauccccaacagcaaccuggacaaggcccccgugcagcugcugaugcacagacccgagaaggacagaugcccccaggccggccccagagagagagugagauucaacgagaaggugcaguaccacggcuacugccccgacugcgacaccagauacaacaucaagaacagagaggugcaccugcacagcgagcccgugcacccccccggcaagaucccccaccagggccccccccugccccccaccccccaccugccccccuucccccuggagaacggcggcaugggcaucagccacagcaacagcuucccccccaucagacccgccaccgugcccccccccaccgcccccaagccccagaagaccauccugagaaagagcaccaccaccaccguguaa

SEQ ID NO: 22060 - RNA, 417 nt, Artificial Sequence
  PRR34__Homo_sapiens__NP_060750
augcccgccagcgccaccgccgccuggcacugccccccccugugccugcccccccugcccgccagcgcccccaccagcccccccaaccccgccaccagacccgcccccggccccggcagaagagccagaugcccccagagcgcccaccccgcccccaccagaggcgcccugaccuucugggcccccggcagcuggcccagagugcugcuggugcccagaagccccggccccgugcugagagcccccagacugccccaccccgccgccagagccagaagaagagccuggcacggcgccagacugcccggcagccccgccagagccggcagaaccuuccagagaggccuggugagcaacagcugggcccacgccaucuuccugcccagaccccccaacgugcuggagcugcagguguaa

SEQ ID NO: 22061 - RNA, 504 nt, Artificial Sequence
  PRR3__Homo_sapiens__NP_001070965
augcccaagagaaagaagcagaaccaccaccagccccccacccagcagcagcccccccugcccgagagagaggagaccggcgacgaggaggacggcagccccaucgcccugcacagaggcccccccggcagcagaggcccccugauccccccccugcugagccugccccccccccccuggggcagaggccccaucagaagaggccugggccccagaagcagccccuacggcagaggcugguggggcgugaacgccgagccccccuuccccggccccggccacggcggccccaccagaggcagcuuccacaaggagcagagaaaccccagaagacugaagagcuggagccugaucaagaacaccugcccccccaaggacgacccccaggugauggaggacaagagcgacagacccgugugcagacacuucgccaagaagggccacugcagauacgaggaccugugcgccuucuaccaccccggcgugaacggccccccccuguaa

SEQ ID NO: 22062 - RNA, 1140 nt, Artificial Sequence
  PRR5__Homo_sapiens__NP_001017528
augagcagccccagccugagcgaccugggcaagagagagcccgccgccgccgccgacgagagaggcacccagcagagaagagccugcgccaacgccaccuggaacagcauccacaacggcgugaucgccguguuccagagaaagggccugcccgaccaggagcuguucagccugaacgagggcgugagacagcugcugaagaccgagcugggcagcuucuucaccgaguaccugcagaaccagcugcugaccaagggcauggugauccugagagacaagaucagauucuacgagggccagaagcugcuggacagccuggccgagaccugggacuucuucuucagcgacgugcugcccaugcugcaggccaucuucuaccccgugcagggcaaggagcccagcgugagacagcuggcccugcugcacuucagaaacgccaucacccugagcgugaagcuggaggacgcccuggccagagcccacgccagagugccccccgccaucgugcagaugcugcuggugcugcagggcgugcacgagagcagaggcgugaccgaggacuaccugagacuggagacccuggugcagaagguggugagccccuaccugggcaccuacggccugcacagcagcgagggccccuucacccacagcugcauccuggagaagagacugcugagaagaagcagaagcggcgacgugcuggccaagaaccccguggugagaagcaagagcuacaacaccccccugcugaaccccgugcaggagcacgaggccgagggcgccgccgccggcggcaccagcaucagaagacacagcgugagcgagaugaccagcugccccgagccccagggcuucagcgacccccccggccagggccccaccggcaccuucagaagcagccccgccccccacagcggccccugccccagcagacuguaccccaccacccagccccccgagcagggccuggaccccaccagaagcagccugcccagaagcagccccgagaaccugguggaccagauccuggagagcguggacagcgacagcgagggcaucuucaucgacuucggcagaggcagaggcagcggcaugagcgaccuggagggcagcggcggcagacagagcgugguguaa

SEQ ID NO: 22063 - RNA, 387 nt, Artificial Sequence
  PRR9__Homo_sapiens__XP_011508108
augaccgccugcaccugcagcgccaaccaccccagaaugagcuucagcgagcagcagugcaagcagcccugcgugcccccccccugccugcccaagacccaggagcagugccaggccaaggccgaggaggugugccugcccaccugccagcaccccugccaggacaagugccuggugcaggcccaggaggugugccugagccagugccaggagagcagccaggagaagugcccccagcagggccaggagcccuaccugccccccugccaggaccagugccccccccagugcgccgagcccugccaggagcuguuccagaccaagugcguggaggugugcccccagaaggugcaggagaagugcagcagccccggcaagggcaaguaa

SEQ ID NO: 22064 - RNA, 1389 nt, Artificial Sequence
  PRRC1__Homo_sapiens__NP_001273737
augauggaggagagcggcaucgagaccaccccccccggcacccccccccccaaccccgccggccuggccgccaccgccaugagcagcacccccgugccccuggccgccaccagcagcuucagcagccccaacgugagcagcauggagagcuuccccccccuggccuacagcaccccccagcccccccugccccccgugagacccagcgccccccugcccuucgugcccccccccgccgugcccagcgugcccccccuggugaccagcaugcccccccccgugagccccagcaccgccgccgccuucggcaacccccccgugagccacuucccccccagcaccagcgcccccaacacccugcugcccgccccccccagcggcccccccaucagcggcuucagcgugggcagcaccuacgacaucaccagaggccacgccggcagagccccccagaccccccugaugcccagcuucagcgcccccagcggcaccggccugcugcccacccccaucacccagcaggccagccugaccagccuggcccagggcaccggcaccaccagcgccaucaccuuccccgaggagcaggaggaccccagaaucaccagaggccaggacgaggccagcgccggcggcaucuggggcuucaucaagggcguggccggcaaccccauggugaagagcgugcuggacaagaccaagcacagcguggagagcaugaucaccacccuggaccccggcauggcccccuacaucaagagcggcggcgagcuggacaucguggugaccagcaacaaggaggugaagguggccgccgugagagacgccuuccaggagguguucggccuggccgugguggugggcgaggccggccagagcaacaucgccccccagcccgugggcuacgccgccggccugaagggcgcccaggagagaaucgacagccugagaagaaccggcgugauccacgagaagcagaccgccgugagcguggagaacuucaucgccgagcugcugcccgacaagugguucgacaucggcugccuggugguggaggaccccgugcacggcauccaccuggagaccuucacccaggccacccccgugccccuggaguucgugcagcaggcccagagccugaccccccaggacuacaaccugagauggagcggccugcuggugaccgugggcgaggugcuggagaagagccugcugaacgugagcagaaccgacuggcacauggccuucaccggcaugagcagaagacagaugaucuacagcgccgccagagccaucgccgacgacuacuuccccagaauccccaaggagcaguggcagagcauggccuggcugaagcuggagaucuuccugccccuggugaccugguaa

SEQ ID NO: 22065 - RNA, 6474 nt, Artificial Sequence
  PRRC2A__Homo_sapiens__NP_542417
augagcgacagaagcggccccaccgccaagggcaaggacggcaagaaguacagcagccugaaccuguucgacaccuacaagggcaagagccuggagauccagaagcccgccguggcccccagacacggccugcagagccugggcaagguggccaucgccagaagaaugcccccccccgccaaccugcccagccugaaggccgagaacaagggcaacgaccccaacgugagccuggugcccaaggacggcaccggcugggccagcaagcaggagcagagcgaccccaagagcagcgacgccagcaccgcccagccccccgagagccagccccugcccgccagccagacccccgccagcaaccagcccaagagaccccccgccgcccccgagaacaccccccuggugcccagcggcgugaagagcugggcccaggccagcgugacccacggcgcccacggcgacggcggcagagccagcagccugcugagcagauucagcagagaggaguuccccacccugcaggccgccggcgaccaggacaaggccgccaaggagagagagagcgccgagcagagcagcggccccggccccagccugagaccccagaacagcaccaccuggagagacggcggcggcagaggccccgacgagcuggagggccccgacagcaagcugcaccacggccacgaccccagaggcggccugcagcccagcggccccccccaguucccccccuacagaggcaugaugccccccuucauguacccccccuaccugcccuuccccccccccuacggcccccagggccccuacagauaccccacccccgacggccccagcagauuccccagaguggccggccccagaggcagcggcccccccaugagacugguggagcccgugggcagacccagcauccugaaggaggacaaccugaaggaguucgaccagcuggaccaggagaacgacgacggcugggccggcgcccacgaggagguggacuacaccgagaagcugaaguucagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgccugggccgagaccagcagaccccccgagaccgagcccggcccccccgcccccaagcccccccugccccccccccacagaggccccgccggcaacuggggcccccccggcgacuaccccgacagaggcggcccccccugcaagccccccgcccccgaggacgaggacgaggccuggagacagagaagaaagcagagcagcagcgagaucagccuggccguggagagagccagaagaagaagagaggaggaggagagaagaaugcaggaggagagaagagccgccugcgccgagaagcugaagagacuggacgagaaguucggcgcccccgacaagagacugaaggccgagcccgccgccccccccgccgcccccagcacccccgcccccccccccgccgugcccaaggagcugcccgccccccccgcccccccccccgccagcgcccccacccccgagaccgagcccgaggagcccgcccaggccccccccgcccagagcacccccacccccggcguggccgccgcccccacccuggugagcggcggcggcagcaccagcagcaccagcagcggcagcuucgaggccagccccguggagccccagcugcccagcaaggagggccccgagccccccgaggaggugcccccccccaccaccccccccgugcccaagguggagcccaagggcgacggcaucggccccaccagacagccccccagccagggccugggcuaccccaaguaccagaagagccugccccccagauuccagagacagcagcaggagcagcugcugaagcagcagcagcagcaccaguggcagcagcaccagcagggcagcgccccccccacccccgugccccccagccccccccagcccgugacccugggcgccgugcccgccccccaggcccccccccccccccccaaggcccuguaccccggcgcccugggcagacccccccccaugccccccaugaacuucgaccccagauggaugaugaucccccccuacguggaccccagacugcugcagggcagacccccccuggacuucuacccccccggcgugcaccccagcggccuggugcccagagagagaagcgacagcggcggcagcagcagcgagcccuucgacagacacgcccccgccaugcugagagagagaggcaccccccccguggaccccaagcuggccugggugggcgacguguucaccgccacccccgccgagcccagaccccugaccagcccccugagacaggccgccgacgaggacgacaagggcaugagaagcgagaccccccccgugcccccccccccccccuaccuggccagcuaccccggcuuccccgagaacggcgcccccggcccccccaucagcagauucccccuggaggagcccggccccagaccccugcccuggccccccggcagcgacgagguggccaagauccagacccccccccccaagaaggagccccccaaggaggagaccgcccagcugaccggccccgaggccggcagaaagcccgccagaggcgugggcagcggcggccagggcccccccccccccagaagagagagcagaaccgagaccagauggggccccagacccggcagcagcagaagaggcaucccccccgaggagcccggcgccccccccagaagagccggccccaucaagaagccccccccccccaccaagguggaggagcugccccccaagccccuggagcagggcgacgagacccccaagccccccaagcccgacccccugaagaucaccaagggcaagcugggcggccccaaggagaccccccccaacggcaaccugagccccgcccccagacugagaagagacuacagcuacgagagagugggccccaccagcugcagaggcagaggcagaggcgaguacuucgccagaggcagaggcuucagaggcaccuacggcggcagaggcagaggcgccagaagcagagaguucagaagcuacagagaguucagaggcgacgacggcagaggcggcggcaccggcggccccaaccacccccccgcccccagaggcagaaccgccagcgagaccagaagcgagggcagcgaguacgaggagauccccaagagaagaagacagagaggcagcgagaccggcagcgagacccacgagagcgaccuggcccccagcgacaaggaggcccccacccccaaggagggcacccugacccaggugccccuggccccccccccccccggcgccccccccagccccgcccccgccagauucaccgccagaggcggcagaguguucacccccagaggcgugcccagcagaagaggcagaggcggcggcagaccccccccccaggugugccccggcuggagcccccccgccaagagccuggcccccaagaagccccccaccggcccccugccccccagcaaggagccccugaaggagaagcugauccccggcccccugagccccguggccagaggcggcagcaacggcggcagcaacgugggcauggaggacggcgagagacccagaagaagaagacacggcagagcccagcagcaggacaagccccccagauucagaagacugaagcaggagagagagaacgccgccagaggcagcgagggcaagcccagccugacccugcccgccagcgcccccggccccgaggaggcccugaccaccgugaccguggcccccgcccccagaagagccgccgccaagagccccgaccugagcaaccagaacagcgaccaggccaacgaggagugggagaccgccagcgagagcagcgacuucaccagcgagagaagaggcgacaaggaggcccccccccccgugcugcugacccccaaggccgugggcacccccggcggcggcggcggcggcgccgugcccggcaucagcgccaugagcagaggcgaccugagccagagagccaaggaccugagcaagagaagcuucagcagccagagacccggcauggagagacagaacagaagacccggccccggcggcaaggccggcagcagcggcagcagcagcggcggcggcggcggcggccccggcggcagaaccggccccggcagaggcgacaagagaagcuggcccagccccaagaacagaagcagaccccccgaggagagaccccccggccugccccugcccccccccccccccagcagcagcgccguguucagacuggaccaggugauccacagcaaccccgccggcauccagcaggcccuggcccagcugagcagcagacagggcagcgugaccgcccccggcggccaccccagacacaagcccggccugccccaggccccccagggccccagccccagaccccccaccagauacgagccccagagagugaacagcggccugagcagcgacccccacuucgaggagcccggccccauggugagaggcgugggcggcacccccagagacagcgccggcgugagccccuucccccccaagagaagagagagaccccccagaaagcccgagcugcugcaggaggagagccugccccccccccacagcagcggcuuccugggcagcaagcccgagggccccggcccccaggccgagagcagagacaccggcaccgaggcccugaccccccacaucuggaacagacugcacaccgccaccagcagaaagagcuacagacccagcagcauggagcccuggauggagccccugagccccuucgaggacguggccggcaccgagaugagccagagcgacagcggcguggaccugagcggcgacagccaggugagcagcggccccugcagccagagaagcagccccgacggcggccugaagggcgccgccgagggcccccccaagagacccggcggcagcagcccccugaacgccgugcccugcgagggcccccccggcagcgagccccccagaagacccccccccgccccccacgacggcgacagaaaggagcugcccagagagcagccccugccccccggccccaucggcaccgagagaagccagagaaccgacagaggcaccgagcccggccccaucagacccagccacagacccggcccccccgugcaguucggcaccagcgacaaggacagcgaccugagacugguggugggcgacagccugaaggccgagaaggagcugaccgccagcgugaccgaggccauccccgugagcagagacugggagcugcugcccagcgccgccgccagcgccgagccccagagcaagaaccuggacagcggccacugcgugcccgagcccagcagcagcggccagagacuguaccccgagguguucuacggcagcgccggccccagcagcagccagaucagcggcggcgccauggacagccagcugcaccccaacagcggcggcuucagacccggcacccccagccugcaccccuacagaagccagccccuguaccugccccccggccccgccccccccagcgcccugcugagcggccuggcccugaagggccaguuccuggacuucagcaccaugcaggccaccgagcugggcaagcugcccgccggcggcgugcuguaccccccccccagcuuccuguacagccccgccuucugccccagcccccugcccgacaccagccugcugcaggugagacaggaccugcccagccccagcgacuucuacagcaccccccugcagcccggcggccagagcggcuuccugcccagcggcgcccccgcccagcagaugcugcugcccaugguggacagccagcugcccguggugaacuucggcagccugccccccgcccccccccccgccccccccccccugagccugcugcccgugggccccgcccugcagccccccagccuggccgugagacccccccccgcccccgccaccagagugcugcccagccccgccagacccuuccccgccagccugggcagagccgagcugcaccccguggagcugaagcccuuccaggacuaccagaagcugagcagcaaccugggcggccccggcagcagcagaaccccccccaccggcagaagcuucagcggccugaacagcagacugaaggccacccccagcaccuacagcggcguguucagaacccagagaguggaccuguaccagcaggccagcccccccgacgcccugagauggauccccaagcccugggagagaaccggccccccccccagagagggccccagcagaagagccgaggagcccggcagcagaggcgacaaggagcccggccugcccccccccagauaa

SEQ ID NO: 22066 - RNA, 8454 nt, Artificial Sequence
  PRRC2C__Homo_sapiens__NP_055987
augagcgagaagagcggccagagcaccaaggccaaggacggcaagaaguacgccacccugagccuguucaacaccuacaagggcaagagccuggagacccagaagaccaccgccagacacggccugcagagccugggcaaggugggcaucagcagaagaaugcccccccccgccaaccugcccagccugaaggccgagaacaagggcaacgaccccaacgugaacaucgugcccaaggacggcaccggcugggccagcaagcaggagcagcacgaggaggagaagacccccgaggugccccccgcccagcccaagcccggcguggccgccccccccgagguggcccccgcccccaagagcugggccagcaacaagcagggcggccagggcgacggcauccaggugaacagccaguuccagcaggaguuccccagccugcaggccgccggcgaccaggagaagaaggagaaggagaccaacgacgacaacuacggccccggccccagccugagaccccccaacguggccugcuggagagacggcggcaaggccgccggcagccccagcagcagcgaccaggacgagaagcugcccggccaggacgagagcaccgccggcaccagcgagcagaacgacauccugaaggugguggagaagagaaucgccugcggccccccccaggccaagcugaacggccagcaggccgcccuggccagccaguacagagccaugaugccccccuacauguuccagcaguaccccagaaugaccuaccccccccugcacggccccaugagauucccccccagccugagcgagaccaacaagggccugagaggcagaggccccccccccagcugggccagcgagcccgagagacccagcauccugagcgccagcgagcugaaggagcuggacaaguucgacaaccuggacgccgaggccgacgagggcugggccggcgcccagauggagguggacuacaccgagcagcugaacuucagcgacgacgacgagcagggcagcaacagccccaaggagaacaacagcgaggaccagggcagcaaggccagcgagaacaacgagaacaagaaggagaccgacgaggugagcaacaccaagagcagcagccagauccccgcccagcccagcguggccaaggugcccuacggcaagggccccagcuucaaccaggagagaggcaccagcagccaccugccccccccccccaagcugcuggcccagcagcaccccccccccgacagacaggccgugcccggcagacccggccccuuccccagcaagcagcagguggccgacgaggacgagaucuggaagcagagaagaagacagcagagcgagaucagcgccgccguggagagagccagaaagagaagagaggaggaggagagaagaauggaggagcagagaaaggccgccugcgccgagaagcugaagagacuggacgagaagcugggcauccuggagaagcagcccagccccgaggagaucagagagagagagagagagaaggagagagagagagagaaggagcuggagaaggagcaggagcaggagagagagaaggagagagagaaggacagagagagacagcaggagaaggagaaggagcuggagaaggagcaggagaagcagagagagauggagaaggagagaaagcaggagaaggagaaggagcuggagagacagaaggagaaggagaaggagcugcagaagaugaaggagcaggagaaggagugcgagcuggagaaggagagagagaagcuggaggagaagaucgagcccagagagcccaaccuggagcccaugguggagaagcaggagagcgagaacagcugcaacaaggaggaggagcccguguucaccagacaggacagcaacagaagcgagaaggaggccacccccguggugcacgagaccgagcccgagagcggcagccagcccagacccgccgugcugagcggcuacuucaagcaguuccagaagagccugccccccagauuccagagacagcaggagcagaugaagcagcagcaguggcagcagcagcagcagcagggcgugcugccccagaccgugcccagccagcccagcagcagcaccgugcccccccccccccacagaccccuguaccagcccaugcagccccacccccagcaccuggccagcaugggcuucgaccccagauggcugaugaugcagagcuacauggaccccagaaugaugagcggcagacccgccauggacaucccccccauccaccccggcaugaucccccccaagccccugaugagaagagaccagauggagggcagccccaacagcagcgagagcuucgagcacaucgccagaagcgccagagaccacgccaucagccugagcgagcccagaaugcuguggggcagcgaccccuacccccacgccgagccccagcaggccaccacccccaaggccaccgaggagcccgaggacgugagaagcgaggccgcccuggaccaggagcagaucaccgccgccuacagcguggagcacaaccagcuggaggcccaccccaaggccgacuucaucagagagagcagcgaggcccaggugcagaaguuccugagcagaagcguggaggacgugagaccccaccacaccgacgccaacaaccagagcgccugcuucgaggcccccgaccagaagacccugagcgccccccaggaggagagaaucagcgccguggagagccagcccagcagaaagagaagcgugagccacggcagcaaccacacccagaagcccgacgagcagagaagcgagcccagcgccggcauccccaaggugaccagcagaugcaucgacagcaaggagcccaucgagagacccgaggagaagcccaagaaggagggcuucaucagaagcagcgagggccccaagcccgagaagguguacaagagcaagagcgagaccagauggggccccagacccagcagcaacagaagagaggaggugaacgacagacccgugagaagaagcggccccaucaagaagcccgugcugagagacaugaaggaggagagagagcagagaaaggagaaggagggcgagaaggccgagaaggugaccgagaaggugguggugaagcccgagaagaccgagaagaaggaccugccccccccccccccccccccccagccccccgcccccauccagccccagagcgugcccccccccauccagcccgaggccgagaaguuccccagcaccgagaccgccacccuggcccagaagcccagccaggacaccgagaagccccuggagcccgugagcaccgugcagguggagcccgccgugaagaccgugaaccagcagaccauggccgcccccguggugaaggaggagaagcagcccgagaaggugaucagcaaggaccuggugaucgagagacccagacccgacagcagacccgccgugaagaaggagagcacccugccccccagaaccuacuggaaggaggccagagagagagacugguuccccgaccagggcuacagaggcagaggcagaggcgaguacuacagcagaggcagaagcuacagaggcagcuacggcggcagaggcagaggcggcagaggccacaccagagacuacccccaguacagagacaacaagcccagagccgagcacauccccagcggcccccugagacagagagaggagagcgagaccagaagcgagagcagcgacuucgagguggugcccaagagaagaagacagagaggcagcgagaccgacaccgacagcgagauccacgagagcgccagcgacaaggacagccugagcaagggcaagcugcccaagagagaggagagacccgagaacaagaagcccgugaagccccacagcagcuucaagcccgacaaccacgugagaaucgacaacagacugcuggagaagcccuacgugagagacgacgacaaggccaagcccggcuuccugcccaagggcgagcccaccagaagaggcagaggcggcaccuucagaagaggcggcagagaccccggcggcagacccagcagacccagcacccugagaagacccgccuacagagacaaccaguggaaccccagacagagcgaggugcccaagcccgaggacggcgagccccccagaagacacgagcaguucauccccaucgccgccgacaagagaccccccaaguucgagagaaaguucgaccccgccagagagagacccagaagacagagacccaccagaccccccagacaggacaagccccccagauucagaagacugagagagagagaggccgccagcaagagcaacgaggugguggccgugcccaccaacggcaccgugaacaacguggcccaggagcccgugaacacccugggcgacaucagcggcaacaagacccccgaccugagcaaccagaacagcagcgaccaggccaacgaggagugggagaccgccagcgagagcagcgacuucaacgagagaagagagagagacgagaagaagaacgccgaccugaacgcccagaccguggugaaggugggcgagaacgugcugccccccaagagagagaucgccaagagaagcuucagcagccagagacccguggacagacagaacagaagaggcaacaacggcccccccaagagcggcagaaacuucagcggccccagaaacgagagaagaagcggcccccccagcaagagcggcaagagaggccccuucgacgaccagcccgccggcaccaccggcguggaccugaucaacggcagcagcgcccaccaccaggagggcgugcccaacggcaccggccagaagaacagcaaggacagcaccggcaagaagagagaggaccccaagcccggccccaagaagcccaaggagaagguggacgcccugagccaguucgaccugaacaacuacgccagcguggugaucaucgacgaccaccccgaggugaccgugaucgaggacccccagagcaaccugaacgacgacggcuucaccgagguggugagcaagaagcagcagaagagacugcaggacgaggagagaagaaagaaggaggagcaggugauccagguguggaacaagaagaacgccaacgagaagggcagaagccagaccagcaagcugccccccagauucgccaagaagcaggccaccggcauccagcaggcccagagcagcgccagcgugcccccccuggccagcgccccccugccccccagcaccagcgccagcgugcccgccagcaccagcgccccccugcccgccacccugacccccgugcccgccagcaccagcgcccccgugcccgccagcacccuggcccccgugcuggccagcaccagcgcccccgugcccgccagcccccuggcccccgugagcgccagcgccagcgugagcgccagcgugcccgccagcaccagcgccgccgccaucaccagcagcagcgcccccgccagcgcccccgcccccacccccauccuggccagcgugagcacccccgccagcgugaccauccuggccagcgccagcauccccauccuggccagcgcccuggccagcaccagcgcccccacccccgcccccgccgccagcagccccgccgcccccgugaucaccgcccccaccauccccgccagcgcccccaccgccagcgugccccuggcccccgccagcgccagcgcccccgcccccgcccccacccccgugagcgcccccaaccccgccccccccgcccccgcccagacccaggcccagacccacaagcccgugcagaacccccugcagaccaccagccagagcagcaagcagcccccccccagcaucagacugcccagcgcccagacccccaacggcaccgacuacguggccagcggcaagagcauccagaccccccagagccacggcacccugaccgccgagcugugggacaacaagguggccccccccgccgugcugaacgacaucagcaagaagcugggccccaucagccccccccagccccccagcgugagcgccuggaacaagccccugaccagcuucggcagcgcccccagcagcgagggcgccaagaacggccaggagagcggccuggagaucggcaccgacaccauccaguucggcgcccccgccagcaacggcaacgagaacgagguggugcccgugcugagcgagaagagcgccgacaagauccccgagcccaaggagcagagacagaagcagcccagagccggccccaucaaggcccagaagcugcccgaccugagccccguggagaacaaggagcacaagcccggccccaucggcaaggagagaagccugaagaacagaaaggugaaggacgcccagcagguggagcccgagggccaggagaagcccagccccgccaccgugagaagcaccgaccccgugaccaccaaggagaccaaggccgugagcgagaugagcaccgagaucggcaccaugaucagcgugagcagcgccgaguacggcaccaacgccaaggagagcgugaccgacuacaccacccccagcagcagccugcccaacaccguggccaccaacaacaccaagauggaggacacccuggugaacaacgugccccugcccaacacccugccccugcccaagagagagaccauccagcagagcagcagccugaccagcgugccccccaccaccuucagccugaccuucaagauggagagcgccagaaaggccugggagaacagccccaacgugagagagaagggcagccccgugaccagcaccgccccccccaucgccaccggcgugagcagcagcgccagcggccccagcaccgccaacuacaacagcuucagcagcgccagcaugccccagauccccguggccagcgugacccccaccgccagccugagcggcgccggcaccuacaccaccagcagccugagcaccaagagcaccaccaccagcgacccccccaacaucugcaaggugaagccccagcagcugcagaccagcagccugcccagcgccagccacuucagccagcugagcugcaugcccagccugaucgcccagcagcagcagaacccccagguguacgugagccagagcgccgccgcccagauccccgccuucuacauggacaccagccaccuguucaacacccagcacgccagacuggccccccccagccuggcccagcagcagggcuuccagcccggccugagccagcccaccagcgugcagcagauccccauccccaucuacgccccccugcagggccagcaccaggcccagcugagccugggcgccggccccgccgugagccaggcccaggagcuguucagcagcagccugcagcccuacagaagccagcccgccuucaugcagagcagccugagccagcccagcguggugcugagcggcaccgccauccacaacuuccccaccgugcagcaccaggagcuggccaaggcccagagcggccuggccuuccagcagaccagcaacacccagcccauccccauccuguacgagcaccagcugggccaggccagcggccugggcggcagccagcugaucgacacccaccugcugcaggccagagccaaccugacccaggccagcaaccuguacagcggccaggugcagcagcccggccagaccaacuucuacaacaccgcccagagccccagcgcccugcagcaggugaccgugccccugcccgccagccagcugagccugcccaacuucggcagcaccggccagccccugaucgcccugccccagacccugcagcccccccugcagcacaccaccccccaggcccaggcccagagccugagcagacccgcccaggugagccagcccuucagaggccugauccccgccggcacccagcacagcaugaucgccaccaccggcaagaugagcgagauggagcugaaggccuucggcagcggcaucgacaucaagcccggcaccccccccaucgccggcagaagcaccacccccaccagcagccccuucagagccaccagcaccagccccaacagccagagcagcaagaugaacagcaucguguaccagaagcaguuccagagcgcccccgccaccgugagaaugacccagcccuuccccacccaguucgccccccaggccaagcagagagccgaggugcugcagagcacccagagauucuucagcgagcagcagcagagcaagcagaucggcggcggcaaggcccagaagguggacagcgacagcagcaagccccccgagacccugaccgacccccccggcgugugccaggagaagguggaggagaagcccccccccgcccccagcaucgccaccaagcccgugagaaccggccccaucaagccccaggccaucaagaccgaggagaccaagagcuaa

SEQ ID NO: 22067 - RNA, 681 nt, Artificial Sequence
  PRRG4__Homo_sapiens__NP_076986
auguucacccugcuggugcugcugagccagcugcccaccgugacccugggcuucccccacugcgccagaggccccaaggccagcaagcacgccggcgaggagguguucaccagcaaggaggaggccaacuucuucauccacagaagacugcuguacaacagauucgaccuggagcuguucacccccggcaaccuggagagagagugcaacgaggagcugugcaacuacgaggaggccagagagaucuucguggacgaggacaagaccaucgccuucuggcaggaguacagcgccaagggccccaccaccaagagcgacggcaacagagagaagaucgacgugaugggccugcugaccggccugaucgccgccggcguguuccuggugaucuucggccugcugggcuacuaccugugcaucaccaagugcaacagacugcagcaccccugcagcagcgccguguacgagagaggcagacacacccccagcaucaucuucagaagacccgaggaggccgcccugagcccccugccccccagcguggaggacgccggccugcccagcuacgagcaggccguggcccugaccagaaagcacagcgugagcccccccccccccuaccccggccacaccaagggcuucagaguguucaagaagagcaugagccugcccagccacuaa

SEQ ID NO: 22068 - RNA, 921 nt, Artificial Sequence
  PRRT1__Homo_sapiens__NP_085154
augagcagcgagaagagcggccugcccgacagcgugccccacaccagccccccccccuacaacgccccccagccccccgccgagccccccgccccccccccccaggccgcccccagcagccaccaccaccaccaccaccacuaccaccagagcggcaccgccacccugcccagacugggcgccggcggccuggccagcagcgccgccaccgcccagagaggccccagcagcagcgccacccugcccagacccccccaccacgccccccccggccccgccgccggcgcccccccccccggcugcgccacccugcccagaaugccccccgaccccuaccugcaggagaccagauucgagggcccccugcccccccccccccccgccgccgccgccccccccccccccgcccccgcccagaccgcccaggcccccggcuucguggugcccacccacgccggcaccgugggcacccugccccugggcggcuacguggcccccggcuacccccugcagcugcagcccugcaccgccuacgugcccguguaccccgugggcacccccuacgccggcggcacccccggcggcaccggcgugaccagcacccugcccccccccccccagggccccggccuggcccugcuggagcccagaagacccccccacgacuacaugcccaucgccgugcugaccaccaucugcugcuucuggcccaccggcaucaucgccaucuucaaggccgugcaggugagaaccgcccuggccagaggcgacauggugagcgccgagaucgccagcagagaggccagaaacuucagcuucaucagccuggccgugggcaucgccgccauggugcugugcaccauccugaccguggugaucaucaucgccgcccagcaccacgagaacuacugggaccccuaa

SEQ ID NO: 22069 - RNA, 900 nt, Artificial Sequence
  PRRT2__Homo_sapiens__NP_001243372
auggccgccagcagcagcgagaucagcgagaugaagggcguggaggagagccccaaggugcccggcgagggccccggccacagcgaggccgagaccggccccccccaggugcuggccggcgugcccgaccagcccgaggccccccagcccggccccaacaccaccgccgcccccguggacagcggccccaaggccggccuggcccccgagaccaccgagacccccgccggcgccagcgagaccgcccaggccaccgaccugagccugagccccggcggcgagagcaaggccaacugcagccccgaggaccccugccaggagaccgugagcaagcccgaggugagcaaggaggccaccgccgaccagggcagcagacuggagagcgccgccccccccgagcccgcccccgagcccgccccccagcccgaccccagacccgacagccagcccacccccaagcccgcccugcagcccgagcugcccacccaggaggaccccacccccgagauccugagcgagagcgugggcgagaagcaggagaacggcgccguggugccccugcaggccggcgacggcgaggagggccccgcccccgagccccacagcccccccagcaagaagagcccccccgccaacggcgccccccccagagugcugcagcagcugguggaggaggacagaaugagaagagcccacagcggccaccccggcagccccagaggcagccugagcagacaccccagcagccagcuggccggccccggcguggagggcggcgagggcacccagaagcccagagacuacaucauccuggccauccugagcugcuucugccccauguggcccgugaacaucguggccuucgccuacgccgugauggugagccccaugggccccuaa

SEQ ID NO: 22070 - RNA, 654 nt, Artificial Sequence
  PRRX1__Homo_sapiens__NP_008833
augaccagcagcuacggccacgugcuggagagacagcccgcccugggcggcagacuggacagccccggcaaccuggacacccugcaggccaagaagaacuucagcgugagccaccugcuggaccuggaggaggccggcgacaugguggccgcccaggccgacgagaacgugggcgaggccggcagaagccugcuggagagccccggccugaccagcggcagcgacaccccccagcaggacaacgaccagcugaacagcgaggagaagaagaagagaaagcagagaagaaacagaaccaccuucaacagcagccagcugcaggcccuggagagaguguucgagagaacccacuaccccgacgccuucgugagagaggaccuggccagaagagugaaccugaccgaggccagagugcaggugugguuccagaacagaagagccaaguucagaagaaacgagagagccaugcuggccaacaagaacgccagccugcugaagagcuacagcggcgacgugaccgccguggagcagcccaucgugcccagacccgcccccagacccaccgacuaccugagcuggggcaccgccagccccuacagaagcagcagccugcccagaugcugccugcacgagggccugcacaacggcuucuaa

SEQ ID NO: 22071 - RNA, 762 nt, Artificial Sequence
  PRRX2__Homo_sapiens__NP_057391
auggacagcgccgccgccgccuucgcccuggacaagcccgcccugggccccggcccccccccccccccccccgcccugggccccggcgacugcgcccaggccagaaagaacuucagcgugagccaccugcuggaccuggaggagguggccgccgccggcagacuggccgccagacccggcgccagagccgaggccagagagggcgccgccagagagcccagcggcggcagcagcggcagcgaggccgccccccaggacggcgagugccccagccccggcagaggcagcgccgccaagagaaagaagaagcagagaagaaacagaaccaccuucaacagcagccagcugcaggcccuggagagaguguucgagagaacccacuaccccgacgccuucgugagagaggagcuggccagaagagugaaccugagcgaggccagagugcaggugugguuccagaacagaagagccaaguucagaagaaacgagagagccaugcuggccagcagaagcgccagccugcugaagagcuacagccaggaggccgccaucgagcagcccguggcccccagacccaccgcccugagccccgacuaccugagcuggaccgccagcagccccuacagcaccgugccccccuacagccccggcagcagcggccccgccacccccggcgugaacauggccaacagcaucgccagccugagacugaaggccaaggaguucagccugcaccacagccaggugcccaccgugaacuaa

SEQ ID NO: 22072 - RNA, 2628 nt, Artificial Sequence
  PRSS12__Homo_sapiens__NP_003610
augacccuggccagauucgugcuggcccugaugcugggcgcccugcccgagguggugggcuucgacagcgugcugaacgacagccugcaccacagccacagacacagcccccccgccggcccccacuaccccuacuaccugcccacccagcagagaccccccagaaccagacccccccccccccugcccagauuccccagaccccccagagcccugcccgcccagagaccccacgcccugcaggccggccacacccccagaccccaccccuggggcugccccgccggcgagcccugggugagcgugaccgacuucggcgcccccugccugagaugggccgaggugccccccuuccuggagagaagcccccccgccagcugggcccagcugagaggccagagacacaacuucugcagaagccccgacggcgccggcagacccuggugcuucuacggcgacgccagaggcaagguggacuggggcuacugcgacugcagacacggcagcgugagacugagaggcggcaagaacgaguucgagggcaccguggagguguacgccagcggcguguggggcaccgugugcagcagccacugggacgacagcgacgccagcgugaucugccaccagcugcagcugggcggcaagggcaucgccaagcagacccccuucagcggccugggccugauccccaucuacuggagcaacgugagaugcagaggcgacgaggagaacauccugcugugcgagaaggacaucuggcagggcggcgugugcccccagaagauggccgccgccgugaccugcagcuucagccacggccccaccuuccccaucaucagacuggccggcggcagcagcgugcacgagggcagaguggagcuguaccacgccggccaguggggcaccgugugcgacgaccagugggacgacgccgacgccgaggugaucugcagacagcugggccugagcggcaucgccaaggccuggcaccaggccuacuucggcgagggcagcggccccgugaugcuggacgaggugagaugcaccggcaacgagcugagcaucgagcagugccccaagagcagcuggggcgagcacaacugcggccacaaggaggacgccggcgugagcugcaccccccugaccgacggcgugaucagacuggccggcggcaagggcagccacgagggcagacuggagguguacuacagaggccaguggggcaccgugugcgacgacggcuggaccgagcugaacaccuacguggugugcagacagcugggcuucaaguacggcaagcaggccagcgccaaccacuucgaggagagcaccggccccaucuggcuggacgacgugagcugcagcggcaaggagaccagauuccugcagugcagcagaagacaguggggcagacacgacugcagccacagagaggacgugagcaucgccugcuaccccggcggcgagggccacagacugagccugggcuuccccgugagacugauggacggcgagaacaagaaggagggcagaguggagguguucaucaacggccaguggggcaccaucugcgacgacggcuggaccgacaaggacgccgccgugaucugcagacagcugggcuacaagggccccgccagagccagaaccauggccuacuucggcgagggcaagggccccauccacguggacaacgugaagugcaccggcaacgagagaagccuggccgacugcaucaagcaggacaucggcagacacaacugcagacacagcgaggacgccggcgugaucugcgacuacuucggcaagaaggccagcggcaacagcaacaaggagagccugagcagcgugugcggccugagacugcugcacagaagacagaagagaaucaucggcggcaagaacagccugagaggcggcuggcccuggcaggugagccugagacugaagagcagccacggcgacggcagacugcugugcggcgccacccugcugagcagcugcugggugcugaccgccgcccacugcuucaagagauacggcaacagcaccagaagcuacgccgugagagugggcgacuaccacacccuggugcccgaggaguucgaggaggagaucggcgugcagcagaucgugauccacagagaguacagacccgacagaagcgacuacgacaucgcccuggugagacugcagggccccgaggagcagugcgccagauucagcagccacgugcugcccgccugccugccccuguggagagagagaccccagaagaccgccagcaacugcuacaucaccggcuggggcgacaccggcagagccuacagcagaacccugcagcaggccgccaucccccugcugcccaagagauucugcgaggagagauacaagggcagauucaccggcagaaugcugugcgccggcaaccugcacgagcacaagagaguggacagcugccagggcgacagcggcggcccccugaugugcgagagacccggcgagagcugggugguguacggcgugaccagcuggggcuacggcugcggcgugaaggacagccccggcguguacaccaaggugagcgccuucgugcccuggaucaagagcgugaccaagcuguaa

SEQ ID NO: 22073 - RNA, 1545 nt, Artificial Sequence
  PRSS16__Homo_sapiens__NP_005856
auggccguguggcuggcccaguggcugggcccccugcugcuggugagccuguggggccugcuggcccccgccagccugcugagaagacugggcgagcacauccagcaguuccaggagagcagcgcccagggccugggccugagccugggccccggcgccgccgcccugcccaaggugggcuggcuggagcagcugcuggaccccuucaacgugagcgacagaagaagcuuccugcagagauacugggugaacgaccagcacugggugggccaggacggccccaucuuccugcaccugggcggcgagggcagccugggccccggcagcgugaugagaggccaccccgccgcccuggcccccgccuggggcgcccuggugaucagccuggagcacagauucuacggccugagcauccccgccggcggccuggagauggcccagcugagauuccugagcagcagacuggcccuggccgacguggugagcgccagacuggcccugagcagacuguucaacaucagcagcagcagccccuggaucugcuucggcggcagcuacgccggcagccuggccgccugggccagacugaaguucccccaccugaucuucgccagcguggccagcagcgcccccgugagagccgugcuggacuucagcgaguacaacgacguggugagcagaagccugaugagcaccgccaucggcggcagccuggagugcagagccgccgugagcguggccuucgccgagguggagagaagacugagaagcggcggcgccgcccaggccgcccugagaaccgagcugagcgccugcggcccccugggcagagccgagaaccaggccgagcugcugggcgcccugcaggcccuggugggcggcguggugcaguacgacggccagaccggcgccccccugagcgugagacagcugugcggccugcugcugggcggcggcggcaacagaagccacagcacccccuacugcggccugagaagagccgugcagaucgugcugcacagccugggccagaagugccugagcuucagcagagccgagaccguggcccagcugagaagcaccgagccccagcugagcggcgugggcgacagacaguggcuguaccagaccugcaccgaguucggcuucuacgugaccugcgagaaccccagaugccccuucagccagcugcccgcccugcccagccagcuggaccugugcgagcagguguucggccugagcgcccugagcguggcccaggccguggcccagaccaacagcuacuacggcggccagacccccggcgccaacaaggugcuguucgugaacggcgacaccgaccccuggcacgugcugagcgugacccaggcccugggcagcagcgagagcacccugcugaucagaaccggcagccacugccuggacauggcccccgagagacccagcgacagccccagccugagacugggcagacagaacaucuuccagcagcugcagaccuggcugaagcuggccaaggagagccagaucaagggcgagguguaa

SEQ ID NO: 22074 - RNA, 744 nt, Artificial Sequence
  PRSS1__Homo_sapiens__NP_002760
augaacccccugcugauccugaccuucguggccgccgcccuggccgcccccuucgacgacgacgacaagaucgugggcggcuacaacugcgaggagaacagcgugcccuaccaggugagccugaacagcggcuaccacuucugcggcggcagccugaucaacgagcaguggguggugagcgccggccacugcuacaagagcagaauccaggugagacugggcgagcacaacaucgaggugcuggagggcaacgagcaguucaucaacgccgccaagaucaucagacacccccaguacgacagaaagacccugaacaacgacaucaugcugaucaagcugagcagcagagccgugaucaacgccagagugagcaccaucagccugcccaccgccccccccgccaccggcaccaagugccugaucagcggcuggggcaacaccgccagcagcggcgccgacuaccccgacgagcugcagugccuggacgcccccgugcugagccaggccaagugcgaggccagcuaccccggcaagaucaccagcaacauguucugcgugggcuuccuggagggcggcaaggacagcugccagggcgacagcggcggccccguggugugcaacggccagcugcagggcguggugagcuggggcgacggcugcgcccagaagaacaagcccggcguguacaccaagguguacaacuacgugaaguggaucaagaacaccaucgccgccaacagcuaa

SEQ ID NO: 22075 - RNA, 678 nt, Artificial Sequence
  PRSS21__Homo_sapiens__NP_001257381
augggcgccagaggcgcccugcugcuggcccugcugcuggccagagccggccugagaaagcccgagagccaggaggccgccccccugagcggccccugcggcagaagagugaucaccagcagaaucgugggcggcgaggacgccgagcugggcagauggcccuggcagggcagccugagacugugggacagccacgugugcggcgugagccugcugagccacagaugggcccugaccgccgcccacugcuucgagaccgaccugagcgaccccagcggcuggauggugcaguucggccagcugaccagcaugcccagcuucuggagccugcaggccuacuacaccagauacuucgugagcaacaucuaccugagccccagauaccugggcaacagccccuacgacaucgcccuggugaagcugagcgcccccgugaccuacaccaagcacauccagcccaucugccugcaggccagcaccuucgaguucgagaacagaaccgacugcugggugaccggcuggggcuacaucaaggaggacgagggcagcagcggcagacaccacaagcagcuguacgugcagcccccccugccccaggugcaguucccccagggccaccuguggagacacggccugugcuggcagugccccagaagagagggcugccugcugagauaa

SEQ ID NO: 22076 - RNA, 954 nt, Artificial Sequence
  PRSS22__Homo_sapiens__NP_071402
augguggugagcggcgccccccccgcccugggcggcggcugccugggcaccuucaccagccugcugcugcuggccagcaccgccauccugaacgccgccagaauccccgugccccccgccugcggcaagccccagcagcugaacagaguggugggcggcgaggacagcaccgacagcgaguggcccuggaucgugagcauccagaagaacggcacccaccacugcgccggcagccugcugaccagcagaugggugaucaccgccgcccacugcuucaaggacaaccugaacaagcccuaccuguucagcgugcugcugggcgccuggcagcugggcaaccccggcagcagaagccagaaggugggcguggccuggguggagccccaccccguguacagcuggaaggagggcgccugcgccgacaucgcccuggugagacuggagagaagcauccaguucagcgagagagugcugcccaucugccugcccgacgccagcauccaccugccccccaacacccacugcuggaucagcggcuggggcagcauccaggacggcgugccccugccccacccccagacccugcagaagcugaaggugcccaucaucgacagcgaggugugcagccaccuguacuggagaggcgccggccagggccccaucaccgaggacaugcugugcgccggcuaccuggagggcgagagagacgccugccugggcgacagcggcggcccccugaugugccagguggacggcgccuggcugcuggccggcaucaucagcuggggcgagggcugcgccgagagaaacagacccggcguguacaucagccugagcgcccacagaagcuggguggagaagaucgugcagggcgugcagcugagaggcagagcccagggcggcggcgcccugagagcccccagccagggcagcggcgccgccgccagaagcuaa

SEQ ID NO: 22077 - RNA, 1299 nt, Artificial Sequence
  PRSS23__Homo_sapiens__NP_001280107
augugcagcggcgccggcggcgugagagccgccagccccagacccgaggccggcagagccggccugggcuggagaggcggcagaaccagacagcugcccgcccugcuggccagccugcuggcccugggcugcgccgccggccaggccugggagcccagagcccugagcagaagaccccaccugagcgagagaagaagcgagcccagacccggcagagccgccagaagaggcaccgugcugggcauggccggcauccccggccugcuguuccugcuguucuuccugcugugcgccgugggccaggugagccccuacagcgcccccuggaagcccaccuggcccgccuacagacugcccguggugcugccccagagcacccugaaccuggccaagcaguaccugagcuacgagacccuguacgccaacggcagcagaaccgagacccaggugggcaucuacauccugagcagcagcggcgacggcgcccagcacagagacagcggcagcagcggcaagagcagaagaaagagacagaucuacggcuacgacagcagauucagcaucuucggcaaggacuuccugcugaacuaccccuucagcaccagcgugaagcugagcaccggcugcaccggcacccugguggccgagaagcacgugcugaccgccgcccacugcauccacgacggcaagaccuacgugaagggcacccagaagcugagagugggcuuccugaagcccaaguucaaggacggcggcagaggcgccaacgacagcaccagcgccaugcccgagcagaugaaguuccaguggaucagagugaagagaacccacgugcccaagggcuggaucaagggcaacgccaacgacaucggcauggacuacgacuacgcccugcuggagcugaagaagccccacaagagaaaguucaugaagaucggcgugagcccccccgccaagcagcugcccggcggcagaauccacuucagcggcuacgacaacgacagacccggcaaccugguguacagauucugcgacgugaaggacgagaccuacgaccugcuguaccagcagugcgacgcccagcccggcgccagcggcagcggcguguacgugagaauguggaagagacagcagcagaagugggagagaaagaucaucggcaucuucagcggccaccaguggguggacaugaacggcagcccccaggacuucaacguggccgugagaaucaccccccugaaguacgcccagaucugcuacuggaucaagggcaacuaccuggacugcagagagggcuaa

SEQ ID NO: 22078 - RNA, 873 nt, Artificial Sequence
  PRSS27__Homo_sapiens__NP_114154
augagaagacccgccgccgugccccugcugcugcugcugugcuucggcagccagagagccaaggccgccaccgccugcggcagacccagaaugcugaacagaauggugggcggccaggacacccaggagggcgaguggcccuggcaggugagcauccagagaaacggcagccacuucugcggcggcagccugaucgccgagcagugggugcugaccgccgcccacugcuucagaaacaccagcgagaccagccuguaccaggugcugcugggcgccagacagcuggugcagcccggcccccacgccauguacgccagagugagacagguggagagcaacccccuguaccagggcaccgccagcagcgccgacguggcccugguggagcuggaggcccccgugcccuucaccaacuacauccugcccgugugccugcccgaccccagcgugaucuucgagaccggcaugaacugcugggugaccggcuggggcagccccagcgaggaggaccugcugcccgagcccagaauccugcagaagcuggccgugcccaucaucgacacccccaagugcaaccugcuguacagcaaggacaccgaguucggcuaccagcccaagaccaucaagaacgacaugcugugcgccggcuucgaggagggcaagaaggacgccugcaagggcgacagcggcggcccccuggugugccuggugggccagagcuggcugcaggccggcgugaucagcuggggcgagggcugcgccagacagaacagacccggcguguacaucagagugaccgcccaccacaacuggauccacagaaucauccccaagcugcaguuccagcccgccagacugggcggccagaaguaa

SEQ ID NO: 22079 - RNA, 744 nt, Artificial Sequence
  PRSS2__Homo_sapiens__NP_002761
augaaccugcugcugauccugaccuucguggccgccgccguggccgcccccuucgacgacgacgacaagaucgugggcggcuacaucugcgaggagaacagcgugcccuaccaggugagccugaacagcggcuaccacuucugcggcggcagccugaucagcgagcaguggguggugagcgccggccacugcuacaagagcagaauccaggugagacugggcgagcacaacaucgaggugcuggagggcaacgagcaguucaucaacgccgccaagaucaucagacaccccaaguacaacagcagaacccuggacaacgacauccugcugaucaagcugagcagccccgccgugaucaacagcagagugagcgccaucagccugcccaccgccccccccgccgccggcaccgagagccugaucagcggcuggggcaacacccugagcagcggcgccgacuaccccgacgagcugcagugccuggacgcccccgugcugagccaggccgagugcgaggccagcuaccccggcaagaucaccaacaacauguucugcgugggcuuccuggagggcggcaaggacagcugccagggcgacagcggcggccccguggugagcaacggcgagcugcagggcaucgugagcuggggcuacggcugcgcccagaagaacagacccggcguguacaccaagguguacaacuacguggacuggaucaaggacaccaucgccgccaacagcuaa

SEQ ID NO: 22080 - RNA, 843 nt, Artificial Sequence
  PRSS33__Homo_sapiens__NP_690851
augagaggcgugagcugccugcaggugcugcugcugcuggugcugggcgccgccggcacccagggcagaaagagcgccgccugcggccagcccagaaugagcagcagaaucgugggcggcagagacggcagagacggcgaguggcccuggcaggccagcauccagcacagaggcgcccacgugugcggcggcagccugaucgccccccagugggugcugaccgccgcccacugcuuccccagaagagcccugcccgccgaguacagagugagacugggcgcccugagacugggcagcaccagccccagaacccugagcgugcccgugagaagagugcugcugccccccgacuacagcgaggacggcgccagaggcgaccuggcccugcugcagcugagaagacccgugccccugagcgccagagugcagcccgugugccugcccgugcccggcgccagacccccccccggcacccccugcagagugaccggcuggggcagccugagacccggcgugccccugcccgaguggagaccccugcagggcgugagagugccccugcuggacagcagaaccugcgacggccuguaccacgugggcgccgacgugccccaggccgagagaaucgugcugcccggcagccugugcgccggcuacccccagggccacaaggacgccugccagggcgacagcggcggcccccugaccugccugcagagcggcagcugggugcuggugggcguggugagcuggggcaagggcugcgcccugcccaacagacccggcguguacaccagcguggccaccuacagccccuggauccaggccagagugagcuucuaa

SEQ ID NO: 22081 - RNA, 1242 nt, Artificial Sequence
  PRSS35__Homo_sapiens__NP_001163894
auggagaacaugcugcuguggcugaucuucuucacccccggcuggacccugaucgacggcagcgagauggagugggacuucauguggcaccugagaaaggugcccagaaucgugagcgagagaaccuuccaccugaccagccccgccuucgaggccgacgccaagaugauggugaacaccgugugcggcaucgagugccagaaggagcugcccacccccagccugagcgagcuggaggacuaccugagcuacgagaccguguucgagaacggcaccagaacccugaccagagugaaggugcaggaccuggugcuggagcccacccagaacaucaccaccaagggcgugagcgugagaagaaagagacagguguacggcaccgacagcagauucagcauccuggacaagagauuccugaccaacuuccccuucagcaccgccgugaagcugagcaccggcugcagcggcauccugaucagcccccagcacgugcugaccgccgcccacugcgugcacgacggcaaggacuacgugaagggcagcaagaagcugagagugggccugcugaagaugagaaacaagagcggcggcaagaagagaagaggcagcaagagaagcagaagagaggccagcggcggcgaccagagagagggcaccagagagcaccugagagagagagccaagggcggcagaagaagaaagaagagcggcagaggccagagaaucgccgagggcagacccagcuuccaguggaccagagugaagaacacccacauccccaagggcugggccagaggcggcaugggcgacgccacccuggacuacgacuacgcccugcuggagcugaagagagcccacaagaagaaguacauggagcugggcaucagccccaccaucaagaagaugcccggcggcaugauccacuucagcggcuucgacaacgacagagccgaccagcugguguacagauucugcagcgugagcgacgagagcaacgaccugcuguaccaguacugcgacgccgagagcggcagcaccggcagcggcguguaccugagacugaaggaccccgacaagaagaacuggaagagaaagaucaucgccguguacagcggccaccaguggguggacgugcacggcgugcagaaggacuacaacguggccgugagaaucaccccccugaaguacgcccagaucugccuguggauccacggcaacgacgccaacugcgccuacggcuaa

SEQ ID NO: 22082 - RNA, 786 nt, Artificial Sequence
  PRSS3__Homo_sapiens__NP_001184026
augcacaugagagagaccagcggcuucacccugaagaagggcagaagcgccccccugguguuccacccccccgacgcccugaucgccgugcccuucgacgacgacgacaagaucgugggcggcuacaccugcgaggagaacagccugcccuaccaggugagccugaacagcggcagccacuucugcggcggcagccugaucagcgagcaguggguggugagcgccgcccacugcuacaagaccagaauccaggugagacugggcgagcacaacaucaaggugcuggagggcaacgagcaguucaucaacgccgccaagaucaucagacaccccaaguacaacagagacacccuggacaacgacaucaugcugaucaagcugagcagccccgccgugaucaacgccagagugagcaccaucagccugcccaccgccccccccgccgccggcaccgagugccugaucagcggcuggggcaacacccugagcuucggcgccgacuaccccgacgagcugaagugccuggacgcccccgugcugacccaggccgagugcaaggccagcuaccccggcaagaucaccaacagcauguucugcgugggcuuccuggagggcggcaaggacagcugccagagagacagcggcggccccguggugugcaacggccagcugcagggcguggugagcuggggccacggcugcgccuggaagaacagacccggcguguacaccaagguguacaacuacguggacuggaucaaggacaccaucgccgccaacagcuaa

SEQ ID NO: 22083 - RNA, 1158 nt, Artificial Sequence
  PRSS50__Homo_sapiens__NP_037402
augggcagauggugccagaccguggccagaggccagagacccagaaccagcgcccccagcagagccggcgcccugcugcugcugcugcugcugcugagaagcgccggcugcuggggcgccggcgaggcccccggcgcccugagcaccgccgaccccgccgaccagagcgugcagugcgugcccaaggccaccugccccagcagcagacccagacugcuguggcagacccccaccacccagacccugcccagcaccaccauggagacccaguuccccgugagcgagggcaagguggaccccuacagaagcugcggcuucagcuacgagcaggaccccacccugagagaccccgaggccguggccagaagauggcccuggauggugagcgugagagccaacggcacccacaucugcgccggcaccaucaucgccagccagugggugcugaccguggcccacugccugaucuggagagacgugaucuacagcgugagagugggcagccccuggaucgaccagaugacccagaccgccagcgacgugcccgugcugcaggugaucaugcacagcagauacagagcccagagauucuggagcugggugggccaggccaacgacaucggccugcugaagcugaagcaggagcugaaguacagcaacuacgugagacccaucugccugcccggcaccgacuacgugcugaaggaccacagcagaugcaccgugaccggcuggggccugagcaaggccgacggcauguggccccaguucagaaccauccaggagaaggaggugaucauccugaacaacaaggagugcgacaacuucuaccacaacuucaccaagauccccacccuggugcagaucaucaagagccagaugaugugcgccgaggacacccacagagagaaguucugcuacgagcugaccggcgagccccuggugugcagcauggagggcaccugguaccuggugggccuggugagcuggggcgccggcugccagaagagcgaggccccccccaucuaccugcaggugagcagcuaccagcacuggaucugggacugccugaacggccaggcccuggcccugcccgcccccagcagaacccugcugcuggcccugccccugccccugagccugcuggccgcccuguaa

SEQ ID NO: 22084 - RNA, 1662 nt, Artificial Sequence
  PRSS53__Homo_sapiens__NP_001034592
augaaguggugcuggggccccgugcugcugaucgccggcgccaccgugcugauggagggccugcaggccgcccagagagccugcggccagagaggccccggcccccccaagccccaggagggcaacaccgugcccggcgaguggcccuggcaggccagcgugagaagacagggcgcccacaucugcagcggcagccugguggccgacaccugggugcugaccgccgcccacugcuucgagaaggccgccgccaccgagcugaacagcuggagcguggugcugggcagccugcagagagagggccugagccccggcgccgaggaggugggcguggccgcccugcagcugcccagagccuacaaccacuacagccagggcagcgaccuggcccugcugcagcuggcccaccccaccacccacaccccccugugccugccccagcccgcccacagauuccccuucggcgccagcugcugggccaccggcugggaccaggacaccagcgacgcccccggcacccugagaaaccugagacugagacugaucagcagacccaccugcaacugcaucuacaaccagcugcaccagagacaccugagcaaccccgccagacccggcaugcugugcggcggcccccagcccggcgugcagggccccugccagggcgacagcggcggccccgugcugugccuggagcccgacggccacugggugcaggccggcaucaucagcuucgccagcagcugcgcccaggaggacgcccccgugcugcugaccaacaccgccgcccacagcagcuggcugcaggccagagugcagggcgccgccuuccuggcccagagccccgagacccccgagaugagcgacgaggacagcugcguggccugcggcagccugagaaccgccggcccccaggccggcgcccccagccccuggcccugggaggccagacugaugcaccagggccagcuggccugcggcggcgcccuggugagcgaggaggccgugcugaccgccgcccacugcuucaucggcagacaggcccccgaggaguggagcgugggccugggcaccagacccgaggaguggggccugaagcagcugauccugcacggcgccuacacccaccccgagggcggcuacgacauggcccugcugcugcuggcccagcccgugacccugggcgccagccugagaccccugugccugcccuaccccgaccaccaccugcccgacggcgagagaggcugggugcugggcagagccagacccggcgccggcaucagcagccugcagaccgugcccgugacccugcugggccccagagccugcagcagacugcacgccgcccccggcggcgacggcagccccauccugcccggcauggugugcaccagcgccgugggcgagcugcccagcugcgagggccugagcggcgccccccuggugcacgaggugagaggcaccugguuccuggccggccugcacagcuucggcgacgccugccagggccccgccagacccgccguguucaccgcccugcccgccuacgaggacugggugagcagccuggacuggcagguguacuucgccgaggagcccgagcccgaggccgagcccggcagcugccuggccaacaucagccagcccaccagcugcuaa

SEQ ID NO: 22085 - RNA, 831 nt, Artificial Sequence
  PRSS55__Homo_sapiens__NP_001183949
augcugcuguucagcgugcugcugcugcugagccuggugaccggcacccagcugggccccagaaccccccugcccgaggccggcguggccauccugggcagagccagaggcgcccacagaccccagcccccccacccccccagccccgugagcgagugcggcgacagaagcaucuucgagggcagaaccagauacagcagaaucaccggcggcauggaggccgaggugggcgaguuccccuggcaggugagcauccaggccagaagcgagcccuucugcggcggcagcauccugaacaagugguggauccugaccgccgcccacugccuguacagcgaggagcuguuccccgaggagcugagcguggugcugggcaccaacgaccugaccagccccagcauggagaucaaggagguggccagcaucauccugcacaaggacuucaagagagccaacauggacaacgacaucgcccugcugcugcuggccagccccaucaagcuggacgaccugaaggugcccaucugccugcccacccagcccggccccgccaccuggagagagugcuggguggccggcuggggccagaccaacgccgccgacaagaacagcgugaagaccgaccugaugaaggcccccauggugaucauggacugggaggagugcagcaagauguuccccaagcugaccaagaacaugcugugcgccggcuacaagaacgagagcuacgacgccugcaagcagagcuacuuccccacccugcagagaaugaacaccggcagcagccagaccaagccccccggcagccacaccuuccaccugcagaacuaa

SEQ ID NO: 22086 - RNA, 852 nt, Artificial Sequence
  PRSS57__Homo_sapiens__NP_999875
augggccugggccugagaggcuggggcagaccccugcugaccguggccaccgcccugaugcugcccgugaagccccccgccggcagcuggggcgcccagaucaucggcggccacgaggugaccccccacagcagacccuacauggccagcgugagauucggcggccagcaccacugcggcggcuuccugcugagagccagauggguggugagcgccgcccacugcuucagccacagagaccugagaaccggccugguggugcugggcgcccacgugcugagcaccgccgagcccacccagcagguguucggcaucgacgcccugaccacccaccccgacuaccaccccaugacccacgccaacgacaucugccugcugagacugaacggcagcgccgugcugggccccgccgugggccugcugagacugcccggcagaagagccagaccccccaccgccggcaccagaugcagaguggccggcuggggcuucgugagcgacuucgaggagcugccccccggccugauggaggccaaggugagagugcuggaccccgacgugugcaacagcagcuggaagggccaccugacccugaccaugcugugcaccagaagcggcgacagccacagaagaggcuucugcagcgccgacagcggcggcccccuggugugcagaaacagagcccacggccuggugagcuucagcggccuguggugcggcgaccccaagacccccgacguguacacccaggugagcgccuucguggccuggaucugggacguggugagaagaagcagcccccagcccggcccccugcccggcaccaccagaccccccggcgaggccgccuaa

SEQ ID NO: 22087 - RNA, 726 nt, Artificial Sequence
  PRSS58__Homo_sapiens__NP_001001317
augaaguucauccugcugugggcccugcugaaccugaccguggcccuggccuucaaccccgacuacaccgugagcagcaccccccccuaccugguguaccugaagagcgacuaccugcccugcgccggcgugcugauccacccccugugggugaucaccgccgcccacugcaaccugcccaagcugagagugauccugggcgugaccauccccgccgacagcaacgagaagcaccugcaggugaucggcuacgagaagaugauccaccacccccacuucagcgugaccagcaucgaccacgacaucaugcugaucaagcugaagaccgaggccgagcugaacgacuacgugaagcuggccaaccugcccuaccagaccaucagcgagaacaccaugugcagcgugagcaccuggagcuacaacgugugcgacaucuacaaggagcccgacagccugcagaccgugaacaucagcgugaucagcaagccccagugcagagacgccuacaagaccuacaacaucaccgagaacaugcugugcgugggcaucgugcccggcagaagacagcccugcaaggaggugagcgccgcccccgccaucugcaacggcaugcugcagggcauccugagcuucgccgacggcugcgugcugagagccgacgugggcaucuacgccaagaucuucuacuacauccccuggaucgagaacgugauccagaacaacuaa

SEQ ID NO: 22088 - RNA, 1032 nt, Artificial Sequence
  PRSS8__Homo_sapiens__NP_002764
auggcccagaagggcgugcugggccccggccagcugggcgccguggccauccugcuguaccugggccugcugagaagcggcaccggcgccgagggcgccgaggcccccugcggcguggccccccaggccagaaucaccggcggcagcagcgccguggccggccaguggcccuggcaggugagcaucaccuacgagggcgugcacgugugcggcggcagccuggugagcgagcagugggugcugagcgccgcccacugcuuccccagcgagcaccacaaggaggccuacgaggugaagcugggcgcccaccagcuggacagcuacagcgaggacgccaaggugagcacccugaaggacaucaucccccaccccagcuaccugcaggagggcagccagggcgacaucgcccugcugcagcugagcagacccaucaccuucagcagauacaucagacccaucugccugcccgccgccaacgccagcuuccccaacggccugcacugcaccgugaccggcuggggccacguggcccccagcgugagccugcugacccccaagccccugcagcagcuggaggugccccugaucagcagagagaccugcaacugccuguacaacaucgacgccaagcccgaggagccccacuucgugcaggaggacauggugugcgccggcuacguggagggcggcaaggacgccugccagggcgacagcggcggcccccugagcugccccguggagggccugugguaccugaccggcaucgugagcuggggcgacgccugcggcgccagaaacagacccggcguguacacccuggccagcagcuacgccagcuggauccagagcaaggugaccgagcugcagcccagaguggugccccagacccaggagagccagcccgacagcaaccugugcggcagccaccuggccuucagcagcgcccccgcccagggccugcugagacccauccuguuccugccccugggccuggcccugggccugcugagccccuggcugagcgagcacuaa

SEQ ID NO: 22089 - RNA, 573 nt, Artificial Sequence
  PRTFDC1__Homo_sapiens__NP_001269715
auggccggcagcagcgaggaggcccccgacuacggcagaggcguggugaucauggacgacuggcccggcuacgaccugaaccuguucaccuacccccagcacuacuacggcgaccuggaguacgugcugaucccccacggcaucaucguggacagaaucgagagacuggccaaggacaucaugaaggacaucggcuacagcgacaucauggugcugugcgugcugaagggcggcuacaaguucugcgccgaccugguggagcaccugaagaacaucagcagaaacagcgacagauucgugagcaugaagguggacuucaucagacugaagagcuacagaaacgaccagagcaugggcgagaugcagaucaucggcggcgacgaccugagcacccuggccggcaagaacgugcugaucguggaggacguggugggcaccggcagaaccaugaaggcccugcugagcaacaucgagaaguacaagcccaacaugaucaagguggccagccugcuggugaagagaaccagcagaagcgacggcuucagacccgacagccacaugagacaccaguaa

SEQ ID NO: 22090 - RNA, 3453 nt, Artificial Sequence
  PRTG__Homo_sapiens__NP_776175
auggcccccccccugagaccccuggccagacugagaccccccggcaugcugcugagagcccugcugcugcugcugcugcugagcccccugcccggcguguggugcuucagcgagcugagcuucgugaaggagccccaggacgugaccgugaccagaaaggaccccguggugcuggacugccaggcccacggcgaggugcccaucaaggugaccuggcugaagaacggcgccaagaugagcgagaacaagagaaucgaggugcugagcaacggcagccuguacaucagcgagguggagggcagaagaggcgagcagagcgacgagggcuucuaccagugccuggccaugaacaaguacggcgccauccugagccagaaggcccaccuggcccugagcaccaucagcgccuucgaggugcagcccaucagcaccgaggugcacgagggcggcguggccagauucgccugcaagaucagcagccacccccccgccgugaucaccugggaguucaacagaaccacccugcccaugaccauggacagaaucaccgcccugcccaccggcgugcugcagaucuacgacgugagccagagagacagcggcaacuacagaugcaucgccgccaccguggcccacagaagaaagagcauggaggccagccugaccgugauccccgccaaggagagcaagagcuuccacacccccaccaucaucgccggcccccagaacaucaccaccagccugcaccagaccguggugcuggagugcauggccaccggcaaccccaagcccaucaucagcuggagcagacuggaccacaagagcaucgacguguucaacaccagagugcugggcaacggcaaccugaugaucagcgacgugagacugcagcacgccggcguguacgugugcagagccaccacccccggcaccagaaacuucaccguggccauggccacccugaccgugcuggccccccccagcuucguggaguggcccgagagccugaccagacccagagccggcaccgccagauucgugugccaggccgagggcauccccagccccaagaugagcuggcugaagaacggcagaaagauccacagcaacggcagaaucaagauguacaacagcaagcuggugaucaaccagaucauccccgaggacgacgccaucuaccagugcauggccgagaacagccagggcagcauccugagcagagccagacugaccguggugaugagcgaggacagacccagcgcccccuacaacgugcacgccgagaccaugagcagcagcgccauccugcuggccugggagagaccccuguacaacagcgacaaggugaucgccuacagcgugcacuacaugaaggccgagggccugaacaacgaggaguaccagguggugaucggcaacgacaccacccacuacaucaucgacgaccuggagcccgccagcaacuacaccuucuacaucguggccuacaugcccaugggcgccagccagaugagcgaccacgugacccagaacacccuggaggacgugccccugagaccccccgagaucagccugaccagcagaagccccaccgacauccugaucagcuggcugcccauccccgccaaguacagaagaggccagguggugcuguacagacugagcuucagacugagcaccgagaacagcauccaggugcuggagcugcccggcaccacccacgaguaccugcuggagggccugaagcccgacagcguguaccuggugagaaucaccgccgccaccagagugggccugggcgagagcagcguguggaccagccacagaacccccaaggccaccagcgugaaggcccccaagagccccgagcugcaccuggagccccugaacugcaccaccaucagcgugagauggcagcaggacguggaggacaccgccgccauccagggcuacaagcuguacuacaaggaggagggccagcaggagaacggccccaucuuccuggacaccaaggaccugcuguacacccugagcggccuggaccccagaagaaaguaccacgugagacugcuggccuacaacaacaucgacgacggcuaccaggccgaccagaccgugagcacccccggcugcgugagcgugagagacagaauggugcccccccccccccccccccaccaccuguacgccaaggccaacaccagcagcagcaucuuccugcacuggagaagacccgccuucaccgccgcccagaucaucaacuacaccaucagaugcaaccccgugggccugcagaacgccagccuggugcuguaccugcagaccagcgagacccacaugcuggugcagggccuggagcccaacaccaaguacgaguucgccgugagacugcacguggaccagcugagcagccccuggagccccgugguguaccacagcacccugcccgaggcccccgccggcccccccgugggcgugaaggugacccugaucgaggacgacaccgcccuggugagcuggaagccccccgacggccccgagaccguggugaccagauacaccauccuguacgccagcagaaaggccuggaucgccggcgaguggcaggugcugcacagagagggcgccaucaccauggcccugcuggagaaccugguggccggcaacguguacaucgugaagaucagcgccagcaacgaggugggcgagggccccuucagcaacagcguggagcuggccgugcugcccaaggagaccagcgagagcaaccagagacccaagagacuggacagcgccgacgccaagguguacagcggcuacuaccaccuggaccagaagagcaugaccggcaucgccgugggcgugggcaucgcccugaccugcauccugaucugcgugcugauccugaucuacagaagcaaggccagaaagagcagcgccagcaagaccgcccagaacggcacccagcagcugcccagaaccagcgccagccuggccagcggcaacgaggugggcaagaaccuggagggcgccgugggcaacgaggagagccugaugcccaugaucaugcccaacagcuucaucgacgccaagggcggcaccgaccugaucaucaacagcuacggccccaucaucaagaacaacagcaagaagaagugguucuucuuccaggacagcaagaagauccagguggagcagccccagagaagauucacccccgccgugugcuucuaccagcccggcaccaccgugcugaucagcgacgaggacagccccagcagccccggccagaccaccagcuucagcagacccuucggcguggccgccgacaccgagcacagcgccaacagcgagggcagccacgagaccggcgacagcggcagauucagccacgagagcaacgacgagauccaccugagcagcgugaucagcaccaccccccccaaccuguaa

SEQ ID NO: 22091 - RNA, 771 nt, Artificial Sequence
  PRTN3__Homo_sapiens__NP_002768
auggcccacagaccccccagccccgcccuggccagcgugcugcuggcccugcugcugagcggcgccgccagagccgccgagaucgugggcggccacgaggcccagccccacagcagacccuacauggccagccugcagaugagaggcaaccccggcagccacuucugcggcggcacccugauccaccccagcuucgugcugaccgccgcccacugccugagagacaucccccagagacuggugaacguggugcugggcgcccacaacgugagaacccaggagcccacccagcagcacuucagcguggcccagguguuccugaacaacuacgacgccgagaacaagcugaacgacgugcugcugauccagcugagcagccccgccaaccugagcgccagcguggccaccgugcagcugccccagcaggaccagcccgugccccacggcacccagugccuggccaugggcuggggcagagugggcgcccacgacccccccgcccaggugcugcaggagcugaacgugaccguggugaccuucuucugcagaccccacaacaucugcaccuucgugcccagaagaaaggccggcaucugcuucggcgacagcggcggcccccugaucugcgacggcaucauccagggcaucgacagcuucgugaucuggggcugcgccaccagacuguuccccgacuucuucaccagaguggcccuguacguggacuggaucagaagcacccugagaagaguggaggccaagggcagacccuaa

SEQ ID NO: 22092 - RNA, 9267 nt, Artificial Sequence
  PRUNE2__Homo_sapiens__NP_056040
auggaggaguuccugcagagagccaagagcaagcugaacagaagcaagagacuggagaaggugcacguggugaucggccccaagagcugcgaccuggacagccugaucagcaccuucaccuacgccuacuuccuggacaaggugagcccccccggcgugcugugccugcccgugcugaacauccccagaaccgaguucaacuacuucaccgagaccagauucauccuggaggagcugaacaucagcgagagcuuccacaucuucagagacgagaucaaccugcaccagcugaacgacgagggcaagcugagcaucacccuggugggcagcagcgugcuggccagcgaggacaagacccuggagagcgccguggugaaggugaucaaccccguggagcagagcgacgccaacguggaguucagagagagcagcagcagccuggugcugaaggagauccugcaggaggcccccgagcugaucaccgagcagcuggcccacagacugagaggcagcauccuguucaaguggaugaccauggagagcgagaagaucagcgagaagcaggaggagauccugagcauccuggaggagaaguuccccaaccugccccccagagaggacaucaucaacgugcugcaggagacccaguucagcgcccagggccugagcaucgagcagaccaugcugaaggaccugaaggagcugagcgacggcgagaucaagguggccaucagcaccgugagcaugaaccuggagaacugccuguuccacagcaacaucaccagcgaccugaaggccuucaccgacaaguucggcuucgacgugcugauccuguucagcagcuaccugagcgaggagcagcagcccagaagacagaucgccguguacagcgagaacauggagcugugcagccagaucugcugcgagcuggaggagugccagaaccccugccuggagcuggagcccuucgacugcggcugcgacgagauccugguguaccagcaggaggaccccagcgugaccugcgaccagguggugcugguggugaaggaggugaucaacagaagaugccccgagauggugagcaacagcagaaccagcagcaccgaggccguggccggcagcgccccccugagccagggcagcagcggcaucauggagcuguacggcagcgacaucgagccccagcccagcagcgugaacuucaucgagaacccccccgaccugaacgacagcaaccaggcccagguggacgccaacguggaccuggugagccccgacagcggccuggccaccaucagaagcagcagaagcagcaaggagagcagcguguuccugagcgacgacagccccgugggcgagggcgccggcccccaccacacccugcugcccggccuggacagcuacagccccauccccgagggcgccguggccgaggagcacgccuggagcggcgagcacggcgagcacuucgaccuguucaacuucgaccccgcccccauggccagcggccagagccagcagagcagccacagcgccgacuacagccccgccgacgacuucuuccccaacagcgaccugagcgagggccagcugcccgccggccccgagggccuggacggcaugggcaccaacaugagcaacuacagcagcagcagccugcugagcggcgccggcaaggacagccugguggagcacgacgaggaguucgugcagagacaggacagccccagagacaacagcgagagaaaccugagccugaccgacuucgugggcgacgagagccccagccccgagagacugaagaacaccggcaagagaaucccccccacccccaugaacagccugguggagagcagccccagcaccgaggagcccgccagccuguacaccgaggacaugacccagaaggccaccgacaccggccacaugggccccccccagacccacgccagaugcagcagcugguggggcggccuggagaucgacagcaagaacaucgccgacgccuggagcagcagcgagcaggagagcguguuccagagccccgagagcuggaaggagcacaagcccagcagcaucgacagaagagccagcgacagcguguuccagcccaagagccuggaguucaccaagagcggccccugggagagcgaguucggccagcccgagcugggcagcaacgacauccaggacaagaacgaggagagccugcccuuccagaaccugcccauggagaagagcccccugcccaacaccagcccccagggcaccaaccaccugaucgaggacuucgccagccuguggcacagcggcagaagccccaccgccaugcccgagcccuggggcaaccccaccgacgacggcgagcccgccgccguggcccccuuccccgccuggagcgccuucggcaaggaggaccacgacgaggcccugaagaacaccuggaaccugcaccccaccagcagcaagacccccagcgugagagaccccaacgagugggccauggccaagagcggcuucgccuucagcagcagcgagcugcuggacaacagccccagcgagaucaacaacgaggccgcccccgagaucuggggcaagaagaacaacgacagcagagaccacaucuucgcccccggcaaccccagcagcgaccuggaccacaccuggaccaacagcaagccccccaaggaggaccagaacggccugguggaccccaagaccagaggcaagguguacgagaagguggacagcuggaaccuguucgaggagaacaugaagaagggcggcagcgacgugcuggugcccugggaggacagcuuccugagcuacaagugcagcgacuacagcgccagcaaccugggcgaggacagcgugcccagcccccuggacaccaacuacagcaccagcgacagcuacaccagccccaccuucgccggcgacgagaaggagaccgagcacaagcccuucgccaaggaggagggcuucgagagcaaggacggcaacagcaccgccgaggagaccgacauccccccccagagccugcagcagagcagcagaaacagaaucagcagcggccccggcaaccuggacaugugggccagcccccacaccgacaacagcagcgagaucaacaccacccacaaccuggacgagaacgagcugaagaccgagcacaccgacggcaagaacaucagcauggaggacgacgugggcgagagcagccagagcagcuacgacgaccccagcaugaugcagcuguacaacgagaccaacagacagcugacccugcugcacagcagcaccaacagcagacagaccgcccccgacagccuggaccuguggaacagagugauccuggaggacacccagagcaccgccaccaucagcgacauggacaacgaccuggacugggacgacugcagcggcggcgccgccauccccagcgacggccagaccgagggcuacauggccgagggcagcgagcccgagaccagauucaccgugagacagcuggagcccuggggccuggaguaccaggaggccaaccagguggacugggagcugcccgccagcgacgagcacaccaaggacagcgcccccagcgagcaccacacccugaacgagaagagcggccagcugaucgccaacagcaucugggacagcgugaugagagacaaggacaugagcagcuucaugcugcccggcagcagccacaucaccgacagcgagcagagagagcugccccccgagauccccagccacagcgccaacgugaaggacacccacagccccgacgcccccgccgccagcggcaccagcgagagcgaggcccugaucagccaccuggacaagcaggacaccgagagagagacccugcagagcgacgccgccagccuggccaccagacuggagaaccccggcuacuucccccaccccgaccccuggaagggccacggcgacggccagagcgagagcgagaaggaggcccagggcgccaccgacagaggccaccuggacgaggaggaggugaucgccagcggcguggagaacgccagcggcaucagcgagaagggccagagcgaccaggagcugagcagccugguggccagcgagcaccaggagaucugcaucaagagcggcaagaucagcagccuggccgugaccuucagcccccagaccgaggagcccgaggaggugcuggaguacgaggagggcagcuacaaccuggacagcagagacgugcagaccggcaugagcgccgacaaccugcagcccaaggacacccacgagaagcaccugaugagccagagaaacagcggcgagaccaccgagaccagcgacggcaugaacuucaccaaguacgugagcgugcccgagaaggaccuggagaagaccgaggagugcaacuuccuggagcccgagaacgugggcggcggccccccccacagagugcccagaagccuggacuucggcgacgugcccaucgacagcgacgugcacgugagcagcaccugcagcgagaucaccaagaaccuggacgugaagggcagcgagaacagccugcccggcgccggcagcagcggcaacuucgacagagacaccaucagcagcgaguacacccacagcagcgccagcagccccgagcugaacgacagcagcguggcccugagcagcuggggccagcagcccagcagcggcuaccaggaggagaaccagggcaacuggagcgagcagaaccaccaggagagcgagcugaucaccaccgacggccagguggagaucgugaccaaggugaaggaccuggagaagaacagaaucaacgaguucgagaagagcuucgacagaaagacccccaccuuccuggagaucuggaacgacagcguggacggcgacagcuucagcagccugagcagccccgagaccggcaaguacagcgagcacagcggcacccaccaggagagcaaccugaucgccagcuaccaggagaagaacgagcacgacaucagcgccaccgugcagcccgaggacgccagagugaucagcaccagcagcggcagcgacgacgacagcgugggcggcgaggagagcaucgaggaggagauccagguggccaacugccacguggccgaggacgagagcagagccugggacagccugaacgagagcaacaaguuccuggugaccgccgaccccaagagcgagaacaucuacgacuaccuggacagcagcgagcccgccgagaacgagaacaagagcaaccccuucugcgacaaccagcagagcagccccgaccccuggaccuucagcccccugaccgagaccgagaugcagaucaccgccguggagaaggagaagagaagcagccccgagaccggcaccaccggcgacguggccuggcagaucagccccaaggccagcuuccccaagaacgaggacaacagccagcuggagaugcugggcuucagcgccgacagcaccgagugguggaaggccagcccccaggagggcagacugaucgagagccccuucgagagagagcugagcgacagcagcggcgugcuggagaucaacagcagcgugcaccagaacgccagccccuggggcgugcccgugcagggcgacaucgagcccguggagacccacuacaccaaccccuucagcgacaaccaccagagccccuuccuggagggcaacggcaagaacagccacgagcagcuguggaacauccagcccagacagcccgaccccgacgccgacaaguucagccagcuggugaagcuggaccagaucaaggagaaggacagcagagagcagaccuucgugagcgccgccggcgacgagcugacccccgagacccccacccaggagcagugccaggacaccaugcugcccgugugcgaccaccccgacaccgccuucacccacgccgaggagaacagcugcgugaccagcaacgugagcaccaacgagggccaggagaccaaccagugggagcaggagaagagcuaccugggcgagaugaccaacagcagcaucgccaccgagaacuuccccgccgugagcagccccacccagcugaucaugaagcccggcagcgagugggacggcagcacccccagcgaggacagcagaggcaccuucgugcccgacauccugcacggcaacuuccaggagggcggccagcuggccagcgccgcccccgaccuguggaucgacgccaagaagcccuucagccugaaggccgacggcgagaaccccgacauccugacccacugcgagcacgacagcaacagccaggccagcgacagccccgacaucugccacgacagcgaggccaagcaggagaccgagaagcaccugagcgccugcaugggccccgagguggagagcagcgagcugugccugaccgagcccgagaucgacgaggagcccaucuacgagcccggcagagaguucgugcccagcaacgccgagcuggacagcgagaacgccaccgugcugccccccaucggcuaccaggccgacaucaagggcagcagccagcccgccagccacaagggcagccccgagcccagcgagaucaacggcgacaacagcaccggccugcaggugagcgagaagggcgccagccccgacauggcccccauccuggagcccguggacagaagaauccccagaaucgagaacguggccaccagcaucuucgugacccaccaggagcccacccccgagggcgacggcagcuggaucagcgacagcuucagccccgagagccagcccggcgccagagcccuguucgacggcgacccccaccugagcaccgagaaccccgcccuggugcccgacgcccugcuggccagcgacaccugccuggacaucagcgaggccgccuucgaccacagcuucagcgacgccagcggccugaacaccagcaccggcaccaucgacgacaugagcaagcugacccugagcgagggccaccccgagacccccguggacggcgaccugggcaagcaggacaucugcagcagcgaggccagcuggggcgacuucgaguacgacgugaugggccagaacaucgacgaggaccugcugagagagcccgagcacuuccuguacggcggcgaccccccccuggaggaggacagccugaagcagagccuggcccccuacaccccccccuucgaccugagcuaccugaccgagcccgcccagagcgccgagaccaucgaggaggccggcagccccgaggacgagagccugggcugcagagccgccgagaucgugcugagcgcccugcccgacagaagaagcgagggcaaccaggccgagaccaagaacagacugcccggcagccagcuggccgugcugcacaucagagaggaccccgagagcguguaccugcccgugggcgccggcagcaacauccugagccccagcaacguggacugggagguggagaccgacaacagcgaccugcccgccggcggcgacaucggcccccccaacggcgccagcaaggagaucagcgagcuggaggaggagaagaccauccccaccaaggagcccgagcagaucaagagcgaguacaaggaggagagaugcaccgagaagaacgaggacagacacgcccugcacauggacuacauccuggugaacagagaggagaacagccacagcaagcccgagaccugcgaggagagagagagcaucgccgagcuggagcuguacgugggcagcaaggagaccggccugcagggcacccagcuggccagcuuccccgacaccugccagcccgccagccugaacgagagaaagggccugagcgccgagaagaugagcagcaagagcgacaccagaagcagcuucgagagccccgcccaggaccagagcuggauguuccugggccacagcgaggugggcgaccccagccuggacgccagagacagcggccccggcuggagcggcaagaccguggagcccuucagcgagcugggccugggcgagggcccccagcugcagauccuggaggagaugaagccccuggagagccuggcccuggaggaggccagcggccccgugagccagagccagaagagcaagagcagaggcagagccggccccgacgccgugacccugcaggccgugacccacgacaacgagugggagaugcugagcccccagcccgugcagaagaacaugauccccgacaccgagauggaggaggagaccgaguuccuggagcugggcaccagaaucagcagacccaacggccugcugagcgaggacgugggcauggacauccccuucgaggagggcgugcugagccccagcgccgccgacaugagacccgagccccccaacagccuggaccugaacgacacccaccccagaagaaucaagcugaccgcccccaacaucaaccugagccuggaccagagcgagggcagcauccugagcgacgacaaccuggacagccccgacgagaucgacaucaacguggacgagcuggacacccccgacgaggccgacagcuucgaguacaccggccacgaccccaccgccaacaaggacagcggccaggagagcgagagcauccccgaguacaccgccgaggaggagagagaggacaacagacuguggagaaccguggugaucggcgagcaggagcagagaaucgacaugaaggugaucgagcccuacagaagagugaucagccacggcggcuacuacggcgacggccugaacgccaucaucguguucgccgccugcuuccugcccgacagcagcagagccgacuaccacuacgugauggagaaccuguuccuguacgugaucagcacccuggagcugaugguggccgaggacuacaugaucguguaccugaacggcgccacccccagaagaagaaugcccggccugggcuggaugaagaagugcuaccagaugaucgacagaagacugagaaagaaccugaagagcuucaucaucgugcaccccagcugguucaucagaaccauccuggccgugaccagacccuucaucagcagcaaguucagcagcaagaucaaguacgugaacagccugagcgagcugagcggccugauccccauggacugcauccacauccccgagagcaucaucaagcuggacgaggagcugagagaggccagcgaggccgccaagaccagcugccuguacaacgaccccgagaugagcagcauggagaaggacaucgaccugaagcugaaggagaagcccuaa

SEQ ID NO: 22093 - RNA, 816 nt, Artificial Sequence
  PRUNE__Homo_sapiens__NP_001290158
auggaccugaagaucggcaaggccacccccaaggacagcaaguacguggagaagcuggaggcccuguuccccgaccugcccaagagaaacgacaucuucgacagccugcagaaggccaaguucgacgugagcggccugaccaccgagcagaugcugagaaaggaccagaagaccaucuacagacagggcgugaagguggccaucagcgccaucuacauggaccuggaggccuuccugcagagaagcaaccugcuggccgaccugcacgccuucugccaggcccacagcuacgacgugcugguggccaugaccaucuucuucaacacccacaacgagcccgugagacagcuggccaucuucugcccccacguggcccugcagaccaccaucugcgaggugcuggagagaagccacagccccccccugaagcugacccccgccagcagcacccaccccaaccugcacgccuaccugcagggcaacacccaggugagcagaaagaagcugcugccccugcugcaggaggcccugagcgccuacuucgacagcaugaagauccccagcggccagcccgagaccgccgacgugagcagagagcagguggacaaggagcuggacagagccagcaacagccugaucagcggccugagccaggacgaggaggaccccccccugccccccacccccaugaacagccugguggacgagugcccccuggaccagggccugcccaagcugagcgccgaggccguguucgagaagugcagccagaucagccugagccagagcaccaccgccagccugagcaagaaguaa

SEQ ID NO: 22094 - RNA, 444 nt, Artificial Sequence
  PRX__Homo_sapiens__NP_066007
auggaggccagaagcagaagcgccgaggagcugagaagagccgagcugguggagaucaucguggagaccgaggcccagaccggcgugagcggcaucaacguggccggcggcggcaaggagggcaucuucgugagagagcugagagaggacagccccgccgccagaagccugagccugcaggagggcgaccagcugcugagcgccagaguguucuucgagaacuucaaguacgaggacgcccugagacugcugcagugcgccgagcccuacaaggugagcuucugccugaagagaaccgugcccaccggcgaccuggcccugagacccggcaccgugagcggcuacgagaucaagggccccagagccaagguggccaagcuggugagagugcugagccccgcccccgcccuggacugccccagcgaccccgugagcgcccccuaa

SEQ ID NO: 22095 - RNA, 444 nt, Artificial Sequence
  PRY__Homo_sapiens__XP_011529813
augggcgccaccggccugggcuuccugcugagcuggagacaggacaaccugaacggcaccgacugccagggcugcaacauccuguacuucagcgagaccaccggcagcaugugcagcgagcugagccugaacagaggccuggaggccagaagaaagaaggaccugaaggacagcuuccuguggagauacggcaaggugggcugcaucagccugccccugagagagaugaccgccuggaucaaccccccccagaucagcgagaucuuccagggcuaccaccagagagugcacggcgccgacgcccugagccugcagaccaacagccugagaagcagacugagcagccagugccugggccagagcuuccugcugagaacccuggagagaggcagaggcuucagagcccugggcgacaucugcggccacgugcacgaggaggacuaa

SEQ ID NO: 22096 - RNA, 1584 nt, Artificial Sequence
  PSAP__Homo_sapiens__NP_001035930
auguacgcccuguuccugcuggccagccugcugggcgccgcccuggccggccccgugcugggccugaaggagugcaccagaggcagcgccguguggugccagaacgugaagaccgccagcgacugcggcgccgugaagcacugccugcagaccguguggaacaagcccaccgugaagagccugcccugcgacaucugcaaggacguggugaccgccgccggcgacaugcugaaggacaacgccaccgaggaggagauccugguguaccuggagaagaccugcgacuggcugcccaagcccaacaugagcgccagcugcaaggagaucguggacagcuaccugcccgugauccuggacaucaucaagggcgagaugagcagacccggcgaggugugcagcgcccugaaccugugcgagagccugcagaagcaccuggccgagcugaaccaccagaagcagcuggagagcaacaagauccccgagcuggacaugaccgaggugguggcccccuucauggccaacaucccccugcugcuguacccccaggacggccccagaagcaagccccagcccaaggacaacggcgacgugugccaggacugcauccagauggugaccgacauccagaccgccgugagaaccaacagcaccuucgugcaggcccugguggagcacgugaaggaggagugcgacagacugggccccggcauggccgacaucugcaagaacuacaucagccaguacagcgagaucgccauccagaugaugaugcacaugcaggaccagcagcccaaggagaucugcgcccuggugggcuucugcgacgaggugaaggagaugcccaugcagacccuggugcccgccaagguggccagcaagaacgugauccccgcccuggagcugguggagcccaucaagaagcacgaggugcccgccaagagcgacguguacugcgaggugugcgaguuccuggugaaggaggugaccaagcugaucgacaacaacaagaccgagaaggagauccuggacgccuucgacaagaugugcagcaagcugcccaagagccugagcgaggagugccaggaggugguggacaccuacggcagcagcauccugagcauccugcuggaggaggugagccccgagcuggugugcagcaugcugcaccugugcagcggcaccagacugcccgcccugaccgugcacgugacccagcccaaggacggcggcuucugcgaggugugcaagaagcuggugggcuaccuggacagaaaccuggagaagaacagcaccaagcaggagauccuggccgcccuggagaagggcugcagcuuccugcccgaccccuaccagaagcagugcgaccaguucguggccgaguacgagcccgugcugaucgagauccugguggaggugauggaccccagcuucgugugccugaagaucggcgccugccccagcgcccacaagccccugcugggcaccgagaagugcaucuggggccccagcuacuggugccagaacaccgagaccgccgcccagugcaacgccguggagcacugcaagagacacguguggaacuaa

SEQ ID NO: 22097 - RNA, 975 nt, Artificial Sequence
  PSAT1__Homo_sapiens__NP_066977
auggacgcccccagacagguggugaacuucggccccggccccgccaagcugccccacagcgugcugcuggagauccagaaggagcugcuggacuacaagggcgugggcaucagcgugcuggagaugagccacagaagcagcgacuucgccaagaucaucaacaacaccgagaaccuggugagagagcugcuggccgugcccgacaacuacaaggugaucuuccugcagggcggcggcugcggccaguucagcgccgugccccugaaccugaucggccugaaggccggcagaugcgccgacuacguggugaccggcgccuggagcgccaaggccgccgaggaggccaagaaguucggcaccaucaacaucgugcaccccaagcugggcagcuacaccaagauccccgaccccagcaccuggaaccugaaccccgacgccagcuacguguacuacugcgccaacgagaccgugcacggcguggaguucgacuucauccccgacgugaagggcgccgugcuggugugcgacaugagcagcaacuuccugagcaagcccguggacgugagcaaguucggcgugaucuucgccggcgcccagaagaacgugggcagcgccggcgugaccguggugaucgugagagacgaccugcugggcuucgcccugagagagugccccagcgugcuggaguacaaggugcaggccggcaacagcagccuguacaacaccccccccugcuucagcaucuacgugaugggccuggugcuggaguggaucaagaacaacggcggcgccgccgccauggagaagcugagcagcaucaagagccagaccaucuacgagaucaucgacaacagccagggcuucuacgugagcgugggcggcaucagagccagccuguacaacgccgugaccaucgaggacgugcagaagcuggccgccuucaugaagaaguuccuggagaugcaccagcuguaa

SEQ ID NO: 22098 - RNA, 345 nt, Artificial Sequence
  PSCA__Homo_sapiens__NP_005663
auggccggccuggcccugcagcccggcaccgcccugcugugcuacagcugcaaggcccaggugagcaacgaggacugccugcagguggagaacugcacccagcugggcgagcagugcuggaccgccagaaucagagccgugggccugcugaccgugaucagcaagggcugcagccugaacugcguggacgacagccaggacuacuacgugggcaagaagaacaucaccugcugcgacaccgaccugugcaacgccagcggcgcccacgcccugcagcccgccgccgccauccuggcccugcugcccgcccugggccugcugcuguggggccccggccagcuguaa

SEQ ID NO: 22099 - RNA, 3144 nt, Artificial Sequence
  PSD3__Homo_sapiens__NP_056125
auggagggcagaagcgccgccgccgagaccuucgugugggugaacaacgccagcgcccacagccagagcguggccaaggccaaguacgaguuccuguucggcagaagcgagggcaaggcccccgacaccagcgaccacggcggcagcacccugcugccccccaacgugaccaacgaguuccccgaguacggcaccauggaggagggcggcgagggccugagagccagccuggaguucgacggcgaggcccugcccugccacccccaggagcagcagggcgugcagccccugaccggcugccacagcggccuggacagcgugaccgagggccccaaggacgugagagaggcccccagccagagccaccugaaggagcagagccugcagcccaucgacagccugaucagcgcccugaaggccaccgaggccagaaucaucagcggcacccugcaggccaccaaggugcuggaccaggacgccgugagcagcuucagcgugcagcagguggagaaggagcuggacaccgccagcagaaagacccagagagugaacaagacccugcccgccggccagaagaaccugcccgagaucccccugagcgccgaggugaccaccgaggagagcuucuaccugagcauccagaaggaccugaccgcccugcugaccggcgacacccaggccgagaucagccagaucaugaacaacggcagaaagggcgccgugugcgugcaggagcccagcugcccccuggccagccugggcagcagcgccgugaccugccacagcgccggcagcgugggcuuccugaaggagcagagaagcgcccugggcagagagcaccccggcggcugcgacagaagcagcagcaugggcagacccggcagagugaagcacguggaguuccagggcguggagauccuguggaccggcggcgacaagagagagacccagcaccccaucgacuucgagaccagccugcagagaaccgccagccccgacagcaaggagagcagcaaggugcccagacaccugaucagcagcgccggccugugcaacagcagcagccugaccgagaacgugugggacgagagcuggaaggcccccagcgagagacccggcaccagcagcggcaccuucagccccgugagacuggacgagagcggcgaggacgagguguuccugcaggagaacaagcagcaccuggagaagacccccaagcccgagagagacagagagagaaucagcgagcaggaggagcacgugaagggcgaggacgaggacauccugggccccggcuacaccgaggacagcaccgacguguacagcagccaguucgagaccauccuggacaacaccagccuguacuacagcgccgagagccuggagacccuguacagcgagcccgacagcuacuucagcuucgagaugccccugacccccaugauccagcagagaaucaaggagggcggccaguuccuggagagaaccagcggcggcggccaccaggacauccugagcgugagcgccgacggcggcaucgugaugggcuacagcagcggcgugaccaacggccugaacgacgccagcgacagcaucuacaccaagggcacccccgagaucgccuucuggggcagcaacgccggcgugaagaccaccagacuggaggcccacagcgagaugggcagcaccgagauccuggagaaggagacccccgagaaccugagcaacggcaccagcagcaacguggaggccgccaagagacuggccaagagacuguaccagcuggacagauucaagagaagcgacguggccaagcaccugggcaagaacaacgaguucagcaagcugguggccgaggaguaccugaaguucuucgacuucaccggcaugacccuggaccagagccugagauacuucuucaaggccuucagccuggugggcgagacccaggagagagagagagugcugauccacuucagcaacagauacuucuacugcaaccccgacaccaucgccagccaggacggcgugcacugccugaccugcgccaucaugcugcugaacaccgaccugcacggccacaacaucggcaagaagaugaccugccaggaguucaucgccaaccugcagggcgugaacgagggcguggacuucagcaaggaccugcugaaggcccuguacaacagcaucaagaacgagaagcuggagugggccguggacgacgaggagaagaagaagagccccagcgagagcaccgaggagaaggccaacggcacccaccccaagaccaucagcagaaucggcagcaccaccaaccccuuccuggacaucccccacgaccccaacgccgccguguacaagagcggcuuccuggccagaaagauccacgccgacauggacggcaagaagacccccagaggcaagagaggcuggaagaccuucuacgccgugcugaagggcaccgugcuguaccugcagaaggacgaguacaagcccgagaaggcccugagcgaggaggaccugaagaacgccgugagcgugcaccacgcccuggccagcaaggccaccgacuacgagaagaagcccaacguguucaagcugaagaccgccgacuggagagugcugcuguuccagacccagagccccgaggagaugcagggcuggaucaacaagaucaacugcguggccgccguguucagcgccccccccuuccccgccgccaucggcagccagaagaaguucagcagaccccugcugcccgccaccaccaccaagcugagccaggaggagcagcugaagagccacgagagcaagcugaagcagaucaccaccgagcuggccgagcacagaagcuacccccccgacaagaaggugaaggccaaggacguggacgaguacaagcugaaggaccacuaccuggaguucgagaagaccagauacgagauguacgugagcauccugaaggagggcggcaaggagcugcugagcaacgacgagagcgaggccgccggccugaagaagagccacagcagccccagccugaaccccgacaccagccccaucaccgccaaggugaagagaaacgugagcgagagaaaggaccacagacccgagacccccagcaucaagcagaaggugaccuaa

SEQ ID NO: 22100 - RNA, 3171 nt, Artificial Sequence
  PSD4__Homo_sapiens__NP_036587
augaugggcgacuacagacugcccgaccacccccagcccauggagauccugaaccuguaccugggcgacagccuggagccccaccccggcgagugccccagagagaccugcagccacgaggacccccccgagcccuucgaggagcagaccugggccaccgacccccccgagcccaccagacagaacgugccccccuggggcagcggcguggagcugacccaccugggcagcugggugcaccaggacggccuggagcccugccaggagcagaccagagccaccgacccccccgagagcaccagacaggacgccccccccuggggcagcggcguggagcugacccaccugggcagccccagcgcccagagagagcacagacagaacaccgccagccccggcagccccgugaacagccaccugcccggcagccccaagcagaacagaagcaccagcacccaggugguguucugggccggcauccugcaggcccagaugugcgugcuggaccuggaggaggagcuggagaagaccgagggccugaaggccggccugaagugcugccugcccaccccccccguggaccugcccggcgacaccggccugcacagcagcccccccgagaacgaggacagcggcgaggacagcagcgagcccgagggcgagggccaggccuggcugagagagggcacccccgacagcagcccccaguggggcgccgaggaggagagcauguucuucagcaacccccuguuccuggccagccccugcagcgagaacagcgccagcggcgagugcuucagcuggggcgccagcgacagccacgccggcgugagaaccggccccgagagccccgccacccuggagcccccccugcccgaggacaccgugcugugggagcuggagagcgagcccgaccugggcgacggcgccgccaucagcggccacugcaccccccccuuccccgugcccaucuacaagccccacagcaucugcugggccagcguggccgccgccgagggcgcccccgccgccccccccggccacggcgagagcgagggcgacagacugggccccgcccccagcgccgcccccugcguggacgaggcccugaccugggagagcggcugcgugggcagcgaccugggccccgccgcccaccccgugcagcccugggccagccugagccccgagggcuggcagagaggcggccccuucuggccccaggugacccugaacagccaggacagagacgagagagagggcggccacccccaggagagccugcccugcacccuggcccccugccccuggagaagccccgccagcagccccgagcccagcagccccgagagcgagagcagaggccccggccccagacccagccccgccagcagccaggagggcagcccccagcugcagcaccacagcagcggcauccugcccaaguggacccuggacgccagccagagcagccugcuggagaccgacggcgagcagcccagcagccugaagaagaaggaggccggcgaggcccccaagcccggcgaggaggugaagagcgagggcaccgccagacccgccgagaccggcgacgugcagcccgacauccaccugaccagcgccgagcacgagaaccugagaacccccaugaacagcagcuggcugcccggcagccccaugccccaggcccagagccccgaggagggccagagaccccccgccggcgacaagcuggccaacggcgugagaaacaacaagguggccuggaaccuggccagcagacuguacagacuggagggcuucagaaagagcgagguggccgccuaccugcagaagaacaacgacuucagcagagccguggccgaggaguaccugagcuucuuccaguucggcggccagagccuggacagagcccugagaagcuuccugcaggcccuggugcugagcggcgagacccaggagagagagagaauccuguaccaguucagcagaagauuccaccacugcaaccccggcaucuuccccagcguggacagcgugcacacccugaccugcgccaucaugcugcugaacaccgaccugcacggccagaacaucggcaagagcaugagcugccaggaguucaucaccaaccugaacggccugagagacggcggcaacuuccccaaggagcugcugaaggcccuguacuggagcaucagaagcgagaagcuggagugggccguggacgaggaggacaccgccagacccgagaaggcccagcccagccugcccgccggcaagaugagcaagcccuuccugcagcuggcccaggaccccaccgugcccaccuacaagcagggcauccuggccagaaagaugcaccaggacgccgacggcaagaagacccccuggggcaagagaggcuggaagauguuccacacccugcugagaggcauggugcuguacuuccugaagcagggcgaggaccacugccuggagggcgagagccuggugggccagaugguggacgagcccgugggcgugcaccacagccuggccacccccgccacccacuacaccaagaagccccacguguuccagcugagaaccgccgacuggagacuguaccuguuccaggcccccaccgccaaggagaugagcagcuggaucgccagaaucaaccuggccgccgccacccacagcgccccccccuuccccgccgccgugggcagccagagaagauucgugagacccauccugcccgugggccccgcccagagcagccuggaggagcagcacagaagccacgagaacugccuggacgccgccgccgacgaccugcuggaccugcagagaaaccugcccgagagaagaggcagaggcagagagcuggaggagcacagacugagaaaggaguaccuggaguacgagaagaccagauacgagaccuacgugcagcugcugguggccagacugcacugccccagcgacgcccuggaccugugggaggagcagcugggcagagaggccggcggcaccagagagcccaagcugagccugaagaagagccacagcagccccagccugcaccaggacgaggcccccaccaccgccaaggugaagagaaacaucagcgagagaagaaccuacagaaagaucauccccaagagaaacagaaaccagcuguaa

SEQ ID NO: 22101 - RNA, 3075 nt, Artificial Sequence
  PSD__Homo_sapiens__NP_002770
auggcccagggcgccaugagauucugcagcgagggcgacugcgccaucagcccccccagaugccccagaagauggcugcccgagggccccgugccccagagcccccccgccagcauguacggcagcaccggcagccugcugagaagaguggccggccccggccccagaggcagagagcugggcagagugaccgcccccugcaccccccugagaggcccccccagccccagaguggcccccagccccugggcccccagcagccccaccggccagcccccccccggcgcccagagcagcguggugaucuucagauucguggagaaggccagcgugagaccccugaacggccugcccgcccccggcggccugagcagaagcugggaccugggcggcgugagcccccccagacccacccccgcccugggccccggcagcaacagaaagcugagacuggaggccagcaccagcgacccccugcccgccagaggcggcagcgcccugcccggcagcagaaaccuggugcacggcccccccgcccccccccaggugggcgccgacggccuguacagcagccugcccaacggccugggcggcccccccgagagacuggccacccuguucggcggccccgccgacaccggcuuccugaaccagggcgacaccuggagcagccccagagaggugagcagccacgcccagagaaucgccagagccaagugggaguucuucuacggcagccuggacccccccagcagcggcgccaagccccccgagcaggccccccccagcccccccggcgugggcagcagacagggcagcggcguggccgugggcagagccgccaaguacagcgagaccgaccuggacaccgugccccugagaugcuacagagagaccgacaucgacgaggugcuggccgagagagaggaggccgacagcgccaucgagagccagcccagcagcgagggcccccccggcaccgccuacccccccgcccccagacccggcccccugcccggcccccaccccagccugggcagcggcaacgaggacgaggacgacgacgaggccggcggcgaggaggacguggacgacgagguguucgaggccagcgagggcgccagacccggcagcagaaugccccugaagagccccgugcccuuccugcccggcaccagccccagcgccgacggccccgacagcuucagcugcguguucgaggccauccuggagagccacagagccaagggcaccagcuacaccagccuggccagccuggaggcccuggccagccccggccccacccagagccccuucuucaccuucgagcugcccccccagccccccgcccccagacccgacccccccgcccccgccccccuggccccccuggagcccgacagcggcaccagcagcgccgccgacggccccuggacccagagaggcgaggaggaggaggccgaggccagagccaagcuggcccccggcagagagccccccagccccugccacagcgaggacagccugggccugggcgccgccccccugggcagcgagcccccccugagccagcuggugagcgacagcgacagcgagcuggacagcaccgagagacuggcccugggcagcaccgacacccugagcaacggccagaaggccgaccuggaggccgcccagagacuggccaagagacuguacagacuggacggcuucagaaaggccgacguggccagacaccugggcaagaacaacgacuucagcaagcugguggccggcgaguaccugaaguucuucguguucaccggcaugacccuggaccaggcccugagaguguuccugaaggagcuggcccugaugggcgagacccaggagagagagagagugcuggcccacuucagccagagauacuuccagugcaaccccgaggcccugagcagcgaggacggcgcccacacccugaccugcgcccugaugcugcugaacaccgaccugcacggccacaacaucggcaagagaaugaccugcggcgacuucaucggcaaccuggagggccugaacgacggcggcgacuuccccagagagcugcugaaggcccuguacagcagcaucaagaacgagaagcugcagugggccaucgacgaggaggagcugagaagaagccugagcgagcuggccgaccccaaccccaaggugaucaagagaaucagcggcggcagcggcagcggcagcagccccuuccuggaccugacccccgagcccggcgccgccguguacaagcacggcgcccuggugagaaaggugcacgccgaccccgacugcagaaagacccccagaggcaagagaggcuggaagagcuuccacggcauccugaagggcaugauccuguaccugcagaaggaggaguacaagcccggcaaggcccugagcgagaccgagcugaagaacgccaucagcauccaccacgcccuggccaccagagccagcgacuacagcaagagaccccacguguucuaccugagaaccgccgacuggagaguguuccuguuccaggcccccagccuggagcagaugcagagcuggaucaccagaaucaacgugguggccgccauguucagcgccccccccuuccccgccgccgugagcagccagaagaaguucagcagaccccugcugcccagcgccgccaccagacugagccaggaggagcaggugagaacccacgaggccaagcugaaggccauggccagcgagcugagagagcacagagccgcccagcugggcaagaagggcagaggcaaggaggccgaggagcagagacagaaggaggccuaccuggaguucgagaagagcagauacagcaccuacgccgcccugcugagagugaagcugaaggccggcagcgaggagcuggacgccguggaggccgcccuggcccaggccggcagcaccgaggacggccugccccccagccacagcagccccagccugcagcccaagcccagcagccagcccagagcccagagacacagcagcgagcccagacccggcgccggcagcggcagaagaaagcccuaa

SEQ ID NO: 22102 - RNA, 1404 nt, Artificial Sequence
  PSEN1__Homo_sapiens__XP_011535274
augaccgagcugcccgccccccugagcuacuuccagaacgcccagaugagcgaggacaaccaccugagcaacaccgugagaagccagaacgacaacagagagagacaggagcacaacgacagaagaagccugggccaccccgagccccugagcaacggcagaccccagggcaacagcagacaggugguggagcaggacgaggaggaggacgaggagcugacccugaaguacggcgccaagcacgugaucaugcuguucgugcccgugacccugugcauggugguggugguggccaccaucaagagcgugagcuucuacaccagaaaggacggccagcugaucuacacccccuucaccgaggacaccgagaccgugggccagagagcccugcacagcauccugaacgccgccaucaugaucagcgugaucguggugaugaccauccugcugguggugcuguacaaguacagaugcuacaaggugauccacgccuggcugaucaucagcagccugcugcugcuguucuucuucagcuucaucuaccugggcgagguguucaagaccuacaacguggccguggacuacaucaccguggcccugcugaucuggaacuucggcguggugggcaugaucagcauccacuggaagggcccccugagacugcagcaggccuaccugaucaugaucagcgcccugauggcccugguguucaucaaguaccugcccgaguggaccgccuggcugauccuggccgugaucagcguguacgaccugguggccgugcugugccccaagggcccccugagaaugcugguggagaccgcccaggagagaaacgagacccuguuccccgcccugaucuacagcagcaccaugguguggcuggugaacauggccgagggcgaccccgaggcccagagaagagugagcaagaacagcaaguacaacgccgagagcaccgagagagagagccaggacaccguggccgagaacgacgacggcggcuucagcgaggagugggaggcccagagagacagccaccugggcccccacagaagcacccccgagagcagagccgccgugcaggagcugagcagcagcauccuggccggcgaggaccccgaggagagaggcgugaagcugggccugggcgacuucaucuucuacagcgugcuggugggcaaggccagcgccaccgccagcggcgacuggaacaccaccaucgccugcuucguggccauccugaucggccugugccugacccugcugcugcuggccaucuucaagaaggcccugcccgcccugcccaucagcaucaccuucggccugguguucuacuucgccaccgacuaccuggugcagcccuucauggaccagcuggccuuccaccaguucuacaucuaa

SEQ ID NO: 22103 - RNA, 1344 nt, Artificial Sequence
  PSEN2__Homo_sapiens__NP_036618
augcugaccuucauggccagcgacagcgaggaggaggugugcgacgagagaaccagccugaugagcgccgagagccccacccccagaagcugccaggagggcagacagggccccgaggacggcgagaacaccgcccaguggagaagccaggagaacgaggaggacggcgaggaggaccccgacagauacgugugcagcggcgugcccggcagaccccccggccuggaggaggagcugacccugaaguacggcgccaagcacgugaucaugcuguucgugcccgugacccugugcaugaucguggugguggccaccaucaagagcgugagauucuacaccgagaagaacggccagcugaucuacacccccuucaccgaggacacccccagcgugggccagagacugcugaacagcgugcugaacacccugaucaugaucagcgugaucguggugaugaccaucuuccugguggugcuguacaaguacagaugcuacaaguucauccacggcuggcugaucaugagcagccugaugcugcuguuccuguucaccuacaucuaccugggcgaggugcugaagaccuacaacguggccauggacuaccccacccugcugcugaccguguggaacuucggcgccgugggcauggugugcauccacuggaagggcccccuggugcugcagcaggccuaccugaucaugaucagcgcccugauggcccugguguucaucaaguaccugcccgaguggagcgccugggugauccugggcgccaucagcguguacgaccugguggccgugcugugccccaagggcccccugagaaugcugguggagaccgcccaggagagaaacgagcccaucuuccccgcccugaucuacagcagcgccaugguguggaccgugggcauggccaagcuggaccccagcagccagggcgcccugcagcugcccuacgaccccgagauggaggacagcuacgacagcuucggcgagcccagcuaccccgagguguucgagcccccccugaccggcuaccccggcgaggagcuggaggaggaggaggagagaggcgugaagcugggccugggcgacuucaucuucuacagcgugcuggugggcaaggccgccgccaccggcagcggcgacuggaacaccacccuggccugcuucguggccauccugaucggccugugccugacccugcugcugcuggccguguucaagaaggcccugcccgcccugcccaucagcaucaccuucggccugaucuucuacuucagcaccgacaaccuggugagacccuucauggacacccuggccagccaccagcuguacaucuaa

SEQ ID NO: 22104 - RNA, 306 nt, Artificial Sequence
  PSENEN__Homo_sapiens__NP_001268461
augaaccuggagagagugagcaacgaggagaagcugaaccugugcagaaaguacuaccugggcggcuucgccuuccugcccuuccuguggcuggugaacaucuucugguucuucagagaggccuuccuggugcccgccuacaccgagcagagccagaucaagggcuacguguggagaagcgccgugggcuuccuguucugggugaucgugcugaccagcuggaucaccaucuuccagaucuacagacccagauggggcgcccugggcgacuaccugagcuucaccaucccccugggcacccccuaa

SEQ ID NO: 22105 - RNA, 1260 nt, Artificial Sequence
  PSG1__Homo_sapiens__NP_001171754
augggcacccugagcgccccccccugcacccagagaaucaaguggaagggccugcugcugaccgccagccugcugaacuucuggaaccugcccaccaccgcccaggugaccaucgaggccgagcccaccaaggugagcgagggcaaggacgugcugcugcuggugcacaaccugccccagaaccugaccggcuacaucugguacaagggccagaugagagaccuguaccacuacaucaccagcuacgugguggacggcgagaucaucaucuacggccccgccuacagcggcagagagaccgccuacagcaacgccagccugcugauccagaacgugaccagagaggacgccggcagcuacacccugcacaucaucaagggcgacgacggcaccagaggcgugaccggcagauucaccuucacccugcaccuggagacccccaagcccagcaucagcagcagcaaccugaaccccagagagaccauggaggccgugagccugaccugcgaccccgagacccccgacgccagcuaccugugguggaugaacggccagagccugcccaugacccacagccugaagcugagcgagaccaacagaacccuguuccugcugggcgugaccaaguacaccgccggccccuacgagugcgagaucagaaaccccgugagcgccagcagaagcgaccccgugacccugaaccugcugcccaagcugcccaagcccuacaucaccaucaacaaccugaaccccagagagaacaaggacgugcugaacuucaccugcgagcccaagagcgagaacuacaccuacaucugguggcugaacggccagagccugcccgugagccccagagugaagagacccaucgagaacagaauccugauccugcccagcgugaccagaaacgagaccggccccuaccagugcgagaucagagacagauacggcggcaucagaagcgaccccgugacccugaacgugcuguacggccccgaccugcccagaaucuaccccagcuucaccuacuacagaagcggcgaggugcuguaccugagcugcagcgccgacagcaacccccccgcccaguacagcuggaccaucaacgagaaguuccagcugcccggccagaagcuguucaucagacacaucaccaccaagcacagcggccuguacgugugcagcgugagaaacagcgccaccggcaaggagagcagcaagagcaugaccguggaggugagcgacuggaccgugcccuaa

SEQ ID NO: 22106 - RNA, 1008 nt, Artificial Sequence
  PSG2__Homo_sapiens__NP_112536
augggcccccugagcgccccccccugcaccgagcacaucaaguggaagggccugcuggugaccgccagccugcugaacuucuggaaccugcccaccaccgcccaggugaccaucgaggcccagccccccaaggugagcgagggcaaggacgugcugcugcuggugcacaaccugccccagaaccugaccggcuacaucugguacaagggccagaucagagaccuguaccacuacaucaccagcuacgugguggacggccagaucaucaucuacggccccgccuacagcggcagagagaccgccuacagcaacgccagccugcugauccagaacgugaccagagaggacgccggcagcuacacccugcacaucaucaagagaggcgacggcaccagaggcgugaccggcuacuucaccuucacccuguaccuggagacccccaagcccagcaucagcagcagcaaccugaaccccagagaggccauggagaccgugauccugaccugcgaccccgagacccccgacaccagcuaccagugguggaugaacggccagagccugcccaugacccacagauuccagcugagcgagaccaacagaacccuguuccuguucggcgugaccaaguacaccgccggccccuacgagugcgagaucagaaacagcggcagcgccagcagaagcgaccccgugacccugaaccugcugcacggccccgaccugcccagaauccaccccagcuacaccaacuacagaagcggcgacaaccuguaccugagcugcuucgccaacagcaacccccccgcccaguacagcuggaccaucaacggcaaguuccagcagagcggccagaaccuguucaucccccagaucaccaccaagcacagcggccuguacgugugcagcgugagaaacagcgccaccggcgaggagagcagcaccagccugaccgugaaggugagcgccagcaccagaaucggccugcugccccugcugaaccccaccuaa

SEQ ID NO: 22107 - RNA, 1008 nt, Artificial Sequence
  PSG5__Homo_sapiens__NP_001123486
augggcccccugagcgccccccccugcacccagcacaucaccuggaagggccugcugcugaccgccagccugcugaacuucuggaaccugcccaucaccgcccaggugaccaucgaggcccugccccccaaggugagcgagggcaaggacgugcugcugcuggugcacaaccugccccagaaccuggccggcuacaucugguacaagggccagcugauggaccuguaccacuacaucaccagcuacgugguggacggccagaucaacaucuacggccccgccuacaccggcagagagaccguguacagcaacgccagccugcugauccagaacgugaccagagaggacgccggcagcuacacccugcacaucaucaagagaggcgacagaaccagaggcgugaccggcuacuucaccuucaaccuguaccugaagcugcccaagcccuacaucaccaucaacaacagcaagcccagagagaacaaggacgugcuggccuucaccugcgagcccaagagcgagaacuacaccuacaucugguggcugaacggccagagccugcccgugagccccagagugaagagacccaucgagaacagaauccugauccugcccagcgugaccagaaacgagaccggccccuacgagugcgagaucagagacagagacggcggcaugagaagcgaccccgugacccugaacgugcuguacggccccgaccugcccagcaucuaccccagcuucaccuacuacagaagcggcgagaaccuguaccugagcugcuucgccgagagcaacccccccgccgaguacuucuggaccaucaacggcaaguuccagcagagcggccagaagcugagcaucccccagaucaccaccaagcacagaggccuguacaccugcagcgugagaaacagcgccaccggcaaggagagcagcaagagcaugaccguggaggugagcgcccccagcggcaucggcagacugccccugcugaaccccaucuaa

SEQ ID NO: 22108 - RNA, 1275 nt, Artificial Sequence
  PSG6__Homo_sapiens__NP_001027020
augggcccccugagcgccccccccugcacccagcacaucaccuggaagggccugcugcugaccgccagccugcugaacuucuggaaccugcccaccaccgcccaggugaucaucgaggccaagccccccaaggugagcgagggcaaggacgugcugcugcuggugcacaaccugccccagaaccugaccggcuacaucugguacaagggccagaugaccgaccuguaccacuacaucaccagcuacguggugcacggccagaucaucuacggccccgccuacagcggcagagagaccguguacagcaacgccagccugcugauccagaacgugacccaggaggacgccggcagcuacacccugcacaucaucaagagaggcgacggcaccggcggcgugaccggcuacuucaccgugacccuguacagcgagacccccaagcccagcaucagcagcagcaaccugaaccccagagaggugauggaggccgugagacugaucugcgaccccgagacccccgacgccagcuaccuguggcugcugaacggccagaaccugcccaugacccacagacugcagcugagcaagaccaacagaacccuguaccuguucggcgugaccaaguacaucgccggccccuacgagugcgagaucagaaaccccgugagcgccagcagaagcgaccccgugacccugaaccugcugcccaagcugcccaugcccuacaucaccaucaacaaccugaaccccagagagaagaaggacgugcuggccuucaccugcgagcccaagagcagaaacuacaccuacaucugguggcugaacggccagagccugcccgugagccccagagugaagagacccaucgagaacagaauccugauccugcccagcgugaccagaaacgagaccggccccuaccagugcgagaucagagacagauacggcggcaucagaagcaaccccgugacccugaacgugcuguacggccccgaccugcccagaaucuaccccagcuucaccuacuacagaagcggcgagaaccuggaccugagcugcuucgccgacagcaacccccccgccgaguacagcuggaccaucaacggcaaguuccagcugagcggccagaagcuguucaucccccagaucaccaccaaccacagcggccuguacgccugcagcgugagaaacagcgccaccggcaaggagaucagcaagagcaugaucgugaaggugagcggccccugccacggcaaccagaccgagagccacuaa

SEQ ID NO: 22109 - RNA, 1260 nt, Artificial Sequence
  PSG8__Homo_sapiens__NP_001123639
augggccugcugagcgccccccccugcacccagagaaucaccuggaagggccugcugcugaccgccagccugcugaacuucuggaacccccccaccaccgcccaggugaccaucgaggcccagcccaccaaggugagcgagggcaaggacgugcugcugcuggugcacaaccugccccagaaccugaccggcuacaucugguacaagggccagaucagagaccuguaccacuacaucaccagcuacgugguggacggccagaucaucaucuacggccccgccuacagcggcagagagaccaucuacagcaacgccagccugcugauccagaacgugacccaggaggacgccggcagcuacacccugcacaucaucaugggcggcgacgagaacagaggcgugaccggccacuucaccuucacccuguaccuggagacccccaagcccagcaucagcagcagcaagcugaaccccagagaggccauggaggccgugagccugaccugcgaccccgagacccccgacgccagcuaccugugguggaugaacggccagagccugcccaugagccacagacugcagcugagcgagaccaacagaacccuguuccugcugggcgugaccaaguacaccgccggccccuacgagugcgagaucagaaaccccgugagcgccagcagaagcgaccccuucacccugaaccugcugcccaagcugcccaagcccuacaucaccaucaacaaccugaagcccagagagaacaaggacgugcugaacuucaccugcgagcccaagagcgagaacuacaccuacaucugguggcugaacggccagagccugcccgugagccccagagugaagagacccaucgagaacagaauccugauccugcccagcgugaccagaaacgagaccggccccuaccagugcgagaucagagaccaguacggcggcaucagaagcuaccccgugacccugaacgugcuguacggccccgaccugcccagaaucuaccccagcuucaccuacuacagaagcggcgaggugcuguaccugagcugcagcgccgacagcaacccccccgcccaguacagcuggaccaucaacggcaaguuccagcugagcggccagaagcuguucaucccccagaucaccaccaagcacagcggccuguacgccugcagcgugagaaacagcgccaccggcaaggagagcagcaagagcaugaccgugaaggugagcgacuggacccugcccuaa

SEQ ID NO: 22110 - RNA, 1002 nt, Artificial Sequence
  PSG9__Homo_sapiens__NP_001288636
augggcccccugcccgcccccagcugcacccagagaaucaccuggaagggccugcugcugaccgccagccugcugaacuucuggaacccccccaccaccgccgaggugaccaucgaggcccagccccccaaggugagcgagggcaaggacgugcugcugcuggugcacaaccugccccagaaccugcccggcuacuucugguacaagggcgagaugaccgaccuguaccacuacaucaucagcuacaucguggacggcaagaucaucaucuacggccccgccuacagcggcagagagaccguguacagcaacgccagccugcugauccagaacgugaccagaaaggacgccggcaccuacacccugcacaucaucaagagaggcgacgagaccagagaggagaucagacacuucaccuucacccuguacagcaagcugcccauccccuacaucaccaucaacaaccugaaccccagagagaacaaggacgugcuggccuucaccugcgagcccaagagcgagaacuacaccuacaucugguggcugaacggccagagccugcccgugagccccggcgugaagagacccaucgagaacagaauccugauccugcccagcgugaccagaaacgagaccggccccuaccagugcgagaucagagacagauacggcggccugagaagcaaccccgugauccugaacgugcuguacggccccgaccugcccagaaucuaccccagcuucaccuacuacagaagcggcgagaaccuggaccugagcugcuucaccgagagcaacccccccgccgaguacuucuggaccaucaacggcaaguuccagcagagcggccagaagcuguucaucccccagaucaccagaaaccacagcggccuguacgccugcagcgugcacaacagcgccaccggcaaggagaucagcaagagcaugaccgugaaggugagcggccccugccacggcgaccugaccgagagccagagcuaa

SEQ ID NO: 22111 - RNA, 1593 nt, Artificial Sequence
  PSIP1__Homo_sapiens__NP_001121689
augaccagagacuucaagcccggcgaccugaucuucgccaagaugaagggcuacccccacuggcccgccagaguggacgaggugcccgacggcgccgugaagccccccaccaacaagcugcccaucuucuucuucggcacccacgagaccgccuuccugggccccaaggacaucuuccccuacagcgagaacaaggagaaguacggcaagcccaacaagagaaagggcuucaacgagggccugugggagaucgacaacaaccccaaggugaaguucagcagccagcaggccgccaccaagcagagcaacgccagcagcgacguggagguggaggagaaggagaccagcgugagcaaggaggacaccgaccacgaggagaaggccagcaacgaggacgugaccaaggccguggacaucaccacccccaaggccgccagaagaggcagaaagagaaaggccgagaagcagguggagaccgaggaggccggcguggugaccaccgccaccgccagcgugaaccugaaggugagccccaagagaggcagacccgccgccaccgaggugaagauccccaagcccagaggcagacccaagauggugaagcagcccugccccagcgagagcgacaucaucaccgaggaggacaagagcaagaagaagggccaggaggagaagcagcccaagaagcagcccaagaaggacgaggagggccagaaggaggaggacaagcccagaaaggagcccgacaagaaggagggcaagaaggagguggagagcaagagaaagaaccuggccaagaccggcgugaccagcaccagcgacagcgaggaggagggcgacgaccaggagggcgagaagaagagaaagggcggcagaaacuuccagaccgcccacagaagaaacaugcugaagggccagcacgagaaggaggccgccgacagaaagagaaagcaggaggagcagauggagaccgagcagcagaacaaggacgagggcaagaagcccgaggugaagaagguggagaagaagagagagaccagcauggacagcagacugcagagaauccacgccgagaucaagaacagccugaagaucgacaaccuggacgugaacagaugcaucgaggcccuggacgagcuggccagccugcaggugaccaugcagcaggcccagaagcacaccgagaugaucaccacccugaagaagaucagaagauucaaggugagccaggugaucauggagaagagcaccaugcuguacaacaaguucaagaacauguuccuggugggcgagggcgacagcgugaucacccaggugcugaacaagagccuggccgagcagagacagcacgaggaggccaacaagaccaaggaccagggcaagaagggccccaacaagaagcuggagaaggagcagaccggcagcaagacccugaacggcggcagcgacgcccaggacggcaaccagccccagcacaacggcgagagcaacgaggacagcaaggacaaccacgaggccagcaccaagaagaagcccagcagcgaggagagagagaccgagaucagccugaaggacagcacccuggacaacuaa

SEQ ID NO: 22112 - RNA, 1275 nt, Artificial Sequence
  PSKH1__Homo_sapiens__NP_006733
augggcugcggcaccagcaaggugcugcccgagccccccaaggacgugcagcuggaccuggugaagaagguggagcccuucagcggcaccaagagcgacguguacaagcacuucaucaccgagguggacagcgugggccccgugaaggccggcuuccccgccgccagccaguacgcccaccccugccccggcccccccaccgccggccacaccgagccccccagcgagccccccagaagagccagaguggccaaguacagagccaaguucgaccccagagugaccgccaaguacgacaucaaggcccugaucggcagaggcagcuucagcagaguggugagaguggagcacagagccaccagacagcccuacgccaucaagaugaucgagaccaaguacagagagggcagagaggugugcgagagcgagcugagagugcugagaagagugagacacgccaacaucauccagcugguggagguguucgagacccaggagagaguguacauggugauggagcuggccaccggcggcgagcuguucgacagaaucaucgccaagggcagcuucaccgagagagacgccaccagagugcugcagauggugcuggacggcgugagauaccugcacgcccugggcaucacccacagagaccugaagcccgagaaccugcuguacuaccaccccggcaccgacagcaagaucaucaucaccgacuucggccuggccagcgccagaaagaagggcgacgacugccugaugaagaccaccugcggcacccccgaguacaucgcccccgaggugcuggugagaaagcccuacaccaacagcguggacaugugggcccugggcgugaucgccuacauccugcugagcggcaccaugcccuucgaggacgacaacagaaccagacuguacagacagauccugagaggcaaguacagcuacagcggcgagcccuggcccagcgugagcaaccuggccaaggacuucaucgacagacugcugaccguggaccccggcgccagaaugaccgcccugcaggcccugagacaccccuggguggugagcauggccgccagcagcagcaugaagaaccugcacagaagcaucagccagaaccugcugaagagagccagcagcagaugccagagcaccaagagcgcccagagcaccagaagcagcagaagcaccagaagcaacaagagcagaagagugagagagagagagcugagagagcugaaccugagauaccagcagcaguacaacggcuaa

SEQ ID NO: 22113 - RNA, 393 nt, Artificial Sequence
  PSMA1__Homo_sapiens__NP_001137409
auguucagaaaccaguacgacaacgacgugaccguguggagcccccagggcagaauccaccagaucgaguacgccauggaggccgugaagcagggcagcgccaccgugggccugaagagcaagacccacgccgugcugguggcccugaagagagcccagagcgagcuggccgcccaccagaagaagauccugcacguggacaaccacaucggcaucagcaucgccggccugaccgccgacgccagacugcugugcaacuucaugagacaggagugccuggacagcagauucguguucgacagaccccugcccgugagcagacuggugagccugaucggcagcagcauccuguucaugcuggccuucauggacaugaacuucgagggcuucuaa

SEQ ID NO: 22114 - RNA, 705 nt, Artificial Sequence
  PSMA2__Homo_sapiens__NP_002778
auggccgagagaggcuacagcuucagccugaccaccuucagccccagcggcaagcuggugcagaucgaguacgcccuggccgccguggccggcggcgcccccagcgugggcaucaaggccgccaacggcguggugcuggccaccgagaagaagcagaagagcauccuguacgacgagagaagcgugcacaagguggagcccaucaccaagcacaucggccugguguacagcggcaugggccccgacuacagagugcuggugcacagagccagaaagcuggcccagcaguacuaccugguguaccaggagcccauccccaccgcccagcuggugcagagaguggccagcgugaugcaggaguacacccagagcggcggcgugagacccuucggcgugagccugcugaucugcggcuggaacgagggcagacccuaccuguuccagagcgaccccagcggcgccuacuucgccuggaaggccaccgccaugggcaagaacuacgugaacggcaagaccuuccuggagaagagauacaacgaggaccuggagcuggaggacgccauccacaccgccauccugacccugaaggagagcuucgagggccagaugaccgaggacaacaucgaggugggcaucugcaacgaggccggcuucagaagacugacccccaccgaggugaaggacuaccuggccgccaucgccuaa

SEQ ID NO: 22115 - RNA, 768 nt, Artificial Sequence
  PSMA3__Homo_sapiens__NP_002779
augagcagcaucggcaccggcuacgaccugagcgccagcaccuucagccccgacggcagaguguuccagguggaguacgccaugaaggccguggagaacagcagcaccgccaucggcaucagaugcaaggacggcgugguguucggcguggagaagcuggugcugagcaagcuguacgaggagggcagcaacaagagacuguucaacguggacagacacgugggcauggccguggccggccugcuggccgacgccagaagccuggccgacaucgccagagaggaggccagcaacuucagaagcaacuucggcuacaacaucccccugaagcaccuggccgacagaguggccauguacgugcacgccuacacccuguacagcgccgugagacccuucggcugcagcuucaugcugggcagcuacagcgugaacgacggcgcccagcuguacaugaucgaccccagcggcgugagcuacggcuacuggggcugcgccaucggcaaggccagacaggccgccaagaccgagaucgagaagcugcagaugaaggagaugaccugcagagacaucgugaaggagguggccaagaucaucuacaucgugcacgacgaggugaaggacaaggccuucgagcuggagcugagcugggugggcgagcugaccaacggcagacacgagaucgugcccaaggacaucagagaggaggccgagaaguacgccaaggagagccugaaggaggaggacgagagcgacgacgacaacauguaa

SEQ ID NO: 22116 - RNA, 786 nt, Artificial Sequence
  PSMA4__Homo_sapiens__NP_001096137
augagcagaagauacgacagcagaaccaccaucuucagccccgagggcagacuguaccagguggaguacgccauggaggccaucggccacgccggcaccugccugggcauccuggccaacgacggcgugcugcuggccgccgagagaagaaacauccacaagcugcuggacgagguguucuucagcgagaagaucuacaagcugaacgaggacauggccugcagcguggccggcaucaccagcgacgccaacgugcugaccaacgagcugagacugaucgcccagagauaccugcugcaguaccaggagcccauccccugcgagcagcuggugaccgcccugugcgacaucaagcaggccuacacccaguucggcggcaagagacccuucggcgugagccugcuguacaucggcugggacaagcacuacggcuuccagcuguaccagagcgaccccagcggcaacuacggcggcuggaaggccaccugcaucggcaacaacagcgccgccgccgugagcaugcugaagcaggacuacaaggagggcgagaugacccugaagagcgcccuggcccuggccaucaaggugcugaacaagaccauggacgugagcaagcugagcgccgagaagguggagaucgccacccugaccagagagaacggcaagaccgugaucagagugcugaagcagaaggagguggagcagcugaucaagaagcacgaggaggaggaggccaaggccgagagagagaagaaggagaaggagcagaaggagaaggacaaguaa

SEQ ID NO: 22117 - RNA, 504 nt, Artificial Sequence
  PSMA6__Homo_sapiens__NP_001269161
augaccggcaugaccgccgacagcagaagccaggugcagagagccagauacgaggccgccaacuggaaguacaaguacggcuacgagauccccguggacaugcugugcaagagaaucgccgacaucagccagguguacacccagaacgccgagaugagaccccugggcugcugcaugauccugaucggcaucgacgaggagcagggcccccagguguacaagugcgaccccgccggcuacuacugcggcuucaaggccaccgccgccggcgugaagcagaccgagagcaccagcuuccuggagaagaaggugaagaagaaguucgacuggaccuucgagcagaccguggagaccgccaucaccugccugagcaccgugcugagcaucgacuucaagcccagcgagaucgaggugggcguggugaccguggagaaccccaaguucagaauccugaccgaggccgagaucgacgcccaccugguggcccuggccgagagagacuaa

SEQ ID NO: 22118 - RNA, 747 nt, Artificial Sequence
  PSMA7__Homo_sapiens__NP_002783
augagcuacgacagagccaucaccguguucagccccgacggccaccuguuccagguggaguacgcccaggaggccgugaagaagggcagcaccgccgugggcgugagaggcagagacaucguggugcugggcguggagaagaagagcguggccaagcugcaggacgagagaaccgugagaaagaucugcgcccuggacgacaacgugugcauggccuucgccggccugaccgccgacgccagaaucgugaucaacagagccagaguggagugccagagccacagacugaccguggaggaccccgugaccguggaguacaucaccagauacaucgccagccugaagcagagauacacccagagcaacggcagaagacccuucggcaucagcgcccugaucgugggcuucgacuucgacggcacccccagacuguaccagaccgaccccagcggcaccuaccacgccuggaaggccaacgccaucggcagaggcgccaagagcgugagagaguuccuggagaagaacuacaccgacgaggccaucgagaccgacgaccugaccaucaagcuggugaucaaggcccugcuggagguggugcagagcggcggcaagaacaucgagcuggccgugaugagaagagaccagagccugaagauccugaaccccgaggagaucgagaaguacguggccgagaucgagaaggagaaggaggagaacgagaagaagaagcagaagaaggccagcuaa

SEQ ID NO: 22119 - RNA, 822 nt, Artificial Sequence
  PSMB10__Homo_sapiens__NP_002792
augcugaagcccgcccuggagcccagaggcggcuucagcuucgagaacugccagagaaacgccagccuggagagagugcugcccggccugaaggugccccacgccagaaagaccggcaccaccaucgccggccugguguuccaggacggcgugauccugggcgccgacaccagagccaccaacgacagcgugguggccgacaagagcugcgagaagauccacuucaucgcccccaagaucuacugcugcggcgccggcguggccgccgacgccgagaugaccaccagaaugguggccagcaagauggagcugcacgcccugagcaccggcagagagcccagaguggccaccgugaccagaauccugagacagacccuguucagauaccagggccacgugggcgccagccugaucgugggcggcguggaccugaccggcccccagcuguacggcgugcacccccacggcagcuacagcagacugcccuucaccgcccugggcagcggccaggacgccgcccuggccgugcuggaggacagauuccagcccaacaugacccuggaggccgcccagggccugcugguggaggccgugaccgccggcauccugggcgaccugggcagcggcggcaacguggacgccugcgugaucaccaagaccggcgccaagcugcugagaacccugagcagccccaccgagcccgugaagagaagcggcagauaccacuucgugcccggcaccaccgccgugcugacccagaccgugaagccccugacccuggagcugguggaggagaccgugcaggccauggagguggaguaa

SEQ ID NO: 22120 - RNA, 726 nt, Artificial Sequence
  PSMB1__Homo_sapiens__NP_002784
augcugagcagcaccgccauguacagcgcccccggcagagaccugggcauggagccccacagagccgccggcccccugcagcugagauucagccccuacguguucaacggcggcaccauccuggccaucgccggcgaggacuucgccaucguggccagcgacaccagacugagcgagggcuucagcauccacaccagagacagccccaagugcuacaagcugaccgacaagaccgugaucggcugcagcggcuuccacggcgacugccugacccugaccaagaucaucgaggccagacugaagauguacaagcacagcaacaacaaggccaugaccaccggcgccaucgccgccaugcugagcaccauccuguacagcagaagauucuuccccuacuacguguacaacaucaucggcggccuggacgaggagggcaagggcgccguguacagcuucgaccccgugggcagcuaccagagagacagcuucaaggccggcggcagcgccagcgccaugcugcagccccugcuggacaaccaggugggcuucaagaacaugcagaacguggagcacgugccccugagccuggacagagccaugagacuggugaaggacguguucaucagcgccgccgagagagacguguacaccggcgacgcccugagaaucugcaucgugaccaaggagggcaucagagaggagaccgugagccugagaaaggacuaa

SEQ ID NO: 22121 - RNA, 795 nt, Artificial Sequence
  PSMB4__Homo_sapiens__NP_002787
auggaggccuuccugggcagcagaagcggccugugggccggcggccccgcccccggccaguucuacagaauccccagcacccccgacagcuucauggaccccgccagcgcccuguacagaggccccaucaccagaacccagaaccccauggugaccggcaccagcgugcugggcgugaaguucgagggcggcguggugaucgccgccgacaugcugggcagcuacggcagccuggccagauucagaaacaucagcagaaucaugagagugaacaacagcaccaugcugggcgccagcggcgacuacgccgacuuccaguaccugaagcaggugcugggccagauggugaucgacgaggagcugcugggcgacggccacagcuacagccccagagccauccacagcuggcugaccagagccauguacagcagaagaagcaagaugaacccccuguggaacaccauggugaucggcggcuacgccgacggcgagagcuuccugggcuacguggacaugcugggcguggccuacgaggcccccagccuggccaccggcuacggcgccuaccuggcccagccccugcugagagaggugcuggagaagcagcccgugcugagccagaccgaggccagagaccugguggagagaugcaugagagugcuguacuacagagacgccagaagcuacaacagauuccagaucgccaccgugaccgagaagggcguggagaucgagggcccccugagcaccgagaccaacugggacaucgcccacaugaucagcggcuucgaguaa

SEQ ID NO: 22122 - RNA, 483 nt, Artificial Sequence
  PSMB5__Homo_sapiens__NP_001124197
auggccggcggcgccgccgacugcagcuucugggagagacugcuggccagacagugcagaaucuacgagcugagaaacaaggagagaaucagcguggccgccgccagcaagcugcuggccaacaugguguaccaguacaagggcaugggccugagcaugggcaccaugaucugcggcugggacaagagaggccccggccuguacuacguggacagcgagggcaacagaaucagcggcgccaccuucagcgugggcagcggcagcguguacgccuacggcgugauggacagaggcuacagcuacgaccuggagguggagcaggccuacgaccuggccagaagagccaucuaccaggccaccuacagagacgccuacagcggcggcgccgugaaccuguaccacgugagagaggacggcuggaucagagugagcagcgacaacguggccgaccugcacgagaaguacagcggcagcacccccuaa

SEQ ID NO: 22123 - RNA, 720 nt, Artificial Sequence
  PSMB6__Homo_sapiens__NP_002789
auggccgccacccugcuggccgccagaggcgccggccccgcccccgccuggggccccgaggccuucacccccgacugggagagcagagaggugagcaccggcaccaccaucauggccgugcaguucgacggcggcguggugcugggcgccgacagcagaaccaccaccggcagcuacaucgccaacagagugaccgacaagcugacccccauccacgacagaaucuucugcugcagaagcggcagcgccgccgacacccaggccguggccgacgccgugaccuaccagcugggcuuccacagcaucgagcugaacgagcccccccuggugcacaccgccgccagccuguucaaggagaugugcuacagauacagagaggaccugauggccggcaucaucaucgccggcugggacccccaggagggcggccagguguacagcgugcccaugggcggcaugauggugagacagagcuucgccaucggcggcagcggcagcagcuacaucuacggcuacguggacgccaccuacagagagggcaugaccaaggaggagugccugcaguucaccgccaacgcccuggcccuggccauggagagagacggcagcagcggcggcgugaucagacuggccgccaucgccgagagcggcguggagagacaggugcugcugggcgaccagauccccaaguucgccguggccacccugccccccgccuaa

SEQ ID NO: 22124 - RNA, 834 nt, Artificial Sequence
  PSMB7__Homo_sapiens__NP_002790
auggccgccgugagcguguacgccccccccgugggcggcuucagcuucgacaacugcagaagaaacgccgugcuggaggccgacuucgccaagagaggcuacaagcugcccaaggugagaaagaccggcaccaccaucgccggcgugguguacaaggacggcaucgugcugggcgccgacaccagagccaccgagggcauggugguggccgacaagaacugcagcaagauccacuucaucagccccaacaucuacugcugcggcgccggcaccgccgccgacaccgacaugaccacccagcugaucagcagcaaccuggagcugcacagccugagcaccggcagacugcccagaguggugaccgccaacagaaugcugaagcagaugcuguucagauaccagggcuacaucggcgccgcccuggugcugggcggcguggacgugaccggcccccaccuguacagcaucuacccccacggcagcaccgacaagcugcccuacgugaccaugggcagcggcagccuggccgccauggccguguucgaggacaaguucagacccgacauggaggaggaggaggccaagaaccuggugagcgaggccaucgccgccggcaucuucaacgaccugggcagcggcagcaacaucgaccugugcgugaucagcaagaacaagcuggacuuccugagacccuacaccgugcccaacaagaagggcaccagacugggcagauacagaugcgagaagggcaccaccgccgugcugaccgagaagaucaccccccuggagaucgaggugcuggaggagaccgugcagaccauggacaccagcuaa

SEQ ID NO: 22125 - RNA, 819 nt, Artificial Sequence
  PSMB8__Homo_sapiens__NP_004150
augcugaucggcacccccacccccagagacaccacccccagcagcuggcugaccagcagccugcugguggaggccgccccccuggacgacaccacccugcccacccccgugagcagcggcugccccggccuggagcccaccgaguucuuccagagccugggcggcgacggcgagagaaacgugcagaucgagauggcccacggcaccaccacccuggccuucaaguuccagcacggcgugaucgccgccguggacagcagagccagcgccggcagcuacaucagcgcccugagagugaacaaggugaucgagaucaaccccuaccugcugggcaccaugagcggcugcgccgccgacugccaguacugggagagacugcuggccaaggagugcagacuguacuaccugagaaacggcgagagaaucagcgugagcgccgccagcaagcugcugagcaacaugaugugccaguacagaggcaugggccugagcaugggcagcaugaucugcggcugggacaagaagggccccggccuguacuacguggacgagcacggcaccagacugagcggcaacauguucagcaccggcagcggcaacaccuacgccuacggcgugauggacagcggcuacagacccaaccugagccccgaggaggccuacgaccugggcagaagagccaucgccuacgccacccacagagacagcuacagcggcggcguggugaacauguaccacaugaaggaggacggcugggugaagguggagagcaccgacgugagcgaccugcugcaccaguacagagaggccaaccaguaa

SEQ ID NO: 22126 - RNA, 660 nt, Artificial Sequence
  PSMB9__Homo_sapiens__NP_002791
augcugagagccggcgcccccaccggcgaccugcccagagccggcgaggugcacaccggcaccaccaucauggccguggaguucgacggcggcguggugaugggcagcgacagcagagugagcgccggcgaggccguggugaacagaguguucgacaagcugagcccccugcacgagagaaucuacugcgcccugagcggcagcgccgccgacgcccaggccguggccgacauggccgccuaccagcuggagcugcacggcaucgagcuggaggagcccccccuggugcuggccgccgccaacguggugagaaacaucagcuacaaguacagagaggaccugagcgcccaccugaugguggccggcugggaccagagagagggcggccagguguacggcacccugggcggcaugcugaccagacagcccuucgccaucggcggcagcggcagcaccuucaucuacggcuacguggacgccgccuacaagcccggcaugagccccgaggagugcagaagauucaccaccgacgccaucgcccuggccaugagcagagacggcagcagcggcggcgugaucuaccuggugaccaucaccgccgccggcguggaccacagagugauccugggcaacgagcugcccaaguucuacgacgaguaa

SEQ ID NO: 22127 - RNA, 1323 nt, Artificial Sequence
  PSMC1__Homo_sapiens__NP_002793
augggccagagccagagcggcggccacggccccggcggcggcaagaaggacgacaaggacaagaagaagaaguacgagccccccgugcccaccagagugggcaagaagaagaagaagaccaagggccccgacgccgccagcaagcugccccuggugaccccccacacccagugcagacugaagcugcugaagcuggagagaaucaaggacuaccugcugauggaggaggaguucaucagaaaccaggagcagaugaagccccuggaggagaagcaggaggaggagagaagcaagguggacgaccugagaggcacccccaugagcgugggcacccuggaggagaucaucgacgacaaccacgccaucgugagcaccagcgugggcagcgagcacuacgugagcauccugagcuucguggacaaggaccugcuggagcccggcugcagcgugcugcugaaccacaaggugcacgccgugaucggcgugcugauggacgacaccgacccccuggugaccgugaugaagguggagaaggccccccaggagaccuacgccgacaucggcggccuggacaaccagauccaggagaucaaggagagcguggagcugccccugacccaccccgaguacuacgaggagaugggcaucaagccccccaagggcgugauccuguacggcccccccggcaccggcaagacccugcuggccaaggccguggccaaccagaccagcgccaccuuccugagaguggugggcagcgagcugauccagaaguaccugggcgacggccccaagcuggugagagagcuguucagaguggccgaggagcacgcccccagcaucguguucaucgacgagaucgacgccaucggcaccaagagauacgacagcaacagcggcggcgagagagagauccagagaaccaugcuggagcugcugaaccagcuggacggcuucgacagcagaggcgacgugaaggugaucauggccaccaacagaaucgagacccuggaccccgcccugaucagacccggcagaaucgacagaaagaucgaguucccccugcccgacgagaagaccaagaagagaaucuuccagauccacaccagcagaaugacccuggccgacgacgugacccuggacgaccugaucauggccaaggacgaccugagcggcgccgacaucaaggccaucugcaccgaggccggccugauggcccugagagagagaagaaugaaggugaccaacgaggacuucaagaagagcaaggagaacgugcuguacaagaagcaggagggcacccccgagggccuguaccuguaa

SEQ ID NO: 22128 - RNA, 426 nt, Artificial Sequence
  PSMC2__Homo_sapiens__NP_001191382
augcccgacuaccugggcgccgaccagagaaagaccaaggaggacgagaaggacgacaagcccaucagagcccuggacgagggcgacaucgcccugcugaagaccuacggccagagcaccuacagcagacagaucaagcagguggaggacgacauccagcagcugcugaagaagaucaacgagcugaccggcaucaaggagagcgacaccggccuggccccccccgcccugugggaccuggccgccgacaagcagacccugcagagcgagcagccccugcagguggccagaugcaccaagaucaucaacgccgacagcgaggaccccaaguacaucaucaacgugaagcaguucgccaaguucgugguggaccugagcgaccagguggcccccaccgacaucgaggagggcaugagagugggcuaa

SEQ ID NO: 22129 - RNA, 1320 nt, Artificial Sequence
  PSMC3__Homo_sapiens__NP_002795
augaaccugcugcccaacaucgagagccccgugaccagacaggagaagauggccaccgugugggacgaggccgagcaggacggcaucggcgaggaggugcugaagaugagcaccgaggagaucauccagagaaccagacugcuggacagcgagaucaagaucaugaagagcgaggugcugagagugacccacgagcugcaggccaugaaggacaagaucaaggagaacagcgagaagaucaaggugaacaagacccugcccuaccuggugagcaacgugaucgagcugcuggacguggaccccaacgaccaggaggaggacggcgccaacaucgaccuggacagccagagaaagggcaagugcgccgugaucaagaccagcaccagacagaccuacuuccugcccgugaucggccugguggacgccgagaagcugaagcccggcgaccuggugggcgugaacaaggacagcuaccugauccuggagacccugcccaccgaguacgacagcagagugaaggccauggagguggacgagagacccaccgagcaguacagcgacaucggcggccuggacaagcagauccaggagcugguggaggccaucgugcugcccaugaaccacaaggagaaguucgagaaccugggcauccagccccccaagggcgugcugauguacggcccccccggcaccggcaagacccugcuggccagagccugcgccgcccagaccaaggccaccuuccugaagcuggccggcccccagcuggugcagauguucaucggcgacggcgccaagcuggugagagacgccuucgcccuggccaaggagaaggcccccagcaucaucuucaucgacgagcuggacgccaucggcaccaagagauucgacagcgagaaggccggcgacagagaggugcagagaaccaugcuggagcugcugaaccagcuggacggcuuccagcccaacacccaggugaaggugaucgccgccaccaacagaguggacauccuggaccccgcccugcugagaagcggcagacuggacagaaagaucgaguuccccaugcccaacgaggaggccagagccagaaucaugcagauccacagcagaaagaugaacgugagccccgacgugaacuacgaggagcuggccagaugcaccgacgacuucaacggcgcccagugcaaggccgugugcguggaggccggcaugaucgcccugagaagaggcgccaccgagcugacccacgaggacuacauggagggcauccuggaggugcaggccaagaagaaggccaaccugcaguacuacgccuaa

SEQ ID NO: 22130 - RNA, 465 nt, Artificial Sequence
  PSMC3IP__Homo_sapiens__NP_001242943
auguacggcaagcagaagaucuacuucgccgaccaggaccaguucgacauggugagcgacgccgaccugcaggugcuggacggcaagaucguggcccugaccgccaaggugcagagccugcagcagagcugcagauacauggaggccgagcugaaggagcugagcagcgcccugaccacccccgagaugcagaaggagauccaggagcugaagaaggagugcgccggcuacagagagagacugaagaacaucaaggccgccaccaaccacgugacccccgaggagaaggagcagguguacagagagagacagaaguacugcaaggaguggagaaagagaaagagaauggccaccgagcugagcgacgccauccuggagggcuaccccaagagcaagaagcaguucuucgaggaggugggcaucgagaccgacgaggacuacaacgugacccugcccgaccccuaa

SEQ ID NO: 22131 - RNA, 1257 nt, Artificial Sequence
  PSMC4__Homo_sapiens__NP_006494
auggaggagaucggcauccugguggagaaggcccaggacgagauccccgcccugagcgugagcagaccccagaccggccugagcuuccugggccccgagcccgaggaccuggaggaccuguacagcagauacaagaagcugcagcaggagcuggaguuccuggaggugcaggaggaguacaucaaggacgagcagaagaaccugaagaaggaguuccugcacgcccaggaggaggugaagagaauccagagcaucccccuggugaucggccaguuccuggaggccguggaccagaacaccgccaucgugggcagcaccaccggcagcaacuacuacgugagaauccugagcaccaucgacagagagcugcugaagcccaacgccagcguggcccugcacaagcacagcaacgcccugguggacgugcugccccccgaggccgacagcagcaucaugaugcugaccagcgaccagaagcccgacgugauguacgccgacaucggcggcauggacauccagaagcaggaggugagagaggccguggagcugccccugacccacuucgagcuguacaagcagaucggcaucgacccccccagaggcgugcugauguacggcccccccggcugcggcaagaccaugcuggccaaggccguggcccaccacaccaccgccgccuucaucagaguggugggcagcgaguucgugcagaaguaccugggcgagggccccagaauggugagagacguguucagacuggccaaggagaacgcccccgccaucaucuucaucgacgagaucgacgccaucgccaccaagagauucgacgcccagaccggcgccgacagagaggugcagagaauccugcuggagcugcugaaccagauggacggcuucgaccagaacgugaacgugaaggugaucauggccaccaacagagccgacacccuggaccccgcccugcugagacccggcagacuggacagaaagaucgaguucccccugcccgacagaagacagaagagacugaucuucagcaccaucaccagcaagaugaaccugagcgaggagguggaccuggaggacuacguggccagacccgacaagaucagcggcgccgacaucaacagcaucugccaggagagcggcaugcuggccgugagagagaacagauacaucgugcuggccaaggacuucgagaaggccuacaagaccgugaucaagaaggacgagcaggagcacgaguucuacaaguaa

SEQ ID NO: 22132 - RNA, 1197 nt, Artificial Sequence
  PSMC5__Homo_sapiens__NP_001186092
auggagcuggaggagggcaaggccggcagcggccugagacaguacuaccugagcaagaucgaggagcugcagcugaucgugaacgacaagagccagaaccugagaagacugcaggcccagagaaacgagcugaacgccaaggugagacugcugagagaggagcugcagcugcugcaggagcagggcagcuacgugggcgagguggugagagccauggacaagaagaaggugcuggugaaggugcaccccgagggcaaguucgugguggacguggacaagaacaucgacaucaacgacgugacccccaacugcagaguggcccugagaaacgacagcuacacccugcacaagauccugcccaacaagguggacccccuggugagccugaugaugguggagaaggugcccgacagcaccuacgagaugaucggcggccuggacaagcagaucaaggagaucaaggaggugaucgagcugcccgugaagcaccccgagcuguucgaggcccugggcaucgcccagcccaagggcgugcugcuguacggcccccccggcaccggcaagacccugcuggccagagccguggcccaccacaccgacugcaccuucaucagagugagcggcagcgagcuggugcagaaguucaucggcgagggcgccagaauggugagagagcuguucgugauggccagagagcacgcccccagcaucaucuucauggacgagaucgacagcaucggcagcagcagacuggagggcggcagcggcggcgacagcgaggugcagagaaccaugcuggagcugcugaaccagcuggacggcuucgaggccaccaagaacaucaaggugaucauggccaccaacagaaucgacauccuggacagcgcccugcugagacccggcagaaucgacagaaagaucgaguuccccccccccaacgaggaggccagacuggacauccugaagauccacagcagaaagaugaaccugaccagaggcaucaaccugagaaagaucgccgagcugaugcccggcgccagcggcgccgaggugaagggcgugugcaccgaggccggcauguacgcccugagagagagaagagugcacgugacccaggaggacuucgagauggccguggccaaggugaugcagaaggacagcgagaagaacaugagcaucaagaagcuguggaaguaa

SEQ ID NO: 22133 - RNA, 1212 nt, Artificial Sequence
  PSMC6__Homo_sapiens__NP_002797
auggccauccccggcauccccuacgagagaagacugcugaucauggccgaccccagagacaaggcccugcaggacuacagaaagaagcugcuggagcacaaggagaucgacggcagacugaaggagcugagagagcagcugaaggagcugaccaagcaguacgagaagagcgagaacgaccugaaggcccugcagagcgugggccagaucgugggcgaggugcugaagcagcugaccgaggagaaguucaucgugaaggccaccaacggccccagauacguggugggcugcagaagacagcuggacaagagcaagcugaagcccggcaccagaguggcccuggacaugaccacccugaccaucaugagauaccugcccagagagguggacccccugguguacaacaugagccacgaggaccccggcaacgugagcuacagcgagaucggcggccugagcgagcagaucagagagcugagagaggugaucgagcugccccugaccaaccccgagcuguuccagagagugggcaucaucccccccaagggcugccugcuguacggcccccccggcaccggcaagacccugcuggccagagccguggccagccagcuggacugcaacuuccugaagguggugagcagcagcaucguggacaaguacaucggcgagagcgccagacugaucagagagauguucaacuacgccagagaccaccagcccugcaucaucuucauggacgagaucgacgccaucggcggcagaagauucagcgagggcaccagcgccgacagagagauccagagaacccugauggagcugcugaaccagauggacggcuucgacacccugcacagagugaagaugaucauggccaccaacagacccgacacccuggaccccgcccugcugagacccggcagacuggacagaaagauccacaucgaccugcccaacgagcaggccagacuggacauccugaagauccacgccggccccaucaccaagcacggcgagaucgacuacgaggccaucgugaagcugagcgacggcuucaacggcgccgaccugagaaacgugugcaccgaggccggcauguucgccaucagagccgaccacgacuucguggugcaggaggacuucaugaaggccgugagaaagguggccgacagcaagaagcuggagagcaagcuggacuacaagcccguguaa

SEQ ID NO: 22134 - RNA, 681 nt, Artificial Sequence
  PSMD10__Homo_sapiens__NP_002805
auggagggcugcgugagcaaccugauggugugcaaccuggccuacagcggcaagcuggaggagcugaaggagagcauccuggccgacaagagccuggccaccagaaccgaccaggacagcagaaccgcccugcacugggccugcagcgccggccacaccgagaucguggaguuccugcugcagcugggcgugcccgugaacgacaaggacgacgccggcuggagcccccugcacaucgccgccagcgccggcagagacgagaucgugaaggcccugcugggcaagggcgcccaggugaacgccgugaaccagaacggcugcaccccccugcacuacgccgccagcaagaacagacacgagaucgccgugaugcugcuggagggcggcgccaaccccgacgccaaggaccacuacgaggccaccgccaugcacagagccgccgccaagggcaaccugaagaugauccacauccugcuguacuacaaggccagcaccaacauccaggacaccgagggcaacaccccccugcaccuggccugcgacgaggagagaguggaggaggccaagcugcuggugagccagggcgccagcaucuacaucgagaacaaggaggagaagaccccccugcagguggccaagggcggccugggccugauccugaagagaaugguggagggcuaa

SEQ ID NO: 22135 - RNA, 1371 nt, Artificial Sequence
  PSMD12__Homo_sapiens__NP_002807
auggccgacggcggcagcgagagagccgacggcagaaucgugaagauggagguggacuacagcgccaccguggaccagagacugcccgagugcgccaagcuggccaaggagggcagacugcaggaggugaucgagacccugcugagccuggagaagcagaccagaaccgccagcgacauggugagcaccagcagaauccugguggccguggugaagaugugcuacgaggccaaggagugggaccugcugaacgagaacaucaugcugcugagcaagagaagaagccagcugaagcaggccguggccaagauggugcagcagugcugcaccuacguggaggagaucaccgaccugcccaucaagcugagacugaucgacacccugagaauggugaccgagggcaagaucuacguggagaucgagagagccagacugaccaagacccuggccaccaucaaggagcagaacggcgacgugaaggaggccgccagcauccugcaggagcugcagguggagaccuacggcagcauggagaagaaggagagaguggaguucauccuggagcagaugagacugugccuggccgugaaggacuacaucagaacccagaucaucagcaagaagaucaacaccaaguucuuccaggaggagaacaccgagaagcugaagcugaaguacuacaaccugaugauccagcuggaccagcacgagggcagcuaccugagcaucugcaagcacuacagagccaucuacgacacccccugcauccaggccgagagcgagaaguggcagcaggcccugaagagcguggugcuguacgugauccuggcccccuucgacaacgagcagagcgaccuggugcacagaaucagcggcgacaagaagcuggaggagauccccaaguacaaggaccugcugaagcuguucaccaccauggagcugaugagauggagcacccugguggaggacuacggcauggagcugagaaagggcagccuggagagccccgccaccgacguguucggcagcaccgaggagggcgagaagagauggaaggaccugaagaacagagugguggagcacaacaucagaaucauggccaaguacuacaccagaaucaccaugaagagaauggcccagcugcuggaccugagcguggacgagagcgaggccuuccugagcaaccugguggugaacaagaccaucuucgccaagguggacagacuggccggcaucaucaacuuccagagacccaaggaccccaacaaccugcugaacgacuggagccagaagcugaacagccugaugagccuggugaacaagaccacccaccugaucgccaaggaggagaugauccacaaccugcaguaa

SEQ ID NO: 22136 - RNA, 1131 nt, Artificial Sequence
  PSMD13__Homo_sapiens__NP_002808
augaaggacgugcccggcuuccugcagcagagccagaacagcggccccggccagcccgccguguggcacagacuggaggagcuguacaccaagaagcuguggcaccagcugacccugcaggugcuggacuucgugcaggaccccugcuucgcccagggcgacggccugaucaagcuguacgagaacuucaucagcgaguucgagcacagagugaacccccugagccugguggagaucauccugcacguggugagacagaugaccgaccccaacguggcccugaccuuccuggagaagaccagagagaaggugaagagcagcgacgaggccgugauccugugcaagaccgccaucggcgcccugaagcugaacaucggcgaccugcaggugaccaaggagaccaucgaggacguggaggagaugcugaacaaccugcccggcgugaccagcgugcacagcagauucuacgaccugagcagcaaguacuaccagaccaucggcaaccacgccagcuacuacaaggacgcccugagauuccugggcugcguggacaucaaggaccugcccgugagcgagcagcaggagagagccuucacccugggccuggccggccugcugggcgagggcguguucaacuucggcgagcugcugaugcaccccgugcuggagagccugagaaacaccgacagacaguggcugaucgacacccuguacgccuucaacagcggcaacguggagagauuccagacccugaagaccgccuggggccagcagcccgaccuggccgccaacgaggcccagcugcugagaaagauccagcugcugugccugauggagaugaccuucaccagacccgccaaccacagacagcugaccuucgaggagaucgccaagagcgccaagaucaccgugaacgagguggagcugcuggugaugaaggcccugagcgugggccuggugaagggcagcaucgacgagguggacaagagagugcacaugaccugggugcagcccagagugcuggaccugcagcagaucaagggcaugaaggacagacuggaguucuggugcaccgacgugaagagcauggagaugcugguggagcaccaggcccacgacauccugaccuaa

SEQ ID NO: 22137 - RNA, 933 nt, Artificial Sequence
  PSMD14__Homo_sapiens__NP_005796
auggacagacugcugagacugggcggcggcaugcccggccugggccagggcccccccaccgacgcccccgccguggacaccgccgagcagguguacaucagcagccuggcccugcugaagaugcugaagcacggcagagccggcgugcccauggaggugaugggccugaugcugggcgaguucguggacgacuacaccgugagagugaucgacguguucgccaugccccagagcggcaccggcgugagcguggaggccguggaccccguguuccaggccaagaugcuggacaugcugaagcagaccggcagacccgagaugguggugggcugguaccacagccaccccggcuucggcugcuggcugagcggcguggacaucaacacccagcagagcuucgaggcccugagcgagagagccguggccguggugguggaccccauccagagcgugaagggcaagguggugaucgacgccuucagacugaucaacgccaacaugauggugcugggccacgagcccagacagaccaccagcaaccugggccaccugaacaagcccagcauccaggcccugauccacggccugaacagacacuacuacagcaucaccaucaacuacagaaagaacgagcuggagcagaagaugcugcugaaccugcacaagaagagcuggauggagggccugacccugcaggacuacagcgagcacugcaagcacaacgagagcguggugaaggagaugcuggagcuggccaagaacuacaacaaggccguggaggaggaggacaagaugacccccgagcagcuggccaucaagaacgugggcaagcaggaccccaagagacaccuggaggagcacguggacgugcugaugaccagcaacaucgugcagugccuggccgccaugcuggacaccgugguguucaaguaa

SEQ ID NO: 22138 - RNA, 2769 nt, Artificial Sequence
  PSMD1__Homo_sapiens__NP_001177966
augaucaccagcgccgccggcaucaucagccugcuggacgaggacgagccccagcugaaggaguucgcccugcacaagcugaacgccguggugaacgacuucugggccgagaucagcgagagcguggacaagaucgaggugcuguacgaggacgagggcuucagaagcagacaguucgccgcccugguggccagcaagguguucuaccaccugggcgccuucgaggagagccugaacuacgcccugggcgccggcgaccuguucaacgugaacgacaacagcgaguacguggagaccaucaucgccaagugcaucgaccacuacaccaagcagugcguggagaacgccgaccugcccgagggcgagaagaagcccaucgaccagagacuggagggcaucgugaacaagauguuccagagaugccuggacgaccacaaguacaagcaggccaucggcaucgcccuggagaccagaagacuggacguguucgagaagaccauccuggagagcaacgacgugcccggcaugcuggccuacagccugaagcugugcaugagccugaugcagaacaagcaguucagaaacaaggugcugagagugcuggugaagaucuacaugaaccuggagaagcccgacuucaucaacgugugccagugccugaucuuccuggacgacccccaggccgugagcgacauccuggagaagcuggugaaggaggacaaccugcugauggccuaccagaucugcuucgaccuguacgagagcgccagccagcaguuccugagcagcgugauccagaaccugagaaccgugggcacccccaucgccagcgugcccggcagcaccaacaccggcaccgugcccggcagcgagaaggacagcgacagcauggagaccgaggagaagaccagcagcgccuucgugggcaagacccccgaggccagccccgagcccaaggaccagacccugaagaugaucaagauccugagcggcgagauggccaucgagcugcaccugcaguuccugaucagaaacaacaacaccgaccugaugauccugaagaacaccaaggacgccgugagaaacagcgugugccacaccgccaccgugaucgccaacagcuucaugcacugcggcaccaccagcgaccaguuccugagagacaaccuggaguggcuggccagagccaccaacugggccaaguucaccgccaccgccagccugggcgugauccacaagggccacgagaaggaggcccugcagcugauggccaccuaccugcccaaggacaccagccccggcagcgccuaccaggagggcggcggccuguacgcccugggccugauccacgccaaccacggcggcgacaucaucgacuaccugcugaaccagcugaagaacgccagcaacgacaucgugagacacggcggcagccugggccugggccuggccgccaugggcaccgccagacaggacguguacgaccugcugaagaccaaccuguaccaggacgacgccgugaccggcgaggccgccggccuggcccugggccuggugaugcugggcagcaagaacgcccaggccaucgaggacauggugggcuacgcccaggagacccagcacgagaagauccugagaggccuggccgugggcaucgcccuggugauguacggcagaauggaggaggccgacgcccugaucgagagccugugcagagacaaggaccccauccugagaagaagcggcauguacaccguggccauggccuacugcggcagcggcaacaacaaggccaucagaagacugcugcacguggccgugagcgacgugaacgacgacgugagaagagccgccguggagagccugggcuucauccuguucagaacccccgagcagugccccagcguggugagccugcugagcgagagcuacaacccccacgugagauacggcgccgccauggcccugggcaucugcugcgccggcaccggcaacaaggaggccaucaaccugcuggagcccaugaccaacgaccccgugaacuacgugagacagggcgcccugaucgccagcgcccugaucaugauccagcagaccgagaucaccugccccaaggugaaccaguucagacagcuguacagcaaggugaucaacgacaagcacgacgacgugauggccaaguucggcgccauccuggcccagggcauccuggacgccggcggccacaacgugaccaucagccugcagagcagaaccggccacacccacaugcccagcguggugggcgugcugguguucacccaguucugguucugguucccccugagccacuuccugagccuggccuacacccccaccugcgugaucggccugaacaaggaccugaaggugagcaccgccgugcugagcaucaccgccaaggccaagaagaaggagaaggagaaggagaagaaggaggaggagaagauggagguggacgaggccgagaagaaggaggagaaggagaagaagaaggagcccgagcccaacuuccagcugcuggacaaccccgccagagugaugcccgcccagcugaaggugcugaccaugcccgagaccugcagauaccagcccuucaagccccugagcaucggcggcaucaucauccugaaggacaccagcgaggacaucgaggagcugguggagcccguggccgcccacggccccaagaucgaggaggaggagcaggagcccgagccccccgagcccuucgaguacaucgacgacuaa

SEQ ID NO: 22139 - RNA, 2250 nt, Artificial Sequence
  PSMD2__Homo_sapiens__NP_001265638
augagcaugagcggcgagguggccaaggaguggcaggagcuggacgacgccgagaaggugcagagagagccccugcugacccuggugaaggagaucgugcccuacaacauggcccacaacgccgagcacgaggccugcgaccugcugauggagaucgagcagguggacaugcuggagaaggacaucgacgagaacgccuacgccaaggugugccuguaccugaccagcugcgugaacuacgugcccgagcccgagaacagcgcccugcugagaugcgcccugggcguguucagaaaguucagcagauuccccgaggcccugagacuggcccugaugcugaacgacauggagcugguggaggacaucuucaccagcugcaaggacgugguggugcagaagcagauggccuucaugcugggcagacacggcguguuccuggagcugagcgaggacguggaggaguacgaggaccugaccgagaucaugagcaacgugcagcugaacagcaacuuccuggcccuggccagagagcuggacaucauggagcccaaggugcccgacgacaucuacaagacccaccuggagaacaacagauucggcggcagcggcagccagguggacagcgccagaaugaaccuggccagcagcuucgugaacggcuucgugaacgccgccuucggccaggacaagcugcugaccgacgacggcaacaaguggcuguacaagaacaaggaccacggcaugcugagcgccgccgccagccugggcaugauccugcugugggacguggacggcggccugacccagaucgacaaguaccuguacagcagcgaggacuacaucaagagcggcgcccugcuggccugcggcaucgugaacagcggcgugagaaacgagugcgaccccgcccuggcccugcugagcgacuacgugcugcacaacagcaacaccaugagacugggcagcaucuucggccugggccuggccuacgccggcagcaacagagaggacgugcugacccugcugcugcccgugaugggcgacagcaagagcagcauggagguggccggcgugaccgcccuggccugcggcaugaucgccgugggcagcugcaacggcgacgugaccagcaccauccugcagaccaucauggagaagagcgagaccgagcugaaggacaccuacgccagauggcugccccugggccugggccugaaccaccugggcaagggcgaggccaucgaggccauccuggccgcccuggagguggugagcgagcccuucagaagcuucgccaacacccugguggacgugugcgccuacgccggcagcggcaacgugcugaaggugcagcagcugcugcacaucugcagcgagcacuucgacagcaaggagaaggaggaggacaaggacaagaaggagaagaaggacaaggacaagaaggaggcccccgccgacaugggcgcccaccagggcguggccgugcugggcaucgcccugaucgccaugggcgaggagaucggcgccgagauggcccugagaaccuucggccaccugcugagauacggcgagcccacccugagaagagccgugccccuggcccuggcccugaucagcgugagcaaccccagacugaacauccuggacacccugagcaaguucagccacgacgccgaccccgaggugagcuacaacagcaucuucgccaugggcauggugggcagcggcaccaacaacgccagacuggccgccaugcugagacagcuggcccaguaccacgccaaggaccccaacaaccuguucauggugagacuggcccagggccugacccaccugggcaagggcacccugacccugugccccuaccacagcgacagacagcugaugagccagguggccguggccggccugcugaccgugcuggugagcuuccuggacgugagaaacaucauccugggcaagagccacuacgugcuguacggccugguggccgccaugcagcccagaaugcuggugaccuucgacgaggagcugagaccccugcccgugagcgugagagugggccaggccguggacguggugggccaggccggcaagcccaagaccaucaccggcuuccagacccacaccacccccgugcugcuggcccacggcgagagagccgagcuggccaccgaggaguuccugcccgugacccccauccuggagggcuucgugauccugagaaagaaccccaacuacgaccuguaa

SEQ ID NO: 22140 - RNA, 1605 nt, Artificial Sequence
  PSMD3__Homo_sapiens__NP_002800
augaagcaggagggcagcgccagaagaagaggcgccgacaaggccaagcccccccccggcggcggcgagcaggagcccccccccccccccgccccccaggacguggagaugaaggaggaggccgccaccggcggcggcagcaccggcgaggccgacggcaagaccgccgccgccgccgccgagcacagccagagagagcuggacaccgugacccuggaggacaucaaggagcacgugaagcagcuggagaaggccgugagcggcaaggagcccagauucgugcugagagcccugagaaugcugcccagcaccagcagaagacugaaccacuacgugcuguacaaggccgugcagggcuucuucaccagcaacaacgccaccagagacuuccugcugcccuuccuggaggagcccauggacaccgaggccgaccugcaguucagacccagaaccggcaaggccgccagcaccccccugcugcccgagguggaggccuaccugcagcugcugguggugaucuucaugaugaacagcaagagauacaaggaggcccagaagaucagcgacgaccugaugcagaagaucagcacccagaacagaagagcccuggaccugguggccgccaagugcuacuacuaccacgccagaguguacgaguuccuggacaagcuggacguggugagaagcuuccugcacgccagacugagaaccgccacccugagacacgacgccgacggccaggccacccugcugaaccugcugcugagaaacuaccugcacuacagccuguacgaccaggccgagaagcuggugagcaagagcguguuccccgagcaggccaacaacaacgagugggccagauaccuguacuacaccggcagaaucaaggccauccagcuggaguacagcgaggccagaagaaccaugaccaacgcccugagaaaggccccccagcacaccgccgugggcuucaagcagaccgugcacaagcugcugaucgugguggagcugcugcugggcgagauccccgacagacugcaguucagacagcccagccugaagagaagccugaugcccuacuuccugcugacccaggccgugagaaccggcaaccuggccaaguucaaccaggugcuggaccaguucggcgagaaguuccaggccgacggcaccuacacccugaucaucagacugagacacaacgugaucaagaccggcgugagaaugaucagccugagcuacagcagaaucagccuggccgacaucgcccagaagcugcagcuggacagccccgaggacgccgaguucaucguggccaaggccaucagagacggcgugaucgaggccagcaucaaccacgagaagggcuacgugcagagcaaggagaugaucgacaucuacagcaccagagagccccagcuggccuuccaccagagaaucagcuucugccuggacauccacaacaugagcgugaaggccaugagauucccccccaagagcuacaacaaggaccuggagagcgccgaggagagaagagagagagagcagcaggaccuggaguucgccaaggagauggccgaggacgacgacgacagcuuccccuaa

SEQ ID NO: 22141 - RNA, 1134 nt, Artificial Sequence
  PSMD4__Homo_sapiens__NP_002801
auggugcuggagagcaccauggugugcguggacaacagcgaguacaugagaaacggcgacuuccugcccaccagacugcaggcccagcaggacgccgugaacaucgugugccacagcaagaccagaagcaaccccgagaacaacgugggccugaucacccuggccaacgacugcgaggugcugaccacccugacccccgacaccggcagaauccugagcaagcugcacaccgugcagcccaagggcaagaucaccuucugcaccggcaucagaguggcccaccuggcccugaagcacagacagggcaagaaccacaagaugagaaucaucgccuucgugggcagccccguggaggacaacgagaaggaccuggugaagcuggccaagagacugaagaaggagaaggugaacguggacaucaucaacuucggcgaggaggaggugaacaccgagaagcugaccgccuucgugaacacccugaacggcaaggacggcaccggcagccaccuggugaccgugccccccggccccagccuggccgacgcccugaucagcagccccauccuggccggcgagggcggcgccaugcugggccugggcgccagcgacuucgaguucggcguggaccccagcgccgaccccgagcuggcccuggcccugagagugagcauggaggagcagagacagagacaggaggaggaggccagaagagccgccgccgccagcgccgccgaggccggcaucgccaccaccggcaccgaggacagcgacgacgcccugcugaagaugaccaucagccagcaggaguucggcagaaccggccugcccgaccugagcagcaugaccgaggaggagcagaucgccuacgccaugcagaugagccugcagggcgccgaguucggccaggccgagagcgccgacaucgacgccagcagcgccauggacaccagcgagcccgccaaggaggaggacgacuacgacgugaugcaggaccccgaguuccugcagagcgugcuggagaaccugcccggcguggaccccaacaacgaggccaucagaaacgccaugggcagccuggccagccaggccaccaaggacggcaagaaggacaagaaggaggaggacaagaaguaa

SEQ ID NO: 22142 - RNA, 1329 nt, Artificial Sequence
  PSMD6__Homo_sapiens__NP_001258708
augccccuggagaaccuggaggaggagggccugcccaagaaccccgaccugagaaucgcccagcugagauuccugcugagccugcccgagcacagaggcgacgccgccgugagagacgagcugauggccgccgugagagacaacaacuucuggaacagaaucagacaggagcagaccgaggacugcccccccagcagccccagcagaggcuggcacugccaggacuggcccagcagaaagccccccaccagcaucagacugugcuucgccaagcccaucaucaagagacacagaaugcccagcuacauggcccccuacuacgaggcccugugcaagagccuggacuggcagaucgacguggaccugcugaacaagaugaagaaggccaacgaggacgagcugaagagacuggacgaggagcuggaggacgccgagaagaaccugggcgagagcgagaucagagacgccaugauggccaaggccgaguaccugugcagaaucggcgacaaggagggcgcccugaccgccuucagaaagaccuacgacaagaccguggcccugggccacagacuggacaucguguucuaccugcugagaaucggccuguucuacauggacaacgaccugaucaccagaaacaccgagaaggccaagagccugaucgaggagggcggcgacugggacagaagaaacagacugaagguguaccagggccuguacugcguggccaucagagacuucaagcaggccgccgagcuguuccuggacaccgugagcaccuucaccagcuacgagcugauggacuacaagaccuucgugaccuacaccguguacgugagcaugaucgcccuggagagacccgaccugagagagaaggugaucaagggcgccgagauccuggaggugcugcacagccugcccgccgugagacaguaccuguucagccuguacgagugcagauacagcguguucuuccagagccuggccgugguggagcaggagaugaagaaggacuggcuguucgccccccacuacagauacuacgugagagagaugagaauccacgccuacagccagcugcuggagagcuacagaagccugacccugggcuacauggccgaggccuucggcgugggcguggaguucaucgaccaggagcugagcagauucaucgccgccggcagacugcacugcaagaucgacaaggugaacgagaucguggagaccaacagacccgacagcaagaacuggcaguaccaggagaccaucaagaagggcgaccugcugcugaacagagugcagaagcugagcagagugaucaacauguaa

SEQ ID NO: 22143 - RNA, 975 nt, Artificial Sequence
  PSMD7__Homo_sapiens__NP_002802
augcccgagcuggccgugcagaaggugguggugcacccccuggugcugcugagcgugguggaccacuucaacagaaucggcaaggugggcaaccagaagagaguggugggcgugcugcugggcagcuggcagaagaaggugcuggacgugagcaacagcuucgccgugcccuucgacgaggacgacaaggacgacagcgugugguuccuggaccacgacuaccuggagaacauguacggcauguucaagaaggugaacgccagagagagaaucgugggcugguaccacaccggccccaagcugcacaagaacgacaucgccaucaacgagcugaugaagagauacugccccaacagcgugcuggugaucaucgacgugaagcccaaggaccugggccugcccaccgaggccuacaucagcguggaggaggugcacgacgacggcacccccaccagcaagaccuucgagcacgugaccagcgagaucggcgccgaggaggccgaggaggugggcguggagcaccugcugagagacaucaaggacaccaccgugggcacccugagccagagaaucaccaaccaggugcacggccugaagggccugaacagcaagcugcuggacaucagaagcuaccuggagaagguggccaccggcaagcugcccaucaaccaccagaucaucuaccagcugcaggacguguucaaccugcugcccgacgugagccugcaggaguucgugaaggccuucuaccugaagaccaacgaccagaugguggugguguaccuggccagccugaucagaagcgugguggcccugcacaaccugaucaacaacaagaucgccaacagagacgccgagaagaaggagggccaggagaaggaggagagcaagaaggacagaaaggaggacaaggagaaggacaaggacaaggagaagagcgacgugaagaaggaggagaagaaggagaagaaguaa

SEQ ID NO: 22144 - RNA, 1053 nt, Artificial Sequence
  PSMD8__Homo_sapiens__NP_002803
auguucaucaagggcagagcccccagagccccccccagagagagaagaagagccaccagaggcggccugagacaggugguggccccccccagagcccugggcagcaccagcagaccccacuucagaagagccagcgugugcagaagaagaugcagaaagagcggcggccugcuggccgccagcagaaagauggccgccgccgccgugaacggcgccgccggcuucagcagcagcggccccgccgccaccagcggcgccgugcugcaggccgccaccggcauguacgagcagcugaagggcgaguggaacagaaagagccccaaccugagcaagugcggcgaggagcugggcagacugaagcuggugcugcuggagcugaacuuccugcccaccaccggcaccaagcugaccaagcagcagcugauccuggccagagacauccuggagaucggcgcccaguggagcauccugagaaaggacauccccagcuucgagagauacauggcccagcugaagugcuacuacuucgacuacaaggagcagcugcccgagagcgccuacaugcaccagcugcugggccugaaccugcuguuccugcugagccagaacagaguggccgaguuccacaccgagcuggagagacugcccgccaaggacauccagaccaacguguacaucaagcaccccgugagccuggagcaguaccugauggagggcagcuacaacaagguguuccuggccaagggcaacauccccgccgagagcuacaccuucuucaucgacauccugcuggacaccaucagagacgagaucgccggcugcaucgagaaggccuacgagaagauccuguucaccgaggccaccagaauccuguucuucaacacccccaagaagaugaccgacuacgccaagaagagaggcugggugcugggccccaacaacuacuacagcuucgccagccagcagcagaagcccgaggacaccaccauccccagcaccgagcuggccaagcaggugaucgaguacgccagacagcuggagaugaucguguaa

SEQ ID NO: 22145 - RNA, 672 nt, Artificial Sequence
  PSMD9__Homo_sapiens__NP_002804
augagcgacgaggaggccagacagagcggcggcagcagccaggccggcguggugaccgugagcgacgugcaggagcugaugagaagaaaggaggagaucgaggcccagaucaaggccaacuacgacgugcuggagagccagaagggcaucggcaugaacgagccccugguggacugcgagggcuaccccagaagcgacguggaccuguaccaggugagaaccgccagacacaacaucaucugccugcagaacgaccacaaggccgugaugaagcagguggaggaggcccugcaccagcugcacgccagagacaaggagaagcaggccagagacauggccgaggcccacaaggaggccaugagcagaaagcugggccagagcgagagccagggcccccccagagccuucgccaaggugaacagcaucagccccggcagccccgccagcaucgccggccugcagguggacgacgagaucguggaguucggcagcgugaacacccagaacuuccagagccugcacaacaucggcagcguggugcagcacagcgagggcaagccccugaacgugaccgugaucagaagaggcgagaagcaccagcugagacuggugcccaccagaugggccggcaagggccugcugggcugcaacaucaucccccugcagagauaa

SEQ ID NO: 22146 - RNA, 750 nt, Artificial Sequence
  PSME1__Homo_sapiens__NP_006254
auggccaugcugagagugcagcccgaggcccaggccaagguggacguguucagagaggaccugugcaccaagaccgagaaccugcugggcagcuacuuccccaagaagaucagcgagcuggacgccuuccugaaggagcccgcccugaacgaggccaaccugagcaaccugaaggccccccuggacauccccgugcccgaccccgugaaggagaaggagaaggaggagagaaagaagcagcaggagaaggaggacaaggacgagaagaagaagggcgaggacgaggacaagggcccccccugcggccccgugaacugcaacgagaagaucguggugcugcugcagagacugaagcccgagaucaaggacgugaucgagcagcugaaccuggugaccaccuggcugcagcugcagauccccagaaucgaggacggcaacaacuucggcguggccgugcaggagaagguguucgagcugaugaccagccugcacaccaagcuggagggcuuccacacccagaucagcaaguacuucagcgagagaggcgacgccgugaccaaggccgccaagcagccccacgugggcgacuacagacagcuggugcacgagcuggacgaggccgaguacagagacaucagacugauggugauggagaucagaaacgccuacgccgugcuguacgacaucauccugaagaacuucgagaagcugaagaagcccagaggcgagaccaagggcaugaucuacuaa

SEQ ID NO: 22147 - RNA, 720 nt, Artificial Sequence
  PSME2__Homo_sapiens__NP_002809
auggccaagcccugcggcgugagacugagcggcgaggccagaaagcagguggagguguucagacagaaccuguuccaggaggccgaggaguuccuguacagauuccugccccagaagaucaucuaccugaaccagcugcugcaggaggacagccugaacguggccgaccugaccagccugagagccccccuggacauccccauccccgaccccccccccaaggacgacgagauggagaccgacaagcaggagaagaaggaggugcacaagugcggcuuccugcccggcaacgagaaggugcugagccugcuggcccuggugaagcccgagguguggacccugaaggagaagugcauccuggugaucaccuggauccagcaccugauccccaagaucgaggacggcaacgacuucggcguggccauccaggagaaggugcuggagagagugaacgccgugaagaccaagguggaggccuuccagaccaccaucagcaaguacuucagcgagagaggcgacgccguggccaaggccagcaaggagacccacgugauggacuacagagcccuggugcacgagagagacgaggccgccuacggcgagcugagagccauggugcuggaccugagagccuucuacgccgagcuguaccacaucaucagcagcaaccuggagaagaucgugaaccccaagggcgaggagaagcccagcauguacuaa

SEQ ID NO: 22148 - RNA, 798 nt, Artificial Sequence
  PSME3__Homo_sapiens__NP_001253974
auggagaaguggauccugaagaagaucaaguaccugcagagcggcggccugagcgccagcuacuacagcuacaagguggacagcuucagagagagaaucaccagcgaggccgaggaccugguggccaacuucuuccccaagaagcugcuggagcuggacagcuuccugaaggagcccauccugaacauccacgaccugacccagauccacagcgacaugaaccugcccgugcccgaccccauccugcugaccaacagccacgacggccuggacggccccaccuacaagaagagaagacuggacgagugcgaggaggccuuccagggcaccaagguguucgugaugcccaacggcaugcugaagagcaaccagcagcugguggacaucaucgagaaggugaagcccgagaucagacugcugaucgagaagugcaacaccgugaagaugugggugcagcugcugauccccagaaucgaggacggcaacaacuucggcgugagcauccaggaggagaccguggccgagcugagaaccguggagagcgaggccgccagcuaccuggaccagaucagcagauacuacaucaccagagccaagcuggugagcaagaucgccaaguacccccacguggaggacuacagaagaaccgugaccgagaucgacgagaaggaguacaucagccugagacugaucaucagcgagcugagaaaccaguacgugacccugcacgacaugauccugaagaacaucgagaagaucaagagacccagaagcagcaacgccgagacccuguacuaa

SEQ ID NO: 22149 - RNA, 5532 nt, Artificial Sequence
  PSME4__Homo_sapiens__NP_055429
auggagcccgccgagagagccggcgugggcgagccccccgagcccggcggcagacccgagcccggccccagaggcuucgugccccagaaggagaucguguacaacaagcugcugcccuacgccgagagacuggacgccgagagcgaccugcagcuggcccagaucaagugcaaccugggcagagccgugcagcugcaggagcuguggcccggcggccuguucuggaccagaaagcugagcaccuacaucagacuguacggcagaaaguucagcaaggaggaccacgugcuguucaucaagcugcuguacgagcuggugagcauccccaagcuggagaucagcaugaugcagggcuucgccagacugcugaucaaccugcugaagaagaaggagcugcugagcagagccgaccuggagcugcccuggagaccccuguacgacaugguggagagaauccuguacagcaagaccgagcaccugggccugaacugguuccccaacagcguggagaacauccugaagacccuggugaagagcugcagacccuacuuccccgccgacgccaccgccgagaugcuggaggaguggagaccccugaugugccccuucgacgugaccaugcagaaggccaucaccuacuucgagaucuuccugcccaccagccugccccccgagcugcaccacaagggcuucaagcugugguucgacgagcugaucggccugugggugagcgugcagaaccugccccagugggagggccagcuggugaaccuguucgccagacuggccaccgacaacaucggcuacaucgacugggaccccuacgugcccaagaucuucaccagaauccugagaagccugaaccugcccgugggcagcagccaggugcuggugcccagauuccugaccaacgccuacgacaucggccacgccgugaucuggaucaccgccaugaugggcggccccagcaagcuggugcagaagcaccuggccggccuguucaacagcaucaccagcuucuaccaccccagcaacaacggcagauggcugaacaagcugaugaagcugcugcagagacugcccaacagcguggugagaagacugcacagagagagauacaagaagcccagcuggcugacccccgugcccgacagccacaagcugaccgaccaggacgugaccgacuucgugcagugcaucauccagcccgugcugcuggccauguucagcaagaccggcagccuggaggccgcccaggcccugcagaaccuggcccugaugagacccgagcuggugaucccccccgugcuggagagaaccuaccccgcccuggagacccugaccgagccccaccagcugaccgccacccugagcugcgugaucggcguggccagaagccuggugagcggcggcagaugguuccccgagggccccacccacaugcugccccugcugaugagagcccugcccggcguggaccccaacgacuucagcaagugcaugaucaccuuccaguucaucgccaccuucagcacccuggugccccugguggacugcagcagcgugcugcaggagagaaacgaccugaccgagguggagagagagcugugcagcgccaccgccgaguucgaggacuucgugcugcaguucauggacagaugcuucggccugaucgagagcagcacccuggagcagaccagagaggagaccgagaccgagaagaugacccaccuggagagccugguggagcugggccugagcagcaccuucagcaccauccugacccagugcagcaaggagaucuucaugguggcccugcagaagguguucaacuucagcaccagccacaucuucgagaccagaguggccggcagaaugguggccgacaugugcagagccgccgugaagugcugccccgaggagagccugaagcuguucgugccccacugcugcagcgugaucacccagcugaccaugaacgacgacgugcugaacgacgaggagcuggacaaggagcugcuguggaaccugcagcugcugagcgagaucaccagaguggacggcagaaagcugcugcuguacagagagcagcuggugaagauccugcagagaacccugcaccugaccugcaagcagggcuacacccugagcugcaaccugcugcaccaccugcugagaagcaccacccugaucuaccccaccgaguacugcagcgugcccggcggcuucgacaagccccccagcgaguacuuccccaucaaggacuggggcaagcccggcgaccuguggaaccugggcauccaguggcacgugcccagcagcgaggaggugagcuucgccuucuaccugcuggacagcuuccugcagcccgagcuggugaagcugcagcacugcggcgacggcaagcuggagaugagcagagacgacauccugcagagccugaccaucgugcacaacugccugaucggcagcggcaaccugcugcccccccugaagggcgagcccgugaccaaccuggugcccagcauggugagccuggaggagaccaagcuguacaccggccuggaguacgaccugagcagagagaaccacagagaggugaucgccaccgugaucagaaagcugcugaaccacauccuggacaacagcgaggacgacaccaagagccuguuccugaucaucaagaucaucggcgaccugcugcaguuccagggcagccacaagcacgaguucgacagcagauggaagagcuucaaccuggugaagaagagcauggagaacagacugcacggcaagaagcagcacaucagagcccugcugaucgacagagugaugcugcagcacgagcugagaacccugaccguggagggcugcgaguacaagaagauccaccaggacaugaucagagaccugcugagacugagcaccagcagcuacagccaggugagaaacaaggcccagcagaccuucuucgccgcccugggcgccuacaacuucugcugcagagacaucaucccccuggugcuggaguuccugagacccgacagacagggcgugacccagcagcaguucaagggcgcccuguacugccugcugggcaaccacagcggcgugugccuggccaaccugcacgacugggacugcaucgugcagaccuggcccgccaucgugagcagcggccugagccaggccaugagccuggagaagcccagcaucgugagacuguucgacgaccuggccgagaagauccacagacaguacgagaccaucggccuggacuucaccauccccaagagcugcguggagaucgccgagcugcugcagcagagcaagaaccccagcaucaaccagauccugcugagccccgagaagaucaaggagggcaucaagagacagcaggagaagaacgccgacgcccugagaaacuacgagaaccugguggacacccugcuggacggcguggagcagagaaaccugcccuggaaguucgagcacaucggcaucggccugcugagccugcugcugagagacgacagagugcugccccugagagccaucagauucuucguggagaaccugaaccacgacgccaucguggugagaaagauggccaucagcgccguggccggcauccugaagcagcugaagagaacccacaagaagcugaccaucaaccccugcgagaucagcggcugccccaagcccacccagaucaucgccggcgacagacccgacaaccacuggcugcacuacgacagcaagaccauccccagaaccaagaaggagugggagagcagcugcuucguggagaagacccacuggggcuacuacaccuggcccaagaacauggugguguacgccggcguggaggagcagcccaagcugggcagaagcagagaggacaugaccgaggccgagcagaucaucuucgaccacuucagcgaccccaaguucguggagcagcugaucaccuuccugagccuggaggacagaaagggcaaggacaaguucaaccccagaagauucugccuguucaagggcaucuucagaaacuucgacgacgccuuccugcccgugcugaagccccaccuggagcaccugguggccgacagccacgagagcacccagagaugcguggccgagaucaucgccggccugaucagaggcagcaagcacuggaccuucgagaagguggagaagcugugggagcugcugugcccccugcugagaaccgcccugagcaacaucaccguggagaccuacaacgacuggggcgccugcaucgccaccagcugcgagagcagagaccccagaaagcugcacuggcuguucgagcugcugcuggagagcccccugagcggcgagggcggcagcuucguggacgccugcagacuguacgugcugcagggcggccuggcccagcaggaguggagagugcccgagcugcugcacagacugcugaaguaccuggagcccaagcugacccagguguacaagaacgugagagagagaaucggcagcgugcugaccuacaucuucaugaucgacgugagccugcccaacaccacccccaccaucagcccccacgugcccgaguucaccgccagaauccuggagaagcugaagccccugauggacguggacgaggagauccagaaccacgugauggaggagaacggcaucggcgaggaggacgagagaacccagggcaucaagcugcugaagaccauccugaaguggcugauggccagcgccggcagaagcuucagcaccgccgugaccgagcagcugcagcugcugccccuguucuucaagaucgcccccguggagaacgacaacagcuacgacgagcugaagagagacgccaagcugugccugagccugaugagccagggccugcuguacccccaccaggugccccuggugcugcaggugcugaagcagaccgccagaagcagcagcuggcacgccagauacaccgugcugaccuaccugcagaccaugguguucuacaaccuguucaucuuccugaacaacgaggacgccgugaaggacaucagauggcuggugaucagccugcuggaggacgagcagcuggaggugagagagauggccgccaccacccugagcggccugcugcagugcaacuuccugaccauggacagccccaugcagauccacuucgagcagcugugcaagaccaagcugcccaagaagagaaagagagaccccggcagcgugggcgacaccauccccagcgccgagcuggugaagagacacgccggcgugcugggccugggcgccugcgugcugagcagccccuacgacgugcccaccuggaugccccagcugcugaugaaccugagcgcccaccugaacgacccccagcccaucgagaugaccgugaagaagacccugagcaacuucagaagaacccaccacgacaacuggcaggagcacaagcagcaguucaccgacgaccagcugcuggugcugaccgaccugcuggugagccccugcuacuacgccuaa

SEQ ID NO: 22150 - RNA, 816 nt, Artificial Sequence
  PSMF1__Homo_sapiens__NP_848693
auggccggccuggaggugcuguucgccagcgccgcccccgccaucaccugcagacaggacgcccuggugugcuuccugcacugggagguggugacccacggcuacuucggccugggcgugggcgaccagcccggccccaacgacaagaagagcgagcugcugcccgccggcuggaacaacaacaaggaccuguacgugcugagauacgaguacaaggacggcagcagaaagcugcuggugaaggccaucaccguggagagcagcaugauccugaacgugcuggaguacggcagccagcagguggccgaccugacccugaaccuggacgacuacaucgacgccgagcaccugggcgacuuccacagaaccuacaagaacagcgaggagcugagaagcagaaucgugagcggcaucaucacccccauccacgagcagugggagaaggccaacgugagcagcccccacagagaguucccccccgccaccgccagagagguggacccccugagaauccccccccaccacccccacaccagcagacagccccccuggugcgacccccugggccccuucguggugggcggcgaggaccuggaccccuucggccccagaagaggcggcaugaucguggacccccugagaagcggcuuccccagagcccugaucgaccccagcagcggccugcccaacagacugccccccggcgccgugccccccggcgccagauucgaccccuucggccccaucggcaccagcccccccggccccaaccccgaccaccugcccccccccggcuacgacgacauguaccuguaa

SEQ ID NO: 22151 - RNA, 867 nt, Artificial Sequence
  PSMG1__Homo_sapiens__NP_003711
auggccgccaccuucuucggcgagguggugaaggcccccugcagagccggcaccgaggacgaggaggaggaggaggagggcagaagagagacccccgaggacagagaggugagacugcagcuggccagaaagagagaggugagacugcugagaagacagaccaagaccagccuggaggugagccugcuggagaaguaccccugcagcaaguucaucaucgccaucggcaacaacgccguggccuuccugagcagcuucgugaugaacagcggcgugugggaggaggugggcugcgccaagcuguggaacgaguggugcagaaccaccgacaccacccaccugagcagcaccgaggccuucugcguguucuaccaccugaagagcaaccccagcguguuccugugccagugcagcugcuacguggccgaggaccagcaguaccaguggcuggagaagguguucggcagcugccccagaaagaacaugcagaucaccauccugaccugcagacacgugaccgacuacaagaccagcgagagcaccggcagccugcccagccccuuccugagagcccugaagacccagaacuucaaggacagcgccugcugcccccugcuggagcagcccaacaucgugcacgaccugcccgccgccgugcugagcuacugccagguguggaagauccccgccauccuguaccugugcuacaccgacgugaugaagcuggaccugaucaccguggaggccuucaagcccauccugagcaccagaagccugaagggccuggugaagaacaucccccagagcaccgagauccugaagaagcugaugaccaccaacgagauccagagcaacaucuacaccuaa

SEQ ID NO: 22152 - RNA, 795 nt, Artificial Sequence
  PSMG2__Homo_sapiens__NP_064617
auguucgugcccugcggcgagagcgcccccgaccuggccggcuucacccugcugaugcccgccgugagcgugggcaacgugggccagcuggccauggaccugaucaucagcacccugaacaugagcaagaucggcuacuucuacaccgacugccuggugcccauggugggcaacaaccccuacgccaccaccgagggcaacagcaccgagcugagcaucaacgccgagguguacagccugcccagcagaaagcugguggcccugcagcugagaagcaucuucaucaaguacaagagcaagcccuucugcgagaagcugcugagcugggugaagagcagcggcugcgccagagugaucgugcugagcagcagccacagcuaccagagaaacgaccugcagcugagaagcacccccuucagauaccugcugacccccagcaugcagaagagcgugcagaacaagaucaagagccugaacugggaggagauggagaagagcagaugcauccccgagaucgacgacagcgaguucugcaucagaauccccggcggcggcaucaccaagacccuguacgacgagagcugcagcaaggagauccagauggccgugcugcugaaguucgugagcgagggcgacaacauccccgacgcccugggccugguggaguaccugaacgaguggcugcagauccugaagccccugagcgacgaccccaccgugagcgccagcagauggaagauccccagcagcuggagacugcuguucggcagcggccugccccccgcccuguucuaa

SEQ ID NO: 22153 - RNA, 369 nt, Artificial Sequence
  PSMG3__Homo_sapiens__XP_011513881
auggaggacaccccccuggugaucagcaagcagaagaccgagguggugugcggcgugcccacccagguggugugcaccgccuucagcagccacauccuggugguggugacccaguucggcaagaugggcacccuggugagccuggagcccagcagcguggccagcgacgugagcaagcccgugcugaccaccaaggugcugcugggccaggacgagccccugauccacguguucgccaagaaccugguggccuucgugagccaggaggccggcaacagagccgugcugcuggccguggccgugaaggacaagagcauggagggccugaaggcccugagagaggugaucagagugugccaggugugguaa

SEQ ID NO: 22154 - RNA, 459 nt, Artificial Sequence
  PSORS1C1__Homo_sapiens__NP_054787
augaccugcaccgaccagaagagccacagccagagagcccugggcacccagacccccgcccugcagggcccccagcugcugaacaccgaccccagcagcgaggagaccagacccccccacgugaaccccgacagacugugccacauggagcccgccaaccacuucuggcacgccggcgaccugcaggccaugaucagcaaggaguuccaccuggccgccacccaggacgacugcagaaagggcagaacccaggaggacauccuggugcccagcagccaccccgagcuguucgccagcgugcugcccauggcccccgaggaggccgccagacugcagcagccccagccccugcccccccccagcggcauccaccugagcgccagcagaacccuggcccccacccugcuguacagcagcccccccagccacagccccuucggccugagcagccugaucuaa

SEQ ID NO: 22155 - RNA, 411 nt, Artificial Sequence
  PSORS1C2__Homo_sapiens__NP_054788
augauccugaacuggaagcugcugggcauccuggugcugugccugcacaccagaggcaucagcggcagcgagggccaccccagccacccccccgccgaggacagagaggaggccggcagccccacccugccccagggcccccccgugcccggcgaccccuggcccggcgcccccccccuguucgaggaccccccccccaccagacccagcagacccuggagagaccugcccgagaccggcguguggcugcccgagccccccagaaccgaccccccccagccccccagacccgacgaccccuggcccgccggcccccagccccccgagaaccccuggccccccgcccccgagguggacaacagaccccaggaggagcccgaccuggacccccccagagaggaguacagauaa

SEQ ID NO: 22156 - RNA, 1572 nt, Artificial Sequence
  PSPC1__Homo_sapiens__XP_006719907
augaugcugagaggcaaccugaagcaggugagaaucgagaagaaccccgccagacugagagcccuggagagcgccgugggcgagagcgagcccgccgccgccgccgccauggcccuggcccuggccggcgagcccgccccccccgcccccgccccccccgaggaccaccccgacgaggagaugggcuucaccaucgacaucaagagcuuccugaagcccggcgagaagaccuacacccagagaugcagacuguucgugggcaaccugcccaccgacaucaccgaggaggacuucaagagacuguucgagagauacggcgagcccagcgagguguucaucaacagagacagaggcuucggcuucaucagacuggagagcagaacccuggccgagaucgccaaggccgagcuggacggcaccauccugaagagcagaccccugagaaucagauucgccacccacggcgccgcccugaccgugaagaaccugagccccguggugagcaacgagcugcuggagcaggccuucagccaguucggccccguggagaaggccgugguggugguggacgacagaggcagagccaccggcaagggcuucguggaguucgccgccaagccccccgccagaaaggcccuggagagaugcggcgacggcgccuuccugcugaccaccacccccagacccgugaucguggagcccauggagcaguucgacgacgaggacggccugcccgagaagcugaugcagaagacccagcaguaccacaaggagagagagcagccccccagauucgcccagcccggcaccuucgaguucgaguacgccagcagauggaaggcccuggacgagauggagaagcagcagagagagcagguggacagaaacaucagagaggccaaggagaagcuggaggccgagauggaggccgccagacacgagcaccagcugaugcugaugagacaggaccugaugagaagacaggaggagcugagaagacuggaggagcugagaaaccaggagcugcagaagagaaagcagauccagcugagacacgaggaggagcacagaagaagagaggaggagaugaucagacacagagagcaggaggagcugagaagacagcaggagggcuucaagcccaacuacauggagaacagagagcaggagaugagaaugggcgacaugggccccagaggcgccaucaacaugggcgacgccuucagccccgcccccgccggcaaccagggccccccccccaugaugggcaugaacaugaacaacagagccaccauccccggcccccccaugggccccggccccgccaugggccccgagggcgccgccaacaugggcacccccaugaugcccgacaacggcgccgugcacaacgacagauucccccagggcccccccagccagaugggcagccccaugggcagcagaaccggcagcgagaccccccaggcccccaugagcggcgugggccccgugagcggcggccccggcggcuucggcagaggcagccagggcggcaacuucgagggccccaacaagagaagaagauacuaa

SEQ ID NO: 22157 - RNA, 678 nt, Artificial Sequence
  PSPH__Homo_sapiens__XP_011513763
auggugagccacagcgagcugagaaagcuguucuacagcgccgacgccgugugcuucgacguggacagcaccgugaucagagaggagggcaucgacgagcuggccaagaucugcggcguggaggacgccgugagcgagaugaccagaagagccaugggcggcgccgugcccuucaaggccgcccugaccgagagacuggcccugauccagcccagcagagagcaggugcagagacugaucgccgagcagcccccccaccugacccccggcaucagagagcuggugagcagacugcaggagagaaacgugcagguguuccugaucagcggcggcuucagaagcaucguggagcacguggccagcaagcugaacauccccgccaccaacguguucgccaacagacugaaguucuacuucaacggcgaguacgccggcuucgacgagacccagcccaccgccgagagcggcggcaagggcaaggugaucaagcugcugaaggagaaguuccacuucaagaagaucaucaugaucggcgacggcgccaccgacauggaggccugcccccccgccgacgccuucaucggcuucggcggcaacgugaucagacagcaggugaaggacaacgccaagugguacaucaccgacuucguggagcugcugggcgagcuggaggaguaa

SEQ ID NO: 22158 - RNA, 471 nt, Artificial Sequence
  PSPN__Homo_sapiens__NP_004149
auggccgugggcaaguuccugcugggcagccugcugcugcugagccugcagcugggccagggcuggggccccgacgccagaggcgugcccguggccgacggcgaguucagcagcgagcagguggccaaggccggcggcaccuggcugggcacccacagaccccuggccagacugagaagagcccugagcggccccugccagcuguggagccugacccugagcguggccgagcugggccugggcuacgccagcgaggagaaggugaucuucagauacugcgccggcagcugccccagaggcgccagaacccagcacggccuggcccuggccagacugcagggccagggcagagcccacggcggccccugcugcagacccaccagauacaccgacguggccuuccuggacgacagacacagauggcagagacugccccagcugagcgccgccgccugcggcugcggcggcuaa

SEQ ID NO: 22159 - RNA, 1251 nt, Artificial Sequence
  PSTPIP1__Homo_sapiens__NP_003969
augaugccccagcugcaguucaaggacgccuucuggugcagagacuucaccgcccacaccggcuacgaggugcugcugcagagacugcuggacggcagaaagaugugcaaggacauggaggagcugcugagacagagagcccaggccgaggagagauacggcaaggagcuggugcagaucgccagaaaggccggcggccagaccgagaucaacagccugagagccagcuucgacagccugaagcagcagauggagaacgugggcagcagccacauccagcuggcccugacccugagagaggagcugagaagccuggaggaguucagagagagacagaaggagcagagaaagaaguacgaggccgugauggacagagugcagaagagcaagcugagccuguacaagaaggccauggagagcaagaagaccuacgagcagaagugcagagacgccgacgacgccgagcaggccuucgagagaaucagcgccaacggccaccagaagcagguggagaagagccagaacaaggccagacagugcaaggacagcgccaccgaggccgagagaguguacagacagagcaucgcccagcuggagaaggugagagccgagugggagcaggagcacagaaccaccugcgaggccuuccagcugcaggaguucgacagacugaccauccugagaaacgcccugugggugcacagcaaccagcugagcaugcagugcgugaaggacgacgagcuguacgaggaggugagacugacccuggagggcugcagcaucgacgccgacaucgacagcuucauccaggccaagagcaccggcaccgagccccccgcccccgugcccuaccagaacuacuacgacagagaggugaccccccugaccagcagccccggcauccagcccagcugcggcaugaucaagagauucagcggccugcugcacggcagccccaagaccaccagccuggccgccagcgccgccagcaccgagacccugacccccacccccgagagaaacgagggcguguacaccgccaucgccgugcaggagauccagggcaaccccgccagccccgcccaggaguacagagcccuguacgacuacaccgcccagaaccccgacgagcuggaccugagcgccggcgacauccuggaggugauccuggagggcgaggacggcugguggaccguggagagaaacggccagagaggcuucgugcccggcagcuaccuggagaagcuguaa

SEQ ID NO: 22160 - RNA, 1005 nt, Artificial Sequence
  PSTPIP2__Homo_sapiens__NP_077748
augaccagaagccuguucaagggcaacuucuggagcgccgacauccugagcaccaucggcuacgacaacaucauccagcaccugaacaacggcagaaagaacugcaaggaguucgaggacuuccugaaggagagagccgccaucgaggagagauacggcaaggaccugcugaaccugagcagaaagaagcccugcggccagagcgagaucaacacccugaagagagcccuggagguguucaagcagcagguggacaacguggcccagugccacauccagcuggcccagagccugagagaggaggccagaaagauggaggaguucagagagaagcagaagcugcagagaaagaagaccgagcugaucauggacgccauccacaagcagaagagccugcaguucaagaagaccauggacgccaagaagaacuacgagcagaagugcagagacaaggacgaggccgagcaggccgugagcagaagcgccaaccuggugaaccccaagcagcaggagaagcuguucgugaagcuggccaccagcaagaccgccguggaggacagcgacaaggccuacaugcugcacaucggcacccuggacaaggugagagaggaguggcagagcgagcacaucaaggccugcgaggccuucgaggcccaggagugcgagagaaucaacuucuucagaaacgcccuguggcugcacgugaaccagcugagccagcagugcgugaccagcgacgagauguacgagcaggugagaaagagccuggagaugugcagcauccagagagacaucgaguacuucgugaaccagagaaagaccggccagaucccccccgcccccaucauguacgagaacuucuacagcagccagaagaacgccgugcccgccggcaaggccaccggccccaaccuggccagaagaggcccccugcccauccccaagagcagccccgacgaccccaacuacagccugguggacgacuacagccugcuguaccaguaa

SEQ ID NO: 22161 - RNA, 1674 nt, Artificial Sequence
  PTBP1__Homo_sapiens__NP_002810
auggacggcaucgugcccgacaucgccgugggcaccaagagaggcagcgacgagcuguucagcaccugcgugaccaacggccccuucaucaugagcagcaacagcgccagcgccgccaacggcaacgacagcaagaaguucaagggcgacagcagaagcgccggcgugcccagcagagugauccacaucagaaagcugcccaucgacgugaccgagggcgaggugaucagccugggccugcccuucggcaaggugaccaaccugcugaugcugaagggcaagaaccaggccuucaucgagaugaacaccgaggaggccgccaacaccauggugaacuacuacaccagcgugacccccgugcugagaggccagcccaucuacauccaguucagcaaccacaaggagcugaagaccgacagcagccccaaccaggccagagcccaggccgcccugcaggccgugaacagcgugcagagcggcaaccuggcccuggccgccagcgccgccgccguggacgccggcauggccauggccggccagagccccgugcugagaaucaucguggagaaccuguucuaccccgugacccuggacgugcugcaccagaucuucagcaaguucggcaccgugcugaagaucaucaccuucaccaagaacaaccaguuccaggcccugcugcaguacgccgaccccgugagcgcccagcacgccaagcugagccuggacggccagaacaucuacaacgccugcugcacccugagaaucgacuucagcaagcugaccagccugaacgugaaguacaacaacgacaagagcagagacuacaccagacccgaccugcccagcggcgacagccagcccagccuggaccagaccauggccgccgccuucggcgcccccggcaucaucagcgccagccccuacgccggcgccggcuucccccccaccuucgccaucccccaggccgccggccugagcgugcccaacgugcacggcgcccuggccccccuggccauccccagcgccgccgccgccgccgccgccgccggcagaaucgccauccccggccuggccggcgccggcaacagcgugcugcuggugagcaaccugaaccccgagagagugaccccccagagccuguucauccuguucggcguguacggcgacgugcagagagugaagauccuguucaacaagaaggagaacgcccuggugcagauggccgacggcaaccaggcccagcuggccaugagccaccugaacggccacaagcugcacggcaagcccaucagaaucacccugagcaagcaccagaacgugcagcugcccagagagggccaggaggaccagggccugaccaaggacuacggcaacagcccccugcacagauucaagaagcccggcagcaagaacuuccagaacaucuucccccccagcgccacccugcaccugagcaacaucccccccagcgugagcgaggaggaccugaaggugcuguucagcagcaacggcggcguggugaagggcuucaaguucuuccagaaggacagaaagauggcccugauccagaugggcagcguggaggaggccgugcaggcccugaucgaccugcacaaccacgaccugggcgagaaccaccaccugagagugagcuucagcaagagcaccaucuaa

SEQ ID NO: 22162 - RNA, 1614 nt, Artificial Sequence
  PTBP2__Homo_sapiens__NP_001287914
auggacggcaucgugaccgagguggccgugggcgugaagagaggcagcgacgagcugcugagcggcagcgugcugagcagccccaacagcaacaugagcagcaugguggugaccgccaacggcaacgacagcaagaaguucaagggcgaggacaagauggacggcgcccccagcagagugcugcacaucagaaagcugcccggcgaggugaccgagaccgaggugaucgcccugggccugcccuucggcaaggugaccaacauccugaugcugaagggcaagaaccaggccuuccuggagcuggccaccgaggaggccgccaucaccauggugaacuacuacagcgccgugaccccccaccugagaaaccagcccaucuacauccaguacagcaaccacaaggagcugaagaccgacaacacccugaaccagagagcccaggccgugcugcaggccgugaccgccgugcagaccgccaacaccccccugagcggcaccaccgugagcgagagcgccgugacccccgcccagagccccgugcugagaaucaucaucgacaacauguacuaccccgugacccuggacgugcugcaccagaucuucagcaaguucggcgccgugcugaagaucaucaccuucaccaagaacaaccaguuccaggcccugcugcaguacggcgaccccgugaacgcccagcaggccaagcuggcccuggacggccagaacaucuacaacgccugcugcacccugagaaucgacuucagcaagcuggugaaccugaacgugaaguacaacaacgacaagagcagagacuacaccagacccgaccugcccagcggcgacggccagcccgcccuggaccccgccaucgccgccgccuucgccaaggagaccagccugcugggccugcccguggccgccgugcccggcgcccugagcccccuggccauccccaacgccgccgccgccgccgccgccgccgccgccggcagagugggcaugcccggcgugagcgccggcggcaacaccgugcugcuggugagcaaccugaacgaggagauggugaccccccagagccuguucacccuguucggcguguacggcgacgugcagagagugaagauccuguacaacaagaaggacagcgcccugauccagauggccgacggcaaccagagccagcuggccaugaaccaccugaacggccagaagauguacggcaagaucaucagagugacccugagcaagcaccagaccgugcagcugcccagagagggccuggacgaccagggccugaccaaggacuucggcaacagcccccugcacagauucaagaagcccggcagcaagaacuuccagaacaucuucccccccagcgccacccugcaccugagcaacaucccccccagcguggccgaggaggaccugagaacccuguucgccaacaccggcggcaccgugaaggccuucaaguucuuccagagagaccacaagauggcccugcugcagauggccaccguggaggaggccauccaggcccugaucgaccugcacaacuacaaccugggcgagaaccaccaccugagagugagcuucagcaagagcaccaucuaa

SEQ ID NO: 22163 - RNA, 2103 nt, Artificial Sequence
  PTCD1__Homo_sapiens__NP_056360
auggacuucgugagacuggccagacuguucgccagagccagacccaugggccuguucauccugcagcaccuggaccccugcagagccagaugggccggcggcagagagggccugaugagacccaugugggcccccuucagcagcagcagcagccagcugccccugggccaggagagacaggagaacaccggcagccugggcagcgaccccagccacagcaacagcaccgccacccaggaggaggacgaggaggaggaggagagcuucggcacccugagcgacaaguacagcagcagaagacuguucagaaagagcgccgcccaguuccacaaccugagauucggcgagagaagagacgagcagauggagcccgagcccaagcuguggagaggcagaagaaacacccccuacugguacuuccugcagugcaagcaccugaucaaggagggcaagcugguggaggcccuggaccuguucgagagacagaugcugaaggaggagagacugcagcccauggagagcaacuacaccgugcugaucggcggcugcggcagagugggcuaccugaagaaggccuucaaccuguacaaccagaugaagaagagagaccuggagcccagcgacgccaccuacaccgcccuguucaacgugugcgccgagagccccuggaaggacagcgcccugcagagcgcccugaagcugagacagcagcugcaggccaagaacuucgagcugaaccugaagaccuaccacgcccugcugaagauggccgccaagugcgccgaccugagaaugugccuggacguguucaaggagaucauccacaagggccacguggugaccgaggagaccuucagcuuccugcugaugggcugcauccaggacaagaagaccggcuucagauacgcccugcagguguggagacugaugcugagccugggccugcagcccagcagagacagcuacaaccugcugcugguggccgccagagacugcggccugggcgacccccagguggccagcgagcugcugcugaagcccagagaggaggccaccgugcugcagccccccgugagcagacagagacccagaagaaccgcccaggccaaggccggcaaccugaugagcgccaugcugcacguggaggcccuggagagacagcuguuccuggagcccagccaggcccugggcccccccgagccccccgaggccagagugcccggcaaggcccagcccgagguggacaccaaggccgagcccagccacaccgccgcccugaccgccguggcccugaagcccccccccguggagcuggaggugaaccugcugacccccggcgccgugccccccaccguggugagcuucggcaccgugaccacccccgccgacagacuggcccugaucggcggccuggagggcuuccugagcaagauggccgagcacagacagcagcccgacaucagaacccugacccugcuggccgaggugguggagagcggcagccccgccgagagccugcugcuggcccugcuggacgagcaccagguggaggccgaccugaccuucuucaacacccuggugagaaagaagagcaagcugggcgaccuggagggcgccaaggcccugcugcccgugcuggccaagagaggccuggugcccaaccugcagaccuucugcaaccuggccaucggcugccacagacccaaggacggccugcagcugcugaccgacaugaagaagagccaggugacccccaacacccacaucuacagcgcccugaucaacgccgccaucagaaagcugaacuacaccuaccugaucagcauccugaaggacaugaagcagaacagagugcccgugaacgagguggugaucagacagcuggaguucgccgcccaguacccccccaccuucgacagauaccagggcaagaacaccuaccuggagaagaucgacggcuucagagccuacuacaagcaguggcugaccgugaugcccgccgaggagaccccccaccccuggcagaaguucagaaccaagccccagggcgaccaggacaccggcaaggaggccgacgacggcugcgcccugggcggcagauaa

SEQ ID NO: 22164 - RNA, 4344 nt, Artificial Sequence
  PTCH1__Homo_sapiens__NP_000255
auggccagcgccggcaacgccgccgagccccaggacagaggcggcggcggcagcggcugcaucggcgcccccggcagacccgccggcggcggcagaagaagaagaaccggcggccugagaagagccgccgcccccgacagagacuaccugcacagacccagcuacugcgacgccgccuucgcccuggagcagaucagcaagggcaaggccaccggcagaaaggccccccuguggcugagagccaaguuccagagacugcuguucaagcugggcugcuacauccagaagaacugcggcaaguuccugguggugggccugcugaucuucggcgccuucgccgugggccugaaggccgccaaccuggagaccaacguggaggagcuguggguggaggugggcggcagagugagcagagagcugaacuacaccagacagaagaucggcgaggaggccauguucaacccccagcugaugauccagacccccaaggaggagggcgccaacgugcugaccaccgaggcccugcugcagcaccuggacagcgcccugcaggccagcagagugcacguguacauguacaacagacaguggaagcuggagcaccugugcuacaagagcggcgagcugaucaccgagaccggcuacauggaccagaucaucgaguaccuguaccccugccugaucaucaccccccuggacugcuucugggagggcgccaagcugcagagcggcaccgccuaccugcugggcaagcccccccugagauggaccaacuucgacccccuggaguuccuggaggagcugaagaagaucaacuaccagguggacagcugggaggagaugcugaacaaggccgaggugggccacggcuacauggacagacccugccugaaccccgccgaccccgacugccccgccaccgcccccaacaagaacagcaccaagccccuggacauggcccuggugcugaacggcggcugccacggccugagcagaaaguacaugcacuggcaggaggagcugaucgugggcggcaccgugaagaacagcaccggcaagcuggugagcgcccacgcccugcagaccauguuccagcugaugacccccaagcagauguacgagcacuucaagggcuacgaguacgugagccacaucaacuggaacgaggacaaggccgccgccauccuggaggccuggcagagaaccuacguggagguggugcaccagagcguggcccagaacagcacccagaaggugcugagcuucaccaccaccacccuggacgacauccugaagagcuucagcgacgugagcgugaucagaguggccagcggcuaccugcugaugcuggccuacgccugccugaccaugcugagaugggacugcagcaagagccagggcgccgugggccuggccggcgugcugcugguggcccugagcguggccgccggccugggccugugcagccugaucggcaucagcuucaacgccgccaccacccaggugcugcccuuccuggcccugggcgugggcguggacgacguguuccugcuggcccacgccuucagcgagaccggccagaacaagagaauccccuucgaggacagaaccggcgagugccugaagagaaccggcgccagcguggcccugaccagcaucagcaacgugaccgccuucuucauggccgcccugauccccauccccgcccugagagccuucagccugcaggccgccgugguggugguguucaacuucgccauggugcugcugaucuuccccgccauccugagcauggaccuguacagaagagaggacagaagacuggacaucuucugcugcuucaccagccccugcgugagcagagugauccagguggagccccaggccuacaccgacacccacgacaacaccagauacagcccccccccccccuacagcagccacagcuucgcccacgagacccagaucaccaugcagagcaccgugcagcugagaaccgaguacgacccccacacccacguguacuacaccaccgccgagcccagaagcgagaucagcgugcagcccgugaccgugacccaggacacccugagcugccagagccccgagagcaccagcagcaccagagaccugcugagccaguucagcgacagcagccugcacugccuggagccccccugcaccaaguggacccugagcagcuucgccgagaagcacuacgcccccuuccugcugaagcccaaggccaaggugguggugaucuuccuguuccugggccugcugggcgugagccuguacggcaccaccagagugagagacggccuggaccugaccgacaucgugcccagagagaccagagaguacgacuucaucgccgcccaguucaaguacuucagcuucuacaacauguacaucgugacccagaaggccgacuaccccaacauccagcaccugcuguacgaccugcacagaagcuucagcaacgugaaguacgugaugcuggaggagaacaagcagcugcccaagauguggcugcacuacuucagagacuggcugcagggccugcaggacgccuucgacagcgacugggagaccggcaagaucaugcccaacaacuacaagaacggcagcgacgacggcgugcuggccuacaagcugcuggugcagaccggcagcagagacaagcccaucgacaucagccagcugaccaagcagagacugguggacgccgacggcaucaucaaccccagcgccuucuacaucuaccugaccgccugggugagcaacgaccccguggccuacgccgccagccaggccaacaucagaccccacagacccgagugggugcacgacaaggccgacuacaugcccgagaccagacugagaauccccgccgccgagcccaucgaguacgcccaguuccccuucuaccugaacggccugagagacaccagcgacuucguggaggccaucgagaaggugagaaccaucugcagcaacuacaccagccugggccugagcagcuaccccaacggcuaccccuuccuguucugggagcaguacaucggccugagacacuggcugcugcuguucaucagcguggugcuggccugcaccuuccuggugugcgccguguuccugcugaaccccuggaccgccggcaucaucgugauggugcuggcccugaugaccguggagcuguucggcaugaugggccugaucggcaucaagcugagcgccgugcccguggugauccugaucgccagcgugggcaucggcguggaguucaccgugcacguggcccuggccuuccugaccgccaucggcgacaagaacagaagagccgugcuggcccuggagcacauguucgcccccgugcuggacggcgccgugagcacccugcugggcgugcugaugcuggccggcagcgaguucgacuucaucgugagauacuucuucgccgugcuggccauccugaccauccugggcgugcugaacggccuggugcugcugcccgugcugcugagcuucuucggccccuaccccgaggugagccccgccaacggccugaacagacugcccacccccagccccgagcccccccccagcguggugagauucgccaugccccccggccacacccacagcggcagcgacagcagcgacagcgaguacagcagccagaccaccgugagcggccugagcgaggagcugagacacuacgaggcccagcagggcgccggcggccccgcccaccaggugaucguggaggccaccgagaaccccguguucgcccacagcaccguggugcaccccgagagcagacaccacccccccagcaaccccagacagcagccccaccuggacagcggcagccugccccccggcagacagggccagcagcccagaagagacccccccagagagggccuguggcccccccccuacagacccagaagagacgccuucgagaucagcaccgagggccacagcggccccagcaacagagccagauggggccccagaggcgccagaagccacaaccccagaaaccccgccagcaccgccaugggcagcagcgugcccggcuacugccagcccaucaccaccgugaccgccagcgccagcgugaccguggccgugcaccccccccccgugcccggccccggcagaaaccccagaggcggccugugccccggcuaccccgagaccgaccacggccuguucgaggacccccacgugcccuuccacgugagaugcgagagaagagacagcaagguggaggugaucgagcugcaggacguggagugcgaggagagacccagaggcagcagcagcaacuaa

SEQ ID NO: 22165 - RNA, 2667 nt, Artificial Sequence
  PTCHD1__Homo_sapiens__NP_775766
augcugagacaggugcugcacagaggccugagaaccugcuucagcagacugggccacuucaucgccagccaccccguguucuucgccagcgcccccgugcugaucagcauccugcugggcgccagcuucagcagauaccagguggaggagagcguggagcaccugcuggccccccagcacagccuggccaagaucgagagaaaccuggugaacagccuguuccccgugaacagaagcaagcacagacuguacagcgaccugcagacccccggcagauacggcagagugaucgugaccagcuuccagaaggccaacaugcuggaccagcaccacaccgaccugauccugaagcugcacgccgccgugaccaagauccaggugcccagacccggcuucaacuacaccuucgcccacaucugcauccugaacaacgacaagaccugcaucguggacgacaucgugcacgugcuggaggagcugaagaacgccagagccaccaacagaaccaacuucgccaucaccuaccccaucacccaccugaaggacggcagagccguguacaacggccaccagcugggcggcgugaccgugcacagcaaggacagagugaagagcgccgaggccauccagcugaccuacuaccugcagagcaucaacagccugaacgacaugguggccgagagaugggagagcagcuucugcgacaccgugagacuguuccagaagagcaacagcaaggugaagauguaccccuacaccagcagcagccugagagaggacuuccagaagaccagcagagugagcgagagauaccuggugaccagccugauccugguggugaccauggccauccugugcugcagcaugcaggacugcgugagaagcaagcccuggcugggccugcugggccuggugaccaucagccuggccacccugaccgccgccggcaucaucaaccugaccggcggcaaguacaacagcaccuuccugggcgugcccuucgugaugcugggccacggccuguacggcaccuucgagaugcugagcagcuggagaaagaccagagaggaccagcacgugaaggagagaaccgccgccguguacgccgacagcaugcugagcuucagccugaccaccgccauguaccuggugaccuucggcaucggcgccagccccuucaccaacaucgaggccgccagaaucuucugcugcaacagcugcaucgccaucuucuucaacuaccuguacgugcugagcuucuacggcagcagccugguguucaccggcuacaucgagaacaacuaccagcacagcaucuucugcagaaaggugcccaagcccgaggcccugcaggagaagcccgccugguacagauuccugcugaccgccagauucagcgaggacaccgccgagggcgaggaggccaacaccuacgagagccaccugcuggugugcuuccugaagagauacuacugcgacuggaucaccaacaccuacgugaagcccuucguggugcuguucuaccugaucuacaucagcuucgcccugaugggcuaccugcaggugagcgagggcagcgaccugagcaacaucguggccaccgccacccagaccaucgaguacaccaccgcccagcagaaguacuucagcaacuacagccccgugaucggcuucuacaucuacgagagcaucgaguacuggaacaccagcgugcaggaggacgugcuggaguacaccaagggcuucgugagaaucagcugguucgagagcuaccugaacuaccugagaaagcugaacgugagcaccggccugcccaagaagaacuucaccgacaugcugagaaacagcuuccugaaggccccccaguucagccacuuccaggaggacaucaucuucagcaagaaguacaacgacgagguggacgugguggccagcagaauguuccugguggccaagaccauggagaccaacagagaggagcuguacgaccugcuggagacccugagaagacugagcgugaccagcaaggugaaguucaucguguucaaccccagcuucguguacauggacagauacgccagcagccugggcgccccccugcacaacagcugcaucagcgcccuguuccugcuguucuucagcgccuuccugguggccgacagccugaucaacguguggaucacccugaccguggugagcguggaguucggcgugaucggcuucaugacccuguggaagguggagcuggacugcaucagcgugcugugccugaucuacggcaucaacuacaccaucgacaacugcgcccccaugcugagcaccuucgugcugggcaaggacuucaccagaaccaagugggugaagaacgcccuggaggugcacggcguggccauccugcagagcuaccugugcuacaucgugggccugaucccccuggccgccgugcccagcaaccugaccugcacccuguucagaugccuguuccugaucgccuucgugaccuucuuccacugcuucgccauccugcccgugauccugaccuuccugccccccagcaagaagaagagaaaggagaagaagaaccccgagaacagagaggagaucgagugcguggagaugguggacaucgacagcaccagagugguggaccagaucaccaccguguaa

SEQ ID NO: 22166 - RNA, 2541 nt, Artificial Sequence
  PTCHD4__Homo_sapiens__NP_001013754
augugcuuccugagaagacccggcgcccccgccagcuggaucugguggagaaugcugagacaggugcugagaagaggccugcagagcuucugccacagacugggccugugcgugagcagacaccccguguucuuccugaccgugcccgccgugcugaccaucaccuucggccugagcgcccugaacagauuccagcccgagggcgaccuggagagacugguggcccccagccacagccuggccaagaucgagagaagccuggccagcagccuguucccccuggaccagagcaagagccagcuguacagcgaccugcacacccccggcagauacggcagagugauccugcugagccccaccggcgacaacauccugcugcaggccgagggcauccugcagacccacagagccgugcuggagaugaaggacggcagaaacagcuucaucggccaccagcugggcggcgugguggaggugcccaacagcaaggaccagagagugaagagcgccagagccauccagaucaccuacuaccugcagaccuacggcagcgccacccaggaccugaucggcgagaagugggagaacgaguucugcaagcugaucagaaagcugcaggaggagcaccaggagcugcagcuguacagccuggccagcuucagccuguggagagacuuccacaagaccagcauccuggccagaagcaaggugcuggugagccuggugcugauccugaccaccgccacccugagcagcagcaugaaggacugccugagaagcaagcccuuccugggccugcugggcgugcugaccgugugcaucagcaucaucaccgccgccggcaucuucuucaucaccgacggcaaguacaacagcacccugcugggcauccccuucuucgccaugggccacggcaccaagggcguguucgagcugcugagcggcuggagaagaaccaaggagaaccugcccuucaaggacagaaucgccgacgccuacagcgacgugauggugaccuacaccaugaccagcagccuguacuucaucaccuucggcaugggcgccagccccuucaccaacaucgaggccgugaagguguucugccagaacaugugcgugagcauccugcugaacuacuucuacaucuucagcuucuucggcagcugccugguguucgccggccagcuggagcagaacagauaccacagcaucuucugcugcaagauccccagcgccgaguaccuggacagaaagcccgugugguuccagaccgugaugagcgacggccaccagcagaccagccaccacgagaccaaccccuaccagcaccacuucauccagcacuuccugagagagcacuacaacgaguggaucaccaacaucuacgugaagcccuucguggugauccuguaccugaucuacgccagcuucagcuucaugggcugccugcagaucagcgacggcgccaacaucaucaaccugcuggccagcgacagccccagcgugagcuacgccauggugcagcagaaguacuucagcaacuacagccccgugaucggcuucuacguguacgagccccuggaguacuggaacagcagcgugcaggacgaccugagaagacugugcagcggcuucaccgccgugagcuggguggagcaguacuaccaguuccugaaggugagcaacgugagcgccaacaacaagagcgacuucaucagcgugcugcagagcagcuuccugaagaagcccgaguuccagcacuucagaaacgacaucaucuucagcaaggccggcgacgagagcaacaucaucgccagcagacuguaccugguggccagaaccagcagagacaagcagaaggagaucaccgaggugcuggagaagcugagaccccugagccugagcaagagcaucagauucaucguguucaaccccagcuucguguucauggaccacuacagccugagcgugaccgugcccgugcugaucgccggcuucggcgugcugcuggugcugauccugaccuucuuccuggugauccacccccugggcaacuucuggcugauccugagcgugaccagcaucgagcugggcgugcugggccugaugacccuguggaacguggacauggacugcaucagcauccugugccugaucuacacccugaacuucgccaucgaccacugcgccccccugcuguucaccuucgugcuggccaccgagcacaccagaacccagugcaucaagagcagccugcaggaccacggcaccgccauccugcagaacgugaccagcuuccugaucggccuggugccccugcuguucgugcccagcaaccugaccuucacccuguucaagugccugcugcugaccggcggcugcacccugcugcacugcuucgugauccugcccguguuccugaccuucuucccccccagcaagaagcaccacaagaagaagaagagagccaagagaaaggagagagaggagaucgagugcaucgagauccaggagaaccccgaccacgugaccaccguguaa

SEQ ID NO: 22167 - RNA, 771 nt, Artificial Sequence
  PTCRA__Homo_sapiens__NP_001230098
auggccggcaccuggcugcugcugcugcuggcccugggcugccccgcccugcccaccggccccgugagcuuccccagcagccccgaggccgccaccaccggccccaucugguucagcgccggcaacggcagcgcccuggacgccuucaccuacggccccagccccgccaccgacggcaccuggaccaaccuggcccaccugagccugcccagcgaggagcuggccagcugggagccccuggugugccacaccggccccggcgccgagggccacagcagaagcacccagcccaugcaccugagcggcgaggccagcaccgccagaaccugcccccaggagccccugagaggcacccccggcggcgcccuguggcugggcgugcugagacugcugcuguucaagcugcugcuguucgaccugcugcugaccugcagcugccugugcgaccccgccggcccccugcccagccccgccaccaccaccagacugagagcccugggcagccacagacugcaccccgccaccgagaccggcggcagagaggccaccagcagccccagaccccagcccagagacagaagauggggcgacaccccccccggcagaaagcccggcagccccguguggggcgagggcagcuaccugagcagcuaccccaccugccccgcccaggccuggugcagcagaagcgcccugagagcccccagcagcagccugggcgccuucuucgccggcgaccugccccccccccugcaggccggcgccgccuaa

SEQ ID NO: 22168 - RNA, 984 nt, Artificial Sequence
  PTDSS1__Homo_sapiens__NP_001277154
auggaguacgccgugaacugccacgugaucaccugggagagaaucaucagccacuucgacaucuucgccuucggccacuucuggggcugggccaugaaggcccugcugaucagaagcuacggccugugcuggaccaucagcaucaccugggagcugaccgagcuguucuucaugcaccugcugcccaacuucgccgagugcuggugggaccaggugauccuggacauccugcugugcaacggcggcggcaucuggcugggcaugguggugugcagauuccuggagaugagaaccuaccacugggccagcuucaaggacauccacaccaccaccggcaagaucaagagagccgugcugcaguucacccccgccagcuggaccuacgugagaugguucgaccccaagagcagcuuccagagaguggccggcguguaccuguucaugaucaucuggcagcugaccgagcugaacaccuucuuccugaagcacaucuucguguuccaggccagccacccccugagcuggggcagaauccuguucaucggcggcaucaccgcccccaccgugagacaguacuacgccuaccugaccgacacccagugcaagagagugggcacccagugcuggguguucggcgugaucggcuuccuggaggccaucgugugcaucaaguucggccaggaccuguucagcaagacccagauccuguacguggugcuguggcugcugugcguggccuucaccaccuuccugugccuguacggcaugaucugguacgccgagcacuacggccacagagagaagaccuacagcgagugcgaggacggcaccuacagccccgagaucagcuggcaccacagaaagggcaccaagggcagcgaggacagcccccccaagcacgccggcaacaacgagagccacagcagcagaagaagaaacagacacagcaagagcaaggugaccaacggcgugggcaagaaguaa

SEQ ID NO: 22169 - RNA, 1212 nt, Artificial Sequence
  PTEN__Homo_sapiens__NP_000305
augaccgccaucaucaaggagaucgugagcagaaacaagagaagauaccaggaggacggcuucgaccuggaccugaccuacaucuaccccaacaucaucgccaugggcuuccccgccgagagacuggagggcguguacagaaacaacaucgacgacguggugagauuccuggacagcaagcacaagaaccacuacaagaucuacaaccugugcgccgagagacacuacgacaccgccaaguucaacugcagaguggcccaguaccccuucgaggaccacaaccccccccagcuggagcugaucaagcccuucugcgaggaccuggaccaguggcugagcgaggacgacaaccacguggccgccauccacugcaaggccggcaagggcagaaccggcgugaugaucugcgccuaccugcugcacagaggcaaguuccugaaggcccaggaggcccuggacuucuacggcgaggugagaaccagagacaagaagggcgugaccauccccagccagagaagauacguguacuacuacagcuaccugcugaagaaccaccuggacuacagacccguggcccugcuguuccacaagaugauguucgagaccauccccauguucagcggcggcaccugcaacccccaguucguggugugccagcugaaggugaagaucuacagcagcaacagcggccccaccagaagagaggacaaguucauguacuucgaguucccccagccccugcccgugugcggcgacaucaagguggaguucuuccacaagcagaacaagaugcugaagaaggacaagauguuccacuucugggugaacaccuucuucauccccggccccgaggagaccagcgagaagguggagaacggcagccugugcgaccaggagaucgacagcaucugcagcaucgagagagccgacaacgacaaggaguaccuggugcugacccugaccaagaacgaccuggacaaggccaacaaggacaaggccaacagauacuucagccccaacuucaaggugaagcuguacuucaccaagaccguggaggagcccagcaaccccgaggccagcagcagcaccagcgugacccccgacgugagcgacaacgagcccgaccacuacagauacagcgacaccaccgacagcgaccccgagaacgagcccuucgacgaggaccagcacacccagaucaccaagguguaa

SEQ ID NO: 22170 - RNA, 909 nt, Artificial Sequence
  PTER__Homo_sapiens__NP_001248766
augagcagccugagcggcaaggugcagaccgugcugggccugguggagcccagcaagcugggcagaacccugacccacgagcaccuggccaugaccuucgacugcugcuacugcccccccccccccugccaggaggccaucagcaaggagcccaucgugaugaagaaccuguacuggauccagaagaacgccuacagccacaaggagaaccugcagcugaaccaggagaccgaggccaucaaggaggagcugcuguacuucaaggccaacggcggcggcgcccugguggagaacaccaccaccggcaucagcagagacacccagacccugaagagacuggccgaggagaccggcgugcacaucaucagcggcgccggcuucuacguggacgccacccacagcagcgagaccagagccaugagcguggagcagcugaccgacgugcugaugaacgagauccugcacggcgccgacggcaccagcaucaagugcggcaucaucggcgagaucggcugcagcuggccccugaccgagagcgagagaaaggugcugcaggccaccgcccacgcccaggcccagcugggcugccccgugaucauccaccccggcagaagcagcagagcccccuuccagaucaucagaauccugcaggaggccggcgccgacaucagcaagaccgugaugagccaccuggacagagugagacugcugguggaggagggcugcgaggacagaauccugguggcccacgacauccacaccaagaccagacugaugaaguacggcggccacggcuacagccacauccugaccaacguggugcccaagaugcugcugagaggcaucaccgagaacgugcuggacaagauccugaucgagaaccccaagcaguggcugaccuucaaguaa

SEQ ID NO: 22171 - RNA, 987 nt, Artificial Sequence
  PTF1A__Homo_sapiens__NP_835455
auggacgccgugcugcuggagcacuuccccggcggccuggacgccuuccccagcagcuacuucgacgaggacgacuucuucaccgaccagagcagcagagacccccuggaggacggcgacgagcugcuggccgacgagcaggccgagguggaguuccugagccaccagcugcacgaguacugcuacagagacggcgccugccugcugcugcagcccgccccccccgccgccccccuggcccuggccccccccagcagcggcggccugggcgagcccgacgacggcggcggcggcggcuacugcugcgagaccggcgccccccccggcggcuuccccuacagccccggcagcccccccagcugccuggccuaccccugcgccggcgccgccgugcugagccccggcgccagacugagaggccugagcggcgccgccgccgccgccgccagaagaagaagaagagugagaagcgaggccgagcugcagcagcugagacaggccgccaacgugagagagagaagaagaaugcagagcaucaacgacgccuucgagggccugagaagccacauccccacccugcccuacgagaagagacugagcaagguggacacccugagacuggccaucggcuacaucaacuuccugagcgagcuggugcaggccgaccugccccugagaggcggcggcgccggcggcugcggcggccccggcggcggcggcagacugggcggcgacagccccggcagccaggcccagaaggugaucaucugccacagaggcaccagaagccccagccccagcgaccccgacuacggccugcccccccuggccggccacagccugagcuggaccgacgagaagcagcugaaggagcagaacaucaucagaaccgccaagguguggacccccgaggaccccagaaagcugaacagcaagagcagcuucaacaacaucgagaacgagccccccuucgaguucgugagcuaa

SEQ ID NO: 22172 - RNA, 1188 nt, Artificial Sequence
  PTGDR2__Homo_sapiens__NP_004769
augagcgccaacgccacccugaagccccugugccccauccuggagcagaugagcagacugcagagccacagcaacaccagcaucagauacaucgaccacgccgccgugcugcugcacggccuggccagccugcugggccugguggagaacggcgugauccuguucguggugggcugcagaaugagacagaccguggugaccaccugggugcugcaccuggcccugagcgaccugcuggccagcgccagccugcccuucuucaccuacuuccuggccgugggccacagcugggagcugggcaccaccuucugcaagcugcacagcagcaucuucuuccugaacauguucgccagcggcuuccugcugagcgccaucagccuggacagaugccugcagguggugagacccgugugggcccagaaccacagaaccguggccgccgcccacaaggugugccuggugcugugggcccuggccgugcugaacaccgugcccuacuucguguucagagacaccaucagcagacuggacggcagaaucaugugcuacuacaacgugcugcugcugaaccccggccccgacagagacgccaccugcaacagcagacagguggcccuggccgugagcaaguuccugcuggccuuccuggugccccuggccaucaucgccagcagccacgccgccgugagccugagacugcagcacagaggcagaagaagacccggcagauucgugagacugguggccgccgugguggccgccuucgcccugugcuggggccccuaccacguguucagccugcuggaggccagagcccacgccaaccccggccugagaccccugguguggagaggccugcccuucgugaccagccuggccuucuucaacagcguggccaaccccgugcuguacgugcugaccugccccgacaugcugagaaagcugagaagaagccugagaaccgugcuggagagcgugcugguggacgacagcgagcugggcggcgccggcagcagcagaagaagaagaaccagcagcaccgccagaagcgccagcccccuggcccugugcagcagacccgaggagcccagaggccccgccagacugcugggcuggcugcugggcagcugcgccgccagcccccagaccggcccccugaacagagcccugagcagcaccagcagcuaa

SEQ ID NO: 22173 - RNA, 1080 nt, Artificial Sequence
  PTGDR__Homo_sapiens__XP_005267948
augaagagccccuucuacagaugccagaacaccaccagcguggagaagggcaacagcgccgugaugggcggcgugcuguucagcaccggccugcugggcaaccugcuggcccugggccugcuggccagaagcggccugggcuggugcagcagaagaccccugagaccccugcccagcguguucuacaugcuggugugcggccugaccgugaccgaccugcugggcaagugccugcugagccccguggugcuggccgccuacgcccagaacagaagccugagagugcuggcccccgcccuggacaacagccugugccaggccuucgccuucuucaugagcuucuucggccugagcagcacccugcagcugcuggccauggcccuggagugcuggcugagccugggccaccccuucuucuacagaagacacaucacccugagacugggcgcccugguggcccccguggugagcgccuucagccuggccuucugcgcccugcccuucaugggcuucggcaaguucgugcaguacugccccggcaccuggugcuucauccagauggugcacgaggagggcagccugagcgugcugggcuacagcgugcuguacagcagccugauggcccugcuggugcuggccaccgugcugugcaaccugggcgccaugagaaaccuguacgccaugcacagaagacugcagagacaccccagaagcugcaccagagacugcgccgagcccagagccgacggcagagaggccagcccccagccccuggaggagcuggaccaccugcugcugcuggcccugaugaccgugcuguucaccaugugcagccugcccgugaucuacagagccuacuacggcgccuucaaggacgugaaggagaagaacagaaccagcgaggaggccgaggaccugagagcccugagauuccugagcgugaucagcaucguggaccccuggaucuucaucaucuucagaagccccguguucagaaucuucuuccacaagaucuucaucagaccccugagauacagaagcagaugcagcaacagcaccaacauggagagcagccuguaa

SEQ ID NO: 22174 - RNA, 573 nt, Artificial Sequence
  PTGDS__Homo_sapiens__NP_000945
auggccacccaccacacccuguggaugggccuggcccugcugggcgugcugggcgaccugcaggccgcccccgaggcccaggugagcgugcagcccaacuuccagcaggacaaguuccugggcagaugguucagcgccggccuggccagcaacagcagcuggcugagagagaagaaggccgcccugagcaugugcaagagcgugguggcccccgccaccgacggcggccugaaccugaccagcaccuuccugagaaagaaccagugcgagaccagaaccaugcugcugcagcccgccggcagccugggcagcuacagcuacagaagcccccacuggggcagcaccuacagcgugagcgugguggagaccgacuacgaccaguacgcccugcuguacagccagggcagcaagggccccggcgaggacuucagaauggccacccuguacagcagaacccagacccccagagccgagcugaaggagaaguucaccgccuucugcaaggcccagggcuucaccgaggacaccaucguguuccugccccagaccgacaagugcaugaccgagcaguaa

SEQ ID NO: 22175 - RNA, 1209 nt, Artificial Sequence
  PTGER1__Homo_sapiens__NP_000946
augagccccugcggcccccugaaccugagccuggccggcgaggccaccaccugcgccgcccccugggugcccaacaccagcgccgugccccccagcggcgccagccccgcccugcccaucuucagcaugacccugggcgccgugagcaaccugcuggcccuggcccugcuggcccaggccgccggcagacugagaagaagaagaagcgccgccaccuuccugcuguucguggccagccugcuggccaccgaccuggccggccacgugauccccggcgcccuggugcugagacuguacaccgccggcagagcccccgccggcggcgccugccacuuccugggcggcugcaugguguucuucggccugugcccccugcugcugggcugcggcauggccguggagagaugcgugggcgugaccagaccccugcugcacgccgccagagugagcguggccagagccagacuggcccuggccgccguggccgccguggcccuggccguggcccugcugccccuggccagagugggcagauacgagcugcaguaccccggcaccuggugcuucaucggccugggcccccccggcggcuggagacaggcccugcuggccggccuguucgccagccugggccugguggcccugcuggccgcccuggugugcaacacccugagcggccuggcccugcugagagccagauggagaagaagaagcagaagacccccccccgccagcggccccgacagcagaagaagauggggcgcccacggccccagaagcgccagcgccagcagcgccagcagcaucgccagcgccagcaccuucuucggcggcagcagaagcagcggcagcgccagaagagccagagcccacgacguggagauggugggccagcuggugggcaucaugguggugagcugcaucugcuggagccccaugcuggugcugguggcccuggccgugggcggcuggagcagcaccagccugcagagaccccuguuccuggccgugagacuggccagcuggaaccagauccuggaccccuggguguacauccugcugagacaggccgugcugagacagcugcugagacugcugccccccagagccggcgccaagggcggccccgccggccugggccugacccccagcgccugggaggccagcagccugagaagcagcagacacagcggccugagccacuucuaa

SEQ ID NO: 22176 - RNA, 1077 nt, Artificial Sequence
  PTGER2__Homo_sapiens__NP_000947
augggcaacgccagcaacgacagccagagcgaggacugcgagaccagacaguggcugccccccggcgagagccccgccaucagcagcgugauguucagcgccggcgugcugggcaaccugaucgcccuggcccugcuggccagaagauggagaggcgacgugggcugcagcgccggcagaagaagcagccugagccuguuccacgugcuggugaccgagcugguguucaccgaccugcugggcaccugccugaucagccccguggugcuggccagcuacgccagaaaccagacccugguggcccuggcccccgagagcagagccugcaccuacuucgccuucgccaugaccuucuucagccuggccaccaugcugaugcuguucgccauggcccuggagagauaccugagcaucggccaccccuacuucuaccagagaagagugagcagaagcggcggccuggccgugcugcccgugaucuacgccgugagccugcuguucugcagccugccccugcuggacuacggccaguacgugcaguacugccccggcaccuggugcuucaucagacacggcagaaccgccuaccugcagcuguacgccacccugcugcugcugcugaucgugagcgugcuggccugcaacuucagcgugauccugaaccugaucagaaugcacagaagaagcagaagaagcagaugcggccccagccugggcagcggcagaggcggccccggcgccagaagaagaggcgagagagugagcauggccgaggagaccgaccaccugauccugcuggccaucaugaccaucaccuucgccgugugcagccugcccuucaccaucuucgccuacaugaacgagaccagcagcagaaaggagaagugggaccugcaggcccugagauuccugagcaucaacagcaucaucgaccccuggguguucgccauccugagaccccccgugcugagacugaugagaagcgugcugugcugcagaaucagccugagaacccaggacgccacccagaccagcugcagcacccagagcgacgccagcaagcaggccgaccuguaa

SEQ ID NO: 22177 - RNA, 1257 nt, Artificial Sequence
  PTGER3__Homo_sapiens__XP_011540111
augaaggagaccagaggcuacggcggcgacgcccccuucugcaccagacugaaccacagcuacaccggcaugugggcccccgagagaagcgccgaggccagaggcaaccugaccagaccccccggcagcggcgaggacugcggcagcgugagcguggccuuccccaucaccaugcugcugaccggcuucgugggcaacgcccuggccaugcugcuggugagcagaagcuacagaagaagagagagcaagagaaagaagagcuuccugcugugcaucggcuggcuggcccugaccgaccuggugggccagcugcugaccacccccguggugaucgugguguaccugagcaagcagagaugggagcacaucgaccccagcggcagacugugcaccuucuucggccugaccaugaccguguucggccugagcagccuguucaucgccagcgccauggccguggagagagcccuggccaucagagccccccacugguacgccagccacaugaagaccagagccaccagagccgugcugcugggcguguggcuggccgugcuggccuucgcccugcugcccgugcugggcgugggccaguacaccgugcaguggcccggcaccuggugcuucaucagcaccggcagaggcggcaacggcaccagcagcagccacaacuggggcaaccuguucuucgccagcgccuucgccuuccugggccugcuggcccugaccgugaccuucagcugcaaccuggccaccaucaaggcccuggugagcagaugcagagccaaggccaccgccagccagagcagcgcccaguggggcagaaucaccaccgagaccgccauccagcugaugggcaucaugugcgugcugagcgugugcuggagcccccugcugaucaugaugcugaagaugaucuucaaccagaccagcguggagcacugcaagacccacaccgagaagcagaaggagugcaacuucuuccugaucgccgugagacuggccagccugaaccagauccuggaccccuggguguaccugcugcugagaaagauccugcugagaaaguucugccagaugagaaagagaagacugagagagcaggccccccugcugcccaccagcaccgugaucgaccccagcagauucugcgcccagcccuucagaugguuccuggaccugagcuuccccgccaugagcagcagccacccccagcugccccugacccuggccagcuucaagcugcugagcaaguaa

SEQ ID NO: 22178 - RNA, 1467 nt, Artificial Sequence
  PTGER4__Homo_sapiens__NP_000949
augagcacccccggcgugaacagcagcgccagccugagccccgacagacugaacagccccgugaccauccccgccgugauguucaucuucggcguggugggcaaccugguggccaucguggugcugugcaagagcagaaaggagcagaaggagaccaccuucuacacccuggugugcggccuggccgugaccgaccugcugggcacccugcuggugagccccgugaccaucgccaccuacaugaagggccaguggcccggcggccagccccugugcgaguacagcaccuucauccugcuguucuucagccugagcggccugagcaucaucugcgccaugagcguggagagauaccuggccaucaaccacgccuacuucuacagccacuacguggacaagagacuggccggccugacccuguucgccguguacgccagcaacgugcuguucugcgcccugcccaacaugggccugggcagcagcagacugcaguaccccgacaccuggugcuucaucgacuggaccaccaacgugaccgcccacgccgccuacagcuacauguacgccggcuucagcagcuuccugauccuggccaccgugcugugcaacgugcuggugugcggcgcccugcugagaaugcacagacaguucaugagaagaaccagccugggcaccgagcagcaccacgccgccgccgccgccagcguggccagcagaggccaccccgccgccagccccgcccugcccagacugagcgacuucagaagaagaagaagcuucagaagaaucgccggcgccgagauccagauggugauccugcugaucgccaccagccugguggugcugaucugcagcaucccccugguggugagaguguucgugaaccagcuguaccagcccagccuggagagagaggugagcaagaaccccgaccugcaggccaucagaaucgccagcgugaaccccauccuggaccccuggaucuacauccugcugagaaagaccgugcugagcaaggccaucgagaagaucaagugccuguucugcagaaucggcggcagcagaagagagagaagcggccagcacugcagcgacagccagagaaccagcagcgccaugagcggccacagcagaagcuucaucagcagagagcugaaggagaucagcagcaccagccagacccugcugcccgaccugagccugcccgaccugagcgagaacggccugggcggcagaaaccugcugcccggcgugcccggcaugggccuggcccaggaggacaccaccagccugagaacccugagaaucagcgagaccagcgacagcagccagggccaggacagcgagagcgugcugcugguggacgaggccggcggcagcggcagagccggccccgcccccaagggcagcagccugcaggugaccuuccccagcgagacccugaaccugagcgagaagugcaucuaa

SEQ ID NO: 22179 - RNA, 1134 nt, Artificial Sequence
  PTGES2__Homo_sapiens__NP_079348
auggaccccgccgccagaguggugagagcccuguggcccggcggcugcgcccuggccuggagacugggcggcagaccccagccccugcugcccacccagagcagagccggcuucgccggcgccgccggcggccccagccccguggccgccgccagaaagggcagccccagacugcugggcgccgccgcccuggcccugggcggcgcccugggccuguaccacaccgccagauggcaccugagagcccaggaccugcacgccgagagaagcgccgcccagcugagccugagcagcagacugcagcugacccuguaccaguacaagaccugccccuucugcagcaaggugagagccuuccuggacuuccacgcccugcccuaccaggugguggaggugaaccccgugagaagagccgagaucaaguucagcagcuacagaaaggugcccauccugguggcccaggagggcgagagcagccagcagcugaacgacagcagcgugaucaucagcgcccugaagaccuaccuggugagcggccagccccuggaggagaucaucaccuacuaccccgccaugaaggccgugaacgagcagggcaaggaggugaccgaguucggcaacaaguacuggcugaugcugaacgagaaggaggcccagcagguguacggcggcaaggaggccagaaccgaggagaugaaguggagacagugggccgacgacuggcuggugcaccugaucagccccaacguguacagaacccccaccgaggcccuggccagcuucgacuacaucgugagagagggcaaguucggcgccguggagggcgccguggccaaguacaugggcgccgccgccauguaccugaucagcaagagacugaagagcagacacagacugcaggacaacgugagagaggaccuguacgaggccgccgacaaguggguggccgccgugggcaaggacagacccuucaugggcggccagaagcccaaccuggccgaccuggccguguacggcgugcugagagugauggagggccuggacgccuucgacgaccugaugcagcacacccacauccagcccugguaccugagaguggagagagccaucaccgaggccagccccgcccacuaa

SEQ ID NO: 22180 - RNA, 483 nt, Artificial Sequence
  PTGES3__Homo_sapiens__NP_006592
augcagcccgccagcgccaagugguacgacagaagagacuacguguucaucgaguucugcguggaggacagcaaggacgugaacgugaacuucgagaagagcaagcugaccuucagcugccugggcggcagcgacaacuucaagcaccugaacgagaucgaccuguuccacugcaucgaccccaacgacagcaagcacaagagaaccgacagaagcauccugugcugccugagaaagggcgagagcggccagagcuggcccagacugaccaaggagagagccaagcugaacuggcugagcguggacuucaacaacuggaaggacugggaggacgacagcgacgaggacaugagcaacuucgacagauucagcgagaugaugaacaacaugggcggcgacgaggacguggaccugcccgagguggacggcgccgacgacgacagccaggacagcgacgacgagaagaugcccgaccuggaguaa

SEQ ID NO: 22181 - RNA, 459 nt, Artificial Sequence
  PTGES__Homo_sapiens__NP_004869
augcccgcccacagccuggugaugagcagccccgcccugcccgccuuccugcugugcagcacccugcuggugaucaagauguacgugguggccaucaucaccggccaggugagacugagaaagaaggccuucgccaaccccgaggacgcccugagacacggcggcccccaguacugcagaagcgaccccgacguggagagaugccugagagcccacagaaacgacauggagaccaucuaccccuuccuguuccugggcuucguguacagcuuccugggccccaaccccuucguggccuggaugcacuuccugguguuccuggugggcagaguggcccacaccguggccuaccugggcaagcugagagcccccaucagaagcgugaccuacacccuggcccagcugcccugcgccagcauggcccugcagauccugugggaggccgccagacaccuguaa

SEQ ID NO: 22182 - RNA, 1161 nt, Artificial Sequence
  PTGIR__Homo_sapiens__NP_000951
auggccgacagcugcagaaaccugaccuacgugagaggcagcgugggccccgccaccagcacccugauguucguggccggcguggugggcaacggccuggcccugggcauccugagcgccagaagacccgccagacccagcgccuucgccgugcuggugaccggccuggccgccaccgaccugcugggcaccagcuuccugagccccgccguguucguggccuacgccagaaacagcagccugcugggccuggccagaggcggccccgcccugugcgacgccuucgccuucgccaugaccuucuucggccuggccagcaugcugauccuguucgccauggccguggagagaugccuggcccugagccaccccuaccuguacgcccagcuggacggccccagaugcgccagacuggcccugcccgccaucuacgccuucugcgugcuguucugcgcccugccccugcugggccugggccagcaccagcaguacugccccggcagcuggugcuuccugagaaugagaugggcccagcccggcggcgccgccuucagccuggccuacgccggccugguggcccugcugguggccgccaucuuccugugcaacggcagcgugacccugagccugugcagaauguacagacagcagaagagacaccagggcagccugggccccagacccagaaccggcgaggacgagguggaccaccugauccugcuggcccugaugaccguggugauggccgugugcagccugccccugaccaucagaugcuucacccaggccguggcccccgacagcagcagcgagaugggcgaccugcuggccuucagauucuacgccuucaaccccauccuggaccccuggguguucauccuguucagaaaggccguguuccagagacugaagcugugggugugcugccugugccugggccccgcccacggcgacagccagaccccccugagccagcuggccagcggcagaagagaccccagagcccccagcgcccccgugggcaaggagggcagcugcgugccccugagcgccuggggcgagggccagguggagccccugccccccacccagcagagcagcggcagcgccgugggcaccagcagcaaggccgaggccagcguggccugcagccugugcuaa

SEQ ID NO: 22183 - RNA, 1503 nt, Artificial Sequence
  PTGIS__Homo_sapiens__NP_000952
auggccugggccgcccugcugggccugcuggccgcccugcugcugcugcugcugcugagcagaagaagaaccagaagacccggcgagcccccccuggaccugggcagcauccccuggcugggcuacgcccuggacuucggcaaggacgccgccagcuuccugaccagaaugaaggagaagcacggcgacaucuucaccauccuggugggcggcagauacgugaccgugcugcuggacccccacagcuacgacgccguggugugggagcccagaaccagacuggacuuccacgccuacgccaucuuccugauggagagaaucuucgacgugcagcugccccacuacagccccagcgacgagaaggccagaaugaagcugacccugcugcacagagagcugcaggcccugaccgaggccauguacaccaaccugcacgccgugcugcugggcgacgccaccgaggccggcagcggcuggcacgagaugggccugcuggacuucagcuacagcuuccugcugagagccggcuaccugacccuguacggcaucgaggcccugcccagaacccacgagagccaggcccaggacagagugcacagcgccgacguguuccacaccuucagacagcuggacagacugcugcccaagcuggccagaggcagccugagcgugggcgacaaggaccacaugugcagcgugaagagcagacuguggaagcugcugagccccgccagacuggccagaagagcccacagaagcaaguggcuggagagcuaccugcugcaccuggaggagaugggcgugagcgaggagaugcaggccagagcccuggugcugcagcugugggccacccagggcaacaugggccccgccgccuucuggcugcugcuguuccugcugaagaaccccgaggcccuggccgccgugagaggcgagcuggagagcauccuguggcaggccgagcagcccgugagccagaccaccacccugccccagaaggugcuggacagcacccccgugcuggacagcgugcugagcgagagccugagacugaccgccgcccccuucaucaccagagagguggugguggaccuggccaugcccauggccgacggcagagaguucaaccugagaagaggcgacagacugcugcuguuccccuuccugagcccccagagagaccccgagaucuacaccgaccccgagguguucaaguacaacagauuccugaaccccgacggcagcgagaagaaggacuucuacaaggacggcaagagacugaagaacuacaacaugcccuggggcgccggccacaaccacugccugggcagaagcuacgccgugaacagcaucaagcaguucguguuccuggugcuggugcaccuggaccuggagcugaucaacgccgacguggagauccccgaguucgaccugagcagauacggcuucggccugaugcagcccgagcacgacgugcccgugagauacagaaucagacccuaa

SEQ ID NO: 22184 - RNA, 906 nt, Artificial Sequence
  PTGR1__Homo_sapiens__NP_001139581
auggugagaaccaagaccuggacccugaagaagcacuucgugggcuaccccaccaacagcgacuucgagcugaagaccgccgagcugcccccccugaagaacggcgaggugcugcuggaggcccuguuccugaccguggaccccuacaugagaguggccgccaagagacugaaggagggcgacaccaugaugggccagcagguggccaaggugguggagagcaagaacguggcccugcccaagggcaccaucgugcuggccagccccggcuggaccacccacagcaucagcgacggcaaggaccuggagaagcugcugaccgaguggcccgacaccaucccccugagccuggcccugggcaccgugggcaugcccggccugaccgccuacuucggccugcuggagaucugcggcgugaagggcggcgagaccgugauggugaacgccgccgccggcgccgugggcagcguggugggccagaucgccaagcugaagggcugcaagguggugggcgccgugggcagcgacgagaagguggccuaccugcagaagcugggcuucgacgugguguucaacuacaagaccguggagagccuggaggagacccugaagaaggccagccccgacggcuacgacugcuacuucgacaacgugggcggcgaguucagcaacaccgugaucggccagaugaagaaguucggcagaaucgccaucugcggcgccaucagcaccuacaacagaaccggcccccugccccccggccccccccccgagaucgugaucuaccaggagcugagaauggaggccuucgugguguacagauggcagggcgacgccagacagaaggcccugaaggaccugcugaagugggugcuggagaucaagagagagaacgaggaggacuaa

SEQ ID NO: 22185 - RNA, 1800 nt, Artificial Sequence
  PTGS1__Homo_sapiens__NP_000953
augagcagaagccugcugcugugguuccugcuguuccugcugcugcugcccccccugcccgugcugcuggccgaccccggcgcccccacccccgugaaccccugcugcuacuaccccugccagcaccagggcaucugcgugagauucggccuggacagauaccagugcgacugcaccagaaccggcuacagcggccccaacugcaccauccccggccuguggaccuggcugagaaacagccugagacccagccccagcuucacccacuuccugcugacccacggcagaugguucugggaguucgugaacgccaccuucaucagagagaugcugaugagacuggugcugaccgugagaagcaaccugauccccagcccccccaccuacaacagcgcccacgacuacaucagcugggagagcuucagcaacgugagcuacuacaccagaauccugcccagcgugcccaaggacugccccacccccaugggcaccaagggcaagaagcagcugcccgacgcccagcugcuggccagaagauuccugcugagaagaaaguucauccccgacccccagggcaccaaccugauguucgccuucuucgcccagcacuucacccaccaguucuucaagaccagcggcaagaugggccccggcuucaccaaggcccugggccacggcguggaccugggccacaucuacggcgacaaccuggagagacaguaccagcugagacuguucaaggacggcaagcugaaguaccaggugcuggacggcgagauguacccccccagcguggaggaggcccccgugcugaugcacuaccccagaggcauccccccccagagccagauggccgugggccaggagguguucggccugcugcccggccugaugcuguacgccacccuguggcugagagagcacaacagagugugcgaccugcugaaggccgagcaccccaccuggggcgacgagcagcuguuccagaccaccagacugauccugaucggcgagaccaucaagaucgugaucgaggaguacgugcagcagcugagcggcuacuuccugcagcugaaguucgaccccgagcugcuguucggcgugcaguuccaguacagaaacagaaucgccauggaguucaaccaccuguaccacuggcacccccugaugcccgacagcuucaaggugggcagccaggaguacagcuacgagcaguuccuguucaacaccagcaugcugguggacuacggcguggaggcccugguggacgccuucagcagacagaucgccggcagaaucggcggcggcagaaacauggaccaccacauccugcacguggccguggacgugaucagagagagcagagagaugagacugcagcccuucaacgaguacagaaagagauucggcaugaagcccuacaccagcuuccaggagcuggugggcgagaaggagauggccgccgagcuggaggagcuguacggcgacaucgacgcccuggaguucuaccccggccugcugcuggagaagugccaccccaacagcaucuucggcgagagcaugaucgagaucggcgcccccuucagccugaagggccugcugggcaaccccaucugcagccccgaguacuggaagcccagcaccuucggcggcgaggugggcuucaacaucgugaagaccgccacccugaagaagcuggugugccugaacaccaagaccugccccuacgugagcuucagagugcccgacgccagccaggacgacggccccgccguggagagacccagcaccgagcuguaa

SEQ ID NO: 22186 - RNA, 1815 nt, Artificial Sequence
  PTGS2__Homo_sapiens__NP_000954
augcuggccagagcccugcugcugugcgccgugcuggcccugagccacaccgccaaccccugcugcagccaccccugccagaacagaggcgugugcaugagcgugggcuucgaccaguacaagugcgacugcaccagaaccggcuucuacggcgagaacugcagcacccccgaguuccugaccagaaucaagcuguuccugaagcccacccccaacaccgugcacuacauccugacccacuucaagggcuucuggaacguggugaacaacauccccuuccugagaaacgccaucaugagcuacgugcugaccagcagaagccaccugaucgacagcccccccaccuacaacgccgacuacggcuacaagagcugggaggccuucagcaaccugagcuacuacaccagagcccugccccccgugcccgacgacugccccaccccccugggcgugaagggcaagaagcagcugcccgacagcaacgagaucguggagaagcugcugcugagaagaaaguucauccccgacccccagggcagcaacaugauguucgccuucuucgcccagcacuucacccaccaguucuucaagaccgaccacaagagaggccccgccuucaccaacggccugggccacggcguggaccugaaccacaucuacggcgagacccuggccagacagagaaagcugagacuguucaaggacggcaagaugaaguaccagaucaucgacggcgagauguacccccccaccgugaaggacacccaggccgagaugaucuaccccccccaggugcccgagcaccugagauucgccgugggccaggagguguucggccuggugcccggccugaugauguacgccaccaucuggcugagagagcacaacagagugugcgacgugcugaagcaggagcaccccgaguggggcgacgagcagcuguuccagaccagcagacugauccugaucggcgagaccaucaagaucgugaucgaggacuacgugcagcaccugagcggcuaccacuucaagcugaaguucgaccccgagcugcuguucaacaagcaguuccaguaccagaacagaaucgccgccgaguucaacacccuguaccacuggcacccccugcugcccgacaccuuccagauccacgaccagaaguacaacuaccagcaguucaucuacaacaacagcauccugcuggagcacggcaucacccaguucguggagagcuucaccagacagaucgccggcagaguggccggcggcagaaacgugccccccgccgugcagaaggugagccaggccagcaucgaccagagcagacagaugaaguaccagagcuucaacgaguacagaaagagauucaugcugaagcccuacgagagcuucgaggagcugaccggcgagaaggagaugagcgccgagcuggaggcccuguacggcgacaucgacgccguggagcuguaccccgcccugcugguggagaagcccagacccgacgccaucuucggcgagaccaugguggaggugggcgcccccuucagccugaagggccugaugggcaacgugaucugcagccccgccuacuggaagcccagcaccuucggcggcgaggugggcuuccagaucaucaacaccgccagcauccagagccugaucugcaacaacgugaagggcugccccuucaccagcuucagcgugcccgaccccgagcugaucaagaccgugaccaucaacgccagcagcagcagaagcggccuggacgacaucaaccccaccgugcugcugaaggagagaagcaccgagcuguaa

SEQ ID NO: 22187 - RNA, 1782 nt, Artificial Sequence
  PTH1R__Homo_sapiens__NP_000307
augggcaccgccagaaucgcccccggccuggcccugcugcugugcugccccgugcugagcagcgccuacgcccugguggacgccgacgacgugaugaccaaggaggagcagaucuuccugcugcacagagcccaggcccagugcgagaagagacugaaggaggugcugcagagacccgccagcaucauggagagcgacaagggcuggaccagcgccagcaccagcggcaagcccagaaaggacaaggccagcggcaagcuguaccccgagagcgaggaggacaaggaggcccccaccggcagcagauacagaggcagacccugccugcccgagugggaccacauccugugcuggccccugggcgcccccggcgaggugguggccgugcccugccccgacuacaucuacgacuucaaccacaagggccacgccuacagaagaugcgacagaaacggcagcugggagcuggugcccggccacaacagaaccugggccaacuacagcgagugcgugaaguuccugaccaacgagaccagagagagagagguguucgacagacugggcaugaucuacaccgugggcuacagcgugagccuggccagccugaccguggccgugcugauccuggccuacuucagaagacugcacugcaccagaaacuacauccacaugcaccuguuccugagcuucaugcugagagccgugagcaucuucgugaaggacgccgugcuguacagcggcgccacccuggacgaggccgagagacugaccgaggaggagcugagagccaucgcccaggccccccccccccccgccaccgccgccgccggcuacgccggcugcagaguggccgugaccuucuuccuguacuuccuggccaccaacuacuacuggauccugguggagggccuguaccugcacagccugaucuucauggccuucuucagcgagaagaaguaccuguggggcuucaccguguucggcuggggccugcccgccguguucguggccgugugggugagcgugagagccacccuggccaacaccggcugcugggaccugagcagcggcaacaagaaguggaucauccaggugcccauccuggccagcaucgugcugaacuucauccuguucaucaacaucgugagagugcuggccaccaagcugagagagaccaacgccggcagaugcgacaccagacagcaguacagaaagcugcugaagagcacccuggugcugaugccccuguucggcgugcacuacaucguguucauggccacccccuacaccgaggugagcggcacccuguggcaggugcagaugcacuacgagaugcuguucaacagcuuccagggcuucuucguggccaucaucuacugcuucugcaacggcgaggugcaggccgagaucaagaagagcuggagcagauggacccuggcccuggacuucaagagaaaggccagaagcggcagcagcagcuacagcuacggccccauggugagccacaccagcgugaccaacgugggccccagagugggccugggccugccccugagccccagacugcugcccaccgccaccaccaacggccacccccagcugcccggccacgccaagcccggcacccccgcccuggagacccuggagaccaccccccccgccauggccgcccccaaggacgacggcuuccugaacggcagcugcagcggccuggacgaggaggccagcggccccgagagaccccccgcccugcugcaggaggagugggagaccgugauguaa

SEQ ID NO: 22188 - RNA, 303 nt, Artificial Sequence
  PTH2__Homo_sapiens__NP_848544
auggagaccagacaggugagcagaagccccagagugagacugcugcugcugcugcugcugcugcugguggugcccuggggcgugagaaccgccagcggcguggcccugccccccgugggcgugcugagccugagaccccccggcagagccugggccgaccccgccacccccagacccagaagaagccuggcccuggccgacgacgccgccuucagagagagagccagacugcuggccgcccuggagagaagacacuggcugaacagcuacaugcacaagcugcuggugcuggacgcccccuaa

SEQ ID NO: 22189 - RNA, 1653 nt, Artificial Sequence
  PTH2R__Homo_sapiens__NP_005039
auggccggccugggcgccagccugcacguguggggcuggcugaugcugggcagcugccugcuggccagagcccagcuggacagcgacggcaccaucaccaucgaggagcagaucgugcuggugcugaaggccaaggugcagugcgagcugaacaucaccgcccagcugcaggagggcgagggcaacugcuuccccgagugggacggccugaucugcuggcccagaggcaccgugggcaagaucagcgccgugcccugcccccccuacaucuacgacuucaaccacaagggcguggccuucagacacugcaaccccaacggcaccugggacuucaugcacagccugaacaagaccugggccaacuacagcgacugccugagauuccugcagcccgacaucagcaucggcaagcaggaguucuucgagagacuguacgugauguacaccgugggcuacagcaucagcuucggcagccuggccguggccauccugaucaucggcuacuucagaagacugcacugcaccagaaacuacauccacaugcaccuguucgugagcuucaugcugagagccaccagcaucuucgugaaggacagaguggugcacgcccacaucggcgugaaggagcuggagagccugaucaugcaggacgacccccagaacagcaucgaggccaccagcguggacaagagccaguacaucggcugcaagaucgccguggugauguucaucuacuuccuggccaccaacuacuacuggauccugguggagggccuguaccugcacaaccugaucuucguggccuucuucagcgacaccaaguaccuguggggcuucauccugaucggcuggggcuuccccgccgccuucguggccgccugggccguggccagagccacccuggccgacgccagaugcugggagcugagcgccggcgacaucaaguggaucuaccaggcccccauccuggccgccaucggccugaacuucauccuguuccugaacaccgugagagugcuggccaccaagaucugggagaccaacgccgugggccacgacaccagaaagcaguacagaaagcuggccaagagcacccuggugcuggugcugguguucggcgugcacuacaucguguucgugugccugccccacagcuucaccggccugggcugggagaucagaaugcacugcgagcuguucuucaacagcuuccagggcuucuucgugagcaucaucuacugcuacugcaacggcgaggugcaggccgaggugaagaagauguggagcagauggaaccugagcguggacuggaagagaaccccccccugcggcagcagaagaugcggcagcgugcugaccaccgugacccacagcaccagcagccagagccagguggccgccagcaccagaauggugcugaucagcggcaaggccgccaagaucgccagcagacagcccgacagccacaucacccugcccggcuacguguggagcaacagcgagcaggacugccugccccacagcuuccacgaggagaccaaggaggacagcggcagacagggcgacgacauccugauggagaagcccagcagacccauggagagcaaccccgacaccgagggcugccagggcgagaccgaggacgugcuguaa

SEQ ID NO: 22190 - RNA, 348 nt, Artificial Sequence
  PTH__Homo_sapiens__NP_000306
augauccccgccaaggacauggccaaggugaugaucgugaugcuggccaucugcuuccugaccaagagcgacggcaagagcgugaagaagagaagcgugagcgagauccagcugaugcacaaccugggcaagcaccugaacagcauggagagaguggaguggcugagaaagaagcugcaggacgugcacaacuucguggcccugggcgccccccuggcccccagagacgccggcagccagagacccagaaagaaggaggacaacgugcugguggagagccacgagaagagccugggcgaggccgacaaggccgacgugaacgugcugaccaaggccaagagccaguaa

SEQ ID NO: 22191 - RNA, 528 nt, Artificial Sequence
  PTHLH__Homo_sapiens__NP_945315
augcagagaagacuggugcagcaguggagcguggccguguuccugcugagcuacgccgugcccagcugcggcagaagcguggagggccugagcagaagacugaagagagccgugagcgagcaccagcugcugcacgacaagggcaagagcauccaggaccugagaagaagauucuuccugcaccaccugaucgccgagauccacaccgccgagaucagagccaccagcgaggugagccccaacagcaagcccagccccaacaccaagaaccaccccgugagauucggcagcgacgacgagggcagauaccugacccaggagaccaacaagguggagaccuacaaggagcagccccugaagacccccggcaagaagaagaagggcaagcccggcaagagaaaggagcaggagaagaagaagagaagaaccagaagcgccuggcuggacagcggcgugaccggcagcggccuggagggcgaccaccugagcgacaccagcaccaccagccuggagcuggacagcagauaa

SEQ ID NO: 22192 - RNA, 2904 nt, Artificial Sequence
  PTK2B__Homo_sapiens__NP_775267
augagcggcgugagcgagccccugagcagagugaagcugggcacccugagaagacccgagggccccgccgagcccauggugguggugcccguggacguggagaaggaggacgugagaauccugaaggugugcuucuacagcaacagcuucaaccccggcaagaacuucaagcuggugaagugcaccgugcagaccgagaucagagagaucaucaccagcauccugcugagcggcagaaucggccccaacaucagacuggccgagugcuacggccugagacugaagcacaugaagagcgacgagauccacuggcugcacccccagaugaccgugggcgaggugcaggacaaguacgagugccugcacguggaggccgaguggagauacgaccugcagaucagauaccugcccgaggacuucauggagagccugaaggaggacagaaccacccugcuguacuucuaccagcagcugagaaacgacuacaugcagagauacgccagcaaggugagcgagggcauggcccugcagcugggcugccuggagcugagaagauucuucaaggacaugccccacaacgcccuggacaagaagagcaacuucgagcugcuggagaaggaggugggccuggaccuguucuuccccaagcagaugcaggagaaccugaagcccaagcaguucagaaagaugauccagcagaccuuccagcaguacgccagccugagagaggaggagugcgugaugaaguucuucaacacccuggccggcuucgccaacaucgaccaggagaccuacagaugcgagcugauccagggcuggaacaucaccguggaccuggugaucggccccaagggcaucagacagcugaccagccaggacgccaagcccaccugccuggccgaguucaagcagaucagaagcaucagaugccugccccuggaggagggccaggccgugcugcagcugggcaucgagggcgccccccaggcccugagcaucaagaccagcagccuggccgaggccgagaacauggccgaccugaucgacggcuacugcagacugcagggcgagcaccagggcagccugaucauccaccccagaaaggacggcgagaagagaaacagccugccccagauccccaugcugaaccuggaggccagaagaagccaccugagcgagagcugcagcaucgagagcgacaucuacgccgagauccccgacgagacccugagaagacccggcggcccccaguacggcaucgccagagaggacguggugcugaacagaauccugggcgagggcuucuucggcgagguguacgagggcguguacaccaaccacaagggcgagaagaucaacguggccgugaagaccugcaagaaggacugcacccuggacaacaaggagaaguucaugagcgaggccgugaucaugaagaaccuggaccacccccacaucgugaagcugaucggcaucaucgaggaggagcccaccuggaucaucauggagcuguaccccuacggcgagcugggccacuaccuggagagaaacaagaacagccugaaggugcugacccuggugcuguacagccugcagaucugcaaggccauggccuaccuggagagcaucaacugcgugcacagagacaucgccgugagaaacauccugguggccagccccgagugcgugaagcugggcgacuucggccugagcagauacaucgaggacgaggacuacuacaaggccagcgugaccagacugcccaucaaguggaugagccccgagagcaucaacuucagaagauucaccaccgccagcgacguguggauguucgccgugugcaugugggagauccugagcuucggcaagcagcccuucuucuggcuggagaacaaggacgugaucggcgugcuggagaagggcgacagacugcccaagcccgaccugugcccccccgugcuguacacccugaugaccagaugcugggacuacgaccccagcgacagacccagauucaccgagcuggugugcagccugagcgacguguaccagauggagaaggacaucgccauggagcaggagagaaacgccagauacagaacccccaagauccuggagcccaccgccuuccaggagcccccccccaagcccagcagacccaaguacagaccccccccccagaccaaccugcuggcccccaagcugcaguuccaggaggaggacuucauccagcccagcagcagagaggaggcccagcagcugugggaggccgagaaggugaagaugagacagauccuggacaagcagcagaagcagaugguggaggacuaccaguggcugagacaggaggagaagagccuggaccccaugguguacaugaacgacaagagcccccugacccccgagaaggaggugggcuaccuggaguucaccggccccccccagaagccccccagacugggcgcccagagcauccagcccaccgccaaccuggacagaaccgacgaccugguguaccugaacgugauggagcuggugagagccgugcuggagcugaagaacgagcugugccagcugccccccgagggcuacguggugguggugaagaacgugggccugacccugagaaagcugaucggcagcguggacgaccugcugcccagccugcccagcagcagcagaaccgagaucgagggcacccagaagcugcugaacaaggaccuggccgagcugaucaacaagaugagacuggcccagcagaacgccgugaccagccugagcgaggagugcaagagacagaugcugaccgccagccacacccuggccguggacgccaagaaccugcuggacgccguggaccaggccaaggugcuggccaaccuggcccacccccccgccgaguaa

SEQ ID NO: 22193 - RNA, 3198 nt, Artificial Sequence
  PTK2__Homo_sapiens__NP_001186578
auggccgccgccuaccuggaccccaaccugaaccacacccccaacagcagcaccaagacccaccugggcaccggcauggagagaagccccggcgccauggagagagugcugaagguguuccacuacuucgagagcaacagcgagcccaccaccugggccagcaucaucagacacggcgacgccaccgacgugagaggcaucauccagaagaucguggacagccacaaggugaagcacguggccugcuacggcuucagacugagccaccugagaagcgaggaggugcacuggcugcacguggacaugggcgugagcagcgugagagagaaguacgagcuggcccacccccccgaggaguggaaguacgagcugagaaucagauaccugcccaagggcuuccugaaccaguucaccgaggacaagcccacccugaacuucuucuaccagcaggugaagagcgacuacaugcuggagaucgccgaccagguggaccaggagaucgcccugaagcugggcugccuggagaucagaagaagcuacugggagaugagaggcaacgcccuggagaagaagagcaacuacgaggugcuggagaaggacgugggccugaagagauucuuccccaagagccugcuggacagcgugaaggccaagacccugagaaagcugauccagcagaccuucagacaguucgccaaccugaacagagaggagagcauccugaaguucuucgagauccugagccccguguacagauucgacaaggagugcuucaagugcgcccugggcagcagcuggaucaucagcguggagcuggccaucggccccgaggagggcaucagcuaccugaccgacaagggcugcaaccccacccaccuggccgacuucacccaggugcagaccauccaguacagcaacagcgaggacaaggacagaaagggcaugcugcagcugaagaucgccggcgcccccgagccccugaccgugaccgcccccagccugaccaucgccgagaacauggccgaccugaucgacggcuacugcagacuggugaacggcaccagccagagcuucaucaucagaccccagaaggagggcgagagagcccugcccagcauccccaagcuggccaacagcgagaagcagggcaugagaacccacgccgugagcgugagcgagaccgacgacuacgccgagaucaucgacgaggaggacaccuacaccaugcccagcaccagagacuacgagauccagagagagagaaucgagcugggcagaugcaucggcgagggccaguucggcgacgugcaccagggcaucuacaugagccccgagaaccccgcccuggccguggccaucaagaccugcaagaacugcaccagcgacagcgugagagagaaguuccugcaggaggcccugaccaugagacaguucgaccacccccacaucgugaagcugaucggcgugaucaccgagaaccccguguggaucaucauggagcugugcacccugggcgagcugagaagcuuccugcaggugagaaaguacagccuggaccuggccagccugauccuguacgccuaccagcugagcaccgcccuggccuaccuggagagcaagagauucgugcacagagacaucgccgccagaaacgugcuggugagcagcaacgacugcgugaagcugggcgacuucggccugagcagauacauggaggacagcaccuacuacaaggccagcaagggcaagcugcccaucaaguggauggcccccgagagcaucaacuucagaagauucaccagcgccagcgacguguggauguucggcgugugcaugugggagauccugaugcacggcgugaagcccuuccagggcgugaagaacaacgacgugaucggcagaaucgagaacggcgagagacugcccaugccccccaacugcccccccacccuguacagccugaugaccaagugcugggccuacgaccccagcagaagacccagauucaccgagcugaaggcccagcugagcaccauccuggaggaggagaaggcccagcaggaggagagaaugagaauggagagcagaagacaggccaccgugagcugggacagcggcggcagcgacgaggccccccccaagcccagcagacccggcuaccccagccccagaagcagcgagggcuucuaccccagcccccagcacauggugcagaccaaccacuaccaggugagcggcuaccccggcagccacggcaucaccgccauggccggcagcaucuaccccggccaggccagccugcuggaccagaccgacagcuggaaccacagaccccaggagaucgccauguggcagcccaacguggaggacagcaccgugcuggaccugagaggcaucggccaggugcugcccacccaccugauggaggagagacugaucagacagcagcaggagauggaggaggaccagagauggcuggagaaggaggagagauuccugaagcccgacgugagacugagcagaggcagcaucgacagagaggacggcagccugcagggccccaucggcaaccagcacaucuaccagcccgugggcaagcccggcaaggaggagaagaacugggccgagagaaaccccgccgccccccccaagaagccccccagacccggcgcccccggccaccugggcagccuggccagccugagcagccccgccgacagcuacaacgagggcgugaagcccuggagacugcagccccaggagaucagccccccccccaccgccaaccuggacagaagcaacgacaagguguacgagaacgugaccggccuggugaaggccgugaucgagaugagcagcaagauccagcccgccccccccgaggaguacgugcccauggugaaggaggugggccuggcccugagaacccugcuggccaccguggacgagaccaucccccugcugcccgccagcacccacagagagaucgagauggcccagaagcugcugaacagcgaccugggcgagcugaucaacaagaugaagcuggcccagcaguacgugaugaccagccugcagcaggaguacaagaagcagaugcugaccgccgcccacgcccuggccguggacgccaagaaccugcuggacgugaucgaccaggccagacugaagaugcugggccagaccagaccccacuaa

SEQ ID NO: 22194 - RNA, 405 nt, Artificial Sequence
  PTK6__Homo_sapiens__NP_001243287
auggugagcagagaccaggcccaccugggccccaaguacgugggccugugggacuucaagagcagaaccgacgaggagcugagcuucagagccggcgacguguuccacguggccagaaaggaggagcagugguggugggccacccugcuggacgaggccggcggcgccguggcccagggcuacgugccccacaacuaccuggccgagagagagaccguggagagcgagcccgccggccacgccggcugcgccgcccugcaggaccuggccgccugcagaggccccgccgcccccgagagaggcggcgugcugccccagcccgccagagccugcgagcugccccagggccccgagcccgugcccagacccgccgccggcagagcccugcccgaggccagagccuaa

SEQ ID NO: 22195 - RNA, 3237 nt, Artificial Sequence
  PTK7__Homo_sapiens__NP_001257327
augggcagcuuccugagcggcgagaagagacccagcgcccccaccgugggcagcgccauggagaagaaggaguuccccaccccccccggcagagugggccccggcacccagaccgccaucguguucaucaagcagcccagcagccaggacgcccugcagggcagaagagcccugcugagaugcgagguggaggcccccggccccgugcacguguacuggcugcuggacggcgcccccgugcaggacaccgagagaagauucgcccagggcagcagccugagcuucgccgccguggacagacugcaggacagcggcaccuuccagugcguggccagagacgacgugaccggcgaggaggccagaagcgccaacgccagcuucaacaucaaguggaucgaggccggccccguggugcugaagcaccccgccagcgaggccgagauccagccccagacccaggugacccugagaugccacaucgacggccaccccagacccaccuaccagugguucagagacggcaccccccugagcgacggccagagcaaccacaccgugagcagcaaggagagaaaccugacccugagacccgccggccccgagcacagcggccuguacagcugcugcgcccacagcgccuucggccaggccugcagcagccagaacuucacccugagcaucgccgacgagagcuucgccagaguggugcuggccccccaggacguggugguggccagauacgaggaggccauguuccacugccaguucagcgcccagcccccccccagccugcaguggcuguucgaggacgagacccccaucaccaacagaagcagacccccccaccugagaagagccaccguguucgccaacggcagccugcugcugacccaggugagacccagaaacgccggcaucuacagaugcaucggccagggccagagaggcccccccaucauccuggaggccacccugcaccuggccgagaucgaggacaugccccuguucgagcccagaguguucaccgccggcagcgaggagagagugaccugccugccccccaagggccugcccgagcccagcguguggugggagcacgccggcgugagacugcccacccacggcagaguguaccagaagggccacgagcuggugcuggccaacaucgccgagagcgacgccggcguguacaccugccacgccgccaaccuggccggccagagaagacaggacgugaacaucaccguggccaccgugcccagcuggcugaagaagccccaggacagccagcuggaggagggcaagcccggcuaccuggacugccugacccaggccacccccaagcccaccguggugugguacagaaaccagaugcugaucagcgaggacagcagauucgagguguucaagaacggcacccugagaaucaacagcguggagguguacgacggcaccugguacagaugcaugagcagcacccccgccggcagcaucgaggcccaggccagagugcaggugcuggagaagcugaaguucaccccccccccccagccccagcagugcauggaguucgacaaggaggccaccgugcccugcagcgccaccggcagagagaagcccaccaucaagugggagagagccgacggcagcagccugcccgagugggugaccgacaacgccggcacccugcacuucgccagagugaccagagacgacgccggcaacuacaccugcaucgccagcaacggcccccagggccagaucagagcccacgugcagcugaccguggccguguucaucaccuucaagguggagcccgagagaaccaccguguaccagggccacaccgcccugcugcagugcgaggcccagggcgaccccaagccccugauccaguggaagggcaaggacagaauccuggaccccaccaagcugggccccagaaugcacaucuuccagaacggcagccuggugauccacgacguggcccccgaggacagcggcagauacaccugcaucgccggcaacagcugcaacaucaagcacaccgaggccccccuguacgugguggacaagcccgugcccgaggagagcgagggccccggcagccccccccccuacaagaugauccagaccaucggccugagcgugggcgccgccguggccuacaucaucgccgugcugggccugauguucuacugcaagaagagaugcaaggccaagagacugcagaagcagcccgagggcgaggagcccgagauggagugccugaacggcggcccccugcagaacggccagcccagcgccgagauccaggaggagguggcccugaccagccugggcagcggccccgccgccaccaacaagagacacagcaccagcgacaagaugcacuuccccagaagcagccugcagcccaucaccacccugggcaagagcgaguucggcgagguguuccuggccaaggcccagggccuggaggagggcguggccgagacccuggugcuggugaagagccugcagagcaaggacgagcagcagcagcuggacuucagaagagagcuggagauguucggcaagcugaaccacgccaacguggugagacugcugggccugugcagagaggccgagccccacuacauggugcuggaguacguggaccugggcgaccugaagcaguuccugagaaucagcaagagcaaggacgagaagcugaagagccagccccugagcaccaagcagaagguggcccugugcacccagguggcccugggcauggagcaccugagcaacaacagauucgugcacaaggaccuggccgccagaaacugccuggugagcgcccagagacaggugaaggugagcgcccugggccugagcaaggacguguacaacagcgaguacuaccacuucagacaggccugggugccccugagauggaugagccccgaggccauccuggagggcgacuucagcaccaagagcgacgugugggccuucggcgugcugaugugggagguguucacccacggcgagaugccccacggcggccaggccgacgacgaggugcuggccgaccugcaggccggcaaggccagacugccccagcccgagggcugccccagcaagcuguacagacugaugcagagaugcugggcccugagccccaaggacagacccagcuucagcgagaucgccagcgcccugggcgacagcaccguggacagcaagcccuaa

SEQ ID NO: 22196 - RNA, 336 nt, Artificial Sequence
  PTMA__Homo_sapiens__NP_001092755
augagcgacgccgccguggacaccagcagcgagaucaccaccaaggaccugaaggagaagaaggaggugguggaggaggccgagaacggcagagacgcccccgccaacggcaacgccgagaacgaggagaacggcgagcaggaggccgacaacgagguggacgaggaggaggaggagggcggcgaggaggaggaggaggaggaggagggcgacggcgaggaggaggacggcgacgaggacgaggaggccgagagcgccaccggcaagagagccgccgaggacgacgaggacgacgacguggacaccaagaagcagaagaccgacgaggacgacuaa

SEQ ID NO: 22197 - RNA, 309 nt, Artificial Sequence
  PTMS__Homo_sapiens__NP_002815
augagcgagaagagcguggaggccgccgccgagcugagcgccaaggaccugaaggagaagaaggagaagguggaggagaaggccagcagaaaggagagaaagaaggaggugguggaggaggaggagaacggcgccgaggaggaggaggaggagaccgccgaggacggcgaggaggaggacgagggcgaggaggaggacgaggaggaggaggaggaggacgacgagggccccgcccugaagagagccgccgaggaggaggacgaggccgaccccaagagacagaagaccgagaacggcgccagcgccuaa

SEQ ID NO: 22198 - RNA, 507 nt, Artificial Sequence
  PTN__Homo_sapiens__XP_005250572
augcaggcccagcaguaccagcagcagagaagaaaguucgccgccgccuuccuggccuucaucuucauccuggccgccguggacaccgccgaggccggcaagaaggagaagcccgagaagaaggugaagaagagcgacugcggcgaguggcaguggagcgugugcgugcccaccagcggcgacugcggccugggcaccagagagggcaccagaaccggcgccgagugcaagcagaccaugaagacccagagaugcaagauccccugcaacuggaagaagcaguucggcgccgagugcaaguaccaguuccaggccuggggcgagugcgaccugaacaccgcccugaagaccagaaccggcagccugaagagagcccugcacaacgccgagugccagaagaccgugaccaucagcaagcccugcggcaagcugaccaagcccaagccccaggccgagagcaagaagaagaagaaggagggcaagaagcaggagaagaugcuggacuaa

SEQ ID NO: 22199 - RNA, 1251 nt, Artificial Sequence
  PTOV1__Homo_sapiens__NP_059128
auggugagacccagaagagcccccuacagaagcggcgccggcggcccccugggcggcagaggcagaccccccagaccccugguggugagagccgugagaagcagaagcuggcccgccagccccagaggcccccagccccccagaaucagagccagaagcgccccccccauggagggcgccagaguguucggcgcccugggccccaucggccccagcagccccggccugacccugggcggccuggccgugagcgagcacagacugagcaacaagcugcuggccuggagcggcgugcuggaguggcaggagaagagaagacccuacagcgacagcaccgccaagcugaagagaacccugcccugccaggccuacgugaaccagggcgagaaccuggagaccgaccaguggccccagaagcugaucaugcagcugaucccccagcagcugcugaccacccugggcccccuguucagaaacagccagcuggcccaguuccacuucaccaacagagacugcgacagccugaagggccugugcagaaucaugggcaacggcuucgccggcugcaugcuguucccccacaucagccccugcgaggugagagugcugaugcugcuguacagcagcaagaagaagaucuucaugggccugauccccuacgaccagagcggcuucgugagcgccaucagacaggugaucaccaccagaaagcaggccgugggccccggcggcgugaacagcggccccgugcagaucgugaacaacaaguuccuggccuggagcggcgugauggaguggcaggagcccagacccgagcccaacagcagaagcaagagauggcugcccagccacguguacgugaaccagggcgagauccugagaaccgagcaguggcccagaaagcuguacaugcagcugaucccccagcagcugcugaccacccuggugccccuguucagaaacagcagacuggugcaguuccacuucaccaaggaccuggagacccugaagagccugugcagaaucauggacaacggcuucgccggcugcgugcacuucagcuacaaggccagcugcgagaucagagugcugaugcugcuguacagcagcgagaagaagaucuucaucggccugaucccccacgaccagggcaacuucgugaacggcaucagaagagugaucgccaaccagcagcaggugcugcagagaaaccuggagcaggagcagcagcagagaggcaugggcggcuaa

SEQ ID NO: 22200 - RNA, 522 nt, Artificial Sequence
  PTP4A1__Homo_sapiens__XP_011534414
auggccagaaugaacagacccgcccccguggaggugaccuacaagaacaugagauuccugaucacccacaaccccaccaacgccacccugaacaaguucaucgaggagcugaagaaguacggcgugaccaccaucgugagagugugcgaggccaccuacgacaccacccugguggagaaggagggcauccacgugcuggacuggcccuucgacgacggcgccccccccagcaaccagaucguggacgacuggcugagccuggugaagaucaaguucagagaggagcccggcugcugcaucgccgugcacugcguggccggccugggcagagcccccgugcugguggcccuggcccugaucgagggcggcaugaaguacgaggacgccgugcaguucaucagacagaagagaagaggcgccuucaacagcaagcagcugcuguaccuggagaaguacagacccaagaugagacugagauucaaggacagcaacggccacagaaacaacugcugcauccaguaa

SEQ ID NO: 22201 - RNA, 447 nt, Artificial Sequence
  PTP4A3__Homo_sapiens__XP_005250824
auggccagaaugaacagacccgcccccguggaggugagcuacaagcacaugagauuccugaucacccacaaccccaccaacgccacccugagcaccuucaucgaggaccugaagaaguacggcgccaccaccguggugagagugugcgaggugaccuacgacaagaccccccuggagaaggacggcaucaccgugguggacuggcccuucgacgacggcgcccccccccccggcaaggugguggaggacuggcugagccuggugaaggccaaguucugcgaggcccccggcagcugcguggccgugcacugcguggccggccugggcagaaagagaagaggcgccaucaacagcaagcagcugaccuaccuggagaaguacagacccaagcagagacugagauucaaggacccccacacccacaagaccagaugcugcgugauguaa

SEQ ID NO: 22202 - RNA, 456 nt, Artificial Sequence
  PTPMT1__Homo_sapiens__NP_001137456
auggccgccaccgcccugcuggaggccggccuggccagagugcuguucuaccccacccugcuguacacccuguucagaggcaaggugcccggcagagcccacagagacugguaccacagaaucgaccccaccgugcugcugggcgcccugccccugagaagccugaccagacaggugagcagagccggcgagcccggcccccugcccagacccagaagaagcgugcccgugggcccccugggcagcccccccagccugcugagccaccuguucgccagcgccgccggcaccggcagagagagagccagaggcgaccaccacgagagaggcgugagagacgaggugcccgugcagcuguucaccggcgcccagauggagagcagaggcggcugcaagagccacagacaggaccccgugauccacccccaccaggccuggcccgccggcugcagcuaa

SEQ ID NO: 22203 - RNA, 1782 nt, Artificial Sequence
  PTPN11__Homo_sapiens__NP_002825
augaccagcagaagaugguuccaccccaacaucaccggcguggaggccgagaaccugcugcugaccagaggcguggacggcagcuuccuggccagacccagcaagagcaaccccggcgacuucacccugagcgugagaagaaacggcgccgugacccacaucaagauccagaacaccggcgacuacuacgaccuguacggcggcgagaaguucgccacccuggccgagcuggugcaguacuacauggagcaccacggccagcugaaggagaagaacggcgacgugaucgagcugaaguacccccugaacugcgccgaccccaccagcgagagaugguuccacggccaccugagcggcaaggaggccgagaagcugcugaccgagaagggcaagcacggcagcuuccuggugagagagagccagagccaccccggcgacuucgugcugagcgugagaaccggcgacgacaagggcgagagcaacgacggcaagagcaaggugacccacgugaugaucagaugccaggagcugaaguacgacgugggcggcggcgagagauucgacagccugaccgaccugguggagcacuacaagaagaaccccaugguggagacccugggcaccgugcugcagcugaagcagccccugaacaccaccagaaucaacgccgccgagaucgagagcagagugagagagcugagcaagcuggccgagaccaccgacaaggugaagcagggcuucugggaggaguucgagacccugcagcagcaggagugcaagcugcuguacagcagaaaggagggccagagacaggagaacaagaacaagaacagauacaagaacauccugcccuucgaccacaccagaguggugcugcacgacggcgaccccaacgagcccgugagcgacuacaucaacgccaacaucaucaugcccgaguucgagaccaagugcaacaacagcaagcccaagaagagcuacaucgccacccagggcugccugcagaacaccgugaacgacuucuggagaaugguguuccaggagaacagcagagugaucgugaugaccaccaaggagguggagagaggcaagagcaagugcgugaaguacuggcccgacgaguacgcccugaaggaguacggcgugaugagagugagaaacgugaaggagagcgccgcccacgacuacacccugagagagcugaagcugagcaaggugggccagggcaacaccgagagaaccguguggcaguaccacuucagaaccuggcccgaccacggcgugcccagcgaccccggcggcgugcuggacuuccuggaggaggugcaccacaagcaggagagcaucauggacgccggccccgugguggugcacugcagcgccggcaucggcagaaccggcaccuucaucgugaucgacauccugaucgacaucaucagagagaagggcguggacugcgacaucgacgugcccaagaccauccagauggugagaagccagagaagcggcauggugcagaccgaggcccaguacagauucaucuacauggccgugcagcacuacaucgagacccugcagagaagaaucgaggaggagcagaagagcaagagaaagggccacgaguacaccaacaucaaguacagccuggccgaccagaccagcggcgaccagagcccccugccccccugcacccccaccccccccugcgccgagaugagagaggacagcgccagaguguacgagaacgugggccugaugcagcagcagaagagcuucagauaa

SEQ ID NO: 22204 - RNA, 1986 nt, Artificial Sequence
  PTPN12__Homo_sapiens__NP_001124480
augaucugggaguacaacguggugaucaucgugauggccugcagagaguucgagaugggcagaaagaagugcgagagauacuggccccuguacggcgaggaccccaucaccuucgcccccuucaagaucagcugcgaggacgagcaggccagaaccgacuacuucaucagaacccugcugcuggaguuccagaacgagagcagaagacuguaccaguuccacuacgugaacuggcccgaccacgacgugcccagcagcuucgacagcauccuggacaugaucagccugaugagaaaguaccaggagcacgaggacgugcccaucugcauccacugcagcgccggcugcggcagaaccggcgccaucugcgccaucgacuacaccuggaaccugcugaaggccggcaagauccccgaggaguucaacguguucaaccugauccaggagaugagaacccagagacacagcgccgugcagaccaaggagcaguacgagcuggugcacagagccaucgcccagcuguucgagaagcagcugcagcuguacgagauccacggcgcccagaagaucgccgacggcgugaacgagaucaacaccgagaacauggugagcagcaucgagcccgagaagcaggacagccccccccccaagccccccagaaccagaagcugccugguggagggcgacgccaaggaggagauccugcagccccccgagccccaccccgugccccccauccugacccccagcccccccagcgccuuccccaccgugaccaccguguggcaggacaacgacagauaccaccccaagcccgugcugcacauggugagcagcgagcagcacagcgccgaccugaacagaaacuacagcaagagcaccgagcugcccggcaagaacgagagcaccaucgagcagaucgacaagaagcuggagagaaaccugagcuucgagaucaagaaggugccccugcaggagggccccaagagcuucgacggcaacacccugcugaacagaggccacgccaucaagaucaagagcgccagccccugcaucgccgacaagaucagcaagccccaggagcugagcagcgaccugaacgugggcgacaccagccagaacagcugcguggacugcagcgugacccagagcaacaaggugagcgugaccccccccgaggagagccagaacagcgacaccccccccagacccgacagacugccccuggacgagaagggccacgugaccuggagcuuccacggccccgagaacgccauccccauccccgaccugagcgagggcaacagcagcgacaucaacuaccagaccagaaagaccgugagccugacccccagccccaccacccagguggagacccccgaccugguggaccacgacaacaccagcccccuguucagaaccccccugagcuucaccaacccccugcacagcgacgacagcgacagcgacgagagaaacagcgacggcgccgugacccagaacaagaccaacaucagcaccgccagcgccaccgugagcgccgccaccagcaccgagagcaucagcaccagaaaggugcugcccaugagcaucgccagacacaacaucgccggcaccacccacagcggcgccgagaaggacguggacgugagcgaggacagcccccccccccugcccgagagaacccccgagagcuucgugcuggccagcgagcacaacacccccgugagaagcgaguggagcgagcugcagagccaggagagaagcgagcagaagaagagcgagggccugaucaccagcgagaacgagaagugcgaccaccccgccggcggcauccacuacgagaugugcaucgagugcccccccaccuucagcgacaagagagagcagaucagcgagaaccccaccgaggccaccgacaucggcuucggcaacagaugcggcaagcccaagggccccagagacccccccagcgaguggaccuaa

SEQ ID NO: 22205 - RNA, 7401 nt, Artificial Sequence
  PTPN13__Homo_sapiens__NP_006255
augcacgugagccuggccgaggcccuggaggugagaggcggcccccugcaggaggaggagaucugggccgugcugaaccagagcgccgagagccugcaggagcuguucagaaaggugagccuggccgaccccgccgcccugggcuucaucaucagccccuggagccugcugcugcugcccagcggcagcgugagcuucaccgacgagaacaucagcaaccaggaccugagagccuucaccgcccccgaggugcugcagaaccagagccugaccagccugagcgacguggagaagauccacaucuacagccugggcaugacccuguacuggggcgccgacuacgaggugccccagagccagcccaucaagcugggcgaccaccugaacagcauccugcugggcaugugcgaggacgugaucuacgccagagugagcgugagaaccgugcuggacgccugcagcgcccacaucagaaacagcaacugcgcccccagcuucagcuacgugaagcaccuggugaagcuggugcugggcaaccugagcggcaccgaccagcugagcugcaacagcgagcagaagcccgacagaagccaggccaucagagacagacugagaggcaagggccugcccaccggcagaagcagcaccagcgacgugcuggacauccagaagcccccccugagccaccagaccuuccugaacaagggccugagcaagagcaugggcuuccugagcaucaaggacacccaggacgagaacuacuucaaggacauccugagcgacaacagcggcagagaggacagcgagaacaccuucagccccuaccaguucaagaccagcggccccgagaagaagcccauccccggcaucgacgugcugagcaagaagaagaucugggccagcagcauggaccugcugugcaccgccgacagagacuucagcagcggcgagaccgccaccuacagaagaugccaccccgaggccgugaccgugagaaccagcaccacccccagaaagaaggaggccagauacagcgacggcagcaucgcccuggacaucuucggcccccagaagauggaccccaucuaccacaccagagagcugcccaccagcagcgccaucagcagcgcccuggacagaaucagagagagacagaagaagcugcaggugcugagagaggccaugaacguggaggagcccgugagaagauacaagaccuaccacggcgacguguucagcaccagcagcgagagccccagcaucaucagcagcgagagcgacuucagacaggugagaagaagcgaggccagcaagagauucgagagcagcagcggccugcccggcguggacgagacccugagccagggccagagccagagacccagcagacaguacgagacccccuucgagggcaaccugaucaaccaggagaucaugcugaagagacaggaggaggagcugaugcagcugcaggccaagauggcccugagacagagcagacugagccuguaccccggcgacaccaucaaggccagcaugcuggacaucaccagagacccccugagagagaucgcccuggagaccgccaugacccagagaaagcugagaaacuucuucggccccgaguucgugaagaugaccaucgagcccuucaucagccuggaccugcccagaagcauccugaccaagaagggcaagaacgaggacaacagaagaaaggugaacaucaugcugcugaacggccagagacuggagcugaccugcgacaccaagaccaucugcaaggacguguucgacauggugguggcccacaucggccugguggagcaccaccuguucgcccuggccacccugaaggacaacgaguacuucuucguggaccccgaccugaagcugaccaagguggcccccgagggcuggaaggaggagcccaagaagaagaccaaggccaccgugaacuucacccuguucuucagaaucaaguucuucauggacgacgugagccugauccagcacacccugaccugccaccaguacuaccugcagcugagaaaggacauccuggaggagagaaugcacugcgacgacgagaccagccugcugcuggccagccuggcccugcaggccgaguacggcgacuaccagcccgaggugcacggcgugagcuacuucagaauggagcacuaccugcccgccagagugauggagaagcuggaccugagcuacaucaaggaggagcugcccaagcugcacaacaccuacgugggcgccagcgagaaggagaccgagcuggaguuccugaaggugugccagagacugaccgaguacggcgugcacuuccacagagugcaccccgagaagaagagccagaccggcauccugcugggcgugugcagcaagggcgugcugguguucgaggugcacaacggcgugagaacccuggugcugagauuccccuggagagagaccaagaagaucagcuucagcaagaagaagaucacccugcagaacaccagcgacggcaucaagcacggcuuccagaccgacaacagcaagaucugccaguaccugcugcaccugugcagcuaccagcacaaguuccagcugcagaugagagccagacagagcaaccaggacgcccaggacaucgagagagccagcuucagaagccugaaccugcaggccgagagcgugagaggcuucaacaugggcagagccaucagcaccggcagccuggccagcagcacccugaacaagcuggccgugagaccccugagcgugcaggccgagauccugaagagacugagcugcagcgagcugagccuguaccagccccugcagaacagcagcaaggagaagaacgacaaggccagcugggaggagaagcccagagagaugagcaagagcuaccacgaccugagccaggccagccuguacccccacagaaagaacgugaucgugaacauggagccccccccccagaccguggccgagcuggugggcaagcccagccaccagaugagcagaagcgacgccgagagccuggccggcgugaccaagcugaacaacagcaagagcguggccagccugaacagaagccccgagagaagaaagcacgagagcgacagcagcagcaucgaggaccccggccaggccuacgugcuggacgugcugcacaagagauggagcaucgugagcagccccgagagagagaucacccuggugaaccugaagaaggacgccaaguacggccugggcuuccagaucaucggcggcgagaagaugggcagacuggaccugggcaucuucaucagcagcguggcccccggcggccccgccgaccuggacggcugccugaagcccggcgacagacugaucagcgugaacagcgugagccuggagggcgugagccaccacgccgccaucgagauccugcagaacgcccccgaggacgugacccuggugaucagccagcccaaggagaagaucagcaaggugcccagcacccccgugcaccugaccaacgagaugaagaacuacaugaagaagagcagcuacaugcaggacagcgccaucgacagcagcagcaaggaccaccacuggagcagaggcacccugagacacaucagcgagaacagcuucggccccagcggcggccugagagagggcagccugagcagccaggacagcagaaccgagagcgccagccugagccagagccaggugaacggcuucuucgccagccaccugggcgaccagaccuggcaggagagccagcacggcagccccagccccagcgugaucagcaaggccaccgagaaggagaccuucaccgacagcaaccagagcaagaccaagaagcccggcaucagcgacgugaccgacuacagcgacagaggcgacagcgacauggacgaggccaccuacagcagcagccaggaccaccagacccccaagcaggagagcagcagcagcgugaacaccagcaacaagaugaacuucaagaccuucagcagcagcccccccaagcccggcgacaucuucgagguggagcuggccaagaacgacaacagccugggcaucagcgugaccggcggcgugaacaccagcgugagacacggcggcaucuacgugaaggccgugaucccccagggcgccgccgagagcgacggcagaauccacaagggcgacagagugcuggccgugaacggcgugagccuggagggcgccacccacaagcaggccguggagacccugagaaacaccggccagguggugcaccugcugcuggagaagggccagagccccaccagcaaggagcacgugcccgugaccccccagugcacccugagcgaccagaacgcccagggccagggccccgagaaggugaagaagaccacccaggugaaggacuacagcuucgugaccgaggagaacaccuucgaggugaagcuguucaagaacagcagcggccugggcuucagcuucagcagagaggacaaccugauccccgagcagaucaacgccagcaucgugagagugaagaagcuguuccccggccagcccgccgccgagagcggcaagaucgacgugggcgacgugauccugaaggugaacggcgccagccugaagggccugagccagcaggaggugaucagcgcccugagaggcaccgcccccgagguguuccugcugcugugcagacccccccccggcgugcugcccgagaucgacaccgcccugcugaccccccugcagagccccgcccaggugcugcccaacagcagcaaggacagcagccagcccagcugcguggagcagagcaccagcagcgacgagaacgagaugagcgacaagagcaagaagcagugcaagagccccagcagaagagacagcuacagcgacagcagcggcagcggcgaggacgaccuggugaccgcccccgccaacaucagcaacagcaccuggagcagcgcccugcaccagacccugagcaacauggugagccaggcccagagccaccacgaggcccccaagagccaggaggacaccaucugcaccauguucuacuacccccagaagauccccaacaagcccgaguucgaggacagcaaccccagcccccugccccccgacauggcccccggccagagcuaccagccccagagcgagagcgccagcagcagcagcauggacaaguaccacauccaccacaucagcgagcccaccagacaggagaacuggaccccccugaagaacgaccuggagaaccaccuggaggacuucgagcuggagguggagcugcugaucacccugaucaagagcgagaagggcagccugggcuucaccgugaccaagggcaaccagagaaucggcugcuacgugcacgacgugauccaggaccccgccaagagcgacggcagacugaagcccggcgacagacugaucaaggugaacgacaccgacgugaccaacaugacccacaccgacgccgugaaccugcugagagccgccagcaagaccgugagacuggugaucggcagagugcuggagcugcccagaauccccaugcugccccaccugcugcccgacaucacccugaccugcaacaaggaggagcugggcuucagccugugcggcggccacgacagccuguaccaggugguguacaucagcgacaucaaccccagaagcguggccgccaucgagggcaaccugcagcugcuggacgugauccacuacgugaacggcgugagcacccagggcaugacccuggaggaggugaacagagcccuggacaugagccugcccagccuggugcugaaggccaccagaaacgaccugcccguggugcccagcagcaagagaagcgccgugagcgcccccaagagcaccaagggcaacggcagcuacagcgugggcagcugcagccagcccgcccugacccccaacgacagcuucagcaccguggccggcgaggagaucaacgagaucagcuaccccaagggcaagugcagcaccuaccagaucaagggcagccccaaccugacccugcccaaggagagcuacauccaggaggacgacaucuacgacgacagccaggaggccgaggugauccagagccugcuggacgugguggacgaggaggcccagaaccugcugaacgagaacaacgccgccggcuacagcugcggccccggcacccugaagaugaacggcaagcugagcgaggagagaaccgaggacaccgacugcgacggcagcccccugcccgaguacuucaccgaggccaccaagaugaacggcugcgaggaguacugcgaggagaaggugaagagcgagagccugauccagaagccccaggagaagaagaccgacgacgacgagaucaccuggggcaacgacgagcugcccaucgagagaaccaaccacgaggacagcgacaaggaccacagcuuccugaccaacgacgagcuggccgugcugcccguggugaaggugcugcccagcggcaaguacaccggcgccaaccugaagagcgugaucagagugcugagaggccugcuggaccagggcauccccagcaaggagcuggagaaccugcaggagcugaagccccuggaccagugccugaucggccagaccaaggagaacagaagaaagaacagauacaagaacauccugcccuacgacgccaccagagugccccugggcgacgagggcggcuacaucaacgccagcuucaucaagauccccgugggcaaggaggaguucguguacaucgccugccagggcccccugcccaccaccgugggcgacuucuggcagaugaucugggagcagaagagcaccgugaucgccaugaugacccaggagguggagggcgagaagaucaagugccagagauacuggcccaacauccugggcaagaccaccauggugagcaacagacugagacuggcccuggugagaaugcagcagcugaagggcuucguggugagagccaugacccuggaggacauccagaccagagaggugagacacaucagccaccugaacuucaccgccuggcccgaccacgacacccccagccagcccgacgaccugcugaccuucaucagcuacaugagacacauccacagaagcggccccaucaucacccacugcagcgccggcaucggcagaagcggcacccugaucugcaucgacguggugcugggccugaucagccaggaccuggacuucgacaucagcgaccuggugagaugcaugagacugcagagacacggcauggugcagaccgaggaccaguacaucuucugcuaccaggugauccuguacgugcugaccagacugcaggccgaggaggagcagaagcagcagccccagcugcugaaguaa

SEQ ID NO: 22206 - RNA, 3564 nt, Artificial Sequence
  PTPN14__Homo_sapiens__NP_005392
augcccuucggccugaagcugagaagaaccagaagauacaacgugcugagcaagaacugcuucgugaccagaaucagacugcuggacagcaacgugaucgagugcacccugagcguggagagcaccggccaggagugccuggaggccguggcccagagacuggagcugagagagacccacuacuucggccugugguuccugagcaagagccagcaggccagauggguggagcuggagaagccccugaagaagcaccuggacaaguucgccaacgagccccugcuguucuucggcgugauguucuacgugcccaacgugagcuggcugcagcaggaggccaccagauaccaguacuaccugcaggugaagaaggacgugcuggagggcagacugagaugcacccuggaccaggugaucagacuggccggccuggccgugcaggccgacuucggcgacuacaaccaguucgacagccaggacuuccugagagaguacgugcuguuccccauggaccuggcccuggaggaggccgugcuggaggagcugacccagaagguggcccaggagcacaaggcccacagcggcauccugcccgccgaggccgagcugauguacaucaacgagguggagagacuggacggcuucggccaggagaucuuccccgugaaggacaaccacggcaacugcgugcaccugggcaucuucuucaugggcaucuucgugagaaacagaaucggcagacaggccgugaucuacagauggaacgacaugggcaacaucacccacaacaagagcaccauccugguggagcugaucaacaaggaggagaccgcccuguuccacaccgacgacaucgagaacgccaaguacaucagcagacuguucgccaccagacacaaguucuacaagcagaacaagaucugcaccgagcagagcaacagccccccccccaucagaagacagcccaccuggagcagaagcagccugcccagacagcagcccuacauccugccccccgugcacgugcagugcggcgagcacuacagcgagacccacaccagccaggacagcaucuuccacggcaacgaggaggcccuguacugcaacagccacaacagccuggaccugaacuaccugaacggcaccgugaccaacggcagcgugugcagcgugcacagcgugaacagccugaacugcagccagagcuucauccaggccagccccgugagcagcaaccugagcauccccggcagcgacaucaugagagccgacuacauccccagccacagacacagcgccaucaucgugcccagcuacagacccacccccgacuacgagaccgugaugagacagaugaagagaggcauccugcacaccgacagccagagccagagccugagaaaccugaacaucaucaacacccacgccuacaaccagcccgaggaccugguguacagccagcccgagaugagagagagacaccccuacaccgugcccuacggcccccagggcguguacagcaacaagcuggugagccccagcgaccagagaaaccccaagaacaacguggugcccagcaagcccggcgccagcgccaucagccacaccgugagcacccccgagcuggccaacaugcagcugcagggcagccacaacuacagcaccgcccacaugcugaagaacuaccuguucagaccccccccccccuaccccagacccagacccgccaccagcacccccgaccuggccagccacagacacaaguacgugagcggcagcagccccgaccuggugaccagaaaggugcagcugagcgugaagaccuuccaggaggacagcagccccguggugcaccagagccugcaggaggugagcgagccccugaccgccaccaagcaccacggcaccgugaacaagagacacagccuggaggugaugaacagcauggugagaggcauggaggccaugacccugaagagccugcaccugcccauggccagaagaaacacccugagagagcagggcccccccgaggagggcagcggcagccacgaggugccccagcugccccaguaccaccacaagaagaccuucagcgacgccaccaugcugauccacagcagcgagagcgaggaggaggaggaggaggcccccgagagcgugccccagauccccaugcugagagagaagauggaguacagcgcccagcugcaggccgcccuggccagaauccccaacaagcccccccccgaguaccccggccccagaaagagcgugagcaacggcgcccugagacaggaccaggccagccugccccccgccauggccagagccagagugcugagacacggccccgccaaggccaucagcaugagcagaaccgacccccccgccgugaacggcgccagccugggccccagcaucagcgagcccgaccugaccagcgugaaggagagagugaagaaggagcccgugaaggagagacccgugagcgagauguucagccuggaggacagcaucaucgagagagagaugaugaucagaaaccuggagaagcagaagauggccggccuggaggcccagaagagaccccugaugcuggccgcccugaacggccugagcguggccagagugagcggcagagaggagaacagaguggacgccaccagagugcccauggacgagagauucagaacccugaagaagaagcuggaggagggcaugguguucaccgaguacgagcagauccccaagaagaaggccaacggcaucuucagcaccgccgcccugcccgagaacgccgagagaagcagaaucagagagguggugcccuacgaggagaacagaguggagcugauccccaccaaggagaacaacaccggcuacaucaacgccagccacaucaaggugguggugggcggcgccgaguggcacuacaucgccacccagggcccccugccccacaccugccacgacuucuggcagauggugugggagcagggcgugaacgugaucgccauggugaccgccgaggaggagggcggcagaaccaagagccacagauacuggcccaagcugggcagcaagcacagcagcgccaccuacggcaaguucaaggugaccaccaaguucagaaccgacagcgugugcuacgccaccaccggccugaaggugaagcaccugcugagcggccaggagagaaccguguggcaccugcaguacaccgacuggcccgaccacggcugccccgaggacgugcagggcuuccugagcuaccuggaggagauccagagcgugagaagacacaccaacagcaugcuggagggcaccaagaacagacacccccccaucguggugcacugcagcgccggcgugggcagaaccggcgugcugauccugagcgagcugaugaucuacugccuggagcacaacgagaagguggaggugcccaugaugcugagacugcugagagagcagagaauguucaugauccagaccaucgcccaguacaaguucguguaccaggugcugauccaguuccugcagaacagcagacugaucuaa

SEQ ID NO: 22207 - RNA, 1062 nt, Artificial Sequence
  PTPN18__Homo_sapiens__NP_001135842
augagcagaagccuggacagcgccagaagcuuccuggagagacuggaggccagaggcggcagagagggcgccgugcuggccggcgaguucagcaagagaugcgagagauacugggcccaggagcaggagccccugcagaccggccuguucugcaucacccugaucaaggagaaguggcugaacgaggacaucaugcugagaacccugaaggugaccuuccagaaggagagcagaagcguguaccagcugcaguacaugagcuggcccgacagaggcgugcccagcagccccgaccacaugcuggccaugguggaggaggccagaagacugcagggcagcggccccgagccccugugcgugcacugcagcgccggcugcggcagaaccggcgugcugugcaccguggacuacgugagacagcugcugcugacccagaugaucccccccgacuucagccuguucgacguggugcugaagaugagaaagcagagacccgccgccgugcagaccgaggagcaguacagauuccuguaccacaccguggcccagauguucugcagcacccugcagaacgccagcccccacuaccagaacaucaaggagaacugcgccccccuguacgacgacgcccuguuccugagaaccccccaggcccugcuggccauccccagaccccccggcggcgugcugagaagcaucagcgugcccggcagccccggccacgccauggccgacaccuacgccguggugcagaagagaggcgcccccgccggcgccggcagcggcacccagaccggcaccggcaccggcaccggcgccagaagcgccgaggaggccccccuguacagcaaggugacccccagagcccagagacccggcgcccacgccgaggacgccagaggcacccugcccggcagagugcccgccgaccagagccccgccggcagcggcgccuacgaggacguggccggcggcgcccagaccggcggccugggcuucaaccugagaaucggcagacccaagggccccagagacccccccgccgaguggaccagaguguaa

SEQ ID NO: 22208 - RNA, 1089 nt, Artificial Sequence
  PTPN1__Homo_sapiens__NP_001265547
auggaggaggcccagagaagcuacauccugacccagggcccccugcccaacaccugcggccacuucugggagauggugugggagcagaagagcagaggcguggugaugcugaacagagugauggagaagggcagccugaagugcgcccaguacuggccccagaaggaggagaaggagaugaucuucgaggacaccaaccugaagcugacccugaucagcgaggacaucaagagcuacuacaccgugagacagcuggagcuggagaaccugaccacccaggagaccagagagauccugcacuuccacuacaccaccuggcccgacuucggcgugcccgagagccccgccagcuuccugaacuuccuguucaaggugagagagagcggcagccugagccccgagcacggccccgugguggugcacugcagcgccggcaucggcagaagcggcaccuucugccuggccgacaccugccugcugcugauggacaagagaaaggaccccagcagcguggacaucaagaaggugcugcuggagaugagaaaguucagaaugggccugauccagaccgccgaccagcugagauucagcuaccuggccgugaucgagggcgccaaguucaucaugggcgacagcagcgugcaggaccaguggaaggagcugagccacgaggaccuggagcccccccccgagcacaucccccccccccccagaccccccaagagaauccuggagccccacaacggcaagugcagagaguucuuccccaaccaccagugggugaaggaggagacccaggaggacaaggacugccccaucaaggaggagaagggcagcccccugaacgccgcccccuacggcaucgagagcaugagccaggacaccgaggugagaagcagaguggugggcggcagccugagaggcgcccaggccgccagccccgccaagggcgagcccagccugcccgagaaggacgaggaccacgcccugagcuacuggaagcccuuccuggugaacaugugcguggccaccgugcugaccgccggcgccuaccugugcuacagauuccuguucaacagcaacaccuaa

SEQ ID NO: 22209 - RNA, 3525 nt, Artificial Sequence
  PTPN21__Homo_sapiens__XP_011534669
augccccugcccuucggccugaagcugaagagaaccagaagauacaccgugagcagcaagagcugccugguggccagaauccagcugcugaacaacgaguucguggaguucacccugagcguggagagcaccggccaggagagccuggaggccguggcccagagacuggagcugagagaggugaccuacuucagccugugguacuacaacaagcagaaccagagaagauggguggaccuggagaagccccugaagaagcagcuggacaaguacgcccuggagcccaccguguacuucggcgugguguucuacgugcccagcgugagccagcugcagcaggagaucaccagauaccaguacuaccugcagcugaagaaggacauccuggagggcagcauccccugcacccuggagcaggccauccagcuggccggccuggccgugcaggccgacuucggcgacuucgaccaguacgagagccaggacuuccugcagaaguucgcccuguuccccgugggcuggcugcaggacgagaaggugcuggaggaggccacccagaagguggcccugcugcaccagaaguacagaggccugaccgcccccgacgccgagaugcuguacaugcaggagguggagagaauggacggcuacggcgaggagagcuaccccgccaaggacagccagggcagcgacaucagcaucggcgccugccuggagggcaucuucgugaagcacaagaacggcagacaccccgugguguucagauggcacgacaucgccaacaugagccacaacaagagcuucuucgcccuggagcuggccaacaaggaggagaccauccaguuccagaccgaggacauggagaccgccaaguacaucuggagacugugcguggccagacacaaguucuacagacugaaccagugcaaccugcagacccagaccgugaccgugaaccccaucagaagaagaagcagcagcagaaugagccugcccaagccccagcccuacgugaugcccccccccccccagcugcacuacaacggccacuacaccgagcccuacgccagcagccaggacaaccuguucgugcccaaccagaacggcuacuacugccacagccagaccagccuggacagagcccagaucgaccugaacggcagaaucagaaacggcagcguguacagcgcccacagcaccaacagccugaacaacccccagcccuaccugcagcccagccccaugagcagcaaccccagcaucaccggcagcgacgugaugagacccgacuaccugcccagccacagacacagcgccgugaucccccccagcuacagacccacccccgacuacgagaccgugaugaagcagcugaacagaggccuggugcacgccgagagacagagccacagccugagaaaccugaacaucggcagcagcuacgccuacagcagacccgccgcccugguguacagccagcccgagaucagagagcacgcccagcugcccagccccgccgccgcccacugccccuucagccugagcuacagcuuccacagccccagccccuaccccuaccccgccgagagaagacccguggugggcgccgugagcgugcccgagcugaccaacgcccagcugcaggcccaggacuaccccagccccaacaucaugagaacccagguguacagaccccccccccccuaccccccccccagacccgccaacagcacccccgaccugagcagacaccuguacaucagcagcagcaaccccgaccugaucaccagaagagugcaccacagcgugcagaccuuccaggaggacagccugcccguggcccacagccugcaggaggugagcgagccccugaccgccgccagacacgcccagcugcacaagagaaacagcaucgagguggccggccugagccacggccuggagggccugagacugaaggagagaacccugagcgccagcgccgccgagguggcccccagagccgugagcgugggcagccagcccagcguguucaccgagagaacccagagagagggccccgaggaggccgagggccugagauacggccacaagaagagccugagcgacgccaccaugcugauccacagcagcgaggaggaggaggacgaggacuucgaggaggagagcggcgccagagccccccccgccagagccagagagcccagacccggccuggcccaggacccccccggcugccccagagugcugcuggccggcccccugcacauccuggagcccaaggcccacgugcccgacgccgagaagagaaugauggacagcagccccgugagaaccaccgccgaggcccagagacccuggagagacggccugcugaugcccagcaugagcgagagcgaccugaccaccagcggcagauacagagccagaagagacagccugaagaagagacccgugagcgaccugcugagcggcaagaagaacaucguggagggccugcccccccugggcggcaugaagaagaccagaguggacgccaagaagaucggcccccugaagcuggccgcccugaacggccugagccugagcagagugccccugcccgacgagggcaaggagguggccaccagagccaccaacgacgagagaugcaagauccuggagcagagacuggagcagggcaugguguucaccgaguacgagagaauccugaagaagagacugguggacggcgagugcagcaccgccagacugcccgagaacgccgagagaaacagauuccaggacgugcugcccuacgacgacgugagaguggagcuggugcccaccaaggagaacaacaccggcuacaucaacgccagccacaucaaggugagcgugagcggcaucgagugggacuacaucgccacccagggcccccugcagaacaccugccaggacuucuggcagauggugugggagcagggcaucgccaucaucgccauggugaccgccgaggaggagggcggcagagagaagagcuucagauacuggcccagacugggcagcagacacaacaccgugaccuacggcagauucaagaucaccaccagauucagaaccgacagcggcugcuacgccaccaccggccugaagaugaagcaccugcugaccggccaggagagaaccguguggcaccugcaguacaccgacuggcccgagcacggcugccccgaggaccugaagggcuuccugagcuaccuggaggagauccagagcgugagaagacacaccaacagcaccagcgacccccagagccccaaccccccccugcuggugcacugcagcgccggcgugggcagaaccggcguggugauccugagcgagaucaugaucgccugccuggagcacaacgaggugcuggacauccccagagugcuggacaugcugagacagcagagaaugaugcuggugcagacccugugccaguacaccuucguguacagagugcugauccaguuccugaagagcagcagacugaucuaa

SEQ ID NO: 22210 - RNA, 1980 nt, Artificial Sequence
  PTPN22__Homo_sapiens__XP_011539526
augcagcuggaguucggccccuucagcgugagcugcgaggccgagaagagaaagagcgacuacaucaucagaacccugaaggugaaguucaacagcgagaccagaaccaucuaccaguuccacuacaagaacuggcccgaccacgacgugcccagcagcaucgaccccauccuggagcugaucugggacgugagaugcuaccaggaggacgacagcgugcccaucugcauccacugcagcgccggcugcggcagaaccggcgugaucugcgccaucgacuacaccuggaugcugcugaaggacggcaucauccccgagaacuucagcguguucagccugaucagagagaugagaacccagagacccagccuggugcagacccaggagcaguacgagcugguguacaacgccgugcuggagcuguucaagagacagauggacgugaucagagacaagcacagcggcaccgagagccaggccaagcacugcauccccgagaagaaccacacccugcaggccgacagcuacagccccaaccugcccaagagcaccaccaaggccgccaagaugaugaaccagcagagaaccaagauggagaucaaggagagcagcagcuucgacuucagaaccagcgagaucagcgccaaggaggagcuggugcugcaccccgccaagagcagcaccagcuucgacuuccuggagcugaacuacagcuucgacaagaacgccgacaccaccaugaaguggcagaccaaggccuuccccaucgugggcgagccccugcagaagcaccagagccuggaccugggcagccugcuguucgagggcugcagcaacagcaagcccgugaacgccgccggcagauacuucaacagcaaggugcccaucaccagaaccaagagcacccccuucgagcugauccagcagagagagaccaaggagguggacagcaaggagaacuucagcuaccuggagagccagccccacgacagcugcuucguggagaugcaggcccagaaggugaugcacgugagcagcgccgagcugaacuacagccugcccuacgacagcaagcaccagaucagaaacgccagcaacgugaagcaccacgacagcagcgcccugggcguguacagcuacaucccccugguggagaaccccuacuucagcagcuggccccccagcggcaccagcagcaagaugagccuggaccugcccgagaagcaggacggcaccguguuccccagcagccugcugcccaccagcagcaccagccuguucagcuacuacaacagccacgacagccugagccugaacagccccaccaacaucagcagccugcugaaccaggagagcgccgugcuggccaccgcccccagaaucgacgacgagaucccccccccccugcccguguggacccccgagagcuucaucgugguggaggaggccggcgaguucagccccaacgugcccaagagccugagcagcgccgugaaggugaagaucggcaccagccuggaguggggcggcaccagcgagcccaagaaguucgacgacagcgugauccugagacccagcaagagcgugaagcugagaagccccaagagcgagcugcaccaggacagaagcagccccccccccccccugcccgagagaacccuggagagcuucuuccuggccgacgaggacugcaugcaggcccagagcaucgagaccuacagcaccagcuaccccgacaccauggagaacagcaccagcagcaagcagacccugaagacccccggcaagagcuucaccagaagcaagagccugaagauccugagaaacaugaagaagagcaucugcaacagcugcccccccaacaagcccgccgagagcgugcagagcaacaacagcagcagcuuccugaacuucggcuucgccaacagauucagcaagcccaagggccccagaaaccccccccccaccuggaacaucuaa

SEQ ID NO: 22211 - RNA, 4533 nt, Artificial Sequence
  PTPN23__Homo_sapiens__NP_001291411
augcugggcgccauggacaagagagugagcgaggagggcaugaaggugagcugcacccacuuccagugcgccgccggcgccuucgccuaccugagagagcacuucccccaggccuacagcguggacaugagcagacagauccugacccugaacgugaaccugaugcugggccaggcccaggagugccugcuggagaagagcaugcuggacaacagaaagagcuuccugguggccagaaucagcgcccaggugguggacuacuacaaggaggccugcagagcccuggagaaccccgacaccgccagccugcugggcagaauccagaaggacuggaagaagcuggugcagaugaagaucuacuacuucgccgccguggcccaccugcacaugggcaagcaggccgaggagcagcagaaguucggcgagagaguggccuacuuccagagcgcccuggacaagcugaacgaggccaucaagcuggccaagggccagcccgacaccgugcaggacgcccugagauucaccauggacgugaucggcggcaaguacaacagcgccaagaaggacaacgacuucaucuaccacgaggccgugcccgcccuggacacccugcagcccgugaagggcgccccccuggugaagccccugcccgugaaccccaccgaccccgccgugaccggccccgacaucuucgccaagcuggugcccauggccgcccacgaggccagcagccuguacagcgaggagaaggccaagcugcugagagagaugauggccaagaucgaggacaagaacgaggugcuggaccaguucauggacagcaugcagcuggaccccgagaccguggacaaccuggacgccuacagccacauccccccccagcugauggagaagugcgccgcccugagcgugagacccgacaccgugagaaaccuggugcagagcaugcaggugcugagcggcguguucaccgacguggaggccagccugaaggacaucagagaccugcuggaggaggacgagcugcuggagcagaaguuccaggaggccgugggccaggccggcgccaucagcaucaccagcaaggccgagcuggccgaggugagaagagagugggccaaguacauggaggugcacgagaaggccagcuucaccaacagcgagcugcacagagccaugaaccugcacgugggcaaccugagacugcugagcggcccccuggaccaggugagagccgcccugcccacccccgcccugagccccgaggacaaggccgugcugcagaaccugaagagaauccuggccaaggugcaggagaugagagaccagagagugagccuggagcagcagcugagagagcugauccagaaggacgacaucaccgccagccuggugaccaccgaccacagcgagaugaagaagcuguucgaggagcagcugaagaaguacgaccagcugaagguguaccuggagcagaaccuggccgcccaggacagagugcugugcgcccugaccgaggccaacgugcaguacgccgccgugagaagagugcugagcgaccuggaccagaaguggaacagcacccugcagacccugguggccagcuacgaggccuacgaggaccugaugaagaagagccaggagggcagagacuucuacgccgaccuggagagcaagguggccgcccugcuggagagaacccagagcaccugccaggccagagaggccgccagacagcagcugcuggacagagagcugaagaagaagcccccccccagacccaccgcccccaagccccugcugcccagaagagaggagagcgaggccguggaggccggcgacccccccgaggagcugagaagccugccccccgacaugguggccggccccagacugcccgacaccuuccugggcagcgccaccccccugcacuucccccccagccccuuccccagcagcaccggccccggcccccacuaccugagcggcccccugccccccggcaccuacagcggccccacccagcugauccagcccagagcccccggcccccacgccaugcccguggcccccggccccgcccuguaccccgcccccgccuacacccccgagcugggccuggugcccagaagcagcccccagcacggcguggugagcagccccuacgugggcgugggccccgccccccccguggccggccugcccagcgccccccccccccaguucagcggccccgagcuggccauggccgugagacccgccaccaccaccguggacagcauccaggcccccauccccagccacaccgcccccagacccaaccccacccccgccccccccccccccugcuuccccgugccccccccccagccccugcccacccccuacaccuaccccgccggcgccaagcagcccauccccgcccagcaccacuucagcagcggcauccccgccggcuuccccgcccccagaaucggcccccagccccagccccacccccagccccaccccagccaggccuucggcccccagcccccccagcagccccugccccugcagcacccccaccuguuccccccccaggcccccggccugcugcccccccagagccccuaccccuacgccccccagcccggcgugcugggccagcccccccccccccugcacacccagcuguaccccggccccgcccaggacccccugcccgcccacagcggcgcccugcccuuccccagccccggccccccccagcccccccaccccccccuggccuacggccccgcccccagcaccagacccaugggcccccaggccgccccccugaccaucagaggccccagcagcgccggccagagcacccccagcccccaccuggugcccagccccgcccccagccccggccccggccccgugccccccagaccccccgccgccgagcccccccccugccugagaagaggcgccgccgccgccgaccugcugagcagcagccccgagagccagcacggcggcacccagagccccggcggcggccagccccugcugcagcccaccaagguggacgccgccgagggcagaagaccccaggcccugagacugaucgagagagaccccuacgagcaccccgagagacugagacagcugcagcaggagcuggaggccuucagaggccagcugggcgacgugggcgcccuggacaccguguggagagagcugcaggacgcccaggagcacgacgccagaggcagaagcaucgccaucgccagaugcuacagccugaagaacagacaccaggacgugaugcccuacgacagcaacagaguggugcugagaagcggcaaggacgacuacaucaacgccagcugcguggagggccugagccccuacugccccccccugguggccacccaggccccccugcccggcaccgccgccgacuucuggcugauggugcacgagcagaaggugagcgugaucgugaugcuggugagcgaggccgagauggagaagcagaagguggccagauacuuccccaccgagagaggccagcccauggugcacggcgcccugagccuggcccugagcagcgugagaagcaccgagacccacguggagagagugcugagccugcaguucagagaccagagccugaagagaagccuggugcaccugcacuuccccaccuggcccgagcugggccugcccgacagccccagcaaccugcugagauucauccaggaggugcacgcccacuaccugcaccagagaccccugcacacccccaucaucgugcacugcagcagcggcgugggcagaaccggcgccuucgcccugcuguacgccgccgugcaggagguggaggccggcaacggcauccccgagcugccccagcuggugagaagaaugagacagcagagaaagcacaugcugcaggagaagcugcaccugagauucugcuacgaggccguggugagacacguggagcaggugcugcagagacacggcgugcccccccccugcaagccccuggccagcgccagcaucagccagaagaaccaccugccccaggacagccaggaccuggugcugggcggcgacgugcccaucagcagcauccaggccaccaucgccaagcugagcaucagaccccccggcggccuggagagccccguggccagccugcccggccccgccgagccccccggccugccccccgccagccugcccgagagcacccccauccccagcagcagcccccccccccugagcagcccccugcccgaggccccccagcccaaggaggagccccccgugcccgaggcccccagcagcggcccccccagcagcagccuggagcugcuggccagccugacccccgaggccuucagccuggacagcagccugagaggcaagcagagaaugagcaagcacaacuuccugcaggcccacaacggccagggccugagagccaccagacccagcgacgacccccugagccugcuggacccccuguggacccugaacaagaccuaa

SEQ ID NO: 22212 - RNA, 1233 nt, Artificial Sequence
  PTPN2__Homo_sapiens__NP_001193942
augcccaccaccaucgagagagaguucgaggagcuggacacccagagaagauggcagccccuguaccuggagaucagaaacgagagccacgacuacccccacagaguggccaaguuccccgagaacagaaacagaaacagauacagagacgugagccccuacgaccacagcagagugaagcugcagaacgccgagaacgacuacaucaacgccagccugguggacaucgaggaggcccagagaagcuacauccugacccagggcccccugcccaacaccugcugccacuucuggcugaugguguggcagcagaagaccaaggccguggugaugcugaacagaaucguggagaaggagagcgugaagugcgcccaguacuggcccaccgacgaccaggagaugcuguucaaggagaccggcuucagcgugaagcugcugagcgaggacgugaagagcuacuacaccgugcaccugcugcagcuggagaacaucaacuacaucgagaaccuguggaucacccuguaccugaagcugcugaugcuggacgugaagagaagccugaagagcggcgagaccagaaccaucagccacuuccacuacaccaccuggcccgacuucggcgugcccgagagccccgccagcuuccugaacuuccuguucaaggugagagagagcggcagccugaaccccgaccacggccccgccgugauccacugcagcgccggcaucggcagaagcggcaccuucagccugguggacaccugccuggugcugauggagaagggcgacgacaucaacaucaagcaggugcugcugaacaugagaaaguacagaaugggccugauccagacccccgaccagcugagauucagcuacauggccaucaucgagggcgccaagugcaucaagggcgacagcagcauccagaagagauggaaggagcugagcaaggaggaccugagccccgccuucgaccacagccccaacaagaucaugaccgagaaguacaacggcaacagaaucggccuggaggaggagaagcugaccggcgacagaugcaccggccugagcagcaagaugcaggacaccauggaggagaacagcgagagcgcccugagaaagagaaucagagaggacagaaaggccaccaccgcccagaaggugcagcagaugaagcagagacugaacgagaacgagagaaagagaaagagacccagacugaccgacaccuaa

SEQ ID NO: 22213 - RNA, 2607 nt, Artificial Sequence
  PTPN3__Homo_sapiens__NP_001138840
augaccagcagacugagagcccugggcggcagaaucaacaacaucagaaccagcgagcugcccaaggagaagaccagaagcgaggugaucugcagcauccacuuccuggacggcguggugcagaccuucaaggugaccaagcaggacaccggccaggugcugcuggacauggugcacaaccaccugggcgugaccgagaaggaguacuucggccugcagcacgacgacgacagcguggacagccccagauggcuggaggccagcaaggccaucagaaagcagcugaagggcggcuuccccugcacccugcacuucagagugagauucuucauccccgaccccaacacccugcagcaggagcagaccagacaccuguacuuccugcagcugaagauggacaucugcgagggcagacugaccugcccccugaacagcgccguggugcuggccagcuacgccgugcagagccacuucggcgacuacaacagcagcauccaccaccccggcuaccugagcgacagccacuucauccccgaccagaacgaggacuuccugaccaagguggagagccugcacgagcagcacagcggccugaagcagagcgaggccgagagcugcuacaucaacaucgccagaacccuggacuucuacggcguggagcugcacagcggcagagaccugcacaaccuggaccugaugaucggcaucgccagcgccggcguggccguguacagaaaguacaucugcaccagcuucuaccccugggugaacauccugaagaucagcuucaagagaaagaaguucuucauccaccagagacagaagcaggccgagagcagagagcacaucguggccuucaacaugcugaacuacagaagcugcaagaaccuguggaagagcugcguggagcaccacaccuucuuccaggccaagaagcugcugccccaggagaagaacgugcugagccaguacuggaccaugggcagcagaaacaccaagaagagaagccccagacugagacacgagaucagaaagcccagacacagcagcgccgacaaccuggccaacgagaugaccuacaucaccgagaccgaggacguguucuacaccuacaagggcagccuggccccccaggacagcgacagcgaggugagccagaacagaagcccccaccaggagagccugagcgagaacaaccccgcccagagcuaccugacccagaagagcagcagcagcgugagccccagcagcaacgcccccggcagcugcagccccgacggcguggaccagcagcugcuggacgacuuccacagagugaccaagggcggcagcaccgaggacgccagccaguacuacugcgacaagaacgacaacggcgacagcuaccuggugcugaucagaaucacccccgacgaggacggcaaguucggcuucaaccugaagggcggcguggaccagaagaugccccugguggugagcagaaucaaccccgagagccccgccgacaccugcauccccaagcugaacgagggcgaccagaucgugcugaucaacggcagagacaucagcgagcacacccacgaccagguggugauguucaucaaggccagcagagagagccacagcagagagcuggcccuggugaucagaagaagagccgugagaagcuucgccgacuucaagagcgaggacgagcugaaccagcuguuccccgaggccaucuuccccaugugccccgagggcggcgacacccuggagggcagcauggcccagcugaagaagggccuggagagcggcaccgugcugauccaguucgagcagcuguacagaaagaagcccggccuggccaucaccuucgccaagcugccccagaaccuggacaagaacagauacaaggacgugcugcccuacgacaccaccagagugcugcugcagggcaacgaggacuacaucaacgccagcuacgugaacauggagauccccgccgccaaccuggugaacaaguacaucgccacccagggcccccugccccacaccugcgcccaguucuggcagguggugugggaccagaagcugagccugaucgugaugcugaccacccugaccgagagaggcagaaccaagugccaccaguacuggcccgacccccccgacgugaugaaccacggcggcuuccacauccagugccagagcgaggacugcaccaucgccuacgugagcagagagaugcuggugaccaacacccagaccggcgaggagcacaccgugacccaccugcaguacguggccuggcccgaccacggcgugcccgacgacagcagcgacuuccuggaguucgugaacuacgugagaagccugagaguggacagcgagcccgugcuggugcacugcagcgccggcaucggcagaaccggcgugcuggugaccauggagaccgccaugugccugaccgagagaaaccugcccaucuacccccuggacaucgugagaaagaugagagaccagagagccaugauggugcagaccagcagccaguacaaguucgugugcgaggccauccugagaguguacgaggagggccuggugcagaugcuggaccccagcuaa

SEQ ID NO: 22214 - RNA, 2781 nt, Artificial Sequence
  PTPN4__Homo_sapiens__NP_002821
augaccagcagauucagacugcccgccggcagaaccuacaacgugagagccagcgagcuggccagagacagacagcacaccgagguggugugcaacauccugcugcuggacaacaccgugcaggccuucaaggugaacaagcacgaccagggccaggugcugcuggacgugguguucaagcaccuggaccugaccgagcaggacuacuucggccugcagcuggccgacgacagcaccgacaaccccagauggcuggaccccaacaagcccaucagaaagcagcugaagagaggcagccccuacagccugaacuucagagugaaguucuucgugagcgaccccaacaagcugcaggaggaguacaccagauaccaguacuuccugcagaucaagcaggacauccugaccggcagacugcccugccccagcaacaccgccgcccugcuggccagcuucgccgugcagagcgagcugggcgacuacgaccagagcgagaaccugagcggcuaccugagcgacuacagcuucauccccaaccagccccaggacuucgagaaggagaucgccaagcugcaccagcagcacaucggccugagccccgccgaggccgaguucaacuaccugaacaccgccagaacccuggagcuguacggcguggaguuccacuacgccagagaccagagcaacaacgagaucaugaucggcgugaugagcggcggcauccugaucuacaagaacagagugagaaugaacaccuuccccuggcugaagaucgugaagaucagcuucaagugcaagcaguucuucauccagcugagaaaggagcugcacgagagcagagagacccugcugggcuucaacauggugaacuacagagccugcaagaaccuguggaaggccugcguggagcaccacaccuucuucagacuggacagaccccugcccccccagaagaacuucuucgcccacuacuucacccugggcagcaaguucagauacugcggcagaaccgaggugcagagcgugcaguacggcaaggagaaggccaacaaggacagaguguucgccagaagccccagcaagccccuggccagaaagcugauggacugggagguggugagcagaaacagcaucagcgacgacagacuggagacccagagccugcccagcagaagcccccccggcacccccaaccacagaaacagcaccuucacccaggagggcaccagacugagacccagcagcgugggccaccugguggaccacauggugcacaccagccccagcgagguguucgugaaccagagaagccccagcagcacccaggccaacagcaucgugcuggagagcagccccagccaggagacccccggcgacggcaagccccccgcccugccccccaagcagagcaagaagaacagcuggaaccagauccacuacagccacagccagcaggaccuggagagccacaucaacgagaccuucgacauccccagcagccccgagaagcccacccccaacggcggcaucccccacgacaaccuggugcugaucagaaugaagcccgacgagaacggcagauucggcuucaacgugaagggcggcuacgaccagaagaugcccgugaucgugagcagaguggcccccggcacccccgccgaccugugcgugcccagacugaacgagggcgaccagguggugcugaucaacggcagagacaucgccgagcacacccacgaccagguggugcuguucaucaaggccagcugcgagagacacagcggcgagcugaugcugcuggugagacccaacgccguguacgacgugguggaggagaagcuggagaacgagcccgacuuccaguacauccccgagaaggccccccuggacagcgugcaccaggacgaccacagccugagagagagcaugauccagcuggccgagggccugaucaccggcaccgugcugacccaguucgaccagcuguacagaaagaagcccggcaugaccaugagcugcgccaagcugccccagaacaucagcaagaacagauacagagacaucagccccuacgacgccaccagagugauccugaagggcaacgaggacuacaucaacgccaacuacaucaacauggagauccccagcagcagcaucaucaaccaguacaucgccugccagggcccccugccccacaccugcaccgacuucuggcagaugaccugggagcagggcagcagcaugguggugaugcugaccacccagguggagagaggcagagugaagugccaccaguacuggcccgagcccaccggcagcagcagcuacggcugcuaccaggugaccugccacagcgaggagggcaacaccgccuacaucuucagaaagaugacccuguucaaccaggagaagaacgagagcagaccccugacccagauccaguacaucgccuggcccgaccacggcgugcccgacgacagcagcgacuuccuggacuucgugugccacgugagaaacaagagagccggcaaggaggagcccgugguggugcacugcagcgccggcaucggcagaaccggcgugcugaucaccauggagaccgccaugugccugaucgagugcaaccagcccguguacccccuggacaucgugagaaccaugagagaccagagagccaugaugauccagacccccagccaguacagauucgugugcgaggccauccugaagguguacgaggagggcuucgugaagccccugaccaccagcaccaacaaguaa

SEQ ID NO: 22215 - RNA, 1602 nt, Artificial Sequence
  PTPN5__Homo_sapiens__NP_001265165
augaacuacgagggcgccagaagcgagagagagaaccacgccgccgacgacagcgagggcggcgcccuggacaugugcugcagcgagagacugcccggccugccccagcccaucgugauggaggcccuggacgaggccgagggccugcaggacagccagagagagaugccccccccccccccccccagcccccccagcgaccccgcccagaagcccccccccagaggcgccggcagccacagccugaccgugagaagcagccugugccuguucgccgccagccaguuccugcuggagcccaccgccuggcuggacagcggcaccuggggcgugcccagccugcugcugguguuccugagcgugggccuggugcuggugaccacccugguguggcaccugcugagaaccccccccgagccccccaccccccugccccccgaggacagaagacagagcgugagcagacagcccagcuucaccuacagcgaguggauggaggagaagaucgaggacgacuuccuggaccuggaccccgugcccgagacccccguguucgacugcgugauggacaucaagcccgaggccgaccccaccagccugaccgugaagagcaugggccugcaggagagaagaggcagcaacgugagccugacccuggacaugugcacccccggcugcaacgaggagggcuucggcuaccugaugagccccagagaggagagcgccagagaguaccugcugagcgccagcagagugcugcaggccgaggagcugcacgagaaggcccuggaccccuuccugcugcaggccgaguucuucgagauccccaugaacuucguggaccccaaggaguacgacauccccggccuggugagaaagaacagauacaagaccauccugcccaacccccacagcagagugugccugaccagccccgaccccgacgacccccugagcagcuacaucaacgccaacuacaucagaggcuacggcggcgaggagaagguguacaucgccacccagggccccaucgugagcaccguggccgacuucuggagaaugguguggcaggagcacacccccaucaucgugaugaucaccaacaucgaggagaugaacgagaagugcaccgaguacuggcccgaggagcagguggccuacgacggcguggagaucaccgugcagaaggugauccacaccgaggacuacagacugagacugaucagccugaagagcggcaccgaggagagaggccugaagcacuacugguucaccagcuggcccgaccagaagacccccgacagagcccccccccugcugcaccuggugagagagguggaggaggccgcccagcaggagggcccccacugcgcccccaucaucgugcacugcagcgccggcaucggcagaaccggcugcuucaucgccaccagcaucugcugccagcagcugagacaggagggcgugguggacauccugaagaccaccugccagcugagacaggacagaggcggcaugauccagaccugcgagcaguaccaguucgugcaccacgugaugagccuguacgagaagcagcugagccaccagagccccgaguaa

SEQ ID NO: 22216 - RNA, 1788 nt, Artificial Sequence
  PTPN6__Homo_sapiens__NP_002822
auggugagaugguuccacagagaccugagcggccuggacgccgagacccugcugaagggcagaggcgugcacggcagcuuccuggccagacccagcagaaagaaccagggcgacuucagccugagcgugagagugggcgaccaggugacccacaucagaauccagaacagcggcgacuucuacgaccuguacggcggcgagaaguucgccacccugaccgagcugguggaguacuacacccagcagcagggcgugcugcaggacagagacggcaccaucauccaccugaaguacccccugaacugcagcgaccccaccagcgagagaugguaccacggccacaugagcggcggccaggccgagacccugcugcaggccaagggcgagcccuggaccuuccuggugagagagagccugagccagcccggcgacuucgugcugagcgugcugagcgaccagcccaaggccggccccggcagcccccugagagugacccacaucaaggugaugugcgagggcggcagauacaccgugggcggccuggagaccuucgacagccugaccgaccugguggagcacuucaagaagaccggcaucgaggaggccagcggcgccuucguguaccugagacagcccuacuacgccaccagagugaacgccgccgacaucgagaacagagugcuggagcugaacaagaagcaggagagcgaggacaccgccaaggccggcuucugggaggaguucgagagccugcagaagcaggaggugaagaaccugcaccagagacuggagggccagagacccgagaacaagggcaagaacagauacaagaacauccugcccuucgaccacagcagagugauccugcagggcagagacagcaacauccccggcagcgacuacaucaacgccaacuacaucaagaaccagcugcugggccccgacgagaacgccaagaccuacaucgccagccagggcugccuggaggccaccgugaacgacuucuggcagauggccuggcaggagaacagcagagugaucgugaugaccaccagagagguggagaagggcagaaacaagugcgugcccuacuggcccgaggugggcaugcagagagccuacggccccuacagcgugaccaacugcggcgagcacgacaccaccgaguacaagcugagaacccugcaggugagcccccuggacaacggcgaccugaucagagagaucuggcacuaccaguaccugagcuggcccgaccacggcgugcccagcgagcccggcggcgugcugagcuuccuggaccagaucaaccagagacaggagagccugccccacgccggccccaucaucgugcacugcagcgccggcaucggcagaaccggcaccaucaucgugaucgacaugcugauggagaacaucagcaccaagggccuggacugcgacaucgacauccagaagaccauccagauggugagagcccagagaagcggcauggugcagaccgaggcccaguacaaguucaucuacguggccaucgcccaguucaucgagaccaccaagaagaagcuggaggugcugcagagccagaagggccaggagagcgaguacggcaacaucaccuacccccccgccaugaagaacgcccacgccaaggccagcagaaccagcagcaagcacaaggaggacguguacgagaaccugcacaccaagaacaagagagaggagaaggugaagaagcagagaagcgccgacaaggagaagagcaagggcagccugaagagaaaguaa

SEQ ID NO: 22217 - RNA, 1305 nt, Artificial Sequence
  PTPN7__Homo_sapiens__NP_001186726
augaacagacugggcugcuggcccgccagaagccugcccagaagcggcagaggcagcggccagagaagccugggccugggcggccaccccagcggccccagacaccccggcacccccgccgccaagagaaccugggagagccccggcgugagagccagagacugcccccugagcaccagcuggcugagcgagcccccccugggccccgccccccaccugagcauggugcaggcccacggcggcagaagcagagcccagccccugacccugagccugggcgccgccaugacccagcccccccccgagaagacccccgccaagaagcacgugagacugcaggagagaagaggcagcaacguggcccugaugcuggacgugagaagccugggcgccguggagcccaucugcagcgugaacacccccagagaggugacccugcacuuccugagaaccgccggccacccccugaccagaugggcccugcagagacagccccccagccccaagcagcuggaggaggaguuccugaagauccccagcaacuucgugagccccgaggaccuggacauccccggccacgccagcaaggacagauacaagaccauccugcccaacccccagagcagagugugccugggcagagcccagagccaggaggacggcgacuacaucaacgccaacuacaucagaggcuacgacggcaaggagaagguguacaucgccacccagggccccaugcccaacaccgugagcgacuucugggagaugguguggcaggaggaggugagccugaucgugaugcugacccagcugagagagggcaaggagaagugcgugcacuacuggcccaccgaggaggagaccuacggccccuuccagaucagaauccaggacaugaaggagugccccgaguacaccgugagacagcugaccauccaguaccaggaggagagaagaagcgugaagcacauccuguucagcgccuggcccgaccaccagacccccgagagcgccggcccccugcugagacugguggccgagguggaggagagccccgagaccgccgcccaccccggccccaucguggugcacugcagcgccggcaucggcagaaccggcugcuucaucgccaccagaaucggcugccagcagcugaaggccagaggcgagguggacauccugggcaucgugugccagcugagacuggacagaggcggcaugauccagaccgccgagcaguaccaguuccugcaccacacccuggcccuguacgccggccagcugcccgaggagcccagccccuaa

SEQ ID NO: 22218 - RNA, 1782 nt, Artificial Sequence
  PTPN9__Homo_sapiens__NP_002824
auggagcccgccaccgcccccagacccgacauggcccccgagcugacccccgaggaggagcaggccaccaagcaguuccuggaggagaucaacaaguggaccgugcaguacaacgugagcccccugagcuggaacguggccgugaaguuccugauggccagaaaguucgacgugcugagagccaucgagcuguuccacagcuacagagagaccagaagaaaggagggcaucgugaagcugaagccccacgaggagccccugagaagcgagauccugagcggcaaguucaccauccugaacgugagagaccccaccggcgccagcaucgcccuguucaccgccagacugcaccacccccacaagagcgugcagcacguggugcugcaggcccuguucuaccugcuggacagagccguggacagcuucgagacccagagaaacggccugguguucaucuacgacaugugcggcagcaacuacgccaacuucgagcuggaccugggcaagaaggugcugaaccugcugaagggcgccuuccccgccagacugaagaaggugcugaucgugggcgcccccaucugguucagagugcccuacagcaucaucagccugcugcugaaggacaaggugagagagagaauccagauccugaagaccagcgaggugacccagcaccugcccagagagugccugcccgagaaccugggcggcuacgugaagaucgaccuggccaccuggaacuuccaguuccugccccaggugaacggccaccccgaccccuucgacgagaucauccuguucagccugccccccgcccuggacugggacagcgugcacgugcccggcccccacgccaugaccauccaggagcugguggacuacgugaacgccagacagaagcagggcaucuacgaggaguacgaggacaucagaagagagaaccccgugggcaccuuccacugcagcaugagccccggcaaccuggagaagaacagauacggcgacgugcccugccuggaccagaccagagugaagcugaccaagagaagcggccacacccagaccgacuacaucaacgccagcuucauggacggcuacaagcagaagaacgccuacaucggcacccagggcccccuggagaacaccuacagagacuucuggcugauggugugggagcagaaggugcuggugaucgugaugaccaccagauucgaggagggcggcagaagaaagugcggccaguacuggccccuggagaaggacagcagaaucagauucggcuuccugaccgugaccaaccugggcguggagaacaugaaccacuacaagaagaccacccuggagauccacaacaccgaggagagacagaagagacaggugacccacuuccaguuccugagcuggcccgacuacggcgugcccagcagcgccgccagccugaucgacuuccugagaguggugagaaaccagcagagccuggccgugagcaacaugggcgccagaagcaagggccagugccccgagccccccaucguggugcacugcagcgccggcaucggcagaaccggcaccuucugcagccuggacaucugccuggcccagcuggaggagcugggcacccugaacguguuccagaccgugagcagaaugagaacccagagagccuucagcauccagacccccgagcaguacuacuucugcuacaaggccauccuggaguucgccgagaaggagggcauggugagcagcggccagaaccugcuggccguggagagccaguaa

SEQ ID NO: 22219 - RNA, 2409 nt, Artificial Sequence
  PTPRA__Homo_sapiens__NP_002827
auggacagcugguucauccuggugcugcugggcagcggccugaucugcgugagcgccaacaacgccaccaccguggcccccagcgugggcaucaccagacugaucaacagcagcaccgccgagcccgugaaggaggaggccaagaccagcaaccccaccagcagccugaccagccugagcguggcccccaccuucagccccaacaucacccugggccccaccuaccugaccaccgugaacagcagcgacagcgacaacggcaccaccagaaccgccagcaccaacagcaucggcaucaccaucagccccaacggcaccuggcugcccgacaaccaguucaccgacgccagaaccgagcccugggagggcaacagcagcaccgccgccaccacccccgagaccuucccccccagcggcaacagcgacagcaaggacagaagagacgagacccccaucaucgccgugaugguggcccugagcagccugcuggugaucguguucaucaucaucgugcuguacaugcugagauucaagaaguacaagcaggccggcagccacagcaacagcuucagacugagcaacggcagaaccgaggacguggagccccagagcgugccccugcuggccagaagccccagcaccaacagaaaguaccccccccugcccguggacaagcuggaggaggagaucaacagaagaauggccgacgacaacaagcuguucagagaggaguucaacgcccugcccgccugccccauccaggccaccugcgaggccgccagcaaggaggagaacaaggagaagaacagauacgugaacauccugcccuacgaccacagcagagugcaccugacccccguggagggcgugcccgacagcgacuacaucaacgccagcuucaucaacggcuaccaggagaagaacaaguucaucgccgcccagggccccaaggaggagaccgugaacgacuucuggagaaugaucugggagcagaacaccgccaccaucgugauggugaccaaccugaaggagagaaaggagugcaagugcgcccaguacuggcccgaccagggcugcuggaccuacggcaacaucagagugagcguggaggacgugaccgugcugguggacuacaccgugagaaaguucugcauccagcaggugggcgacaugaccaacagaaagccccagagacugaucacccaguuccacuucaccagcuggcccgacuucggcgugcccuucacccccaucggcaugcugaaguuccugaagaaggugaaggccugcaacccccaguacgccggcgccaucguggugcacugcagcgccggcgugggcagaaccggcaccuucguggugaucgacgccaugcuggacaugaugcacaccgagagaaagguggacguguacggcuucgugagcagaaucagagcccagagaugccagauggugcagaccgacaugcaguacguguucaucuaccaggcccugcuggagcacuaccuguacggcgacaccgagcuggaggugaccagccuggagacccaccugcagaagaucuacaacaagauccccggcaccagcaacaacggccuggaggaggaguucaagaagcugaccagcaucaagauccagaacgacaagaugagaaccggcaaccugcccgccaacaugaagaagaacagagugcugcagaucauccccuacgaguucaacagagugaucauccccgugaagagaggcgaggagaacaccgacuacgugaacgccagcuucaucgacggcuacagacagaaggacagcuacaucgccagccagggcccccugcugcacaccaucgaggacuucuggagaaugaucugggaguggaagagcugcagcaucgugaugcugaccgagcuggaggagagaggccaggagaagugcgcccaguacuggcccagcgacggccuggugagcuacggcgacaucaccguggagcugaagaaggaggaggagugcgagagcuacaccgugagagaccugcuggugaccaacaccagagagaacaagagcagacagaucagacaguuccacuuccacggcuggcccgaggugggcauccccagcgacggcaagggcaugaucagcaucaucgccgccgugcagaagcagcagcagcagagcggcaaccaccccaucaccgugcacugcagcgccggcgccggcagaaccggcaccuucugcgcccugagcaccgugcuggagagagugaaggccgagggcauccuggacguguuccagaccgugaagagccugagacugcagagaccccacauggugcagacccuggagcaguacgaguucugcuacaagguggugcaggaguacaucgacgccuucagcgacuacgccaacuucaaguaa

SEQ ID NO: 22220 - RNA, 6648 nt, Artificial Sequence
  PTPRB__Homo_sapiens__NP_001103224
auggaggccgaguucuacauggugauccugaccugccugaucuucagaaacagcgagggcuuccagaucgugcacgugcagaagcagcagugccuguucaagaacgagaaggugguggugggcagcugcaacagaaccauccagaaccagcaguggauguggaccgaggacgagaagcugcugcacgugaagagcgcccugugccuggccaucagcaacagcagcagaggccccagcagaagcgccauccuggacagaugcagccaggcccccagauggaccugcuacgaccaggagggcuuccuggagguggagaacgccagccuguuccugcagaagcagggcagcagagugguggugaagaaggccagaaaguaccugcacagcuggaugaagaucgacgugaacaaggagggcaagcuggugaacgagagccugugccugcagaaggccggccugggcgccgaggugagcgugagaagcaccagaaacaccgcccccccccagauccugaccaccuucaacgccgugcccgacggccugguguuccugaucagaaacaccaccgaggccuucaucagaaacgccgccgagaacuacagccagaacagcagcgagagacagcaccccaaccugcacaugaccggcaucaccgacaccagcugggugcugagcaccacccagcccuucagcagcaccaccgaggagaccggccuggccgagcccgagagaugcaacuucacccuggccgagagcaaggccagcagccacagcgugagcauccaguggagaauccugggcagccccugcaacuucagccugaucuacagcagcgacacccugggcgccgcccugugccccaccuucagaaucgacaacaccaccuacggcugcaaccugcaggaccugcaggccggcaccaucuacaacuucagaaucaucagccuggacgaggagagaaccguggugcugcagaccgacccccugccccccgccagauucggcgugagcaaggagaagaccaccagcaccagccugcacgugugguggacccccagcagcggcaaggugaccagcuacgaggugcagcuguucgacgagaacaaccagaagauccagggcgugcagauccaggagagcaccagcuggaacgaguacaccuucuucaaccugaccgccggcagcaaguacaacaucgccaucaccgccgugagcggcggcaagagaagcuucagcguguacaccaacggcagcaccgugcccagccccgugaaggacaucggcaucagcaccaaggccaacagccugcugaucagcuggagccacggcagcggcaacguggagagauacagacugaugcugauggacaagggcauccuggugcacggcggcgugguggacaagcacgccaccagcuacgccuuccacggccugacccccggcuaccuguacaaccugaccgugaugaccgaggccgccggccugcagaacuacagauggaagcuggugagaaccgcccccauggaggugagcaaccugaaggugaccaacgacggcagccugaccagccugaaggugaaguggcagagaccccccggcaacguggacagcuacaacaucacccugagccacaagggcaccaucaaggagagcagagugcuggcccccuggaucaccgagacccacuucaaggagcuggugcccggcagacuguaccaggugaccgugagcugcgugagcggcgagcugagcgcccagaagauggccgugggcagaaccuuccccgacaagguggccaaccuggaggccaacaacaacggcagaaugagaagccugguggugagcuggagcccccccgccggcgacugggagcaguacagaauccugcuguucaacgacagcguggugcugcugaacaucaccgugggcaaggaggagacccaguacgugauggacgacaccggccuggugcccggcagacaguacgagguggaggugaucguggagagcggcaaccugaagaacagcgagagaugccagggcagaaccgugccccuggccgugcugcagcugagagugaagcacgccaacgagaccagccugagcaucauguggcagacccccguggccgagugggagaaguacaucaucagccuggccgacagagaccugcugcugauccacaagagccugagcaaggacgccaaggaguucaccuucaccgaccuggugcccggcagaaaguacauggccaccgugaccagcaucagcggcgaccugaagaacagcagcagcgugaagggcagaaccgugcccgcccaggugaccgaccugcacguggccaaccagggcaugaccagcagccuguucaccaacuggacccaggcccagggcgacguggaguucuaccaggugcugcugauccacgagaacguggugaucaagaacgagagcaucagcagcgagaccagcagauacagcuuccacagccugaagagcggcagccuguacagcgugguggugaccaccgugagcggcggcaucagcagcagacagguggugguggagggcagaaccgugcccagcagcgugagcggcgugaccgugaacaacagcggcagaaacgacuaccugagcgugagcuggcugcuggcccccggcgacguggacaacuacgaggugacccugagccacgacggcaagguggugcagagccuggugaucgccaagagcgugagagagugcagcuucagcagccugacccccggcagacuguacaccgugaccaucaccaccagaagcggcaaguacgagaaccacagcuucagccaggagagaaccgugcccgacaaggugcagggcgugagcgugagcaacagcgccagaagcgacuaccugagagugagcugggugcacgccaccggcgacuucgaccacuacgaggugaccaucaagaacaagaacaacuucauccagaccaagagcauccccaagagcgagaacgagugcguguucgugcagcuggugcccggcagacuguacagcgugaccgugaccaccaagagcggccaguacgaggccaacgagcagggcaacggcagaaccauccccgagcccgugaaggaccugacccugagaaacagaagcaccgaggaccugcacgugaccuggagcggcgccaacggcgacguggaccaguacgagauccagcugcuguucaacgacaugaagguguucccccccuuccaccuggugaacaccgccaccgaguacagauucaccagccugacccccggcagacaguacaagauccuggugcugaccaucagcggcgacgugcagcagagcgccuucaucgagggcuucaccgugcccagcgccgugaagaacauccacaucagccccaacggcgccaccgacagccugaccgugaacuggacccccggcggcggcgacguggacagcuacaccgugagcgccuucagacacagccagaagguggacagccagaccauccccaagcacguguucgagcacaccuuccacagacuggaggccggcgagcaguaccagaucaugaucgccagcgugagcggcagccugaagaaccagaucaacguggugggcagaaccgugcccgccagcgugcagggcgugaucgccgacaacgccuacagcagcuacagccugaucgugagcuggcagaaggccgccggcguggccgagagauacgacauccugcugcugaccgagaacggcauccugcugagaaacaccagcgagcccgccaccaccaagcagcacaaguucgaggaccugacccccggcaagaaguacaagauccagauccugaccgugagcggcggccuguucagcaaggaggcccagaccgagggcagaaccgugcccgccgccgugaccgaccugagaaucaccgagaacagcaccagacaccugagcuucagauggaccgccagcgagggcgagcugagcugguacaacaucuuccuguacaaccccgacggcaaccugcaggagagagcccagguggacccccuggugcagagcuucagcuuccagaaccugcugcagggcagaauguacaagauggugaucgugacccacagcggcgagcugagcaacgagagcuucaucuucggcagaaccgugcccgccagcgugagccaccugagaggcagcaacagaaacaccaccgacagccugugguucaacuggagccccgccagcggcgacuucgacuucuacgagcugauccuguacaaccccaacggcaccaagaaggagaacuggaaggacaaggaccugaccgaguggagauuccagggccuggugcccggcagaaaguacgugcuguggguggugacccacagcggcgaccugagcaacaaggugaccgccgagagcagaaccgcccccagcccccccagccugaugagcuucgccgacaucgccaacaccagccuggccaucaccuggaagggcccccccgacuggaccgacuacaacgacuucgagcugcaguggcugcccagagacgcccugaccguguucaaccccuacaacaacagaaagagcgagggcagaaucguguacggccugagacccggcagaagcuaccaguucaacgugaagaccgugagcggcgacagcuggaagaccuacagcaagcccaucuucggcagcgugagaaccaagcccgacaagauccagaaccugcacugcagaccccagaacagcaccgccaucgccugcagcuggaucccccccgacagcgacuucgacggcuacagcaucgagugcagaaagauggacacccaggagguggaguucagcagaaagcuggagaaggagaagagccugcugaacaucaugaugcuggugccccacaagagauaccuggugagcaucaaggugcagagcgccggcaugaccagcgaggugguggaggacagcaccaucaccaugaucgacagacccccccccccccccccccacaucagagugaacgagaaggacgugcugaucagcaagagcagcaucaacuucaccgugaacugcagcugguucagcgacaccaacggcgccgugaaguacuucaccgugguggugagagaggccgacggcagcgacgagcugaagcccgagcagcagcacccccugcccagcuaccuggaguacagacacaacgccagcaucagaguguaccagaccaacuacuucgccagcaagugcgccgagaaccccaacagcaacagcaagagcuucaacaucaagcugggcgccgagauggagagccugggcggcaagugcgaccccacccagcagaaguucugcgacggcccccugaagccccacaccgccuacagaaucagcaucagagccuucacccagcuguucgacgaggaccugaaggaguucaccaagccccuguacagcgacaccuucuucagccugcccaucaccaccgagagcgagccccuguucggcgccaucgagggcgugagcgccggccuguuccugaucggcaugcugguggccgugguggcccugcugaucugcagacagaaggugagccacggcagagagagacccagcgccagacugagcaucagaagagacagaccccugagcgugcaccugaaccugggccagaagggcaacagaaagaccagcugccccaucaagaucaaccaguucgagggccacuucaugaagcugcaggccgacagcaacuaccugcugagcaaggaguacgaggagcugaaggacgugggcagaaaccagagcugcgacaucgcccugcugcccgagaacagaggcaagaacagauacaacaacauccugcccuacgacgccaccagagugaagcugagcaacguggacgacgaccccugcagcgacuacaucaacgccagcuacauccccggcaacaacuucagaagagaguacaucgugacccagggcccccugcccggcaccaaggacgacuucuggaagauggugugggagcagaacgugcacaacaucgugauggugacccagugcguggagaagggcagagugaagugcgaccacuacuggcccgccgaccaggacagccuguacuacggcgaccugauccugcagaugcugagcgagagcgugcugcccgaguggaccaucagagaguucaagaucugcggcgaggagcagcuggacgcccacagacugaucagacacuuccacuacaccguguggcccgaccacggcgugcccgagaccacccagagccugauccaguucgugagaaccgugagagacuacaucaacagaagccccggcgccggccccaccguggugcacugcagcgccggcgugggcagaaccggcaccuucaucgcccuggacagaauccugcagcagcuggacagcaaggacagcguggacaucuacggcgccgugcacgaccugagacugcacagagugcacauggugcagaccgagugccaguacguguaccugcaccagugcgugagagacgugcugagagccagaaagcugagaagcgagcaggagaacccccuguuccccaucuacgagaacgugaaccccgaguaccacagagaccccguguacagcagacacuaa

SEQ ID NO: 22221 - RNA, 621 nt, Artificial Sequence
  PTPRCAP__Homo_sapiens__NP_005599
auggcccugcccugcacccugggccugggcaugcugcuggcccugcccggcgcccugggcagcggcggcagcgccgaggacagcgugggcagcagcagcgugaccguggugcugcugcugcugcugcugcugcugcuggccaccggccuggcccuggccuggagaagacugagcagagacagcggcggcuacuaccaccccgccagacugggcgccgcccuguggggcagaaccagaagacugcugugggccagcccccccggcagauggcugcaggccagagccgagcugggcagcaccgacaacgaccuggagagacaggaggacgagcaggacaccgacuacgaccacguggccgacggcggccugcaggccgaccccggcgagggcgagcagcagugcggcgaggccagcagccccgagcaggugcccgugagagccgaggaggccagagacagcgacaccgagggcgaccuggugcugggcagccccggccccgccagcgccggcggcagcgccgaggcccugcugagcgaccugcacgccuucgccggcagcgccgccugggacgacagcgccagagccgccggcggccagggccugcacgugaccgcccuguaa

SEQ ID NO: 22222 - RNA, 4509 nt, Artificial Sequence
  PTPRD__Homo_sapiens__NP_001035802
auggugcacguggccagacugcugcugcugcugcugaccuucuuccugagaaccgacgccgagaccccccccagauucaccagaacccccguggaccagaccggcgugagcggcggcguggccagcuucaucugccaggccaccggcgaccccagacccaagaucguguggaacaagaagggcaagaaggugagcaaccagagauucgaggugaucgaguucgacgacggcagcggcagcgugcugagaauccagccccugagaacccccagagacgaggccaucuacgagugcguggccagcaacaacgugggcgagaucagcgugagcaccagacugaccgugcugagagaggaccagauccccagaggcuuccccaccaucgacaugggcccccagcugaaggugguggagagaaccagaaccgccaccaugcugugcgccgccagcggcaaccccgaccccgagaucaccugguucaaggacuuccugcccguggacaccagcaacaacaacggcagaaucaagcagcugagaagcggcggcacccccaucagaggcgcccugcagaucgagcagagcgaggagagcgaccagggcaaguacgagugcguggccaccaacagcgccggcaccagauacagcgcccccgccaaccuguacgugagagagcugagagaggugagaagagugccccccagauucagcaucccccccaccaaccacgagaucaugcccggcggcagcgugaacaucaccugcguggccgugggcagccccaugcccuacgugaaguggaugcugggcgccgaggaccugacccccgaggacgacaugcccaucggcagaaacgugcuggagcugaacgacgugagacagagcgccaacuacaccugcguggccaugagcacccugggcgugaucgaggccaucgcccagaucaccgugaaggcccugcccaagccccccggcacccccguggugaccgagagcaccgccaccagcaucacccugaccugggacagcggcaaccccgagcccgugagcuacuacaucauccagcacaagcccaagaacagcgaggagcuguacaaggagaucgacggcguggccaccaccagauacagcguggccggccugagccccuacagcgacuacgaguucagagugguggccgugaacaacaucggcagaggcccccccagcgagcccgugcugacccagaccagcgagcaggcccccagcagcgcccccagagacgugcaggccagaaugcugagcagcaccaccauccuggugcaguggaaggagcccgaggagcccaacggccagauccagggcuacagaguguacuacaccauggaccccacccagcacgugaacaacuggaugaagcacaacguggccgacagccagaucaccaccaucggcaaccuggugccccagaagaccuacagcgugaaggugcuggccuucaccagcaucggcgacggcccccugagcagcgacauccaggugaucacccagaccggcgugcccggccagccccugaacuucaaggccgagcccgagagcgagaccagcauccugcugagcuggaccccccccagaagcgacaccaucgccaacuacgagcugguguacaaggacggcgagcacggcgaggagcagagaaucaccaucgagcccggcaccagcuacagacugcagggccugaagcccaacagccuguacuacuucagacuggccgccagaagcccccagggccugggcgccagcaccgccgagaucagcgccagaaccaugcagagcauguucgccaagaacuuccacgugaaggccgugaugaagaccagcgugcugcugagcugggagauccccgagaacuacaacagcgccaugcccuucaagauccuguacgacgacggcaagaugguggaggagguggacggcagagccacccagaagcugaucgugaaccugaagcccgagaagagcuacagcuucgugcugaccaacagaggcaacagcgccggcggccugcagcacagagugaccgccaagaccgcccccgacgugcugagaaccaagcccgccuucaucggcaagaccaaccuggacggcaugaucaccgugcagcugcccgaggugcccgccaacgagaacaucaagggcuacuacaucaucaucgugccccugaagaagagcagaggcaaguucaucaagcccugggagagccccgacgagauggagcuggacgagcugcugaaggagaucagcagaaagagaagaagcaucagauacggcagagagguggagcugaagcccuacaucgccgcccacuucgacgugcugcccaccgaguucacccugggcgacgacaagcacuacggcggcuucaccaacaagcagcugcagagcggccaggaguacguguucuucgugcuggccgugauggagcacgccgagagcaagauguacgccaccagccccuacagcgaccccguggugagcauggaccuggacccccagcccaucaccgacgaggaggagggccugaucuggguggugggccccgugcuggccgugguguucaucaucugcaucgugaucgccauccugcuguacaagagcaagcccgacagaaagagagccgagagcgacagcagaaagagcagcauccccaacaacaaggagauccccagccaccaccccaccgaccccguggagcugagaagacugaacuuccagacccccggcauggccagccacccccccauccccauccuggagcuggccgaccacaucgagagacugaaggccaacgacaaccugaaguucagccaggaguacgagagcaucgaccccggccagcaguucaccugggagcacagcaaccuggaggugaacaagcccaagaacagauacgccaacgugaucgccuacgaccacagcagagugcugcugagcgccaucgagggcauccccggcagcgacuacgugaacgccaacuacaucgacggcuacagaaagcagaacgccuacaucgccacccagggcagccugcccgagaccuucggcgacuucuggagaaugaucugggagcagagaagcgccaccguggugaugaugaccaagcuggaggagagaagcagagugaagugcgaccaguacuggcccagcagaggcaccgagacccacggccuggugcaggugacccugcuggacaccguggagcuggccaccuacugcgugagaaccuucgcccuguacaagaacggcagcagcgagaagagagaggugagacaguuccaguucaccgccuggcccgaccacggcgugcccgagcaccccacccccuuccuggccuuccugagaagagugaagaccugcaacccccccgacgccggccccaugguggugcacugcagcgccggcgugggcagaaccggcugcuucaucgugaucgacgccaugcuggagagaaucaagcacgagaagaccguggacaucuacggccacgugacccugaugagagcccagagaaacuacauggugcagaccgaggaccaguacaucuucauccacgacgcccugcuggaggccgugaccugcggcaacaccgaggugcccgccagaaaccuguacgccuacauccagaagcugacccagaucgagaccggcgagaacgugaccggcauggagcuggaguucaagagacuggccagcagcaaggcccacaccagcagauucaucagcgccaaccugcccugcaacaaguucaagaacagacuggugaacaucaugcccuacgagagcaccagagugugccugcagcccaucagaggcguggagggcagcgacuacaucaacgccagcuucaucgacggcuacagacagcagaaggccuacaucgccacccagggcccccuggccgagaccaccgaggacuucuggagaaugcugugggagcacaacagcaccaucguggugaugcugaccaagcugagagagaugggcagagagaagugccaccaguacuggcccgccgagagaagcgccagauaccaguacuucgugguggaccccauggccgaguacaacaugccccaguacauccugagagaguucaaggugaccgacgccagagacggccagagcagaaccgugagacaguuccaguucaccgacuggcccgagcagggcgugcccaagagcggcgagggcuucaucgacuucaucggccaggugcacaagaccaaggagcaguucggccaggacggccccaucagcgugcacugcagcgccggcgugggcagaaccggcguguucaucacccugagcaucgugcuggagagaaugagauacgagggcgugguggacaucuuccagaccgugaagaugcugagaacccagagacccgccauggugcagaccgaggaccaguaccaguucagcuacagagccgcccuggaguaccugggcagcuucgaccacuacgccaccuaa

SEQ ID NO: 22223 - RNA, 2103 nt, Artificial Sequence
  PTPRE__Homo_sapiens__NP_006495
auggagccccugugcccccugcugcuggugggcuucagccugccccuggccagagcccugagaggcaacgagaccaccgccgacagcaacgagaccaccaccaccagcggcccccccgaccccggcgccagccagccccugcuggccuggcugcugcugccccugcugcugcugcugcuggugcugcugcuggccgccuacuucuucagauucagaaagcagagaaaggccguggugagcaccagcgacaagaagaugcccaacggcauccuggaggagcaggagcagcagagagugaugcugcugagcagaagccccagcggccccaagaaguacuuccccauccccguggagcaccuggaggaggagaucagaaucagaagcgccgacgacugcaagcaguucagagaggaguucaacagccugcccagcggccacauccagggcaccuucgagcuggccaacaaggaggagaacagagagaagaacagauaccccaacauccugcccaacgaccacagcagagugauccugagccagcuggacggcauccccugcagcgacuacaucaacgccagcuacaucgacggcuacaaggagaagaacaaguucaucgccgcccagggccccaagcaggagaccgugaacgacuucuggagaauggugugggagcagaagagcgccaccaucgugaugcugaccaaccugaaggagagaaaggaggagaagugccaccaguacuggcccgaccagggcugcuggaccuacggcaacaucagagugugcguggaggacugcguggugcugguggacuacaccaucagaaaguucugcauccagccccagcugcccgacggcugcaaggcccccagacuggugagccagcugcacuucaccagcuggcccgacuucggcgugcccuucacccccaucggcaugcugaaguuccugaagaaggugaagacccugaaccccgugcacgccggccccaucguggugcacugcagcgccggcgugggcagaaccggcaccuucaucgugaucgacgccaugauggccaugaugcacgccgagcagaagguggacguguucgaguucgugagcagaaucagaaaccagagaccccagauggugcagaccgacaugcaguacaccuucaucuaccaggcccugcuggaguacuaccuguacggcgacaccgagcuggacgugagcagccuggagaagcaccugcagaccaugcacggcaccaccacccacuucgacaagaucggccuggaggaggaguucagaaagcugaccaacgugagaaucaugaaggagaacaugagaaccggcaaccugcccgccaacaugaagaaggccagagugauccagaucauccccuacgacuucaacagagugauccugagcaugaagagaggccaggaguacaccgacuacaucaacgccagcuucaucgacggcuacagacagaaggacuacuucaucgccacccagggcccccuggcccacaccguggaggacuucuggagaaugaucugggaguggaagagccacaccaucgugaugcugaccgaggugcaggagagagagcaggacaagugcuaccaguacuggcccaccgagggcagcgugacccacggcgagaucaccaucgagaucaagaacgacacccugagcgaggccaucagcaucagagacuuccuggugacccugaaccagccccaggccagacaggaggagcaggugagaguggugagacaguuccacuuccacggcuggcccgagaucggcauccccgccgagggcaagggcaugaucgaccugaucgccgccgugcagaagcagcagcagcagaccggcaaccaccccaucaccgugcacugcagcgccggcgccggcagaaccggcaccuucaucgcccugagcaacauccuggagagagugaaggccgagggccugcuggacguguuccaggccgugaagagccugagacugcagagaccccacauggugcagacccuggagcaguacgaguucugcuacaagguggugcaggacuucaucgacaucuucagcgacuacgccaacuucaaguaa

SEQ ID NO: 22224 - RNA, 4338 nt, Artificial Sequence
  PTPRG__Homo_sapiens__NP_002832
augagaagacugcuggagcccugcugguggauccuguuccugaagaucaccagcagcgugcugcacuacguggugugcuuccccgcccugaccgagggcuacgugggcgcccugcacgagaacagacacggcagcgccgugcagaucagaagaagaaaggccagcggcgaccccuacugggccuacagcggcgccuacggccccgagcacugggugaccagcagcgugagcugcggcggcagacaccagagccccaucgacauccuggaccaguacgccagagugggcgaggaguaccaggagcugcagcuggacggcuucgacaacgagagcagcaacaagaccuggaugaagaacaccggcaagaccguggccauccugcugaaggacgacuacuucgugagcggcgccggccugcccggcagauucaaggccgagaagguggaguuccacuggggccacagcaacggcagcgccggcagcgagcacagcaucaacggcagaagauuccccguggagaugcagaucuucuucuacaaccccgacgacuucgacagcuuccagaccgccaucagcgagaacagaaucaucggcgccauggccaucuucuuccaggugagccccagagacaacagcgcccuggaccccaucauccacggccugaagggcguggugcaccacgagaaggagaccuuccuggaccccuucgugcugagagaccugcugcccgccagccugggcagcuacuacagauacaccggcagccugaccaccccccccugcagcgagaucguggaguggaucguguucagaagacccgugcccaucagcuaccaccagcuggaggccuucuacagcaucuucaccaccgagcagcaggaccacgugaagagcguggaguaccugagaaacaacuucagaccccagcagagacugcacgacagaguggugagcaagagcgccgugagagacagcuggaaccacgacaugaccgacuuccuggagaacccccugggcaccgaggccagcaaggugugcagcagcccccccauccacaugaaggugcagccccugaaccagaccgcccugcaggugagcuggagccagcccgagaccaucuaccacccccccaucaugaacuacaugaucagcuacagcuggaccaagaacgaggacgagaaggagaagaccuucaccaaggacagcgacaaggaccugaaggccaccaucagccacgugagccccgacagccuguaccuguucagagugcaggccgugugcagaaacgacaugagaagcgacuucagccagaccaugcuguuccaggccaacaccaccagaaucuuccagggcaccagaaucgugaagaccggcgugcccaccgccagccccgccagcagcgccgacauggcccccaucagcagcggcagcagcaccuggaccagcagcggcauccccuucagcuucgugagcauggccaccggcaugggccccagcagcagcggcagccaggccaccguggccagcguggugaccagcacccugcuggccggccugggcuucggcggcggcggcaucagcagcuuccccagcaccguguggcccaccagacugcccaccgccgccagcgccagcaagcaggccgccagacccgugcuggccaccaccgaggcccuggccagccccggccccgacggcgacagcagccccaccaaggacggcgagggcaccgaggagggcgagaaggacgagaagagcgagagcgaggacggcgagagagagcacgaggaggacggcgagaaggacagcgagaagaaggagaagagcggcgugacccacgccgccgaggagagaaaccagaccgagcccagccccacccccagcagccccaacagaaccgccgagggcggccaccagaccauccccggccacgagcaggaccacaccgccgugcccaccgaccagaccggcggcagaagagacgccggccccggccuggaccccgacauggugaccagcacccaggugccccccaccgccaccgaggagcaguacgccggcagcgaccccaagagacccgagaugcccagcaagaagcccaugagcagaggcgacagauucagcgaggacagcagauucaucaccgugaaccccgccgagaagaacaccagcggcaugaucagcagacccgcccccggcagaauggaguggaucaucccccugaucguggugagcgcccugaccuucgugugccugauccugcugaucgccgugcugguguacuggagaggcugcaacaagaucaagagcaagggcuuccccagaagauucagagaggugcccagcagcggcgagagaggcgagaagggcagcagaaagugcuuccagaccgcccacuucuacguggaggacagcagcagccccagaguggugcccaacgagagcauccccaucauccccauccccgacgacauggaggccauccccgugaagcaguucgugaagcacaucggcgagcuguacagcaacaaccagcacggcuucagcgaggacuucgaggaggugcagagaugcaccgccgacaugaacaucaccgccgagcacagcaaccaccccgagaacaagcacaagaacagauacaucaacauccuggccuacgaccacagcagagugaagcugagaccccugcccggcaaggacagcaagcacagcgacuacaucaacgccaacuacguggacggcuacaacaaggccaaggccuacaucgccacccagggcccccugaagagcaccuucgaggacuucuggagaaugaucugggagcagaacaccggcaucaucgugaugaucaccaaccugguggagaagggcagaagaaagugcgaccaguacuggcccaccgagaacagcgaggaguacggcaacaucaucgugacccugaagagcaccaagauccacgccugcuacaccgugagaagauucagcaucagaaacaccaaggugaagaagggccagaagggcaaccccaagggcagacagaacgagagaguggugauccaguaccacuacacccaguggcccgacaugggcgugcccgaguacgcccugcccgugcugaccuucgugagaagaagcagcgccgccagaaugcccgagaccggccccgugcuggugcacugcagcgccggcgugggcagaaccggcaccuacaucgugaucgacagcaugcugcagcagaucaaggacaagagcaccgugaacgugcugggcuuccugaagcacaucagaacccagagaaacuaccuggugcagaccgaggagcaguacaucuucauccacgacgcccugcuggaggccauccugggcaaggagaccgaggugagcagcaaccagcugcacagcuacgugaacagcauccugauccccggcgugggcggcaagaccagacuggagaagcaguucaagcuggugacccagugcaacgccaaguacguggagugcuucagcgcccagaaggagugcaacaaggagaagaacagaaacagcagcguggugcccagcgagagagccagagugggccuggccccccugcccggcaugaagggcaccgacuacaucaacgccagcuacaucaugggcuacuacagaagcaacgaguucaucaucacccagcacccccugccccacaccaccaaggacuucuggagaaugaucugggaccacaacgcccagaucaucgugaugcugcccgacaaccagagccuggccgaggacgaguucguguacuggcccagcagagaggagagcaugaacugcgaggccuucaccgugacccugaucagcaaggacagacugugccugagcaacgaggagcagaucaucauccacgacuucauccuggaggccacccaggacgacuacgugcuggaggugagacacuuccagugccccaaguggcccaaccccgacgcccccaucagcagcaccuucgagcugaucaacgugaucaaggaggaggcccugaccagagacggccccaccaucgugcacgacgaguacggcgccgugagcgccggcaugcugugcgcccugaccacccugagccagcagcuggagaacgagaacgccguggacguguuccagguggccaagaugaucaaccugaugagacccggcguguucaccgacaucgagcaguaccaguucaucuacaaggccaugcugagccuggugagcaccaaggagaacggcaacggccccaugaccguggacaagaacggcgccgugcugaucgccgacgagagcgaccccgccgagagcauggagagccugguguaa

SEQ ID NO: 22225 - RNA, 2814 nt, Artificial Sequence
  PTPRH__Homo_sapiens__NP_001154912
auggccggcgccggcggcggccugggcguguggggcaaccuggugcugcugggccugugcagcuggaccggcgccagagcccccgcccccaaccccggcagaaaccugaccguggagacccagaccaccagcagcaucagccugagcugggaggugcccgacggccuggacagccagaacagcaacuacugggugcagugcaccggcgacggcggcaccaccgagaccagaaacaccaccgccaccaacgugaccguggacggccugggccccggcagccuguacaccugcagcguguggguggagaaggacggcgugaacagcagcgugggcaccgugaccaccgccaccgcccccaaccccgugagaaaccugaccguggaggcccagaccaacagcagcaucgcccugaccugggaggugcccgacggccccgacccccagaacagcaccuacggcguggaguacaccggcgacggcggcagagccggcaccagaagcaccgcccacaccaacaucaccguggacagacuggagcccggcugccuguacguguucagcgugugggugggcaagaacggcaucaacagcagcagagagaccagaaacgccaccaccgcccccaaccccgugagaaaccugcacauggagacccagaccaacagcagcaucgcccugugcugggaggugcccgacggccccuacccccaggacuacaccuacuggguggaguacaccggcgacggcggcggcaccgagaccagaaacaccaccaacaccagcgugaccgccgagagacuggagcccggcacccuguacaccuucagcgugugggccgagaagaacggcgccagaggcagcagacagaacgugagcaucagcaccgugcccaacgccgugaccagccugagcaagcaggacuggaccaacagcaccaucgcccugagauggaccgccccccagggccccggccagagcagcuacagcuacugggugagcugggugagagagggcaugaccgaccccagaacccagagcaccagcggcaccgacaucacccugaaggagcuggaggccggcagccuguaccaccugaccgugugggccgagagaaacgaggugagaggcuacaacagcacccugaccgccgccaccgcccccaacgaggugaccgaccugcagaacgagacccagaccaagaacagcgugaugcugugguggaaggcccccggcgacccccacagccagcuguacguguacugggugcagugggccagcaagggccaccccagaagaggccaggacccccaggccaacugggugaaccagaccagcagaaccaacgagaccugguacaagguggaggcccuggagcccggcacccuguacaacuucaccgugugggccgagagaaacgacguggccagcagcacccagagccugugcgccagcaccuaccccgacaccgugaccaucaccagcugcgugagcaccagcgccggcuacggcgugaaccugaucuggagcugcccccagggcggcuacgaggccuucgagcuggaggugggcggccagagaggcagccaggacagaagcagcugcggcgaggccgugagcgugcugggccugggccccgccagaagcuaccccgccaccaucaccaccaucugggacggcaugaagguggugagccacagcguggugugccacaccgagagcgccggcgugaucgccggcgccuucgugggcauccugcuguuccugauccuggugggccugcugaucuucuuccugaagagaagaaacaagaagaagcagcagaagcccgagcugagagaccugguguucagcagccccggcgacauccccgccgaggacuucgccgaccacgugagaaagaacgagagagacagcaacugcggcuucgccgacgaguaccagcagcugagccuggugggccacagccagagccagaugguggccagcgccagcgagaacaacgccaagaacagauacagaaacgugcugcccuacgacuggagcagagugccccugaagcccauccacgaggagcccggcagcgacuacaucaacgccagcuucaugcccggccuguggagcccccaggaguucaucgccacccagggcccccugccccagaccgugggcgacuucuggagacuggugugggagcagcagagccacacccuggugaugcugaccaacugcauggaggccggcagagugaagugcgagcacuacuggccccuggacagccagcccugcacccacggccaccugagagugacccuggugggcgaggaggugauggagaacuggaccgugagagagcugcugcugcugcagguggaggagcagaagacccugagcgugagacaguuccacuaccaggccuggcccgaccacggcgugcccagcagccccgacacccugcuggccuucuggagaaugcugagacaguggcuggaccagaccauggagggcggcccccccaucgugcacugcagcgccggcgugggcagaaccggcacccugaucgcccuggacgugcugcugagacagcugcagagcgagggccugcugggccccuucagcuucgugagaaagaugagagagagcagaccccugauggugcagaccgaggcccaguacguguuccugcaccagugcauccugagauuccugcagcagagcgcccaggcccccgccgagaaggaggugcccuacgaggacguggagaaccugaucuacgagaacguggccgccauccaggcccacaagcuggagguguaa

SEQ ID NO: 22226 - RNA, 1620 nt, Artificial Sequence
  PTPRJ__Homo_sapiens__NP_001091973
augaagcccgccgccagagaggccagacugccccccagaagccccggccugagaugggcccugccccugcugcugcugcugcugagacugggccagauccugugcgccggcggcacccccagccccauccccgaccccagcguggccaccguggccaccggcgagaacggcaucacccagaucagcagcaccgccgagagcuuccacaagcagaacggcaccggcaccccccagguggagaccaacaccagcgaggacggcgagagcagcggcgccaacgacagccugagaacccccgagcagggcagcaacggcaccgacggcgccagccagaagacccccagcagcaccggccccagccccguguucgacaucaaggccgugagcaucagccccaccaacgugauccugaccuggaagagcaacgacaccgccgccagcgaguacaaguacguggugaagcacaagauggagaacgagaagaccaucaccguggugcaccagcccuggugcaacaucaccggccugagacccgccaccagcuacguguucagcaucacccccggcaucggcaacgagaccuggggcgaccccagagugaucaaggugaucaccgagcccauccccgugagcgaccugagaguggcccugaccggcgugagaaaggccgcccugagcuggagcaacggcaacggcaccgccagcugcagagugcugcuggagagcaucggcagccacgaggagcugacccaggacagcagacugcaggugaacaucagcggccugaagcccggcgugcaguacaacaucaaccccuaccugcugcagagcaacaagaccaagggcgacccccugggcaccgagggcggccuggacgccagcaacaccgagagaagcagagccggcagccccaccgcccccgugcacgacgagagccuggugggccccguggaccccagcagcggccagcagagcagagacaccgaggugcugcuggugggccuggagcccggcaccagauacaacgccaccguguacagccaggccgccaacggcaccgagggccagccccaggccaucgaguucagaaccaacgccauccagguguucgacgugaccgccgugaacaucagcgccaccagccugacccugaucuggaaggugagcgacaacgagagcagcagcaacuacaccuacaagauccacguggccggcgagaccgacagcagcaaccugaacgugagcgagcccagagccgugauccccggccugagaagcagcaccuucuacaacaucaccgugugccccgugcugggcgacaucgagggcacccccggcuuccugcaggugcacaccccccccgugcccgugagcgacuucagagugaccguggugagcaccaccgagaucggccuggccuggagcagccacgacgccgagagcuuccagaugcacaucacccaggagggcgccggcaacagcagaguggagaucaccaccaaccagagcaucaucaucggcggccuguuccccggcaccaaguacugcuucgagaucgugcccaagggccccaacggcaccgagggcgccagcagaaccgugugcaacagaaccggcuaa

SEQ ID NO: 22227 - RNA, 4341 nt, Artificial Sequence
  PTPRK__Homo_sapiens__NP_001129120
auggacaccaccgccgccgccgcccugcccgccuucguggcccugcugcugcugagccccuggccccugcugggcagcgcccagggccaguucagcgccggcggcugcaccuucgacgacggccccggcgccugcgacuaccaccaggaccuguacgacgacuucgagugggugcacgugagcgcccaggagccccacuaccugccccccgagaugccccagggcagcuacaugaucguggacagcagcgaccacgaccccggcgagaaggccagacugcagcugcccaccaugaaggagaacgacacccacugcaucgacuucagcuaccugcuguacagccagaagggccugaaccccggcacccugaacauccuggugagagugaacaagggcccccuggccaaccccaucuggaacgugaccggcuucaccggcagagacuggcugagagccgagcuggccgugagcaccuucuggcccaacgaguaccaggugaucuucgaggccgaggugagcggcggcagaagcggcuacaucgccaucgacgacauccaggugcugagcuaccccugcgacaagagcccccacuuccugagacugggcgacguggaggugaacgccggccagaacgccaccuuccagugcaucgccaccggcagagacgccgugcacaacaagcuguggcugcagagaagaaacggcgaggacauccccguggcccagaccaagaacaucaaccacagaagauucgccgccagcuucagacugcaggaggugaccaagaccgaccaggaccuguacagaugcgugacccagagcgagagaggcagcggcgugagcaacuucgcccagcugaucgugagagagccccccagacccaucgcccccccccagcugcugggcgugggccccaccuaccugcugauccagcugaacgccaacagcaucaucggcgacggccccaucauccugaaggagguggaguacagaaugaccagcggcagcuggaccgagacccacgccgugaacgcccccaccuacaagcuguggcaccuggaccccgacaccgaguacgagaucagagugcugcugaccagacccggcgagggcggcaccggccugcccggccccccccugaucaccagaaccaagugcgccgagcccaugagaacccccaagacccugaagaucgccgagauccaggccagaagaaucgccguggacugggagagccugggcuacaacaucaccagaugccacaccuucaacgugaccaucugcuaccacuacuucagaggccacaacgagagcaaggccgacugccuggacauggaccccaaggccccccagcacguggugaaccaccugccccccuacaccaacgugagccugaagaugauccugaccaaccccgagggcagaaaggagagcgaggagaccaucauccagaccgacgaggacgugcccggccccgugcccgugaagagccugcagggcaccagcuucgagaacaagaucuuccugaacuggaaggagccccuggaccccaacggcaucaucacccaguacgagaucagcuacagcagcaucagaagcuucgaccccgccgugcccguggccggccccccccagaccgugagcaaccuguggaacagcacccaccacguguucaugcaccugcaccccggcaccaccuaccaguucuucaucagagccagcaccgugaagggcuucggccccgccaccgccaucaacgugaccaccaacaucagcgcccccacccugcccgacuacgagggcguggacgccagccugaacgagaccgccaccaccaucaccgugcugcugagacccgcccaggccaagggcgcccccaucagcgccuaccagaucgugguggaggagcugcacccccacagaaccaagagagaggccggcgccauggagugcuaccaggugcccgugaccuaccagaacgccaugagcggcggcgcccccuacuacuucgccgccgagcugccccccggcaaccugcccgagcccgcccccuucaccgugggcgacaacagaaccuaccagggcuucuggaaccccccccuggcccccagaaagggcuacaacaucuacuuccaggccaugagcagcguggagaaggagaccaagacccagugcgugagaaucgccaccaaggccgccgccaccgaggagcccgaggugauccccgaccccgccaagcagaccgacagaguggugaagaucgccggcaucagcgccggcauccugguguucauccugcugcugcugguggugauccugaucgugaagaagagcaagcuggccaagaagagaaaggacgccaugggcaacaccagacaggagaugacccacauggugaacgccauggacagaagcuacgccgaccagagcacccugcacgccgaggacccccugagcaucaccuucauggaccagcacaacuucagccccagauacgagaaccacagcgccaccgccgagagcagcagacugcuggacgugcccagauaccugugcgagggcaccgagagccccuaccagaccggccagcugcaccccgccaucagaguggccgaccugcugcagcacaucaaccugaugaagaccagcgacagcuacggcuucaaggaggaguacgagagcuucuucgagggccagagcgccagcugggacguggccaagaaggaccagaacagagccaagaacagauacggcaacaucaucgccuacgaccacagcagagugauccugcagcccguggaggacgaccccagcagcgacuacaucaacgccaacuacaucgacaucuggcuguacagagacggcuaccagagacccagccacuacaucgccacccagggccccgugcacgagaccguguacgacuucuggagaaugaucuggcaggagcagagcgccugcaucgugauggugaccaaccugguggaggugggcagagugaagugcuacaaguacuggcccgacgacaccgagguguacggcgacuucaaggugaccugcguggagauggagccccuggccgaguacguggugagaaccuucacccuggagagaagaggcuacaacgagaucagagaggugaagcaguuccacuucaccggcuggcccgaccacggcgugcccuaccacgccaccggccugcugagcuucaucagaagagugaagcugagcaacccccccagcgccggccccaucguggugcacugcagcgccggcgccggcagaaccggcugcuacaucgugaucgacaucaugcuggacauggccgagagagagggcgugguggacaucuacaacugcgugaaggcccugagaagcagaagaaucaacauggugcagaccgaggagcaguacaucuucauccacgacgccauccuggaggccugccugugcggcgagaccgccauccccgugugcgaguucaaggccgccuacuucgacaugaucagaaucgacagccagaccaacagcagccaccugaaggacgaguuccagacccugaacagcgugacccccagacugcaggccgaggacugcagcaucgccugccugcccagaaaccacgacaagaacagauucauggacaugcugccccccgacagaugccugcccuuccugaucaccaucgacggcgagagcagcaacuacaucaacgccgcccugauggacagcuacagacagcccgccgccuucaucgugacccaguacccccugcccaacaccgugaaggacuucuggagacugguguacgacuacggcugcaccagcaucgugaugcugaacgagguggaccugagccagggcugcccccaguacuggcccgaggagggcaugcugagauacggccccauccagguggagugcaugagcugcagcauggacugcgacgugaucaacagaaucuucagaaucugcaaccugaccagaccccaggagggcuaccugauggugcagcaguuccaguaccugggcugggccagccacagagaggugcccggcagcaagagaagcuuccugaagcugauccugcagguggagaaguggcaggaggagugcgaggagggcgagggcagaaccaucauccacugccugaacggcggcggcagaagcggcauguucugcgccaucggcaucgugguggagauggugaagagacagaacgugguggacguguuccacgccgugaagacccugagaaacagcaagcccaacaugguggaggcccccgagcaguacagauucugcuacgacguggcccuggaguaccuggagagcagcuaa

SEQ ID NO: 22228 - RNA, 4398 nt, Artificial Sequence
  PTPRM__Homo_sapiens__NP_001098714
augagaggccugggcaccugccuggccacccuggccggccugcugcugaccgccgccggcgagaccuucagcggcggcugccuguucgacgagcccuacagcaccugcggcuacagccagagcgagggcgacgacuucaacugggagcaggugaacacccugaccaagcccaccagcgaccccuggaugcccagcggcagcuucaugcuggugaacgccagcggcagacccgagggccagagagcccaccugcugcugccccagcugaaggagaacgacacccacugcaucgacuuccacuacuucgugagcagcaagagcaacagcccccccggccugcugaacguguacgugaaggugaacaacggcccccugggcaaccccaucuggaacaucagcggcgaccccaccagaaccuggaacagagccgagcuggccaucagcaccuucuggcccaacuucuaccaggugaucuucgaggugaucaccagcggccaccagggcuaccuggccaucgacgaggugaaggugcugggccaccccugcaccagaaccccccacuuccugagaauccagaacguggaggugaacgccggccaguucgccaccuuccagugcagcgccaucggcagaaccguggccggcgacagacuguggcugcagggcaucgacgugagagacgccccccugaaggagaucaaggugaccagcagcagaagauucaucgccagcuucaacguggugaacaccaccaagagagacgccggcaaguacagaugcaugaucagaaccgagggcggcgugggcaucagcaacuacgccgagcugguggugaaggagccccccgugcccaucgcccccccccagcuggccagcgugggcgccaccuaccuguggauccagcugaacgccaacagcaucaacggcgacggccccaucguggccagagagguggaguacugcaccgccagcggcagcuggaacgacagacagcccguggacagcaccagcuacaagaucggccaccuggaccccgacaccgaguacgagaucagcgugcugcugaccagacccggcgagggcggcaccggcagccccggccccgcccugagaaccagaaccaagugcgccgaccccaugagaggccccagaaagcuggaggugguggaggugaagagcagacagaucaccaucagaugggagcccuucggcuacaacgugaccagaugccacagcuacaaccugaccgugcacuacugcuaccaggugggcggccaggagcaggugagagaggaggugagcugggacaccgagaacagccacccccagcacaccaucaccaaccugagccccuacaccaacgugagcgugaagcugauccugaugaaccccgagggcagaaaggagagccaggagcugaucgugcagaccgacgaggaccugcccggcgccgugcccaccgagagcauccagggcagcaccuucgaggagaagaucuuccugcaguggagagagcccacccagaccuacggcgugaucacccuguacgagaucaccuacaaggccgugagcagcuucgaccccgagaucgaccugagcaaccagagcggcagagugagcaagcugggcaacgagacccacuuccuguucuucggccuguaccccggcaccaccuacagcuucaccaucagagccagcaccgccaagggcuucggcccccccgccaccaaccaguucaccaccaagaucagcgcccccagcaugcccgccuacgagcuggagaccccccugaaccagaccgacaacaccgugaccgugaugcugaagcccgcccacagcagaggcgcccccgugagcguguaccagaucgugguggaggaggagagacccagaagaaccaagaagaccaccgagauccugaagugcuaccccgugcccauccacuuccagaacgccagccugcugaacagccaguacuacuucgccgccgaguuccccgccgacagccugcaggccgcccagcccuucaccaucggcgacaacaagaccuacaacggcuacuggaacaccccccugcugcccuacaagagcuacagaaucuacuuccaggccgccagcagagccaacggcgagaccaagaucgacugcgugcagguggccaccaagggcgccgccacccccaagcccgugcccgagcccgagaagcagaccgaccacaccgugaagaucgccggcgugaucgccggcauccugcuguucgugaucaucuuccugggcguggugcuggugaugaagaagagaaagcuggccaagaagagaaaggagaccaugagcagcaccagacaggagaugaccgugauggugaacagcauggacaagagcuacgccgagcagggcaccaacugcgacgaggccuucagcuucauggacacccacaaccugaacggcagaagcgugagcagccccagcagcuucaccaugaagaccaacacccugagcaccagcgugcccaacagcuacuaccccgaccccuucgugcccaccgccauccuggugcccaucaacgacgagacccacaccauggccagcgacaccagcagccuggugcagagccacaccuacaagaagagagagcccgccgacgugcccuaccagaccggccagcugcaccccgccaucagaguggccgaccugcugcagcacaucacccagaugaagugcgccgagggcuacggcuucaaggaggaguacgagagcuucuucgagggccagagcgcccccugggacagcgccaagaaggacgagaacagaaugaagaacagauacggcaacaucaucgccuacgaccacagcagagugagacugcagaccaucgagggcgacaccaacagcgacuacaucaacggcaacuacaucgacggcuaccacagacccaaccacuacaucgccacccagggccccaugcaggagaccaucuacgacuucuggagaaugguguggcacgagaacaccgccagcaucaucauggugaccaaccugguggaggugggcagagugaagugcugcaaguacuggcccgacgacaccgagaucuacaaggacaucaaggugacccugaucgagaccgagcugcuggccgaguacgugaucagaaccuucgccguggagaagagaggcgugcacgagaucagagagaucagacaguuccacuucaccggcuggcccgaccacggcgugcccuaccacgccaccggccugcugggcuucgugagacaggugaagagcaagagcccccccagcgccggcccccugguggugcacugcagcgccggcgccggcagaaccggcugcuucaucgugaucgacaucaugcuggacauggccgagagagagggcgugguggacaucuacaacugcgugagagagcugagaagcagaagagugaacauggugcagaccgaggagcaguacguguucauccacgacgccauccuggaggccugccugugcggcgacaccagcgugcccgccagccaggugagaagccuguacuacgacaugaacaagcuggacccccagaccaacagcagccagaucaaggaggaguucagaacccugaacauggugacccccacccugagaguggaggacugcagcaucgcccugcugcccagaaaccacgagaagaacagaugcauggacauccugccccccgacagaugccugcccuuccugaucaccaucgacggcgagagcagcaacuacaucaacgccgcccugauggacagcuacaagcagcccagcgccuucaucgugacccagcacccccugcccaacaccgugaaggacuucuggagacuggugcuggacuaccacugcaccagcguggugaugcugaacgacguggaccccgcccagcugugcccccaguacuggcccgagaacggcgugcacagacacggccccauccagguggaguucgugagcgccgaccuggaggaggacaucaucagcagaaucuucagaaucuacaacgccgccagaccccaggacggcuacagaauggugcagcaguuccaguuccugggcuggcccauguacagagacacccccgugagcaagagaagcuuccugaagcugaucagacagguggacaaguggcaggaggaguacaacggcggcgagggcagaaccguggugcacugccugaacggcggcggcagaagcggcaccuucugcgccaucagcaucgugugcgagaugcugagacaccagagaaccguggacguguuccacgccgugaagacccugagaaacaacaagcccaacaugguggaccugcuggaccaguacaaguucugcuacgagguggcccuggaguaccugaacagcggcuaa

SEQ ID NO: 22229 - RNA, 3048 nt, Artificial Sequence
  PTPRN2__Homo_sapiens__NP_002838
augggccccccccugccccugcugcugcugcugcugcugcugcugccccccagagugcugcccgccgcccccagcagcgugcccagaggcagacagcugcccggcagacugggcugccugcuggaggagggccugugcggcgccagcgaggccugcgugaacgacggcguguucggcagaugccagaaggugcccgccauggacuucuacagauacgaggugagccccguggcccugcagagacugagaguggcccugcagaagcugagcggcaccggcuucaccuggcaggacgacuacacccaguacgugauggaccaggagcuggccgaccugcccaagaccuaccugagaagacccgaggccagcagccccgccagacccagcaagcacagcgugggcagcgagagaagauacagcagagagggcggcgccgcccuggccaacgcccugagaagacaccugcccuuccuggaggcccugagccaggcccccgccagcgacgugcuggccagaacccacaccgcccaggacagaccccccgccgagggcgacgacagauucagcgagagcauccugaccuacguggcccacaccagcgcccugaccuacccccccggcagcagaacccagcugagagaggaccugcugcccagaacccugggccagcugcagcccgacgagcugagccccaagguggacagcggcguggacagacaccaccugauggccgcccugagcgccuacgccgcccagagaccccccgccccccccggcgagggcagccuggagccccaguaccugcugagagcccccagcagaaugcccagaccccugcuggcccccgccgccccccagaaguggcccagcccccugggcgacagcgaggaccccagcagcaccggcgacggcgccagaauccacacccugcugaaggaccugcagagacagcccgccgaggugagaggccugagcggccuggagcuggacggcauggccgagcugauggccggccugaugcagggcguggaccacggcguggccagaggcagccccggcagagccgcccugggcgagagcggcgagcaggccgacggccccaaggccacccugagaggcgacagcuuccccgacgacggcgugcaggacgacgacgacagacuguaccaggaggugcacagacugagcgccacccugggcggccugcugcaggaccacggcagcagacugcugcccggcgcccugcccuucgccagaccccuggacauggagagaaagaagagcgagcaccccgagagcagccugagcagcgaggaggagaccgccggcguggagaacgugaagagccagaccuacagcaaggaccugcugggccagcagccccacagcgagcccggcgccgccgccuucggcgagcugcagaaccagaugcccggccccagcaaggaggagcagagccugcccgccggcgcccaggaggcccugagcgacggccugcagcuggaggugcagcccagcgaggaggaggccagaggcuacaucgugaccgacagagacccccugagacccgaggagggcagaagacugguggaggacguggccagacugcugcaggugcccagcagcgccuucgccgacguggaggugcugggccccgccgugaccuucaaggugagcgccaacgugcagaacgugaccaccgaggacguggagaaggccaccguggacaacaaggacaagcuggaggagaccagcggccugaagauccugcagaccggcgugggcagcaagagcaagcugaaguuccugcccccccaggccgagcaggaggacagcaccaaguucaucgcccugacccuggugagccuggccugcauccugggcgugcugcuggccagcggccugaucuacugccugagacacagcagccagcacagacugaaggagaagcugagcggccugggcggcgaccccggcgccgacgccaccgccgccuaccaggagcugugcagacagagaauggccaccagaccccccgacagacccgagggcccccacaccagcagaaucagcagcgugagcagccaguucagcgacggccccauccccagccccagcgccagaagcagcgccagcagcuggagcgaggagcccgugcagagcaacauggacaucagcaccggccacaugauccugagcuacauggaggaccaccugaagaacaagaacagacuggagaaggagugggaggcccugugcgccuaccaggccgagcccaacagcagcuucguggcccagagagaggagaacgugcccaagaacagaagccuggccgugcugaccuacgaccacagcagagugcugcugaaggccgagaacagccacagccacagcgacuacaucaacgccagccccaucauggaccacgaccccagaaaccccgccuacaucgccacccagggcccccugcccgccaccguggccgacuucuggcagauggugugggagagcggcugcguggugaucgugaugcugaccccccuggccgagaacggcgugagacagugcuaccacuacuggcccgacgagggcagcaaccuguaccacaucuacgaggugaaccuggugagcgagcacaucuggugcgaggacuuccuggugagaagcuucuaccugaagaaccugcagaccaacgagaccagaaccgugacccaguuccacuuccugagcugguacgacagaggcgugcccagcagcagcagaagccugcuggacuucagaagaaaggugaacaagugcuacagaggcagaagcugccccaucaucgugcacugcagcgacggcgccggcagaagcggcaccuacgugcugaucgacauggugcugaacaagauggccaagggcgccaaggagaucgacaucgccgccacccuggagcaccugagagaccagagacccggcauggugcagaccaaggagcaguucgaguucgcccugaccgccguggccgaggaggugaacgccauccugaaggcccugccccaguaa

SEQ ID NO: 22230 - RNA, 2853 nt, Artificial Sequence
  PTPRN__Homo_sapiens__NP_001186692
augagaagacccagaagacccggcggccugggcggcagcggcggccugagacugcugcugugccugcugcugcugagcagcagacccggcggcugcagcgccgugagcgcccacggcugccuguucgacagaagacugugcagccaccuggaggugugcauccaggacggccuguucggccagugccaggugggcgugggccaggccagaccccugcugcaggugaccagccccgugcugcagagacugcagggcgugcugagacagcugaugagccagggccugagcuggcacgacgaccugacccaguacgugaucagccaggagauggagagaauccccagacugagaccccccgagcccagacccagagacagaagcggccuggcccccaagagacccggccccgccggcgagcugcugcugcaggacauccccaccggcagcgcccccgccgcccagcacagacugccccagccccccgugggcaagggcggcgccggcgccagcagcagccugagcccccugcaggccgagcugcugcccccccugcuggagcaccugcugcugcccccccagcccccccaccccagccugagcuacgagcccgcccugcugcagcccuaccuguuccaccaguucggcagcagagacggcagcagagugagcgagggcagccccggcauggugagcgugggcccccugcccaaggccgaggcccccgcccuguucagcagaaccgccagcaagggcaucuucggcgaccaccccggccacagcuacggcgaccugcccggccccagccccgcccagcuguuccaggacagcggccugcuguaccuggcccaggagcugcccgcccccagcagagccagagugcccagacugcccgagcagggcagcagcagcagagccgaggacagccccgagggcuacgagaaggagggccugggcgacagaggcgagaagcccgccagccccgccgugcagcccgacgccgcccugcagagacuggccgccgugcuggccggcuacggcguggagcugagacagcugacccccgagcagcugagcacccugcugacccugcugcagcugcugcccaagggcgccggcagaaaccccggcggcguggugaacgugggcgccgacaucaagaagaccauggagggccccguggagggcagagacaccgccgagcugcccgccagaaccagccccaugcccggccaccccaccgccagccccaccagcagcgaggugcagcaggugcccagccccgugagcagcgagccccccaaggccgccagaccccccgugacccccgugcugcuggagaagaagagcccccugggccagagccagcccaccguggccggccagcccagcgccagacccgccgccgaggaguacggcuacaucgugaccgaccagaacguggugggccccgcccugaccuucagaaucagacacaacgagcagaaccugagccuggccgacgugacccagcaggccggccuggugaagagcgagcuggaggcccagaccggccugcagauccugcagaccggcgugggccagagagaggaggccgccgccgugcugccccagaccgcccacagcaccagccccaugagaagcgugcugcugacccugguggcccuggccggcguggccggccugcugguggcccuggccguggcccugugcgugagacagcacgccagacagcaggacaaggagagacuggccgcccugggccccgagggcgcccacggcgacaccaccuucgaguaccaggaccugugcagacagcacauggccaccaagagccuguucaacagagccgagggcccccccgagcccagcagagugagcagcgugagcagccaguucagcgacgccgcccaggccagccccagcagccacagcagcacccccagcuggugcgaggagcccgcccaggccaacauggacaucagcaccggccacaugauccuggccuacauggaggaccaccugagaaacagagacagacuggccaaggaguggcaggcccugugcgccuaccaggccgagcccaacaccugcgccaccgcccagggcgagggcaacaucaagaagaacagacaccccgacuuccugcccuacgaccacgccagaaucaagcugaagguggagagcagccccagcagaagcgacuacaucaacgccagccccaucaucgagcacgaccccagaaugcccgccuacaucgccacccagggcccccugagccacaccaucgccgacuucuggcagauggugugggagagcggcugcaccgugaucgugaugcugaccccccugguggaggacggcgugaagcagugcgacagauacuggcccgacgagggcgccagccuguaccacguguacgaggugaaccuggugagcgagcacaucuggugcgaggacuuccuggugagaagcuucuaccugaagaacgugcagacccaggagaccagaacccugacccaguuccacuuccugagcuggcccgccgagggcacccccgccagcaccagaccccugcuggacuucagaagaaaggugaacaagugcuacagaggcagaagcugccccaucaucgugcacugcagcgacggcgccggcagaaccggcaccuacauccugaucgacauggugcugaacagaauggccaagggcgugaaggagaucgacaucgccgccacccuggagcacgugagagaccagagacccggccuggugagaagcaaggaccaguucgaguucgcccugaccgccguggccgaggaggugaacgccauccugaaggcccugccccaguaa

SEQ ID NO: 22231 - RNA, 3567 nt, Artificial Sequence
  PTPRO__Homo_sapiens__NP_002839
augggccaccugcccaccggcauccacggcgccagaagacugcugccccugcuguggcuguucgugcuguucaagaacgccaccgccuuccacgugaccgugcaggacgacaacaacaucguggugagccuggaggccagcgacgugaucagccccgccagcguguacguggugaagaucaccggcgagagcaagaacuacuucuucgaguucgaggaguucaacagcacccugcccccccccgugaucuucaaggccagcuaccacggccuguacuacaucaucacccuggugguggugaacggcaacguggugaccaagcccagcagaagcaucaccgugcugaccaagccccugcccgugaccagcgugagcaucuacgacuacaagcccagccccgagaccggcgugcuguucgagauccacuaccccgagaaguacaacguguucaccagagugaacaucagcuacugggagggcaaggacuucagaaccaugcuguacaaggacuucuucaagggcaagaccguguucaaccacuggcugcccggcaugugcuacagcaacaucaccuuccagcuggugagcgaggccaccuucaacaagagcacccugguggaguacagcggcgugagccacgagcccaagcagcacagaaccgcccccuaccccccccagaacaucagcgugagaaucgugaaccugaacaagaacaacugggaggagcagagcggcaacuuccccgaggagagcuucaugagaagccaggacaccaucggcaaggagaagcuguuccacuucaccgaggagacccccgagauccccagcggcaacaucagcagcggcuggcccgacuucaacagcagcgacuacgagaccaccagccagcccuacuggugggacagcgccagcgccgcccccgagagcgaggacgaguucgugagcgugcugcccauggaguacgagaacaacagcacccugagcgagaccgagaagagcaccagcggcagcuucagcuucuuccccgugcagaugauccugaccuggcugccccccaagccccccaccgccuucgacggcuuccacauccacaucgagagagaggagaacuucaccgaguaccugaugguggacgaggaggcccacgaguucguggccgagcugaaggagcccggcaaguacaagcugagcgugaccaccuucagcagcagcggcagcugcgagaccagaaagagccagagcgccaagagccugagcuucuacaucagccccagcggcgaguggaucgaggagcugaccgagaagccccagcacgugagcgugcacgugcugagcagcaccaccgcccugaugagcuggaccagcagccaggagaacuacaacagcaccaucgugagcguggugagccugaccugccagaagcagaaggagagccagagacuggagaagcaguacugcacccaggugaacagcagcaagcccaucaucgagaaccuggugcccggcgcccaguaccagguggugaucuaccugagaaagggcccccugaucggcccccccagcgaccccgugaccuucgccaucgugcccaccggcaucaaggaccugaugcuguacccccugggccccaccgccguggugcugagcuggaccagacccuaccugggcguguucagaaaguacgugguggagauguucuacuucaaccccgccaccaugaccagcgaguggaccaccuacuacgagaucgccgccaccgugagccugaccgccagcgugagaaucgccaaccugcugcccgccugguacuacaacuucagagugaccauggugaccuggggcgaccccgagcugagcugcugcgacagcagcaccaucagcuucaucaccgcccccguggcccccgagaucaccagcguggaguacuucaacagccugcuguacaucagcuggaccuacggcgacgacaccaccgaccugagccacagcagaaugcugcacuggauggugguggccgagggcaagaagaagaucaagaagagcgugaccagaaacgugaugaccgccauccugagccugccccccggcgacaucuacaaccugagcgugaccgccugcaccgagagaggcagcaacaccagcaugcugagacuggugaagcuggagcccgccccccccaagagccuguucgccgugaacaagacccagaccagcgugacccugcuguggguggaggagggcguggccgacuucuucgagguguucugccagcaggugggcagcagccagaagaccaagcugcaggagcccguggccgugagcagccacguggugaccaucagcagccugcugcccgccaccgccuacaacugcagcgugaccagcuucagccacgacagccccagcgugcccaccuucaucgccgugagcaccauggugaccgagaugaaccccaacgugguggugaucagcgugcuggccauccugagcacccugcugaucggccugcugcuggugacccugaucauccugagaaagaagcaccugcagauggccagagagugcggcgccggcaccuucgugaacuucgccagccuggagagagacggcaagcugcccuacaacuggagcaagaacggccugaagaagagaaagcugaccaaccccgugcagcuggacgacuucgacgccuacaucaaggacauggccaaggacagcgacuacaaguucagccugcaguucgaggagcugaagcugaucggccuggacaucccccacuucgccgccgaccugccccugaacagaugcaagaacagauacaccaacauccugcccuacgacuucagcagagugagacuggugagcaugaacgaggaggagggcgccgacuacaucaacgccaacuacauccccggcuacaacagcccccaggaguacaucgccacccagggcccccugcccgagaccagaaacgacuucuggaagauggugcugcagcagaagagccagaucaucgugaugcugacccagugcaacgagaagagaagagugaagugcgaccacuacuggcccuucaccgaggagcccaucgccuacggcgacaucaccguggagaugaucagcgaggaggagcaggacgacugggccugcagacacuucagaaucaacuacgccgacgagaugcaggacgugaugcacuucaacuacaccgccuggcccgaccacggcgugcccaccgccaacgccgccgagagcauccugcaguucgugcacauggugagacagcaggccaccaagagcaagggccccaugaucauccacugcagcgccggcgugggcagaaccggcaccuucaucgcccuggacagacugcugcagcacaucagagaccacgaguucguggacauccugggccuggugagcgagaugagaagcuacagaaugagcauggugcagaccgaggagcaguacaucuucauccaccagugcgugcagcugauguggaugaagaagaagcagcaguucugcaucagcgacgugaucuacgagaacgugagcaagagcuaa

SEQ ID NO: 22232 - RNA, 6900 nt, Artificial Sequence
  PTPRQ__Homo_sapiens__NP_001138498
auggacuuccugaucaucuuccugcugcuguucaucggcaccagcgagacccagguggacgugagcaacguggugcccggcaccagauacgacaucaccaucagcagcaucagcaccaccuacaccagccccgugaccagaaucgugaccaccaacgugaccaagcccggcccccccguguuccuggccggcgagagagugggcagcgccggcauccugcugagcuggaacaccccccccaaccccaacggcagaaucaucagcuacaucgugaaguacaaggaggugugccccuggaugcagaccguguacacccaggugagaagcaagcccgacagccuggaggugcugcugaccaaccugaaccccggcaccaccuacgagaucaagguggccgccgagaacagcgccggcaucggcguguucagcgaccccuuccuguuccagaccgccgagagcgcccccggcaagguggugaaccugaccguggaggccuacaacgccagcgccgugaagcugaucugguaccugcccagacagcccaacggcaagaucaccagcuucaagaucagcgugaagcacgccagaagcggcaucguggugaaggacgugagcaucagaguggaggacauccugaccggcaagcugcccgagugcaacgagaacagcgagagcuuccuguggagcaccgccagccccagccccacccugggcagagugaccccccccagcagaaccacccacagcagcagcacccugacccagaacgagaucagcagcguguggaaggagcccaucagcuucguggugacccaccugagacccuacaccaccuaccuguucgaggugagcgccgccaccaccgaggccggcuacaucgacagcaccaucgugagaacccccgagagcgugcccgagggccccccccagaacugcgugaccggcaacaucaccggcaagagcuucagcauccugugggacccccccaccaucgugaccggcaaguucagcuacagaguggagcuguacggccccagcggcagaauccuggacaacagcaccaaggaccugaaguucgccuucaccaaccugacccccuucaccauguacgacguguacaucgccgccgagaccagcgccggcaccggccccaagagcaacaucagcguguucaccccccccgacgugcccggcgccguguucgaccugcagcuggccgagguggagagcacccaggugagaaucaccuggaagaagcccagacagcccaacggcaucaucaaccaguacagagugaaggugcuggugcccgagaccggcaucauccuggagaacacccugcugaccggcaacaacgaguacaucaacgaccccauggcccccgagaucgugaacaucguggagcccauggugggccuguacgagggcagcgccgagaugagcagcgaccugcacagccuggccaccuucaucuacaacagccaccccgacaagaacuuccccgccagaaacagagccgaggaccagaccagccccguggugaccaccagaaaccaguacaucaccgacaucgccgccgagcagcugagcuacgugaucagaagacuggugcccuucaccgagcacaugaucagcgugagcgccuucaccaucaugggcgagggcccccccaccgugcugagcgugagaaccagacagcaggugcccagcagcaucaagaucaucaacuacaagaacaucagcagcagcagcauccugcuguacugggacccccccgaguaccccaacggcaagaucacccacuacaccaucuacgccauggagcuggacaccaacagagccuuccagaucaccaccaucgacaacagcuuccugaucaccggccugaagaaguacaccaaguacaagaugagaguggccgccagcacccacgugggcgagagcagccugagcgaggagaacgacaucuucgugagaaccagcgaggacgagcccgagagcagcccccaggacguggaggugaucgacgugaccgccgacgagaucagacugaaguggagcccccccgagaagcccaacggcaucaucaucgccuacgaggugcuguacaagaacaucgacacccuguacaugaagaacaccagcaccaccgacaucauccugagaaaccugagaccccacacccuguacaacaucagcgugagaagcuacaccagauucggccacggcaaccaggugagcagccugcugagcgugagaaccagcgagaccgugcccgacagcgcccccgagaacaucaccuacaagaacaucagcagcggcgagaucgagcugagcuuccugccccccagcagccccaacggcaucauccagaaguacaccaucuaccugaagagaagcaacggcaacgaggagagaaccaucaacaccaccagccugacccagaacaucaaggugcugaagaaguacacccaguacaucaucgaggugagcgccagcacccugaagggcgagggcgugagaagcgcccccaucagcauccugaccgaggaggacgcccccgacagccccccccaggacuucagcgugaagcagcugagcggcgugaccgugaagcugagcuggcagcccccccuggagcccaacggcaucauccuguacuacaccguguacguguggaacagaagcagccugaagaccaucaacgugaccgagaccagccuggagcugagcgaccuggacuacaacguggaguacagcgccuacgugaccgccagcaccagauucggcgacggcaagaccagaagcaacaucaucagcuuccagacccccgagggcgcccccagcgacccccccaaggacguguacuacgccaaccugagcagcagcagcaucauccuguucuggaccccccccagcaagcccaacggcaucauccaguacuacagcguguacuacagaaacaccagcggcaccuucaugcagaacuucacccugcacgaggugaccaacgacuucgacaacaugaccgugagcaccaucaucgacaagcugaccaucuucagcuacuacaccuucuggcugaccgccagcaccagcgugggcaacggcaacaagagcagcgacaucaucgagguguacaccgaccaggacauccccgagggcuucgugggcaaccugaccuacgagagcaucagcagcaccgccaucaacgugagcugggugccccccgcccagcccaacggccugguguucuacuacgugagccugauccugcagcagacccccagacacgugagacccccccuggugaccuacgagagaagcaucuacuucgacaaccuggagaaguacaccgacuacauccugaagaucacccccagcaccgagaagggcuucagcgacaccuacaccgcccagcuguacaucaagaccgaggaggacgugcccgagaccagccccaucaucaacaccuucaagaaccugagcagcaccagcgugcugcugagcugggacccccccgugaagcccaacggcgccaucaucagcuacgaccugacccugcagggccccaacgagaacuacagcuucaucaccagcgacaacuacaucauccuggaggagcugagccccuucacccuguacagcuucuucgccgccgccagaaccagaaagggccugggccccagcagcauccuguucuucuacaccgacgagagcgugccccuggcccccccccagaaccugacccugaucaacugcaccagcgacuucguguggcugaaguggagccccagcccccugcccggcggcaucgugaagguguacagcuucaagauccacgagcacgagaccgacaccaucuacuacaagaacaucagcggcuucaagaccgaggccaagcuggugggccuggagcccgugagcaccuacagcaucagagugagcgccuucaccaaggugggcaacggcaaccaguucagcaacguggugaaguucaccacccaggagagcgugcccgacguggugcagaacaugcagugcauggccaccagcuggcagagcgugcuggugaagugggacccccccaagaaggccaacggcaucaucacccaguacauggugaccguggagagaaacagcaccaaggugagcccccaggaccacauguacaccuucaucaagcugcuggccaacaccagcuacguguucaaggugagagccagcaccagcgccggcgagggcgacgagagcaccugccacgugagcacccugcccgagaccgugcccagcgugcccaccaacaucgccuucagcgacgugcagagcaccagcgccacccugaccuggaucagacccgacaccauccugggcuacuuccagaacuacaagaucaccacccagcugagagcccagaagugcaaggagugggagagcgaggagugcguggaguaccagaagauccaguaccuguacgaggcccaccugaccgaggagaccguguacggccugaagaaguucagaugguacagauuccagguggccgccagcaccaacgccggcuacggcaacgccagcaacuggaucagcaccaagacccugcccggcccccccgacggcccccccgagaacgugcacgugguggccaccagccccuucagcaucagcaucagcuggagcgagcccgccgugaucaccggccccaccugcuaccugaucgacgugaagagcguggacaacgacgaguucaacaucagcuucaucaagagcaacgaggagaacaagaccaucgagaucaaggaccuggagaucuucaccagauacagcguggugaucaccgccuucaccggcaacaucagcgccgccuacguggagggcaagagcagcgccgagaugaucgugaccacccuggagagcgcccccaaggacccccccaacaacaugaccuuccagaagauccccgacgaggugaccaaguuccagcugaccuuccugccccccagccagcccaacggcaacauccagguguaccaggcccugguguacagagaggacgaccccaccgccgugcagauccacaaccugagcaucauccagaagaccaacaccuucgugaucgccaugcuggagggccugaagggcggccacaccuacaacaucagcguguacgccgugaacagcgccggcgccggccccaaggugcccaugagaaucaccauggacaucaaggcccccgccagacccaagaccaagcccacccccaucuacgacgccaccggcaagcugcuggugaccagcaccaccaucaccaucagaaugcccaucugcuacuacagcgacgaccacggccccaucaagaacgugcaggugcuggugaccgagaccggcgcccagcacgacggcaacgugaccaagugguacgacgccuacuucaacaaggccagacccuacuucaccaacgagggcuuccccaacccccccugcaccgagggcaagaccaaguucagcggcaacgaggagaucuacaucaucggcgccgacaacgccugcaugauccccggcaacgaggacaagaucugcaacggcccccugaagcccaagaagcaguaccuguucaaguucagagccaccaacaucaugggccaguucaccgacagcgacuacagcgaccccgugaagacccugggcgagggccugagcgagagaaccguggagaucauccugagcgugacccugugcauccugagcaucauccugcugggcaccgccaucuucgccuucgccagaaucagacagaagcagaaggagggcggcaccuacagcccccaggacgccgagaucaucgacaccaagcugaagcuggaccagcugaucaccguggccgaccuggagcugaaggacgagagacugaccagacugcugagcuacagaaagagcaucaagcccaucagcaagaagagcuuccugcagcacguggaggagcugugcaccaacaacaaccugaaguuccaggaggaguucagcgagcugcccaaguuccugcaggaccugagcagcaccgacgccgaccugcccuggaacagagccaagaacagauuccccaacaucaagcccuacaacaacaacagagugaagcugaucgccgacgccagcgugcccggcagcgacuacaucaacgccagcuacaucagcggcuaccugugccccaacgaguucaucgccacccagggcccccugcccggcaccgugggcgacuucuggagaauggugugggagaccagagccaagacccuggugaugcugacccagugcuucgagaagggcagaaucagaugccaccaguacuggcccgaggacaacaagcccgugaccguguucggcgacaucgugaucaccaagcugauggaggacgugcagaucgacuggaccaucagagaccugaagaucgagagacacggcgacugcaugaccgugagacagugcaacuucaccgccuggcccgagcacggcgugcccgagaacagcgccccccugauccacuucgugaagcuggugagagccagcagagcccacgacaccacccccaugaucgugcacugcagcgccggcgugggcagaaccggcguguucaucgcccuggaccaccugacccagcacaucaacgaccacgacuucguggacaucuacggccugguggccgagcugagaagcgagagaaugugcauggugcagaaccuggcccaguacaucuuccugcaccagugcauccuggaccugcugagcaacaagggcagcaaccagcccaucugcuucgugaacuacagcgcccugcagaagauggacagccuggacgccauggagggcgacguggagcuggagugggaggagaccaccauguaa

SEQ ID NO: 22233 - RNA, 1638 nt, Artificial Sequence
  PTPRR__Homo_sapiens__NP_001193944
augcagagcaucagcaagcagacccugcagauggacgugaacaagcugaacaucacccugcugagaaucuucagacagggcguggccgccgcccugggccugcugccccagcaggugcacaucaacagacugaucggcaagaagaacagcaucgagcuguucgugagccccaucaacagaaagaccggcaucagcgacgcccugcccagcgaggaggugcugagaagccugaacaucaacgugcugcaccagagccugagccaguucggcaucaccgaggugagccccgagaagaacgugcugcagggccagcacgaggccgacaagaucuggagcaaggagggcuucuacgccguggugaucuuccugagcaucuucgugaucaucgugaccugccugaugauccuguacagacugaaggagagauuccagcugagccugagacaggacaaggagaagaaccaggagauccaccugagccccaucacccugcagcccgcccugagcgaggccaagaccgugcacagcauggugcagcccgagcaggcccccaaggugcugaacguggugguggacccccagggcagaggcgcccccgagaucaaggccaccaccgccaccagcgugugccccagccccuucaagaugaagcccaucggccugcaggagagaagaggcagcaacgugagccugacccuggacaugagcagccugggcaacaucgagcccuucgugagcauccccacccccagagagaagguggccauggaguaccugcagagcgccagcagaauccugaccagaagccagcugagagacgugguggccagcagccaccugcugcagagcgaguucauggagauccccaugaacuucguggaccccaaggagaucgacauccccagacacggcaccaagaacagauacaagaccauccugcccaacccccugagcagagugugccugagacccaagaacgugaccgacagccugagcaccuacaucaacgccaacuacaucagaggcuacagcggcaaggagaaggccuucaucgccacccagggccccaugaucaacaccguggacgacuucuggcagaugguguggcaggaggacagccccgugaucgugaugaucaccaagcugaaggagaagaacgagaagugcgugcuguacuggcccgagaagagaggcaucuacggcaagguggaggugcuggugaucagcgugaacgagugcgacaacuacaccaucagaaaccuggugcugaagcagggcagccacacccagcacgugaagcacuacugguacaccagcuggcccgaccacaagacccccgacagcgcccagccccugcugcagcugaugcuggacguggaggaggacagacuggccagccagggcagaggccccgugguggugcacugcagcgccggcaucggcagaaccggcugcuucaucgccaccagcaucggcugccagcagcugaaggaggagggcgugguggacgcccugagcaucgugugccagcugagaauggacagaggcggcauggugcagaccagcgagcaguacgaguucgugcaccacgcccugugccuguacgagagcagacugagcgccgagaccgugcaguaa

SEQ ID NO: 22234 - RNA, 5847 nt, Artificial Sequence
  PTPRS__Homo_sapiens__NP_002841
auggcccccaccuggggccccggcauggugagcguggugggccccaugggccugcugguggugcugcuggugggcggcugcgccgccgaggagccccccagauucaucaaggagcccaaggaccagaucggcgugagcggcggcguggccagcuucgugugccaggccaccggcgaccccaagcccagagugaccuggaacaagaagggcaagaaggugaacagccagagauucgagaccaucgaguucgacgagagcgccggcgccgugcugagaauccagccccugagaacccccagagacgagaacguguacgagugcguggcccagaacagcgugggcgagaucaccgugcacgccaagcugaccgugcugagagaggaccagcugcccagcggcuuccccaacaucgacaugggcccccagcugaaggugguggagagaaccagaaccgccaccaugcugugcgccgccagcggcaaccccgaccccgagaucaccugguucaaggacuuccugcccguggaccccagcgccagcaacggcagaaucaagcagcugagaagcgagaccuucgagagcacccccaucagaggcgcccugcagaucgagagcagcgaggagaccgaccagggcaaguacgagugcguggccaccaacagcgccggcgugagauacagcagccccgccaaccuguacgugagagagcugagagaggugagaagaguggcccccagauucagcauccugcccaugagccacgagaucaugcccggcggcaacgugaacaucaccugcguggccgugggcagccccaugcccuacgugaaguggaugcagggcgccgaggaccugacccccgaggacgacaugcccgugggcagaaacgugcuggagcugaccgacgugaaggacagcgccaacuacaccugcguggccaugagcagccugggcgugaucgaggccguggcccagaucaccgugaagagccugcccaaggcccccggcacccccauggugaccgagaacaccgccaccagcaucaccaucaccugggacagcggcaaccccgaccccgugagcuacuacgugaucgaguacaagagcaagagccaggacggccccuaccagaucaaggaggacaucaccaccaccagauacagcaucggcggccugagccccaacagcgaguacgagaucugggugagcgccgugaacagcaucggccagggcccccccagcgagagcguggugaccagaaccggcgagcaggcccccgccagcgcccccagaaacgugcaggccagaaugcugagcgccaccaccaugaucgugcagugggaggagcccguggagcccaacggccugaucagaggcuacagaguguacuacaccauggagcccgagcaccccgugggcaacuggcagaagcacaacguggacgacagccugcugaccaccgugggcagccugcuggaggacgagaccuacaccgugagagugcuggccuucaccagcgugggcgacggcccccugagcgaccccauccaggugaagacccagcagggcgugcccggccagcccaugaaccugagagccgaggccagaagcgagaccagcaucacccugagcuggagcccccccagacaggagagcaucaucaaguacgagcugcuguucagagagggcgaccacggcagagaggugggcagaaccuucgaccccaccaccagcuacgugguggaggaccugaagcccaacaccgaguacgccuucagacuggccgccagaagcccccagggccugggcgccuucacccccguggugagacagagaacccugcagagcaagcccagcgcccccccccaggacgugaagugcgugagcgugagaagcaccgccauccuggugagcuggagaccccccccccccgagacccacaacggcgcccuggugggcuacagcgugagauacagaccccugggcagcgaggaccccgagcccaaggaggugaacggcaucccccccaccaccacccagauccugcuggaggcccuggagaaguggacccaguacagaaucaccaccguggcccacaccgaggugggccccggccccgagagcagccccgugguggugagaaccgacgaggacgugcccagcgccccccccagaaagguggaggccgaggcccugaacgccaccgccaucagagugcuguggagaagccccgcccccggcagacagcacggccagaucagaggcuaccaggugcacuacgugagaauggagggcgccgaggccagaggcccccccagaaucaaggacgugaugcuggccgacgcccagugggagaccgacgacaccgccgaguacgagauggugaucaccaaccugcagcccgagaccgccuacagcaucaccguggccgccuacaccaugaagggcgacggcgccagaagcaagcccaaggugguggugaccaagggcgccgugcugggcagacccacccugagcgugcagcagacccccgagggcagccugcuggccagaugggagccccccgccggcaccgccgaggaccaggugcugggcuacagacugcaguucggcagagaggacagcaccccccuggccacccuggaguucccccccagcgaggacagauacaccgccagcggcgugcacaagggcgccaccuacguguucagacuggccgccagaagcagaggcggccugggcgaggaggccgccgaggugcugagcauccccgaggacacccccagaggccacccccagauccuggaggccgccggcaacgccagcgccggcaccgugcugcugagauggcugccccccgugcccgccgagagaaacggcgccaucgugaaguacaccguggccgugagagaggccggcgcccugggccccgccagagagaccgagcugcccgccgccgccgagcccggcgccgagaacgcccugacccugcagggccugaagcccgacaccgccuacgaccugcaggugagagcccacaccagaagaggccccggccccuucagcccccccgugagauacagaaccuuccugagagaccaggugagccccaagaacuucaaggugaagaugaucaugaagaccagcgugcugcugagcugggaguuccccgacaacuacaacagccccacccccuacaagauccaguacaacggccugacccuggacguggacggcagaaccaccaagaagcugaucacccaccugaagccccacaccuucuacaacuucgugcugaccaacagaggcagcagccugggcggccugcagcagaccgugaccgccuggaccgccuucaaccugcugaacggcaagcccagcguggcccccaagcccgacgccgacggcuucaucaugguguaccugcccgacggccagagccccgugcccgugcagagcuacuucaucgugauggugccccugagaaagagcagaggcggccaguuccugaccccccugggcagccccgaggacauggaccuggaggagcugauccaggacaucagcagacugcagagaagaagccugagacacagcagacagcuggaggugcccagacccuacaucgccgccagauucagcgugcugccccccaccuuccaccccggcgaccagaagcaguacggcggcuucgacaacagaggccuggagcccggccacagauacgugcuguucgugcuggccgugcugcagaagagcgagcccaccuucgccgccagccccuucagcgaccccuuccagcuggacaaccccgacccccagcccaucguggacggcgaggagggccugaucugggugaucggccccgugcuggccgugguguucaucaucugcaucgugaucgccauccugcuguacaagaacaagcccgacagcaagagaaaggacagcgagcccagaaccaagugccugcugaacaacgccgaccuggccccccaccaccccaaggaccccguggagaugagaagaaucaacuuccagacccccgacagcggccugagaagcccccugagagagcccggcuuccacuucgagagcaugcugagccacccccccauccccaucgccgacauggccgagcacaccgagagacugaaggccaacgacagccugaagcugagccaggaguacgagagcaucgaccccggccagcaguucaccugggagcacagcaaccuggaggugaacaagcccaagaacagauacgccaacgugaucgccuacgaccacagcagagugauccugcagcccaucgagggcaucaugggcagcgacuacaucaacgccaacuacguggacggcuacagaugccagaacgccuacaucgccacccagggcccccugcccgagaccuucggcgacuucuggagaauggugugggagcagagaagcgccaccaucgugaugaugaccagacuggaggagaagagcagaaucaagugcgaccaguacuggcccaacagaggcaccgagaccuacggcuucauccaggugacccugcuggacaccaucgagcuggccaccuucugcgugagaaccuucagccugcacaagaacggcagcagcgagaagagagaggugagacaguuccaguucaccgccuggcccgaccacggcgugcccgaguaccccacccccuuccuggccuuccugagaagagugaagaccugcaacccccccgacgccggccccaucguggugcacugcagcgccggcgugggcagaaccggcugcuucaucgugaucgacgccaugcuggagagaaucaagcccgagaagaccguggacguguacggccacgugacccugaugagaagccagagaaacuacauggugcagaccgaggaccaguacagcuucauccacgaggcccugcuggaggccgugggcugcggcaacaccgaggugcccgccagaagccuguacgccuacauccagaagcuggcccagguggagcccggcgagcacgugaccggcauggagcuggaguucaagagacuggccaacagcaaggcccacaccagcagauucaucagcgccaaccugcccugcaacaaguucaagaacagacuggugaacaucaugcccuacgagagcaccagagugugccugcagcccaucagaggcguggagggcagcgacuacaucaacgccagcuucaucgacggcuacagacagcagaaggccuacaucgccacccagggcccccuggccgagaccaccgaggacuucuggagaaugcugugggagaacaacagcaccaucguggugaugcugaccaagcugagagagaugggcagagagaagugccaccaguacuggcccgccgagagaagcgccagauaccaguacuucgugguggaccccauggccgaguacaacaugccccaguacauccugagagaguucaaggugaccgacgccagagacggccagagcagaaccgugagacaguuccaguucaccgacuggcccgagcagggcgugcccaagagcggcgagggcuucaucgacuucaucggccaggugcacaagaccaaggagcaguucggccaggacggccccaucagcgugcacugcagcgccggcgugggcagaaccggcguguucaucacccugagcaucgugcuggagagaaugagauacgagggcgugguggacaucuuccagaccgugaagaugcugagaacccagagacccgccauggugcagaccgaggacgaguaccaguucugcuaccaggccgcccuggaguaccugggcagcuucgaccacuacgccaccuaa

SEQ ID NO: 22235 - RNA, 4326 nt, Artificial Sequence
  PTPRT__Homo_sapiens__NP_008981
auggccagccuggccgcccuggcccugagccugcugcugagacugcagcugcccccccugcccggcgccagagcccagagcgccgccggcggcugcagcuucgacgagcacuacagcaacugcggcuacagcguggcccugggcaccaacggcuucaccugggagcagaucaacaccugggagaagcccaugcuggaccaggccgugcccaccggcagcuucaugauggugaacagcagcggcagagccagcggccagaaggcccaccugcugcugcccacccugaaggagaacgacacccacugcaucgacuuccacuacuacuucagcagcagagacagaagcagccccggcgcccugaacguguacgugaaggugaacggcggcccccagggcaaccccguguggaacgugagcggcguggugaccgagggcugggugaaggccgagcuggccaucagcaccuucuggccccacuucuaccaggugaucuucgagagcgugagccugaagggccaccccggcuacaucgccguggacgaggugagagugcuggcccaccccugcagaaaggccccccacuuccugagacugcagaacguggaggugaacgugggccagaacgccaccuuccagugcaucgccggcggcaaguggagccagcacgacaagcuguggcugcagcaguggaacggcagagacaccgcccugauggugaccagaguggugaaccacagaagauucagcgccaccgugagcguggccgacaccgcccagagaagcgugagcaaguacagaugcgugaucagaagcgacggcggcagcggcgugagcaacuacgccgagcugaucgugaaggagccccccacccccaucgccccccccgagcugcuggccgugggcgccaccuaccuguggaucaagcccaacgccaacagcaucaucggcgacggccccaucauccugaaggagguggaguacagaaccaccaccggcaccugggccgagacccacaucguggacagccccaacuacaagcuguggcaccuggaccccgacguggaguacgagaucagagugcugcugaccagacccggcgagggcggcaccggcccccccggccccccccugaccaccagaaccaagugcgccgaccccgugcacggcccccagaacguggagaucguggacaucagagccagacagcugacccugcagugggagcccuucggcuacgccgugaccagaugccacagcuacaaccugaccgugcaguaccaguacguguucaaccagcagcaguacgaggccgaggaggugauccagaccagcagccacuacacccugagaggccugagacccuucaugaccaucagacugagacugcugcugagcaaccccgagggcagaauggagagcgaggagcugguggugcagaccgaggaggacgugcccggcgccgugccccuggagagcauccagggcggccccuucgaggagaagaucuacauccaguggaagccccccaacgagaccaacggcgugaucacccuguacgagaucaacuacaaggccgugggcagccuggaccccagcgccgaccugagcagccagagaggcaagguguucaagcugagaaacgagacccaccaccuguucgugggccuguaccccggcaccaccuacagcuucaccaucaaggccagcaccgccaagggcuucggcccccccgugaccaccagaaucgccaccaagaucagcgcccccagcaugcccgaguacgacaccgacaccccccugaacgagaccgacaccaccaucaccgugaugcugaagcccgcccagagcagaggcgcccccgugagcguguaccagcugguggugaaggaggagagacugcagaagagcagaagagccgccgacaucaucgagugcuucagcgugcccgugagcuacagaaacgccagcagccuggacagccugcacuacuucgccgccgagcugaagcccgccaaccugcccgugacccagcccuucaccgugggcgacaacaagaccuacaacggcuacuggaaccccccccugagcccccugaagagcuacagcaucuacuuccaggcccugagcaaggccaacggcgagaccaagaucaacugcgugagacuggccaccaagggcgccagcacccagaacagcaacaccguggagcccgagaagcagguggacaacaccgugaagauggccggcgugaucgccggccugcugauguucaucaucauccugcugggcgugaugcugaccaucaagagaagaagaaacgccuacagcuacagcuacuaccugaagcuggccaagaagcagaaggagacccagagcggcgcccagagagagaugggccccguggccagcgccgacaagcccaccaccaagcugagcgccagcagaaacgacgagggcuucagcagcagcagccaggacgugaacggcuucaccgacggcagcagaggcgagcugagccagcccacccugaccauccagacccaccccuacagaaccugcgaccccguggagaugagcuaccccagagaccaguuccagcccgccaucagaguggccgaccugcugcagcacaucacccagaugaagagaggccagggcuacggcuucaaggaggaguacgaggcccugcccgagggccagaccgccagcugggacaccgccaaggaggacgagaacagaaacaagaacagauacggcaacaucaucagcuacgaccacagcagagugagacugcuggugcuggacggcgacccccacagcgacuacaucaacgccaacuacaucgacggcuaccacagacccagacacuacaucgccacccagggccccaugcaggagaccgugaaggacuucuggagaaugaucuggcaggagaacagcgccagcaucgugauggugaccaaccugguggaggugggcagagugaagugcgugagauacuggcccgacgacaccgagguguacggcgacaucaaggugacccugaucgagaccgagccccuggccgaguacgugaucagaaccuucaccgugcagaagaagggcuaccacgagaucagagagcugagacuguuccacuucaccagcuggcccgaccacggcgugcccugcuacgccaccggccugcugggcuucgugagacaggugaaguuccugaacccccccgaggccggccccaucguggugcacugcagcgccggcgccggcagaaccggcugcuucaucgccaucgacaccaugcuggacauggccgagaacgagggcgugguggacaucuucaacugcgugagagagcugagagcccagagagugaaccuggugcagaccgaggagcaguacguguucgugcacgacgccauccuggaggccugccugugcggcaacaccgccauccccgugugcgaguucagaagccuguacuacaacaucagcagacuggacccccagaccaacagcagccagaucaaggacgaguuccagacccugaacaucgugacccccagagugagacccgaggacugcagcaucggccugcugcccagaaaccacgacaagaacagaagcauggacgugcugccccuggacagaugccugcccuuccugaucagcguggacggcgagagcagcaacuacaucaacgccgcccugauggacagccacaagcagcccgccgccuucguggugacccagcacccccugcccaacaccguggccgacuucuggagacugguguucgacuacaacugcagcagcguggugaugcugaacgagauggacaccgcccaguucugcaugcaguacuggcccgagaagaccagcggcugcuacggccccauccagguggaguucgugagcgccgacaucgacgaggacaucauccacagaaucuucagaaucugcaacauggccagaccccaggacggcuacagaaucgugcagcaccugcaguacaucggcuggcccgccuacagagacaccccccccagcaagagaagccugcugaagguggugagaagacuggagaaguggcaggagcaguacgacggcagagagggcagaaccguggugcacugccugaacggcggcggcagaagcggcaccuucugcgccaucugcagcgugugcgagaugauccagcagcagaacaucaucgacguguuccacaucgugaagacccugagaaacaacaagagcaacaugguggagacccuggagcaguacaaguucguguacgagguggcccuggaguaccugagcagcuucuaa

SEQ ID NO: 22236 - RNA, 4347 nt, Artificial Sequence
  PTPRZ1__Homo_sapiens__NP_001193768
augagaauccugaagagauuccuggccugcauccagcugcugugcgugugcagacuggacugggccaacggcuacuacagacagcagagaaagcugguggaggagaucggcuggagcuacaccggcgcccugaaccagaagaacuggggcaagaaguaccccaccugcaacagccccaagcagagccccaucaacaucgacgaggaccugacccaggugaacgugaaccugaagaagcugaaguuccagggcugggacaagaccagccuggagaacaccuucauccacaacaccggcaagaccguggagaucaaccugaccaacgacuacagagugagcggcggcgugagcgagaugguguucaaggccagcaagaucaccuuccacuggggcaagugcaacaugagcagcgacggcagcgagcacagccuggagggccagaaguucccccuggagaugcagaucuacugcuucgacgccgacagauucagcagcuucgaggaggccgugaagggcaagggcaagcugagagcccugagcauccuguucgaggugggcaccgaggagaaccuggacuucaaggccaucaucgacggcguggagagcgugagcagauucggcaagcaggccgcccuggaccccuucauccugcugaaccugcugcccaacagcaccgacaaguacuacaucuacaacggcagccugaccagcccccccugcaccgacaccguggacuggaucguguucaaggacaccgugagcaucagcgagagccagcuggccguguucugcgaggugcugaccaugcagcagagcggcuacgugaugcugauggacuaccugcagaacaacuucagagagcagcaguacaaguucagcagacagguguucagcagcuacaccggcaaggaggagauccacgaggccgugugcagcagcgagcccgagaacgugcaggccgaccccgagaacuacaccagccugcuggugaccugggagagacccagagugguguacgacaccaugaucgagaaguucgccgugcuguaccagcagcuggacggcgaggaccagaccaagcacgaguuccugaccgacggcuaccaggaccugggcgccauccugaacaaccugcugcccaacaugagcuacgugcugcagaucguggccaucugcaccaacggccuguacggcaaguacagcgaccagcugaucguggacaugcccaccgacaaccccgagcuggaccuguuccccgagcugaucggcaccgaggagaucaucaaggaggaggaggagggcaaggacaucgaggagggcgccaucgugaaccccggcagagacagcgccaccaaccagaucagaaagaaggagccccagaucagcaccaccacccacuacaacagaaucggcaccaaguacaacgaggccaagaccaacagaagccccaccagaggcagcgaguucagcggcaagggcgacgugcccaacaccagccugaacagcaccagccagcccgugaccaagcuggccaccgagaaggacaucagccugaccagccagaccgugaccgagcugcccccccacaccguggagggcaccagcgccagccugaacgacggcagcaagaccgugcugagaagcccccacaugaaccugagcggcaccgccgagagccugaacaccgugagcaucaccgaguacgaggaggagagccugcugaccagcuucaagcuggacaccggcgccgaggacagcagcggcagcagccccgccaccagcgccauccccuucaucagcgagaacaucagccagggcuacaucuucagcagcgagaaccccgagaccaucaccuacgacgugcugauccccgagagcgccagaaacgccagcgaggacagcaccagcagcggcagcgaggagagccugaaggaccccagcauggagggcaacgugugguuccccagcagcaccgacaucaccgcccagcccgacgugggcagcggcagagagagcuuccugcagaccaacuacaccgagaucagaguggacgagagcgagaagaccaccaagagcuucagcgccggccccgugaugagccagggccccagcgugaccgaccuggagaugccccacuacagcaccuucgccuacuuccccaccgaggugaccccccacgccuucacccccagcagcagacagcaggaccuggugagcaccgugaacgugguguacagccagaccacccagcccguguacaacgaggccagcaacagcagccacgagagcagaaucggccuggccgagggccuggagagcgagaagaaggccgugaucccccuggugaucgugagcgcccugaccuucaucugccugguggugcuggugggcauccugaucuacuggagaaagugcuuccagaccgcccacuucuaccuggaggacagcaccagccccagagugaucagcaccccccccacccccaucuuccccaucagcgacgacgugggcgccauccccaucaagcacuuccccaagcacguggccgaccugcacgccagcagcggcuucaccgaggaguucgaggaggugcagagcugcaccguggaccugggcaucaccgccgacagcagcaaccaccccgacaacaagcacaagaacagauacaucaacaucguggccuacgaccacagcagagugaagcuggcccagcuggccgagaaggacggcaagcugaccgacuacaucaacgccaacuacguggacggcuacaacagacccaaggccuacaucgccgcccagggcccccugaagagcaccgccgaggacuucuggagaaugaucugggagcacaacguggaggugaucgugaugaucaccaaccugguggagaagggcagaagaaagugcgaccaguacuggcccgccgacggcagcgaggaguacggcaacuuccuggugacccagaagagcgugcaggugcuggccuacuacaccgugagaaacuucacccugagaaacaccaagaucaagaagggcagccagaagggcagacccagcggcagaguggugacccaguaccacuacacccaguggcccgacaugggcgugcccgaguacagccugcccgugcugaccuucgugagaaaggccgccuacgccaagagacacgccgugggccccgugguggugcacugcagcgccggcgugggcagaaccggcaccuacaucgugcuggacagcaugcugcagcagauccagcacgagggcaccgugaacaucuucggcuuccugaagcacaucagaagccagagaaacuaccuggugcagaccgaggagcaguacguguucauccacgacacccugguggaggccauccugagcaaggagaccgaggugcuggacagccacauccacgccuacgugaacgcccugcugauccccggccccgccggcaagaccaagcuggagaagcaguuccagcugcugagccagagcaacauccagcagagcgacuacagcgccgcccugaagcagugcaacagagagaagaacagaaccagcagcaucauccccguggagagaagcagagugggcaucagcagccugagcggcgagggcaccgacuacaucaacgccagcuacaucaugggcuacuaccagagcaacgaguucaucaucacccagcacccccugcugcacaccaucaaggacuucuggagaaugaucugggaccacaacgcccagcugguggugaugauccccgacggccagaacauggccgaggacgaguucguguacuggcccaacaaggacgagcccaucaacugcgagagcuucaaggugacccugauggccgaggagcacaagugccugagcaacgaggagaagcugaucauccaggacuucauccuggaggccacccaggacgacuacgugcuggaggugagacacuuccagugccccaaguggcccaaccccgacagccccaucagcaagaccuucgagcugaucagcgugaucaaggaggaggccgccaacagagacggccccaugaucgugcacgacgagcacggcggcgugaccgccggcaccuucugcgcccugaccacccugaugcaccagcuggagaaggagaacagcguggacguguaccagguggccaagaugaucaaccugaugagacccggcguguucgccgacaucgagcaguaccaguuccuguacaaggugauccugagccuggugagcaccagacaggaggagaaccccagcaccagccuggacagcaacggcgccgcccugcccgacggcaacaucgccgagagccuggagagccugguguaa

SEQ ID NO: 22237 - RNA, 1173 nt, Artificial Sequence
  PTRF__Homo_sapiens__NP_036364
auggaggaccccacccuguacaucguggagagaccccugcccggcuaccccgacgccgaggcccccgagcccagcagcgccggcgcccaggccgccgaggagcccagcggcgccggcagcgaggagcugaucaagagcgaccaggugaacggcgugcuggugcugagccugcuggacaagaucaucggcgccguggaccagauccagcugacccaggcccagcuggaggagagacaggccgagauggagggcgccgugcagagcauccagggcgagcugagcaagcugggcaaggcccacgccaccaccagcaacaccgugagcaagcugcuggagaaggugagaaaggugagcgugaacgugaagaccgugagaggcagccuggagagacaggccggccagaucaagaagcuggaggugaacgaggccgagcugcugagaagaagaaacuucaaggugaugaucuaccaggacgaggugaagcugcccgccaagcugagcaucagcaagagccugaaggagagcgaggcccugcccgagaaggagggcgaggagcugggcgagggcgagagacccgaggaggacgccgccgcccuggagcugagcagcgacgaggccguggagguggaggaggugaucgaggagagcagagccgagagaaucaagagaagcggccugagaagaguggacgacuucaagaaggccuucagcaaggagaagauggagaagaccaaggugagaaccagagagaaccuggagaagaccagacugaagaccaaggagaaccuggagaagaccagacacacccuggagaagagaaugaacaagcugggcaccagacuggugcccgccgagagaagagagaagcugaagaccagcagagacaagcugagaaagagcuucacccccgaccacgugguguacgccagaagcaagaccgccguguacaaggugccccccuucaccuuccacgugaagaagaucagagagggccagguggaggugcugaaggccaccgagaugguggaggugggcgccgacgacgacgagggcggcgccgagagaggcgaggccggcgaccugagaagaggcagcagccccgacgugcacgcccugcuggagaucaccgaggagagcgacgccgugcugguggacaagagcgacagcgacuaa

SEQ ID NO: 22238 - RNA, 645 nt, Artificial Sequence
  PTRH1__Homo_sapiens__NP_001002913
augagacccggcggcuuccugggcgccggccagagacugagcagagccaugagcagaugcgugcuggagcccagaccccccggcaagagauggaugguggccggccugggcaaccccggccugcccggcaccagacacagcgugggcauggccgugcugggccagcuggccagaagacugggcguggccgagagcuggaccagagacagacacugcgccgccgaccuggcccuggccccccugggcgacgcccagcuggugcugcugagacccagaagacugaugaacgccaacggcagaagcguggccagagccgccgagcuguucggccugaccgccgaggagguguaccuggugcacgacgagcuggacaagccccugggcagacuggcccugaagcugggcggcagcgccagaggccacaacggcgugagaagcugcaucagcugccugaacagcaacgccaugcccagacugagagugggcaucggcagacccgcccaccccgaggccgugcaggcccacgugcugggcugcuucagccccgccgagcaggagcugcugccccugcugcuggacagagccaccgaccugauccuggaccacaucagagagagaagccagggccccagccugggccccuaa

SEQ ID NO: 22239 - RNA, 540 nt, Artificial Sequence
  PTRH2__Homo_sapiens__NP_057161
augcccagcaagagccuggugauggaguaccuggcccaccccagcacccugggccuggccgugggcguggccugcggcaugugccugggcuggagccugagagugugcuucggcaugcugcccaagagcaagaccagcaagacccacaccgacaccgagagcgaggccagcauccugggcgacagcggcgaguacaagaugauccugguggugagaaacgaccugaagaugggcaagggcaagguggccgcccagugcagccacgccgccgugagcgccuacaagcagauccagagaagaaaccccgagaugcugaagcagugggaguacugcggccagcccaaggugguggugaaggcccccgacgaggagacccugaucgcccugcuggcccacgccaagaugcugggccugaccgugagccugauccaggacgccggcagaacccagaucgcccccggcagccagaccgugcugggcaucggccccggccccgccgaccugaucgacaaggugaccggccaccugaagcuguacuaa

SEQ ID NO: 22240 - RNA, 423 nt, Artificial Sequence
  PTRHD1__Homo_sapiens__NP_001013685
augcacagaggcgugggccccgccuucagaguggugagaaagauggccgccagcggcgccgagccccaggugcuggugcaguaccuggugcugagaaaggaccugagccaggcccccuucagcuggcccgccggcgcccugguggcccaggccugccacgccgccaccgccgcccugcacacccacagagaccacccccacaccgccgccuaccugcaggagcugggcagaaugagaaagguggugcuggaggcccccgacgagaccacccugaaggagcuggccgagacccugcagcagaagaacaucgaccacaugcuguggcuggagcagcccgagaacaucgccaccugcaucgcccugagacccuaccccaaggaggaggugggccaguaccugaagaaguucagacuguucaaguaa

SEQ ID NO: 22241 - RNA, 438 nt, Artificial Sequence
  PTS__Homo_sapiens__NP_000308
augagcaccgagggcggcggcagaagaugccaggcccaggugagcagaagaaucagcuucagcgccagccacagacuguacagcaaguuccugagcgacgaggagaaccugaagcuguucggcaagugcaacaaccccaacggccacggccacaacuacaaggugguggugaccgugcacggcgagaucgaccccgccaccggcauggugaugaaccuggccgaccugaagaaguacauggaggaggccaucaugcagccccuggaccacaagaaccuggacauggacgugcccuacuucgccgacguggugagcaccaccgagaacguggccguguacaucugggacaaccugcagaaggugcugcccgugggcgugcuguacaaggugaagguguacgagaccgacaacaacaucgugguguacaagggcgaguaa

SEQ ID NO: 22242 - RNA, 609 nt, Artificial Sequence
  PTTG1__Homo_sapiens__NP_001269312
auggccacccugaucuacguggacaaggagaacggcgagcccggcaccagagugguggccaaggacggccugaagcugggcagcggccccagcaucaaggcccuggacggcagaagccaggugagcacccccagauucggcaagaccuucgacgccccccccgcccugcccaaggccaccagaaaggcccugggcaccgugaacagagccaccgagaagagcgugaagaccaagggcccccugaagcagaagcagcccagcuucagcgccaagaagaugaccgagaagaccgugaaggccaagagcagcgugcccgccagcgacgacgccuaccccgagaucgagaaguucuuccccuucaacccccuggacuucgagagcuucgaccugcccgaggagcaccagaucgcccaccugccccugagcggcgugccccugaugauccuggacgaggagagagagcuggagaagcuguuccagcugggcccccccagccccgugaagaugcccagcccccccugggagagcaaccugcugcagagccccagcagcauccugagcacccuggacguggagcugccccccgugugcugcgacaucgacaucuaa

SEQ ID NO: 22243 - RNA, 429 nt, Artificial Sequence
  PTTG1IP__Homo_sapiens__NP_001273751
auggcccccggcguggccagaggccccacccccuacuggagacugagacugggcggcgccgcccugcugcugcugcugauccccguggccgccgcccaggagccccccggcgccgccugcagccagaacaccaacaagaccugcgaggagugccugaagaacgugagcgccugccugaagaagaagaccagaaugcuggaccugaagaccaccaaggcccugcagcacaucagccccgacgccagcugcgaggugcacgccccccagcccagccccgccggcagacccagaggccacugcggccugcugacccuggccagcgagcccgccagccugcccggccaggccgccggcgagcugccccugaaggacagcccccuggugcugcagaccggcgaccugcuguuccccgugcaccugugcuucuaa

SEQ ID NO: 22244 - RNA, 576 nt, Artificial Sequence
  PTTG2__Homo_sapiens__NP_006598
auggccacccugaucuacguggacaaggagaucggcgagcccggcaccagaguggccgccaaggacgugcugaagcuggagagcagacccagcaucaaggcccuggacggcaucagccaggugcugaccagaagauucggcaagaccuacgacgcccccagcgcccugcccaaggccaccagaaaggcccugggcaccgugaacagagccaccgagaagagcgugaagaccaacggccccagaaagcagaagcagcccagcuucagcgccaagaagaugaccgagaagaccgugaagaccaagagcagcgugcccgccagcgacgacgccuaccccgagaucgagaaguucuuccccuucaaccugcuggacuucgagagcuucgaccugcccgaggagagacagaucgcccaccugccccugagcggcgugccccugaugauccuggacgaggagggcgagcuggagaagcuguuccagcugggcccccccagccccgugaagaugcccagcccccccugggagugcaaccuguucgccgugagcuucaagcacagcguggaccccggcugcuaa

SEQ ID NO: 22245 - RNA, 1146 nt, Artificial Sequence
  PTX3__Homo_sapiens__NP_002843
augcaccugcuggccauccuguucugcgcccuguggagcgccgugcuggccgagaacagcgacgacuacgaccugauguacgugaaccuggacaacgagaucgacaacggccugcaccccaccgaggaccccacccccugcgccugcggccaggagcacagcgagugggacaagcuguucaucaugcuggagaacagccagaugagagagagaaugcugcugcaggccaccgacgacgugcugagaggcgagcugcagagacugagagaggagcugggcagacuggccgagagccuggccagacccugcgcccccggcgcccccgccgaggccagacugaccagcgcccuggacgagcugcugcaggccaccagagacgccggcagaagacuggccagaauggagggcgccgaggcccagagacccgaggaggccggcagagcccuggccgccgugcuggaggagcugagacagaccagagccgaccugcacgccgugcagggcugggccgccagaagcuggcugcccgccggcugcgagaccgccauccuguuccccaugagaagcaagaagaucuucggcagcgugcaccccgugagacccaugagacuggagagcuucagcgccugcaucugggugaaggccaccgacgugcugaacaagaccauccuguucagcuacggcaccaagagaaaccccuacgagauccagcuguaccugagcuaccagagcaucguguucguggugggcggcgaggagaacaagcugguggccgaggccauggugagccugggcagauggacccaccugugcggcaccuggaacagcgaggagggccugaccagccugugggugaacggcgagcuggccgccaccaccguggagauggccaccggccacaucgugcccgagggcggcauccugcagaucggccaggagaagaacggcugcugcgugggcggcggcuucgacgagacccuggccuucagcggcagacugaccggcuucaacaucugggacagcgugcugagcaacgaggagaucagagagaccggcggcgccgagagcugccacaucagaggcaacaucgugggcuggggcgugaccgagauccagccccacggcggcgcccaguacgugagcuaa

SEQ ID NO: 22246 - RNA, 1551 nt, Artificial Sequence
  PUF60__Homo_sapiens__NP_001129505
auggagaacggccagagcaccgccgccaagcugggccugcccccccugacccccgagcagcaggaggcccugcagaaggccaagaaguacgccauggagcagagcaucaagagcgugcuggugaagcagaccaucgcccaccagcagcagcagcugaccaaccugcagauggccgccgugaccaugggcuucggcgacccccugagcccccugcagagcauggccgcccagagacagagagcccuggccaucaugugcagaguguacgugggcagcaucuacuacgagcugggcgaggacaccaucagacaggccuucgcccccuucggccccaucaagagcaucgacaugagcugggacagcgugaccaugaagcacaagggcuucgccuucguggaguacgaggugcccgaggccgcccagcuggcccuggagcagaugaacagcgugaugcugggcggcagaaacaucaaggugggcagacccagcaacaucggccaggcccagcccaucaucgaccagcuggccgaggaggccagagccuucaacagaaucuacguggccagcgugcaccaggaccugagcgacgacgacaucaagagcguguucgaggccuucggcaagaucaagagcugcacccuggccagagaccccaccaccggcaagcacaagggcuacggcuucaucgaguacgagaaggcccagagcagccaggacgccgugagcagcaugaaccuguucgaccugggcggccaguaccugagagugggcaaggccgugaccccccccaugccccugcugacccccgccacccccggcggccugccccccgccgccgccguggccgccgccgccgccaccgccaagaucaccgcccaggaggccguggccggcgccgccgugcugggcacccugggcacccccggccuggugagccccgcccugacccuggcccagccccugggcacccugccccaggccgugauggccgcccaggcccccggcgugaucaccggcgugacccccgccagaccccccauccccgugaccauccccagcgugggcguggugaaccccauccuggccagcccccccacccugggccugcuggagcccaagaaggagaaggaggaggaggagcuguuccccgagagcgagagacccgagaugcugagcgagcaggagcacaugagcaucagcggcagcagcgccagacacauggugaugcagaagcugcugagaaagcaggagagcaccgugauggugcugagaaacaugguggaccccaaggacaucgacgacgaccuggagggcgaggugaccgaggagugcggcaaguucggcgccgugaacagagugaucaucuaccaggagaagcagggcgaggaggaggacgccgagaucaucgugaagaucuucguggaguucagcaucgccagcgagacccacaaggccauccaggcccugaacggcagaugguucgccggcagaaaggugguggccgagguguacgaccaggagagauucgacaacagcgaccugagcgccuaa

SEQ ID NO: 22247 - RNA, 3027 nt, Artificial Sequence
  PUM2__Homo_sapiens__NP_001269681
augagccagcccaucauggugcagagaagaagcggccagggcuuccacggcaacagcgaggugaacgccauccugagccccagaagcgagagcggcggccugggcgugagcaugguggaguacgugcugagcagcagccccgccgacaagcuggacagcagauucagaaagggcaacuucggcaccagagacgccgagaccgacggccccgagaagggcgaccagaagggcaaggccagccccuucgaggaggaccagaacagagaccugaagcagggcgacgacgacgacagcaagaucaacggcagaggccugcccaacggcauggacgccgacugcaaggacuucaacagaacccccggcagcagacaggccagccccaccgaggugguggagagacugggccccaacaccaaccccagcgagggccugggcccccugcccaaccccaccgccaacaagccccugguggaggaguucagcaaccccgagacccagaaccuggacgccauggagcaggugggccuggagagccugcaguucgacuaccccggcaaccaggugcccauggacagcagcggcgccaccgugggccuguucgacuacaacagccagcagcagcuguuccagagaaccaacgcccugaccgugcagcagcugaccgccgcccagcagcagcaguacgcccuggccgccgcccagcagccccacaucgccggcguguucagcgccggccuggcccccgccgccuucgugcccaaccccuacaucaucagcgccgccccccccggcaccgaccccuacaccgccgccggccuggccgccgccgccacccuggccggccccgccguggugcccccccaguacuacggcgugcccuggggcguguaccccgccaaccuguuccagcagcaggccgccgccgccgccaacaacaccgccagccagcaggccgccagccaggcccagcccggccagcagcaggugcugagagccggcgccggccagagaccccugacccccaaccagggccagcagggccagcaggccgagagccuggccgccgccgccgccgccaaccccacccuggccuucggccagggccuggccaccggcaugcccggcuaccaggugcuggcccccaccgccuacuacgaccagaccggcgcccugguggugggccccggcgccagaaccggccugggcgcccccgugagacugauggcccccacccccgugcugaucagcagcgccgccgcccaggccgccgccgccgccgccgccggcggcaccgccagcagccugaccggcagcaccaacggccuguucagacccaucggcacccagcccccccagcagcagcagcagcagcccagcaccaaccugcagagcaacagcuucuacggcagcagcagccugaccaacagcagccagagcagcagccuguucagccacggccccggccagcccggcagcaccagccugggcuucggcagcggcaacagccugggcgccgccaucggcagcgcccugagcggcuucggcagcagcgugggcagcagcgccagcagcagcgccaccagaagagagagccugagcaccagcagcgaccuguacaagagaagcagcagcagccuggcccccaucggccagcccuucuacaacagccugggcuucagcagcagccccagccccaucggcaugccccugcccagccagacccccggccacagccugacccccccccccagccugagcagccacggcagcagcagcagccugcaccugggcggccugaccaacggcagcggcagauacaucagcgccgcccccggcgccgaggccaaguacagaagcgccagcagcaccagcagccuguucagcagcagcagccagcuguucccccccagcagacugagauacaacagaagcgacaucaugcccagcggcagaagcagacugcuggaggacuucagaaacaacagauuccccaaccugcagcugagagaccugaucggccacaucguggaguucagccaggaccagcacggcagcagauucauccagcagaagcuggagagagccacccccgccgagagacagaugguguucaacgagauccugcaggccgccuaccagcugaugaccgacguguucggcaacuacgugauccagaaguucuucgaguucggcagccuggaccagaagcuggcccuggccaccagaaucagaggccacgugcugccccuggcccugcagauguacggcugcagagugauccagaaggcccuggagagcaucagcagcgaccagcagagcgagauggugaaggagcuggacggccacgugcugaagugcgugaaggaccagaacggcaaccacguggugcagaagugcaucgagugcgugcagccccagagccugcaguucaucaucgacgccuucaagggccagguguucgugcugagcacccaccccuacggcugcagagugauccagagaauccuggagcacugcaccgccgagcagacccugcccauccuggaggagcugcaccagcacaccgagcagcuggugcaggaccaguacggcaacuacgugauccagcacgugcuggagcacggcagacccgaggacaagagcaagaucgugagcgagaucagaggcaaggugcuggcccugagccagcacaaguucgccagcaacgugguggagaagugcgugacccacgccagcagagccgagagagcccugcugaucgacgaggugugcugccagaacgacggcccccacagcgcccuguacaccaugaugaaggaccaguacgccaacuacguggugcagaagaugaucgacauggccgagcccgcccagagaaagaucaucaugcacaagaucagaccccacaucaccacccugagaaaguacaccuacggcaagcacauccuggccaagcuggagaaguacuaccugaagaacagccccgaccugggccccaucggcggcccccccaacggcaugcuguaa

SEQ ID NO: 22248 - RNA, 969 nt, Artificial Sequence
  PURA__Homo_sapiens__NP_005850
auggccgacagagacagcggcagcgagcagggcggcgccgcccugggcagcggcggcagccugggccaccccggcagcggcagcggcagcggcggcggcggcggcggcggcggcggcggcggcggcagcggcggcggcggcggcggcgcccccggcggccugcagcacgagacccaggagcuggccagcaagagaguggacauccagaacaagagauucuaccuggacgugaagcagaacgccaagggcagauuccugaagaucgccgaggugggcgccggcggcaacaagagcagacugacccugagcaugagcguggccguggaguucagagacuaccugggcgacuucaucgagcacuacgcccagcugggccccagccagccccccgaccuggcccaggcccaggacgagcccagaagagcccugaagagcgaguuccuggugagagagaacagaaaguacuacauggaccugaaggagaaccagagaggcagauuccugagaaucagacagaccgugaacagaggccccggccugggcagcacccagggccagaccaucgcccugcccgcccagggccugaucgaguucagagacgcccuggccaagcugaucgacgacuacggcguggaggaggagcccgccgagcugcccgagggcaccagccugaccguggacaacaagagauucuucuucgacgugggcagcaacaaguacggcguguucaugagagugagcgaggugaagcccaccuacagaaacagcaucaccgugcccuacaaggugugggccaaguucggccacaccuucugcaaguacagcgaggagaugaagaagauccaggagaagcagagagagaagagagccgccugcgagcagcugcaccagcagcagcagcagcagcaggaggagaccgccgccgccacccugcugcugcagggcgaggaggagggcgaggaggacuaa

SEQ ID NO: 22249 - RNA, 939 nt, Artificial Sequence
  PURB__Homo_sapiens__NP_150093
auggccgacggcgacagcggcagcgagagaggcggcggcggcggccccugcggcuuccagcccgccagcagaggcggcggcgagcaggagacccaggagcuggccagcaagagacuggacauccagaacaagagauucuaccuggacgugaagcagaacgccaagggcagauuccugaagaucgccgaggugggcgccggcggcagcaagagcagacugacccugagcauggccguggccgccgaguucagagacagccugggcgacuucaucgagcacuacgcccagcugggccccagcagccccgagcagcuggccgccggcgccgaggagggcggcggccccagaagagcccugaagagcgaguuccuggugagagagaacagaaaguacuaccuggaccugaaggagaaccagagaggcagauuccugagaaucagacagaccgugaacagaggcggcggcggcuucggcgccggccccggccccggcggccugcagagcggccagaccaucgcccugcccgcccagggccugaucgaguucagagacgcccuggccaagcugaucgacgacuacggcggcgaggacgacgagcuggccggcggccccggcggcggcgccggcggccccggcggcggccuguacggcgagcugcccgagggcaccagcaucaccguggacagcaagagauucuucuucgacgugggcugcaacaaguacggcguguuccugagagugagcgaggugaagcccagcuacagaaacgccaucaccgugcccuucaaggccuggggcaaguucggcggcgccuucugcagauacgccgacgagaugaaggagauccaggagagacagagagacaagcuguacgagagaagaggcggcggcagcggcggcggcgaggagagcgagggcgaggagguggacgaggacuaa

SEQ ID NO: 22250 - RNA, 1590 nt, Artificial Sequence
  PUS10__Homo_sapiens__XP_011530879
auguucccccugaccgaggagaacaagcacguggcccagcugcugcugaacaccggcaccugccccagaugcaucuucagauucugcggcguggacuuccacgcccccuacaagcugcccuacaaggagcugcugaacgagcugcagaaguuccuggagaccgagaaggacgagcugauccuggaggugaugaaccccccccccaagaagaucagacugcaggagcuggaggacagcaucgacaaccugagccagaacggcgagggcagaaucagcgugagccacgugggcagcaccgccagcaagaacagcaaccugaacgugugcaacgugugccugggcauccugcaggaguucugcgagaaggacuucaucaagaaggugugccagaagguggaggccagcggcuucgaguucaccagccugguguucagcgugagcuuccccccccagcugagcgugagagagcacgccgccuggcugcuggugaagcaggagaugggcaagcagagccugagccugggcagagacgacaucgugcagcugaaggaggccuacaaguggaucacccacccccuguucagcgaggagcugggcgugcccaucgacggcaagagccuguucgaggugagcgugguguucgcccaccccgagaccguggaggacugccacuuccuggccgccaucugccccgacugcuucaagcccgccaagaacaagcagagcguguucaccagaauggccgugaugaaggcccugaacaagaucaaggaggaggacuuccugaagcaguuccccugcccccccaacagccccaaggccgugugcgccgugcuggagaucgagugcgcccacggcgccguguucguggccggcagauacaacaaguacagcagaaaccugccccagacccccuggaucaucgacggcgagagaaagcuggagagcagcguggaggagcugaucagcgaccaccugcuggccguguucaaggccgagagcuucaacuucagcagcagcggcagagaggacguggacgugagaacccugggcaacggcagacccuucgccaucgagcuggugaacccccacagagugcacuucaccagccaggagaucaaggagcugcagcagaagaucaacaacagcagcaacaagauccaggugagagaccugcagcuggugaccagagaggccaucggccacaugaaggagggcgaggaggagaagaccaagaccuacagcgcccugaucuggaccaacaaggccauccagaagaaggacaucgaguuccugaacgacaucaaggaccugaagaucgaccagaagaccccccugagagugcugcacagaagaccccuggccgugagagccagagugauccacuucauggagacccaguacguggacgagcaccacuucagacugcaccugaagacccaggccggcaccuacaucaaggaguucgugcacggcgacuucggcagaaccaagcccaacaucggcagccugaugaacgugaccgccgacauccuggagcuggacguggagagcguggacguggacuggccccccgcccuggacgacuaa

SEQ ID NO: 22251 - RNA, 1200 nt, Artificial Sequence
  PUS1__Homo_sapiens__NP_001002019
auggccggcaacgccgagcccccccccgccggcgccgccugcccccaggacagaagaagcugcagcggcagagccggcggcgacagagugugggaggacggcgagcaccccgccaagaagcugaagagcggcggcgacgaggagagaagagagaagccccccaagagaaagaucgugcugcugauggccuacagcggcaagggcuaccacggcaugcagagaaacgugggcagcagccaguucaagaccaucgaggacgaccuggugagcgcccuggugagaagcggcugcauccccgagaaccacggcgaggacaugagaaagaugagcuuccagagaugcgccagaaccgacaagggcgugagcgccgccggccagguggugagccugaagguguggcugaucgacgacauccuggagaagaucaacagccaccugcccagccacaucagaauccugggccugaagagagugaccggcggcuucaacagcaagaacagaugcgacgccagaaccuacugcuaccugcugcccaccuucgccuucgcccacaaggacagagacgugcaggacgagaccuacagacugagcgccgagacccugcagcaggugaacagacugcuggccugcuacaagggcacccacaacuuccacaacuucaccagccagaagggcccccaggaccccagcgccugcagauacauccuggagauguacugcgaggagcccuucgugagagagggccuggaguucgccgugaucagagugaagggccagagcuucaugaugcaccagaucagaaagauggugggccuggugguggccaucgugaagggcuacgcccccgagagcgugcuggagagaagcuggggcaccgagaagguggacgugcccaaggcccccggccugggccuggugcuggagagagugcacuucgagaaguacaaccagagauucggcaacgacggccugcacgagccccuggacugggcccaggaggagggcaagguggccgccuucaaggaggagcacaucuaccccaccaucaucggcaccgagagagacgagagaagcauggcccaguggcugagcacccugcccauccacaacuucagcgccaccgcccugaccgccggcggcaccggcgccaaggugcccagcccccuggagggcagcgagggcgacggcgacaccgacuaa

SEQ ID NO: 22252 - RNA, 324 nt, Artificial Sequence
  PVALB__Homo_sapiens__XP_011545203
augagcaugaccgaccugcugaacgccgaggacaucaagaaggccgugggcgccuucagcgccaccgacagcuucgaccacaagaaguucuuccagauggugggccugaagaagaagagcgccgacgacgugaagaagguguuccacaugcuggacaaggacaagagcggcuucaucgaggaggacgagcugggcuucauccugaagggcuucagccccgacgccagagaccugagcgccaaggagaccaagaugcugauggccgccggcgacaaggacggcgacggcaagaucggcguggacgaccccgccgacguggacuaa

SEQ ID NO: 22253 - RNA, 1119 nt, Artificial Sequence
  PVR__Homo_sapiens__NP_001129240
auggccagagccauggccgccgccuggccccugcugcugguggcccugcuggugcugagcuggcccccccccggcaccggcgacgugguggugcaggcccccacccaggugcccggcuuccugggcgacagcgugacccugcccugcuaccugcaggugcccaacauggaggugacccacgugagccagcugaccugggccagacacggcgagagcggcagcauggccguguuccaccagacccagggccccagcuacagcgagagcaagagacuggaguucguggccgccagacugggcgccgagcugagaaacgccagccugagaauguucggccugagaguggaggacgagggcaacuacaccugccuguucgugaccuucccccagggcagcagaagcguggacaucuggcugagagugcuggccaagccccagaacaccgccgaggugcagaaggugcagcugaccggcgagcccgugcccauggccagaugcgugagcaccggcggcagaccccccgcccagaucaccuggcacagcgaccugggcggcaugcccaacaccagccaggugcccggcuuccugagcggcaccgugaccgugaccagccuguggauccuggugcccagcagccagguggacggcaagaacgugaccugcaagguggagcacgagagcuucgagaagccccagcugcugaccgugaaccugaccguguacuacccccccgaggugagcaucagcggcuacgacaacaacugguaccugggccagaacgaggccacccugaccugcgacgccagaagcaaccccgagcccaccggcuacaacuggagcaccaccaugggcccccugccccccuucgccguggcccagggcgcccagcugcugaucagacccguggacaagcccaucaacaccacccugaucugcaacgugaccaacgcccugggcgccagacaggccgagcugaccgugcaggugaaggagggcccccccagcgagcacagcggcaccgagcacgccagcgccagcgccaacggccacgugagcuacagcgccgugagcagagagaacagcagcagccaggacccccagaccgagggcaccagauaa

SEQ ID NO: 22254 - RNA, 1554 nt, Artificial Sequence
  PVRL1__Homo_sapiens__NP_002846
auggccagaaugggccuggccggcgccgccggcagaugguggggccuggcccugggccugaccgccuucuuccugcccggcgugcacagccagguggugcaggugaacgacagcauguacggcuucaucggcaccgacguggugcugcacugcagcuucgccaacccccugcccagcgugaagaucacccaggugaccuggcagaagagcaccaacggcagcaagcagaacguggccaucuacaaccccagcaugggcgugagcgugcuggcccccuacagagagagaguggaguuccugagacccagcuucaccgacggcaccaucagacugagcagacuggagcuggaggacgagggcguguacaucugcgaguucgccaccuuccccaccggcaacagagagagccagcugaaccugaccgugauggccaagcccaccaacuggaucgagggcacccaggccgugcugagagccaagaagggccaggacgacaaggugcugguggccaccugcaccagcgccaacggcaagccccccagcguggugagcugggagaccagacugaagggcgaggccgaguaccaggagaucagaaaccccaacggcaccgugaccgugaucagcagauacagacuggugcccagcagagaggcccaccagcagagccuggccugcaucgugaacuaccacauggacagauucaaggagagccugacccugaacgugcaguacgagcccgaggugaccaucgagggcuucgacggcaacugguaccugcagagaauggacgugaagcugaccugcaaggccgacgccaacccccccgccaccgaguaccacuggaccacccugaacggcagccugcccaagggcguggaggcccagaacagaacccuguucuucaagggccccaucaacuacagccuggccggcaccuacaucugcgaggccaccaaccccaucggcaccagaagcggccagguggaggugaacaucaccgaguuccccuacacccccagcccccccgagcacggcagaagagccggccccgugcccaccgccaucaucggcggcguggccggcagcauccugcuggugcugaucguggugggcggcaucgugguggcccugagaagaagaagacacaccuucaagggcgacuacagcaccaagaagcacguguacggcaacggcuacagcaaggccggcaucccccagcaccacccccccauggcccagaaccugcaguaccccgacgacagcgacgacgagaagaaggccggcccccugggcggcagcagcuacgaggaggaggaggaggaggaggagggcggcggcggcggcgagagaaaggugggcggcccccaccccaaguacgacgaggacgccaagagacccuacuucaccguggacgaggccgaggccagacaggacggcuacggcgacagaacccugggcuaccaguacgaccccgagcagcuggaccuggccgagaacauggugagccagaacgacggcagcuucaucagcaagaaggagugguacguguaa

SEQ ID NO: 22255 - RNA, 1617 nt, Artificial Sequence
  PVRL2__Homo_sapiens__NP_001036189
auggccagagccgccgcccugcugcccagcagaagcccccccaccccccugcuguggccccugcugcugcugcugcugcuggagaccggcgcccaggacgugagagugcaggugcugcccgaggugagaggccagcugggcggcaccguggagcugcccugccaccugcugccccccgugcccggccuguacaucagccuggugaccuggcagagacccgacgcccccgccaaccaccagaacguggccgccuuccaccccaagaugggccccagcuuccccagccccaagcccggcagcgagagacugagcuucgugagcgccaagcagagcaccggccaggacaccgaggccgagcugcaggacgccacccuggcccugcacggccugaccguggaggacgagggcaacuacaccugcgaguucgccaccuuccccaagggcagcgugagaggcaugaccuggcugagagugaucgccaagcccaagaaccaggccgaggcccagaaggugaccuucagccaggaccccaccaccguggcccugugcaucagcaaggagggcagaccccccgccagaaucagcuggcugagcagccuggacugggaggccaaggagacccaggugagcggcacccuggccggcaccgugaccgugaccagcagauucacccuggugcccagcggcagagccgacggcgugaccgugaccugcaagguggagcacgagagcuucgaggagcccgcccugauccccgugacccugagcgugagauacccccccgaggugagcaucagcggcuacgacgacaacugguaccugggcagaaccgacgccacccugagcugcgacgugagaagcaaccccgagcccaccggcuacgacuggagcaccaccagcggcaccuuccccaccagcgccguggcccagggcagccagcuggugauccacgccguggacagccuguucaacaccaccuucgugugcaccgugaccaacgccgugggcaugggcagagccgagcaggugaucuucgugagagagacccccaacaccgccggcgccggcgccaccggcggcaucaucggcggcaucaucgccgccaucaucgccaccgccguggccgccaccggcauccugaucugcagacagcagagaaaggagcagacccugcagggcgccgaggaggacgaggaccuggagggcccccccagcuacaagccccccacccccaaggccaagcuggaggcccaggagaugcccagccagcuguucacccugggcgccagcgagcacagcccccugaagacccccuacuucgacgccggcgccagcugcaccgagcaggagaugcccagauaccacgagcugcccacccuggaggagagaagcggcccccugcaccccggcgccaccagccugggcagccccauccccgugccccccggcccccccgccguggaggacgugagccuggaccuggaggacgaggagggcgaggaggaggaggaguaccuggacaagaucaaccccaucuacgacgcccugagcuacagcagccccagcgacagcuaccagggcaagggcuucgugaugagcagagccauguacguguaa

SEQ ID NO: 22256 - RNA, 1101 nt, Artificial Sequence
  PVRL3__Homo_sapiens__NP_001230215
auggccagaacccugagacccagcccccugugccccggcggcggcaaggcccagcugagcagcgccagccugcugggcgccggccugcugcugcagccccccaccccccccccccugcugcugcugcuguucccccugcugcuguucagcagacugugcggcgcccuggccggccccaucaucguggagccccacgugaccgccguguggggcaagaacgugagccugaagugccugaucgaggugaacgagaccaucacccagaucagcugggagaagauccacggcaagagcagccagaccguggccgugcaccacccccaguacggcuucagcgugcagggcgaguaccagggcagagugcuguucaagaacuacagccugaacgacgccaccaucacccugcacaacaucggcuucagcgacagcggcaaguacaucugcaaggccgugaccuucccccugggcaacgcccagagcagcaccaccgugaccgugcugguggagcccaccgugagccugaucaagggccccgacagccugaucgacggcggcaacgagaccguggccgccaucugcaucgccgccaccggcaagcccguggcccacaucgacugggagggcgaccugggcgagauggagagcaccaccaccagcuuccccaacgagaccgccaccaucaucagccaguacaagcuguuccccaccagauucgccagaggcagaagaaucaccugcguggugaagcaccccgcccuggagaaggacaucagauacagcuucauccuggacauccaguacgcccccgaggugagcgugaccggcuacgacggcaacugguucgugggcagaaagggcgugaaccugaagugcaacgccgacgccaaccccccccccuucaagagcguguggagcagacuggacggccaguggcccgacggccugcuggccagcgacaacacccugcacuucgugcacccccugaccuucaacuacagcggcguguacaucugcaaggugaccaacagccugggccagagaagcgaccagaaggugaucuacaucagcgccuacaacagcguggccagccugaacugcuaa

SEQ ID NO: 22257 - RNA, 1533 nt, Artificial Sequence
  PVRL4__Homo_sapiens__NP_112178
augccccugagccugggcgccgagauguggggccccgaggccuggcugcugcugcugcugcugcuggccagcuucaccggcagaugccccgccggcgagcuggagaccagcgacguggugaccguggugcugggccaggacgccaagcugcccugcuucuacagaggcgacagcggcgagcaggugggccagguggccugggccagaguggacgccggcgagggcgcccaggagcuggcccugcugcacagcaaguacggccugcacgugagccccgccuacgagggcagaguggagcagccccccccccccagaaacccccuggacggcagcgugcugcugagaaacgccgugcaggccgacgagggcgaguacgagugcagagugagcaccuuccccgccggcagcuuccaggccagacugagacugagagugcuggugcccccccugcccagccugaaccccggccccgcccuggaggagggccagggccugacccuggccgccagcugcaccgccgagggcagccccgcccccagcgugaccugggacaccgaggugaagggcaccaccagcagcagaagcuucaagcacagcagaagcgccgccgugaccagcgaguuccaccuggugcccagcagaagcaugaacggccagccccugaccugcguggugagccaccccggccugcugcaggaccagagaaucacccacauccugcacgugagcuuccuggccgaggccagcgugagaggccuggaggaccagaaccuguggcacaucggcagagagggcgccaugcugaagugccugagcgagggccagcccccccccagcuacaacuggaccagacuggacggcccccugcccagcggcgugagaguggacggcgacacccugggcuuccccccccugaccaccgagcacagcggcaucuacgugugccacgugagcaacgaguucagcagcagagacagccaggugaccguggacgugcuggacccccaggaggacagcggcaagcagguggaccuggugagcgccagcguggugguggugggcgugaucgccgcccugcuguucugccugcuggugguggugguggugcugaugagcagauaccacagaagaaaggcccagcagaugacccagaaguacgaggaggagcugacccugaccagagagaacagcaucagaagacugcacagccaccacaccgaccccagaagccagcccgaggagagcgugggccugagagccgagggccaccccgacagccugaaggacaacagcagcugcagcgugaugagcgaggagcccgagggcagaagcuacagcacccugaccaccgugagagagaucgagacccagaccgagcugcugagccccggcagcggcagagccgaggaggaggaggaccaggacgagggcaucaagcaggccaugaaccacuucgugcaggagaacggcacccugagagccaagcccaccggcaacggcaucuacaucaacggcagaggccaccugguguaa

SEQ ID NO: 22258 - RNA, 2760 nt, Artificial Sequence
  PWP2__Homo_sapiens__NP_005040
augaaguucgccuacagauucagcaaccugcugggcaccguguacagaagaggcaaccugaacuucaccugcgacggcaacagcgugaucagccccgugggcaacagagugaccguguucgaccugaagaacaacaagagcgacacccugccccuggccaccagauacaacgugaagugcgugggccugagccccgacggcagacuggccaucaucguggacgagggcggcgacgcccugcuggugagccuggugugcagaagcgugcugcaccacuuccacuucaagggcagcgugcacagcgugagcuucagccccgacggcagaaaguucguggugaccaagggcaacaucgcccagauguaccacgcccccggcaagaagagagaguucaacgccuucgugcuggacaagaccuacuucggccccuacgacgagaccaccugcaucgacuggaccgacgacagcagaugcuucguggugggcagcaaggacaugagcaccuggguguucggcgccgagagaugggacaaccugaucuacuacgcccugggcggccacaaggacgccaucguggccugcuucuucgagagcaacagccuggaccuguacagccugagccaggacggcgugcugugcauguggcagugcgacaccccccccgagggccugagacugaagccccccgccggcuggaaggccgaccugcugcagagagaggaggaggaggaggaggaggaggaccaggagggcgacagagagaccaccaucagaggcaaggccacccccgccgaggaggagaagaccggcaaggugaaguacagcagacuggccaaguacuucuucaacaaggagggcgacuucaacaaccugaccgccgccgccuuccacaagaagagccaccugcuggugaccggcuucgccagcggcaucuuccaccugcacgagcugcccgaguucaaccugauccacagccugagcaucagcgaccagagcaucgccagcguggccaucaacagcagcggcgacuggaucgccuucggcugcagcggccugggccagcugcuggugugggaguggcagagcgagagcuacgugcugaagcagcagggccacuucaacagcaugguggcccuggccuacagccccgacggccaguacaucgugaccggcggcgacgacggcaaggugaagguguggaacacccugagcggcuucugcuucgugaccuucaccgagcacagcagcggcgugaccggcgugaccuucaccgccaccggcuacgugguggugaccagcagcauggacggcaccgugagagccuucgaccugcacagauacagaaacuucagaaccuucaccagccccagacccacccaguucagcugcguggccguggacgccagcggcgagaucgugagcgccggcgcccaggacagcuucgagaucuucguguggagcaugcagaccggcagacugcuggacgugcugagcggccacgagggccccaucagcggccugugcuucaaccccaugaagagcgugcuggccagcgccagcugggacaagaccgugagacugugggacauguucgacagcuggagaaccaaggagacccuggcccugaccagcgacgcccuggccgugaccuucagacccgacggcgccgagcuggccguggccacccugaacagccagaucaccuucugggaccccgagaacgccgugcagaccggcagcaucgagggcagacacgaccugaagaccggcagaaaggagcuggacaagaucaccgccaagcacgccgccaagggcaaggccuucaccgcccugugcuacagcgccgacggccacagcauccuggccggcggcaugagcaaguucgugugcaucuaccacgugagagagcagauccugaugaagagauucgagaucagcugcaaccugagccuggacgccauggaggaguuccugaacagaagaaagaugaccgaguucggcaaccuggcccugaucgaccaggacgccggccaggaggacggcguggccaucccccugcccggcgugagaaagggcgacaugagcagcagacacuucaagcccgagaucagagugaccagccugagauucagccccaccggcagaugcugggccgccaccaccaccgagggccugcugaucuacagccuggacaccagagugcuguucgaccccuucgagcuggacaccagcgugacccccggcagagugagagaggcccugagacagcaggacuucaccagagccauccugauggcccugagacugaacgagagcaagcuggugcaggaggcccuggaggccgugcccagaggcgagaucgagguggugaccagcagccugcccgagcuguacguggagaaggugcuggaguuccuggccagcagcuucgaggugagcagacaccuggaguucuaccugcuguggacccacaagcugcugaugcugcacggccagaagcugaagagcagagccggcacccugcugcccgugauccaguuccugcagaagagcauccagagacaccuggacgaccugagcaagcugugcagcuggaaccacuacaacaugcaguacgcccuggccgugagcaagcagagaggcaccaagagaagccuggacccccugggcagcgaggaggaggccgaggccagcgaggacgacagccugcaccugcugggcggcggcggcagagacagcgaggaggagaugcuggccuaa

SEQ ID NO: 22259 - RNA, 1500 nt, Artificial Sequence
  PWWP2B__Homo_sapiens__NP_001092107
auggagcccagagccggcugcagacugcccgugagaguggagcagguggugaacggcgcccugguggugaccgugagcugcggcgagagaagcuucgccggcauccugcuggacugcaccaagaagagcggccuguucggccugcccccccuggccccccugccccagguggacgagagccccgugaacgacagccacggcagagcccccgaggagggcgacgccgaggugaugcagcugggcagcagcagccccccccccgccagaggcgugcagccccccgagaccaccagacccgagcccccccccccccuggugcccccccugcccgccggcagccugccccccuacccccccuacuucgagggcgcccccuucccccacccccuguggcugagagacaccuacaagcugugggugccccagcccccccccagaaccaucaagagaaccagaagaagacugagcagaaacagagaccccggcagacugauccugagcaccaucagacugagacccagacaggugcugugcgagaagugcaagagcacccugagcccccccgaggccagccccggcccccccgccgcccccagagccagaagaagacugggcagcggccccgacagagagcugagaaagcccgaggagcccgagaacggcgagcccaccgccgccgccaccgccagaagaagcaagagagagagaagagaggaggacagagcccccgccgagcaggugcccagaagccccgugaucaagaucagcuacagcaccccccagggcaagggcgagguggugaagauccccagcagagugcacggcagccuggagcccuucagaccccagcaggccccccaggacgacggcagccaggaccccgaggugcuggacagagagagcagagacagacccagcugcgcccccagcgccagcauccccaagcugaagcugaccagacccgugcccgccggcgccgaccugcccccccccaagaucagacugaagccccacagacugggcgacagcgagcacgagcccguguacagagccgagcuggugggcgagcugaacggcuaccugagagacagcagccccgcccccugcgccgacggccccgccggcggccuggccgaccugagcagcggcagcagcggcgaggacgacgacuucaagagcugcccccagggcccccagggcagagagggccuggccuuccuggugagcugccccgagggcagagccgacugcgccagcgagagcgccugcagcagcgacagccuggacgaggccagaagcagcggcagcgagggcacccccgccgacaccggcgaccugagccccggccacggcgccagcgcccccagcgugagcagagaggccagacagaccgugcccccccugaccgugagacugcacacccagagcgugagcgagugcaucaccgaggacggcagaaccguggccgugggcgacaucguguggggccacagaagauaa

SEQ ID NO: 22260 - RNA, 4440 nt, Artificial Sequence
  PXDN__Homo_sapiens__NP_036425
auggccaagagaagcagaggccccggcagaagaugccugcuggcccuggugcuguucugcgccuggggcacccuggccgugguggcccagaagcccggcgccggcugccccagcagaugccugugcuucagaaccaccgugagaugcaugcaccugcugcuggaggccgugcccgccguggccccccagaccagcauccuggaccugagauucaacagaaucagagagauccagcccggcgccuucagaagacugagaaaccugaacacccugcugcugaacaacaaccagaucaagagaauccccagcggcgccuucgaggaccuggagaaccugaaguaccuguaccuguacaagaacgagauccagagcaucgacagacaggccuucaagggccuggccagccuggagcagcuguaccugcacuucaaccagaucgagacccuggaccccgacagcuuccagcaccugcccaagcuggagagacuguuccugcacaacaacagaaucacccaccuggugcccggcaccuucaaccaccuggagagcaugaagagacugagacuggacagcaacacccugcacugcgacugcgagauccuguggcuggccgaccugcugaagaccuacgccgagagcggcaacgcccaggccgccgccaucugcgaguaccccagaagaauccagggcagaagcguggccaccaucacccccgaggagcugaacugcgagagacccagaaucaccagcgagccccaggacgccgacgugaccagcggcaacaccguguacuucaccugcagagccgagggcaaccccaagcccgagaucaucuggcugagaaacaacaacgagcugagcaugaagaccgacagcagacugaaccugcuggacgacggcacccugaugauccagaacacccaggagaccgaccagggcaucuaccagugcauggccaagaacguggccggcgaggugaagacccaggaggugacccugagauacuucggcagccccgccagacccaccuucgugauccagccccagaacaccgaggugcuggugggcgagagcgugacccuggagugcagcgccaccggccaccccccccccagaaucagcuggaccagaggcgacagaaccccccugcccguggaccccagagugaacaucacccccagcggcggccuguacauccagaacguggugcagggcgacagcggcgaguacgccugcagcgccaccaacaacaucgacagcgugcacgccaccgccuucaucaucgugcaggcccugccccaguucaccgugaccccccaggacagaguggugaucgagggccagaccguggacuuccagugcgaggccaagggcaaccccccccccgugaucgccuggaccaagggcggcagccagcugagcguggacagaagacaccuggugcugagcagcggcacccugagaaucagcggcguggcccugcacgaccagggccaguacgagugccaggccgugaacaucaucggcagccagaaggugguggcccaccugaccgugcagcccagagugacccccguguucgccagcauccccagcgacaccaccguggaggugggcgccaacgugcagcugcccugcagcagccagggcgagcccgagcccgccaucaccuggaacaaggacggcgugcaggugaccgagagcggcaaguuccacaucagccccgagggcuuccugaccaucaacgacgugggccccgccgacgccggcagauacgagugcguggccagaaacaccaucggcagcgccagcgugagcauggugcugagcgugaacgugcccgacgugagcagaaacggcgaccccuucguggccaccagcaucguggaggccaucgccaccguggacagagccaucaacagcaccagaacccaccuguucgacagcagacccagaagccccaacgaccugcuggcccuguucagauaccccagagaccccuacaccguggagcaggccagagccggcgagaucuucgagagaacccugcagcugauccaggagcacgugcagcacggccugaugguggaccugaacggcaccagcuaccacuacaacgaccuggugagcccccaguaccugaaccugaucgccaaccugagcggcugcaccgcccacagaagagugaacaacugcagcgacaugugcuuccaccagaaguacagaacccacgacggcaccugcaacaaccugcagcaccccauguggggcgccagccugaccgccuucgagagacugcugaagagcguguacgagaacggcuucaacacccccagaggcaucaacccccacagacuguacaacggccacgcccugcccaugcccagacuggugagcaccacccugaucggcaccgagaccgugacccccgacgagcaguucacccacaugcugaugcaguggggccaguuccuggaccacgaccuggacagcaccgugguggcccugagccaggccagauucagcgacggccagcacugcagcaacgugugcagcaacgacccccccugcuucagcgugaugaucccccccaacgacagcagagccagaagcggcgccagaugcauguucuucgugagaagcagccccgugugcggcagcggcaugaccagccugcugaugaacagcguguaccccagagagcagaucaaccagcugaccagcuacaucgacgccagcaacguguacggcagcaccgagcacgaggccagaagcaucagagaccuggccagccacagaggccugcugagacagggcaucgugcagagaagcggcaagccccugcugcccuucgccaccggcccccccaccgagugcaugagagacgagaacgagagccccauccccugcuuccuggccggcgaccacagagccaacgagcagcugggccugaccagcaugcacacccugugguucagagagcacaacagaaucgccaccgagcugcugaagcugaacccccacugggacggcgacaccaucuacuacgagaccagaaagaucgugggcgccgagauccagcacaucaccuaccagcacuggcugcccaagauccugggcgaggugggcaugagaacccugggcgaguaccacggcuacgaccccggcaucaacgccggcaucuucaacgccuucgccaccgccgccuucagauucggccacacccuggugaacccccugcuguacagacuggacgagaacuuccagcccaucgcccaggaccaccugccccugcacaaggccuucuucagccccuucagaaucgugaacgagggcggcaucgacccccugcugagaggccuguucggcguggccggcaagaugagagugcccagccagcugcugaacaccgagcugaccgagagacuguucagcauggcccacaccguggcccuggaccuggccgccaucaacauccagagaggcagagaccacggcaucccccccuaccacgacuacagaguguacugcaaccugagcgccgcccacaccuucgaggaccugaagaacgagaucaagaaccccgagaucagagagaagcugaagagacuguacggcagcacccugaacaucgaccuguuccccgcccuggugguggaggaccuggugcccggcagcagacugggccccacccugaugugccugcugagcacccaguucaagagacugagagacggcgacagacugugguacgagaaccccggcguguucagccccgcccagcugacccagaucaagcagaccagccuggccagaauccugugcgacaacgccgacaacaucaccagagugcagagcgacguguucagaguggccgaguucccccacggcuacggcagcugcgacgagauccccagaguggaccugagaguguggcaggacugcugcgaggacugcagaaccagaggccaguucaacgccuucagcuaccacuucagaggcagaagaagccuggaguucagcuaccaggaggacaagcccaccaagaagaccagacccagaaagauccccagcgugggcagacagggcgagcaccugagcaacagcaccagcgccuucagcaccagaagcgacgccagcggcaccaacgacuucagagaguucgugcuggagaugcagaagaccaucaccgaccugagaacccagaucaagaagcuggagagcagacugagcaccaccgagugcguggacgccggcggcgagagccacgccaacaacaccaaguggaagaaggacgccugcaccaucugcgagugcaaggacggccaggugaccugcuucguggaggccugcccccccgccaccugcgccgugcccgugaacauccccggcgccugcugccccgugugccugcagaagagagccgaggagaagcccuaa

SEQ ID NO: 22261 - RNA, 4392 nt, Artificial Sequence
  PXDNL__Homo_sapiens__NP_653252
auggagcccagacuguucugcuggaccacccuguuccugcuggccggcuggugccugcccggccugcccugccccagcagaugccugugcuucaagagcaccgugagaugcaugcaccugaugcuggaccacaucccccaggugccccagcagaccaccgugcuggaccugagauucaacagaaucagagagauccccggcagcgccuucaagaagcugaagaaccugaacacccugcugcugaacaacaaccacaucagaaagaucagcagaaacgccuucgagggccuggagaaccugcuguaccuguaccuguacaagaacgagauccacgcccuggacaagcagaccuucaagggccugaucagccuggagcaccuguacauccacuucaaccagcuggagaugcugcagcccgagaccuucggcgaccugcugagacuggagagacuguuccugcacaacaacaagcugagcaagauccccgccggcagcuucagcaaccuggacagccugaagagacugagacuggacagcaacgcccuggugugcgacugcgaccugauguggcugggcgagcugcugcagggcuucgcccagcacggccacacccaggccgccgccaccugcgaguaccccagaagacugcacggcagagccguggccagcgugaccguggaggaguucaacugccagagccccagaaucaccuucgagccccaggacguggaggugcccagcggcaacaccguguacuucaccugcagagccgagggcaaccccaagcccgagaucaucuggauccacaacaaccacagccuggaccuggaggacgacaccagacugaacguguucgacgacggcacccugaugaucagaaacaccagagagagcgaccagggcguguaccagugcauggccagaaacagcgccggcgaggccaagacccagagcgccaugcugagauacagcagccugcccgccaagcccagcuucgugauccagccccaggacaccgaggugcugaucggcaccagcaccacccuggagugcauggccaccggccacccccacccccugaucaccuggaccagagacaacggccuggagcuggacggcagcagacacguggccaccagcagcggccuguaccugcagaacaucacccagagagaccacggcagauucaccugccacgccaacaacagccacggcaccgugcaggccgccgccaacaucaucgugcaggcccccccccaguucaccgugacccccaaggaccagguggugcuggaggagcacgccguggaguggcugugcgaggccgacggcaaccccccccccgugaucguguggaccaagaccggcggccagcugcccguggagggccagcacaccgugcugagcagcggcacccugagaaucgacagagccgcccagcacgaccagggccaguacgagugccaggccgugagcagccugggcgugaagaaggugagcgugcagcugaccgugaagcccaaggcccuggccguguucacccagcugccccaggacaccagcguggaggugggcaagaacaucaacaucagcugccacgcccagggcgagccccagcccaucaucaccuggaacaaggagggcgugcagaucaccgagagcggcaaguuccacguggacgacgagggcacccugaccaucuacgacgccggcuuccccgaccagggcagauacgagugcguggccagaaacagcuucggccuggccgugaccaacauguuccugaccgugaccgccauccagggcagacaggccggcgacgacuucguggagagcagcauccuggacgccgugcagagaguggacagcgccaucaacagcaccagaagacaccuguucagccagaagccccacaccagcagcgaccugcuggcccaguuccacuaccccagagacccccugaucguggagauggccagagccggcgagaucuucgagcacacccugcagcugaucagagagagagugaagcagggccugaccguggaccuggagggcaaggaguucagauacaacgaccuggugagccccagaagccugagccugaucgccaaccugagcggcugcaccgccagaagaccccugcccaacugcagcaacagaugcuuccacgccaaguacagagcccacgacggcaccugcaacaaccugcagcagcccaccuggggcgccgcccugaccgccuucgccagacugcugcagcccgccuacagagacggcaucagagcccccagaggccugggccugcccgugggcagcagacagccccugcccccccccagacugguggccaccgugugggccagagccgccgccgugacccccgaccacagcuacaccagaaugcugaugcacuggggcugguuccuggagcacgaccuggaccacaccgugcccgcccugagcaccgccagauucagcgacggcagacccugcagcagcgugugcaccaacgacccccccugcuuccccaugaacaccagacacgccgaccccagaggcacccacgcccccugcaugcuguucgccagaagcagccccgccugcgccagcggcagacccagcgccaccguggacagcguguacgccagagagcagaucaaccagcagaccgccuacaucgacggcagcaacguguacggcagcagcgagagagagagccaggcccugagagaccccagcgugcccagaggccugcugaagaccggcuuccccuggccccccagcggcaagccccugcugcccuucagcaccggcccccccaccgagugcgccagacaggagcaggagagccccugcuuccuggccggcgaccacagagccaacgagcaccuggcccuggccgccaugcacacccugugguucagagagcacaacagaguggccaccgagcugagcgcccugaacccccacugggagggcaacaccguguaccaggaggccagaaagaucgugggcgccgagcugcagcacaucaccuacagccacuggcugcccaaggugcugggcgaccccggcaccagaaugcugagaggcuacagaggcuacaaccccaacgugaacgccggcaucaucaacagcuucgccaccgccgccuucagauucggccacacccugaucaaccccauccuguacagacugaacgccacccugggcgagaucagcgagggccaccugcccuuccacaaggcccuguucagccccagcagaaucaucaaggagggcggcaucgaccccgugcugagaggccuguucggcguggccgccaaguggagagcccccagcuaccugcugagccccgagcugacccagagacuguucagcgccgccuacagcgccgccguggacagcgccgccaccaucauccagagaggcagagaccacggcaucccccccuacguggacuucagaguguucugcaaccugaccagcgugaagaacuucgaggaccugcagaacgagaucaaggacagcgagaucagacagaagcugagaaagcuguacggcagccccggcgacaucgaccuguggcccgcccugaugguggaggaccugauccccggcaccagagugggccccacccugaugugccuguucgugacccaguuccagagacugagagacggcgacagauucugguacgagaaccccggcguguucacccccgcccagcugacccagcugaagcaggccagccugagcagagugcugugcgacaacggcgacagcauccagcaggugcaggccgacguguucgugaaggccgaguacccccaggacuaccugaacugcagcgagauccccaagguggaccugagaguguggcaggacugcugcgccgacugcagaagcagaggccaguucagagccgugacccaggagagccagaagaagagaagcgcccaguacagcuaccccguggacaaggacauggagcugagccaccugagaagcagacagcaggacaagaucuacgugggcgaggacgccagaaacgugaccgugcuggccaagaccaaguucagccaggacuucagcaccuucgccgccgagauccaggagaccaucaccgcccugagagagcagaucaacaagcuggaggccagacugagacaggccggcugcaccgacgugagaggcgugcccagaaaggccgaggagagauggaugaaggaggacugcacccacugcaucugcgagagcggccaggugaccugcgugguggagaucugcccccccgcccccugccccagccccgagcuggugaagggcaccugcugccccgugugcagagacagaggcaugcccagcgacagccccgagaagagauaa

SEQ ID NO: 22262 - RNA, 1638 nt, Artificial Sequence
  PXK__Homo_sapiens__NP_001276025
auggccuucauggagaagccccccgccggcaaggugcugcuggacgacaccgugccccugaccgccgccaucgaggccagccagagccugcagagccacaccaucgccggccugagccugccccugccccccaagaagcugaucggcaacauggacagagaguucaucgccgagagacagaagggccugcagaacuaccugaacgugaucaccaccaaccacauccugagcaacugcgagcuggugaagaaguuccuggaccccaacaacuacagcgccaacuacaccgagaucgcccugcagcaggugagcauguucuucagaagcgagcccaagugggaggugguggagccccugaaggacaucggcuggagaaucagaaagaaguacuuccugaugaagaucaagaaccagcccaaggagagacuggugcugagcugggccgaccugggccccgacaaguaccugagcgacaaggacuuccagugccugaucaagcugcugcccagcugccugcaccccuacaucuacagagugaccuucgccaccgccaacgagagcagcgcccugcugaucagaauguucaacgagaagggcacccugaaggaccugaucuacaaggccaagcccaaggaccccuuccugaagaaguacugcaaccccaagaagauccagggccuggagcugcagcagaucaagaccuacggcagacagauccuggaggugcugaaguuccugcacgacaagggcuuccccuacggccaccugcacgccagcaacgugaugcuggacggcgacaccugcagacugcuggaccuggagaacagccugcugggccugcccagcuucuacagaagcuacuucagccaguucagaaagaucaacacccuggagagcguggacgugcacugcuucggccaccugcuguacgagaugaccuacggcagaccccccgacagcgugcccguggacagcuucccccccgcccccagcauggccgugguggccgugcuggagagcacccugagcugcgaggccugcaagaacggcaugcccaccaucagcagacugcugcagaugccccuguucagcgacgugcugcugaccaccagcgagaagccccaguucaagauccccaccaagcugaaggaggcccugagaaucgccaaggagugcaucgagaagagacugaucgaggagcagaagcagauccaccagcacagaagacugaccagagcccagagccaccacggcagcgaggaggagagaaagaagagaaagauccuggccagaaagaagagcaagagaagcgcccuggagaacagcgaggagcacagcgccaaguacagcaacagcaacaacagcgccggcagcggcgccagcagcccccugaccagccccagcagccccaccccccccagcaccagcggcaucagcgcccugccccccccccccccccccccccccccccccgccgccccccugccccccgccagcaccgaggcccccgcccagcugagcagccaggccgugaacggcaugagcagaggcgcccugcugagcagcauccagaacuuccagaagggcacccugagaaaggccaagaccugcgaccacagcgcccccaagaucggcuaa

SEQ ID NO: 22263 - RNA, 588 nt, Artificial Sequence
  PXMP2__Homo_sapiens__NP_061133
auggcccccgccgccagcagacugagagccgaggccggccugggcgcccugcccagaagagcccuggcccaguaccugcuguuccugagacuguaccccgugcugaccaaggccgccaccagcggcauccugagcgcccugggcaacuuccuggcccagaugaucgagaagaagagaaagaaggagaacagcagaagccuggacgugggcggcccccugagauacgccguguacggcuucuucuucaccggcccccugagccacuucuucuacuucuucauggagcacuggaucccccccgaggugccccuggccggccugagaagacugcugcuggacagacugguguucgcccccgccuuccugaugcuguucuuccugaucaugaacuuccuggagggcaaggacgccagcgccuucgccgccaagaugagaggcggcuucuggcccgcccugagaaugaacuggagaguguggaccccccugcaguucaucaacaucaacuacgugccccugaaguucagagugcuguucgccaaccuggccgcccuguucugguacgccuaccuggccagccugggcaaguaa

SEQ ID NO: 22264 - RNA, 1776 nt, Artificial Sequence
  PXN__Homo_sapiens__NP_001074324
auggacgaccuggacgcccugcuggccgaccuggagagcaccaccagccacaucagcaagagacccguguuccugagcgaggagacccccuacagcuaccccaccggcaaccacaccuaccaggagaucgccgugcccccccccgugccccccccccccagcagcgaggcccugaacggcaccauccuggacccccuggaccaguggcagcccagcagcagcagauucauccaccagcagccccagagcagcagccccguguacggcagcagcgccaagaccagcagcgugagcaacccccaggacagcgugggcagccccugcagcagagugggcgaggaggagcacguguacagcuuccccaacaagcagaagagcgccgagcccagccccaccgugaugagcaccagccugggcagcaaccugagcgagcuggacagacugcugcuggagcugaacgccgugcagcacaacccccccggcuuccccgccgacgaggccaacagcagccccccccugcccggcgcccugagcccccuguacggcgugcccgagaccaacagcccccugggcggcaaggccggcccccugaccaaggagaagcccaagagaaacggcggcagaggccuggaggacgugagacccagcguggagagccugcuggacgagcuggagagcagcgugcccagccccgugcccgccaucaccgugaaccagggcgagaugagcagcccccagagagugaccagcacccagcagcagaccagaaucagcgccagcagcgccaccagagagcuggacgagcugauggccagccugagcgacuucaagauccagggccuggagcagagagccgacggcgagagaugcugggccgccggcuggcccagagacggcggcagaagcagccccggcggccaggacgagggcggcuucauggcccagggcaagaccggcagcagcagcccccccggcggcccccccaagcccggcagccagcuggacagcaugcugggcagccugcagagcgaccugaacaagcugggcguggccaccguggccaagggcgugugcggcgccugcaagaagcccaucgccggccagguggugaccgccaugggcaagaccuggcaccccgagcacuucgugugcacccacugccaggaggagaucggcagcagaaacuucuucgagagagacggccagcccuacugcgagaaggacuaccacaaccuguucagccccagaugcuacuacugcaacggccccauccuggacaagguggugaccgcccuggacagaaccuggcaccccgagcacuucuucugcgcccagugcggcgccuucuucggccccgagggcuuccacgagaaggacggcaaggccuacugcagaaaggacuacuucgacauguucgcccccaagugcggcggcugcgccagagccauccuggagaacuacaucagcgcccugaacacccuguggcaccccgagugcuucgugugcagagagugcuucacccccuucgugaacggcagcuucuucgagcacgacggccagcccuacugcgaggugcacuaccacgagagaagaggcagccugugcagcggcugccagaagcccaucaccggcagaugcaucaccgccauggccaagaaguuccaccccgagcacuucgugugcgccuucugccugaagcagcugaacaagggcaccuucaaggagcagaacgacaagcccuacugccagaacugcuuccugaagcuguucugcuaa

SEQ ID NO: 22265 - RNA, 420 nt, Artificial Sequence
  PXT1__Homo_sapiens__XP_011512702
augaagggcaagaacaugaagaagaagcacgacggcaucguguacgagaccaaggaggugcugaaccccagccccaaggugacccacugcugcaagagccuguggcugaaguacagcuuccagaaggccuacaugacccagcuggugagcagccagcccgugcccgccaugagcagaaaccccgaccacaaccugcugagccagcccaaggagcacagcaucgugcagaagcaccaccaggaggagaucauccacaagcuggccaugcagcugagacacaucggcgacaacaucgaccacagaauggugagagaggaccugcagcaggacggcagagacgcccuggaccacuucguguucuucuucuucagaagagugcaggugcugcugcacuucuucuggaacaaccaccugcuguaa

SEQ ID NO: 22266 - RNA, 588 nt, Artificial Sequence
  PYCARD__Homo_sapiens__NP_037390
augggcagagccagagacgccauccuggacgcccuggagaaccugaccgccgaggagcugaagaaguucaagcugaagcugcugagcgugccccugagagagggcuacggcagaauccccagaggcgcccugcugagcauggacgcccuggaccugaccgacaagcuggugagcuucuaccuggagaccuacggcgccgagcugaccgccaacgugcugagagacaugggccugcaggagauggccggccagcugcaggccgccacccaccagggcagcggcgccgcccccgccggcauccaggcccccccccagagcgccgccaagcccggccugcacuucaucgaccagcacagagccgcccugaucgccagagugaccaacguggaguggcugcuggacgcccuguacggcaaggugcugaccgacgagcaguaccaggccgugagagccgagcccaccaaccccagcaagaugagaaagcuguucagcuucacccccgccuggaacuggaccugcaaggaccugcugcugcaggcccugagagagagccagagcuaccugguggaggaccuggagagaagcuaa

SEQ ID NO: 22267 - RNA, 867 nt, Artificial Sequence
  PYCR1__Homo_sapiens__NP_001269208
augagcgugggcuucaucggcgccggccagcuggccuucgcccuggccaagggcuucaccgccgccggcgugcuggccgcccacaagaucauggccagcagccccgacauggaccuggccaccgugagcgcccugagaaagaugggcgugaagcugaccccccacaacaaggagaccgugcagcacagcgacgugcuguuccuggccgugaagccccacaucauccccuucauccuggacgagaucggcgccgacaucgaggacagacacaucguggugagcugcgccgccggcgugaccaucagcagcaucgagaagaagcugagcgccuucagacccgcccccagagugaucagaugcaugaccaacacccccgugguggugagagagggcgccaccguguacgccaccggcacccacgcccagguggaggacggcagacugauggagcagcugcugagcagcgugggcuucugcaccgagguggaggaggaccugaucgacgccgugaccggccugagcggcagcggccccgccuacggcgccgccaagaugcugcugcacagcgagcagcaccccggccagcugaaggacaacgugagcagccccggcggcgccaccauccacgcccugcacgugcuggagagcggcggcuucagaagccugcugaucaacgccguggaggccagcugcaucagaaccagagagcugcagagcauggccgaccaggagcaggugagccccgccgccaucaagaagaccauccuggacaaggugaagcuggacagccccgccggcaccgcccugagccccagcggccacaccaagcugcugcccagaagccuggcccccgccggcaaggacuaa

SEQ ID NO: 22268 - RNA, 270 nt, Artificial Sequence
  PYDC1__Homo_sapiens__NP_690865
augggcaccaagagagaggccauccugaaggugcuggagaaccugacccccgaggagcugaagaaguucaagaugaagcugggcaccgugccccugagagagggcuucgagagaauccccagaggcgcccugggccagcuggacaucguggaccugaccgacaagcugguggccagcuacuacgaggacuacgccgccgagcuggugguggccgugcugagagacaugagaaugcuggaggaggccgccagacugcagagagccgccuaa

SEQ ID NO: 22269 - RNA, 294 nt, Artificial Sequence
  PYDC2__Homo_sapiens__NP_001076777
auggccagcagcgccgagcuggacuucaaccugcaggcccugcuggagcagcugagccaggacgagcugagcaaguucaagagccugaucagaaccaucagccugggcaaggagcugcagaccgugccccagaccgagguggacaaggccaacggcaagcagcugguggagaucuucaccagccacagcugcagcuacugggccggcauggccgccauccagguguucgagaagaugaaccagacccaccugagcggcagagccgacgagcacugcgugaugcccccccccuaa

SEQ ID NO: 22270 - RNA, 2532 nt, Artificial Sequence
  PYGB__Homo_sapiens__NP_002853
auggccaagccccugaccgacagcgagaagagaaagcagaucagcgugagaggccuggccggccugggcgacguggccgaggugagaaagagcuucaacagacaccugcacuucacccuggugaaggacagaaacguggccacccccagagacuacuucuucgcccuggcccacaccgugagagaccaccuggugggcagauggaucagaacccagcagcacuacuacgagagagaccccaagagaaucuacuaccugagccuggaguucuacaugggcagaacccugcagaacaccauggugaaccugggccugcagaacgccugcgacgaggccaucuaccagcugggccuggaccuggaggagcuggaggagaucgaggaggacgccggccugggcaacggcggccugggcagacuggccgccugcuuccuggacagcauggccacccugggccuggccgccuacggcuacggcaucagauacgaguucggcaucuucaaccagaagaucgugaacggcuggcagguggaggaggccgacgacuggcugagauacggcaaccccugggagaaggccagacccgaguacaugcugcccgugcacuucuacggcagaguggagcacacccccgacggcgugaaguggcuggacacccagguggugcuggccaugcccuacgacacccccgugcccggcuacaagaacaacaccgugaacaccaugagacuguggagcgccaaggcccccaacgacuucaagcugcaggacuucaacgugggcgacuacaucgaggccgugcuggacagaaaccuggccgagaacaucagcagagugcuguaccccaacgacaacuucuucgagggcaaggagcugagacugaagcaggaguacuucgugguggccgccacccugcaggacaucaucagaagauucaagagcagcaaguucggcugcagagaccccgugagaaccugcuucgagaccuuccccgacaagguggccauccagcugaacgacacccaccccgcccugagcauccccgagcugaugagaauccugguggacguggagaagguggacugggacaaggccugggagaucaccaagaagaccugcgccuacaccaaccacaccgugcugcccgaggcccuggagagauggcccgugagcauguucgagaagcugcugcccagacaccuggagaucaucuacgccaucaaccagagacaccuggaccacguggccgcccuguuccccggcgacguggacagacugagaagaaugagcgugaucgaggagggcgacugcaagagaaucaacauggcccaccugugcgugaucggcagccacgccgugaacggcguggccagaauccacagcgagaucgugaagcagagcguguucaaggacuucuacgagcuggagcccgagaaguuccagaacaagaccaacggcaucacccccagaagauggcugcugcugugcaaccccggccuggccgacaccaucguggagaagaucggcgaggaguuccugaccgaccugagccagcugaagaagcugcugccccuggugagcgacgagguguucaucagagacguggccaaggugaagcaggagaacaagcugaaguucagcgccuuccuggagaaggaguacaaggugaagaucaaccccagcagcauguucgacgugcacgugaagagaauccacgaguacaagagacagcugcugaacugccugcacguggugacccuguacaacagaaucaagagagaccccgccaaggccuucgugcccagaaccgugaugaucggcggcaaggccgcccccggcuaccacauggccaagcugaucaucaagcuggugaccagcaucggcgacguggugaaccacgaccccguggugggcgacagacugaaggugaucuuccuggagaacuacagagugagccuggccgagaaggugauccccgccgccgaccugagccagcagaucagcaccgccggcaccgaggccagcggcaccggcaacaugaaguucaugcugaacggcgcccugaccaucggcaccauggacggcgccaacguggagauggccgaggaggccggcgccgagaaccuguucaucuucggccugagaguggaggacguggaggcccuggacagaaagggcuacaacgccagagaguacuacgaccaccugcccgagcugaagcaggccguggaccagaucagcagcggcuucuucagccccaaggagcccgacugcuucaaggacaucgugaacaugcugaugcaccacgacagauucaagguguucgccgacuacgaggccuacaugcagugccaggcccagguggaccagcuguacagaaaccccaaggaguggaccaagaaggugaucagaaacaucgccugcagcggcaaguucagcagcgacagaaccaucaccgaguacgccagagagaucuggggcguggagcccagcgaccugcagauccccccccccaacauccccagagacuaa

SEQ ID NO: 22271 - RNA, 2442 nt, Artificial Sequence
  PYGL__Homo_sapiens__NP_001157412
auggccaagccccugaccgaccaggagaagagaagacagaucagcaucagaggcaucgugggcguggagaacguggccgagcugaagaagagcuucaacagacaccugcacuucacccuggugaaggacagaaacguggccaccaccagagacuacuacuucgcccuggcccacaccgugagagaccaccuggugggcagauggaucagaacccagcagcacuacuacgacaagugccccaagcugggccuggacaucgaggagcuggaggagaucgaggaggacgccggccugggcaacggcggccugggcagacuggccgccugcuuccuggacagcauggccacccugggccuggccgccuacggcuacggcaucagauacgaguacggcaucuucaaccagaagaucagagacggcuggcagguggaggaggccgacgacuggcugagauacggcaaccccugggagaagagcagacccgaguucaugcugcccgugcacuucuacggcaagguggagcacaccaacaccggcaccaaguggaucgacacccagguggugcuggcccugcccuacgacacccccgugcccggcuacaugaacaacaccgugaacaccaugagacuguggagcgccagagcccccaacgacuucaaccugagagacuucaacgugggcgacuacauccaggccgugcuggacagaaaccuggccgagaacaucagcagagugcuguaccccaacgacaacuucuucgagggcaaggagcugagacugaagcaggaguacuucgugguggccgccacccugcaggacaucaucagaagauucaaggccagcaaguucggcagcaccagaggcgccggcaccguguucgacgccuuccccgaccagguggccauccagcugaacgacacccaccccgcccuggccauccccgagcugaugagaaucuucguggacaucgagaagcugcccuggagcaaggccugggagcugacccagaagaccuucgccuacaccaaccacaccgugcugcccgaggcccuggagagauggcccguggaccugguggagaagcugcugcccagacaccuggagaucaucuacgagaucaaccagaagcaccuggacagaaucguggcccuguuccccaaggacguggacagacugagaagaaugagccugaucgaggaggagggcagcaagagaaucaacauggcccaccugugcaucgugggcagccacgccgugaacggcguggccaagauccacagcgacaucgugaagaccaagguguucaaggacuucagcgagcuggagcccgacaaguuccagaacaagaccaacggcaucacccccagaagauggcugcugcugugcaaccccggccuggccgagcugaucgccgagaagaucggcgaggacuacgugaaggaccugagccagcugaccaagcugcacagcuuccugggcgacgacguguuccugagagagcuggccaaggugaagcaggagaacaagcugaaguucagccaguuccuggagaccgaguacaaggugaagaucaaccccagcagcauguucgacgugcaggugaagagaauccacgaguacaagagacagcugcugaacugccugcacgugaucaccauguacaacagaaucaagaaggaccccaagaagcuguucgugcccagaaccgugaucaucggcggcaaggccgcccccggcuaccacauggccaagaugaucaucaagcugaucaccagcguggccgacguggugaacaacgaccccauggugggcagcaagcugaaggugaucuuccuggagaacuacagagugagccuggccgagaaggugauccccgccaccgaccugagcgagcagaucagcaccgccggcaccgaggccagcggcaccggcaacaugaaguucaugcugaacggcgcccugaccaucggcaccauggacggcgccaacguggagauggccgaggaggccggcgaggagaaccuguucaucuucggcaugagaaucgacgacguggccgcccuggacaagaagggcuacgaggccaaggaguacuacgaggcccugcccgagcugaagcuggugaucgaccagaucgacaacggcuucuucagccccaagcagcccgaccuguucaaggacaucaucaacaugcuguucuaccacgacagauucaagguguucgccgacuacgaggccuacgugaagugccaggacaaggugagccagcuguacaugaaccccaaggccuggaacaccauggugcugaagaacaucgccgccagcggcaaguucagcagcgacagaaccaucaaggaguacgcccagaacaucuggaacguggagcccagcgaccugaagaucagccugagcaacgagagcaacaaggugaacggcaacuaa

SEQ ID NO: 22272 - RNA, 2265 nt, Artificial Sequence
  PYGM__Homo_sapiens__NP_001158188
augagcagaccccugagcgaccaggagaagagaaagcagaucagcgugagaggccuggccggcguggagaacgugaccgagcugaagaagaacuucaacagacaccugcacuucacccuggugaaggacagaaacguggccacccccagagacuacuacuucgcccuggcccacaccgugagagaccaccuggugggcagauggaucagaacccagcagcacuacuacgagaaggaccccaagaagaucagcggcggcuggcagauggaggaggccgacgacuggcugagauacggcaaccccugggagaaggccagacccgaguucacccugcccgugcacuucuacggccacguggagcacaccagccagggcgccaaguggguggacacccagguggugcuggccaugcccuacgacacccccgugcccggcuacagaaacaacguggugaacaccaugagacuguggagcgccaaggcccccaacgacuucaaccugaaggacuucaacgugggcggcuacauccaggccgugcuggacagaaaccuggccgagaacaucagcagagugcuguaccccaacgacaacuucuucgagggcaaggagcugagacugaagcaggaguacuucgugguggccgccacccugcaggacaucaucagaagauucaagagcagcaaguucggcugcagagaccccgugagaaccaacuucgacgccuuccccgacaagguggccauccagcugaacgacacccaccccagccuggccauccccgagcugaugagaauccugguggaccuggagagaauggacugggacaaggccugggacgugaccgugagaaccugcgccuacaccaaccacaccgugcugcccgaggcccuggagagauggcccgugcaccugcuggagacccugcugcccagacaccugcagaucaucuacgagaucaaccagagauuccugaacagaguggccgccgccuuccccggcgacguggacagacugagaagaaugagccugguggaggagggcgccgugaagagaaucaacauggcccaccugugcaucgccggcagccacgccgugaacggcguggccagaauccacagcgagauccugaagaagaccaucuucaaggacuucuacgagcuggagccccacaaguuccagaacaagaccaacggcaucacccccagaagauggcuggugcugugcaaccccggccuggccgaggugaucgccgagagaaucggcgaggacuucaucagcgaccuggaccagcugagaaagcugcugagcuucguggacgacgaggccuucaucagagacguggccaaggugaagcaggagaacaagcugaaguucgccgccuaccuggagagagaguacaaggugcacaucaaccccaacagccuguucgacauccaggugaagagaauccacgaguacaagagacagcugcugaacugccugcacgugaucacccuguacaacagaaucaagagagagcccaacaaguucuucgugcccagaaccgugaugaucggcggcaaggccgcccccggcuaccacauggccaagaugaucaucagacuggugaccgccaucggcgacguggugaaccacgaccccgccgugggcgacagacugagagugaucuuccuggagaacuacagagugagccuggccgagaaggugauccccgccgccgaccugagcgagcagaucagcaccgccggcaccgaggccagcggcaccggcaacaugaaguucaugcugaacggcgcccugaccaucggcaccauggacggcgccaacguggagauggccgaggaggccggcgaggagaacuucuucaucuucggcaugagaguggaggacguggacaagcuggaccagagaggcuacaacgcccaggaguacuacgacagaauccccgagcugagacaggugaucgagcagcugagcagcggcuucuucagccccaagcagcccgaccuguucaaggacaucgugaacaugcugaugcaccacgacagauucaagguguucgccgacuacgaggacuacaucaagugccaggagaaggugagcgcccuguacaagaaccccagagaguggaccagaauggugaucagaaacaucgccaccagcggcaaguucagcagcgacagaaccaucgcccaguacgccagagagaucuggggcguggagcccagcagacagagacugcccgcccccgacgaggccaucuaa

SEQ ID NO: 22273 - RNA, 1260 nt, Artificial Sequence
  PYGO1__Homo_sapiens__NP_056432
augcccgccgagaacagccccgcccccgccuacaaggugagcagccacggcggcgacagcggccuggacggccugggcggccccggcgugcagcugggcagccccgacaagaagaagagaaaggccaacacccagggccccagcuuccccccccugagcgaguacgcccccccccccaaccccaacagcgaccaccugguggccgccaaccccuucgacgacaacuacaacaccaucagcuacaagccccugcccagcagcaaccccuaccugggccccggcuaccccggcuucggcggcuacagcaccuucagaaugcccccccacgugccccccagaaugagcagccccuacugcggccccuacagccugagaaaccagccccaccccuucccccagaacccccugggcaugggcuucaacagaccccacgccuucaacuucggcccccacgacaacagcagcuucggcaaccccagcuacaacaacgcccugagccagaacgugaacaugcccaaccagcacuucagacagaaccccgccgagaacuucagccagauccccccccagaacgccagccaggugagcaaccccgaccuggccagcaacuucgugcccggcaacaacagcaacuucaccagcccccuggagagcaaccacagcuucauccccccccccaacaccuucggccaggccaaggcccccccccccaagcaggacuucacccagggcgccaccaagaacaccaaccagaacagcagcgcccaccccccccaccugaacauggacgacaccgugaaccagagcaacaucgagcugaagaacgugaacagaaacaacgccgugaaccaggagaacagcagaagcagcagcaccgaggccaccaacaacaaccccgccaacggcacccagaacaagcccagacagcccagaggcgccgccgacgccugcaccaccgagaagagcaacaagagcagccugcaccccaacagacacggccacagcagcagcgaccccguguaccccugcggcaucugcaccaacgaggugaacgacgaccaggacgccauccugugcgaggccagcugccagaagugguuccacagaaucugcaccggcaugaccgagaccgccuacggccugcugaccgccgaggccagcgccguguggggcugcgacaccugcauggccgacaaggacgugcagcugaugagaaccagagagaccuucggccccagcgccgugggcagcgacgccuaa

SEQ ID NO: 22274 - RNA, 1221 nt, Artificial Sequence
  PYGO2__Homo_sapiens__NP_612157
auggccgccagcgccccccccccccccgacaagcuggagggcggcggcggccccgcccccccccccgccccccccagcaccggcagaaagcagggcaaggccggccugcagaugaagagccccgagaagaagagaagaaagagcaacacccagggccccgccuacagccaccugaccgaguucgcccccccccccacccccaugguggaccaccugguggccagcaaccccuucgaggacgacuucggcgcccccaaggugggcguggccgccccccccuuccugggcagccccgugcccuucggcggcuucagagugcagggcggcauggccggccaggugccccccggcuacagcaccggcggcggcggcggcccccagccccugagaagacagcccccccccuucccccccaaccccaugggccccgccuucaacaugcccccccagggccccggcuaccccccccccggcaacaugaacuuccccagccagcccuucaaccagccccugggccagaacuucagcccccccagcggccagaugaugcccggccccgugggcggcuucggccccaugaucagccccaccaugggccagccccccagagccgagcugggcccccccagccugagccagagauucgcccagcccggcgcccccuucggccccagcccccugcagagacccggccagggccugcccagccugccccccaacaccagccccuuccccggccccgaccccggcuuccccggccccggcggcgaggacggcggcaagccccugaacccccccgccagcaccgccuucccccaggagccccacagcggcagccccgccgccgccgugaacggcaaccagcccagcuucccccccaacagcagcggcagaggcggcggcacccccgacgccaacagccuggccccccccggcaaggccggcggcggcagcggcccccagcccccccccggccugguguaccccugcggcgccugcagaagcgaggugaacgacgaccaggacgccauccugugcgaggccagcugccagaagugguuccacagagagugcaccggcaugaccgagagcgccuacggccugcugaccaccgaggccagcgccgugugggccugcgaccugugccugaagaccaaggagauccagagcguguacaucagagagggcaugggccagcugguggccgccaacgacggcuaa

SEQ ID NO: 22275 - RNA, 1479 nt, Artificial Sequence
  PYHIN1__Homo_sapiens__NP_689714
auggccaacaacuacaagaagaucgugcugcugaagggccuggaggugaucaacgacuaccacuucagaaucgugaagagccugcugagcaacgaccugaagcugaaccccaagaugaaggaggaguacgacaagauccagaucgccgaccugauggaggagaaguuccccggcgacgccggccugggcaagcugaucgaguucuucaaggagauccccacccugggcgaccuggccgagacccugaagagagagaagcugaagguggccaacaagaucgagagcauccccgugaagggcaucauccccagcaagaagaccaagcagaaggagguguaccccgccacccccgccugcacccccagcaacagacugaccgccaagggcgccgaggagacccugggcccccagaagagaaagaagcccagcgaggaggagaccggcaccaagagaagcaagaugagcaaggagcagaccagacccagcugcagcgccggcgccagcaccagcaccgccaugggcagaagcccccccccccagaccagcagcagcgccccccccaacaccagcagcaccgagagccugaagccccuggccaacagacacgccaccgccagcaagaacaucuucagagaggaccccaucaucgccauggugcugaacgccaccaagguguucaaguacgagagcagcgagaacgagcagagaagaauguuccacgccaccguggccacccagacccaguucuuccacgugaaggugcugaacaucaaccugaagagaaaguucaucaagaagagaaucaucaucaucagcaacuacagcaagagaaacagccugcuggaggugaacgaggccagcagcgugagcgaggccggccccgaccagaccuucgaggugcccaaggacaucaucagaagagccaagaagauccccaagaucaacauccugcacaagcagaccagcggcuacaucguguacggccuguucaugcugcacaccaagaucgugaacagaaagaccaccaucuacgagauccaggacaagaccggcagcauggccguggugggcaagggcgagugccacaacauccccugcgagaagggcgacaagcugagacuguucugcuucagacugagaaagagagagaacaugagcaagcugaugagcgagaugcacagcuucauccagauccagaagaacaccaaccagagaagccacgacagcagaagcauggcccugccccaggagcagagccagcaccccaagcccagcgaggccagcaccacccugcccgagagccaccugaagaccccccagaugccccccaccacccccagcagcagcagcuucaccaagaaggacgagacccaccccggcgcccagagcagccccgccaacuucagaaucaccagccccaccguggcccccccccugagcagcgacaccagcaccaacagacaccccgccgugcccuaa

SEQ ID NO: 22276 - RNA, 1503 nt, Artificial Sequence
  PYROXD1__Homo_sapiens__NP_079130
auggaggccgccagacccccccccaccgccggcaaguucgugguggugggcggcggcaucgccggcgugaccugcgccgagcagcuggccacccacuuccccagcgaggacauccugcuggugaccgccagccccgugaucaaggccgugaccaacuucaagcagaucagcaagauccuggaggaguucgacguggaggagcagagcagcaccaugcugggcaagagauuccccaacaucaaggugaucgagagcggcgugaagcagcugaagagcgaggagcacugcaucgugaccgaggacggcaaccagcacguguacaagaagcugugccugugcgccggcgccaagcccaagcugaucugcgagggcaaccccuacgugcugggcaucagagacaccgacagcgcccaggaguuccagaagcagcugaccaaggccaagagaaucaugaucaucggcaacggcggcaucgcccuggagcugguguacgagaucgagggcugcgaggugaucugggccaucaaggacaaggccaucggcaacaccuucuucgacgccggcgccgccgaguuccugaccagcaagcugaucgccgagaagagcgaggccaagaucgcccacaagagaaccagauacaccaccgagggcagaaagaaggaggccagaagcaagagcaaggccgacaacgugggcagcgcccugggccccgacuggcacgagggccugaaccugaagggcaccaaggaguucagccacaagauccaccuggagaccaugugcgaggugaagaagaucuaccugcaggacgaguucagaauccugaagaagaagagcuucaccuuccccagagaccacaagagcgugaccgccgacaccgagauguggcccguguacguggagcugaccaacgagaagaucuacggcugcgacuucaucgugagcgccaccggcgugacccccaacguggagcccuuccugcacggcaacagcuucgaccugggcgaggacggcggccugaagguggacgaccacaugcacaccagccugcccgacaucuacgccgccggcgacaucugcaccaccagcuggcagcugagccccguguggcagcagaugagacuguggacccaggccagacagaugggcugguacgccgccaagugcauggccgccgccagcagcggcgacagcaucgacauggacuucagcuucgagcuguucgcccacgugaccaaguucuucaacuacaagguggugcugcugggcaaguacaacgcccagggccugggcagcgaccacgagcugaugcugagaugcaccaagggcagagaguacaucaagguggugaugcagaacggcagaaugaugggcgccgugcugaucggcgagaccgaccuggaggagaccuucgagaaccugauccugaaccagaugaaccugagcagcuacggcgaggaccugcuggaccccaacaucgacaucgaggacuacuucgacuaa

SEQ ID NO: 22277 - RNA, 294 nt, Artificial Sequence
  PYY__Homo_sapiens__NP_004151
augguguucgugagaagacccuggcccgcccugaccaccgugcugcuggcccugcuggugugccugggcgcccugguggacgccuaccccaucaagcccgaggcccccggcgaggacgccagccccgaggagcugaacagauacuacgccagccugagacacuaccugaaccuggugaccagacagagauacggcaagagagacggccccgacacccugcugagcaagaccuucuuccccgacggcgaggacagacccgugagaagcagaagcgagggccccgaccugugguaa

SEQ ID NO: 22278 - RNA, 4449 nt, Artificial Sequence
  PZP__Homo_sapiens__NP_002855
augagaaaggacagacugcugcaccugugccuggugcugcugcugauccugcugagcgccagcgacagcaacagcaccgagccccaguacauggugcuggugcccagccugcugcacaccgaggcccccaagaagggcugcgugcugcugagccaccugaacgagaccgugaccgugagcgccagccuggagagcggcagagagaacagaagccuguucaccgaccugguggccgagaaggaccuguuccacugcgugagcuucacccugcccagaaucagcgccagcagcgagguggccuuccugagcauccagaucaagggccccacccaggacuucagaaagagaaacaccgugcuggugcugaacacccagagccugguguucgugcagaccgacaagcccauguacaagcccggccagaccgugagauucagaguggugagcguggacgagaacuucagacccagaaacgagcugaucccccugaucuaccuggagaaccccagaagaaacagaaucgcccaguggcagagccugaagcuggaggccggcaucaaccagcugagcuucccccugagcagcgagcccauccagggcagcuacagagugguggugcagaccgagagcggcggcagaauccagcaccccuucaccguggaggaguucgugcugcccaaguucgaggugaaggugcaggugcccaagaucaucagcaucauggacgagaaggugaacaucaccgugugcggcgaguacaccuacggcaagcccgugcccggccuggccaccgugagccugugcagaaagcugagcagagugcugaacugcgacaagcaggaggugugcgaggaguucagccagcagcugaacagcaacggcugcaucacccagcaggugcacaccaagaugcugcagaucaccaacaccggcuucgagaugaagcugagaguggaggccagaaucagagaggagggcaccgaccuggaggugaccgccaacagaaucagcgagaucaccaacaucgugagcaagcugaaguucgugaagguggacagccacuucagacagggcauccccuucuucgcccaggugcugcugguggacggcaagggcgugcccauccccaacaagcuguucuucaucagcgugaacgacgccaacuacuacagcaacgccaccaccaacgagcagggccuggcccaguucagcaucaacaccaccagcaucagcgugaacaagcuguucgugagaguguucaccgugcaccccaaccugugcuuccacuacagcuggguggccgaggaccaccagggcgcccagcacaccgccaacagaguguucagccugagcggcagcuacauccaccuggagcccguggccggcacccugcccugcggccacaccgagaccaucaccgcccacuacacccugaacagacaggccaugggcgagcugagcgagcugagcuuccacuaccugaucauggccaagggcgugaucgugagaagcggcacccacacccugcccguggagagcggcgacaugaagggcagcuucgcccugagcuuccccguggagagcgacguggcccccaucgccagaauguucaucuucgccauccugcccgacggcgagguggugggcgacagcgagaaguucgagaucgagaacugccuggccaacaagguggaccugagcuucagccccgcccagagcccccccgccagccacgcccaccugcagguggccgccgccccccagagccugugcgcccugagagccguggaccagagcgugcugcugaugaagcccgaggccgagcugagcgugagcagcguguacaaccugcugaccgugaaggaccugaccaacuuccccgacaacguggaccagcaggaggaggagcagggccacugccccagacccuucuucauccacaacggcgccaucuacgugccccugagcagcaacgaggccgacaucuacagcuuccugaagggcaugggccugaagguguucaccaacagcaagaucagaaagcccaagagcugcagcgugauccccagcgugagcgccggcgccgugggccagggcuacuacggcgccggccugggcgugguggagagacccuacgugccccagcugggcaccuacaacgugaucccccugaacaacgagcagagcagcggccccgugcccgagaccgugagaagcuacuuccccgagaccuggaucugggagcugguggccgugaacagcagcggcguggccgaggugggcgugaccgugcccgacaccaucaccgaguggaaggccggcgccuucugccugagcgaggacgccggccugggcaucagcagcaccgccagccugagagccuuccagcccuucuucguggagcugaccaugcccuacagcgugaucagaggcgagguguucacccugaaggccaccgugcugaacuaccugcccaagugcaucagagugagcgugcagcugaaggccagccccgccuuccuggccagccagaacaccaagggcgaggagagcuacugcaucugcggcaacgagagacagacccugagcuggaccgugacccccaagacccugggcaacgugaacuucagcgugagcgccgaggccaugcagagccuggagcugugcggcaacgaggugguggaggugcccgagaucaagagaaaggacaccgugaucaagacccugcugguggaggccgagggcaucgagcaggagaagaccuucagcagcaugaccugcgccagcggcgccaacgugagcgagcagcugagccugaagcugcccagcaacguggugaaggagagcgccagagccagcuucagcgugcugggcgacauccugggcagcgccaugcagaacauccagaaccugcugcagaugcccuacggcugcggcgagcagaacauggugcuguucgcccccaacaucuacgugcugaacuaccugaacgagacccagcagcugacccaggagaucaaggccaaggccgugggcuaccugaucaccggcuaccagagacagcugaacuacaagcaccaggacggcagcuacagcaccuucggcgagagauacggcagaaaccagggcaacaccuggcugaccgccuucgugcugaagaccuucgcccaggccagaagcuacaucuucaucgacgaggcccacaucacccagagccugaccuggcugagccagaugcagaaggacaacggcugcuucagaagcagcggcagccugcugaacaacgccaucaagggcggcguggaggacgaggccacccugagcgccuacgugaccaucgcccugcuggagaucccccugcccgugaccaaccccaucgugagaaacgcccuguucugccuggagagcgccuggaacguggccaaggagggcacccacggcagccacguguacaccaaggcccugcuggccuacgccuucagccugcugggcaagcagaaccagaacagagagauccugaacagccuggacaaggaggccgugaaggaggacaaccuggugcacugggagagaccccagagacccaaggcccccgugggccaccuguaccagacccaggcccccagcgccgagguggagaugaccagcuacgugcugcuggccuaccugaccgcccagcccgcccccaccagcggcgaccugaccagcgccaccaacaucgugaaguggaucaugaagcagcagaacgcccagggcggcuucagcagcacccaggacaccgugguggcccugcacgcccugagcagauacggcgccgccaccuucaccagaaccgagaagaccgcccaggugaccgugcaggacagccagaccuucagcaccaacuuccagguggacaacaacaaccugcugcugcugcagcagaucagccugcccgagcugcccggcgaguacgugaucaccgugaccggcgagagaugcguguaccugcagaccagcaugaaguacaacauccugcccgagaaggaggacagccccuucgcccugaaggugcagaccgugccccagaccugcgacggccacaaggcccacaccagcuuccagaucagccugaccaucagcuacaccggcaacagacccgccagcaacauggugaucguggacgugaagauggugagcggcuucaucccccugaagcccaccgugaagaugcuggagagaagcagcagcgugagcagaaccgaggugagcaacaaccacgugcugaucuacguggagcaggugaccaaccagacccugagcuucagcuucauggugcugcaggacauccccgugggcgaccugaagcccgccaucgugaagguguacgacuacuacgagaccgacgagagcgugguggccgaguacaucgcccccugcagcaccgacaccgagcacggcaacguguaa

SEQ ID NO: 22279 - RNA, 2295 nt, Artificial Sequence
  QARS__Homo_sapiens__NP_001259002
auggccgcccuggacagccugagccuguucaccagccugggccugagcgagcagaaggccagagagacccugaagaacagcgcccugagcgcccagcugagagaggccgccacccaggcccagcagacccugggcagcaccaucgacaaggccaccggcauccugcuguacggccuggccagcagacugagagacaccagaagacugagcuuccuggugagcuacaucgccaccgcccuggaguacgugagaagccacccccuggaccccaucgacaccguggacuucgagagagagugcggcgugggcgugaucgugacccccgagcagaucgaggaggccguggaggccgccaucaacagacacagaccccagcugcugguggagagauaccacuucaacaugggccugcugaugggcgaggccagagccgugcugaagugggccgacggcaagaugaucaagaacgagguggacaugcaggugcugcaccugcugggccccaagcuggaggccgaccuggagaagaaguucaagguggccaaggccagacuggaggagaccgacagaagaaccgccaaggacgugguggagaacggcgagaccgccgaccagacccugagccugauggagcagcugagaggcgaggcccugaaguuccacaagcccggcgagaacuacaagacccccggcuacguggugaccccccacaccaugaaccugcugaagcagcaccuggagaucaccggcggccaggugagaaccagauucccccccgagcccaacggcauccugcacaucggccacgccaaggccaucaacuucaacuucggcuacgccaaggccaacaacggcaucugcuuccugagauucgacgacaccaaccccgagaaggaggaggccaaguucuucaccgccaucugcgacaugguggccuggcugggcuacacccccuacaaggugaccuacgccagcgacuacuucgaccagcuguacgccugggccguggagcugaucagaagaggccuggccuacgugugccaccagagaggcgaggagcugaagggccacaacacccugcccagccccuggagagacagacccauggaggagagccugcugcuguucgaggccaugagaaagggcaaguucagcgagggcgaggccacccugagaaugaagcuggugauggaggacggcaagauggaccccguggccuacagagugaaguacaccccccaccacagaaccggcgacaaguggugcaucuaccccaccuacgacuacacccacugccugugcgacagcaucgagcacaucacccacagccugugcaccaaggaguuccaggccagaagaagcagcuacuucuggcugugcaacgcccuggacguguacugccccgugcagugggaguacggcagacugaaccugcacuacgccguggugagcaagagaaagauccugcagcugguggccaccggcgccgugagagacugggacgaccccagacuguucacccugaccgcccugagaagaagaggcuucccccccgaggccaucaacaacuucugcgccagagugggcgugaccguggcccagaccaccauggagccccaccugcuggaggccugcgugagagacgugcugaacgacaccgcccccagagccauggccgugcuggagagccugagagugaucaucaccaacuuccccgccgccaagagccuggacauccaggugcccaacuuccccgccgacgagaccaagggcuuccaccaggugcccuucgcccccaucguguucaucgagagaaccgacuucaaggaggagcccgagcccggcuucaagagacuggccuggggccagcccgugggccugagacacaccggcuacgugaucgagcugcagcacguggugaagggccccagcggcugcguggagagccuggaggugaccugcagaagagccgacgccggcgagaagcccaaggccuucauccacugggugagccagccccugaugugcgaggugagacuguacgagagacuguuccagcacaagaaccccgaggaccccaccgaggugcccggcggcuuccugagcgaccugaaccuggccagccugcacgugguggacgccgcccugguggacugcagcguggcccuggccaagcccuucgacaaguuccaguucgagagacugggcuacuucagcguggaccccgacagccaccagggcaagcugguguucaacagaaccgugacccugaaggaggaccccggcaagguguaa

SEQ ID NO: 22280 - RNA, 735 nt, Artificial Sequence
  QDPR__Homo_sapiens__NP_000311
auggccgccgccgccgccgccggcgaggccagaagagugcugguguacggcggcagaggcgcccugggcagcagaugcgugcaggccuucagagccagaaacugguggguggccagcguggacgugguggagaacgaggaggccagcgccagcaucaucgugaagaugaccgacagcuucaccgagcaggccgaccaggugaccgccgaggugggcaagcugcugggcgaggagaagguggacgccauccugugcguggccggcggcugggccggcggcaacgccaagagcaagagccuguucaagaacugcgaccugauguggaagcagagcaucuggaccagcaccaucagcagccaccuggccaccaagcaccugaaggagggcggccugcugacccuggccggcgccaaggccgcccuggacggcacccccggcaugaucggcuacggcauggccaagggcgccgugcaccagcugugccagagccuggccggcaagaacagcggcaugccccccggcgccgccgccaucgccgugcugcccgugacccuggacacccccaugaacagaaagagcaugcccgaggccgacuucagcagcuggaccccccuggaguuccugguggagaccuuccacgacuggaucaccggcaagaacagacccagcagcggcagccugauccagguggugaccaccgagggcagaaccgagcugacccccgccuacuucuaa

SEQ ID NO: 22281 - RNA, 1002 nt, Artificial Sequence
  QKI__Homo_sapiens__NP_001288014
auggugggcgagauggagaccaaggagaagcccaagcccacccccgacuaccugaugcagcugaugaacgacaagaagcugaugagcagccugcccaacuucugcggcaucuucaaccaccuggagagacugcuggacgaggagaucagcagagugagaaaggacauguacaacgacacccugaacggcagcaccgagaagagaagcgccgagcugcccgacgccgugggccccaucgugcagcugcaggagaagcuguacgugcccgugaaggaguaccccgacuucaacuucgugggcagaauccugggccccagaggccugaccgccaagcagcuggaggccgagaccggcugcaagaucauggugagaggcaagggcagcaugagagacaagaagaaggaggagcagaacagaggcaagcccaacugggagcaccugaacgaggaccugcacgugcugaucaccguggaggacgcccagaacagagccgagaucaagcugaagagagccguggaggaggugaagaagcugcuggugcccgccgccgagggcgaggacagccugaagaagaugcagcugauggagcuggccauccugaacggcaccuacagagacgccaacaucaagagccccaccgcccaggccgcccccagaaucaucaccggccccgcccccgugcugccccccgccgcccugagaacccccacccccgccggccccaccaucaugccccugaucagacagauccagaccgccgugaugcccaacggcaccccccaccccaccgccgccaucgugccccccggccccgaggccggccugaucuacacccccuacgaguaccccuacacccuggcccccgccaccagcauccuggaguaccccaucgagcccagcggcgugcugggcgccguggccaccaaggugagaagacacgacaugagagugcaccccuaccagagaaucgugaccgccgacagagccgccaccggcaacuaa

SEQ ID NO: 22282 - RNA, 1086 nt, Artificial Sequence
  QPCT__Homo_sapiens__NP_036545
auggccggcggcagacacagaagaguggugggcacccugcaccugcugcugcugguggccgcccugcccugggccagcagaggcgugagccccagcgccagcgccuggcccgaggagaagaacuaccaccagcccgccauccugaacagcagcgcccugagacagaucgccgagggcaccagcaucagcgagauguggcagaacgaccugcagccccugcugaucgagagauaccccggcagccccggcagcuacgccgccagacagcacaucaugcagagaauccagagacugcaggccgacugggugcuggagaucgacaccuuccugagccagacccccuacggcuacagaagcuucagcaacaucaucagcacccugaaccccaccgccaagagacaccuggugcuggccugccacuacgacagcaaguacuucagccacuggaacaacagaguguucgugggcgccaccgacagcgccgugcccugcgccaugaugcuggagcuggccagagcccuggacaagaagcugcugagccugaagaccgugagcgacagcaagcccgaccugagccugcagcugaucuucuucgacggcgaggaggccuuccugcacuggagcccccaggacagccuguacggcagcagacaccuggccgccaagauggccagcaccccccacccccccggcgccagaggcaccagccagcugcacggcauggaccugcuggugcugcuggaccugaucggcgcccccaaccccaccuuccccaacuucuuccccaacagcgccagaugguucgagagacugcaggccaucgagcacgagcugcacgagcugggccugcugaaggaccacagccuggagggcagauacuuccagaacuacagcuacggcggcgugauccaggacgaccacauccccuuccugagaagaggcgugcccgugcugcaccugauccccagccccuuccccgagguguggcacaccauggacgacaacgaggagaaccuggacgagagcaccaucgacaaccugaacaagauccugcagguguucgugcuggaguaccugcaccuguaa

SEQ ID NO: 22283 - RNA, 867 nt, Artificial Sequence
  QPCTL__Homo_sapiens__NP_001156849
augagaagcggcggcagaggcagacccagacugagacugggcgagagaggccugauggagccccugcugccccccaagagaagacugcugcccagagugagacugcugccccugcugcuggcccuggccgugggcagcgccuucuacaccaucuggagcggcuggcacagaagaaccgaggagcugccccugggcagagagcugagagugccccugaucggcagccugcccgaggccagacugagaagaguggugggccagcuggacccccagagacuguggagcaccuaccugagaccccugcugguggugagaacccccggcagccccggcaaccugcaggugagaaaggccgcccccgugacccugcagcugcuguuccuggacggcgaggaggcccugaaggaguggggccccaaggacagccuguacggcagcagacaccuggcccagcugauggagagcaucccccacagccccggccccaccagaauccaggccaucgagcuguucaugcugcuggaccugcugggcgcccccaaccccaccuucuacagccacuuccccagaaccgugagaugguuccacagacugagaagcaucgagaagagacugcacagacugaaccugcugcagagccacccccaggaggugauguacuuccagcccggcgagcccuucggcagcguggaggacgaccacauccccuuccugagaagaggcgugcccgugcugcaccugaucagcacccccuuccccgccguguggcacacccccgccgacaccgaggugaaccugcacccccccaccgugcacaaccugugcagaauccuggccguguuccuggccgaguaccugggccuguaa

SEQ ID NO: 22284 - RNA, 894 nt, Artificial Sequence
  QPRT__Homo_sapiens__NP_055113
auggacgccgagggccuggcccugcugcugccccccgugacccuggccgcccugguggacagcuggcugagagaggacugccccggccugaacuacgccgcccuggugagcggcgccggccccagccaggccgcccugugggccaagagccccggcgugcuggccggccagcccuucuucgacgccaucuucacccagcugaacugccaggugagcugguuccugcccgagggcagcaagcuggugcccguggccagaguggccgaggugagaggccccgcccacugccugcugcugggcgagagaguggcccugaacacccuggccagaugcagcggcaucgccagcgccgccgccgccgccguggaggccgccagaggcgccggcuggaccggccacguggccggcaccagaaagaccacccccggcuucagacugguggagaaguacggccugcuggugggcggcgccgccagccacagauacgaccugggcggccuggugauggugaaggacaaccacgugguggccgccggcggcguggagaaggccgugagagccgccagacaggccgccgacuucgcccugaagguggagguggagugcagcagccugcaggaggccgugcaggccgccgaggccggcgccgaccuggugcugcuggacaacuucaagcccgaggagcugcaccccaccgccaccgugcugaaggcccaguuccccagcguggccguggaggccagcggcggcaucacccuggacaaccugccccaguucugcggcccccacaucgacgugaucagcaugggcaugcugacccaggccgcccccgcccuggacuucagccugaagcuguucgccaaggagguggcccccgugcccaagauccacuaa

SEQ ID NO: 22285 - RNA, 411 nt, Artificial Sequence
  QRFP__Homo_sapiens__NP_937823
auggugagacccuacccccugaucuacuuccuguuccugccccugggcgccugcuucccccugcuggacagaagagagcccaccgacgccaugggcggccugggcgccggcgagagaugggccgaccuggccaugggccccagaccccacagcguguggggcagcagcagauggcugagagccagccagccccaggcccugcuggugaucgccagaggccugcagaccagcggcagagagcacgccggcugcagauucagauucggcagacaggacgagggcagcgaggccaccggcuuccugcccgccgccggcgagaagaccagcggcccccugggcaaccuggccgaggagcugaacggcuacagcagaaagaagggcggcuucagcuucagauucggcagaagauaa

SEQ ID NO: 22286 - RNA, 1296 nt, Artificial Sequence
  QRFPR__Homo_sapiens__NP_937822
augcaggcccugaacaucacccccgagcaguucagcagacugcugagagaccacaaccugaccagagagcaguucaucgcccuguacagacugagaccccugguguacacccccgagcugcccggcagagccaagcuggcccuggugcugaccggcgugcugaucuucgcccuggcccuguucggcaacgcccugguguucuacguggugaccagaagcaaggccaugagaaccgugaccaacaucuucaucugcagccuggcccugagcgaccugcugaucaccuucuucugcauccccgugaccaugcugcagaacaucagcgacaacuggcugggcggcgccuucaucugcaagauggugcccuucgugcagagcaccgccguggugaccgagauccugaccaugaccugcaucgccguggagagacaccagggccuggugcaccccuucaagaugaaguggcaguacaccaacagaagagccuucaccaugcugggcgugguguggcugguggccgugaucgugggcagccccauguggcacgugcagcagcuggagaucaaguacgacuuccuguacgagaaggagcacaucugcugccuggaggaguggaccagccccgugcaccagaagaucuacaccaccuucauccuggugauccuguuccugcugccccugauggugaugcugauccuguacagcaagaucggcuacgagcuguggaucaagaagagagugggcgacggcagcgugcugagaaccauccacggcaaggagaugagcaagaucgccagaaagaagaagagagccgugaucaugauggugaccgugguggcccuguucgccgugugcugggcccccuuccacguggugcacaugaugaucgaguacagcaacuucgagaaggaguacgacgacgugaccaucaagaugaucuucgccaucgugcagaucaucggcuucagcaacagcaucugcaaccccaucguguacgccuucaugaacgagaacuucaagaagaacgugcugagcgccgugugcuacugcaucgugaacaagaccuucagccccgcccagagacacggcaacagcggcaucaccaugaugagaaagaaggccaaguucagccugagagagaaccccguggaggagaccaagggcgaggccuucagcgacggcaacaucgaggugaagcugugcgagcagaccgaggagaagaagaagcugaagagacaccuggcccuguucagaagcgagcuggccgagaacagcccccuggacagcggccacuaa

SEQ ID NO: 22287 - RNA, 1587 nt, Artificial Sequence
  QRSL1__Homo_sapiens__NP_060762
augcugggcagaagccugagagaggugagcgccgcccugaagcagggccagaucacccccaccgagcugugccagaagugccugagccugaucaagaagaccaaguuccugaacgccuacaucaccgugagcgaggagguggcccugaagcaggccgaggagagcgagaagagauacaagaacggccagagccugggcgaccuggacggcauccccaucgccgugaaggacaacuucagcaccagcggcaucgagaccaccugcgccagcaacaugcugaagggcuacaucccccccuacaacgccaccguggugcagaagcugcuggaccagggcgcccugcugaugggcaagaccaaccuggacgaguucgccaugggcagcggcagcaccgacggcguguucggccccgugaagaaccccuggagcuacagcaagcaguacagagagaagagaaagcagaacccccacagcgagaacgaggacagcgacuggcugaucaccggcggcagcagcggcggcagcgccgccgccgugagcgccuucaccugcuacgccgcccugggcagcgacaccggcggcagcaccagaaaccccgccgcccacugcggccuggugggcuucaagcccagcuacggccuggugagcagacacggccugaucccccuggugaacagcauggacgugcccggcauccugaccagaugcguggacgacgccgccaucgugcugggcgcccuggccggccccgaccccagagacagcaccaccgugcacgagcccaucaacaagcccuucaugcugcccagccuggccgacgugagcaagcugugcaucggcauccccaaggaguaccuggugcccgagcugagcagcgaggugcagagccuguggagcaaggccgccgaccuguucgagagcgagggcgccaaggugaucgaggugagccugccccacaccagcuacagcaucgugugcuaccacgugcugugcaccagcgagguggccagcaacauggccagauucgacggccugcaguacggccacagaugcgacaucgacgugagcaccgaggccauguacgccgccaccagaagagagggcuucaacgacguggugagaggcagaauccugagcggcaacuucuuccugcugaaggagaacuacgagaacuacuucgugaaggcccagaaggugagaagacugaucgccaacgacuucgugaacgccuucaacagcggcguggacgugcugcugacccccaccacccugagcgaggccgugcccuaccuggaguucaucaaggaggacaacagaaccagaagcgcccaggacgacaucuucacccaggccgugaacauggccggccugcccgccgugagcauccccguggcccugagcaaccagggccugcccaucggccugcaguucaucggcagagccuucugcgaccagcagcugcugaccguggccaagugguucgagaagcaggugcaguuccccgugauccagcugcaggagcugauggacgacugcagcgccgugcuggagaacgagaagcuggccagcgugagccugaagcaguaa

SEQ ID NO: 22288 - RNA, 1815 nt, Artificial Sequence
  QSOX1__Homo_sapiens__NP_001004128
augagaagaugcaacagcggcagcggccccccccccagccugcugcugcugcugcuguggcugcuggccgugcccggcgccaacgccgcccccagaagcgcccuguacagccccagcgacccccugacccugcugcaggccgacaccgugagaggcgccgugcugggcagcagaagcgccugggccguggaguucuucgccagcuggugcggccacugcaucgccuucgcccccaccuggaaggcccuggccgaggacgugaaggccuggagacccgcccuguaccuggccgcccuggacugcgccgaggagaccaacagcgccgugugcagagacuucaacauccccggcuuccccaccgugagauucuucaaggccuucaccaagaacggcagcggcgccguguuccccguggccggcgccgacgugcagacccugagagagagacugaucgacgcccuggagagccaccacgacaccuggccccccgccugccccccccuggagcccgccaagcuggaggagaucgacggcuucuucgccagaaacaacgaggaguaccuggcccugaucuucgagaagggcggcagcuaccugggcagagagguggcccuggaccugagccagcacaagggcguggccgugagaagagugcugaacaccgaggccaacguggugagaaaguucggcgugaccgacuuccccagcugcuaccugcuguucagaaacggcagcgugagcagagugcccgugcugauggagagcagaagcuucuacaccgccuaccugcagagacugagcggccugaccagagaggccgcccagaccaccguggcccccaccaccgccaacaagaucgcccccaccguguggaagcuggccgacagaagcaagaucuacauggccgaccuggagagcgcccugcacuacauccugagaaucgaggugggcagauuccccgugcuggagggccagagacugguggcccugaagaaguucguggccgugcuggccaaguacuuccccggcagaccccuggugcagaacuuccugcacagcgugaacgaguggcugaagagacagaagagaaacaagauccccuacagcuucuucaagaccgcccuggacgacagaaaggagggcgccgugcuggccaagaaggugaacuggaucggcugccagggcagcgagccccacuucagaggcuuccccugcagccugugggugcuguuccacuuccugaccgugcaggccgccagacagaacguggaccacagccaggaggccgccaaggccaaggaggugcugcccgccaucagaggcuacgugcacuacuucuucggcugcagagacugcgccagccacuucgagcagauggccgccgccagcaugcacagagugggcagccccaacgccgccgugcuguggcuguggagcagccacaacagagugaacgccagacuggccggcgcccccagcgaggacccccaguuccccaaggugcaguggccccccagagagcugugcagcgccugccacaacgagagacuggacgugcccgugugggacguggaggccacccugaacuuccugaaggcccacuucagccccagcaacaucauccuggacuuccccgccgccggcagcgccgccagaagagacgugcagaacguggccgccgcccccgagcuggccaugggcgcccuggagcuggagagcagaaacagcacccuggaccccggcaagcccgagaugaugaagagccccaccaacaccaccccccacgugcccgccgagggccccgagcugaucuaa

SEQ ID NO: 22289 - RNA, 2097 nt, Artificial Sequence
  QSOX2__Homo_sapiens__NP_859052
auggccgccgccggcgccgccguggccagaagccccggcaucggcgccggccccgcccugagagccagaagaagccccccccccagagccgccagacugcccagacugcuggugcugcuggccgccgccgccgugggccccggcgccggcggcgccgccagacuguacagagccggcgaggacgccgugugggugcuggacagcggcagcgugagaggcgccaccgccaacagcagcgccgccuggcuggugcaguucuacagcagcuggugcggccacugcaucggcuacgcccccaccuggagagcccuggccggcgacgugagagacugggccagcgccaucagaguggccgcccuggacugcauggaggagaagaaccaggccgugugccacgacuacgacauccacuucuaccccaccuucagauacuucaaggccuucaccaaggaguucaccaccggcgagaacuucaagggccccgacagagagcugagaaccgugagacagaccaugaucgacuuccugcagaaccacaccgagggcagcagaccccccgccugccccagacuggaccccauccagcccagcgacgugcugagccugcuggacaacagaggcagccacuacguggccaucguguucgagagcaacagcagcuaccugggcagagaggugauccuggaccugauccccuacgagagcaucguggugaccagagcccuggacggcgacaaggccuuccuggagaagcugggcgugagcagcgugcccagcugcuaccugaucuaccccaacggcagccacggccugaucaacguggugaagccccugagagccuucuucagcagcuaccugaagagccugcccgacgugagaaagaagagccugccccugcccgagaagccccacaaggaggagaacagcgagaucgugguguggagagaguucgacaagagcaagcuguacaccguggaccuggagagcggccugcacuaccugcugagaguggagcuggccgcccacaagagccuggccggcgccgagcugaagacccugaaggacuucgugaccgugcuggccaagcuguuccccggcagaccccccgugaagaagcugcuggagaugcugcaggaguggcuggccagccugccccuggacagaauccccuacaacgccgugcuggaccuggugaacaacaagaugagaaucagcggcaucuuccugaccaaccacaucaagugggugggcugccagggcagcagaagcgagcugagaggcuaccccugcagccuguggaagcuguuccacacccugaccguggaggccagcacccaccccgacgcccuggugggcaccggcuucgaggacgacccccaggccgugcugcagaccaugagaagauacgugcacaccuucuucggcugcaaggagugcggcgagcacuucgaggagauggccaaggagagcauggacagcgugaagacccccgaccaggccauccuguggcuguggaagaagcacaacauggugaacggcagacuggccggccaccugagcgaggaccccagauuccccaagcugcaguggcccacccccgaccugugccccgccugccacgaggagaucaagggccuggccagcugggacgagggccacgugcugaccuuccugaagcagcacuacggcagagacaaccugcuggacaccuacagcgccgaccagggcgacagcagcgagggcggcacccuggccagaggcgaggaggaggagaagagacugaccccccccgaggugagccacggcgacagagacacccagagcgugagaccccccggcgcccugggccccagacccgcccugcccgagagccugcaccacagccuggacggcaagcugcagagccuggacggccccggcgcccacaaggaggugggcggcgccgcccccuuccugggcguggacuucagcagccuggacaugagccugugcguggugcuguacguggccagcagccuguuccugauggugauguacuucuucuucagagugagaagcagaagauggaaggugaagcaccaccaccccgccguguaa

SEQ ID NO: 22290 - RNA, 1212 nt, Artificial Sequence
  QTRT1__Homo_sapiens__NP_112486
auggccggcgccgccacccaggccagccuggagagcgcccccagaaucaugagacugguggccgagugcagcagaagcagagccagagccggcgagcuguggcugccccacggcaccguggccacccccguguucaugcccgugggcacccaggccaccaugaagggcaucaccaccgagcagcuggacgcccugggcugcagaaucugccugggcaacaccuaccaccugggccugagacccggccccgagcugauccagaaggccaacggccugcacggcuucaugaacuggccccacaaccugcugaccgacagcggcggcuuccagauggugagccuggugagccugagcgaggugaccgaggagggcgugagauucagaagccccuacgacggcaacgagacccugcugagccccgagaagagcgugcagauccagaacgcccugggcagcgacaucaucaugcagcuggacgacguggugagcagcaccgugaccggccccagaguggaggaggccauguacagaagcaucagauggcuggacagaugcaucgccgcccaccagagacccgacaagcagaaccuguucgccaucauccagggcggccuggacgccgaccugagagccaccugccuggaggagaugaccaagagagacgugcccggcuucgccaucggcggccugagcggcggcgagagcaagagccaguucuggagaaugguggcccugagcaccagcagacugcccaaggacaagcccagauaccugaugggcgugggcuacgccaccgaccugguggugugcguggcccugggcugcgacauguucgacugcguguuccccaccagaaccgccagauucggcagcgcccuggugcccaccggcaaccugcagcugagaaagaagguguucgagaaggacuucggccccaucgaccccgagugcaccugccccaccugccagaagcacagcagagccuuccugcacgcccugcugcacagcgacaacaccgccgcccugcaccaccugaccgugcacaacaucgccuaccagcugcagcugaugagcgccgugagaaccagcaucguggagaagagauuccccgacuucgugagagacuucaugggcgccauguacggcgaccccacccugugccccaccugggccaccgacgcccuggccagcgugggcaucacccugggcuaa

SEQ ID NO: 22291 - RNA, 1323 nt, Artificial Sequence
  R3HCC1__Homo_sapiens__NP_001129580
auggcccugcugugccuggacggcguguuccugagcagcgccgagaacgacuucgugcacagaauccaggaggagcuggacagauuccugcugcagaagcagcugagcaaggugcugcuguuccccccccugagcagcagacugagauaccugauccacagaaccgccgagaacuucgaccugcugagcagcuucagcgugggcgagggcuggaagagaagaaccgugaucugccaccaggacaucagagugcccagcagcgacggccugagcggccccugcagagcccccgccagcugccccagcagauaccacggccccagacccaucagcaaccagggcgccgccgccgugcccagaggcgccagagccggcagaugguacagaggcagaaagcccgaccagccccuguacgugcccagagugcugagaagacaggaggaguggggccugaccagcaccagcgugcugaagagagaggcccccgccggcagagaccccgaggagcccggcgacgugggcgccggcgaccccaacagcgaccagggccugcccgugcugaugacccagggcaccgaggaccugaagggccccggccagagaugcgagaacgagccccugcuggaccccgugggccccgagccccugggccccgagagccagagcggcaagggcgacaugguggagauggccaccagauucggcagcacccugcagcuggaccuggagaagggcaaggagagccugcuggagaagagacugguggccgaggaggaggaggacgaggaggagguggaggaggacggccccagcagcugcagcgaggacgacuacagcgagcugcugcaggagaucaccgacaaccugaccaagaaggagauccagaucgagaagauccaccuggacaccagcagcuucguggaggagcugcccggcgagaaggaccuggcccacgugguggagaucuacgacuucgagcccgcccugaagaccgaggaccugcuggccaccuucagcgaguuccaggagaagggcuucagaauccaguggguggacgacacccacgcccugggcaucuuccccugccuggccagcgccgccgaggcccugaccagagaguucagcgugcugaagaucagaccccugacccagggcaccaagcagagcaagcugaaggcccugcagagacccaagcugcugagacuggugaaggagagaccccagaccaacgccaccguggccagaagacugguggccagagcccugggccugcagcacaagaagaaggagagacccgccgugagaggcccccugccccccuaa

SEQ ID NO: 22292 - RNA, 2379 nt, Artificial Sequence
  R3HCC1L__Homo_sapiens__NP_001243548
augcagcaggagagcgagagaugcagagugagagccagaagacccgacauggcccuguacgugcccaaggccagaagaggcgccgugcugcugaagaccggcgacgaggaggagagcugcggcagccccaacagcguggugaaggagaagcagaaggagagcagccugagccagaaggagguguucaaggacaagcccgaggccagaagacugaacaucaaccccgacagaaaggagcacaacugcagagaggagaagaagagcagcaccaagcugagaauggacaccugccugcagaagaccaacagagugugcagcaagagaggcaccaccgagagcaaggaggugcugagccagggccagcagcagggcgcccccaacgccggcgugaucaccaacgccccccugcagagacacuucaagcccaagaagguggagugccuggagguggagaccaccgacgugaccggccacgagagaauccugcugagccaggccugccuggagaucagcgaggcccaggugcccagcaagcccuuccagaacguggaguucugcgacuucagcagacacgagcccgacggcgaggccuucgaggacaaggaccuggagggcagaaucgagaccgacaccaaggugcuggagauccuguacgaguuccccagaguguucagcagcgugaugaagcccgagaacaugaucgugcccaucaagcugagcagcgacagcgagaucgugcagcagagcaugcagaccagcgacggcauccugaaccccagcagcggcggcaucaccaccaccagcgugcccggcagccccgacggcguguucgaccagaccugcguggacuucgagguggagagcgugggcggcaucgccaacagcaccggcuucauccuggaccagaaggacaccgacagcauccccgccaccaugggccacaucagccugagcgagagcaccaacgacaccgugagccccgugaugaucagagagugcgagaagaacgacagcaccgccgacgagcugcacgugaagcacgagccccccgacaccgccgugcuggcccacgagacccacagagacagcggcuucaagaacgugggcgacaucaccaacaaggccugcaugauggacaccaccggcaugagcugcagcgaccacgugaccguggacagccccuacgugguggccgugagaaucgccgacgagaccagcaucaacaccagaagcuucagcaaguucgugggcaugagcgccgacgccaccccccugcacguggccagaagcggcaacgacaccgaggacuucagcaaccccagcgccugcagcgacaucuacggcgagagcaucagcagccacuucaccgagagcaccggcaagcugaucgagagccugagcgacugcgccagcagccugcccaucaagaagaucgccggcagcaacuacaacaccuuccuggacagcgagcugagcaugcugaacggcaccaaggugcugagcgacagcgccgugggcaucgaccugggcagcaccggcgacaccaccgaggcccugcacgagcugagaaccgccgaggaguucaagaccgaggagcaggacgacagcggcagcaucgaguucggcgugagcuuccccgacagagagagcagcagcauggagaccagcaucgagcccaaggccaccgagaccagccacaccgagggcaucaccgccaucgaggagagcugggagagcauguucaacgacgacggcgacugccuggaccccagacugcugcaggagggcauccugaugcacaucaagcccgagaaccacugcagcaagcugagcggcaacaccaagagcagagagagcauccaggagcccagaagcgacuacuacaaccacgaggugcccgacaucgaccugagcgacugcgaguucccccacgugaucgagaucuacgacuucccccaggaguucagaaccgaggaccugcugagaguguucugcagcuaccagaagaagggcuucgacaucaaguggguggacgacacccacgcccugggcguguucagcagccccaucaccgccagagacgcccugggcaucaagcacaccauggugaagaucagaccccugagccaggccaccagagccgccaaggccaaggccagagccuacgccgaguuccugcagcccgccaaggagagacccgagaccagcgccgcccuggccagaagacuggugaucagcgcccugggcgugagaagcaagcagagcaagaccgagagagaggccgagcugaagaagcugcaggaggccagagagagaaagagacuggaggccaagcagagagaggacaucugggagggcagagaccagagcaccguguaa

SEQ ID NO: 22293 - RNA, 2916 nt, Artificial Sequence
  R3HDM1__Homo_sapiens__NP_001269728
augagaaugagcgacaccgugaccgugaaggacgagaccgccaccaugaaggaccuggaggccgaggugaaggacaccaccagaguggagaaccugaucaagagcgagaacuacggcaagauccugguggagaagaacgagcacugcaucgagaacaacaucgaccugcaggagaagauccagauccagcugacccagagcuucgagaaggaggagaagcccagcaaggacgaggccgagaaggagaaggccagcgacaagcugcccagaaagaugcugagcagagacagcagccaggaguacaccgacagcaccggcaucgaccugcacgaguuccuggugaacacccugaagaacaaccccagagacagaaugaugcugcugaagcuggagcaggagauccuggacuucaucggcaacaacgagagccccagaaagaaguucccccccaugaccagcuaccacagaaugcugcugcacagaguggccgccuacuucggccuggaccacaacguggaccagagcggcaagagcgugaucgugaacaagaccagcaacaccagaauccccgaccagaaguucaacgagcacaucaaggacgacaagggcgaggacuuccagaagagauacauccugaagagagacaacagcagcuucgacaaggacgacaaccagaugagaaucagacugaaggacgacagaagaagcaagagcaucgaggagagagaggaggaguaccagagagccagagacagaaucuucagccaggacagccugugcagccaggagaacuacaucaucgacaagagacugcaggacgaggacgccagcagcacccagcagagaagacagaucuucagagugaacaaggacgccagcggcagaagcaccaacagccaccagagcagcaccgagaacgagcugaaguacagcgagcccagacccuggagcagcaccgacagcgacagcagccugagaaaccugaagcccgccgugaccaaggccagcagcuucagcggcaucagcgugcugaccagaggcgacagcagcggcagcagcaagagcaucggcagacugagcaagaccggccagcccuucaucaaccccgacggcagccccgugguguacaacccccccaugacccagcagcccgugagaagccaggugcccggccccccccagcccccccugcccgcccccccccagcagcccgccgccaaccacaucuucagccagcaggacaaccugggcagccaguucagccacaugagccuggccagacagcccagcgccgacggcagcgacccccacgccgccauguuccagagcaccguggugcugcagagcccccagcagagcggcuacaucaugaccgccgccccccccccccacccccccccccccccccccccccccccccccccccccccccugccccccggccagcccgugcccaccgccggcuaccccgccagcggccaccccgugagccagcccgugcugcagcagcagggcuacauccagcagcccagcccccagaugcccgccugcuacugcgcccccggccacuaccacagcagccagccccaguacagacccgugcccagcgugcacuacaacagccaccugaaccagccccugccccagcccgcccagcagaccggcuaccaggugauccccaaccagcagcagaacuaccagggcaucgugggcgugcagcagccccagagccagagccuggugagcggccagcccaacagcaucggcaaccagauccagggcguggugauccccuacaccagcgugcccaccuaccaggugagccugccccagggcagccagggcaucccccaccagaccuaccagcagcccgugauguuccccaaccagagcaaccagggcagcaugcccaccaccggcaugcccguguacuacagcgugaucccccccggccagcagaacaaccugagcagcagcgugggcuaccugcagcaccccggcagcgagcaggugcaguuccccagaaccaccagccccugcagcagccagcagcugcagggccaccagugcaccgccggccccccccccccccccggcggcggcauggugaugaugcagcugagcgugcccaacaacccccagagcugcgcccacagccccccccaguggaagcagaacaaguacuacugcgaccaccagagaggccagaagugcguggaguucagcagcguggacaacaucgugcagcacagcccccagcugagcagccccaucaucagccccgcccagagccccgcccccgcccagcugagcacccugaagaccgugagacccagcggccccccccugagcaucaugccccaguucagcagacccuucgugcccggccagggcgacagcagauacccccugcugggccagccccugcaguacaacccccccgccgugcugcacggccacauccccaaccagcagggccagcccggcagcagacacggcaacagaggcagaagacaggccaagaaggccgccagcaccgaccugggcgccggcgagaccguggugggcaaggugcuggagaucaccgagcugcccgacggcaucaccagaauggaggccgagaagcuguucggcgagcuguucaagaucggcgccaagaucagauggcugagagacccccagagccagcccagaagacacccccugugcugcggcagcggcgacaacaccgccaaccccgagagaagcaagcccagcgaccuggccagcaccuacaccgugcuggccaccuuccccagcaucagcgccgcccagaacgcccugaagaagcagaucaacagcgugaacaaguucaagcugagaaccagcaagaagcacuacgacuuccacauccuggagagagccagcagccaguaa

SEQ ID NO: 22294 - RNA, 762 nt, Artificial Sequence
  R3HDML__Homo_sapiens__NP_848586
augccccugcugcccagcaccgugggccuggccggccugcuguucugggccggccaggccgugaacgcccugaucaugcccaacgccacccccgcccccgcccagcccgagagcaccgccaugagacugcugagcggccuggaggugcccagauacagaagaaagagacacaucagcgugagagacaugaacgcccugcuggacuaccacaaccacaucagagccagcguguacccccccgccgccaacauggaguacauggugugggacaagagacuggccagagccgccgaggccugggccacccagugcaucugggcccacggccccagccagcugaugagauacgugggccagaaccugagcauccacagcggccaguacagaagcgugguggaccugaugaagagcuggagcgaggagaaguggcacuaccuguuccccgcccccagagacugcaacccccacugccccuggagaugcgacggccccaccugcagccacuacacccagauggugugggccagcagcaacagacugggcugcgccauccacaccugcagcagcaucagcguguggggcaacaccuggcacagagccgccuaccuggugugcaacuacgccaucaagggcaacuggaucggcgagagccccuacaagaugggcaagcccugcagcagcugcccccccagcuaccagggcagcugcaacagcaacaugugcuucaagggccugaagagcaacaaguucaccugguucuaa

SEQ ID NO: 22295 - RNA, 468 nt, Artificial Sequence
  RAB11A__Homo_sapiens__NP_001193765
augggcaccagagacgacgaguacgacuaccuguucaagguggugcugaucggcgacagcggcgugggcaagagcaaccugcugagcagauucaccagaaacgaguucaaccuggagagcaagagcaccaucggcguggaguucgccaccagaagcauccagguggacggcaagaccaucaaggcccagaucugggacaccgccggccaggagagauacagagccaucaccagcgccuacuacagaggcgccgugggcgcccugcugguguacgacaucgccaagcaccugaccuacgagaacguggagagauggcugaaggagcugagagaccacgccgacagcaacaucgugaucaugcuggugggcaacaagagcgaccugagacaccugagagccgugcccaccgacgaggccagagccuucgccgagaagaacgaggccaacgugagacagaccagaaaguaa

SEQ ID NO: 22296 - RNA, 657 nt, Artificial Sequence
  RAB11B__Homo_sapiens__NP_004209
augggcaccagagacgacgaguacgacuaccuguucaagguggugcugaucggcgacagcggcgugggcaagagcaaccugcugagcagauucaccagaaacgaguucaaccuggagagcaagagcaccaucggcguggaguucgccaccagaagcauccagguggacggcaagaccaucaaggcccagaucugggacaccgccggccaggagagauacagagccaucaccagcgccuacuacagaggcgccgugggcgcccugcugguguacgacaucgccaagcaccugaccuacgagaacguggagagauggcugaaggagcugagagaccacgccgacagcaacaucgugaucaugcuggugggcaacaagagcgaccugagacaccugagagccgugcccaccgacgaggccagagccuucgccgagaagaacaaccugagcuucaucgagaccagcgcccuggacagcaccaacguggaggaggccuucaagaacauccugaccgagaucuacagaaucgugagccagaagcagaucgccgacagagccgcccacgacgagagccccggcaacaacgugguggacaucagcgugccccccaccaccgacggccagaagcccaacaagcugcagugcugccagaaccuguaa

SEQ ID NO: 22297 - RNA, 3852 nt, Artificial Sequence
  RAB11FIP1__Homo_sapiens__NP_001002814
augagccugauggugagcgccggcagaggccugggcgccguguggagccccacccacgugcaggugaccgugcugcaggccagaggccugagagccaagggccccggcggcaccagcgacgccuacgccgugauccaggugggcaaggagaaguacgccaccagcgugagcgagagaagccugggcgcccccguguggagagaggaggccaccuucgagcugcccagccugcugagcagcggccccgccgccgccgccacccugcagcugaccgugcugcacagagcccugcugggccuggacaaguuccugggcagagccgagguggaccugagagaccugcacagagaccagggcagaagaaagacccagugguacaagcugaagagcaagcccggcaagaaggacaaggagagaggcgagaucgagguggacauccaguucaugagaaacaacaugaccgccagcauguucgaccugagcaugaaggacaagagcagaaaccccuucggcaagcugaaggacaagaucaagggcaagaacaaggacagcggcagcgacaccgccagcgccaucauccccagcaccacccccagcguggacagcgacgacgagagcguggugaaggacaagaagaagaagagcaagaucaagacccugcugagcaagagcaaccugcagaagaccccccugagccagagcaugagcgugcugcccaccagcaagcccgagaaggugcugcugagacccggcgacuuccagagccagugggacgaggacgacaacgaggacgagagcagcagcgccagcgacgugaugagccacaagagaaccgccagcaccgaccugaagcagcugaaccaggugaacuucacccugcccaagaaggagggccugagcuuccugggcggccugagaagcaagaacgacgugcugagcagaagcaacgugugcaucaacggcaaccacguguaccuggagcagcccgaggccaagggcgagaucaaggacagcagccccagcagcagccccagccccaagggcuucagaaagaagcaccuguucagcagcaccgagaaccuggccgccggcagcuggaaggagcccgccgagggcggcggccugagcagcgacagacagcugagcgagagcagcaccaaggacagccugaagagcaugacccugcccagcuacagacccgccccccuggugagcggcgaccugagagagaacauggcccccgccaacagcgaggccaccaaggaggccaaggagagcaagaagcccgagagcagaagaagcagccugcugagccugaugaccggcaagaaggacguggccaagggcagcgagggcgagaacccccugaccgugcccggcagagagaaggagggcaugcugaugggcgugaagcccggcgaggacgccagcggccccgccgaggaccuggugagaagaagcgagaaggacaccgccgccguggugagcagacagggcagcagccugaaccuguucgaggacgugcagaucaccgagcccgaggccgagcccgagagcaagagcgagcccagaccccccaucagcagccccagagccccccagaccagagccgugaagcccagacuggaggugagccccgaggcccagcccaccgccagacugcccagccccaccgacagccccagcagccugcccccccugcccagcagcagcggccaggccagcgugcccagcgagcugggccacggcgccgacacccagagcagcgagagccccagcguguucagcagccugagcagccccaucgccgcccccaucagcaccagcacccccaucgagagcuggccccugguggacagaggccaggccaagagcgagggccccccccugcugcccaaggccgagcugcagaccgagagccugacccccgugcccaacagcggcagcagcgcccugggcagccuguucaagcagcccagcuuccccgccaacaagggcaccgaggacagccugaugggcagaaccagagagaccggcaccgagaagaacaccagcagccuggagcuggaggagagccugcccgagcagcccgagaccggcagacaggaggaggagcugcccagauuccccugcaagaagcaggacuacagccccagcagcggcgaggcccaggaggugcccuucgcccugagccugagcagcgacggcgccgugagccccgugggcgagcuggccgccggcggcgacagagaccuggagagccaggccggcagccugguggagagcaaggccagagacgccgccgaggagguggcccccccccugcccaugggcgccagcgugcccagcaucgacagcaugaugagaaagcuggaggagaugggccugaaccugagaaaggaccagaagaagaccaagaagagagugagcuucagcgagcagcuguucaccgaggaggccguggccggcgccgcccugcugguggagggccacagcagcugcccccaggagcugaaccccgccuggagcguggccggcaacgccagcgacggcgagccccccgagagcccccacgccgaggacagcgagagagagagcgugaccacccccggccccgccaccugcggcgcccccgccagccccgccgaccaccugcugcugcccagccaggaggagagcuucagcgaggugcccaugagcgaggccagcagcgccaaggacaccccccuguucagaauggagggcgaggacgcccuggugacccaguaccagagcaaggccagcgaccacgagggccugcugagcgacccccugagcgaccugcagcuggugagcgacuucaagagccccaucauggccgaccugaaccugagccugcccagcauccccgagguggccagcgacgacgagagaaucgaccagguggaggacgacggcgaccagguggaggacgacggcgagaccgccaagagcagcacccuggacaucggcgcccugagccugggccugguggugcccugccccgagagaggcaagggccccagcggcgaggccgacagacuggugcugggcgagggccugugcgacuucagacugcaggccccccaggccagcgugaccgcccccagcgagcagaccaccgaguucggcauccacaagccccaccugggcaagagcagcagccuggacaagcagcugcccggccccagcggcggcgaggaggagaagcccaugggcaacggcagccccagccccccccccggcaccagccuggacaaccccgugcccagccccagccccagcgagaucuuccccgugacccacagcuuccccagcagcgcccacagcgacacccaccacaccagcaccgccgagagccagaagaaggccaccgccgagggcagcgccggcagaguggagaacuucggcaagagaaagccccugcugcaggccugggugagccccagcgagacccaccccgugagcgcccagcccggcgccggcaccggcagcgccaagcacagacugcaccccgugaagcccaugaacgccauggccaccaagguggccaacugcagccugggcaccgccaccaucaucagcgagaaccugaacaacgaggugaugaugaagaaguacagccccagcgaccccgccuucgccuacgcccagcugacccacgacgagcugauccagcuggugcugaagcagaaggagaccaucagcaagaaggaguuccaggugagagagcuggaggacuacaucgacaaccugcuggugagagugauggaggagacccccaacauccugagaauccccacccaggugggcaagaaggccggcaagauguaa

SEQ ID NO: 22298 - RNA, 1539 nt, Artificial Sequence
  RAB11FIP2__Homo_sapiens__NP_055719
augaugcugagcgagcaggcccagaagugguuccccacccacgugcaggugaccgugcugcaggccaaggaccugaagcccaagggcaagagcggcaccaacgacaccuacaccaucauccagcugggcaaggagaaguacagcaccagcguggccgagaagacccuggagcccguguggaaggaggaggccagcuucgagcugcccggccugcugauccagggcagccccgagaaguacauccuguuccugaucgugaugcacagaagccuggugggccuggacaaguuccugggccagguggccaucaaccugaacgacaucuucgaggacaagcagagaagaaagaccgagugguucagacuggagagcaagcagggcaagagaaucaagaacagaggcgagaucaaggugaacauccaguucaugagaaacaacaugaccgccagcauguucgaccugagcaugaaggacaagaccagaagccccuucgccaagcugaaggacaagaugaagggcagaaagaacgacggcaccuucagcgacaccagcagcgccaucauccccagcacccacaugcccgacgccaacagcgaguucagcagcggcgagauccagaugaagagcaagcccaagaagcccuuccugcugggcccccagagacugagcagcgcccacagcaugagcgaccugagcggcagccacaugagcagcgagaagcugaaggccggcaccaucggccagacccaccugcugggccaccagcuggacagcuucggcaccgugcccgagagcggcagccugaagagcccccacagaagaacccugagcuucgacaccagcaagaugaaccagcccgacagcaucguggacgagggcgagcugugcuucggcagacagaacgaccccuucaccaacgugaccgccagccugccccagaaguucgccacccugcccagaaagaagaaccccuucgaggagagcagcgagaccugggacagcagcaugaaccuguucagcaagcccaucgagaucagaaaggagaacaagagagagaagagagagaaggugagccuguucgagagagugaccggcaagaaggacagcagaagaagcgacaagcugaacaacggcggcagcgacagccccugcgaccugaagagccccaacgccuucagcgagaacagacaggacuacuucgacuacgagagcaccaaccccuucaccgccaaguucagagccagcaacaucaugcccagcagcagcuuccacaugagccccaccagcaacgaggaccugagaaagauccccgacagcaaccccuucgacgccaccgccggcuacagaagccugaccuacgaggaggugcugcaggagcuggugaagcacaaggagcugcugagaagaaaggacacccacaucagagagcuggaggacuacaucgacaaccugcuggugagagugauggaggagacccccagcauccugagagugcccuacgagcccagcagaaaggccggcaaguucagcaacagcuaa

SEQ ID NO: 22299 - RNA, 1383 nt, Artificial Sequence
  RAB11FIP3__Homo_sapiens__NP_001135744
augcccuuccugaaggccaacgaggugaccgacagcgccuacaugggcagcgagagcaccuacagcgagugcgagaccuucaccgacgaggacaccagcacccuggugcaccccgagcugcagcccgagggcgacgccgacagcgccggcggcagcgccgugcccagcgagugccuggacgccauggaggagcccgaccacggcgcccugcugcugcugcccggcagaccccacccccacggccagagcgugaucaccgugaucggcggcgaggagcacuucgaggacuacggcgagggcagcgaggccgagcugagccccgagacccugugcaacggccagcugggcugcagcgaccccgccuuccugacccccagccccaccaagagacugagcagcaagaagguggccagauaccugcaccagagcggcgcccugaccauggaggcccuggaggaccccagccccgagcugauggagggccccgaggaggacaucgccgacaaggugguguuccuggagagaagagugcuggagcuggagaaggacaccgccgccaccggcgagcagcacagcagacugagacaggagaaccugcagcuggugcacagagccaacgcccuggaggagcagcugaaggagcaggagcugagagccugcgagauggugcuggaggagaccagaagacagaaggagcugcugugcaagauggagagagagaagagcaucgagaucgagaaccugcagaccagacugcagcagcuggacgaggagaacagcgagcugagaagcugcacccccugccugaaggccaacaucgagagacuggaggaggagaagcagaagcugcuggacgagaucgagagccugacccugagacugagcgaggagcaggagaacaagagaagaaugggcgacagacugagccacgagagacaccaguuccagagagacaaggaggccacccaggagcugaucgaggaccugagaaagcagcuggagcaccugcagcugcugaagcuggaggccgagcagagaagaggcagaagcagcagcaugggccugcaggaguaccacagcagagccagagagagcgagcuggagcaggaggugagaagacugaagcaggacaacagaaaccugaaggagcagaacgaggagcugaacggccagaucaucacccugagcauccagggcgccaagagccuguucagcaccgccuucagcgagagccuggccgccgagaucagcagcgugagcagagacgagcugauggaggccauccagaagcaggaggagaucaacuucagacugcaggacuacaucgacagaaucaucguggccaucauggagaccaaccccagcauccuggaggugaaguaa

SEQ ID NO: 22300 - RNA, 1914 nt, Artificial Sequence
  RAB11FIP4__Homo_sapiens__NP_116321
auggccggcggcgccggcuggagcggcgcccccgccgcccugcugagaagcgugagaagacugagagagguguucgaggugugcggcagagaccccgacggcuuccugagaguggagagaguggccgcccugggccugagauucggccagggcgaggagguggagaagcuggugaaguaccuggaccccaacgaccugggcagaaucaacuucaaggacuucugcagaggcguguucgccaugaagggcugcgaggagcugcugaaggacgugcugagcguggagagcgccggcacccugcccugcgcccccgagauccccgacugcguggagcagggcagcgaggugaccggccccaccuucgccgacggcgagcugauccccagagagcccggcuucuuccccgaggacgaggaggaggccaugacccuggccccccccgagggcccccaggagcuguacaccgacagccccauggagagcacccagagccuggagggcagcgugggcagccccgccgagaaggacggcggccugggcggccuguuccugcccgaggacaagagccuggugcacacccccagcaugaccaccagcgaccugagcacccacagcaccaccagccugaucagcaacgaggagcaguucgaggacuacggcgagggcgacgacguggacugcgcccccagcagccccugccccgacgacgagaccagaaccaacguguacagcgaccugggcagcagcgugagcagcagcgccggccagacccccagaaagaugagacacguguacaacagcgagcugcuggacguguacugcagccagugcugcaagaagaucaaccugcugaacgaccuggaggccagacugaagaaccugaaggccaacagccccaacagaaagaucagcagcaccgccuucggcagacagcugaugcacagcagcaacuucagcagcagcaacggcagcaccgaggaccuguucagagacagcaucgacagcugcgacaacgacaucaccgagaaggugagcuuccuggagaagaaggugaccgagcuggagaacgacagccugaccaacggcgaccugaagagcaagcugaagcaggagaacacccagcuggugcacagagugcacgagcuggaggagauggugaaggaccaggagaccaccgccgagcaggcccuggaggaggaggccagaagacacagagaggccuacggcaagcuggagagagagaaggccaccgagguggagcugcugaacgccagagugcagcagcuggaggaggagaacaccgagcugagaaccaccgugaccagacugaagagccagaccgagaagcuggacgaggagagacagagaaugagcgacagacuggaggacaccagccugagacugaaggacgagauggaccuguacaagagaaugauggacaagcugagacagaacagacuggaguuccagaaggagagagaggccacccaggagcugaucgaggaccugagaaaggagcuggagcaccugcagauguacaagcuggacugcgagagacccggcagaggcagaagcgccagcagcggccugggcgaguucaacgccagagccagagagguggagcuggagcacgaggugaagagacugaagcaggagaacuacaagcugagagaccagaacgacgaccugaacggccagauccugagccugagccuguacgaggccaagaaccuguucgccgcccagaccaaggcccagagccuggccgccgagaucgacaccgccagcagagacgagcugauggaggcccugaaggagcaggaggagaucaacuucagacugagacaguacauggacaagaucauccuggccauccuggaccacaaccccagcauccuggagaucaagcacuaa

SEQ ID NO: 22301 - RNA, 1962 nt, Artificial Sequence
  RAB11FIP5__Homo_sapiens__NP_056285
auggcccuggugagaggcgccgagcccgccgccggccccagcagauggcugcccacccacgugcaggugaccgugcugagagccagaggccugagaggcaagagcagcggcgccggcagcaccagcgacgccuacaccgugauccaggugggcagagagaaguacagcaccagcgugguggagaagacccacggcugccccgaguggagagaggagugcagcuucgagcugccccccggcgcccuggacggccugcugagagcccaggaggccgacgccggccccgcccccugggccgccagcagcgccgccgccugcgagcuggugcugaccaccaugcacagaagccugaucggcguggacaaguuccugggccaggccaccguggcccuggacgagguguucggcgccggcagagcccagcacacccagugguacaagcugcacagcaagcccggcaagaaggagaaggagagaggcgagaucgaggugaccauccaguucaccagaaacaaccugagcgccagcauguucgaccugagcaugaaggacaagcccagaagccccuucagcaagaucagagacaagaugaagggcaagaagaaguacgaccuggagagcgccagcgccauccugcccagcagcgccaucgaggaccccgaccugggcagccugggcaagaugggcaaggccaagggcuucuuccugagaaacaagcugagaaagagcagccugacccagagcaacaccagccugggcagcgacagcacccugagcagcgccagcggcagccuggccuaccagggccccggcgccgagcugcugaccagaagccccagcagaagcagcuggcugagcaccgagggcggcagagacagcgcccagagccccaagcuguucacccacaagagaaccuacagcgacgaggccaaccagaugagaguggccccccccagagcccugcuggaccugcagggccaccuggacgccgccagcagaagcagccugugcgugaacggcagccacaucuacaacgaggagccccagggccccgugagacacagaagcagcaucagcggcagccugcccagcagcggcagccugcaggccgugagcagcagauucagcgaggagggccccagaagcaccgacgacaccuggcccagaggcagcagaagcaacagcagcagcgaggccgugcugggccaggaggagcugagcgcccaggccaaggugcuggcccccggcgccagccaccccggcgaggaggagggcgccagacugcccgagggcaagcccgugcagguggccacccccaucguggccagcagcgaggccguggccgagaaggagggcgccagaaaggaggagagaaagcccagaaugggccuguuccaccaccaccaccagggccugagcagaagcgagcugggcagaagaagcagccugggcgagaagggcggccccauccugggcgccagcccccaccacagcagcagcggcgaggagaaggccaagagcagcugguucggccugagagaggccaaggaccccacccagaagcccagcccccaccccgugaagccccugagcgccgcccccguggagggcagccccgacagaaagcagagcagaagcagccugagcaucgcccugagcagcggccuggagaagcugaagaccgugaccagcggcagcauccagcccgugacccaggccccccaggccggccagaugguggacaccaagagacugaaggacagcgccgugcuggaccagagcgccaaguacuaccaccugacccacgacgagcugaucagccugcugcugcagagagagagagagcugagccagagagacgagcacgugcaggagcuggagagcuacaucgacagacugcuggugagaaucauggagaccagccccacccugcugcagaucccccccggcccccccaaguaa

SEQ ID NO: 22302 - RNA, 735 nt, Artificial Sequence
  RAB12__Homo_sapiens__NP_001020471
auggaccccggcgccgcccugcagagaagagccggcggcggcggcggccugggcgccggcagccccgcccugagcggcggccagggcagaagaagaaagcagccccccagacccgccgacuucaagcugcaggugaucaucaucggcagcagaggcgugggcaagaccagccugauggagagauucaccgacgacaccuucugcgaggccugcaagagcaccgugggcguggacuucaagaucaagaccguggagcugagaggcaagaagaucagacugcagaucugggacaccgccggccaggagagauucaacagcaucaccagcgccuacuacagaagcgccaagggcaucauccugguguacgacaucaccaagaaggagaccuucgacgaccugcccaaguggaugaagaugaucgacaaguacgccagcgaggacgccgagcugcugcuggugggcaacaagcuggacugcgagaccgacagagagaucaccagacagcagggcgagaaguucgcccagcagaucaccggcaugagauucugcgaggccagcgccaaggacaacuucaacguggacgagaucuuccugaagcugguggacgacauccugaagaagaugccccuggacauccugagaaacgagcugagcaacagcauccugagccugcagcccgagcccgagaucccccccgagcugcccccccccagaccccacgugagaugcugcuaa

SEQ ID NO: 22303 - RNA, 648 nt, Artificial Sequence
  RAB14__Homo_sapiens__NP_057406
auggccaccgcccccuacaacuacagcuacaucuucaaguacaucaucaucggcgacaugggcgugggcaagagcugccugcugcaccaguucaccgagaagaaguucauggccgacugcccccacaccaucggcguggaguucggcaccagaaucaucgaggugagcggccagaagaucaagcugcagaucugggacaccgccggccaggagagauucagagccgugaccagaagcuacuacagaggcgccgccggcgcccugaugguguacgacaucaccagaagaagcaccuacaaccaccugagcagcuggcugaccgacgccagaaaccugaccaaccccaacaccgugaucauccugaucggcaacaaggccgaccuggaggcccagagagacgugaccuacgaggaggccaagcaguucgccgaggagaacggccugcuguuccuggaggccagcgccaagaccggcgagaacguggaggacgccuuccuggaggccgccaagaagaucuaccagaacauccaggacggcagccuggaccugaacgccgccgagagcggcgugcagcacaagcccagcgccccccagggcggcagacugaccagcgagccccagccccagagagagggcugcggcugcuaa

SEQ ID NO: 22304 - RNA, 627 nt, Artificial Sequence
  RAB15__Homo_sapiens__NP_941959
auggccaagcaguacgacgugcuguucagacugcugcugaucggcgacagcggcgugggcaagaccugccugcugugcagauucaccgacaacgaguuccacagcagccacaucagcaccaucggcguggacuucaagaugaagaccaucgagguggacggcaucaaggugagaauccagaucugggacaccgccggccaggagagauaccagaccaucaccaagcaguacuacagaagagcccagggcaucuuccugguguacgacaucagcagcgagagaagcuaccagcacaucaugaagugggugagcgacguggacgaggugggcgacgccaccagccugcccggcugcggcgagggcgccagccccggcaaggccagaagaggccccgacggcaaggccaacgccagcagaaagcugugccugccccagcccuggaugaagaccagcggcacccaccagaaggccagcagaagaagccugcugggcaucagacugaugagaagcagaaacggcagaugggaggagagcaagggcagcagcuggagaagaagcauggccuggaccagcaugaagcaggugcccgcccccaccagcacccugaagagccacagcagaguguaa

SEQ ID NO: 22305 - RNA, 708 nt, Artificial Sequence
  RAB18__Homo_sapiens__NP_001243339
auggacgaggacgugcugaccacccugaagauccugaucaucggcgagagcggcgugggcaagagcagccugcugcugagauucaccgacgacaccuucgaccccgagcuggccgccaccaucggcguggacuucaaggugaagaccaucagcguggacggcaacaaggccaagcuggccaucugggugacccugcaccagcagaccgccaacuucuuccugaagagccagaucggcaacagccccauccugaagugggccauguggcaguacgacaccgccggccaggagagauucagaacccugacccccagcuacuacagaggcgcccagggcgugauccugguguacgacgugaccagaagagacaccuucgugaagcuggacaacuggcugaacgagcuggagaccuacugcaccagaaacgacaucgugaacaugcuggugggcaacaagaucgacaaggagaacagagagguggacagaaacgagggccugaaguucgccagaaagcacagcaugcuguucaucgaggccagcgccaagaccugcgacggcgugcagugcgccuucgaggagcugguggagaagaucauccagacccccggccugugggagagcgagaaccagaacaagggcgugaagcugagccacagagaggagggccagggcggcggcgccugcggcggcuacugcagcgugcuguaa

SEQ ID NO: 22306 - RNA, 618 nt, Artificial Sequence
  RAB1A__Homo_sapiens__NP_004152
augagcagcaugaaccccgaguacgacuaccuguucaagcugcugcugaucggcgacagcggcgugggcaagagcugccugcugcugagauucgccgacgacaccuacaccgagagcuacaucagcaccaucggcguggacuucaagaucagaaccaucgagcuggacggcaagaccaucaagcugcagaucugggacaccgccggccaggagagauucagaaccaucaccagcagcuacuacagaggcgcccacggcaucaucgugguguacgacgugaccgaccaggagagcuucaacaacgugaagcaguggcugcaggagaucgacagauacgccagcgagaacgugaacaagcugcuggugggcaacaagugcgaccugaccaccaagaaggugguggacuacaccaccgccaaggaguucgccgacagccugggcauccccuuccuggagaccagcgccaagaacgccaccaacguggagcagagcuucaugaccauggccgccgagaucaagaagagaaugggccccggcgccaccgccggcggcgccgagaagagcaacgugaagauccagagcacccccgugaagcagagcggcggcggcugcugcuaa

SEQ ID NO: 22307 - RNA, 606 nt, Artificial Sequence
  RAB1B__Homo_sapiens__NP_112243
augaaccccgaguacgacuaccuguucaagcugcugcugaucggcgacagcggcgugggcaagagcugccugcugcugagauucgccgacgacaccuacaccgagagcuacaucagcaccaucggcguggacuucaagaucagaaccaucgagcuggacggcaagaccaucaagcugcagaucugggacaccgccggccaggagagauucagaaccaucaccagcagcuacuacagaggcgcccacggcaucaucgugguguacgacgugaccgaccaggagagcuacgccaacgugaagcaguggcugcaggagaucgacagauacgccagcgagaacgugaacaagcugcuggugggcaacaagagcgaccugaccaccaagaaggugguggacaacaccaccgccaaggaguucgccgacagccugggcauccccuuccuggagaccagcgccaagaacgccaccaacguggagcaggccuucaugaccauggccgccgagaucaagaagagaaugggccccggcgccgccagcggcggcgagagacccaaccugaagaucgacagcacccccgugaagcccgccggcggcggcugcugcuaa

SEQ ID NO: 22308 - RNA, 705 nt, Artificial Sequence
  RAB20__Homo_sapiens__NP_060287
augagaaagcccgacagcaagaucgugcugcugggcgacaugaacgugggcaagaccagccugcugcagagauacauggagagaagauuccccgacaccgugagcaccgugggcggcgccuucuaccugaagcaguggagaagcuacaacaucagcaucugggacaccgccggcagagagcaguuccacggccugggcagcauguacugcagaggcgccgccgccaucauccugaccuacgacgugaaccacagacagagccugguggagcuggaggacagauuccugggccugaccgacaccgccagcaaggacugccuguucgccaucgugggcaacaagguggaccugaccgaggagggcgcccuggccggccaggagaaggaggagugcagccccaacauggacgccggcgacagagugagccccagagcccccaagcaggugcagcuggaggacgccguggcccuguacaagaagauccugaaguacaagaugcuggacgagcaggacgugcccgccgccgagcagaugugcuucgagaccagcgccaagaccggcuacaacguggaccugcuguucgagacccuguucgaccugguggugcccaugauccugcagcagagagccgagagacccagccacaccguggacaucagcagccacaagccccccaagagaaccagaagcggcugcugcgccuaa

SEQ ID NO: 22309 - RNA, 678 nt, Artificial Sequence
  RAB21__Homo_sapiens__NP_055814
auggccgccgccggcggcggcggcggcggcgccgccgccgccggcagagccuacagcuucaagguggugcugcugggcgagggcugcgugggcaagaccagccuggugcugagauacugcgagaacaaguucaacgacaagcacaucaccacccugcaggccagcuuccugaccaagaagcugaacaucggcggcaagagagugaaccuggccaucugggacaccgccggccaggagagauuccacgcccugggccccaucuacuacagagacagcaacggcgccauccugguguacgacaucaccgacgaggacagcuuccagaaggugaagaacugggugaaggagcugagaaagaugcugggcaacgagaucugccugugcaucgugggcaacaagaucgaccuggagaaggagagacacgugagcauccaggaggccgagagcuacgccgagagcgugggcgccaagcacuaccacaccagcgccaagcagaacaagggcaucgaggagcuguuccuggaccugugcaagagaaugaucgagaccgcccagguggacgagagagccaagggcaacggcagcagccagcccggcaccgccagaagaggcgugcagaucaucgacgacgagccccaggcccagaccagcggcggcggcugcugcagcagcggcuaa

SEQ ID NO: 22310 - RNA, 585 nt, Artificial Sequence
  RAB22A__Homo_sapiens__NP_065724
auggcccugagagagcugaaggugugccugcugggcgacaccggcgugggcaagagcagcaucguguggagauucguggaggacagcuucgaccccaacaucaaccccaccaucggcgccagcuucaugaccaagaccgugcaguaccagaacgagcugcacaaguuccugaucugggacaccgccggccaggagagauucagagcccuggcccccauguacuacagaggcagcgccgccgccaucaucguguacgacaucaccaaggaggagaccuucagcacccugaagaacugggugaaggagcugagacagcacggcccccccaacaucgugguggccaucgccggcaacaagugcgaccugaucgacgugagagaggugauggagagagacgccaaggacuacgccgacagcauccacgccaucuucguggagaccagcgccaagaacgccaucaacaucaacgagcuguucaucgagaucagcagaagaauccccagcaccgacgccaaccugcccagcggcggcaagggcuucaagcugagaagacagcccagcgagcccaagagaagcugcugcuaa

SEQ ID NO: 22311 - RNA, 714 nt, Artificial Sequence
  RAB23__Homo_sapiens__NP_001265595
augcuggaggaggacauggagguggccaucaagauggugguggugggcaacggcgccgugggcaagagcagcaugauccagagauacugcaagggcaucuucaccaaggacuacaagaagaccaucggcguggacuuccuggagagacagauccaggugaacgacgaggacgugagacugaugcugugggacaccgccggccaggaggaguucgacgccaucaccaaggccuacuacagaggcgcccaggccugcgugcugguguucagcaccaccgacagagagagcuucgaggccgugagcagcuggagagagaaggugguggccgaggugggcgacauccccaccgugcuggugcagaacaagaucgaccugcuggacgacagcugcaucaagaacgaggaggccgaggcccuggccaagagacugaagcugagauucuacagaaccagcgugaaggaggaccugaacgugaacgagguguucaaguaccuggccgagaaguaccugcagaagcugaagcagcagaucgccgaggaccccgagcugacccacagcagcagcaacaagaucggcguguucaacaccagcggcggcagccacagcggccagaacagcggcacccugaacggcggcgacgugaucaaccugagacccaacaagcagagaaccaagaagaacagaaaccccuucagcagcugcagcauccccuaa

SEQ ID NO: 22312 - RNA, 612 nt, Artificial Sequence
  RAB24__Homo_sapiens__NP_570137
augagcggccagagaguggacgugaagguggugaugcugggcaaggaguacgugggcaagaccagccugguggagagauacgugcacgacagauuccuggugggccccuaccagaacaccaucggcgccgccuucguggccaaggugaugagcgugggcgacagaaccgugacccugggcaucugggacaccgccggcagcgagagauacgaggccaugagcagaaucuacuacagaggcgccaaggccgccaucgugugcuacgaccugaccgacagcagcagcuucgagagagccaaguucugggugaaggagcugagaagccuggaggagggcugccagaucuaccugugcggcaccaagagcgaccugcuggaggaggacagaagaagaagaagaguggacuuccacgacgugcaggacuacgccgacaacaucaaggcccagcuguucgagaccagcagcaagaccggccagagcguggacgagcuguuccagaagguggccgaggacuacgugagcguggccgccuuccaggugaugaccgaggacaagggcguggaccugggccagaagcccaaccccuacuucuacagcugcugccaccacuaa

SEQ ID NO: 22313 - RNA, 642 nt, Artificial Sequence
  RAB25__Homo_sapiens__NP_065120
augggcaacggcaccgaggaggacuacaacuucguguucaagguggugcugaucggcgagagcggcgugggcaagaccaaccugcugagcagauucaccagaaacgaguucagccacgacagcagaaccaccaucggcguggaguucagcaccagaaccgugaugcugggcaccgccgccgugaaggcccagaucugggacaccgccggccuggagagauacagagccaucaccagcgccuacuacagaggcgccgugggcgcccugcugguguucgaccugaccaagcaccagaccuacgccgugguggagagauggcugaaggagcuguacgaccacgccgaggccaccaucguggugaugcuggugggcaacaagagcgaccugagccaggccagagaggugcccaccgaggaggccagaauguucgccgagaacaacggccugcuguuccuggagaccagcgcccuggacagcaccaacguggagcuggccuucgagaccgugcugaaggagaucuucgccaaggugagcaagcagagacagaacagcaucagaaccaacgccaucacccugggcagcgcccaggccggccaggagcccggccccggcgagaagagagccugcugcaucagccuguaa

SEQ ID NO: 22314 - RNA, 666 nt, Artificial Sequence
  RAB27A__Homo_sapiens__NP_899059
augagcgacggcgacuacgacuaccugaucaaguuccuggcccugggcgacagcggcgugggcaagaccagcgugcuguaccaguacaccgacggcaaguucaacagcaaguucaucaccaccgugggcaucgacuucagagagaagagagugguguacagagccagcggccccgacggcgccaccggcagaggccagagaauccaccugcagcugugggacaccgccggccaggagagauucagaagccugaccaccgccuucuucagagacgccaugggcuuccugcugcuguucgaccugaccaacgagcagagcuuccugaacgugagaaacuggaucagccagcugcagaugcacgccuacugcgagaaccccgacaucgugcugugcggcaacaagagcgaccuggaggaccagagaguggugaaggaggaggaggccaucgcccuggccgagaaguacggcauccccuacuucgagaccagcgccgccaacggcaccaacaucagccaggccaucgagaugcugcuggaccugaucaugaagagaauggagagaugcguggacaagagcuggauccccgagggcguggugagaagcaacggccacgccagcaccgaccagcugagcgaggagaaggagaagggcgccugcggcugcuaa

SEQ ID NO: 22315 - RNA, 657 nt, Artificial Sequence
  RAB27B__Homo_sapiens__XP_005266790
augaccgacggcgacuacgacuaccugaucaagcugcuggcccugggcgacagcggcgugggcaagaccaccuuccuguacagauacaccgacaacaaguucaaccccaaguucaucaccaccgugggcaucgacuucagagagaagagagugguguacaacgcccagggccccaacggcagcagcggcaaggccuucaaggugcaccugcagcugugggacaccgccggccaggagagauucagaagccugaccaccgccuucuucagagacgccaugggcuuccugcugauguucgaccugaccagccagcagagcuuccugaacgugagaaacuggaugagccagcugcaggccaacgccuacugcgagaaccccgacaucgugcugaucggcaacaaggccgaccugcccgaccagagagaggugaacgagagacaggccagagagcuggccgacaaguacggcauccccuacuucgagaccagcgccgccaccggccagaacguggagaaggccguggagacccugcuggaccugaucaugaagagaauggagcagugcguggagaagacccagauccccgacaccgugaacggcggcaacagcggcaaccuggacggcgagaagccccccgagaagaagugcaucugcuaa

SEQ ID NO: 22316 - RNA, 666 nt, Artificial Sequence
  RAB28__Homo_sapiens__NP_001017979
augagcgacagcgaggaggagagccaggacagacagcugaagaucguggugcugggcgacggcgccagcggcaagaccagccugaccaccugcuucgcccaggagaccuucggcaagcaguacaagcagaccaucggccuggacuucuuccugagaagaaucacccugcccggcaaccugaacgugacccugcagaucugggacaucggcggccagaccaucggcggcaagaugcuggacaaguacaucuacggcgcccagggcgugcugcugguguacgacaucaccaacuaccagagcuucgagaaccuggaggacugguacaccguggugaagaaggugagcgaggagagcgagacccagccccugguggcccuggugggcaacaagaucgaccuggagcacaugagaaccaucaagcccgagaagcaccugagauucugccaggagaacggcuucagcagccacuucgugagcgccaagaccggcgacagcguguuccugugcuuccagaagguggccgccgagauccugggcaucaagcugaacaaggccgagaucgagcagagccagagaguggugaaggccgacaucgugaacuacaaccaggagcccaugagcagaaccgugaacccccccagaagcagcaugugcgccgugcaguaa

SEQ ID NO: 22317 - RNA, 540 nt, Artificial Sequence
  RAB29__Homo_sapiens__NP_001129135
augggcagcagagaccaccuguucaaggugcugguggugggcgacgccgccgugggcaagaccagccuggugcagagauacagccaggacagcuucagcaagcacuacaagagcaccgugggcggccaggagagauucaccagcaugaccagacuguacuacagagacgccagcgccugcgugaucauguucgacgugaccaacgccaccaccuucagcaacagccagagauggaagcaggaccuggacagcaagcugacccugcccaacggcgagcccgugcccugccugcugcuggccaacaagugcgaccugagccccugggccgugagcagagaccagaucgacagauucagcaaggagaacggcuucaccggcuggaccgagaccagcgugaaggagaacaagaacaucaacgaggccaugagagugcugaucgagaagaugaugagaaacagcaccgaggacaucaugagccugagcacccagggcgacuacaucaaccugcagaccaagagcagcagcuggagcugcugcuaa

SEQ ID NO: 22318 - RNA, 567 nt, Artificial Sequence
  RAB2A__Homo_sapiens__NP_001229573
auggccuacgccuaccuguucaaguacaucaucaucggcgacaccggcguggaguucggcgccagaaugaucaccaucgacggcaagcagaucaagcugcagaucugggacaccgccggccaggagagcuucagaagcaucaccagaagcuacuacagaggcgccgccggcgcccugcugguguacgacaucaccagaagagacaccuucaaccaccugaccaccuggcuggaggacgccagacagcacagcaacagcaacauggugaucaugcugaucggcaacaagagcgaccuggagagcagaagagaggugaagaaggaggagggcgaggccuucgccagagagcacggccugaucuucauggagaccagcgccaagaccgccagcaacguggaggaggccuucaucaacaccgccaaggagaucuacgagaagauccaggagggcguguucgacaucaacaacgaggccaacggcaucaagaucggcccccagcacgccgccaccaacgccacccacgccggcaaccagggcggccagcaggccggcggcggcugcugcuaa

SEQ ID NO: 22319 - RNA, 588 nt, Artificial Sequence
  RAB31__Homo_sapiens__NP_006859
augauggccaucagagagcugaaggugugccugcugggcgacaccggcgugggcaagagcagcaucgugugcagauucgugcaggaccacuucgaccacaacaucagccccaccaucggcgccagcuucaugaccaagaccgugcccugcggcaacgagcugcacaaguuccugaucugggacaccgccggccaggagagauuccacagccuggcccccauguacuacagaggcagcgccgccgccgugaucguguacgacaucaccaagcaggacagcuucuacacccugaagaagugggugaaggagcugaaggagcacggccccgagaacaucgugauggccaucgccggcaacaagugcgaccugagcgacaucagagaggugccccugaaggacgccaaggaguacgccgagagcaucggcgccaucgugguggagaccagcgccaagaacgccaucaacaucgaggagcuguuccagggcaucagcagacagauccccccccuggacccccacgagaacggcaacaacggcaccaucaagguggagaagcccaccaugcaggccagcagaagaugcugcuaa

SEQ ID NO: 22320 - RNA, 678 nt, Artificial Sequence
  RAB32__Homo_sapiens__NP_006825
auggccggcggcggcgccggcgaccccggccugggcgccgccgccgcccccgcccccgagaccagagagcaccuguucaaggugcuggugaucggcgagcugggcgugggcaagaccagcaucaucaagagauacgugcaccagcuguucagccagcacuacagagccaccaucggcguggacuucgcccugaaggugcugaacugggacagcagaacccuggugagacugcagcugugggacaucgccggccaggagagauucggcaacaugaccagaguguacuacaaggaggccgugggcgccuucgugguguucgacaucagcagaagcagcaccuucgaggccgugcugaaguggaagagcgaccuggacagcaaggugcaccugcccaacggcagccccauccccgccgugcugcuggccaacaagugcgaccagaacaaggacagcagccagagccccagccagguggaccaguucugcaaggagcacggcuucgccggcugguucgagaccagcgccaaggacaacaucaacaucgaggaggccgccagauuccugguggagaagauccuggugaaccaccagagcuuccccaacgaggagaacgacguggacaagaucaagcuggaccaggagacccugagagccgagaacaagagccagugcugcuaa

SEQ ID NO: 22321 - RNA, 690 nt, Artificial Sequence
  RAB33B__Homo_sapiens__NP_112586
auggccgaggagauggagagcagccuggaggccagcuucagcagcagcggcgccgugagcggcgccagcggcuuccugccccccgccagaagcagaaucuucaagaucaucgugaucggcgacagcaacgugggcaagaccugccugaccuacagauucugcgccggcagauuccccgacagaaccgaggccaccaucggcguggacuucagagagagagccguggagaucgacggcgagagaaucaagauccagcugugggacaccgccggccaggagagauucagaaagagcauggugcagcacuacuacagaaacgugcacgccgugguguucguguacgacaugaccaacauggccagcuuccacagccugcccagcuggaucgaggagugcaagcagcaccugcuggccaacgacauccccagaauccuggugggcaacaagugcgaccugagaagcgccauccaggugcccaccgaccuggcccagaaguucgccgacacccacagcaugccccuguucgagaccagcgccaagaaccccaacgacaacgaccacguggaggccaucuucaugacccuggcccacaagcugaagagccacaagccccugaugcugagccagccccccgacaacggcaucauccugaagcccgagcccaagcccgccaugaccugcuggugcuaa

SEQ ID NO: 22322 - RNA, 927 nt, Artificial Sequence
  RAB34__Homo_sapiens__NP_001136096
augagccaccugcccggccuggagcugagaagagaggcccccccccugcugggcccccugcugagccccuucccccugcccgccggcagcuggcacagacagaugcugagaagcagccugagauuccccaucaccaacagcgccggcgcccccugcaaggccgccggcagaaugaacauccuggcccccgugagaagagacagagugcuggccgagcugccccagugccugagaaaggaggccgcccugcacggccacaaggacuuccaccccagagugaccugcgccugccaggagcacagaaccggcaccgugggcuucaagaucagcaaggugaucguggugggcgaccugagcgugggcaagaccugccugaucaacagauucugcaaggacaccuucgacaagaacuacaaggccaccaucggcguggacuucgagauggagagauucgaggugcugggcauccccuucagccugcagcugugggacaccgccggccaggagagauucaagugcaucgccagcaccuacuacagaggcgcccaggccaucaucaucguguucaaccugaacgacguggccagccuggagcacaccaagcaguggcuggccgacgcccugaaggagaacgaccccagcagcgugcugcuguuccugacccccgcccaguacgcccugauggagaaggacgcccugcagguggcccaggagaugaaggccgaguacugggccgugagcagccugaccggcgagaacgugagagaguucuucuucagaguggccgcccugaccuucgaggccaacgugcuggccgagcuggagaagagcggcgccagaagaaucggcgacguggugagaaucaacagcgacgacagcaaccuguaccugaccgccagcaagaagaagcccaccugcugccccuaa

SEQ ID NO: 22323 - RNA, 459 nt, Artificial Sequence
  RAB35__Homo_sapiens__NP_001161078
auggccagagacuacgaccaccuguucaagcugcugaucaucggcgacagcggcgugggcaagagcagccugcugcugagauucgccgacaacaccuucagcggcagcuacaucaccaccaucggcguggacuucaagaucagaaccguggagaucaacggcgagaaggugaagcugcagaucugggacaccgccggccaggagagauucagaaccaucaccagcaccuacuacagaggcacccacggcgugaucgugguguacgacgugaccagcgccgagagcuucgugaacgugaagagauggcugcacgagaucaaccagaacugcgacgacgugugcagaauccuggacgugcagcugcaccacggcgccggcccccccagcaaggagagacagcccggcaagaccgccgccgccaccaccgagagaugcggcgaggcccacgaggagcaguaa

SEQ ID NO: 22324 - RNA, 1002 nt, Artificial Sequence
  RAB36__Homo_sapiens__NP_004905
auggugaucgccggcgccagcuggaugcugggcagagccgccgccagccccacccagaccccccccaccaccagcaccaucagaguggccagaagaagcagaguggcccugguggccauggugaucgccgccgccggcagcggcggccccggcagagccgagccccagcugagccagcccagccuggacugcggcagaaugagaagcagccugaccccccugggcccccccgugagcagagacagagugaucgccagcuuccccaagugguacacccccgaggccugccugcagcugagagagcacuuccacggccaggugagcgccgccugccagagaagaaacaccggcaccgugggccugaagcugagcaagguggugguggugggcgaccuguacgugggcaagaccagccugauccacagauucugcaagaacguguucgacagagacuacaaggccaccaucggcguggacuucgagaucgagagauucgagaucgccggcauccccuacagccugcagaucugggacaccgccggccaggagaaguucaagugcaucgccagcgccuacuacagaggcgcccaggugaucaucaccgccuucgaccugaccgacgugcagacccuggagcacaccagacaguggcuggaggacgcccugagagagaacgaggccggcagcugcuucaucuuccuggugggcaccaagaaggaccugcugagcggcgccgccugcgagcaggccgaggccgacgccgugcaccuggccagagagaugcaggccgaguacuggagcgugagcgccaagaccggcgagaacgugaaggccuucuucagcagaguggccgcccuggccuucgagcagagcgugcugcaggaccuggagagacagagcagcgccagacugcaggugggcaacggcgaccugauccagauggagggcagcccccccgagacccaggagagcaagagacccagcagccugggcugcugcuaa

SEQ ID NO: 22325 - RNA, 672 nt, Artificial Sequence
  RAB37__Homo_sapiens__NP_001006639
augaccggcacccccggcgccguggccaccagagacggcgaggcccccgagagaagcccccccugcagccccagcuacgaccugaccggcaaggugaugcugcugggcgacaccggcgugggcaagaccugcuuccugauccaguucaaggacggcgccuuccugagcggcaccuucaucgccaccgugggcaucgacuucagaaacaagguggugaccguggacggcgugagagugaagcugcagaucugggacaccgccggccaggagagauucagaagcgugacccacgccuacuacagagacgcccaggcccugcugcugcuguacgacaucaccaacaagagcagcuucgacaacaucagagccuggcugaccgagauccacgaguacgcccagagagacguggugaucaugcugcugggcaacaaggccgacaugagcagcgagagagugaucagaagcgaggacggcgagacccuggccagagaguacggcgugcccuuccuggagaccagcgccaagaccggcaugaacguggagcuggccuuccuggccaucgccaaggagcugaaguacagagccggccaccaggccgacgagcccagcuuccagaucagagacuacguggagagccagaagaagagaagcagcugcugcagcuucauguaa

SEQ ID NO: 22326 - RNA, 636 nt, Artificial Sequence
  RAB38__Homo_sapiens__NP_071732
augcaggccccccacaaggagcaccuguacaagcugcuggugaucggcgaccugggcgugggcaagaccagcaucaucaagagauacgugcaccagaacuucagcagccacuacagagccaccaucggcguggacuucgcccugaaggugcugcacugggaccccgagaccguggugagacugcagcugugggacaucgccggccaggagagauucggcaacaugaccagaguguacuacagagaggccaugggcgccuucaucguguucgacgugaccagacccgccaccuucgaggccguggccaaguggaagaacgaccuggacagcaagcugagccugcccaacggcaagcccgugagcguggugcugcuggccaacaagugcgaccagggcaaggacgugcugaugaacaacggccugaagauggaccaguucugcaaggagcacggcuucgugggcugguucgagaccagcgccaaggagaacaucaacaucgacgaggccagcagaugccuggugaagcacauccuggccaacgagugcgaccugauggagagcaucgagcccgacguggugaagccccaccugaccagcaccaagguggccagcugcagcggcugcgccaagagcuaa

SEQ ID NO: 22327 - RNA, 654 nt, Artificial Sequence
  RAB39A__Homo_sapiens__NP_059986
auggagaccaucuggaucuaccaguucagacugaucgugaucggcgacagcaccgugggcaagagcugccugcugcacagauucacccagggcagauuccccggccugagaagccccgccugcgaccccaccgugggcguggacuucuucagcagacugcuggagaucgagcccggcaagagaaucaagcugcagcugugggacaccgccggccaggagagauucagaagcaucaccagaagcuacuacagaaacagcgugggcggcuuccugguguucgacaucaccaacagaagaagcuucgagcacgugaaggacuggcuggaggaggccaagauguacgugcagcccuucagaaucguguuccugcuggugggccacaagugcgaccuggccagccagagacaggugaccagagaggaggccgagaagcugagcgccgacugcggcaugaaguacaucgagaccagcgccaaggacgccaccaacguggaggagagcuucaccauccugaccagagacaucuacgagcugaucaagaagggcgagaucugcauccaggacggcugggagggcgugaagagcggcuucgugcccaacaccgugcacagcagcgaggaggccgugaagcccagaaaggagugcuucugcuaa

SEQ ID NO: 22328 - RNA, 642 nt, Artificial Sequence
  RAB39B__Homo_sapiens__NP_741995
auggaggccaucuggcuguaccaguucagacugaucgugaucggcgacagcaccgugggcaagagcugccugaucagaagauucaccgagggcagauucgcccaggugagcgaccccaccgugggcguggacuucuucagcagacugguggagaucgagcccggcaagagaaucaagcugcagaucugggacaccgccggccaggagagauucagaagcaucaccagagccuacuacagaaacagcgugggcggccugcugcuguucgacaucaccaacagaagaagcuuccagaacgugcacgaguggcuggaggagaccaaggugcacgugcagcccuaccagaucguguucgugcuggugggccacaagugcgaccuggacacccagagacaggugaccagacacgaggccgagaagcuggccgccgccuacggcaugaaguacaucgagaccagcgccagagacgccaucaacguggagaaggccuucaccgaccugaccagagacaucuacgagcuggugaagagaggcgagaucaccauccaggagggcugggagggcgugaagagcggcuucgugcccaacguggugcacagcagcgaggagguggugaagagcgagagaagaugccugugcuaa

SEQ ID NO: 22329 - RNA, 663 nt, Artificial Sequence
  RAB3A__Homo_sapiens__XP_011526466
auggccagcgccaccgacagcagauacggccagaaggagagcagcgaccagaacuucgacuacauguucaagauccugaucaucggcaacagcagcgugggcaagaccagcuuccuguucagauacgccgacgacagcuucacccccgccuucgugagcaccgugggcaucgacuucaaggugaagaccaucuacagaaacgacaagagaaucaagcugcagaucugggacaccgccggccaggagagauacagaaccaucaccaccgccuacuacagaggcgccaugggcuucauccugauguacgacaucaccaacgaggagagcuucaacgccgugcaggacuggagcacccagaucaagaccuacagcugggacaacgcccaggugcugcuggugggcaacaagugcgacauggaggacgagagaguggugagcagcgagagaggcagacagcuggccgaccaccugggcuucgaguucuucgaggccagcgccaaggacaacaucaacgugaagcagaccuucgagagacugguggacgugaucugcgagaagaugagcgagagccuggacaccgccgaccccgccgugaccggcgccaagcagggcccccagcugagcgaccagcaggugcccccccaccaggacugcgccugcuaa

SEQ ID NO: 22330 - RNA, 660 nt, Artificial Sequence
  RAB3D__Homo_sapiens__NP_004274
auggccagcgccggcgacacccaggccggccccagagacgccgccgaccagaacuucgacuacauguucaagcugcugcugaucggcaacagcagcgugggcaagaccagcuuccuguucagauacgccgacgacagcuucacccccgccuucgugagcaccgugggcaucgacuucaaggugaagaccguguacagacacgacaagagaaucaagcugcagaucugggacaccgccggccaggagagauacagaaccaucaccaccgccuacuacagaggcgccaugggcuuccugcugauguacgacaucgccaaccaggagagcuucgccgccgugcaggacugggccacccagaucaagaccuacagcugggacaacgcccaggugauccuggugggcaacaagugcgaccuggaggacgagagaguggugcccgccgaggacggcagaagacuggccgacgaccugggcuucgaguucuucgaggccagcgccaaggagaacaucaacgugaagcagguguucgagagacugguggacgugaucugcgagaagaugaacgagagccuggagcccagcagcagcagcggcagcaacggcaagggccccgccgugggcgacgcccccgccccccagcccagcagcugcagcugcuaa

SEQ ID NO: 22331 - RNA, 2967 nt, Artificial Sequence
  RAB3GAP1__Homo_sapiens__NP_001165906
auggccgccgacagcgagcccgagagcgagguguucgagaucaccgacuucaccaccgccagcgagugggagagauucaucagcaagguggaggaggugcugaacgacuggaagcugaucggcaacagccugggcaagccccuggagaagggcaucuucaccagcggcaccugggaggagaagagcgacgagaucagcuucgccgacuucaaguucagcgugacccaccacuaccuggugcaggagagcaccgacaaggagggcaaggacgagcugcuggaggacguggugccccagagcaugcaggaccugcugggcaugaacaacgacuucccccccagagcccacugccuggugagaugguacggccugagagaguucguggugaucgcccccgccgcccacagcgacgccgugcugagcgagagcaagugcaaccugcugcugagcagcgugagcaucgcccugggcaacaccggcugccaggugccccuguucgugcagauccaccacaaguggagaagaauguacgugggcgagugccagggccccggcgugagaaccgacuucgagauggugcaccugagaaaggugcccaaccaguacacccaccugagcggccugcuggacaucuucaagagcaagaucggcugcccccugaccccccugccccccgugagcaucgccaucagauucaccuacgugcugcaggacuggcagcaguacuucuggccccagcagccccccgacaucgacgcccuggugggcggcgaggugggcggccuggaguucggcaagcugcccuucggcgccugcgaggaccccaucagcgagcugcaccuggccaccaccuggccccaccugaccgagggcaucaucguggacaacgacguguacagcgaccuggaccccauccaggccccccacuggagcgugagagugagaaaggccgagaacccccagugccugcugggcgacuucgugaccgaguucuucaagaucugcagaagaaaggagagcaccgacgagauccugggcagaagcgccuucgaggaggagggcaaggagaccgccgacaucacccacgcccugagcaagcugaccgagcccgccagcgugcccauccacaagcugagcgugagcaacauggugcacaccgccaagaagaagaucagaaagcacagaggcguggaggagagcccccugaacaacgacgugcugaacaccauccugcuguuccuguuccccgacgccgugagcgagaagccccuggacggcaccaccagcaccgacaacaacaacccccccagcgagagcgaggacuacaaccuguacaaccaguucaagagcgcccccagcgacagccugaccuacaagcuggcccugugccugugcaugaucaacuucuaccacggcggccugaagggcguggcccaccuguggcaggaguucgugcuggagaugagauucagaugggagaacaacuuccugauccccggccuggccagcggcccccccgaccugagaugcugccugcugcaccagaagcugcagaugcugaacugcugcaucgagagaaagaaggccagagacgagggcaagaagaccagcgccagcgacgugaccaacaucuaccccggcgacgccggcaaggccggcgaccagcuggugcccgacaaccugaaggagaccgacaaggagaagggcgaggugggcaagagcugggacagcuggagcgacagcgaggaggaguucuucgagugccugagcgacaccgaggagcugaagggcaacggccaggagagcggcaagaagggcggccccaaggagauggccaaccugagacccgagggcagacuguaccagcacggcaagcugacccugcugcacaacggcgagccccuguacauccccgugacccaggagcccgcccccaugaccgaggaccugcuggaggagcagagcgaggugcuggccaagcugggcaccagcgccgagggcgcccaccugagagccagaaugcagagcgccugccugcugagcgacauggagagcuucaaggccgccaaccccggcugcagccuggaggacuucgugagaugguacagccccagagacuacaucgaggaggaggugaucgacgagaagggcaacguggugcugaagggcgagcugagcgccagaaugaagauccccagcaacauguggguggaggccugggagaccgccaagcccauccccgccagaagacagagaagacuguucgacgacaccagagaggccgagaaggugcugcacuaccuggccauccagaagcccgccgaccuggccagacaccugcugcccugcgugauccacgccgccgugcugaaggugaaggaggaggagagccuggagaacaucagcagcgugaagaagaucaucaagcagaucaucagccacagcagcaaggugcugcacuuccccaaccccgaggacaagaagcuggaggagaucauccaccagaucaccaacguggaggcccugaucgccagagccagaagccugaaggccaaguucggcaccgagaagugcgagcaggaggaggagaaggaggaccuggagagauucgugagcugccugcuggagcagcccgaggugcuggugaccggcgccggcagaggccacgccggcagaaucauccacaagcuguucgugaacgcccagagacugaccgagagcagcgacgaggccgccgccaugaccccccccgaggaggagcugaagagaaugggcagccccgaggagagaagacagaacagcgugagcgacuuccccccccccgccggcagagaguucauccugagaaccaccgugcccagacccgcccccuacagcaaggcccugccccagagaauguacagcgugcugaccaaggaggacuucagacuggccggcgccuucagcagcgacaccagcuucuucuaa

SEQ ID NO: 22332 - RNA, 4182 nt, Artificial Sequence
  RAB3GAP2__Homo_sapiens__NP_036546
auggccugcagcaucgugcaguucugcuacuuccaggaccugcaggccgccagagacuuccuguucccccaccugagagaggagauccugagcggcgcccugagaagagaccccagcaagagcaccgacugggaggacgacggcuggggcgccugggaggagaacgagccccaggagcccgaggaggagggcaacaccugcaagacccagaagaccagcuggcugcaggacugcgugcugagccugagccccaccaacgaccugauggugaucgccagagagcagaaggccguguuccuggugcccaaguggaaguacagcgacaagggcaaggaggagaugcaguucgccgugggcuggagcggcagccugaacguggaggagggcgagugcgugaccagcgcccugugcaucccccuggccagccagaagagaagcagcaccggcagacccgacuggaccugcaucguggugggcuucaccagcggcuacgugagauucuacaccgagaacggcgugcugcugcuggcccagcugcugaacgaggaccccgugcugcagcugaagugcagaaccuacgagauccccagacaccccggcgugaccgagcagaacgaggagcugagcauccuguaccccgccgccaucgugaccaucgacggcuucagccuguuccagagccugagagccugcagaaaccagguggccaaggccgccgccagcggcaacgagaacauccagccccccccccuggccuacaagaaguggggccugcaggacaucgacaccaucaucgaccacgccagcgugggcaucaugacccugagccccuucgaccagaugaagaccgccagcaacaucggcggcuucaacgccgccaucaagaacagcccccccgccaugagccaguacaucaccgugggcagcaaccccuucaccggcuucuucuacgcccuggagggcagcacccagccccugcugagccacguggcccuggccguggccagcaagcugaccagcgcccuguucaacgccgccagcggcuggcugggcuggaagagcaagcacgaggaggaggccgugcagaagcagaagcccaagguggagcccgccaccccccuggccgugagauucggccugcccgacagcagaagacacggcgagagcaucugccugagccccugcaacacccuggccgccgugaccgacgacuucggcagagugauccugcuggacguggccagaggcaucgccaucagaauguggaagggcuacagagacgcccagaucggcuggauccagaccguggaggaccugcacgagagagugcccgagaaggccgacuucagccccuucggcaacagccagggccccagcagaguggcccaguuccuggugaucuacgcccccagaagaggcauccuggagguguggagcacccagcagggccccagagugggcgccuucaacgugggcaagcacugcagacugcuguaccccggcuacaagaucaugggccugaacaacgugaccagccagagcuggcagccccagaccuaccagaucugccugguggaccccgugagcggcagcgugaagaccgugaacgugcccuuccaccuggcccugagcgacaagaagagcgagagagccaaggacaugcaccuggugaagaagcuggccgcccugcugaagaccaagagccccaaccuggaccugguggagaccgagaucaaggagcugauccuggacaucaaguaccccgccaccaagaagcaggcccuggagagcauccuggccagcgagagacugcccuucagcugccugagaaacaucacccagacccugauggacacccugaagagccaggagcuggagagcguggacgagggccugcugcaguucugcgccaacaagcugaagcugcugcagcuguacgagagcgugagccagcugaacagccuggacuuccaccuggacacccccuucagcgacaacgaccuggcccugcugcugagacuggacgagaaggagcugcugaagcugcaggcccugcuggagaaguacaagcaggagaacaccagaaccaacgugagauucagcgacgacaaggacggcgugcugcccgugaagaccuuccuggaguaccuggaguacgagaaggacgugcugaacaucaagaagaucagcgaggaggaguacguggcccugggcagcuucuucuucuggaagugccugcacggcgagagcagcaccgaggacaugugccacacccuggagagcgccggccugagcccccagcugcugcugagccugcugcugagcguguggcugagcaaggagaaggacauccuggacaagccccagagcaucugcugccugcacaccaugcugagccugcugagcaagaugaagguggccaucgacgagaccugggacagccagagcgugagccccugguggcagcagaugagaaccgccugcauccagagcgagaacaacggcgccgcccugcugagcgcccacgugggccacagcguggccgcccagaucagcaacaacaugaccgagaagaaguucagccagaccgugcugggcgccgacagcgaggcccugaccgacagcugggaggcccugagccuggacaccgaguacuggaagcugcugcugaagcagcuggaggacugccugauccugcagacccugcugcacagcaagggcaacacccagaccagcaaggugagcagccugcaggccgagccccugcccagacugagcgugaagaagcugcuggagggcggcaagggcggcaucgccgacagcguggccaaguggaucuucaagcaggacuucagccccgaggugcugaagcuggccaacgaggagagagacgccgagaaccccgacgagcccaaggagggcgugaacagaagcuuccuggaggugagcgagauggagauggaccugggcgccauccccgaccugcugcaccuggccuacgagcaguuccccugcagccuggagcuggacgugcugcacgcccacugcugcugggaguacguggugcaguggaacaaggaccccgaggaggccagauucuucgugagaagcaucgagcaccugaagcagaucuucaacgcccacgugcagaacggcaucgcccugaugauguggaacaccuuccuggugaagagauucagcgccgccaccuaccugauggacaaggugggcaagagccccaaggacagacugugcagaagagacgugggcaugagcgacaccgccaugaccagcuuccugggcagcugccuggaccugcugcagauccugauggaggccgacgugagcagagacgagauccaggugcccgugcuggacaccgaggacgccuggcugagcguggagggccccaucagcaucguggagcuggcccuggagcagaagcacauccacuacccccugguggagcaccacagcauccugugcagcauccuguacgccgugaugagauucagccugaagaccgugaagccccugagccuguucgacagcaagggcaagaacgccuucuucaaggaccugaccagcauccagcugcugcccagcggcgagauggaccccaacuucaucagcgugagacagcaguuccugcugaagguggugagcgccgccgugcaggcccagcacagcgccaccaaggugaaggaccccaccgaggaggccacccccacccccuucggcaaggaccaggacuggcccgcccuggccguggaccuggcccaccaccugcaggugagcgaggacguggugagaagacacuacgugggcgagcuguacaacuacggcguggaccaccugggcgaggaggccauccugcaggugcacgacaaggaggugcuggccagccagcugcuggugcugaccggccagagacuggcccacgcccugcugcacacccagaccaaggagggcauggagcugcuggccagacugccccccacccugugcaccuggcugaaggccauggacccccaggaccugcagaacaccgaggugcccaucgccaccaccgccaagcuggugaacaaggugaucgagcugcugcccgagaagcacggccaguacggccuggcccugcaccugaucgaggccguggaggccaucagccugcccagccuguaa

SEQ ID NO: 22333 - RNA, 1071 nt, Artificial Sequence
  RAB3IL1__Homo_sapiens__NP_001258615
auggacagcagcgaggagcacgccggcugccccgccagaggcaccugccccguguuccuggccaugagcgccggcaccgugagauacgcccccagcggccugugccccgugcuggagggcaaccugagagaggagcccuggggcaccgacagccccccccagcccgaccagggccugccccccccccuggccgccgugcccgugcccuggaagagcaccgaccccugccagggccacagagagagccccggcgcccugguggagaccagcgccggcgaggaggcccagggccaggagggccccgccgccgcccagcuggacgugcugagacugagaagcagcagcauggagaucagagagaagggcagcgaguuccugaaggaggagcugcacagagcccagaaggagcugaagcugaaggacgaggagugcgagagacugagcaaggugagagagcagcuggagcaggagcuggaggagcugaccgccagccuguucgaggaggcccacaagauggugagagaggccaacaugaagcaggccgccagcgagaagcagcugaaggaggccagaggcaagguggacaccauccuguucgccgaguuccaggccuggagagagagccccacccuggacaagaccugccccuuccuggagagaguguacagagaggacgugggccccugccuggacuucaccaugcaggagcugagcgugcuggugagagccgccguggaggacaacacccugaccaucgagcccguggccagccagacccugcccaccgugaagguggccgagguggacugcagcagcaccaacaccugcgcccugagcggccugaccagaaccugcagacacagaaucagacugggcgacagcaagagccacuacuacaucagccccagcagcagagccagaaucaccgccgugugcaacuucuucaccuacaucagauacauccagcagggccuggugagacaggacgccgagcccauguucugggagaucaugagacugagaaaggagaugagccuggccaagcugggcuucuucccccaggaggccuaa

SEQ ID NO: 22334 - RNA, 765 nt, Artificial Sequence
  RAB3IP__Homo_sapiens__NP_001019818
auggugagagaggccaacaucaagcaggccaccgccgagaagcagcugaaggaggcccagggcaagaucgacgugcugcaggccgagguggccgcccugaagacccuggugcugagcagcagccccaccagccccacccaggagccccugcccggcggcaagacccccuucaagaagggccacaccagaaacaagagcaccagcagcgccaugagcggcagccaccaggaccugagcgugauccagcccaucgugaaggacugcaaggaggccgaccugagccuguacaacgaguucagacuguggaaggacgagcccaccauggacagaaccugccccuuccuggacaagaucuaccaggaggacaucuuccccugccugaccuucagcaagagcgagcuggccagcgccgugcuggaggccguggagaacaacacccugagcaucgagcccgugggccugcagcccaucagauucgugaaggccagcgccguggagugcggcggccccaagaagugcgcccugaccggccagagcaagagcugcaagcacagaaucaagcugggcgacagcagcaacuacuacuacaucagccccuucugcagauacagaaucaccagcgugugcaacuucuucaccuacaucagauacauccagcagggccuggugaagcagcaggacguggaccagauguucugggaggugaugcagcugagaaaggagaugagccuggccaagcugggcuacuucaaggaggagcuguaa

SEQ ID NO: 22335 - RNA, 837 nt, Artificial Sequence
  RAB40AL__Homo_sapiens__NP_001027004
augagcgcccccggcagccccgaccaggccuacgacuuccugcugaaguuccugcuggugggcgacagagacgugggcaagagcgagauccuggagagccugcaggacggcaccgccgagagccccuacagccaccugggcggcaucgacuacaagaccaccaccauccugcuggacggccagagagugaagcugaagcugugggacaccagcggccagggcagauucugcaccaucuucagaagcuacagcagaggcgcccagggcgugauccugguguacgacaucgccaacagauggagcuucgagggcauggacagauggaucaagaagaucgaggagcacgcccccggcgugcccaagauccuggugggcaacagacugcaccuggccuucaagagacaggugcccagagagcaggcccaggccuacgccgagagacugggcgugaccuucuucgaggugagcccccugugcaacuucaacaucaucgagagcuucaccgagcuggccagaaucgugcugcugagacacagacugaacuggcugggcagacccagcaaggugcugagccugcaggaccugugcugcagaaccaucgugagcugcacccccgugcaccugguggacaagcugccccugcccaucgcccugagaagccaccugaagagcuucagcauggccaagggccugaacgccagaaugaugagaggccugagcuacagccugaccaccagcagcacccacaagagaagcagccugugcaaggugaagaucgugugccccccccagagcccccccaagaacugcaccagaaacagcugcaagaucagcuaa

SEQ ID NO: 22336 - RNA, 837 nt, Artificial Sequence
  RAB40B__Homo_sapiens__NP_006813
augagcgcccugggcagccccgugagagccuacgacuuccugcugaaguuccugcuggugggcgacagcgacgugggcaagggcgagauccuggccagccugcaggacggcgccgccgagagccccuacggccaccccgccggcaucgacuacaagaccaccaccauccugcuggacggcagaagagugaagcugcagcugugggacaccagcggccagggcagauucugcaccaucuucagaagcuacagcagaggcgcccagggcgugauccugguguacgacaucgccaacagauggagcuucgacggcaucgacagauggaucaaggagaucgacgagcacgcccccggcgugcccaagauccuggugggcaacagacugcaccuggccuucaagagacaggugcccaccgagcaggcccaggccuacgccgagagacugggcgugaccuucuucgaggugagcccccugugcaacuucaacaucaccgagagcuucaccgagcuggccagaaucgugcugcugagacacggcauggacagacuguggagacccagcaaggugcugagccugcaggaccugugcugcagagccguggugagcugcacccccgugcaccugguggacaagcugccccugcccaucgcccugagaagccaccugaagagcuucagcauggccaacggccugaacgccagaaugaugcacggcggcagcuacagccugaccaccagcagcacccacaagagaagcagccugagaaaggugaagcuggugagacccccccagagcccccccaagaacugcaccagaaacagcugcaagaucagcuaa

SEQ ID NO: 22337 - RNA, 846 nt, Artificial Sequence
  RAB40C__Homo_sapiens__NP_001166136
augggcagccagggcagccccgugaagagcuacgacuaccugcugaaguuccugcuggugggcgacagcgacgugggcaagggcgagauccuggagagccugcaggacggcgccgccgagagccccuacgccuacagcaacggcaucgacuacaagaccaccaccauccugcuggacggcagaagagugaagcuggagcugugggacaccagcggccagggcagauucugcaccaucuucagaagcuacagcagaggcgcccagggcauccugcugguguacgacaucaccaacagauggagcuucgacggcaucgacagauggaucaaggagaucgacgagcacgcccccggcgugcccagaauccuggugggcaacagacugcaccuggccuucaagagacaggugcccaccgagcaggccagagccuacgccgagaagaacugcaugaccuucuucgaggugagcccccugugcaacuucaacgugaucgagagcuucaccgagcugagcagaaucgugcugaugagacacggcauggagaagaucuggagacccaacagaguguucagccugcaggaccugugcugcagagccaucgugagcugcacccccgugcaccugaucgacaagcugccccugcccgugaccaucaagagccaccugaagagcuucagcauggccaacggcaugaacgccgugaugaugcacggcagaagcuacagccuggccagcggcgccggcggcggcggcagcaagggcaacagccugaagagaagcaagagcaucagacccccccagagccccccccagaacugcagcagaagcaacugcaagaucagcuaa

SEQ ID NO: 22338 - RNA, 657 nt, Artificial Sequence
  RAB4A__Homo_sapiens__NP_004569
augagccagaccgccaugagcgagaccuacgacuuccuguucaaguuccuggugaucggcaacgccggcaccggcaagagcugccugcugcaccaguucaucgagaagaaguucaaggacgacagcaaccacaccaucggcguggaguucggcagcaagaucaucaacgugggcggcaaguacgugaagcugcagaucugggacaccgccggccaggagagauucagaagcgugaccagaagcuacuacagaggcgccgccggcgcccugcugguguacgacaucaccagcagagagaccuacaacgcccugaccaacuggcugaccgacgccagaaugcuggccagccagaacaucgugaucauccugugcggcaacaagaaggaccuggacgccgacagagaggugaccuuccuggaggccagcagauucgcccaggagaacgagcugauguuccuggagaccagcgcccugaccggcgagaacguggaggaggccuucgugcagugcgccagaaagauccugaacaagaucgagagcggcgagcuggaccccgagagaaugggcagcggcauccaguacggcgacgccgcccugagacagcugagaagccccagaagagcccaggcccccaacgcccaggagugcggcugcuaa

SEQ ID NO: 22339 - RNA, 642 nt, Artificial Sequence
  RAB4B__Homo_sapiens__NP_057238
auggccgagaccuacgacuuccuguucaaguuccuggugaucggcagcgccggcaccggcaagagcugccugcugcaccaguucaucgagaacaaguucaagcaggacagcaaccacaccaucggcguggaguucggcagcagaguggugaacgugggcggcaagaccgugaagcugcagaucugggacaccgccggccaggagagauucagaagcgugaccagaagcuacuacagaggcgccgccggcgcccugcugguguacgacaucaccagcagagagaccuacaacagccuggccgccuggcugaccgacgccagaacccuggccagccccaacaucguggugauccugugcggcaacaagaaggaccuggaccccgagagagaggugaccuuccuggaggccagcagauucgcccaggagaacgagcugauguuccuggagaccagcgcccugaccggcgagaacguggaggaggccuuccugaagugcgccagaaccauccugaacaagaucgacagcggcgagcuggaccccgagagaaugggcagcggcauccaguacggcgacgccagccugagacagcugagacagcccagaagcgcccaggccguggccccccagcccugcggcugcuaa

SEQ ID NO: 22340 - RNA, 606 nt, Artificial Sequence
  RAB5A__Homo_sapiens__NP_001278977
auggccagcagaggcgccaccagacccaacggccccaacaccggcaacaagaucugccaguucaagcuggugcugcugggcgagagcgccgugggcaagagcagccuggugcugagauucgugaagggccaguuccacgaguuccaggagagcaccaucggcgugaaguucgagaucugggacaccgccggccaggagagauaccacagccuggcccccauguacuacagaggcgcccaggccgccaucgugguguacgacaucaccaacgaggagagcuucgccagagccaagaacugggugaaggagcugcagagacaggccagccccaacaucgugaucgcccugagcggcaacaaggccgaccuggccaacaagagagccguggacuuccaggaggcccagagcuacgccgacgacaacagccugcuguucauggagaccagcgccaagaccagcaugaacgugaacgagaucuucauggccaucgccaagaagcugcccaagaacgagccccagaaccccggcgccaacagcgccagaggcagaggcguggaccugaccgagcccacccagcccaccagaaaccagugcugcagcaacuaa

SEQ ID NO: 22341 - RNA, 525 nt, Artificial Sequence
  RAB5B__Homo_sapiens__NP_001238966
augaccagcagaagcaccgccagacccaacggccagccccaggccagcaagaucugccaguucaagcuggugcugcugggcgagagcgccgugggcaagagcagccuggugcugagauucgugaagggccaguuccacgaguaccaggagagcaccaucggcgccgccuuccugacccagagcgugugccuggacgacaccaccgugaaguucgagaucugggacaccgccggccaggagagauaccacagccuggcccccauguacuacagaggcgcccaggccgccaucgugguguacgacaucaccaaccaggaggcccaggccuacgccgacgacaacagccugcuguucauggagaccagcgccaagaccgccaugaacgugaacgaccuguuccuggccaucgccaagaagcugcccaagagcgagccccagaaccugggcggcgccgccggcagaagcagaggcguggaccugcacgagcagagccagcagaacaagagccagugcugcagcaacuaa

SEQ ID NO: 22342 - RNA, 750 nt, Artificial Sequence
  RAB5C__Homo_sapiens__NP_001238968
auggagcugagcuggagaagccccagcccccugagcgccagccugcacagcaccagcccccacccccacgcccuguggaccaccaccgccggcagagccauggccggcagaggcggcgccgccagacccaacggccccgccgccggcaacaagaucugccaguucaagcuggugcugcugggcgagagcgccgugggcaagagcagccuggugcugagauucgugaagggccaguuccacgaguaccaggagagcaccaucggcgccgccuuccugacccagaccgugugccuggacgacaccaccgugaaguucgagaucugggacaccgccggccaggagagauaccacagccuggcccccauguacuacagaggcgcccaggccgccaucgugguguacgacaucaccaacaccgacaccuucgccagagccaagaacugggugaaggagcugcagagacaggccagccccaacaucgugaucgcccuggccggcaacaaggccgaccuggccagcaagagagccguggaguuccaggaggcccaggccuacgccgacgacaacagccugcuguucauggagaccagcgccaagaccgccaugaacgugaacgagaucuucauggccaucgccaagaagcugcccaagaacgagccccagaacgccaccggcgcccccggcagaaacagaggcguggaccugcaggagaacaaccccgccagcagaagccagugcugcagcaacuaa

SEQ ID NO: 22343 - RNA, 315 nt, Artificial Sequence
  RAB6A__Homo_sapiens__NP_001230647
augagcaccggcggcgacuucggcaacccccugagaaaguucaagcugguguuccugggcgagcagagcgugggcaagaccagccugaucaccagauucauguacgacagcuucgacaacaccuaccaggccaccaucggcaucgacuuccugagcaagaccauguaccuggaggacagaacccuguucagaagaguggccgccgcccugcccggcauggagagcacccaggacagaagcagagaggacaugaucgacaucaagcuggagaagccccaggagcagcccgugagcgagggcggcugcagcugcuaa

SEQ ID NO: 22344 - RNA, 627 nt, Artificial Sequence
  RAB6B__Homo_sapiens__NP_057661
augagcgccggcggcgacuucggcaacccccugagaaaguucaagcugguguuccugggcgagcagagcgugggcaagaccagccugaucaccagauucauguacgacagcuucgacaacaccuaccaggccaccaucggcaucgacuuccugagcaagaccauguaccuggaggacagaaccgugagacugcagcugugggacaccgccggccaggagagauucagaagccugauccccagcuacaucagagacagcaccguggccguggugguguacgacaucaccaaccugaacagcuuccagcagaccagcaaguggaucgacgacgugagaaccgagagaggcagcgacgugaucaucaugcuggugggcaacaagaccgaccuggccgacaagagacagaucaccaucgaggagggcgagcagagagccaaggagcugagcgugauguucaucgagaccagcgccaagaccggcuacaacgugaagcagcuguucagaagaguggccagcgcccugcccggcauggagaacgugcaggagaagagcaaggagggcaugaucgacaucaagcuggacaagccccaggagccccccgccagcgagggcggcugcagcugcuaa

SEQ ID NO: 22345 - RNA, 765 nt, Artificial Sequence
  RAB6C__Homo_sapiens__NP_115520
augagcgccggcggcgacuucggcaacccccugagaaaguucaagcugguguuccugggcgagcagagcguggccaagaccagccugaucaccagauucagauacgacagcuucgacaacaccuaccaggccaucaucggcaucgacuuccugagcaagaccauguaccuggaggacggcaccaucggccugagacugugggacaccgccggccaggagagacugagaagccugauccccagauacaucagagacagcgccgccgccguggugguguacgacaucaccaacgugaacagcuuccagcagaccaccaaguggaucgacgacgugagaaccgagagaggcagcgacgugaucaucacccuggugggcaacagaaccgaccuggccgacaagagacaggugagcguggaggagggcgagagaaaggccaagggccugaacgugaccuucaucgagaccagagccaaggccggcuacaacgugaagcagcuguucagaagaguggccgccgcccugcccggcauggagagcacccaggacggcagcagagaggacaugagcgacaucaagcuggagaagccccaggagcagaccgugagcgagggcggcugcagcugcuacagccccaugagcagcagcacccugccccagaagccccccuacagcuucaucgacugcagcgugaacaucggccugaaccuguuccccagccugaucaccuucugcaacagcagccugcugcccgugagcuggagauaa

SEQ ID NO: 22346 - RNA, 624 nt, Artificial Sequence
  RAB7A__Homo_sapiens__NP_004628
augaccagcagaaagaaggugcugcugaaggugaucauccugggcgacagcggcgugggcaagaccagccugaugaaccaguacgugaacaagaaguucagcaaccaguacaaggccaccaucggcgccgacuuccugaccaaggaggugaugguggacgacagacuggugaccaugcagaucugggacaccgccggccaggagagauuccagagccugggcguggccuucuacagaggcgccgacugcugcgugcugguguucgacgugaccgcccccaacaccuucaagacccuggacagcuggagagacgaguuccugauccaggccagccccagagaccccgagaacuuccccuucguggugcugggcaacaagaucgaccuggagaacagacagguggccaccaagagagcccaggccuggugcuacagcaagaacaacauccccuacuucgagaccagcgccaaggaggccaucaacguggagcaggccuuccagaccaucgccagaaacgcccugaagcaggagaccgagguggagcuguacaacgaguuccccgagcccaucaagcuggacaagaacgacagagccaaggccagcgccgagagcugcagcugcuaa

SEQ ID NO: 22347 - RNA, 624 nt, Artificial Sequence
  RAB8A__Homo_sapiens__NP_005361
auggccaagaccuacgacuaccuguucaagcugcugcugaucggcgacagcggcgugggcaagaccugcgugcuguucagauucagcgaggacgccuucaacagcaccuucaucagcaccaucggcaucgacuucaagaucagaaccaucgagcuggacggcaagagaaucaagcugcagaucugggacaccgccggccaggagagauucagaaccaucaccaccgccuacuacagaggcgccaugggcaucaugcugguguacgacaucaccaacgagaagagcuucgacaacaucagaaacuggaucagaaacaucgaggagcacgccagcgccgacguggagaagaugauccugggcaacaagugcgacgugaacgacaagagacaggugagcaaggagagaggcgagaagcuggcccuggacuacggcaucaaguucauggagaccagcgccaaggccaacaucaacguggagaacgccuucuucacccuggccagagacaucaaggccaagauggacaagaagcuggagggcaacagcccccagggcagcaaccagggcgugaagaucacccccgaccagcagaagagaagcagcuucuucagaugcgugcugcuguaa

SEQ ID NO: 22348 - RNA, 624 nt, Artificial Sequence
  RAB8B__Homo_sapiens__NP_057614
auggccaagaccuacgacuaccuguucaagcugcugcugaucggcgacagcggcgugggcaagaccugccugcuguucagauucagcgaggacgccuucaacaccaccuucaucagcaccaucggcaucgacuucaagaucagaaccaucgagcuggacggcaagaagaucaagcugcagaucugggacaccgccggccaggagagauucagaaccaucaccaccgccuacuacagaggcgccaugggcaucaugcugguguacgacaucaccaacgagaagagcuucgacaacaucaagaacuggaucagaaacaucgaggagcacgccagcagcgacguggagagaaugauccugggcaacaagugcgacaugaacgacaagagacaggugagcaaggagagaggcgagaagcuggccaucgacuacggcaucaaguuccuggagaccagcgccaagagcagcgccaacguggaggaggccuucuucacccuggccagagacaucaugaccaagcugaacagaaagaugaacgacagcaacagcgccggcgccggcggccccgugaagaucaccgagaacagaagcaagaagaccagcuucuucagaugcagccugcuguaa

SEQ ID NO: 22349 - RNA, 606 nt, Artificial Sequence
  RAB9A__Homo_sapiens__NP_001182257
auggccggcaagagcagccuguucaaggugauccugcugggcgacggcggcgugggcaagagcagccugaugaacagauacgugaccaacaaguucgacacccagcuguuccacaccaucggcguggaguuccugaacaaggaccuggagguggacggccacuucgugaccaugcagaucugggacaccgccggccaggagagauucagaagccugagaacccccuucuacagaggcagcgacugcugccugcugaccuucagcguggacgacagccagagcuuccagaaccugagcaacuggaagaaggaguucaucuacuacgccgacgugaaggagcccgagagcuuccccuucgugauccugggcaacaagaucgacaucagcgagagacaggugagcaccgaggaggcccaggccuggugcagagacaacggcgacuaccccuacuucgagaccagcgccaaggacgccaccaacguggccgccgccuucgaggaggccgugagaagagugcuggccaccgaggacagaagcgaccaccugauccagaccgacaccgugaaccugcacagaaagcccaagcccagcagcagcugcugcuaa

SEQ ID NO: 22350 - RNA, 558 nt, Artificial Sequence
  RABAC1__Homo_sapiens__NP_006414
auggccgcccagaaggaccagcagaaggacgccgaggccgagggccugagcggcaccacccugcugcccaagcugauccccagcggcgccggcagagaguggcuggagagaagaagagccaccaucagacccuggagcaccuucguggaccagcagagauucagcagacccagaaaccugggcgagcugugccagagacuggugagaaacguggaguacuaccagagcaacuacguguucguguuccugggccugauccuguacugcguggugaccagccccaugcugcugguggcccuggccguguucuucggcgccugcuacauccuguaccugagaacccuggagagcaagcuggugcuguucggcagagaggugagccccgcccaccaguacgcccuggccggcggcaucagcuuccccuucuucuggcuggccggcgccggcagcgccguguucugggugcugggcgccacccugguggugaucggcagccacgccgccuuccaccagaucgaggccguggacggcgaggagcugcagauggagcccguguaa

SEQ ID NO: 22351 - RNA, 2490 nt, Artificial Sequence
  RABEP1__Homo_sapiens__NP_001077054
auggcccagcccggccccgccagccagcccgacgugagccugcagcagagaguggccgagcuggagaagaucaacgccgaguuccugagagcccagcagcagcuggagcaggaguucaaccagaagagagccaaguucaaggagcuguaccuggccaaggaggaggaccugaagagacagaacgccgugcugcaggccgcccaggacgaccugggccaccugagaacccagcugugggaggcccaggccgagauggagaacaucaaggccaucgccaccgugagcgagaacaccaagcaggaggccaucgacgaggugaagagacaguggagagaggagguggccagccugcaggccgugaugaaggagaccgugagagacuacgagcaccaguuccaccugagacuggagcaggagagaacccagugggcccaguacagagagagcgccgagagagagaucgccgaccugagaagaagacugagcgagggccaggaggaggagaaccuggagaacgagaugaagaaggcccaggaggacgccgagaagcugagaagcguggugaugcccauggagaaggagaucgccgcccugaaggacaagcugaccgaggccgaggacaagaucaaggagcuggaggccagcaaggugaaggagcugaaccacuaccuggaggccgagaagagcugcagaaccgaccuggagauguacguggccgugcugaacacccagaagagcgugcugcaggaggacgccgagaagcugagaaaggagcugcacgaggugugccaccugcuggagcaggagagacagcagcacaaccagcugaagcacaccuggcagaaggccaacgaccaguuccuggagagccagagacugcugaugagagacaugcagagaauggagaucgugcugaccagcgagcagcugagacagguggaggagcugaagaagaaggaccaggaggacgacgagcagcagagacugaacaagagaaaggaccacaagaaggccgacguggaggaggagaucaagauccccguggugugcgcccugacccaggaggagagcagcgcccagcugagcaacgaggaggagcaccuggacagcaccagaggcagcgugcacagccuggacgccggccugcugcugcccagcggcgaccccuucagcaagagcgacaacgacauguucaaggacggccugagaagagcccagagcaccgacagccugggcaccagcggcagccugcagagcaaggcccugggcuacaacuacaaggccaagagcgccggcaaccuggacgagagcgacuucggcccccuggugggcgccgacagcgugagcgagaacuucgacaccgccagccugggcagccugcagaugcccagcggcuucaugcugaccaaggaccaggagagagccaucaaggccaugacccccgagcaggaggagaccgccagccugcugagcagcgugacccagggcauggagagcgccuacgugagccccagcggcuacagacuggugagcgagaccgaguggaaccugcugcagaaggaggugcacaacgccggcaacaagcugggcagaagaugcgacaugugcagcaacuacgagaagcagcugcagggcauccagauccaggaggccgagaccagagaccaggugaagaagcugcagcugaugcugagacaggccaacgaccagcuggagaagaccaugaaggacaagcaggagcuggaggacuucaucaagcagagcagcgaggacagcagccaccagaucagcgcccuggugcugagagcccaggccagcgagauccugcuggaggagcugcagcagggccugagccaggccaagagagacgugcaggagcagauggccgugcugaugcagagcagagagcaggugagcgaggagcuggugagacugcagaaggacaacgacagccugcagggcaagcacagccugcacgugagccugcagcaggccgaggacuucauccugcccgacaccaccgaggcccugagagagcuggugcugaaguacagagaggacaucaucaacgugagaaccgccgccgaccacguggaggagaagcugaaggccgagauccuguuccugaaggagcagauccaggccgagcagugccugaaggagaaccuggaggagacccugcagcuggagaucgagaacugcaaggaggagaucgccagcaucagcagccugaaggccgagcuggagagaaucaagguggagaagggccaggccaccguggagcagcugauguucgaggagaagaacaaggcccagagacugcagaccgagcuggacgugagcgagcaggugcagagagacuucgugaagcugagccagacccugcaggugcagcuggagagaaucagacaggccgacagccuggagagaaucagagccauccugaacgacaccaagcugaccgacaucaaccagcugcccgagaccuaa

SEQ ID NO: 22352 - RNA, 1710 nt, Artificial Sequence
  RABEP2__Homo_sapiens__NP_079092
auggccgccgccgcccccguggccgccgacgacgacgagagaagaagaagacccggcgccgcccuggaggacagcagaagccaggagggcgccaacggcgaggccgagagcggcgagcugagcagacugagagccgagcuggccggcgcccuggccgagauggagaccaugaaggccguggccgaggugagcgagagcaccaaggccgaggccguggccgccgugcagagacagugccaggaggagguggccagccugcaggccauccugaaggacagcaucagcagcuacgaggcccagaucaccgcccugaagcaggagagacagcagcagcagcaggacugcgaggagaaggagagagagcugggcagacugaagcagcugcugagcagagccuacccccuggacagccuggagaagcagauggagaaggcccacgaggacagcgagaagcugagagagaucgugcugcccauggagaaggagaucgaggagcugaaggccaagcugcugagagccgaggagcugauccaggagauccagagaagacccagacacgcccccagccugcacggcagcaccgagcugcugccccugagcagagaccccagccccccccuggagccccuggaggagcugagcggcgacggcggccccgccgccgaggccuucgcccacaacugcgacgacagcgccagcaucagcagcuucagccugggcggcggcgugggcagcagcagcagccugccccagagcagacagggccugagccccgagcaggaggagaccgccagccuggugagcaccggcacccuggugcccgagggcaucuaccugcccccccccggcuaccagcuggugcccgacacccagugggagcagcugcagaccgagggcagacagcugcagaaggaccuggagagcgugagcagagagagagacgagcugcaggagggccugagaagaagcaacgaggacugcgccaagcagaugcaggugcugcuggcccaggugcagaacagcgagcagcugcugagaacccugcagggcaccgugagccaggcccaggagagagugcagcugcagauggccgagcuggugaccacccacaagugccugcaccacgaggugaagagacugaacgaggagaaccagggccugagagccgagcagcugcccagcagcgccccccagggcagccagcaggagcagggcgaggaggagagccugcccagcagcgugcccgagcugcagcagcugcugugcugcaccagacaggaggccagagccagacugcaggcccaggagcacggcgccgagagacugagaaucgagaucgugacccugagagaggcccuggaggaggagaccguggccagagccagccuggagggccagcugagagugcagagagaggagaccgaggugcuggaggccagccugugcagccugagaaccgagauggagagagugcagcaggagcagagcaaggcccagcugcccgaccugcugagcgagcagagagccaaggugcugagacugcaggccgagcuggagaccagcgagcaggugcagagagacuucgugagacugagccaggcccugcaggugagacuggagagaaucagacaggccgagacccuggagcaggugagaagcaucauggacgaggccccccugaccgacgugagagacaucaaggacaccuaa

SEQ ID NO: 22353 - RNA, 1119 nt, Artificial Sequence
  RABEPK__Homo_sapiens__NP_001167623
augaagcagcugcccgugcuggagcccggcgacaagcccagaaaggccaccugguacacccugaccgugcccggcgacagccccugcgccagagugggccacagcugcagcuaccugccccccgugggcaacgccaagagaggcaagguguucaucgugggcggcgccaaccccaacagaagcuucagcgacgugcacaccauggaccugggcaagcaccagugggaccuggacaccugcaagggccugcugcccagauacgagcacgccagcuucauccccagcugcacccccgacagaaucuggguguucggcggcgccaaccagagcggcaacagaaacugccugcaggugcugaaccccgagaccagaaccuggaccacccccgaggugaccagccccccccccagccccagaaccuuccacaccagcagcgccgccaucggcaaccagcuguacguguucggcggcggcgagagaggcgcccagcccgugcaggacaccaagcugcacguguucgacgccaacacccugaccuggagccagcccgagacccugggcaacccccccagccccagacacggccacgugaugguggccgccggcaccaagcuguucauccacggcggccuggccggcgacagauucuacgacgaccugcacugcaucgacaucagcgacaugaaguggcagaagcugaaccccaccggcgccgcccccgccggcugcgccgcccacagcgccguggccaugggcaagcacguguacaucuucggcggcaugacccccgccggcgcccuggacaccauguaccaguaccacaccgaggagcagcacuggacccugcugaaguucgacacccugcugccccccggcagacuggaccacagcaugugcaucauccccuggcccgugaccugcgccagcgagaaggaggacagcaacagccugacccugaaccacgaggccgagaaggaggacagcgccgacaaggugaugagccacagcggcgacagccacgaggagagccagaccgccacccugcugugccugguguucggcggcaugaacaccgagggcgagaucuacgacgacugcaucgugaccgugguggacuaa

SEQ ID NO: 22354 - RNA, 219 nt, Artificial Sequence
  RABGAP1L__Homo_sapiens__NP_001230692
augauggaggagaucagcaucaugguggccuacgacgcccacguguucagccagcugcacgacgaggacuuccugaccagccugguggccaucagcaagcccagaagcauggugcccaccaagaagcugaagaaguacgagaaggaguaccagaccaugagagagagccagcugcagcaggaggaccccauggacagauacaaguucguguaccuguaa

SEQ ID NO: 22355 - RNA, 900 nt, Artificial Sequence
  RABGEF1__Homo_sapiens__NP_001273989
augcagaccagaggcaaggugccccccgagagaguggagaagaucauggaccagaucgagaaguacaucaugaccagacuguacaaguacguguucugccccgagaccaccgacgacgagaagaaggaccuggccauccagaagagaaucagagcccugagaugggugaccccccagaugcugugcgugcccgugaacgaggacauccccgaggugagcgacaugguggugaaggccaucaccgacaucaucgagauggacagcaagagagugcccagagacaagcuggccugcaucaccaagugcagcaagcacaucuucaacgccaucaagaucaccaagaacgagcccgccagcgccgacgacuuccugcccacccugaucuacaucgugcugaagggcaacccccccagacugcagagcaacauccaguacaucaccagauucugcaaccccagcagacugaugaccggcgaggacggcuacuacuucaccaaccugugcugcgccguggccuucaucgagaagcuggacgcccagagccugaaccugagccaggaggacuucgacagauacaugagcggccagaccagccccagaaagcaggaggccgagagcuggagccccgacgccugccugggcgugaagcagauguacaagaaccuggaccugcugagccagcugaacgagagacaggagagaaucaugaacgaggccaagaagcuggagaaggaccugaucgacuggaccgacggcaucgccagagaggugcaggacaucguggagaaguacccccuggagaucaagccccccaaccagccccuggccgccaucgacagcgagaacguggagaacgacaagcugccccccccccugcagccccagguguacgccggcuaa

SEQ ID NO: 22356 - RNA, 372 nt, Artificial Sequence
  RABIF__Homo_sapiens__NP_002862
auggagcccgccgagcagcccagcgagcuggugagcgccgagggcagaaacagaaaggccgugcugugccagagaugcggcagcagagugcugcagcccggcaccgcccuguucagcagaagacagcuguuccugcccagcaugagaaagaagcccgcccugagcgacggcagcaaccccgacggcgaccugcugcaggagcacuggcugguggaggacauguucaucuucgagaacgugggcuucaccaaggacgugggcaacaucaaguuccuggugugcgccgacugcgagaucggccccaucggcuggcacugccuggacgacaagaacagcuucuacguggcccuggagagagugagccacgaguaa

SEQ ID NO: 22357 - RNA, 2193 nt, Artificial Sequence
  RABL6__Homo_sapiens__NP_001167459
auguucagcgcccugaagaagcuggugggcagcgaccaggcccccggcagagacaagaacauccccgccggccugcagagcaugaaccaggcccugcagagaagauucgccaagggcgugcaguacaacaugaagaucgugaucagaggcgacagaaacaccggcaagaccgcccuguggcacagacugcagggcagacccuucguggaggaguacauccccacccaggagauccaggugaccagcauccacuggagcuacaagaccaccgacgacaucgugaagguggaggugugggacgugguggacaagggcaagugcaagaagagaggcgacggccugaagauggagaacgacccccaggaggccgagagcgagauggcccuggacgccgaguuccuggacguguacaagaacugcaacggcguggugaugauguucgacaucaccaagcaguggaccuucaacuacauccugagagagcugcccaaggugcccacccacgugcccgugugcgugcugggcaacuacagagacaugggcgagcacagagugauccugcccgacgacgugagagacuucaucgacaaccuggacagcagaccccccggcagcagcuacuucagauacgccgagagcagcaugaagaacagcuucggccugaaguaccugcacaaguucuucaacauccccuuccugcagcugcagagagagacccugcugagacagcuggagaccaaccagcuggacauggacgccacccuggaggagcugagcgugcagcaggagaccgaggaccagaacuacggcaucuuccuggagaugauggaggccagaagcagaggccacgccagcccccuggccgccaacggccagagccccagccccggcagccagagccccguggugcccgccggcgccgugagcaccggcagcagcagccccggcaccccccagcccgccccccagcugccccugaacgccgccccccccagcagcgugccccccgugccccccagcgaggcccugcccccccccgccugccccagcgcccccgcccccagaagaagcaucaucagcagacuguucggcaccagccccgccaccgaggccgccccccccccccccgagcccgugcccgccgccgagggccccgccaccgugcagagcguggaggacuucgugcccgacgacagacuggacagaagcuuccuggaggacaccacccccgccagagacgagaagaaggugggcgccaaggccgcccagcaggacagcgacagcgacggcgaggcccugggcggcaaccccaugguggccggcuuccaggacgacguggaccuggaggaccagcccagaggcagccccccccugcccgccggccccgugcccagccaggacaucacccugagcagcgaggaggaggccgagguggccgcccccaccaagggccccgcccccgccccccagcagugcagcgagcccgagaccaaguggagcagcauccccgccagcaagcccagaagaggcaccgcccccaccagaaccgccgccccccccuggcccggcggcgugagcgugagaaccggccccgagaagagaagcagcaccagaccccccgccgagauggagcccggcaagggcgagcaggccagcagcagcgagagcgaccccgagggccccaucgccgcccagaugcugagcuucgugauggacgaccccgacuucgagagcgagggcagcgacacccagagaagagccgacgacuuccccgugagagacgaccccagcgacgugaccgacgaggacgagggccccgccgagcccccccccccccccaagcugccccugcccgccuucagacugaagaacgacagcgaccuguucggccugggccuggaggaggccggccccaaggagagcagcgaggagggcaaggagggcaagacccccagcaaggagaagaagaagaagaagaagaagggcaaggaggaggaggagaaggccgccaagaagaagagcaagcacaagaagagcaaggacaaggaggagggcaaggaggagagaagaagaagacagcagagaccccccagaagcagagagagaaccgccgccgacgagcuggaggccuuccugggcggcggcgcccccggcggcagacaccccggcggcggcgacuacgaggagcuguaa

SEQ ID NO: 22358 - RNA, 579 nt, Artificial Sequence
  RAC1__Homo_sapiens__NP_008839
augcaggccaucaagugcgugguggugggcgacggcgccgugggcaagaccugccugcugaucagcuacaccaccaacgccuuccccggcgaguacauccccaccguguucgacaacuacagcgccaacgugaugguggacggcaagcccgugaaccugggccugugggacaccgccggccaggaggacuacgacagacugagaccccugagcuacccccagaccgacguguuccugaucugcuucagccuggugagccccgccagcuucgagaacgugagagccaagugguaccccgaggugagacaccacugccccaacacccccaucauccuggugggcaccaagcuggaccugagagacgacaaggacaccaucgagaagcugaaggagaagaagcugacccccaucaccuacccccagggccuggccauggccaaggagaucggcgccgugaaguaccuggagugcagcgcccugacccagagaggccugaagaccguguucgacgaggccaucagagccgugcugugccccccccccgugaagaagagaaagagaaagugccugcugcuguaa

SEQ ID NO: 22359 - RNA, 579 nt, Artificial Sequence
  RAC2__Homo_sapiens__NP_002863
augcaggccaucaagugcgugguggugggcgacggcgccgugggcaagaccugccugcugaucagcuacaccaccaacgccuuccccggcgaguacauccccaccguguucgacaacuacagcgccaacgugaugguggacagcaagcccgugaaccugggccugugggacaccgccggccaggaggacuacgacagacugagaccccugagcuacccccagaccgacguguuccugaucugcuucagccuggugagccccgccagcuacgagaacgugagagccaagugguuccccgaggugagacaccacugccccagcacccccaucauccuggugggcaccaagcuggaccugagagacgacaaggacaccaucgagaagcugaaggagaagaagcuggcccccaucaccuacccccagggccuggcccuggccaaggagaucgacagcgugaaguaccuggagugcagcgcccugacccagagaggccugaagaccguguucgacgaggccaucagagccgugcugugcccccagcccaccagacagcagaagagagccugcagccugcuguaa

SEQ ID NO: 22360 - RNA, 579 nt, Artificial Sequence
  RAC3__Homo_sapiens__NP_005043
augcaggccaucaagugcgugguggugggcgacggcgccgugggcaagaccugccugcugaucagcuacaccaccaacgccuuccccggcgaguacauccccaccguguucgacaacuacagcgccaacgugaugguggacggcaagcccgugaaccugggccugugggacaccgccggccaggaggacuacgacagacugagaccccugagcuacccccagaccgacguguuccugaucugcuucagccuggugagccccgccagcuucgagaacgugagagccaagugguaccccgaggugagacaccacugcccccacacccccauccugcuggugggcaccaagcuggaccugagagacgacaaggacaccaucgagagacugagagacaagaagcuggcccccaucaccuacccccagggccuggccauggccagagagaucggcagcgugaaguaccuggagugcagcgcccugacccagagaggccugaagaccguguucgacgaggccaucagagccgugcugugccccccccccgugaagaagcccggcaagaagugcaccguguucuaa

SEQ ID NO: 22361 - RNA, 1935 nt, Artificial Sequence
  RACGAP1__Homo_sapiens__NP_001306935
augagcugccccugcuucugccccguggcccugagaauggacaccaugaugcugaacgugagaaaccuguucgagcagcuggugagaagaguggagauccugagcgagggcaacgaggugcaguucauccagcuggccaaggacuucgaggacuucagaaagaaguggcagagaaccgaccacgagcugggcaaguacaaggaccugcugaugaaggccgagaccgagagaagcgcccuggacgugaagcugaagcacgccagaaaccagguggacguggagaucaagagaagacagagagccgaggccgacugcgagaagcuggagagacagauccagcugaucagagagaugcugaugugcgacaccagcggcagcauccagcugagcgaggagcagaagagcgcccuggccuuccugaacagaggccagcccagcagcagcaacgccggcaacaagagacugagcaccaucgacgagagcggcagcauccugagcgacaucagcuucgacaagaccgacgagagccuggacugggacagcagccuggugaagaccuucaagcugaagaagagagagaagagaagaagcaccagcagacaguucguggacggcccccccggccccgugaagaagaccagaagcaucggcagcgccguggaccagggcaacgagagcaucguggccaagaccaccgugaccgugcccaacgacggcggccccaucgaggccgugagcaccaucgagaccgugcccuacuggaccagaagcagaagaaagaccggcacccugcagcccuggaacagcgacagcacccugaacagcagacagcuggagcccagaaccgagaccgacagcgugggcaccccccagagcaacggcggcaugagacugcacgacuucgugagcaagaccgugaucaagcccgagagcugcgugcccugcggcaagagaaucaaguucggcaagcugagccugaagugcagagacugcagaguggugagccaccccgagugcagagacagaugcccccugcccugcauccccacccugaucggcacccccgugaagaucggcgagggcaugcuggccgacuucgugagccagaccagccccaugauccccagcaucguggugcacugcgugaacgagaucgagcagagaggccugaccgagaccggccuguacagaaucagcggcugcgacagaaccgugaaggagcugaaggagaaguuccugagagugaagaccgugccccugcugagcaagguggacgacauccacgccaucugcagccugcugaaggacuuccugagaaaccugaaggagccccugcugaccuucagacugaacagagccuucauggaggccgccgagaucaccgacgaggacaacagcaucgccgccauguaccaggccgugggcgagcugccccaggccaacagagacacccuggccuuccugaugauccaccugcagagaguggcccagagcccccacaccaagauggacguggccaaccuggccaagguguucggccccaccaucguggcccacgccgugcccaaccccgaccccgugaccaugcugcaggacaucaagagacagcccaaggugguggagagacugcugagccugccccuggaguacuggagccaguucaugaugguggagcaggagaacaucgacccccugcacgugaucgagaacagcaacgccuucagcaccccccagacccccgacaucaaggugagccugcugggccccgugaccacccccgagcaccagcugcugaagacccccagcagcagcagccugagccagagagugagaagcacccugaccaagaacacccccagauucggcagcaagagcaagagcgccaccaaccugggcagacagggcaacuucuucgccagccccaugcugaaguaa

SEQ ID NO: 22362 - RNA, 2046 nt, Artificial Sequence
  RAD17__Homo_sapiens__NP_579917
augagcaagaccuuccugagacccaaggugagcagcaccaaggugaccgacuggguggaccccagcuucgacgacuuccuggagugcagcggcgugagcaccaucaccgccaccagccugggcgugaacaacagcagccacagaagaaagaacggccccagcacccuggagagcagcagauuccccgccagaaagagaggcaaccugagcagccuggagcagaucuacggccuggagaacagcaaggaguaccugagcgagaacgagcccuggguggacaaguacaagcccgagacccagcacgagcuggccgugcacaagaagaagaucgaggagguggagaccuggcugaaggcccaggugcuggagagacagcccaagcagggcggcagcauccugcugaucaccggcccccccggcugcggcaagaccaccacccugaagauccugagcaaggagcacggcauccaggugcaggaguggaucaaccccgugcugcccgacuuccagaaggacgacuucaagggcauguucaacaccgagagcagcuuccacauguuccccuaccagagccagaucgccguguucaaggaguuccugcugagagccaccaaguacaacaagcugcagaugcugggcgacgaccugagaaccgacaagaagaucauccugguggaggaccugcccaaccaguucuacagagacagccacacccugcacgaggugcugagaaaguacgugagaaucggcagaugcccccugaucuucaucaucagcgacagccugagcggcgacaacaaccagagacugcuguuccccaaggagauccaggaggagugcagcaucagcaacaucagcuucaaccccguggcccccaccaucaugaugaaguuccugaacagaaucgugaccaucgaggccaacaagaacggcggcaagaucaccgugcccgacaagaccagccuggagcugcugugccagggcugcagcggcgacaucagaagcgccaucaacagccugcaguucagcagcagcaagggcgagaacaaccugagacccagaaagaagggcaugagccugaagagcgacgccgugcugagcaagagcaagagaagaaagaagcccgacagaguguucgagaaccaggaggugcaggccaucggcggcaaggacgugagccuguuccuguucagagcccugggcaagauccuguacugcaagagagccagccugaccgagcuggacagccccagacugcccagccaccugagcgaguacgagagagacacccugcugguggagcccgaggaggugguggagaugagccacaugcccggcgaccuguucaaccuguaccugcaccagaacuacaucgacuucuucauggagaucgacgacaucgugagagccagcgaguuccugagcuucgccgacauccugagcggcgacuggaacaccagaagccugcugagagaguacagcaccagcaucgccaccagaggcgugaugcacagcaacaaggccagaggcuacgcccacugccagggcggcggcagcagcuucagaccccugcacaagccccagugguuccugaucaacaagaaguacagagagaacugccuggccgccaaggcccuguuccccgacuucugccugcccgcccugugccugcagacccagcugcugcccuaccuggcccugcugaccauccccaugagaaaccaggcccagaucagcuucauccaggacaucggcagacugccccugaagagacacuucggcagacugaagauggaggcccugaccgacagagagcacggcaugaucgaccccgacagcggcgacgaggcccagcugaacggcggccacagcgccgaggagagccugggcgagcccacccaggccaccgugcccgagaccuggagccugccccugagccagaacagcgccagcgagcugcccgccagccagccccagcccuucagcgcccagggcgacauggaggagaacaucaucaucgaggacuacgagagcgacggcaccuaa

SEQ ID NO: 22363 - RNA, 1488 nt, Artificial Sequence
  RAD18__Homo_sapiens__NP_064550
auggacagccuggccgagagcagauggccccccggccuggccgugaugaagaccaucgacgaccugcugagaugcggcaucugcuucgaguacuucaacaucgccaugaucaucccccagugcagccacaacuacugcagccugugcaucagaaaguuccugagcuacaagacccagugccccaccugcugcgugaccgugaccgagcccgaccugaagaacaacagaauccuggacgagcuggugaagagccugaacuucgccagaaaccaccugcugcaguucgcccuggagagccccgccaagagccccgccagcagcagcagcaagaaccuggccgugaagguguacacccccguggccagcagacagagccugaagcagggcagcagacugauggacaacuuccugaucagagagaugagcggcagcaccagcgagcugcugaucaaggagaacaagagcaaguucagcccccagaaggaggccagccccgccgccaagaccaaggagaccagaagcguggaggagaucgcccccgaccccagcgaggccaagagacccgagccccccagcaccagcacccugaagcaggugaccaagguggacugccccgugugcggcgugaacauccccgagagccacaucaacaagcaccuggacagcugccugagcagagaggagaagaaggagagccugagaagcagcgugcacaagagaaagccccugcccaagaccguguacaaccugcugagcgacagagaccugaagaagaagcugaaggagcacggccugagcauccagggcaacaagcagcagcugaucaagagacaccaggaguucgugcacauguacaacgcccagugcgacgcccugcaccccaagagcgccgccgagaucgugagagagaucgagaacaucgagaagaccagaaugagacuggaggccagcaagcugaacgagagcgugaugguguucaccaaggaccagaccgagaaggagaucgacgagauccacagcaaguacagaaagaagcacaagagcgaguuccagcugcugguggaccaggccagaaagggcuacaagaagaucgccggcaugagccagaagaccgugaccaucaccaaggaggacgagagcaccgagaagcugagcagcgugugcaugggccaggaggacaacaugaccagcgugaccaaccacuucagccagagcaagcuggacagccccgaggagcuggagcccgacagagaggaggacagcagcagcugcaucgacauccaggaggugcugagcagcagcgagagcgacagcugcaacagcagcagcagcgacaucaucagagaccugcuggaggaggaggaggccugggaggccagccacaagaacgaccugcaggacaccgagaucagccccagacagaacagaagaaccagagccgccgagagcgccgagaucgagcccagaaacaagagaaacagaaacuaa

SEQ ID NO: 22364 - RNA, 849 nt, Artificial Sequence
  RAD1__Homo_sapiens__NP_002844
augccccugcugacccagcagauccaggacgaggacgaccaguacagccugguggccagccuggacaacgugagaaaccugagcaccauccugaaggccauccacuucagagagcacgccaccugcuucgccaccaagaacggcaucaaggugaccguggagaacgccaagugcgugcaggccaacgccuucauccaggccggcaucuuccaggaguucaaggugcaggaggagagcgugaccuucagaaucaaccugaccgugcugcuggacugccugagcaucuucggcagcagccccaugcccggcacccugaccgcccugagaaugugcuaccagggcuacggcuacccccugaugcuguuccuggaggagggcggcguggugaccgugugcaagaucaacacccaggagcccgaggagacccuggacuucgacuucugcagcaccaacgugaucaacaagaucauccugcagagcgagggccugagagaggccuucagcgagcuggacaugaccagcgaggugcugcagaucaccaugagccccgacaagcccuacuucagacugagcaccuucggcaacgccggcagcagccaccuggacuaccccaaggacagcgaccugauggaggccuuccacugcaaccagacccaggugaacagauacaagaucagccugcugaagcccagcaccaaggcccuggugcugagcugcaaggugagcaucagaaccgacaacagaggcuuccugagccugcaguacaugaucagaaacgaggacggccagaucugcuucguggaguacuacugcugccccgacgaggaggugcccgagagcgagagcuaa

SEQ ID NO: 22365 - RNA, 1896 nt, Artificial Sequence
  RAD21__Homo_sapiens__NP_006256
auguucuacgcccacuucgugcugagcaagagaggcccccuggccaagaucuggcuggccgcccacugggacaagaagcugaccaaggcccacguguucgagugcaaccuggagagcagcguggagagcaucaucagccccaaggugaagauggcccugagaaccagcggccaccugcugcugggcguggugagaaucuaccacagaaaggccaaguaccugcuggccgacugcaacgaggccuucaucaagaucaagauggccuucagacccggcgugguggaccugcccgaggagaacagagaggccgccuacaacgccaucacccugcccgaggaguuccacgacuucgaccagccccugcccgaccuggacgacaucgacguggcccagcaguucagccugaaccagagcagaguggaggagaucaccaugagagaggaggugggcaacaucagcauccugcaggagaacgacuucggcgacuucggcauggacgacagagagaucaugagagagggcagcgccuucgaggacgacgacaugcuggugagcaccaccaccagcaaccugcugcuggagagcgagcagagcaccagcaaccugaacgagaagaucaaccaccuggaguacgaggaccaguacaaggacgacaacuucggcgagggcaacgacggcggcauccuggacgacaagcugaucagcaacaacgacggcggcaucuucgacgacccccccgcccugagcgaggccggcgugaugcugcccgagcagcccgcccacgacgacauggacgaggacgacaacgugagcaugggcggccccgacagccccgacagcguggaccccguggagcccaugcccaccaugaccgaccagaccacccuggugcccaacgaggaggaggccuucgcccuggagcccaucgacaucaccgugaaggagaccaaggccaagagaaagagaaagcugaucguggacagcgugaaggagcuggacagcaagaccaucagagcccagcugagcgacuacagcgacaucgugaccacccuggaccuggccccccccaccaagaagcugaugauguggaaggagaccggcggcguggagaagcuguucagccugcccgcccagccccuguggaacaacagacugcugaagcuguucaccagaugccugaccccccuggugcccgaggaccugagaaagagaagaaagggcggcgaggccgacaaccuggacgaguuccugaaggaguucgagaaccccgaggugcccagagaggaccagcagcagcagcaccagcagagagacgugaucgacgagcccaucaucgaggagcccagcagacugcaggagagcgugauggaggccagcagaaccaacaucgacgagagcgccaugccccccccccccccccagggcgugaagagaaaggccggccagaucgaccccgagcccgugaugcccccccagcagguggagcagauggagaucccccccguggagcugccccccgaggagccccccaacaucugccagcugauccccgagcuggagcugcugcccgagaaggagaaggagaaggagaaggagaaggaggacgacgaggaggaggaggacgaggacgccagcggcggcgaccaggaccaggaggagagaagauggaacaagagaacccagcagaugcugcacggccugcagagagcccuggccaagaccggcgccgagagcaucagccugcuggagcugugcagaaacaccaacagaaagcaggccgccgccaaguucuacagcuuccuggugcugaagaagcagcaggccaucgagcugacccaggaggagcccuacagcgacaucaucgccacccccggccccagauuccacaucaucuaa

SEQ ID NO: 22366 - RNA, 1671 nt, Artificial Sequence
  RAD21L1__Homo_sapiens__NP_001130038
auguucuacacccacgugcugaugagcaagagaggcccccuggccaagaucuggcuggccgcccacugggagaagaagcugaccaaggcccacguguucgagugcaaccuggagaucaccaucgagaagauccugagccccaaggugaagaucgcccugagaaccagcggccaccugcugcugggcguggugagaaucuacaacagaaaggccaaguaccugcuggccgacugcagcgaggccuuccugaagaugaagaugaccuucugccccggccugguggaccugcccaaggagaacuucgaggccagcuacaacgccaucacccugcccgaggaguuccacgacuucgacacccagaacaugaacgccaucgacgugagcgagcacuucacccagaaccagagcagacccgaggagaucacccugagagagaacuucgacaacgaccugaucuuccaggccgagagcuucggcgaggagagcgagauccugagaagacacagcuucuucgacgacaacauccugcugaacagcagcggcccccugaucgagcacagcagcggcagccugaccggcgagagaagccuguucuacgacagcggcgacggcuucggcgacgagggcgccgccggcgagaugaucgacaaccugcugcaggacgaccagaacauccugcuggaggacaugcaccugaacagagagaucagccugcccagcgagccccccaacagccuggccguggagcccgacaacagcgagugcaucugcgugcccgagaacgagaagaugaacgagaccauccugcugagcaccgaggaggagggcuucacccuggaccccaucgacaucagcgacaucgccgagaagagaaagggcaagaagagaagacugcugaucgaccccaucaaggagcugagcagcaaggugauccacaagcagcugaccagcuucgccgacacccugauggugcuggagcuggccccccccacccagagacugaugauguggaagaagagaggcggcgugcacacccugcugagcaccgccgcccaggaccugauccacgccgagcugaagaugcuguucaccaagugcuuccugagcagcggcuucaagcugggcagaaagaugauccagaaggagagcgugagagaggaggugggcaaccagaacaucguggagaccagcaugaugcaggagcccaacuaccagcaggagcugagcaagccccagaccuggaaggacgugaucggcggcagccagcacagcagccacgaggacaccaacaagaacaucaacagcgagcaggacaucguggagauggugagccuggccgccgaggagagcagccugaugaacgaccuguucgcccaggagaucgaguacagccccguggagcuggagagccugagcaacgaggagaacaucgagaccgagagauggaacggcagaauccugcagaugcugaacagacugagagagagcaacaagaugggcaugcagagcuucagccugaugaagcugugcagaaacagcgacagaaagcaggccgccgccaaguucuacagcuuccuggugcugaagaagcagcuggccaucgagcugagccagagcgcccccuacgccgacaucaucgccaccaugggccccauguucuacaacaucuaa

SEQ ID NO: 22367 - RNA, 927 nt, Artificial Sequence
  RAD23A__Homo_sapiens__NP_001257292
auggccgugaccaucacccugaagacccugcagcagcagaccuucaagaucagaauggagcccgacgagaccgugaaggugcugaaggagaagaucgaggccgagaagggcagagacgccuuccccguggccggccagaagcugaucuacgccggcaagauccugagcgacgacgugcccaucagagacuacagaaucgacgagaagaacuucgugguggugauggugaccaagaccaaggccggccagggcaccagcgccccccccgaggccagccccaccgccgcccccgagagcagcaccagcuucccccccgcccccaccagcggcaugagccaccccccccccgccgccagagaggacaagagccccagcgaggagagcgcccccaccaccagccccgagagcgugagcggcagcgugcccagcagcggcagcagcggcagagaggaggacgccgccagcacccuggugaccggcagcgaguacgagaccaugcugaccgagaucaugagcaugggcuacgagagagagagagugguggccgcccugagagccagcuacaacaacccccacagagccguggaguaccugcugaccggcauccccggcagccccgagcccgagcacggcagcgugcaggagagccaggugagcgagcagcccgccaccgaggccgccggcgagaacccccuggaguuccugagagaccagccccaguuccagaacaugagacaggugauccagcagaaccccgcccugcugcccgcccugcugcagcagcugggccaggagaacccccagcugcugcagcugaaggcccugggcuuccccgagagccuggugauccaggccuacuucgccugcgagaagaacgagaaccuggccgccaacuuccugcugagccagaacuucgacgacgaguaa

SEQ ID NO: 22368 - RNA, 1167 nt, Artificial Sequence
  RAD23B__Homo_sapiens__NP_001231642
auggugaaggcccugaaggagaagaucgagagcgagaagggcaaggacgccuuccccguggccggccagaagcugaucuacgccggcaagauccugaacgacgacaccgcccugaaggaguacaagaucgacgagaagaacuucgugguggugauggugaccaagcccaaggccgugagcacccccgcccccgccaccacccagcagagcgcccccgccagcaccaccgccgugaccagcagcaccaccaccaccguggcccaggcccccacccccgugcccgcccuggcccccaccagcacccccgccagcaucacccccgccagcgccaccgccagcagcgagcccgcccccgccagcgccgccaagcaggagaagcccgccgagaagcccgccgagacccccguggccaccagccccaccgccaccgacagcaccagcggcgacagcagcagaagcaaccuguucgaggacgccaccagcgcccuggugaccggccagagcuacgagaacauggugaccgagaucaugagcaugggcuacgagagagagcaggugaucgccgcccugagagccagcuucaacaaccccgacagagccguggaguaccugcugaugggcauccccggcgacagagagagccaggccgugguggaccccccccaggccgccagcaccggcgccccccagagcagcgccguggccgccgccgccgccaccaccaccgccaccaccaccaccaccagcagcggcggccacccccuggaguuccugagaaaccagccccaguuccagcagaugagacagaucauccagcagaaccccagccugcugcccgcccugcugcagcagaucggcagagagaacccccagcugcugcagcagaucagccagcaccaggagcacuucauccagaugcugaacgagcccgugcaggaggccggcggccagggcggcggcggcggcggcggcagcggcggcaucgccgaggccggcagcggccacaugaacuacauccaggugaccccccaggagaaggaggccaucgagagacugaaggcccugggcuuccccgagggccuggugauccaggccuacuucgccugcgagaagaacgagaaccuggccgccaacuuccugcugcagcagaacuucgacgaggacuaa

SEQ ID NO: 22369 - RNA, 3939 nt, Artificial Sequence
  RAD50__Homo_sapiens__NP_005723
augagcagaaucgagaagaugagcauccugggcgugagaagcuucggcaucgaggacaaggacaagcagaucaucaccuucuucagcccccugaccauccuggugggccccaacggcgccggcaagaccaccaucaucgagugccugaaguacaucugcaccggcgacuucccccccggcaccaagggcaacaccuucgugcacgaccccaagguggcccaggagaccgacgugagagcccagaucagacugcaguucagagacgugaacggcgagcugaucgccgugcagagaagcauggugugcacccagaagagcaagaagaccgaguucaagacccuggagggcgugaucaccagaaccaagcacggcgagaaggugagccugagcagcaagugcgccgagaucgacagagagaugaucagcagccugggcgugagcaaggccgugcugaacaacgugaucuucugccaccaggaggacagcaacuggccccugagcgagggcaaggcccugaagcagaaguucgacgagaucuucagcgccaccagauacaucaaggcccuggagacccugagacaggugagacagacccagggccagaaggugaaggaguaccagauggagcugaaguaccugaagcaguacaaggagaaggccugcgagaucagagaccagaucaccagcaaggaggcccagcugaccagcagcaaggagaucgugaagagcuacgagaacgagcuggacccccugaagaacagacugaaggagaucgagcacaaccugagcaagaucaugaagcuggacaacgagaucaaggcccuggacagcagaaagaagcagauggagaaggacaacagcgagcuggaggagaagauggagaagguguuccagggcaccgacgagcagcugaacgaccuguaccacaaccaccagagaaccgugagagagaaggagagaaagcugguggacugccacagagagcuggagaagcugaacaaggagagcagacugcugaaccaggagaagagcgagcugcugguggagcagggcagacugcagcugcaggccgacagacaccaggagcacaucagagccagagacagccugauccagagccuggccacccagcuggagcuggacggcuucgagagaggccccuucagcgagagacagaucaagaacuuccacaagcuggugagagagagacaggagggcgaggccaagaccgccaaccagcugaugaacgacuucgccgagaaggagacccugaagcagaagcagaucgacgagaucagagacaagaagaccggccugggcagaaucaucgagcugaagagcgagauccugagcaagaagcagaacgagcugaagaacgugaaguacgagcugcagcagcuggagggcagcagcgacagaauccuggagcuggaccaggagcugaucaaggccgagagagagcugagcaaggccgagaagaacagcaacguggagacccugaagauggaggugaucagccugcagaacgagaaggccgaccuggacagaacccugagaaagcuggaccaggagauggagcagcugaaccaccacaccaccaccagaacccagauggagaugcugaccaaggacaaggccgacaaggacgagcagaucagaaagaucaagagcagacacagcgacgagcugaccagccugcugggcuacuuccccaacaagaagcagcuggaggacuggcugcacagcaagagcaaggagaucaaccagaccagagacagacuggccaagcugaacaaggagcuggccagcagcgagcagaacaagaaccacaucaacaacgagcugaagagaaaggaggagcagcugagcagcuacgaggacaagcuguucgacgugugcggcagccaggacuucgagagcgaccuggacagacugaaggaggagaucgagaagagcagcaagcagagagccaugcuggccggcgccaccgccguguacagccaguucaucacccagcugaccgacgagaaccagagcugcugccccgugugccagagaguguuccagaccgaggccgagcugcaggaggugaucagcgaccugcagagcaagcugagacuggcccccgacaagcugaagagcaccgagagcgagcugaagaagaaggagaagagaagagacgagaugcugggccuggugcccaugagacagagcaucaucgaccugaaggagaaggagauccccgagcugagaaacaagcugcagaacgugaacagagacauccagagacugaagaacgacaucgaggagcaggagacccugcugggcaccaucaugcccgaggaggagagcgccaaggugugccugaccgacgugaccaucauggagagauuccagauggagcugaaggacguggagagaaagaucgcccagcaggccgccaagcugcagggcaucgaccuggacagaaccgugcagcaggugaaccaggagaagcaggagaagcagcacaagcuggacaccgugagcagcaagaucgagcugaacagaaagcugauccaggaccagcaggagcagauccagcaccugaagagcaccaccaacgagcugaagagcgagaagcugcagaucagcaccaaccugcagagaagacagcagcuggaggagcagaccguggagcugagcaccgaggugcagagccuguacagagagaucaaggacgccaaggagcaggugagcccccuggagaccacccuggagaaguuccagcaggagaaggaggagcugaucaacaagaagaacaccagcaacaagaucgcccaggacaagcugaacgacaucaaggagaaggugaagaacauccacggcuacaugaaggacaucgagaacuacauccaggacggcaaggacgacuacaagaagcagaaggagaccgagcugaacaaggugaucgcccagcugagcgagugcgagaagcacaaggagaagaucaacgaggacaugagacugaugagacaggacaucgacacccagaagauccaggagagauggcugcaggacaaccugacccugagaaagagaaacgaggagcugaaggagguggaggaggagagaaagcagcaccugaaggagaugggccagaugcaggugcugcagaugaagagcgagcaccagaagcuggaggagaacaucgacaacaucaagagaaaccacaaccuggcccugggcagacagaagggcuacgaggaggagaucauccacuucaagaaggagcugagagagccccaguucagagacgccgaggagaaguacagagagaugaugaucgugaugagaaccaccgagcuggugaacaaggaccuggacaucuacuacaagacccuggaccaggccaucaugaaguuccacagcaugaagauggaggagaucaacaagaucaucagagaccuguggagaagcaccuacagaggccaggacaucgaguacaucgagaucagaagcgacgccgacgagaacgugagcgccagcgacaagagaagaaacuacaacuacagaguggugaugcugaagggcgacaccgcccuggacaugagaggcagaugcagcgccggccagaaggugcuggccagccugaucaucagacuggcccuggccgagaccuucugccugaacugcggcaucaucgcccuggacgagcccaccaccaaccuggacagagagaacaucgagagccuggcccacgcccugguggagaucaucaagagcagaagccagcagagaaacuuccagcugcuggugaucacccacgacgaggacuucguggagcugcugggcagaagcgaguacguggagaaguucuacagaaucaagaagaacaucgaccagugcagcgagaucgugaagugcagcgugagcagccugggcuucaacgugcacuaa

SEQ ID NO: 22370 - RNA, 1059 nt, Artificial Sequence
  RAD51AP1__Homo_sapiens__NP_001124334
auggugagacccgugagacacaagaagcccgugaacuacagccaguucgaccacagcgacagcgacgacgacuucgugagcgccaccgugccccugaacaagaagagcagaaccgcccccaaggagcugaagcaggacaagcccaagcccaaccugaacaaccugagaaaggaggagauccccgugcaggagaagacccccaagaagagacugcccgagggcaccuucagcauccccgccagcgccgugcccugcaccaagauggcccuggacgacaagcuguaccagagagaccuggagguggcccuggcccugagcgugaaggagcugcccaccgugaccaccaacgugcagaacagccaggacaagagcaucgagaagcacggcagcagcaagaucgagaccaugaacaagagcccccacaucagcaacugcagcguggccagcgacuaccuggaccuggacaagaucaccguggaggacgacgugggcggcgugcagggcaagagaaaggccgccagcaaggccgccgcccagcagagaaagauccugcuggagggcagcgacggcgacagcgccaacgacaccgagcccgacuucgcccccggcgaggacagcgaggacgacagcgacuucugcgagagcgaggacaacgacgaggacuucagcaugagaaagagcaaggugaaggagaucaagaagaaggaggugaaggugaagagccccguggagaagaaggagaagaagagcaagagcaagugcaacgcccuggugaccagcguggacagcgcccccgccgccgugaagagcgagagccagagccugcccaagaaggugagccugagcagcgacaccaccagaaagccccuggagaucagaagccccagcgccgagagcaagaagcccaagugggugccccccgccgccagcggcggcagcagaagcagcagcagcccccuggugguggugagcgugaagagccccaaccagagccugagacugggccugagcagacuggccagagugaagccccugcaccccaacgccaccagcaccuaa

SEQ ID NO: 22371 - RNA, 1053 nt, Artificial Sequence
  RAD51B__Homo_sapiens__NP_002868
augggcagcaagaagcugaagagagugggccugagccaggagcugugcgacagacugagcagacaccagauccugaccugccaggacuuccugugccugagcccccuggagcugaugaaggugaccggccugagcuacagaggcgugcacgagcugcugugcauggugagcagagccugcgcccccaagaugcagaccgccuacggcaucaaggcccagagaagcgccgacuucagccccgccuuccugagcaccacccugagcgcccuggacgaggcccugcacggcggcguggccugcggcagccugaccgagaucaccggcccccccggcugcggcaagacccaguucugcaucaugaugagcauccuggccacccugcccaccaacaugggcggccuggagggcgccgugguguacaucgacaccgagagcgccuucagcgccgagagacugguggagaucgccgagagcagauuccccagauacuucaacaccgaggagaagcugcugcugaccagcagcaaggugcaccuguacagagagcugaccugcgacgaggugcugcagagaaucgagagccuggaggaggagaucaucagcaagggcaucaagcuggugauccuggacagcguggccagcguggugagaaaggaguucgacgcccagcugcagggcaaccugaaggagagaaacaaguuccuggccagagaggccagcagccugaaguaccuggccgaggaguucagcauccccgugauccugaccaaccagaucaccacccaccugagcggcgcccuggccagccaggccgaccuggugagccccgccgacgaccugagccugagcgagggcaccagcggcagcagcugcgugaucgccgcccugggcaacaccuggagccacagcgugaacaccagacugauccugcaguaccuggacagcgagagaagacagauccugaucgccaagagcccccuggcccccuucaccagcuucguguacaccaucaaggaggagggccuggugcugcaggccuacggcaacagcuaa

SEQ ID NO: 22372 - RNA, 408 nt, Artificial Sequence
  RAD51C__Homo_sapiens__NP_002867
augagaggcaagaccuucagauucgagaugcagagagaccuggugagcuucccccugagccccgccgugagagugaagcuggugagcgccggcuuccagaccgccgaggagcugcuggaggugaagcccagcgagcugagcaaggaggugggcaucagcaaggccgaggcccuggagacccugcagaucaucagaagagagugccugaccaacaagcccagauacgccggcaccagcgagagccacaagaagugcaccgcccuggagcugcuggagcaggagcacacccagggcuucaucaucaccuucugcagcgcccuggacgacauccugggcggcggcgugccccugaugaagaccaccgagaucugcggcgcccccggcgugggcaagacccagcugugguaa

SEQ ID NO: 22373 - RNA, 1047 nt, Artificial Sequence
  RAD51D__Homo_sapiens__NP_001136043
augggcgugcugagagugggccugugccccggccugaccgaggagaugauccagcugcugagaagccacagaaucaagaccgugguggaccuggugagcgccgaccuggaggagguggcccagaagugcggccugagcuacaagaccuggagagcccacagcagcggcaaccugggcggccugcagcugccccaggugcccgccggcagaagcuggagcggcgugagaaacgcccugaagaaggccggccugggccacggcggcaccgacggccugagccugaacgccuucgacgagagaggcaccgccgugagcaccagcagacuggacaagcugcuggacgccggccuguacaccggcgaggugaccgagaucgugggcggccccggcagcggcaagacccaggugugccugugcauggccgccaacguggcccacggccugcagcagaacgugcuguacguggacagcaacggcggccugaccgccagcagacugcugcagcugcugcaggccaagacccaggacgaggaggagcaggccgaggcccugagaagaauccagguggugcacgccuucgacaucuuccagaugcuggacgugcugcaggagcugagaggcaccguggcccagcaggugaccggcagcagcggcaccgugaaggugguggugguggacagcgugaccgccguggugagcccccugcugggcggccagcagagagagggccuggcccugaugaugcagcuggccagagagcugaagacccuggccagagaccugggcauggccgugguggugaccaaccacaucaccagagacagagacagcggcagacugaagcccgcccugggcagaagcuggagcuucgugcccagcaccagaauccugcuggacaccaucgagggcgccggcgccagcggcggcagaagaauggccugccuggccaagagcagcagacagcccaccggcuuccaggagaugguggacaucggcaccuggggcaccagcgagcagagcgccacccugcagggcgaccagaccuaa

SEQ ID NO: 22374 - RNA, 843 nt, Artificial Sequence
  RAD51__Homo_sapiens__NP_001157742
auggccaugcagaugcagcuggaggccaacgccgacaccagcguggaggaggagagcuucggcccccagcccaucagcagacuggagcagugcggcaucaacgccaacgacgugaagaagcuggaggaggccggcuuccacaccguggaggccguggccuacgcccccaagaaggagcugaucaacaucaagggcaucagcgaggccaaggccgacaagauccuggccgaggccgccaagcuggugcccaugggcuucaccaccgccaccgaguuccaccagagaagaagcgagaucauccagaucaccaccggcagcaaggagcuggacaagcugcugcagggcggcaucgagaccggcagcaucaccgagauguucggcgaguucagaaccggcaagacccagaucugccacacccuggccgugaccugccagcugcccaucgacagaggcggcggcgagggcaaggccauguacaucgacaccgagggcaccuucagacccgagagacugcuggccguggccgagagauacggccugagcggcagcgacgugcuggacaacguggccuacgccagagccuucaacaccgaccaccagacccagcugcuguaccaggccagcgccaugaugguggagagcagauacgcccugcugaucguggacagcgccaccgcccuguacagaaccgacuacagcggcagaggcgagcugagcgccagacagaugcaccuggccagauuccugagaaugcugcugagacuggccgacgagaucgugagcgaggagagaaagagaggcaaccagaaccugcagaaccugagacugagccugagcagcuaa

SEQ ID NO: 22375 - RNA, 1257 nt, Artificial Sequence
  RAD52__Homo_sapiens__NP_001284348
augagcggcaccgaggaggccauccugggcggcagagacagccaccccgccgccggcggcggcagcgugcugugcuucggccagugccaguacaccgccgaggaguaccaggccauccagaaggcccugagacagagacugggccccgaguacaucagcagcagaauggccggcggcggccagaaggugugcuacaucgagggccacagagugaucaaccuggccaacgagauguucggcuacaacggcugggcccacagcaucacccagcagaacguggacuucguggaccugaacaacggcaaguucuacgugggcgugugcgccuucgugagagugcagcugaaggacggcagcuaccacgaggacgugggcuacggcgugagcgagggccugaagagcaaggcccugagccuggagaaggccagaaaggaggccgugaccgacggccugaagagagcccugagaagcuucggcaacgcccugggcaacugcauccuggacaaggacuaccugagaagccugaacaagcugcccagacagcugccccuggagguggaccugaccaaggccaagagacaggaccuggagcccagcguggaggaggccagauacaacagcugcagacccaacauggcccugggccacccccagcugcagcaggugaccagccccagcagacccagccacgccgugauccccgccgaccaggacugcagcagcagaagccugagcagcagcgccguggagagcgaggccacccaccagagaaagcugagacagaagcagcugcagcagcaguucagagagagaauggagaagcagcaggugagagugagcacccccagcgccgagaagagcgaggccgccccccccgccccccccgugacccacagcacccccgugaccgugagcgagccccugcuggagaaggacuuccuggccggcgugacccaggagcugaucaagacccuggaggacaacagcgagaagugggccgugacccccgacgccggcgacggcguggugaagcccagcagcagagccgaccccgcccagaccagcgacacccuggcccugaacaaccagauggugacccagaacagaaccccccacagcgugugccaccagaagccccaggccaagagcggcagcugggaccugcagaccuacagcgccgaccagagaaccaccggcaacugggagagccacagaaagagccaggacaugaagaagagaaaguacgaccccagcuaa

SEQ ID NO: 22376 - RNA, 354 nt, Artificial Sequence
  RAD54B__Homo_sapiens__NP_001192191
augagaagaagcgccgcccccagccagcugcagggcaacagcuucaagaagcccaaguucaucccccccggcagaagcaaccccggccugaacgaggagaucaccaagcugaaccccgacaucaagcuguucgagggcguggccaucaacaacaccuuccugcccagccagaacgaccugagaaucugcagccugaaccugcccagcgaggagagcaccagagagaucaacaacagagacaacugcagcggcaaguacugcuucgaggcccccacccuggccacccuggaccccccccacaccgugcagaccuggaugagaagacacagacuggugcccgugcacuacagauaa

SEQ ID NO: 22377 - RNA, 1176 nt, Artificial Sequence
  RAD9A__Homo_sapiens__NP_004575
augaagugccuggugaccggcggcaacgugaaggugcugggcaaggccgugcacagccugagcagaaucggcgacgagcuguaccuggagccccuggaggacggccugagccugagaaccgugaacagcagcagaagcgccuacgccugcuuccuguucgccccccuguucuuccagcaguaccaggccgccacccccggccaggaccugcugagaugcaagauccugaugaagagcuuccugagcguguucagaagccuggccaugcuggagaagaccguggagaagugcugcaucagccugaacggcagaagcagcagacugguggugcagcugcacugcaaguucggcgugagaaagacccacaaccugagcuuccaggacugcgagagccugcaggccguguucgaccccgccagcugcccccacaugcugagagcccccgccagagugcugggcgaggccgugcugcccuucagccccgcccuggccgaggugacccugggcaucggcagaggcagaagagugauccugagaagcuaccacgaggaggaggccgacagcaccgccaaggccauggugaccgagaugugccugggcgaggaggacuuccagcagcugcaggcccaggagggcguggccaucaccuucugccugaaggaguucagaggccugcugagcuucgccgagagcgccaaccugaaccugagcauccacuucgacgcccccggcagacccgccaucuucaccaucaaggacagccugcuggacggccacuucgugcuggccacccugagcgacaccgacagccacagccaggaccugggcagccccgagagacaccagcccgugccccagcugcaggcccacagcaccccccaccccgacgacuucgccaacgacgacaucgacagcuacaugaucgccauggagaccaccaucggcaacgagggcagcagagugcugcccagcaucagccugagccccggcccccagccccccaagagccccggcccccacagcgaggaggaggacgaggccgagcccagcaccgugcccggcacccccccccccaagaaguucagaagccuguucuucggcagcauccuggcccccgugagaagcccccagggccccagccccgugcuggccgaggacagcgagggcgagggcuaa

SEQ ID NO: 22378 - RNA, 1038 nt, Artificial Sequence
  RAD9B__Homo_sapiens__NP_001273461
augagcgagaacgagcuggacaccacccugcaccugaagugcaagcugggcaugaagagcauccugcccaucuucagaugccugaacagccuggagagaaacaucgagaagugcagaaucuucaccagaagcgacaagugcaagguggugauccaguucuucuacagacacggcaucaagagaacccacaacaucugcuuccaggagagccagccccugcaggugaucuucgacaagaacgugugcaccaacacccugaugauccagcccagacugcuggccgacgccaucgugcuguucaccagcagccaggaggaggugacccuggccgugaccccccugaacuucugccugaagagcagcaacgaggagagcauggaccugagcaacgccgugcacagcgagauguucgugggcagcgacgaguucgacuucuuccagaucggcauggacaccgagaucaccuucugcuucaaggagcugaagggcauccugaccuucagcgaggccacccacgcccccaucagcaucuacuucgacuuccccggcaagccccuggcccugagcaucgacgacaugcugguggaggccaacuucauccuggccacccuggccgacgagcagagcagagccagcagcccccagagccugugccugagccagaagagaaagagaagcgaccugaucgagaagaaggccggcaagaacgugaccggccaggcccuggagugcaucagcaagaaggccgcccccagaagacuguaccccaaggagacccugaccaacaucagcgcccuggagaacugcggcagccccgccaugaagagaguggacggcgacgugagcgaggugagcgagagcagcgugagcaacaccgaggaggugcccggcagccugugccugagaaaguucagcugcauguucuucggcgccgugagcagcgaccagcaggagcacuucaaccaccccuucgacagccuggccagagccagcgacagcgaggaggacaugaacaacggcagcuucagcaucuucuaa

SEQ ID NO: 22379 - RNA, 1221 nt, Artificial Sequence
  RAE1__Homo_sapiens__XP_005260640
auggcccccgccgaggccgagcugccccccggcagcgcccugcugagagacgccggcgccagagccggccugcugaccaagcugagauacugggcccuggaggccagauucaagaugagccuguucggcaccaccagcggcuucggcaccagcggcaccagcauguucggcagcgccaccaccgacaaccacaaccccaugaaggacaucgaggugaccagcagccccgacgacagcaucggcugccugagcuucagcccccccacccugcccggcaacuuccugaucgccggcagcugggccaacgacgugagaugcugggaggugcaggacagcggccagaccauccccaaggcccagcagaugcacaccggccccgugcuggacgugugcuggagcgacgacggcagcaagguguucaccgccagcugcgacaagaccgccaagaugugggaccugagcagcaaccaggccauccagaucgcccagcacgacgcccccgugaagaccauccacuggaucaaggcccccaacuacagcugcgugaugaccggcagcugggacaagacccugaaguucugggacaccagaagcagcaaccccaugauggugcugcagcugcccgagagaugcuacugcgccgacgugaucuaccccauggccgugguggccaccgccgagagaggccugaucguguaccagcuggagaaccagcccagcgaguucagaagaaucgagagcccccugaagcaccagcacagaugcguggccaucuucaaggacaagcagaacaagcccaccggcuucgcccugggcagcaucgagggcagaguggccauccacuacaucaacccccccaaccccgccaaggacaacuucaccuucaagugccacagaagcaacggcaccaacaccagcgccccccaggacaucuacgccgugaacggcaucgccuuccaccccgugcacggcacccuggccaccgugggcagcgacggcagauucagcuucugggacaaggacgccagaaccaagcugaagaccagcgagcagcuggaccagcccaucagcgccugcugcuucaaccacaacggcaacaucuucgccuacgccagcagcuacgacuggagcaagggccacgaguucuacaacccccagaagaagaacuacaucuuccugagaaacgccgccgaggagcugaagcccagaaacaagaaguaa

SEQ ID NO: 22380 - RNA, 684 nt, Artificial Sequence
  RAET1E__Homo_sapiens__NP_001230254
augagaagaaucagccugaccagcagccccgugagacugcugcuguuccugcugcugcugcugaucgcccuggagaucauguacaacagcgacaacaacauggugaagccccugggccugcugggcaagaagguguacgccaccagcaccuggggcgagcugacccagacccugggcgaggugggcagagaccugagaaugcugcugugcgacaucaagccccagaucaagaccagcgaccccagcacccugcagguggagauguucugccagagagaggccgagagaugcaccggcgccagcuggcaguucgccaccaacggcgagaagagccugcuguucgacgccaugaacaugaccuggaccgugaucaaccacgaggccagcaagaucaaggagaccuggaagaaggacagaggccuggagaaguacuucagaaagcugagcaagggcgacugcgaccacuggcugagagaguuccugggccacugggaggccaugcccgagcccaccgugagccccgugaacgccagcgacauccacuggagcagcagcagccugcccgacagauggaucauccugggcgccuucauccugcuggugcugaugggcaucgugcugaucugcgugugguggcagaacggcgaguggcaggccggccuguggccccugagaaccagcuaa

SEQ ID NO: 22381 - RNA, 741 nt, Artificial Sequence
  RAET1L__Homo_sapiens__NP_570970
auggccgccgccgccauccccgcccugcugcugugccugccccugcuguuccugcuguucggcuggagcagagccagaagagacgacccccacagccugugcuacgacaucaccgugauccccaaguucagacccggccccagauggugcgccgugcagggccagguggacgagaagaccuuccugcacuacgacugcggcaacaagaccgugacccccgugagcccccugggcaagaagcugaacgugaccauggccuggaaggcccagaaccccgugcugagagaggugguggacauccugaccgagcagcugcuggacauccagcuggagaacuacacccccaaggagccccugacccugcaggccagaaugagcugcgagcagaaggccgagggccacagcagcggcagcuggcaguucagcaucgacggccagaccuuccugcuguucgacagcgagaagagaauguggaccaccgugcaccccggcgccagaaagaugaaggagaagugggagaacgacaaggacguggccaugagcuuccacuacaucagcaugggcgacugcaucggcuggcuggaggacuuccugaugggcauggacagcacccuggagcccagcgccggcgccccccuggccaugagcagcggcaccacccagcugagagccaccgccaccacccugauccugugcugccugcugaucauccugcccugcuucauccugcccggcaucuaa

SEQ ID NO: 22382 - RNA, 1947 nt, Artificial Sequence
  RAF1__Homo_sapiens__NP_002871
auggagcacauccagggcgccuggaagaccaucagcaacggcuucggcuucaaggacgccguguucgacggcagcagcugcaucagccccaccaucgugcagcaguucggcuaccagagaagagccagcgacgacggcaagcugaccgaccccagcaagaccagcaacaccaucagaguguuccugcccaacaagcagagaaccguggugaacgugagaaacggcaugagccugcacgacugccugaugaaggcccugaaggugagaggccugcagcccgagugcugcgccguguucagacugcugcacgagcacaagggcaagaaggccagacuggacuggaacaccgacgccgccagccugaucggcgaggagcugcagguggacuuccuggaccacgugccccugaccacccacaacuucgccagaaagaccuuccugaagcuggccuucugcgacaucugccagaaguuccugcugaacggcuucagaugccagaccugcggcuacaaguuccacgagcacugcagcaccaaggugcccaccaugugcguggacuggagcaacaucagacagcugcugcuguuccccaacagcaccaucggcgacagcggcgugcccgcccugcccagccugaccaugagaagaaugagagagagcgugagcagaaugcccgugagcagccagcacagauacagcaccccccacgccuucaccuucaacaccagcagccccagcagcgagggcagccugagccagagacagagaagcaccagcacccccaacgugcacauggugagcaccacccugcccguggacagcagaaugaucgaggacgccaucagaagccacagcgagagcgccagccccagcgcccugagcagcagccccaacaaccugagccccaccggcuggagccagcccaagacccccgugcccgcccagagagagagagcccccgugagcggcacccaggagaagaacaagaucagacccagaggccagagagacagcagcuacuacugggagaucgaggccagcgaggugaugcugagcaccagaaucggcagcggcagcuucggcaccguguacaagggcaaguggcacggcgacguggccgugaagauccugaaggugguggaccccacccccgagcaguuccaggccuucagaaacgagguggccgugcugagaaagaccagacacgugaacauccugcuguucaugggcuacaugaccaaggacaaccuggccaucgugacccaguggugcgagggcagcagccuguacaagcaccugcacgugcaggagaccaaguuccagauguuccagcugaucgacaucgccagacagaccgcccagggcauggacuaccugcacgccaagaacaucauccacagagacaugaagagcaacaacaucuuccugcacgagggccugaccgugaagaucggcgacuucggccuggccaccgugaagagcagauggagcggcagccagcagguggagcagcccaccggcagcgugcuguggauggcccccgaggugaucagaaugcaggacaacaaccccuucagcuuccagagcgacguguacagcuacggcaucgugcuguacgagcugaugaccggcgagcugcccuacagccacaucaacaacagagaccagaucaucuucauggugggcagaggcuacgccagccccgaccugagcaagcuguacaagaacugccccaaggccaugaagagacugguggccgacugcgugaagaaggugaaggaggagagaccccuguucccccagauccugagcagcaucgagcugcugcagcacagccugcccaagaucaacagaagcgccagcgagcccagccugcacagagccgcccacaccgaggacaucaacgccugcacccugaccaccagccccagacugcccguguucuaa

SEQ ID NO: 22383 - RNA, 3132 nt, Artificial Sequence
  RAG1__Homo_sapiens__XP_005253098
auggccgccagcuucccccccacccugggccugagcagcgcccccgacgagauccagcacccccacaucaaguucagcgaguggaaguucaagcuguucagagugagaagcuucgagaagacccccgaggaggcccagaaggagaagaaggacagcuucgagggcaagcccagccuggagcagagccccgccgugcuggacaaggccgacggccagaagcccgugcccacccagccccugcugaaggcccaccccaaguucagcaagaaguuccacgacaacgagaaggccagaggcaaggccauccaccaggccaaccugagacaccugugcagaaucugcggcaacagcuucagagccgacgagcacaacagaagauaccccgugcacggccccguggacggcaagacccugggccugcugagaaagaaggagaagagagccaccagcuggcccgaccugaucgccaagguguucagaaucgacgugaaggccgacguggacagcauccaccccaccgaguucugccacaacugcuggagcaucaugcacagaaaguucagcagcgcccccugcgagguguacuuccccagaaacgugaccauggaguggcacccccacacccccagcugcgacaucugcaacaccgccagaagaggccugaagagaaagagccugcagcccaaccugcagcugagcaagaagcugaagaccgugcuggaccaggccagacaggccagacagcacaagagaagagcccaggccagaaucagcagcaaggacgugaugaagaagaucgccaacugcagcaagauccaccugagcaccaagcugcuggccguggacuuccccgagcacuucgugaagagcaucagcugccagaucugcgagcacauccuggccgaccccguggagaccaacugcaagcacguguucugcagagugugcauccugagaugccugaaggugaugggcagcuacugccccagcugcagauaccccugcuuccccaccgaccuggagagccccgugaagagcuuccugagcgugcugaacagccugauggugaagugccccgccaaggagugcaacgaggaggugagccuggagaaguacaaccaccacaucagcagccacaaggagagcaaggagaucuucgugcacaucaacaagggcggcagacccagacagcaccugcugagccugaccagaagagcccagaagcacagacugagagagcugaagcugcaggugaaggccuucgccgacaaggaggagggcggcgacgugaagagcgugugcaugacccuguuccugcuggcccugagagccagaaacgagcacagacaggccgacgagcuggaggccaucaugcagggcaagggcagcggccugcagcccgccgugugccuggccaucagagugaacaccuuccugagcugcagccaguaccacaagauguacagaaccgugaaggccaucaccggcagacagaucuuccagccccugcacgcccugagaaacgccgagaaggugcugcugcccggcuaccaccacuucgaguggcagcccccccugaagaacgugagcagcagcaccgacgugggcaucaucgacggccugagcggccugagcagcagcguggacgacuaccccguggacaccaucgccaagagauucagauacgacagcgcccuggugagcgcccugauggacauggaggaggacauccuggagggcaugagaagccaggaccuggacgacuaccugaacggccccuucaccgugguggugaaggagagcugcgacggcaugggcgacgugagcgagaagcacggcagcggccccguggugcccgagaaggccgugagauucagcuucaccaucaugaagaucaccaucgcccacagcagccagaacgugaagguguucgaggaggccaagcccaacagcgagcugugcugcaagccccugugccugaugcuggccgacgagagcgaccacgagacccugaccgccauccugagcccccugaucgccgagagagaggccaugaagagcagcgagcugaugcuggagcugggcggcauccugagaaccuucaaguucaucuucagaggcaccggcuacgacgagaagcuggugagagagguggagggccuggaggccagcggcagcguguacaucugcacccugugcgacgccaccagacuggaggccagccagaaccugguguuccacagcaucaccagaagccacgccgagaaccuggagagauacgagguguggagaagcaaccccuaccacgagagcguggaggagcugagagacagagugaagggcgugagcgccaagcccuucaucgagaccgugcccagcaucgacgcccugcacugcgacaucggcaacgccgccgaguucuacaagaucuuccagcuggagaucggcgagguguacaagaaccccaacgccagcaaggaggagagaaagagauggcaggccacccuggacaagcaccugagaaagaagaugaaccugaagcccaucaugagaaugaacggcaacuucgccagaaagcugaugaccaaggagaccguggacgccgugugcgagcugauccccagcgaggagagacacgaggcccugagagagcugauggaccuguaccugaagaugaagcccguguggagaagcagcugccccgccaaggagugccccgagagccugugccaguacagcuucaacagccagagauucgccgagcugcugagcaccaaguucaaguacagauacgagggcaagaucaccaacuacuuccacaagacccuggcccacgugcccgagaucaucgagagagacggcagcaucggcgccugggccagcgagggcaacgagagcggcaacaagcuguucagaagauucagaaagaugaacgccagacagagcaagugcuacgagauggaggacgugcugaagcaccacuggcuguacaccagcaaguaccugcagaaguucaugaacgcccacaacgcccugaagaccagcggcuucaccaugaacccccaggccagccugggcgacccccugggcaucgaggacagccuggagagccaggacagcauggaguucuaa

SEQ ID NO: 22384 - RNA, 1584 nt, Artificial Sequence
  RAG2__Homo_sapiens__NP_001230714
augagccugcagauggugaccgugagcaacaacaucgcccugauccagcccggcuucagccugaugaacuucgacggccagguguucuucuucggccagaagggcuggcccaagagaagcugccccaccggcguguuccaccuggacgugaagcacaaccacgugaagcugaagcccaccaucuucagcaaggacagcugcuaccugcccccccugagauaccccgccaccugcaccuucaagggcagccuggagagcgagaagcaccaguacaucauccacggcggcaagacccccaacaacgaggugagcgacaagaucuacgugaugagcaucgugugcaagaacaacaagaaggugaccuucagaugcaccgagaaggaccuggugggcgacgugcccgaggccagauacggccacagcaucaacgugguguacagcagaggcaagagcaugggcgugcuguucggcggcagaagcuacaugcccagcacccacagaaccaccgagaaguggaacagcguggccgacugccugcccugcguguuccugguggacuucgaguucggcugcgccaccagcuacauccugcccgagcugcaggacggccugagcuuccacgugagcaucgccaagaacgacaccaucuacauccugggcggccacagccuggccaacaacaucagacccgccaaccuguacagaaucagaguggaccugccccugggcagccccgccgugaacugcaccgugcugcccggcggcaucagcgugagcagcgccauccugacccagaccaacaacgacgaguucgugaucgugggcggcuaccagcuggagaaccagaagagaaugaucugcaacaucaucagccuggaggacaacaagaucgagaucagagagauggagacccccgacuggacccccgacaucaagcacagcaagaucugguucggcagcaacaugggcaacggcaccguguuccugggcauccccggcgacaacaagcagguggugagcgagggcuucuacuucuacaugcugaagugcgccgaggacgacaccaacgaggagcagaccaccuucaccaacagccagaccagcaccgaggaccccggcgacagcacccccuucgaggacagcgaggaguucugcuucagcgccgaggccaacagcuucgacggcgacgacgaguucgacaccuacaacgaggacgacgaggaggacgagagcgagaccggcuacuggaucaccugcugccccaccugcgacguggacaucaacaccugggugcccuucuacagcaccgagcugaacaagcccgccaugaucuacugcagccacggcgacggccacugggugcacgcccagugcauggaccuggccgagagaacccugauccaccugagcgccggcagcaacaaguacuacugcaacgagcacguggagaucgccagagcccugcacaccccccagagagugcugccccugaagaagccccccaugaagagccugagaaagaagggcagcggcaagauccugacccccgccaagaagagcuuccugagaagacuguucgacuaa

SEQ ID NO: 22385 - RNA, 2943 nt, Artificial Sequence
  RAI14__Homo_sapiens__NP_001138992
augaagagccugaaggccaaguucagaaagagcgacaccaacgaguggaacaagaacgacgacagacugcugcaggccguggagaacggcgacgccgagaagguggccagccugcugggcaagaagggcgccagcgccaccaagcacgacagcgagggcaagaccgccuuccaccuggccgccgccaagggccacguggagugccugagagugaugaucacccacggcguggacgugaccgcccaggacaccaccggccacagcgcccugcaccuggccgccaagaacagccaccacgagugcaucagaaagcugcugcagagcaagugccccgccgagagcguggacagcagcggcaagaccgcccugcacuacgccgccgcccagggcugccugcaggccgugcagauccugugcgagcacaagagccccaucaaccugaaggaccuggacggcaacaucccccugcugcuggccgugcagaacggccacagcgagaucugccacuuccugcuggaccacggcgccgacgugaacagcagaaacaagagcggcagaaccgcccugaugcuggccugcgagaucggcagcagcaacgccguggaggcccugaucaagaagggcgccgaccugaaccugguggacagccugggcuacaacgcccugcacuacagcaagcugagcgagaacgccggcauccagagccugcugcugagcaagaucagccaggacgccgaccugaagacccccaccaagcccaagcagcacgaccaggugagcaagaucagcagcgagagaagcggcacccccaagaagagaaaggccccccccccccccaucagccccacccagcugagcgacgugagcagccccagaagcaucaccagcaccccccugagcggcaaggagagcguguucuucgccgagccccccuucaaggccgagaucagcagcaucagagagaacaaggacagacugagcgacagcaccaccggcgccgacagccugcuggacaucagcagcgaggccgaccagcaggaccugcugagccugcugcaggccaagguggccagccugacccugcacaacaaggagcugcaggacaagcugcaggccaagagccccaaggaggccgaggccgaccugagcuucgacagcuaccacagcacccagaccgaccugggccccagccugggcaagcccggcgagaccagcccccccgacagcaagagcagccccagcgugcugauccacagccugggcaagagcaccaccgacaacgacgugagaauccagcagcugcaggagauccugcaggaccugcagaagagacuggagagcagcgaggccgagagaaagcagcugcagguggagcugcagagcagaagagccgagcuggugugccugaacaacaccgagaucagcgagaacagcagcgaccugagccagaagcugaaggagacccagagcaaguacgaggaggccaugaaggaggugcugagcgugcagaagcagaugaagcugggccuggugagccccgagagcauggacaacuacagccacuuccacgagcugagagugaccgaggaggagaucaacgugcugaagcaggaccugcagaacgcccuggaggagagcgagagaaacaaggagaaggugagagagcuggaggagaagcugguggagagagagaagggcaccgugaucaagccccccguggaggaguacgaggagaugaagagcagcuacugcagcgugaucgagaacaugaacaaggagaaggccuuccuguucgagaaguaccaggaggcccaggaggagaucaugaagcugaaggacacccugaagagccagaugacccaggaggccagcgacgaggccgaggacaugaaggaggccaugaacagaaugaucgacgagcugaacaagcaggugagcgagcugagccagcuguacaaggaggcccaggccgagcuggaggacuacagaaagagaaagagccuggaggacgugaccgccgaguacauccacaaggccgagcacgagaagcugaugcagcugaccaacgugagcagagccaaggccgaggacgcccugagcgagaugaagagccaguacagcaaggugcugaacgagcugacccagcugaagcagcugguggacgcccagaaggagaacagcgugagcaucaccgagcaccugcaggugaucaccacccugagaaccgccgccaaggagauggaggagaagaucagcaaccugaaggagcaccuggccagcaaggagguggagguggccaagcuggagaagcagcugcuggaggagaaggccgccaugaccgacgccauggugcccagaagcagcuacgagaagcugcagagcagccuggagagcgaggugagcgugcuggccagcaagcugaaggagagcgugaaggagaaggagaaggugcacagcgagguggugcagaucagaagcgaggugagccaggugaagagagagaaggagaacauccagacccugcugaagagcaaggagcaggaggugaacgagcugcugcagaaguuccagcaggcccaggaggagcuggccgagaugaagagauacgccgagagcagcagcaagcuggaggaggacaaggacaagaagaucaacgagaugagcaaggaggugaccaagcugaaggaggcccugaacagccugagccagcugagcuacagcaccagcagcagcaagagacagagccagcagcuggaggcccugcagcagcaggugaagcagcugcagaaccagcuggccgagugcaagaagcagcaccaggaggugaucagcguguacagaaugcaccugcuguacgccgugcagggccagauggacgaggacgugcagaaggugcugaagcagauccugaccaugugcaagaaccagagccagaagaaguaa

SEQ ID NO: 22386 - RNA, 5721 nt, Artificial Sequence
  RAI1__Homo_sapiens__NP_109590
augcagagcuucagagagagaugcggcuuccacggcaagcagcagaacuaccagcagaccagccaggagaccagcagacuggagaacuacagacagcccagccaggccggccugagcugcgacagacagagacugcuggccaaggacuacuacaacccccagcccuaccccagcuacgagggcggcgccggcacccccagcggcaccgccgccgccguggccgccgacaaguaccacagaggcagcaaggcccugcccacccagcagggccugcagggcagacccgccuuccccggcuacggcgugcaggacagcagccccuaccccggcagauacgccggcgaggagagccugcaggccuggggcgccccccagcccccccccccccagccccagccccugcccgccggcguggccaaguacgacgagaaccugaugaagaagaccgccgugccccccagcagacaguacgccgagcagggcgcccaggugcccuucagaacccacagccugcacgugcagcagcccccccccccccagcagccccuggccuaccccaagcugcagagacagaagcugcagaacgacaucgccagcccccugcccuucccccagggcacccacuucccccagcacagccagagcuuccccaccagcagcaccuacagcagcagcgugcagggcggcggccagggcgcccacagcuacaagagcugcaccgcccccaccgcccagccccacgacagaccccugaccgccagcagcagccuggcccccggccagagagugcagaaccugcacgccuaccagagcggcagacugagcuacgaccagcagcagcagcagcagcagcagcagcagcagcagcagcaggcccugcagagcagacaccacgcccaggagacccugcacuaccagaaccuggccaaguaccagcacuacggccagcagggccagggcuacugccagcccgacgccgccgugagaacccccgagcaguacuaccagaccuucagccccagcagcagccacagccccgccagaagcgugggcagaagccccagcuacagcagcacccccagcccccugaugcccaaccuggagaacuuccccuacagccagcagccccugagcaccggcgccuuccccgccggcaucaccgaccacagccacuucaugccccugcugaaccccagccccaccgacgccaccagcagcguggacacccaggccggcaacugcaagccccugcagaaggacaagcugcccgagaaccugcugagcgaccugagccugcagagccugaccgcccugaccagccagguggagaacaucagcaacaccgugcagcagcugcugcugagcaaggccgccgugccccagaagaagggcgugaagaaccuggugagcagaacccccgagcagcacaagagccagcacugcagccccgagggcagcggcuacagcgccgagcccgccggcaccccccugagcgagccccccagcagcaccccccagagcacccacgccgagccccaggaggccgacuaccugagcggcagcgaggacccccuggagagaagcuuccuguacugcaaccaggccagaggcagccccgccagagugaacagcaacagcaaggccaagcccgagagcgugagcaccugcagcgugaccagccccgacgacaugagcaccaagagcgacgacagcuuccagagccugcacggcagccugccccuggacagcuucagcaaguucguggccggcgagagagacugccccagacugcugcugagcgcccuggcccaggaggaccuggccagcgagauccugggccugcaggaggccaucggcgagaaggccgacaaggccugggccgaggcccccagccuggugaaggacagcagcaagccccccuucagccuggagaaccacagcgccugccuggacagcguggccaagagcgccuggcccagacccggcgagcccgaggcccugcccgacagccugcagcuggacaagggcggcaacgccaaggacuucagccccggccuguucgaggaccccagcguggccuucgccacccccgaccccaagaagaccaccggcccccugagcuucggcaccaagcccacccugggcgugcccgcccccgaccccaccaccgccgccuucgacugcuuccccgacaccaccgccgccagcagcgccgacagcgccaaccccuucgccuggcccgaggagaaccugggcgacgccugccccagauggggccugcaccccggcgagcugaccaagggccuggagcagggcggcaaggccagcgacggcaucagcaagggcgacacccacgaggccagcgccugccugggcuuccaggaggaggacccccccggcgagaagguggccagccugcccggcgacuucaagcaggaggaggugggcggcgugaaggaggaggccggcggccugcugcagugccccgagguggccaaggccgacagauggcuggaggacagcagacacugcugcagcaccgccgacuucggcgaccugccccugcugccccccaccagcagaaaggaggaccuggaggccgaggaggaguacagcagccugugcgagcugcugggcagccccgagcagagacccggcaugcaggacccccugagccccaaggccccccugaucugcaccaaggaggagguggaggaggugcuggacagcaaggccggcuggggcagccccugccaccugagcggcgagagcgugauccugcugggccccaccgugggcaccgagagcaaggugcagagcugguucgagagcagccugagccacaugaagcccggcgaggagggccccgacggcgagagagcccccggcgacagcaccaccagcgacgccagccuggcccagaagcccaacaagcccgccgugcccgaggcccccaucgccaagaaggagcccgugcccagaggcaagagccugagaagcagaagagugcacagaggccugcccgaggccgaggacagccccugcagagcccccgugcugcccaaggaccugcugcugcccgagagcugcaccggccccccccagggccagauggagggcgccggcgcccccggcagaggcgccagcgagggccugcccagaaugugcaccagaagccugaccgcccugagcgagcccagaacccccggcccccccggccugaccaccacccccgccccccccgacaagcugggcggcaagcagagagccgccuucaagagcggcaagagagugggcaagcccagccccaaggccgccagcagccccagcaaccccgccgcccugcccguggccagcgacagcagccccaugggcagcaagaccaaggagaccgacagccccagcacccccggcaaggaccagagaagcaugauccugagaagcagaaccaagacccaggagaucuuccacagcaagagaagaagacccagcgagggcagacugcccaacugcagagccaccaagaagcugcuggacaacagccaccugcccgccaccuucaaggugagcagcagcccccagaaggagggcagagugagccagagagccagagugcccaagcccggcgccggcagcaagcugagcgacagaccccugcacgcccugaagagaaagagcgccuucauggcccccgugcccaccaagaagagaaaccuggugcugagaagcagaagcagcagcagcagcaacgccagcggcaacggcggcgacggcaaggaggagagacccgagggcagccccacccuguucaagagaaugagcagccccaagaaggccaagcccaccaagggcaacggcgagcccgccaccaagcugcccccccccgagacccccgacgccugccugaagcuggccagcagagccgccuuccagggcgccaugaagaccaaggugcugccccccagaaagggcagaggccugaagcuggaggccaucgugcagaagaucaccagccccagccugaagaaguucgccugcaaggcccccggcgccagccccggcaacccccugagccccagccugagcgacaaggacagaggccugaagggcgccggcggcagccccgugggcguggaggagggccuggugaacgugggcaccggccagaagcugcccaccagcggcgccgacccccugugcagaaaccccaccaacagaagccugaagggcaagcugaugaacagcaagaagcugagcagcaccgacugcuucaagaccgaggccuucaccagccccgaggcccugcagcccggcggcaccgcccuggcccccaagaagagaagcagaaagggcagagccggcgcccacggccugagcaagggcccccuggagaagagacccuaccugggccccgcccugcugcugacccccagagacagagccagcggcacccagggcgccagcgaggacaacagcggcggcggcggcaagaagcccaagauggaggagcugggccuggccagccagccccccgagggcagacccugccagccccagaccagagcccagaagcagcccggccacaccaacuacagcagcuacagcaagagaaagagacugaccagaggcagagccaagaacaccaccagcagccccugcaagggcagagccaagagaagaagacagcagcaggugcugccccuggaccccgccgagcccgagaucagacugaaguacaucagcagcugcaagagacugagaagcgacagcagaacccccgccuucagccccuucgugagaguggagaagagagacgccuucaccaccaucugcaccguggugaacagccccggcgacgcccccaagccccacagaaagcccagcagcagcgccagcagcagcagcagcagcagcagcuucagccuggacgccgccggcgccagccuggccacccugcccggcggcagcauccugcagcccagacccagccugccccugagcagcaccaugcaccugggccccguggugagcaaggcccugagcaccagcugccuggugugcugccugugccagaaccccgccaacuucaaggaccugggcgaccugugcggccccuacuaccccgagcacugccugcccaagaagaagcccaagcugaaggagaaggugagacccgagggcaccugcgaggaggccagccugccccuggagagaacccugaagggccccgagugcgccgccgccgccaccgccggcaagccccccagacccgacggccccgccgaccccgccaagcagggcccccugagaaccagcgccagaggccugagcagaagacugcagagcugcuacugcugcgacggcagagaggacggcggcgaggaggccgcccccgccgacaagggcagaaagcacgagugcagcaaggaggcccccgccgagcccggcggcgaggcccaggagcacugggugcacgaggccugcgccguguggaccggcggcguguaccugguggccggcaagcuguucggccugcaggaggccaugaagguggccguggacaugaugugcagcagcugccaggaggccggcgccaccaucggcugcugccacaagggcugccugcacaccuaccacuaccccugcgccagcgacgccggcugcaucuucaucgaggagaacuucagccugaagugccccaagcacaagagacugcccuaa

SEQ ID NO: 22387 - RNA, 1443 nt, Artificial Sequence
  RAI2__Homo_sapiens__NP_001166203
auggacgaccugcagagccagaaccugagcauggacaugaccgacagcccccccgcccuggccaacaacagacuggagaacggcauggcccagcugaucaccaccgaggccuggaacaucaacagcaccgaccugguggagggcagcagcgcccccgagcugaaccccaacggcaacgccaccuacgugaugaccacccagggccccgugcagcugcccguggugcuggagcagcacguguuccagcaccugaacagcccccuggugcugccccaggaggcccccugcagcagcagcaccauccacaacaaccuguuccagggcgccgaggaccccgaggcccagccccagcugcuggaccugagaauccccagccagccccaggagcccacccugcccuucgaggccgugcugcagaaccuguuccccagccagggcacccugggccccccccccugccagcccccccccggcuacgcccccgugcccccccagcccuucagcagcccccugagcccccuggugccccccgccacccugcuggugcccuaccccgugaucgugccccugcccgugcccgugcccauccccauccccauccccgugccccagagcagcgagagcaaguucagcagcagcuuccccaagccccccagcagcuucggccugcaccccuucaagggcacccagaccccccuggagaaggacgagcugaagcccuucgacauccugcagcccaaggaguacuuccagcugagcagacacaccgugaucaagaugggcagcgagaacgaggcccuggaccugagcaugaagagcgugcccuggcugaaggccggcgaggugagcccccccaucuuccaggaggacgccgcccuggaccugagcguggccgcccacagaaagagcgagcccccccccgagacccuguacgacagcggcgccagcguggacagcagcggccacaccgugauggagaagcugcccagcggcauggagaucagcuucgcccccgccaccagccacgaggcccccgccaugauggacagccacaucagcagcagcgacgccgccaccgagaugcugagccagcccaaccaccccagcggcgaggugaaggccgagaacaacaucgagauggugggcgagagccaggccgccaaggugaucgugagcguggaggacgccgugcccaccaucuucugcggcaagaucaagggccugagcggcgugagcaccaagaacuucagcuucaagagagaggacagcgugcugcagggcuacgacaucaacagccagggcgaggagagcaugggcaacgccgagccccugagaaagcccaucaagaacagaagcaucaagcugaagaaggugaacagccaggagauccacaugcugcccaucaagaagcagagacuggccaccuucuuccccagaaaguaa

SEQ ID NO: 22388 - RNA, 621 nt, Artificial Sequence
  RALA__Homo_sapiens__XP_006715825
auggccgccaacaagcccaagggccagaacagccuggcccugcacaaggugaucauggugggcagcggcggcgugggcaagagcgcccugacccugcaguucauguacgacgaguucguggaggacuacgagcccaccaaggccgacagcuacagaaagaagguggugcuggacggcgaggaggugcagaucgacauccuggacaccgccggccaggaggacuacgccgccaucagagacaacuacuucagaagcggcgagggcuuccugugcguguucagcaucaccgagauggagagcuucgccgccaccgccgacuucagagagcagauccugagagugaaggaggacgagaacgugcccuuccugcuggugggcaacaagagcgaccuggaggacaagagacaggugagcguggaggaggccaagaacagagccgagcaguggaacgugaacuacguggagaccagcgccaagaccagagccaacguggacaagguguucuucgaccugaugagagagaucagagccagaaagauggaggacagcaaggagaagaacggcaagaagaagagaaagagccuggccaagagaaucagagagagaugcugcauccuguaa

SEQ ID NO: 22389 - RNA, 621 nt, Artificial Sequence
  RALB__Homo_sapiens__NP_002872
auggccgccaacaagagcaagggccagagcagccuggcccugcacaaggugaucauggugggcagcggcggcgugggcaagagcgcccugacccugcaguucauguacgacgaguucguggaggacuacgagcccaccaaggccgacagcuacagaaagaagguggugcuggacggcgaggaggugcagaucgacauccuggacaccgccggccaggaggacuacgccgccaucagagacaacuacuucagaagcggcgagggcuuccugcugguguucagcaucaccgagcacgagagcuucaccgccaccgccgaguucagagagcagauccugagagugaaggccgaggaggacaagaucccccugcugguggugggcaacaagagcgaccuggaggagagaagacaggugcccguggaggaggccagaagcaaggccgaggaguggggcgugcaguacguggagaccagcgccaagaccagagccaacguggacaagguguucuucgaccugaugagagagaucagaaccaagaagaugagcgagaacaaggacaagaacggcaagaagagcagcaagaacaagaagagcuucaaggagagaugcugccugcuguaa

SEQ ID NO: 22390 - RNA, 1968 nt, Artificial Sequence
  RALBP1__Homo_sapiens__NP_006779
augaccgagugcuuccugccccccaccagcagccccagcgagcacagaagaguggagcacggcagcggccugaccagaacccccagcagcgaggagaucagccccaccaaguuccccggccuguacagaaccggcgagcccagccccccccacgacauccugcacgagccccccgacguggugagcgacgacgagaaggaccacggcaagaagaagggcaaguucaagaagaaggagaagagaaccgagggcuacgccgccuuccaggaggacagcagcggcgacgaggccgagagccccagcaagaugaagagaagcaagggcauccacguguucaagaagcccagcuucagcaagaagaaggagaaggacuucaagaucaaggagaagcccaaggaggagaagcacaaggaggagaagcacaaggaggagaagcacaaggagaagaagagcaaggaccugaccgccgccgacguggugaagcaguggaaggagaagaagaagaagaagaagcccauccaggagcccgaggugccccagaucgacgugcccaaccugaagcccaucuucggcaucccccuggccgacgccguggagagaaccaugauguacgacggcaucagacugcccgccguguucagagagugcaucgacuacguggagaaguacggcaugaagugcgagggcaucuacagagugagcggcaucaagagcaagguggacgagcugaaggccgccuacgacagagaggagagcaccaaccuggaggacuacgagcccaacaccguggccagccugcugaagcaguaccugagagaccugcccgagaaccugcugaccaaggagcugaugcccagauucgaggaggccugcggcagaaccaccgagaccgagaaggugcaggaguuccagagacugcugaaggagcugcccgagugcaacuaccugcugaucagcuggcugaucgugcacauggaccacgugaucgccaaggagcuggagaccaagaugaacauccagaacaucagcaucgugcugagccccaccgugcagaucagcaacagagugcuguacguguucuucacccacgugcaggagcuguucggcaacguggugcugaagcaggugaugaagccccugagauggagcaacauggccaccaugcccacccugcccgagacccaggccggcaucaaggaggagaucagaagacaggaguuccugcugaacugccugcacagagaccugcagggcggcaucaaggaccugagcaaggaggagagacugugggaggugcagagaauccugaccgcccugaagagaaagcugagagaggccaagagacaggagugcgagaccaagaucgcccaggagaucgccagccugagcaaggaggacgugagcaaggaggagaugaacgagaacgaggaggugaucaacauccugcuggcccaggagaacgagauccugaccgagcaggaggagcugcuggccauggagcaguuccugagaagacagaucgccagcgagaaggaggagaucgagagacugagagccgagaucgccgagauccagagcagacagcagcacggcagaagcgagaccgaggaguacagcagcgagagcgagagcgagagcgaggacgaggaggagcugcagaucauccuggaggaccugcagagacagaacgaggagcuggagaucaagaacaaccaccugaaccaggccauccacgaggagagagaggccaucaucgagcugagagugcagcugagacugcugcagaugcagagagccaaggccgagcagcaggcccaggaggacgaggagcccgaguggagaggcggcgccgugcagccccccagagacggcgugcuggagcccaaggccgccaaggagcagcccaaggccggcaaggagcccgccaagcccagccccagcagagacagaaaggagaccagcaucuaa

SEQ ID NO: 22391 - RNA, 6150 nt, Artificial Sequence
  RALGAPA1__Homo_sapiens__NP_001269972
auguucagcaagaagccccacggcgacgugaagaagagcacccagaaggugcuggacaccaagaaggacgcccugaccagacugaagcaccugagaaucgugaucgagaacgccgagagcaucgaccugaagcaguucuucgaccagcacuucagccacaucuacuacguguucuucgagaacuucgugaccaucgaggccagccugaagcagaagggccacaagagccagagagaggagcuggacgccauccuguucaucuucgagaagauccugcagcugcugcccgagagaauccaccagagauggcaguuccacagcaucggccugauccugaagaagcugcugcacaccggcaacagccugaagaucagaagagagggcgugagacuguuccugcuguggcugcaggcccugcagaacaacugcagcaaggagcagcuguggauguucagcugccugauccccggcuucagcgccccccagagcgagcacggccccagaacccuggacaaccugaucaaccccccccugaaccugcaggagacccaggugaccaucgaggagaucaccccccuggugcccccccagagcggcgacaagggccaggaggaccugaccagcuacuuccuggaggcccugcugaaguacaucgugauccaggugaagagccuggaguggaagaacaaggagaaccaggagagaggcuucagcuuccuguucagccacuucaagaaguacuaccugcccuacaucuuccccaacaucugcaaggagaacagccuguaccaccccauccuggacaucccccagaugagacccaagccccacuacguggugaucaagaaggacgccgagaccaacgaggccaucuacugcaccaaggagcccuucaucaaggccagagugaucgugaucagauggcuggugagcuucuggcuggagcccaagccccacaccggcccccacauccccggcauggagggcgaggugcugcccaagaacauccagagagccgccgccagccuggugagcagagaggagagcaagaacgacaacgccgacaagaccgacagaaccaccgagcccgagcagagccacagcaacaccagcacccugaccgagagagagcccagcagcagcagccugugcagcaucgacgaggagcaccugaccgacaucgagaucgugagaagaguguucagcagcaagagaagcaacgugaacuucgugaccgagaucuucagacaggccuuccugcugcccaucugcgaggccgccgccaugagaaagguggugaagguguaccaggaguggauccagcaggaggagaagccccuguucaugcaggagcccgaggagaucgugaucaccagcagcgaccugcccugcaucgagaacgugaccgaccacgacaucagcauggaggagggcgagaagagagaggaggagaacggcaccaacaccgccgaccacgugagaaacagcagcugggccaagaacggcagcuaccagggcgcccugcacaacgccagcgaggaggccaccgagcagaacaucagagccggcacccaggccgugcugcagguguucaucaucaacagcagcaacaucuuccugcuggagcccgccaacgagaucaagaaccugcuggacgagcacaccgacaugugcaagagaauccugaacaucuacagauacaugguggugcaggugagcauggacaagaagaccugggagcagaugcugcuggugcugcugagagugaccgagagcgugcugaagaugcccagccaggccuuccugcaguuccagggcaagaagaacaugacccuggccggcagacuggccggcccccuguuccagacccugaucguggccuggaucaaggccaaccugaacguguacaucagcagagagcugugggacgaccugcugagcgugcugagcagccugaccuacugggaggagcuggccaccgaguggagccugaccauggagacccugaccaaggugcuggccagaaaccuguacagccuggaccugagcgaccugccccuggacaagcugagcgagcagaagcagaagaagcacaagggcaagggcgugggccacgaguuccagaaggugagcguggacaagagcuucagcagaggcuggagcagagaccagcccggccaggcccccaugagacagagaagcgccaccaccaccggcagccccggcaccgagaaggccagaagcaucgugagacagaagaccguggacaucgacgacgcccagauccugcccagaagcaccagagugagacacuucagccagagcgaggagaccggcaacgagguguucggcgcccugaacgaggagcagccccugcccagaagcagcagcaccagcgacauccuggagcccuucaccguggagagagccaaggaggccgagcagaacgccaccagaggcagcaccgagggcagcgugcagagcugcaacggccuguucuggaaggagagcugcagcgacaucggcggcagcagcgccaacgugcccgaccugauggacgaguucaucgccgagagacugagaagcggcaacgccagcaccaugaccagaagaggcagcagccccggcagccuggagauccccaaggaccugcccgacauccugaacaagcagaaccagaugagacccaucgacgaccccggcgugcccagcgaguggaccagccccgccagcgccggcagcagcgaccugaucagcagcgacagccacagcgacagcuucagcgccuuccaguacgacggcagaaaguucgacaacuucggcuucggcaccgacaccggcgugaccagcagcgccgacguggacagcggcagcggccaccaccagagcgccgaggagcaggagguggccagccugaccacccugcacaucgacagcgagaccagcagccugaaccagcaggccuucagcgccgagguggccaccaucaccggcagcgagagcgccagccccgugcacagcccccugggcagcagaagccagacccccagccccagcacccugaacaucgaccacauggagcagaaggaccugcagcuggacgagaagcugcaccacagcgugcugcagacccccgacgaccuggagaucagcgaguuccccagcgagugcugcagcgugauggccggcggcacccugaccggcuggcacgccgacguggccaccgugauguggagaagaaugcugggcauccugggcgacgugaacagcaucauggaccccgagauccacgcccagguguucgacuaccugugcgagcuguggcagaaccuggccaagaucagagacaaccugggcaucagcaccgacaaccugaccagccccagcccccccgugcugauccccccccugagaauccugacccccuggcuguucaaggccaccaugcugaccgacaaguacaagcagggcaagcugcacgccuacaagcugaucugcaacaccaugaagagaagacaggacgugagccccaacagagacuuccugacccacuucuacaacaucaugcacugcggccugcugcacaucgaccaggacaucgugaacaccaucaucaagcacugcagcccccaguucuucagccugggccugcccggcgccaccaugcugaucauggacuucaucguggccgccggcagaguggccagcagcgccuuccugaacgcccccagaguggaggcccaggugcugcugggcagccuggugugcuuccccaaccuguacugcgagcugcccagccugcaccccaacauccccgacguggccgugagccaguucaccgacgugaaggagcugaucaucaagaccgugcugagcagcgccagagacgagcccagcggccccgccagaugcguggcccugugcagccugggcaucuggaucugcgaggagcuggugcacgagagccaccacccccagaucaaggaggcccugaacgugaucugcgugagccugaaguucaccaacaagaccguggcccacguggccugcaacaugcugcacaugcuggugcacuacgugcccagacugcagaucuaccagcccgacagcccccugaagaucauccagauccugaucgccaccaucacccaccugcugcccagcaccgaggccagcagcuacgagauggacaagagacugguggugagccugcugcugugccugcuggacuggaucauggcccugccccugaagacccugcugcagcccuuccacgccaccggcgccgagagcgacaagaccgagaagagcgugcugaacugcaucuacaaggugcugcacggcugcguguacggcgcccagugcuucagcaaccccagauacuuccccaugagccugagcgaccuggccagcguggacuacgaccccuucaugcaccuggagagccugaaggagcccgagccccugcacagccccgacagcgagagaagcagcaagcugcagcccgugaccgaggugaagacccagaugcagcacggccugaucagcaucgccgccagaaccgugaucacccaccuggugaaccaccugggccacuaccccaugagcggcggccccgccaugcugaccagccaggugugcgagaaccacgacaaccacuacagcgagagcaccgagcugagccccgagcuguucgagagccccaacauccaguucuucgugcugaacaacaccacccuggugagcugcauccagaucagaagcgaggagaacaugcccggcggcggccugagcgccggccuggccagcgccaacagcaacgugagaaucaucgugagagaccugagcggcaaguacagcugggacagcgccauccuguacggccccccccccgugagcggccugagcgagcccaccagcuucaugcugagccugagccaccaggagaagcccgaggagccccccaccagcaacgagugccuggaggacaucaccgugaaggacggccugagccugcaguucaagagauucagagagaccgugcccaccugggacaccaucagagacgaggaggacgugcuggacgagcugcugcaguaccugggcgugaccagccccgagugccugcagagaaccggcaucagccugaacauccccgccccccagcccgugugcaucagcgagaagcaggagaacgacgugaucaacgccauccugaagcagcacaccgaggagaaggaguucguggagaagcacuucaacgaccugaacaugaaggccguggagcaggacgagcccaucccccagaagccccagagcgccuucuacuacugcagacugcugcugagcauccugggcaugaacagcugggacaagagaagaagcuuccaccugcugaagaagaacgagaagcugcugagagagcugagaaaccuggacagcagacagugcagagagacccacaagaucgccguguucuacguggccgagggccaggaggacaagcacagcauccugaccaacaccggcggcagccaggccuacgaggacuucguggccggccugggcugggaggugaaccugaccaaccacugcggcuucaugggcggccugcagaagaacaagagcaccggccugaccacccccuacuucgccaccagcaccguggaggugaucuuccacgugagcaccagaaugcccagcgacagcgacgacagccugaccaagaagcugagacaccugggcaacgacgaggugcacaucguguggagcgagcacaccagagacuacagaagaggcaucauccccaccgaguucggcgacgugcugaucgugaucuaccccaugaagaaccacauguucagcauccagaucaugaagaagcccgaggugcccuucuucggcccccuguucgacggcgccaucgugaacggcaaggugcugcccaucauggugagagccaccgccaucaacgccagcagagcccugaagagccugaucccccuguaccagaacuucuacgaggagagagccagauaccugcagaccaucgugcagcaccaccuggagcccaccaccuucgaggacuucgccgcccagguguucagccccgcccccuaccaccaccugcccagcgacgccgaccacuaa

SEQ ID NO: 22392 - RNA, 5622 nt, Artificial Sequence
  RALGAPA2__Homo_sapiens__NP_065076
auguucagcagaagaagccacggcgacgugaagaagagcacccagaaggugcuggaccccaagaaggacgugcugaccagacugaagcaccugagagcccugcuggacaacguggacgccaacgaccugaagcaguucuucgagaccaacuacagccagaucuacuucaucuucuacgagaacuucaucgcccuggagaacagccugaagcugaagggcaacaacaagagccagagagaggagcuggacagcauccuguuccuguucgagaagauccugcaguuccugcccgagagaaucuucuucagauggcacuaccagagcaucggcagcacccugaagaagcugcugcacaccggcaacagcaucaagaucagaugcgagggcaucagacuguuccugcuguggcugcaggcccugcagaccaacugcgccgaggagcaggugcugaucuucgccugccuggugcccggcuuccccgccgugaugagcagcagaggccccugcacccuggagacccugaucaaccccagccccagcguggccgacgugaagaucuaccccgaggagaucaccccccugcugcccgccaucagcggcgagaagaucgccgaggaccagaccugcuucuuccugcagauccugcugaaguacauggugauccaggccgccagccuggaguggaagaacaaggagaaccaggacaccggcuucaaguuccuguucacccuguucagaaaguacuaccugccccaccuguuccccagcuucaccaagcugaccaacaucuacaagcccgugcuggacaucccccaccugagacccaagcccguguacaucaccaccaccagagacaacgagaacaucuacagcaccaagauccccuacauggccgccagagugguguucaucaaguggaucgugaccuucuuccuggagaagaaguaccugaccgccacccagaacaccaagaacggcguggacgugcugcccaagaucauccagaccgugggcggcggcgccgugcaggagagagcccccgagcuggacggcggcggccccaccgagcaggacaagagccacagcaacagcagcacccugagcgacagaagacugagcaacagcagccugugcagcaucgaggaggagcacagaaugguguacgagauggugcagagaauccugcugagcaccagaggcuacgugaacuucgugaacgagguguuccaccaggccuuccugcugcccagcugcgagaucgccgugaccagaaagguggugcagguguacagaaaguggauccugcaggacaagcccguguucauggaggagcccgacagaaaggacguggcccaggaggacgccgagaagcugggcuucagcgagaccgacagcaaggaggccagcagcgagagcagcggccacaagagaagcagcagcuggggcagaaccuacagcuucaccagcgccaugagcagaggcugcgugaccgaggaggagaacaccaacgugaaggccggcgugcaggcccugcugcagguguuccugaccaacagcgccaacaucuuccugcuggagcccugcgccgaggugcccgugcugcugaaggagcagguggacgccugcaaggccgugcugaucaucuucagaagaaugaucauggagcugaccaugaacaagaagaccugggagcagaugcugcagauccugcugagaaucaccgaggccgugaugcagaagcccaaggacaagcagaucaaggaccuguucgcccagagccuggccggccugcuguucagaacccugaugguggccuggaucagagccaaccugugcguguacaucagcagagagcugugggacgacuuccugggcgugcugagcagccugaccgagugggaggagcugaucaacgagugggccaacaucauggacagccugaccgccgugcuggccagaaccguguacggcguggagaugaccaaccugccccuggacaagcugagcgagcagaaggagaagaagcagagaggcaagggcugcgugcuggacccccagaagggcaccaccgugggcagaagcuucagccugagcuggagaagccaccccgacgugaccgagcccaugagauucagaagcgccaccaccagcggcgcccccggcguggagaaggccagaaacaucgugagacagaaggccaccgagguggaggagugccagcagagcgagaacgcccccgccgccggcagcggccaccugaccgugggccagcagcagcaggugcugagaagcagcagcaccagcgacauccccgagccccugugcagcgacagcagccagggccagaaggccgagaacacccagaacagcagcagcagcgagccccagcccauccaggagaacaagggccacgugaagagagagcacgagggcaucaccauccuggugagaagaagcagcagccccgccgagcuggaccugaaggacgaccugcagcagacccagggcaagugcagagagagacagaagagcgagagcaccaacagcgacaccacccugggcugcaccaacgaggccgagcugagcaugggccccuggcagaccugcgaggaggaccccgagcugaacacccccaccgacgugguggccgacgccgacgccagacacuggcugcagcugagccccaccgacgccagcaaccugaccgacagcagcgagugccugaccgacgacugcagcaucaucgccggcggcagccugaccggcuggcaccccgacagcgccgccgugcuguggagaagagugcugggcauccugggcgacgugaacaacauccagagccccaagauccacgccagaguguucugcuaccuguacgagcugugguacaagcuggccaagaucagagacaaccuggccaucagccuggacaaccagagcagccccagcccccccgugcugauccccccccugagaauguucgccagcuggcuguucaaggccgccacccugcccaacgaguacaaggagggcaagcugcaggccuacagacugaucugcgccaugaugaccagaagacaggacgugcugcccaacagcgacuuccuggugcacuucuaccuggugaugcaccugggccugaccagcgaggaccaggacauccugaacaccaucaucagacacugcccccccagauucuucagccugggcuuccccggcuucagcaugcuggugggcgacuucaucaccgccgccgccagagugcugagcaccgacauccugaccgcccccagaagcgaggccgugaccgugcugggcagccuggugugcuuccccaacaccuaccaggagaucccccugcugcagagcgugcccgaggugaacgaggccaucaccggcaccgaggacgugaagcacuaccugaucaacauccugcugaagaacgccaccgaggagcccaacgaguacgccagaugcaucgccgugugcagccugggcguguggaucugcgaggagcuggcccagugcaccagccacccccaggugaaggaggccaucaacgugaucggcgugacccugaaguuccccaacaagaucguggcccagguggccugcgacgugcugcagcugcuggugagcuacugggagaagcugcagauguucgagaccagccugcccagaaagauggccgagauccugguggccaccguggccuuccugcugcccagcgccgaguacagcagcguggagaccgacaagaaguucaucgugagccugcugcugugccugcuggacuggugcauggcccugcccgugagcgugcugcugcaccccgugagcaccgccgugcuggaggagcagcacagcgccagagccccccugcuggacuacaucuacagagugcugcacugcugcgugugcggcagcagcaccuacacccagcagagccacuacauccugacccuggccgaccugagcagcaccgacuacgaccccuuccugccccuggccaacgugaagagcagcgagcccgugcaguaccacagcagcgccgagcugggcaaccugcugaccguggaggaggagaagaagagaagaagccuggagcugaucccccugaccgccagaauggugauggcccaccuggugaaccaccugggccacuacccccugagcggcggccccgccauccugcacagccuggugagcgagaaccacgacaacgcccacguggagggcagcgagcugagcuucgagguguucagaagccccaaccugcagcuguucguguucaacgacagcacccugaucagcuaccugcagacccccaccgagggccccgugggcggcagccccgugggcagccugagcgacgugagagugaucgugagagacaucagcggcaaguacagcugggacggcaaggugcuguacggcccccuggagggcugccuggcccccaacggcagaaaccccagcuuccugaucagcagcuggcacagagacaccuucggcccccagaaggacagcagccagguggaggagggcgacgacgugcuggacaagcugcuggagaacaucggccacaccagccccgagugccugcugcccagccagcugaaccugaacgagcccagccugacccccugcggcaugaacuacgaccaggagaaggagaucaucgaggugauccugagacagaacgcccaggaggacgaguacauccagagccacaacuucgacagcgccaugaaggugaccagccagggccagcccagccccguggagcccagaggccccuucuacuucugcagacugcugcuggacgaccugggcaugaacagcugggacagaagaaagaacuuccaccugcugaagaagaacagcaagcugcugagagagcugaagaaccuggacagcagacagugcagagagacccacaagaucgccguguucuacaucgccgagggccaggaggacaagugcagcauccugagcaacgagagaggcagccaggccuacgaggacuucguggccggccugggcugggagguggaccugagcacccacugcggcuucaugggcggccugcagagaaacggcagcaccggccagaccgcccccuacuacgccaccagcaccguggaggugaucuuccacgugagcaccagaaugcccagcgacagcgacgacagccugaccaagaagcugagacaccugggcaacgacgaggugcacaucguguggagcgagcacagcagagacuacagaagaggcaucauccccaccgccuucggcgacgugagcaucaucaucuaccccaugaagaaccacauguucuucaucgccaucaccaagaagcccgaggugcccuucuucggcccccuguucgacggcgccaucgugagcggcaagcugcugcccagccuggugugcgccaccugcaucaacgccagcagagccgugaagugccugaucccccuguaccagagcuucuacgaggagagagcccuguaccuggaggccaucauccagaaccacagagaggugaugaccuucgaggacuucgccgcccagguguucagccccagccccagcuacagccugagcggcaccgacuaa

SEQ ID NO: 22393 - RNA, 4476 nt, Artificial Sequence
  RALGAPB__Homo_sapiens__NP_001269847
auguacagcgaguggagaagccugcaccuggugauccagaacgaccagggccacaccagcgugcugcacagcuaccccgagagcgugggcagagagguggccaacgccguggugagaccccugggccaggugcugggcacccccagcguggccggcagcgagaaccugcugaagaccgacaaggaggugaaguggaccauggaggugaucugcuacggccugacccugccccuggacggcgagaccgugaaguacugcguggacguguacaccgacuggaucauggcccuggugcugcccaaggacagcaucccccugcccgugaucaaggagcccaaccaguacgugcagaccauccugaagcaccugcagaaccuguucgugcccagacaggagcagggcagcagccagaucagacugugccugcaggugcugagagccauccagaagcuggccagagagagcagccugauggccagagagaccugggaggugcugcugcuguuccugcugcagaucaacgacauccugcuggccccccccaccgugcagggcggcaucgccgagaaccuggccgagaagcugaucggcgugcuguucgagguguggcugcuggccugcaccagaugcuuccccaccccccccuacuggaagaccgccaaggagaugguggccaacuggagacaccaccccgccgugguggagcaguggagcaaggugaucugcgcccugaccagcagacugcugagauucaccuacggccccagcuuccccgccuucaaggugcccgacgaggacgccagccugaucccccccgagauggacaacgagugcguggcccagaccugguucagauuccugcacaugcugagcaaccccguggaccugagcaaccccgccaucaucagcagcacccccaaguuccaggagcaguuccugaacgugagcggcaugccccaggagcugaaccaguaccccugccugaagcaccugccccagaucuucuucagagccaugagaggcaucagcugccugguggacgccuuccugggcaucagcagacccagaagcgacagcgccccccccacccccgugaacagacugagcaugccccagagcgccgccgugagcaccacccccccccacaacagaagacacagagccgugaccgugaacaaggccaccaugaagaccagcaccgugagcaccgcccacgccagcaaggugcagcaccagaccagcagcaccagcccccugagcagccccaaccagaccagcagcgagcccagaccccugcccgcccccagaagacccaaggugaacagcauccugaaccuguucggcagcuggcuguucgacgccgccuucgugcacugcaagcugcacaacggcaucaacagagacagcagcaugaccgccaucaccacccaggccagcauggaguucagaagaaagggcagccagaugagcaccgacaccauggugagcaaccccauguucgacgccagcgaguuccccgacaacuacgaggccggcagagccgaggccugcggcacccugugcagaaucuucugcagcaagaagaccggcgaggagauccugcccgccuaccugagcagauucuacaugcugcugauccagggccugcagaucaacgacuacgugugccaccccgugcuggccagcgugauccugaacagccccccccuguucugcugcgaccugaagggcaucgacgugguggugcccuacuucaucagcgcccuggagaccauccugcccgacagagagcugagcaaguucaagagcuacgugaaccccaccgagcugagaagaagcagcaucaacauccugcugagccugcugccccugccccaccacuucggcaccgugaagagcgagguggugcuggagggcaaguucagcaacgacgacagcagcagcuacgacaagcccaucaccuuccugagccugaagcugagacuggugaacauccugaucggcgcccugcagaccgagaccgaccccaacaacacccagaugauccugggcgccaugcugaacaucgugcaggacagcgcccugcuggaggccaucggcugccagauggagaugggcggcggcgagaacaaccugaagagccacagcagaaccaacagcggcaucagcagcgccagcggcggcagcaccgagcccaccacccccgacagcgagagacccgcccaggcccugcugagagacuacgacagcgccgccggccugcugaucagaagcauccaccuggugacccagagacugaacagccaguggagacaggacaugagcaucagccuggccgcccuggagcugcugagcggccuggccaaggugaaggugaugguggacagcggcgacagaaagagagccaucagcagcgugugcaccuacaucguguaccagugcagcagacccgccccccugcacagcagagaccugcacagcaugaucguggccgccuuccagugccugugcguguggcugaccgagcaccccgacaugcuggacgagaaggacugccugaaggaggugcuggagaucguggagcugggcaucagcggcagcaagagcaagaacaacgagcaggaggugaaguacaagggcgacaaggagcccaaccccgccagcaugagagugaaggacgccgccgaggccacccugaccugcaucaugcagcugcugggcgccuuccccagccccagcggccccgccagccccugcagccuggugaacgagaccacccugaucaaguacagcagacugcccaccaucaacaagcacagcuucagauacuucgugcuggacaacagcgugauccuggccaugcuggagcagccccugggcaacgagcagaacgacuucuuccccagcgugaccgugcuggugagaggcaugagcggcagacuggccugggcccagcagcugugccugcugcccagaggcgccaaggccaaccagaagcuguucgugcccgagcccagacccgugcccaagaacgacgugggcuucaaguacagcgugaagcacagacccuuccccgaggagguggacaagauccccuucgugaaggccgaccugagcauccccgaccugcacgagaucgugaccgaggagcuggaggagagacacgagaagcugagaagcggcauggcccagcagaucgccuacgagauccaccuggagcagcagagcgaggaggagcugcagaagagaagcuuccccgaccccgugaccgacugcaagccccccccccccgcccaggaguuccagaccgccagacuguuccugagccacuucggcuuccugagccuggaggcccugaaggagcccgccaacagcagacugcccccccaccugaucgcccuggacagcaccauccccggcuucuucgacgacaucggcuaccuggaccugcugcccugcagacccuucgacaccguguucaucuucuacaugaagcccggccagaagaccaaccaggagauccugaagaacguggagagcagcagaaccgugcagccccacuuccuggaguuccugcugagccugggcuggagcguggacgugggcagacaccccggcuggaccggccacgugagcaccagcuggagcaucaacugcugcgacgacggcgagggcagccagcaggaggaggugaucagcagcgaggacaucggcgccagcaucuucaacggccagaagaaggugcuguacuacgccgacgcccugaccgagaucgccuucguggugcccagccccguggagagccugaccgacagccuggagagcaacaucagcgaccaggacagcgacagcaacauggaccugaugcccggcauccugaagcagcccagccugacccuggagcuguuccccaaccacaccgacaaccugaacagcagccagagacugagccccagcagcagaaugagaaagcugccccagggcagacccgugcccccccugggccccgagaccagagugagcgugguguggguggagagauacgacgacaucgagaacuucccccugagcgagcugaugaccgagaucagcaccggcguggagaccaccgccaacagcagcaccagccugagaagcaccacccuggagaaggaggugcccgugaucuucauccacccccugaacaccggccuguucagaaucaagauccagggcgccaccggcaaguucaacauggugaucccccugguggacggcaugaucgugagcagaagagcccugggcuuccuggugagacagaccgugaucaacaucugcagaagaaagagacuggagagcgacagcuacagccccccccacgugagaagaaagcagaagaucaccgacaucgugaacaaguacagaaacaagcagcuggagcccgaguucuacaccagccuguuccaggaggugggccugaagaacugcagcagcuaa

SEQ ID NO: 22394 - RNA, 2580 nt, Artificial Sequence
  RALGDS__Homo_sapiens__NP_001035827
augaugguggacugccagagcagcacccaggagaucggcgaggagcugaucaacggcgugaucuacagcaucagccugagaaaggugcagcugcaccacggcggcaacaagggccagagauggcugggcuacgagaacgagagcgcccugaaccuguacgagaccugcaaggugagaaccgugaaggccggcacccuggagaagcugguggagcaccuggugcccgccuuccagggcagcgaccugagcuacgugaccaucuuccugugcaccuacagagccuucaccaccacccagcaggugcuggaccugcuguucaagagauacggcagaugcgacgcccugaccgccagcagcagauacggcugcauccugcccuacagcgacgaggacggcggcccccaggaccagcugaagaacgccaucagcagcauccugggcaccuggcuggaccaguacagcgaggacuucugccagccccccgacuuccccugccugaagcagcugguggccuacgugcagcugaacaugcccggcagcgaccuggagagaagagcccaccugcugcuggcccagcuggagcacagcgagcccaucgaggccgagcccgaggcccugagccccgugcccgcccugaagcccacccccgagcuggagcuggcccugacccccgccagagcccccagccccgugcccgcccccgcccccgagcccgagcccgcccccacccccgcccccggcagcgagcuggagguggcccccgcccccgcccccgagcugcagcaggcccccgagcccgccgugggccuggagagcgcccccgcccccgcccuggagcuggagcccgcccccgagcaggaccccgcccccagccagacccuggagcuggagcccgcccccgcccccgugcccagccugcagcccagcuggcccagccccgugguggccgagaacggccugagcgaggagaagccccaccugcugguguucccccccgaccugguggccgagcaguucacccugauggacgccgagcuguucaagaagguggugcccuaccacugccugggcagcaucuggagccagagagacaagaagggcaaggagcaccuggcccccaccaucagagccaccgugacccaguucaacagcguggccaacugcgugaucaccaccugccugggcaacagaagcaccaaggcccccgacagagccagagugguggagcacuggaucgagguggccagagagugcagaauccugaagaacuucagcagccuguacgccauccugagcgcccugcagagcaacagcauccacagacugaagaagaccugggaggacgugagcagagacagcuucagaaucuuccagaagcugagcgagaucuucagcgacgagaacaacuacagccugagcagagagcugcugaucaaggagggcaccagcaaguucgccacccuggagaugaaccccaagagagcccagaagagacccaaggagaccggcaucauccagggcaccgugcccuaccugggcaccuuccugaccgaccuggugaugcuggacaccgccaugaaggacuaccuguacggcagacugaucaacuucgagaagagaagaaaggaguucgaggugaucgcccagaucaagcugcugcagagcgccugcaacaacuacagcaucgcccccgacgagcaguucggcgccugguucagagccguggagagacugagcgagaccgagagcuacaaccugagcugcgagcuggagccccccagcgagagcgccagcaacacccugagaaccaagaagaacaccgccaucgugaagagauggagcgacagacaggcccccagcaccgagcugagcaccagcggcagcagccacagcaagagcugcgaccagcugagaugcggccccuaccugagcagcggcgacaucgccgacgcccugagcgugcacagcgccggcagcagcagcagcgacguggaggagaucaacaucagcuucgugcccgagagccccgacggccaggagaagaaguucugggagagcgccagccagagcagccccgagaccagcggcaucagcagcgccagcagcagcaccagcagcagcagcgccagcaccacccccguggccgccaccagaacccacaagagaagcgugagcggccugugcaacagcagcagcgcccugccccuguacaaccagcaggugggcgacugcugcaucaucagagugagccuggacguggacaacggcaacauguacaagagcauccuggugaccagccaggacaaggcccccgccgugaucagaaaggccauggacaagcacaaccuggaggaggaggagcccgaggacuacgagcugcugcagauccugagcgacgacagaaagcugaagauccccgagaacgccaacguguucuacgccaugaacagcaccgccaacuacgacuucgugcugaagaagagaaccuucaccaagggcgugaaggugaagcacggcgccagcagcacccugcccagaaugaagcagaagggccugaagaucgccaagggcaucuucuaa

SEQ ID NO: 22395 - RNA, 1590 nt, Artificial Sequence
  RALGPS1__Homo_sapiens__NP_001177657
auguacaagagaaacggccugauggccagcgugcuggugaccagcgccaccccccagggcagcagcagcagcgacagccuggagggccagagcugcgacuacgccagcaagagcuacgacgccgugguguucgacgugcugaaggugacccccgaggaguucgccagccagaucacccugauggacauccccguguucaaggccauccagcccgaggagcuggccagcugcggcuggagcaagaaggagaagcacagccuggcccccaacgugguggccuucaccagaagauucaaccaggugagcuucuggguggugagagagauccugaccgcccagacccugaagaucagagccgagauccugagccacuucgugaagaucgccaagaagcugcuggagcugaacaaccugcacagccugaugagcguggugagcgcccugcagagcgcccccaucuucagacugaccaagaccugggcccugcugaacagaaaggacaagaccaccuucgagaagcuggacuaccugaugagcaaggaggacaacuacaagagaaccagagaguacaucagaagccugaagauggugcccagcauccccuaccugggcaucuaccugcuggaccugaucuacaucgacagcgccuaccccgccagcggcagcaucauggagaacgagcagagaagcaaccagaugaacaacauccugagaaucaucgccgaccugcaggugagcugcagcuacgaccaccugaccacccugccccacgugcagaaguaccugaagagcgugagauacaucgaggagcugcagaaguucguggaggacgacaacuacaagcugagccugagaaucgagcccggcagcagcagccccagacuggugagcagcaaggaggaccuggccggccccagcgccggcagcggcagcgccagauucagcagaagacccaccugccccgacaccagcguggccggcagccugcccaccccccccgugcccagacacagaaagagccacagccugggcaacaacagaggcagacuguacgccacccugggccccaacuggagagugcccgugagaaacagccccagaaccagaagcugcguguacagccccaccggccccugcaucugcagccugggcaacagcgccgccgugcccaccauggagggcccccugagaagaaagacccugcugaaggagggcagaaagcccgcccugagcagcuggaccagauacugggugauccugagcggcagcacccugcuguacuacggcgccaagagccugagaggcaccgacagaaagcacgugagcaucgugggcuggauggugcagcugcccgacgaccccgagcaccccgacaucuuccagcugaacaaccccgacaagggcaacguguacaaguuccagaccggcagcagauuccacgccauccuguggcacaagcaccuggacgacgccugcaagagcaacagaccccaggaggccggcgccgcccccggccccaccggcaccgacagccacgagguggaccaccuggagggcggcgccggcaaggaggccggccccugcgccuaa

SEQ ID NO: 22396 - RNA, 873 nt, Artificial Sequence
  RALY__Homo_sapiens__NP_031393
augagccugaagcugcaggccagcaacgugaccaacaagaacgaccccaagagcaucaacagcagaguguucaucggcaaccugaacaccgcccuggugaagaagagcgacguggagaccaucuucagcaaguacggcagaguggccggcugcagcgugcacaagggcuacgccuucgugcaguacagcaacgagagacacgccagagccgccgugcugggcgagaacggcagagugcuggccggccagacccuggacaucaacauggccggcgagcccaagcccgacagacccaagggccugaagagagccgccagcgccaucuacagacuguucgacuacagaggcagacugagccccgugcccgugcccagagccgugcccgugaagagacccagagugaccgugccccuggugagaagagugaagaccaacgugcccgugaagcuguucgccagaagcaccgccgugaccaccagcagcgccaagaucaagcugaagagcagcgagcugcaggccaucaagaccgagcugacccagaucaagagcaacaucgacgcccugcugagcagacuggagcagaucgccgccgagcagaaggccaaccccgacggcaagaagaagggcgacggcggcggcgccggcggcggcggcggcggcggcggcagcggcggcggcggcagcggcggcggcggcggcggcggcagcagcagaccccccgccccccaggagaacaccaccagcgaggccggccugccccagggcgaggccagaaccagagacgacggcgacgaggagggccugcugacccacagcgaggaggagcuggagcacagccaggacaccgacgccgacgacggcgcccugcaguaa

SEQ ID NO: 22397 - RNA, 915 nt, Artificial Sequence
  RALYL__Homo_sapiens__NP_001093861
augagcaagagaagaagacugaagcagggcgagcccaucaugaccggcaagacccagaccagcaacgugaccaacaagaacgaccccaagagcaucaacagcagaguguucaucggcaaccugaacaccgccaucgugaagaagguggacaucgaggccaucuucagcaaguacggcaagaucgugggcugcagcgugcacaagggcuacgccuucgugcaguacaugagcgagagacacgccagagccgccguggccggcgagaacgccagagugaucgccggccagccccuggacaucaacauggccggcgagcccaagcccuacagacccaagcccggcaacaagagaccccugagcgcccuguacagacuggagagcaaggagcccuuccugagcgugggcggcuacguguucgacuacgacuacuacagagacgacuucuacaacagacuguucgacuaccacggcagagugccccccccccccagagccgugaucccccugaagagacccagaguggccgugaccaccaccagaagaggcaagggcguguucagcaugaagggcggcagcagaagcaccgccagcggcagcaccggcagcaagcugaagagcgacgagcugcagaccaucaagaaggagcugacccagaucaagaccaagaucgacagccugcugggcagacuggagaagaucgagaagcagcagaaggccgaggccgaggcccagaagaagcagcuggaggagagccuggugcugauccaggaggagugcgugagcgagaucgccgaccacagcaccgaggagcccgccgagggcggccccgacgccgacggcgaggagaugaccgacggcaucgaggaggacuucgacgaggacggcggccacgagcuguuccugcagaucaaguaa

SEQ ID NO: 22398 - RNA, 447 nt, Artificial Sequence
  RAMP1__Homo_sapiens__NP_005846
auggccagagcccugugcagacugcccagaagaggccuguggcugcugcuggcccaccaccuguucaugaccaccgccugccaggaggccaacuacggcgcccugcugagagagcugugccugacccaguuccagguggacauggaggccgugggcgagacccuguggugcgacuggggcagaaccaucagaagcuacagagagcuggccgacugcaccuggcacauggccgagaagcugggcugcuucuggcccaacgccgagguggacagauucuuccuggccgugcacggcagauacuucagaagcugccccaucagcggcagagccgugagagacccccccggcagcauccuguaccccuucaucguggugcccaucaccgugacccugcuggugaccgcccuggugguguggcagagcaagagaaccgagggcaucguguaa

SEQ ID NO: 22399 - RNA, 528 nt, Artificial Sequence
  RAMP2__Homo_sapiens__NP_005845
auggccagccugagaguggagagagccggcggccccagacugcccagaaccagagugggcagacccgccgcccugagacugcugcugcugcugggcgccgugcugaacccccacgaggcccuggcccagccccugcccaccaccggcacccccggcagcgagggcggcaccgugaagaacuacgagaccgccgugcaguucugcuggaaccacuacaaggaccagauggaccccaucgagaaggacuggugcgacugggccaugaucagcagacccuacagcacccugagagacugccuggagcacuucgccgagcuguucgaccugggcuuccccaacccccuggccgagagaaucaucuucgagacccaccagauccacuucgccaacugcagccuggugcagcccaccuucagcgacccccccgaggacgugcugcuggccaugaucaucgcccccaucugccugauccccuuccugaucacccuggugguguggagaagcaaggacagcgaggcccaggccuaa

SEQ ID NO: 22400 - RNA, 447 nt, Artificial Sequence
  RAMP3__Homo_sapiens__NP_005847
auggagaccggcgcccugagaagaccccagcugcugccccugcugcugcugcugugcggcggcugccccagagccggcggcugcaacgagaccggcaugcuggagagacugccccugugcggcaaggccuucgccgacaugaugggcaagguggacguguggaaguggugcaaccugagcgaguucaucguguacuacgagagcuucaccaacugcaccgagauggaggccaacguggugggcugcuacuggcccaacccccuggcccagggcuucaucaccggcauccacagacaguucuucagcaacugcaccguggacagagugcaccuggaggacccccccgacgaggugcugaucccccugaucgugauccccguggugcugaccguggccauggccggccuggugguguggagaagcaagagaaccgacacccugcuguaa

SEQ ID NO: 22401 - RNA, 1863 nt, Artificial Sequence
  RANBP10__Homo_sapiens__NP_065901
auggccgccgccaccgccgaccccggcgccggcaacccccagcccggcgacagcagcggcggcggcgccggcggcggccugcccagccccggcgagcaggagcugagcagaagacugcagagacuguaccccgccgugaaccagcaggagaccccccugcccagaagcuggagccccaaggacaaguacaacuacaucggccugagccagggcaaccugagagugcacuacaagggccacggcaagaaccacaaggacgccgccagcgugagagccacccaccccauccccgccgccugcggcaucuacuacuucgaggugaagaucgugagcaagggcagagacggcuacaugggcaucggccugagcgcccagggcgugaacaugaacagacugcccggcugggacaagcacagcuacggcuaccacggcgacgacggccacagcuucugcagcagcggcaccggccagcccuacggccccaccuucaccaccggcgacgugaucggcugcugcgugaaccugaucaacggcaccugcuucuacaccaagaacggccacagccugggcaucgccuucaccgaccugcccgccaaccuguaccccaccgugggccugcagacccccggcgagaucguggacgccaacuucggccagcagcccuuccuguucgacaucgaggacuacaugagagaguggagagccaaggugcagggcaccgugcacugcuuccccaucagcgccagacugggcgaguggcaggccgugcugcagaacauggugagcagcuaccuggugcaccacggcuacugcgccaccgccaccgccuucgccagaaugaccgagacccccauccaggaggagcaggccagcaucaagaacagacagaagauccagaagcuggugcuggagggcagagugggcgaggccaucgagaccacccagagauucuaccccggccugcuggagcacaaccccaaccugcuguucaugcugaagugcagacaguucguggagauggugaacggcaccgacagcgaggugagaagccugagcagcagaagccccaagagccaggacagcuaccccggcagccccagccugagccccagacacggccccagcagcagccacaugcacaacaccggcgccgacagccccagcugcagcaacggcguggccagcaccaagagcaagcagaaccacagcaaguaccccgcccccagcagcagcagcagcagcagcagcagcagcagcagcagcagccccagcagcgugaacuacagcgagagcaacagcaccgacagcaccaagagccagcaccacagcagcaccagcaaccaggagaccagcgacagcgagauggagauggaggccgagcacuaccccaacggcgugcugggcagcaugagcaccagaaucgugaacggcgccuacaagcacgaggaccugcagaccgacgagagcagcauggacgacagacaccccagaagacagcugugcggcggcaaccaggccgccaccgagagaaucauccuguucggcagagagcugcaggcccugagcgagcagcugggcagagaguacggcaagaaccuggcccacaccgagaugcugcaggacgccuucagccugcuggccuacagcgaccccuggagcugccccgugggccagcagcuggaccccauccagagagagcccgugugcgccgcccugaacagcgccauccuggagagccagaaccugcccaagcagcccccccugaugcuggcccugggccaggccagcgagugccugagacugauggccagagccggccugggcagcugcagcuucgccagaguggacgacuaccugcacuaa

SEQ ID NO: 22402 - RNA, 3267 nt, Artificial Sequence
  RANBP17__Homo_sapiens__NP_075048
auggcccugcacuuccagagccuggccgagcuggaggugcugugcacccaccuguacaucggcaccgaccugacccagagaaucgaggccgagaaggcccugcuggagcugaucgacagccccgagugccugagcaagugccagcugcugcuggagcagggcaccaccagcuacgcccagcugcuggccgccaccugccugagcaagcuggugagcagagugagcccccugcccguggagcagagaauggacaucagaaacuacauccugaacuacguggccagccagcccaagcuggcccccuucgugauccaggcccugauccaggugaucgccaagaucaccaagcugggcugguucgaggugcagaaggaccaguucguguucagagagaucaucgccgacgugaagaaguuccugcagggcaccguggagcacugcaucaucggcgugaucauccugagcgagcugacccaggagaugaaccugguggacuacagcagacccagcgccaagcacagaaagaucgccaccagcuucagagacaccagccugaaggacgugcuggugcuggccugcagccugcugaaggagguguucgccaagccccugaaccugcaggaccagugccagcagaaccuggugaugcaggugcugaagcuggugcugaacugccugaacuucgacuucaucggcagcagcgccgacgagagcgccgacgaccugugcaccgugcagauccccaccaccuggagaaccaucuuccuggagcccgagacccuggaccuguucuucaaccuguaccacagccugcccccccugcugagccagcuggcccugagcugccuggugcaguucgccagcaccagaagaagccuguucaacagccccgagagagccaaguaccugggcaaccugaucaagggcgugaagagaauccuggagaacccccagggccugagcgaccccggcaacuaccacgaguucugcagauuccuggccagacugaagaccaacuaccagcugggcgagcuggugauggugaaggaguaccccgaggugaucagacugaucgccaacuucaccaucaccagccugcagcacugggaguucgcccccaacagcgugcacuaccugcugacccuguggcagagaaugguggccagcgugcccuucgugaagagcaccgagccccaccugcuggacaccuacgcccccgagaucaccaaggccuucaucaccagcagacuggacagcguggccaucguggugagagaccaccuggacgacccccuggacgacaccgccaccguguuccagcagcuggagcagcugugcaccgugagcagaugcgaguacgagaagaccugcgcccugcuggugcagcuguucgaccagaacgcccagaacuaccagaagcugcugcaccccuacagcggcgugaccguggacaucaccauccaggagggcagacuggccuggcugguguaccuggugggcaccguggugggcggcagacugaccuacaccagcaccgacgagcacgacgccauggacggcgagcugagcugcagaguguuccagcugaucagccugauggacaccggccugcccagaugcugcaacgagaagaucgagcuggccauccugugguuccuggaccaguucagaaagaccuacgugggcgaccagcugcagagaaccagcaagguguacgccagaaugagcgaggugcugggcaucaccgacgacaaccacgugcuggagaccuucaugaccaagaucgugaccaaccugaaguacuggggcagauacgagcccgugaucagcagaacccugcaguuccugaacgaccugagcgugggcuacauccugcugaagaagcuggugaagaucgacgccgugaaguucaugcugaagaaccacaccagcgagcacuuccccuuccugggcaucagcgacaaccacagccugagcgacuucagaugcagaaccaccuucuacaccgcccugaccagacugcugaugguggaccugggcgaggacgaggacgaguucgagaacuucaugcugccccugaccguggccuucgagaccgugcugcagaucuucaacaacaacuucaagcaggaggacgugaagagaaugcugaucggccuggccagagaccugagaggcaucgccuucgcccugaacaccaagaccagcuacaccaugcuguucgacuggauguaccccaccuaccugccccugcugcagaacgccguggagagaugguacggcgagcccaccugcaccacccccauccugaagcugauggccgagcugaugcagaacagaagccagagacugaacuucgacgugagcagccccaacggcauccugcuguucagagaggccagcaagauggugugcaccuacggcaaccagauccugagccugggcagccugagcaaggaccagaucuaccccaugaagcugaagggcaucagcaucugcuacagcgcccugaagagcgcccugugcggcaacuacgugagcuucggcguguucaagcuguacggcgacaaccacuucgacaacgugcugcaggccuucgugaagaugcugcugagcgugagccacagcgaccugcugcaguacagaaagcugagccagagcuacuacccccugcuggagugccugacccaggaccacaugagcuucaucaucaaccuggagccccccgugcugauguacgugcugaccagcaucagcgagggccugaccacccuggacaccguggugagcagcagcugcugcaccagccuggacuacaucgugaccuaccuguucaagcacaucgccaaggagggcaagaagccccugagaugcagagaggccacccaggccggccagagacugcugcacuucaugcagcagaaccccgacgugcugcagcagaugaugagcgugcugaugaacaccaucguguucgaggacugcagaaaccaguggagcgugagcagaccccugcugggccugauccugcugaacgagaaguacuucagcgagcugagagccagccugaucaacagccagccccugcccaagcaggaggugcuggcccagugcuucagaaaccugauggagggcguggagcagaaccugagcgugaagaacagagacagauucacccagaaccugagcguguucagaagagacguggccgaggcccugagaagcgacggcaacaccgagcccugcagccuggacaugaugagcuaa

SEQ ID NO: 22403 - RNA, 606 nt, Artificial Sequence
  RANBP1__Homo_sapiens__NP_002873
auggccgccgccaaggacacccacgaggaccacgacaccagcaccgagaacaccgacgagagcaaccacgacccccaguucgagcccaucgugagccugcccgagcaggagaucaagacccuggaggaggacgaggaggagcuguucaagaugagagccaagcuguucagauucgccagcgagaacgaccugcccgaguggaaggagagaggcaccggcgacgugaagcugcugaagcacaaggagaagggcgccaucagacugcugaugagaagagacaagacccugaagaucugcgccaaccacuacaucacccccaugauggagcugaagcccaacgccggcagcgacagagccuggguguggaacacccacgccgacuucgccgacgagugccccaagcccgagcugcuggccaucagauuccugaacgccgagaacgcccagaaguucaagaccaaguucgaggagugcagaaaggagaucgaggagagagagaagaaggccggcagcggcaagaacgaccacgccgagaagguggccgagaagcuggaggcccugagcgugaaggaggagaccaaggaggacgccgaggagaagcaguaa

SEQ ID NO: 22404 - RNA, 9675 nt, Artificial Sequence
  RANBP2__Homo_sapiens__NP_006258
augagaagaagcaaggccgacguggagagauacaucgccagcgugcagggcagcacccccagccccagacagaagagcaugaagggcuucuacuucgccaagcuguacuacgaggccaaggaguacgaccuggccaagaaguacaucugcaccuacaucaacgugcaggagagagaccccaaggcccacagauuccugggccugcuguacgagcuggaggagaacaccgacaaggccguggagugcuacagaagaagcguggagcugaaccccacccagaaggaccuggugcugaagaucgccgagcugcugugcaagaacgacgugaccgacggcagagccaaguacuggcuggagagagccgccaagcuguuccccggcagccccgccaucuacaagcugaaggagcagcugcuggacugcgagggcgaggacggcuggaacaagcuguucgaccugauccagagcgagcuguacgugagacccgacgacgugcacgugaacaucagacugguggagguguacagaagcaccaagagacugaaggacgccguggcccacugccacgaggccgagagaaacaucgcccugagaagcagccuggaguggaacagcugcguggugcagacccugaaggaguaccuggagagccugcagugccuggagagcgacaagagcgacuggagagccaccaacaccgaccugcugcuggccuacgccaaccugaugcugcugacccugagcaccagagacgugcaggagagcagagagcugcugcagagcuucgacagcgcccugcagagcgugaagagccugggcggcaacgacgagcugagcgccaccuuccuggagaugaagggccacuucuacaugcacgccggcagccugcugcugaagaugggccagcacagcagcaacgugcaguggagagcccugagcgagcuggccgcccugugcuaccugaucgccuuccaggugcccagacccaagaucaagcugaucaagggcgaggccggccagaaccugcuggagaugauggccugcgacagacugagccagagcggccacaugcugcugaaccugagcagaggcaagcaggacuuccugaaggagaucguggagaccuucgccaacaagagcggccagagcgcccuguacgacgcccuguucagcagccagagccccaaggacaccagcuuccugggcagcgacgacaucggcaacaucgacgugagagagcccgagcuggaggaccugaccagauacgacgugggcgccaucagagcccacaacggcagccugcagcaccugaccuggcugggccugcaguggaacagccugcccgcccugcccggcaucagaaaguggcugaagcagcuguuccaccaccugccccacgagaccagcagacuggagaccaacgcccccgagagcaucugcauccuggaccuggagguguuccugcugggcgugguguacaccagccaccugcagcugaaggagaagugcaacagccaccacagcagcuaccagccccugugccugccccugcccgugugcaagcagcugugcaccgagagacagaagagcuggugggacgccgugugcacccugauccacagaaaggccgugcccggcaacguggccaagcugagacugcuggugcagcacgagaucaacacccugagagcccaggagaagcacggccugcagcccgcccugcuggugcacugggccgagugccugcagaagaccggcagcggccugaacagcuucuacgaccagagagaguacaucggcagaagcgugcacuacuggaagaaggugcugccccugcugaagaucaucaagaagaagaacagcauccccgagcccaucgacccccuguucaagcacuuccacagcguggacauccaggccagcgagaucguggaguacgaggaggacgcccacaucaccuucgccauccuggacgccgugaacggcaacaucgaggacgccgugaccgccuucgagagcaucaagagcguggugagcuacuggaaccuggcccugaucuuccacagaaaggccgaggacaucgagaacgacgcccugagccccgaggagcaggaggagugcaagaacuaccugagaaagaccagagacuaccugaucaagaucaucgacgacagcgacagcaaccugagcguggugaagaagcugcccgugccccuggagagcgugaaggagaugcugaacagcgugaugcaggagcuggaggacuacagcgagggcggcccccuguacaagaacggcagccugagaaacgccgacagcgagaucaagcacagcacccccagccccaccagauacagccugagccccagcaagagcuacaaguacagccccaagaccccccccagaugggccgaggaccagaacagccugcugaagaugaucugccagcagguggaggccaucaagaaggagaugcaggagcugaagcugaacagcagcaacagcgccagcccccacagauggcccaccgagaacuacggccccgacagcgugcccgacggcuaccagggcagccagaccuuccacggcgccccccugaccguggccaccaccggccccagcguguacuacagccagagccccgccuacaacagccaguaccugcugagacccgccgccaacgugacccccaccaagggccccguguacggcaugaacagacugcccccccagcagcacaucuacgccuacccccagcagaugcacaccccccccgugcagagcagcagcgccugcauguucagccaggagauguacggcccccccgcccugagauucgagagccccgccaccggcauccugagccccagaggcgacgacuacuucaacuacaacgugcagcagaccagcaccaaccccccccugcccgagcccggcuacuucaccaagccccccaucgccgcccacgccagcagaagcgccgagagcaagaccaucgaguucggcaagaccaacuucgugcagcccaugcccggcgagggccugagacccagccugcccacccaggcccacaccacccagcccacccccuucaaguucaacagcaacuucaagagcaacgacggcgacuucaccuucagcagcccccagguggugacccagcccccccccgccgccuacagcaacagcgagagccugcugggccugcugaccagcgacaagccccugcagggcgacggcuacagcggcgccaagcccauccccggcggccagaccaucggccccagaaacaccuucaacuucggcagcaagaacgugagcggcaucagcuucaccgagaacaugggcagcagccagcagaagaacagcggcuucagaagaagcgacgacauguucaccuuccacggccccggcaagagcguguucggcacccccacccuggagaccgccaacaagaaccacgagaccgacggcggcagcgcccacggcgacgacgacgacgacggcccccacuucgagcccguggugccccugcccgacaagaucgaggugaagaccggcgaggaggacgaggaggaguucuucugcaacagagccaagcuguucagauucgacguggagagcaaggaguggaaggagagaggcaucggcaacgugaagauccugagacacaagaccagcggcaagaucagacugcugaugagaagagagcaggugcugaagaucugcgccaaccacuacaucagccccgacaugaagcugacccccaacgccggcagcgacagaagcuucguguggcacgcccuggacuacgccgacgagcugcccaagcccgagcagcuggccaucagauucaagacccccgaggaggccgcccuguucaagugcaaguucgaggaggcccagagcauccugaaggcccccggcaccaacguggccauggccagcaaccaggccgugagaaucgugaaggagcccaccagccacgacaacaaggacaucugcaagagcgacgccggcaaccugaacuucgaguuccagguggccaagaaggagggcagcugguggcacugcaacagcugcagccugaagaacgccagcaccgccaagaagugcgugagcugccagaaccugaaccccagcaacaaggagcuggugggccccccccuggccgagaccguguucacccccaagaccagccccgagaacgugcaggacagauucgcccuggugacccccaagaaggagggccacugggacugcagcaucugccuggugagaaacgagcccaccgugagcagaugcaucgccugccagaacaccaagagcgccaacaagagcggcagcagcuucgugcaccaggccagcuucaaguucggccagggcgaccugcccaagcccaucaacagcgacuucagaagcguguucagcaccaaggagggccagugggacugcagcgccugccuggugcagaacgagggcagcagcaccaagugcgccgccugccagaaccccagaaagcagagccugcccgccaccagcauccccacccccgccagcuucaaguucggcaccagcgagaccagcaagacccugaagagcggcuucgaggacauguucgccaagaaggagggccagugggacugcagcagcugccuggugagaaacgaggccaacgccaccagaugcguggccugccagaaccccgacaagcccagccccagcaccagcgugcccgcccccgccagcuucaaguucggcaccagcgagaccagcaaggcccccaagagcggcuucgagggcauguucaccaagaaggagggccagugggacugcagcgugugccuggugagaaacgaggccagcgccaccaagugcaucgccugccagaaccccggcaagcagaaccagaccaccagcgccgugagcacccccgccagcagcgagaccagcaaggcccccaagagcggcuucgagggcauguucaccaagaaggagggccagugggacugcagcgugugccuggugagaaacgaggccagcgccaccaagugcaucgccugccagaaccccggcaagcagaaccagaccaccagcgccgugagcacccccgccagcagcgagaccagcaaggcccccaagagcggcuucgagggcauguucaccaagaaggagggccagugggacugcagcgugugccuggugagaaacgaggccagcgccaccaagugcaucgccugccagugccccagcaagcagaaccagaccaccgccaucagcacccccgccagcagcgagaucagcaaggcccccaagagcggcuucgagggcauguucaucagaaagggccagugggacugcagcgugugcugcgugcagaacgagagcagcagccugaagugcguggccugcgacgccagcaagcccacccacaagcccaucgccgaggcccccagcgccuucacccugggcagcgagaugaagcugcacgacagcagcggcagccaggugggcaccggcuucaagagcaacuucagcgagaaggccagcaaguucggcaacaccgagcagggcuucaaguucggccacguggaccaggagaacagccccagcuucauguuccagggcagcagcaacaccgaguucaagagcaccaaggagggcuucagcauccccgugagcgccgacggcuucaaguucggcaucagcgagcccggcaaccaggagaagaagagcgagaagccccuggagaacggcaccggcuuccaggcccaggacaucagcggccagaagaacggcagaggcgugaucuucggccagaccagcagcaccuucaccuucgccgaccuggccaagagcaccagcggcgagggcuuccaguucggcaagaaggaccccaacuucaagggcuucagcggcgccggcgagaagcuguucagcagccaguacggcaagauggccaacaaggccaacaccagcggcgacuucgagaaggacgacgacgccuacaagaccgaggacagcgacgacauccacuucgagcccguggugcagaugcccgagaagguggagcuggugaccggcgaggaggacgagaaggugcuguacagccagagagugaagcuguucagauucgacgccgaggugagccaguggaaggagagaggccugggcaaccugaagauccugaagaacgaggugaacggcaagcugagaaugcugaugagaagagagcaggugcugaaggugugcgccaaccacuggaucaccaccaccaugaaccugaagccccugagcggcagcgacagagccuggauguggcuggccagcgacuucagcgacggcgacgccaagcuggagcagcuggccgccaaguucaagacccccgagcuggccgaggaguucaagcagaaguucgaggagugccagagacugcugcuggacaucccccugcagaccccccacaagcugguggacaccggcagagccgccaagcugauccagagagccgaggagaugaagagcggccugaaggacuucaagaccuuccugaccaacgaccagaccaaggugaccgaggaggagaacaagggcagcggcaccggcgccgccggcgccagcgacaccaccaucaagcccaaccccgagaacaccggccccacccuggagugggacaacuacgaccugagagaggacgcccuggacgacagcgugagcagcagcagcgugcacgccagcccccuggccagcagccccgugagaaagaaccuguucagauucggcgagagcaccaccggcuucaacuucagcuucaagagcgcccugagccccagcaagagccccgccaagcugaaccagagcggcaccagcgugggcaccgacgaggagagcgacgugacccaggaggaggagagagacggccaguacuucgagcccguggugccccugcccgaccugguggaggugagcagcggcgaggagaacgagcaggugguguucagccacagagccaagcuguacagauacgacaaggacgugggccaguggaaggagagaggcaucggcgacaucaagauccugcagaacuacgacaacaagcaggugagaaucgugaugagaagagaccaggugcugaagcugugcgccaaccacagaaucacccccgacaugacccugcagaacaugaagggcaccgagagaguguggcuguggaccgccugcgacuucgccgacggcgagagaaagguggagcaccuggccgugagauucaagcugcaggacguggccgacagcuucaagaagaucuucgacgaggccaagaccgcccaggagaaggacagccugaucaccccccacgugagcagaagcagcacccccagagagagccccugcggcaagaucgccguggccgugcuggaggagaccaccagagagagaaccgacgugauccagggcgacgacguggccgacgccaccagcgagguggaggugagcagcaccagcgagaccacccccaaggccguggugagcccccccaaguucguguucggcagcgagagcgugaagagcaucuucagcagcgagaagagcaagcccuucgccuucggcaacagcagcgccaccggcagccuguucggcuucagcuucaacgccccccugaagagcaacaacagcgagaccagcagcguggcccagagcggcagcgagagcaagguggagcccaagaagugcgagcugagcaagaacagcgacaucgagcagagcagcgacagcaaggugaagaaccuguucgccagcuuccccaccgaggagagcagcaucaacuacaccuucaagacccccgagaaggccaaggagaagaagaagcccgaggacagccccagcgacgacgacgugcugaucguguacgagcugacccccaccgccgagcagaaggcccuggccaccaagcugaagcugccccccaccuucuucugcuacaagaacagacccgacuacgugagcgaggaggaggaggacgacgaggacuucgagaccgccgugaagaagcugaacggcaagcuguaccuggacggcagcgagaagugcagaccccuggaggagaacaccgccgacaacgagaaggagugcaucaucgugugggagaagaagcccaccguggaggagaaggccaaggccgacacccugaagcugccccccaccuucuucugcggcgugugcagcgacaccgacgaggacaacggcaacggcgaggacuuccagagcgagcugcagaaggugcaggaggcccagaagagccagaccgaggagaucaccagcaccaccgacagcguguacaccggcggcaccgaggugauggugcccagcuucugcaagagcgaggagcccgacagcaucaccaagagcaucagcagccccagcgugagcagcgagaccauggacaagcccguggaccugagcaccagaaaggagaucgacaccgacagcaccagccagggcgagagcaagaucgugagcuucggcuucggcagcagcaccggccugagcuucgccgaccuggccagcagcaacagcggcgacuucgccuucggcagcaaggacaagaacuuccagugggccaacaccggcgccgccguguucggcacccagagcgugggcacccagagcgccggcaaggugggcgaggacgaggacggcagcgacgaggagguggugcacaacgaggacauccacuucgagcccaucgugagccugcccgagguggaggugaagagcggcgaggaggacgaggagauccuguucaaggagagagccaagcuguacagaugggacagagacgugagccaguggaaggagagaggcgugggcgacaucaagauccuguggcacaccaugaagaacuacuacagaauccugaugagaagagaccagguguucaaggugugcgccaaccacgugaucaccaagaccauggagcugaagccccugaacgugagcaacaacgcccugguguggaccgccagcgacuacgccgacggcgaggccaagguggagcagcuggccgugagauucaagaccaaggagguggccgacugcuucaagaagaccuucgaggagugccagcagaaccugaugaagcugcagaagggccacgugagccuggccgccgagcugagcaaggagaccaaccccgugguguucuucgacgugugcgccgacggcgagccccugggcagaaucaccauggagcuguucagcaacaucgugcccagaaccgccgagaacuucagagcccugugcaccggcgagaagggcuucggcuucaagaacagcaucuuccacagagugauccccgacuucgugugccagggcggcgacaucaccaagcacgacggcaccggcggccagagcaucuacggcgacaaguucgaggacgagaacuucgacgugaagcacaccggccccggccugcugagcauggccaaccagggccagaacaccaacaacagccaguucgugaucacccugaagaaggccgagcaccuggacuucaagcacgugguguucggcuucgugaaggacggcauggacaccgugaagaagaucgagagcuucggcagccccaagggcagcgugugcagaagaaucaccaucaccgagugcggccagaucuaa

SEQ ID NO: 22405 - RNA, 1689 nt, Artificial Sequence
  RANBP3__Homo_sapiens__NP_003615
auggccgaccuggccaacgaggagaagcccgccaucgccccccccguguucguguuccagaaggacaagggccagaagagccccgccgagcagaagaaccugagcgacagcggcgaggagcccagaggcgaggccgaggccccccaccacggcaccggccaccccgagagcgccggcgagcacgcccuggagccccccgcccccgccggcgccagcgccagcaccccccccccccccgcccccgaggcccagcugccccccuuccccagagagcuggccggcagaagcgccggcggcagcagccccgagggcggcgaggacagcgacagagaggacggcaacuacugcccccccgugaagagagagagaaccagcagccugacccaguucccccccagccagagcgaggagagaagcagcggcuucagacugaagccccccacccugauccacggccaggcccccagcgccggccugcccagccagaagcccaaggagcagcagagaagcgugcugagacccgccgugcugcaggccccccagcccaaggcccugagccagaccgugcccagcagcggcaccaacggcgugagccugcccgccgacugcaccggcgccgugcccgccgccagccccgacaccgccgccuggagaagccccagcgaggccgccgacgaggagaaggagccccagaagaacgagagcagcaacgccagcgaggaggaggccugcgagaagaaggaccccgccacccagcaggccuucguguucggccagaaccugagagacagagugaagcugaucaacgagagcguggacgaggccgacauggagaacgccggccaccccagcgccgacacccccaccgccaccaacuacuuccugcaguacaucagcagcagccuggagaacagcaccaacagcgccgacgccagcagcaacaaguucguguucggccagaacaugagcgagagagugcugagcccccccaagcugaacgaggugagcagcgacgccaacagagagaacgccgccgccgagagcggcagcgagagcagcagccaggaggccacccccgagaaggagagccuggccgagagcgccgccgccuacaccaaggccaccgccagaaagugccugcuggagaagguggaggugaucaccggcgaggaggccgagagcaacgugcugcagaugcagugcaagcuguucguguucgacaagaccagccagagcuggguggagagaggcagaggccugcugagacugaacgacauggccagcaccgacgacggcacccugcagagcagacuggugaugagaacccagggcagccugagacugauccugaacaccaagcugugggcccagaugcagaucgacaaggccagcgagaagagcaucagaaucaccgccauggacaccgaggaccagggcgugaagguguuccugaucagcgccagcagcaaggacaccggccagcuguacgccgcccugcaccacagaauccuggcccugagaagcagaguggagcaggagcaggaggccaagaugcccgcccccgagcccggcgccgcccccagcaacgaggaggacgacagcgacgacgacgacgugcuggcccccagcggcgccaccgccgccggcgccggcgacgagggcgacggccagaccaccggcagcaccuaa

SEQ ID NO: 22406 - RNA, 1473 nt, Artificial Sequence
  RANBP3L__Homo_sapiens__NP_001154901
augaccaccauccccagaaagggcagcagccaccugcccggcagccugcacaccugcaagcugaagcugcaggaggacagaagacagcaggagaagagcgugaucgcccagcccaucuucguguucgagaagggcgagcagaccuucaagagacccgccgaggacacccuguacgaggccgccgagcccgagugcaacggcuuccccaccaagagagugagaagcagcagcuucaccuuccacaucaccgacagccagagccagggcgugagcacccugagccagaagcagaugagaugcagcagcgugaccaaccugcccaccuucccccacagcggccccgugagaaagaacaacguguucaugaccagcgcccuggugcagagcagcguggacaucaagagcgccgagcagggccccgugaagcacagcaagcacgugaucagacccgccauccugcagcugccccaggccagaagcugcgccaaggugagaaagaccuucggccacaaggcccuggagagcugcaagaccaaggagaagaccaacaacaagaucagcgagggcaacagcuaccugcugagcgagaaccugagcagagccagaaucagcgugcagcugagcaccaaccaggacuuccugggcgccaccagcgugggcugccagcccaacgaggacaagugcagcuucaagagcugcagcagcaacuucguguucggcgagaacaugguggagagagugcugggcacccagaagcugacccagccccagcuggagaacgacagcuacgccaaggagaagcccuucaagagcauccccaaguuccccgugaacuuccugagcagcagaaccgacagcaucaagaacaccagccugaucgagagcgccgccgccuucagcagccagcccagcagaaagugccugcuggagaagaucgacgugaucaccggcgaggagaccgagcacaacgugcugaagaucaacugcaagcuguucaucuucaacaagaccacccagagcuggaucgagagaggcagaggcacccugagacugaacgacaccgccagcaccgacugcggcacccugcagagcagacugaucaugagaaaccagggcagccugagacugauccugaacagcaagcugugggcccagaugaagauccagagagccaaccacaagaacgugagaaucaccgccaccgaccuggaggacuacagcaucaagaucuuccugauccaggccagcgcccaggacaccgccuaccuguacgccgccauccaccacagacugguggcccugcagagcuucaacaagcagagagacgugaaccaggccgagagccugagcgagaccgcccagcagcugaacugcgagagcugcgacgagaacgaggacgacuucauccaggugaccaagaacggcagcgaccccagcagcuggacccacagacagagcguggccugcagcuaa

SEQ ID NO: 22407 - RNA, 3318 nt, Artificial Sequence
  RANBP6__Homo_sapiens__NP_036548
auggccgccaccgccagcgccggcgugcccgccaccgugagcgagaagcaggaguucuaccagcugcugaagaaccugaucaaccccagcugcauggugagaagacaggccgaggagaucuacgagaacauccccggccugugcaagaccaccuuccugcuggacgccgugagaaacagaagagccggcuacgaggugagacagauggccgccgcccugcugagaagacugcugagcagcggcuucgaggagguguaccccaaccugcccgccgacgugcagagagacgugaagaucgagcugauccuggccgugaagcuggagacccacgccagcaugagaaagaagcugugcgacaucuucgccgugcuggccagaaaccugaucgacgaggacggcaccaaccacuggcccgagggccugaaguuccugaucgacagcaucuacagcaagaacguggugcugugggagguggcccugcacguguucuggcacuuccccggcaucuucggcacccaggagagacacgaccuggacaucaucaagagacugcuggaccagugcauccaggaccaggagcaccccgccaucagaacccugagcgccagagccgccgccgccuucgugcuggccaacgagaacaacaucgcccuguucaaggacuucgccgaccugcugcccggcauccugcaggccgugaacgacagcugcuaccaggacgacgacagcgugcuggagagccugguggagaucgccgacaccgugcccaaguaccugggccccuaccuggaggacacccugcagcugagccugaagcugugcggcgacagcagacugagcaaccugcagagacagcuggcccuggaggugaucgugacccugagcgagaccgccacccccaugcugaagaagcacaccaacaucaucgcccaggccgugccccacauccuggccaugaugguggaccugcaggacgacgaggacugggugaacgccgacgagauggaggaggacgacuucgacagcaacgccguggccgccgagagcgcccuggacagacuggccugcggccugggcggcaagguggugcugcccaugaccaaggagcacaucaugcagaugcugcagagccccgacuggaaguacagacacgccggccugauggcccugagcgccaucggcgagggcugccaccagcagauggagagcauccuggacgagaccgugaacagcgugcugcuguuccugcaggacccccaccccagagugagagccgccgccugcaccacccugggccagauggccaccgacuucgcccccaacuuccagaagaaguuccacgagaccgugaucgccgcccugcugagaaccauggagaaccagggcaaccagagagugcagagccacgccgccagcgcccugaucaucuucaucgaggacugccccaagagccugcuggugcuguacguggacagcauggugaagaaccugcacagcgugcuggugaucaagcugcaggagcugaucagaaacggcaccaagcuggcccuggagcagcuggugaccaccaucgccagcguggccgacaccaucgaggagaaguucgugcccuacuacgacaucuucaugcccagccugaagcacaucguggagcuggccgugcagaaggagcugaagcugcugagaggcaagaccaucgagugcaucagccacaucggccuggccgugggcaaggagaaguucaugcaggacgccagcaacgugaugcagcugcugcugaagacccagagcgaccugaacaacauggaggacgacgacccccagaccagcuacauggugagcgccugggccagaaugugcaagauccugggcaaggacuuccagcaguaccugccccuggugaucgagccccugaucaagaccgccagcgccaagcccgacguggcccugcuggacacccaggacguggagaacaugagcgacgacgacggcuggcaguucgugaaccugggcgaccagcagagcuucggcaucaagaccagcggccuggaggccaaggccaccgccugccagaugcugguguacuacgccaaggagcugagagagggcuucguggaguacaccgagcagguggugaagcugauggugccccugcugaaguucuacuuccacgacaacgugagaguggccgccgccgagagcaugcccuuccugcuggagugcgccagaaucagaggccccgaguaccuggcccagauguggcaguucaucugcgacccccugaucaaggccaucggcaccgagcccgacaccgacgugcugagcgagaucaugaacagcuucgccaagagcaucgaggugaugggcgacggcugccugaacgacgagcaccuggaggagcugggcggcauccugaaggccaagcuggagggccacuucaagaaccaggagcugagacaggugaagagacaggaggagaacuacgaccagcagguggagaugagccugcaggacgaggacgagugcgacguguacauccugaccaaggugagcgacauccugcacagccuguucagcaccuacaaggagaagauccugcccugguucgagcagcugcugccccugaucgugaaccugaucugcagcagcagacccuggcccgacagacaguggggccugugcaucuucgacgacaucaucgagcacugcagccccaccagcuucaaguacguggaguacuucagauggcccaugcugcugaacaugagagacaacaaccccgaggugagacaggccgccgccuacggccugggcgugauggcccaguucggcggcgacgacuacagaagccugugcagcgaggccgugccccugcuggugaaggugaucaagugcgccaacagcaagaccaagaagaacgugaucgccaccgagaacugcaucagcgccaucggcaagauccugaaguucaagcccaacugcgugaacguggacgaggugcugccccacuggcugagcuggcugccccugcacgaggacaaggaggaggccauccagacccugagcuuccugugcgaccugaucgagagcaaccaccccguggugaucggccccaacaacagcaaccugcccaagaucaucagcaucaucgccgagggcaagaucaacgagaccaucaacuacgaggaccccugcgccaagagacuggccaacguggugagacaggugcagaccagcgaggaccuguggcuggagugcgugagccagcuggacgacgagcagcaggaggcccugcaggagcugcugaacuucgccuaa

SEQ ID NO: 22408 - RNA, 2190 nt, Artificial Sequence
  RANBP9__Homo_sapiens__NP_005484
augagcggccagcccccccccccccccccccagcagcagcagcagcagcagcagcugagcccccccccccccgccgcccuggcccccgugagcggcguggugcugcccgccccccccgccgugagcgccggcagcagccccgccggcagccccggcggcggcgccggcggcgagggccugggcgccgccgccgccgcccugcugcugcaccccccccccccccccccccccgccaccgccgcccccccccccccccccccccccccccccccccccgccagcgccgccgcccccgccagcggcccccccgccccccccggccuggccgccggccccggccccgccggcggcgcccccacccccgcccugguggccggcagcagcgccgccgcccccuucccccacggcgacagcgcccugaacgagcaggagaaggagcugcagagaagacugaagagacuguaccccgccguggacgagcaggagaccccccugcccagaagcuggagccccaaggacaaguucagcuacaucggccugagccagaacaaccugagagugcacuacaagggccacggcaagacccccaaggacgccgccagcgugagagccacccaccccauccccgccgccugcggcaucuacuacuucgaggugaagaucgugagcaagggcagagacggcuacaugggcaucggccugagcgcccagggcgugaacaugaacagacugcccggcugggacaagcacagcuacggcuaccacggcgacgacggccacagcuucugcagcagcggcaccggccagcccuacggccccaccuucaccaccggcgacgugaucggcugcugcgugaaccugaucaacaacaccugcuucuacaccaagaacggccacagccugggcaucgccuucaccgaccugccccccaaccuguaccccaccgugggccugcagacccccggcgaggugguggacgccaacuucggccagcaccccuucguguucgacaucgaggacuacaugagagaguggagaaccaagauccaggcccagaucgacagauuccccaucggcgacagagagggcgaguggcagaccaugauccagaagauggugagcagcuaccuggugcaccacggcuacugcgccaccgccgaggccuucgccagaagcaccgaccagaccgugcuggaggagcuggccagcaucaagaacagacagagaauccagaagcuggugcuggccggcagaaugggcgaggccaucgagaccacccagcagcuguaccccagccugcuggagagaaaccccaaccugcuguucacccugaaggugagacaguucaucgagauggugaacggcaccgacagcgaggugagaugccugggcggcagaagccccaagagccaggacagcuaccccgugagccccagacccuucagcagccccagcaugagccccagccacggcaugaacauccacaaccuggccagcggcaagggcagcaccgcccacuucagcggcuucgagagcugcagcaacggcgugaucagcaacaaggcccaccagagcuacugccacagcaacaagcaccagagcagcaaccugaacgugcccgagcugaacagcaucaacaugagcagaagccagcaggugaacaacuucaccagcaacgacguggacauggagaccgaccacuacagcaacggcgugggcgagaccagcagcaacggcuuccugaacggcagcagcaagcacgaccacgagauggaggacugcgacaccgagauggagguggacagcagccagcugagaagacagcugugcggcggcagccaggccgccaucgagagaaugauccacuucggcagagagcugcaggccaugagcgagcagcugagaagagacugcggcaagaacaccgccaacaagaagaugcugaaggacgccuucagccugcuggccuacagcgaccccuggaacagccccgugggcaaccagcuggaccccauccagagagagcccgugugcagcgcccugaacagcgccauccuggagacccacaaccugcccaagcagcccccccuggcccuggccaugggccaggccacccagugccugggccugauggccagaagcggcaucggcagcugcgccuucgccaccguggaggacuaccugcacuaa

SEQ ID NO: 22409 - RNA, 1764 nt, Artificial Sequence
  RANGAP1__Homo_sapiens__NP_001265580
auggccagcgaggacaucgccaagcuggccgagacccuggccaagacccagguggccggcggccagcugagcuucaagggcaagagccugaagcugaacaccgccgaggacgccaaggacgugaucaaggagaucgaggacuucgacagccuggaggcccugagacuggagggcaacaccgugggcguggaggccgccagagugaucgccaaggcccuggagaagaagagcgagcugaagagaugccacuggagcgacauguucaccggcagacugagaaccgagaucccccccgcccugaucagccugggcgagggccugaucaccgccggcgcccagcugguggagcuggaccugagcgacaacgccuucggccccgacggcgugcagggcuucgaggcccugcugaagagcagcgccugcuucacccugcaggagcugaagcugaacaacugcggcaugggcaucggcggcggcaagauccuggccgccgcccugaccgagugccacagaaagagcagcgcccagggcaagccccuggcccugaagguguucguggccggcagaaacagacuggagaacgacggcgccaccgcccuggccgaggccuucagagugaucggcacccuggaggaggugcacaugccccagaacggcaucaaccaccccggcaucaccgcccuggcccaggccuucgccgugaacccccugcugagagugaucaaccugaacgacaacaccuucaccgagaagggcgccguggccauggccgagacccugaagacccugagacagguggaggugaucaacuucggcgacugccuggugagaagcaagggcgccguggccaucgccgacgccaucagaggcggccugcccaagcugaaggagcugaaccugagcuucugcgagaucaagagagacgccgcccuggccguggccgaggccauggccgacaaggccgagcuggagaagcuggaccugaacggcaacacccugggcgaggagggcugcgagcagcugcaggaggugcuggagggcuucaacauggccaaggugcuggccagccugagcgacgacgaggacgaggaggaggaggaggagggcgaggaggaggaggaggaggccgaggaggaggaggaggaggacgaggaggaggaggaggaggaggaggaggaggaggaggaggagccccagcagagaggccagggcgagaagagcgccacccccagcagaaagauccuggaccccaacaccggcgagcccgcccccgugcugagcagccccccccccgccgacgugagcaccuuccuggccuuccccagccccgagaagcugcugagacugggccccaagagcagcgugcugaucgcccagcagaccgacaccagcgaccccgagaagguggugagcgccuuccugaaggugagcagcguguucaaggacgaggccaccgugagaauggccgugcaggacgccguggacgcccugaugcagaaggccuucaacagcagcagcuucaacagcaacaccuuccugaccagacugcuggugcacaugggccugcugaagagcgaggacaaggugaaggccaucgccaaccuguacggcccccugauggcccugaaccacauggugcagcaggacuacuuccccaaggcccuggccccccugcugcuggccuucgugaccaagcccaacagcgcccuggagagcugcagcuucgccagacacagccugcugcagacccuguacaagguguaa

SEQ ID NO: 22410 - RNA, 441 nt, Artificial Sequence
  RANGRF__Homo_sapiens__NP_001171272
auggagcccaccagagacugcccccuguucggcggcgccuucagcgccauccugcccaugggcgccaucgacgugagcgaccugagacccgugcccgacaaccaggagguguucugccaccccgugaccgaccagagccugaucguggagcugcuggagcugcaggcccacgugagaggcgaggccgccgccagauaccacuucgaggacgugggcggcgugcagggcgccagagccgugcacguggagagcgugcagccccugagccuggagaaccuggcccugagaggcagaugccaggaggccugggugcugagcggcaagcagcagaucgccaaggagaaccagcagguggccaaggacgugacccugcaccaggcccugcugagacugccccaguaccagaccgaccugcugcugaccuucaaccagccccccuaa

SEQ ID NO: 22411 - RNA, 387 nt, Artificial Sequence
  RAN__Homo_sapiens__NP_001287725
auguucgacgugaccagcagagugaccuacaagaacgugcccaacuggcacagagaccuggugagagugugcgagaacauccccaucgugcugugcggcaacaagguggacaucaaggacagaaaggugaaggccaagagcaucguguuccacagaaagaagaaccugcaguacuacgacaucagcgccaagagcaacuacaacuucgagaagcccuuccuguggcuggccagaaagcugaucggcgaccccaaccuggaguucguggccaugcccgcccuggccccccccgagguggugauggaccccgcccuggccgcccaguacgagcacgaccuggagguggcccagaccaccgcccugcccgacgaggacgacgaccuguaa

SEQ ID NO: 22412 - RNA, 555 nt, Artificial Sequence
  RAP1B__Homo_sapiens__NP_001010942
augagagaguacaagcugguggugcugggcagcggcggcgugggcaagagcgcccugaccgugcaguucgugcagggcaucuucguggagaaguacgaccccaccaucgaggacagcuacagaaagcagguggagguggacgcccagcagugcaugcuggagauccuggacaccgccggcaccgagcaguucaccgccaugagagaccuguacaugaagaacggccagggcuucgcccugguguacagcaucaccgcccagagcaccuucaacgaccugcaggaccugagagagcagauccugagagugaaggacaccgacgacgugcccaugauccuggugggcaacaagugcgaccuggaggacgagagaguggugggcaaggagcagggccagaaccuggccagacaguggaacaacugcgccuuccuggagagcagcgccaagagcaagaucaacgugaacgagaucuucuacgaccuggugagacagaucaacagaaagacccccgugcccggcaaggccagaaagaagagcagcugccagcugcuguaa

SEQ ID NO: 22413 - RNA, 2148 nt, Artificial Sequence
  RAP1GAP2__Homo_sapiens__NP_001093868
auguucggcagaaagagaagcgugagcuucggcggcuucggcuggaucgacaagaccaugcuggccagccugaaggugaagaagcaggagcuggccaacagcagcgacgccacccugcccgacagaccccugagccccccccugaccgccccccccaccaugaagagcagcgaguucuucgagaugcuggagaagaugcaggacgacuacauccccuaccccagcaucgacgaggugguggagaagggcggccccuacccccaggugauccugccccaguucggcggcuacuggaucgaggaccccgagaacgugggcacccccaccagccugggcagcagcaucugcgaggaggaggaggaggacaaccugagccccaacaccuucggcuacaagcuggagugcaagggcgaggccagagccuacagaagacacuuccugggcaaggaccaccugaacuucuacugcaccggcagcagccugggcaaccugauccugagcgugaagugcgaggaggccgagggcaucgaguaccugagagugauccugagaagcaagcugaagaccgugcacgagagaaucccccuggccggccugagcaagcugcccagcgugccccagaucgccaaggccuucugcgacgacgccgugggccugagauucaaccccgugcuguaccccaaggccagccagaugaucgugagcuacgacgagcacgaggugaacaacaccuucaaguucggcgugaucuaccagaaggccagacagacccuggaggaggagcuguucggcaacaacgaggagagccccgccuucaaggaguuccuggaccugcugggcgacaccaucacccugcaggacuucaagggcuucagaggcggccuggacgugacccacggccagaccggcguggagagcguguacaccaccuucagagacagagagaucauguuccacgugagcaccaagcugcccuucaccgacggcgacgcccagcagcugcagagaaagagacacaucggcaacgacaucguggccaucaucuuccaggaggagaacacccccuucgugcccgacaugaucgccagcaacuuccugcacgccuacaucguggugcagguggagacccccggcaccgagacccccagcuacaaggugagcgugaccgccagagaggacgugcccaccuucggccccccccugcccagcccccccguguuccagaagggccccgaguucagagaguuccugcugaccaagcugaccaacgccgagaacgccugcugcaagagcgacaaguucgccaagcuggaggacagaaccagagccgcccugcuggacaaccugcacgacgagcugcacgcccacacccaggccaugcugggccugggccccgaggaggacaaguucgagaacggcggccacggcggcuuccuggagagcuucaagagagccaucagagugagaagccacagcauggagaccauggugggcggccagaagaagagccacagcggcggcauccccggcagccugagcggcggcaucagccacaacagcauggaggugaccaagaccaccuucagcccccccgugguggccgccaccgugaagaaccagagcagaagccccaucaagagaagaagcggccuguuccccagacugcacaccggcagcgagggccagggcgacagcagagccagaugcgacagcaccagcagcacccccaagacccccgacggcggccacagcagccaggagaucaagagcgagaccagcagcaaccccagcagccccgagaucugccccaacaaggagaagcccuucaugaagcugaaggagaacggcagagccaucagcagaagcagcagcagcaccagcagcgugagcagcaccgccggcgagggcgaggccauggaggagggcgacagcggcggcagccagcccagcaccaccagccccuucaagcaggagguguucguguacagccccagccccagcagcgagagccccagccugggcgccgccgccacccccaucaucaugagcagaagccccaccgacgccaagagcagaaacagccccagaagcaaccugaaguucagauucgacaagcugagccacgccagcagcggcgccggccacuaa

SEQ ID NO: 22414 - RNA, 1827 nt, Artificial Sequence
  RAP1GDS1__Homo_sapiens__NP_001093896
auggccgacaaccugagcgacacccugaagaagcugaagaucaccgccguggacaagaccgaggacagccuggagggcugccuggacugccugcugcaggcccuggcccagaacaacaccgagaccagcgagaagauccaggccagcggcauccugcagcuguucgccagccugcugaccccccagagcagcugcaaggccaagguggccaacaucaucgccgagguggccaagaacgaguucaugagaauccccugcguggacgccggccugaucagcccccuggugcagcugcugaacagcaaggaccaggaggugcugcugcagaccggcagagcccugggcaacaucugcuacgacagccacgagggcagaagcgccguggaccaggccggcggcgcccagaucgugaucgaccaccugagaagccugugcagcaucaccgaccccgccaacgagaagcugcugaccguguucugcggcaugcugaugaacuacagcaacgagaacgacagccugcaggcccagcugaucaacaugggcgugauccccacccuggugaagcugcugggcauccacugccagaacgccgcccugaccgagaugugccugguggccuucggcaaccuggccgagcuggagagcagcaaggagcaguucgccagcaccaacaucgccgaggagcuggugaagcuguucaagaagcagaucgagcacgacaagagagagaugaucuucgaggugcuggccccccuggccgagaacgacgccaucaagcugcagcugguggaggccggccugguggagugccugcuggagaucgugcagcagaagguggacagcgacaaggaggacgacaucaccgagcugaagaccggcagcgaccugauggugcugcugcugcugggcgacgagagcaugcagaagcuguucgagggcggcaagggcagcguguuccagagagugcugagcuggauccccagcaacaaccaccagcugcagcuggccggcgcccuggccaucgccaacuucgccagaaacgacgccaacugcauccacaugguggacaacggcaucguggagaagcugauggaccugcuggacagacacguggaggacggcaacgugaccgugcagcacgccgcccugagcgcccugagaaaccuggccauccccgugaucaacaaggccaagaugcugagcgccggcgugaccgaggccgugcugaaguuccugaagagcgagaugccccccgugcaguucaagcugcugggcacccugagaaugcugaucgacgcccaggccgaggccgccgagcagcugggcaagaacgugaagcugguggagagacugguggaguggugcgaggccaaggaccacgccggcgugaugggcgagagcaacagacugcugagcgcccugaucagacacagcaagagcaaggacgugaucaagaccaucgugcagagcggcggcaucaagcaccuggugaccauggccaccagcgagcacgugaucaugcagaacgaggcccugguggcccuggcccugaucgccgcccuggagcugggcaccgccgagaaggaccuggagagcgccaagcuggugcagauccugcacagacugcuggccgacgagagaagcgcccccgagaucaaguacaacagcauggugcugaucugcgcccugaugggcagcgagugccugcacaaggaggugcaggaccuggccuuccuggacguggugagcaagcugagaagccacgagaacaagagcguggcccagcaggccagccugaccgagcagagacugaccguggagagcuaa

SEQ ID NO: 22415 - RNA, 552 nt, Artificial Sequence
  RAP2A__Homo_sapiens__NP_066361
augagagaguacaaggugguggugcugggcagcggcggcgugggcaagagcgcccugaccgugcaguucgugaccggcaccuucaucgagaaguacgaccccaccaucgaggacuucuacagaaaggagaucgagguggacagcagccccagcgugcuggagauccuggacaccgccggcaccgagcaguucgccagcaugagagaccuguacaucaagaacggccagggcuucauccugguguacagccuggugaaccagcagagcuuccaggacaucaagcccaugagagaccagaucaucagagugaagagauacgagaaggugcccgugauccuggugggcaacaagguggaccuggagagcgagagagaggugagcagcagcgagggcagagcccuggccgaggaguggggcugccccuucauggagaccagcgccaagagcaagaccaugguggacgagcuguucgccgagaucgugagacagaugaacuacgccgcccagcccgacaaggacgaccccugcugcagcgccugcaacauccaguaa

SEQ ID NO: 22416 - RNA, 552 nt, Artificial Sequence
  RAP2B__Homo_sapiens__NP_002877
augagagaguacaaggugguggugcugggcagcggcggcgugggcaagagcgcccugaccgugcaguucgugaccggcagcuucaucgagaaguacgaccccaccaucgaggacuucuacagaaaggagaucgagguggacagcagccccagcgugcuggagauccuggacaccgccggcaccgagcaguucgccagcaugagagaccuguacaucaagaacggccagggcuucauccugguguacagccuggugaaccagcagagcuuccaggacaucaagcccaugagagaccagaucaucagagugaagagauacgagagagugcccaugauccuggugggcaacaagguggaccuggagggcgagagagaggugagcuacggcgagggcaaggcccuggccgaggaguggagcugccccuucauggagaccagcgccaagaacaaggccagcguggacgagcuguucgccgagaucgugagacagaugaacuacgccgcccagcccaacggcgacgagggcugcugcagcgccugcgugauccuguaa

SEQ ID NO: 22417 - RNA, 3285 nt, Artificial Sequence
  RAPGEF1__Homo_sapiens__NP_001291204
augagcggcggccugggccugagaagaagccccgagaugagcggcaagaucgagaaggccgacagccagagaagccaccugagcagcuucaccaugaagcugauggacaaguuccacagccccaagaucaagagaacccccagcaagaagggcaagcccgccgaggugagcgugaagauccccgagaagcccgugaacaaggaggccaccgacagauuccugcccgagggcuacccccugccccuggaccuggagcagcaggccguggaguucaugagcaccagcgccguggccagcagaagccagagacagaagaaccugagcuggcuggaggagaaggagaaggagguggugagcgcccugagauacuucaagaccaucguggacaagauggccaucgacaagaaggugcuggagaugcugcccggcagcgccagcaaggugcuggaggccauccugccccuggugcagaacgaccccagaauccagcacagcagcgcccugagcagcugcuacagcagaguguaccagagccuggccaaccugaucagauggagcgaccaggugaugcuggagggcgugaacagcgaggacaaggagauggugaccaccgugaagggcgugaucaaggccgugcuggacggcgugaaggagcuggugagacugaccaucgagaagcagggcagacccagccccaccagccccgugaagcccagcagccccgccagcaagcccgacggccccgccgagcugccccugaccgacagagagguggagauccugaacaagaccaccggcaugagccagagcaccgagcugcugcccgacgccaccgacgaggagguggccccccccaagcccccccugcccggcaucagagugguggacaacagccccccccccgcccugccccccaagaagagacagagcgcccccagccccaccagaguggccgugguggcccccaugagcagagccaccagcggcagcagccugcccgugggcaucaacagacaggacuucgacguggacugcuacgcccagagaagacugagcggcggcagccacagcuacggcggcgagagccccagacugagccccugcagcagcaucggcaagcugagcaagagcgacgagcagcugagcagccuggacagagacagcggccagugcagcagaaacaccagcugcgagacccuggaccacuacgaccccgacuacgaguuccugcagcaggaccugagcaacgccgaccagaucccccagcagaccgccuggaaccugagcccccugcccgagagccugggcgagagcggcagccccuuccugggcccccccuuccagcugccccugggcggccacccccagcccgacggcccccuggcccccggccagcagaccgacaccccccccgcccugcccgagaagaagagaagaagcgccgccagccagaccgccgacggcagcggcugcagagugagcuacgagagacaccccagccaguacgacaacaucagcggcgaggaccugcagagcaccgcccccauccccagcgugcccuacgcccccuucgccgccauccugcccuuccagcacggcggcagcagcgcccccguggaguucgugggcgacuucaccgcccccgagagcaccggcgaccccgagaagccccccccccugcccgagaagaagaacaagcacaugcuggccuacaugcagcugcuggaggacuacagcgagccccagcccagcauguucuaccagaccccccagaacgagcacaucuaccagcagaagaacaagcugcugauggagguguacggcuucagcgacagcuucagcggcguggacagcgugcaggagcuggcccccccccccgcccugccccccaagcagagacagcuggagccccccgccggcaaggacggccaccccagagaccccagcgccgugagcggcgugcccggcaaggacagcagagacggcagcgagagagcccccaagagccccgacgcccuggagagcgcccagagcgaggaggagguggacgagcugagccugaucgaccacaacgagaucaugagcagacugacccugaagcaggagggcgacgacggccccgacgugagaggcggcagcggcgacauccugcuggugcacgccaccgagaccgacagaaaggaccuggugcuguacugcgaggccuuccugaccaccuacagaaccuucaucagccccgaggagcugaucaagaagcugcaguacagauacgagaaguucagccccuucgccgacaccuucaagaagagagugagcaagaacaccuucuucgugcuggugagagugguggacgagcugugccugguggagcugaccgaggagauccugaagcugcugauggagcugguguucagacuggugugcaacggcgagcugagccuggccagagugcugagaaagaacauccuggacaagguggaccagaagaagcugcugagaugcgccaccagcagccagccccuggccgccagaggcguggccgccagacccggcacccugcacgacuuccacagccacgagaucgccgagcagcugacccugcuggacgccgagcuguucuacaagaucgagauccccgaggugcugcugugggccaaggagcagaacgaggagaagagccccaaccugacccaguucaccgagcacuucaacaacaugagcuacugggugagaagcaucaucaugcugcaggagaaggcccaggacagagagagacugcugcugaaguucaucaagaucaugaagcaccugagaaagcugaacaacuucaacagcuaccuggccauccugagcgcccuggacagcgcccccaucagaagacuggaguggcagaagcagaccagcgagggccuggccgaguacugcacccugaucgacagcagcagcagcuucagagccuacagagccgcccugagcgagguggagccccccugcauccccuaccugggccugauccugcaggaccugaccuucgugcaccugggcaaccccgacuacaucgacggcaaggugaacuucagcaagagauggcagcaguucaacauccuggacagcaugagaugcuuccagcaggcccacuacgacaugagaagaaacgacgacaucaucaacuucuucaacgacuucagcgaccaccuggccgaggaggcccugugggagcugagccugaagaucaagcccagaaacaucaccagaagaaagaccgacagagaggagaagaccuaa

SEQ ID NO: 22418 - RNA, 4500 nt, Artificial Sequence
  RAPGEF2__Homo_sapiens__NP_055062
augaagccccuggccauccccgccaaccacggcgugaugggccagcaggagaagcacagccugcccgccgacuucaccaagcugcaccugaccgacagccugcacccccaggugacccacgugagcagcagccacagcggcugcagcaucaccagcgacagcggcagcagcagccugagcgacaucuaccaggccaccgagagcgaggccggcgacauggaccugagcggccugcccgagaccgccguggacagcgaggacgacgacgacgaggaggacaucgagagagccagcgacccccugaugagcagagacaucgugagagacugccuggagaaggaccccaucgacagaaccgacgacgacaucgagcagcugcuggaguucaugcaccagcugcccgccuucgccaacaugaccaugagcgugagaagagagcugugcgccgugaugguguucgccgugguggagagagccggcaccaucgugcugaacgacggcgaggagcuggacagcuggagcgugauccugaacggcagcguggaggugaccuaccccgacggcaaggccgagauccugugcaugggcaacagcuucggcgugagccccaccauggacaaggaguacaugaagggcgugaugagaaccaagguggacgacugccaguucgugugcaucgcccagcaggacuacugcagaauccugaaccagguggagaagaacaugcagaagguggaggaggagggcgagaucgugauggugaaggagcacagagagcuggacagaaccggcaccagaaagggccacaucgugaucaagggcaccagcgagagacugaccaugcaccugguggaggagcacagcgugguggaccccaccuucaucgaggacuuccugcugaccuacagaaccuuccugagcagccccauggaggugggcaagaagcugcuggagugguucaacgaccccagccugagagacaaggugaccagaguggugcugcugugggugaacaaccacuucaacgacuucgagggcgaccccgccaugaccagauuccuggaggaguucgagaacaaccuggagagagagaagaugggcggccaccugagacugcugaacaucgccugcgccgccaaggccaagagaagacugaugacccugaccaagcccagcagagaggccccccugcccuucauccugcugggcggcagcgagaagggcuucggcaucuucguggacagcguggacagcggcagcaaggccaccgaggccggccugaagagaggcgaccagauccuggaggugaacggccagaacuucgagaacauccagcugagcaaggccauggagauccugagaaacaacacccaccugagcaucaccgugaagaccaaccuguucguguucaaggagcugcugaccagacugagcgaggagaagagaaacggcgccccccaccugcccaagaucggcgacaucaagaaggccagcagauacagcauccccgaccuggccguggacguggagcaggugaucggccuggagaaggugaacaagaagagcaaggccaacaccgugggcggcagaaacaagcugaagaagauccuggacaagaccagaaucagcauccugccccagaagcccuacaacgacaucggcaucggccagagccaggacgacagcaucgugggccugagacagaccaagcacauccccaccgcccugcccgugagcggcacccugagcagcagcaaccccgaccugcugcagagccaccacagaauccuggacuucagcgccacccccgaccugcccgaccaggugcugagaguguucaaggccgaccagcagagcagauacaucaugaucagcaaggacaccaccgccaaggagguggugauccaggccaucagagaguucgccgugaccgccacccccgaccaguacagccugugcgaggugagcgugacccccgagggcgugaucaagcagagaagacugcccgaccagcugagcaagcuggccgacagaauccagcugagcggcagauacuaccugaagaacaacauggagaccgagacccugugcagcgacgaggacgcccaggagcugcugagagagagccagaucagccugcugcagcugagcaccguggagguggccacccagcugagcaugagaaacuucgagcuguucagaaacaucgagcccaccgaguacaucgacgaccuguucaagcugagaagcaagaccagcugcgccaaccugaagagauucgaggaggugaucaaccaggagaccuucuggguggccagcgagauccugagagagaccaaccagcugaagagaaugaagaucaucaagcacuucaucaagaucgcccugcacugcagagagugcaagaacuucaacagcauguucgccaucaucagcggccugaaccuggcccccguggccagacugagaaccaccugggagaagcugcccaacaaguacgagaagcuguuccaggaccugcaggaccuguucgaccccagcagaaacauggccaaguacagaaacgugcugaacagccagaaccugcagccccccaucaucccccuguuccccgugaucaagaaggaccugaccuuccugcacgagggcaacgacagcaagguggacggccuggugaacuucgagaagcugagaaugaucgccaaggagaucagacacgugggcagaauggccagcgugaacauggaccccgcccugauguucagaaccagaaagaagaaguggagaagccugggcagccugagccagggcagcaccaacgccaccgugcuggacguggcccagaccggcggccacaagaagagagugagaagaagcagcuuccugaacgccaagaagcuguacgaggacgcccagauggccagaaaggugaagcaguaccugagcaaccuggagcuggagauggacgaggagagccugcagacccugagccugcagugcgagcccgccaccaacacccugcccaagaaccccggcgacaagaagcccgugaagagcgagaccagccccguggcccccagagccggcagccagcagaaggcccagagccugccccagccccagcagcagcccccccccgcccacaagaucaaccagggccugcaggugcccgccgugagccuguaccccagcagaaagaaggugcccgugaaggaccugccccccuucggcaucaacagcccccaggcccugaagaagauccugagccugagcgaggagggcagccuggagagacacaagaagcaggccgaggacaccaucagcaacgccagcagccagcugagcagcccccccaccagcccccagagcagccccagaaagggcuacacccuggcccccagcggcaccguggacaacuucagcgacagcggccacagcgagaucagcagcagaagcagcaucgugagcaacagcagcuucgacagcgugcccgugagccugcacgacgagagaagacagagacacagcgugagcaucguggagaccaaccugggcaugggcagaauggagagaagaaccaugaucgagcccgaccaguacagccugggcagcuacgcccccaugagcgagggcagaggccuguacgccaccgccaccgugaucagcagccccagcaccgaggagcugagccaggaccagggcgacagagccagccuggacgccgccgacagcggcagaggcagcuggaccagcugcagcagcggcagccacgacaacauccagaccauccagcaccagagaagcugggagacccugcccuucggccacacccacuucgacuacagcggcgaccccgccggccugugggccagcagcagccacauggaccagaucauguucagcgaccacagcaccaaguacaacagacagaaccagagcagagagagccuggagcaggcccagagcagagccagcugggccagcagcaccggcuacuggggcgaggacagcgagggcgacaccggcaccaucaagagaagaggcggcaaggacgugagcaucgaggccgagagcagcagccugaccagcgugaccaccgaggagaccaagcccgugcccaugcccgcccacaucgccguggccagcagcaccaccaagggccugaucgccagaaaggagggcagauacagagagcccccccccaccccccccggcuacaucggcauccccaucaccgacuuccccgagggccacagccaccccgccagaaagccccccgacuacaacguggcccugcagagaagcagaaugguggccagaagcagcgacaccgccggccccagcagcgugcagcagccccacggccaccccaccagcagcagacccgugaacaagccccaguggcacaagcccaacgagagcgaccccagacuggcccccuaccagagccagggcuucagcaccgaggaggacgaggacgagcaggugagcgccguguaa

SEQ ID NO: 22419 - RNA, 2772 nt, Artificial Sequence
  RAPGEF3__Homo_sapiens__NP_001092001
augaaggugggcuggcccggcgagagcugcuggcaggugggccuggccguggaggacagccccgcccugggcgcccccagagugggcgcccugcccgacguggugcccgagggcacccugcugaacauggugcugagaagaaugcacagacccagaagcugcagcuaccagcugcugcuggagcaccagagacccagcugcauccagggccugagauggaccccccugaccaacagcgaggagagccuggacuucagcgagagccuggagcaggccagcaccgagagagugcugagagccggcagacagcugcacagacaccugcuggccaccugccccaaccugaucagagacagaaaguaccaccugagacuguacagacagugcugcagcggcagagagcugguggacggcauccuggcccugggccugggcgugcacagcagaagccagguggugggcaucugccaggugcugcuggacgagggcgcccugugccacgugaagcacgacugggccuuccaggacagagacgcccaguucuacagauuccccggccccgagcccgagcccgugggcacccacgagauggaggaggagcuggccgaggccguggcccugcugagccagagaggccccgacgcccugcugaccguggcccugagaaagccccccggccagagaaccgacgaggagcuggaccugaucuucgaggagcugcugcacaucaaggccguggcccaccugagcaacagcgugaagagagagcuggccgccgugcugcuguucgagccccacagcaaggccggcaccgugcuguucagccagggcgacaagggcaccagcugguacaucaucuggaagggcagcgugaacguggugacccacggcaagggccuggugaccacccugcacgagggcgacgacuucggccagcuggcccuggugaacgacgcccccagagccgccaccaucauccugagagaggacaacugccacuuccugagaguggacaagcaggacuucaacagaaucaucaaggacguggaggccaagaccaugagacuggaggagcacggcaagguggugcuggugcuggagagagccagccagggcgccggccccagcagaccccccacccccggcagaaacagauacaccgugaugagcggcacccccgagaagauccuggagcugcugcuggaggccaugggccccgacagcagcgcccacgaccccaccgagaccuuccugagcgacuuccugcugacccacagaguguucaugcccagcgcccagcugugcgccgcccugcugcaccacuuccacguggagcccgccggcggcagcgagcaggagagaagcaccuacgugugcaacaagagacagcagauccugagacuggugagccaguggguggcccuguacggcagcaugcugcacaccgaccccguggccaccagcuuccugcagaagcugagcgaccuggugggcagagacaccagacugagcaaccugcugagagagcaguggcccgagagaagaagaugccacagacuggagaacggcugcggcaacgccagcccccagaugaaggccagaaaccugcccguguggcugcccaaccaggacgagccccugcccggcagcagcugcgccauccaggugggcgacaaggugcccuacgacaucugcagacccgaccacagcgugcugacccugcagcugcccgugaccgccagcgugagagaggugauggccgcccuggcccaggaggacggcuggaccaagggccaggugcuggugaaggugaacagcgccggcgacgccaucggccugcagcccgacgccagaggcguggccaccagccugggccugaacgagagacuguucguggugaacccccaggaggugcacgagcugaucccccaccccgaccagcugggccccaccgugggcagcgccgagggccuggaccuggugagcgccaaggaccuggccggccagcugaccgaccacgacuggagccuguucaacagcauccaccagguggagcugauccacuacgugcugggcccccagcaccugagagacgugaccaccgccaaccuggagagauucaugagaagauucaacgagcugcaguacuggguggccaccgagcugugccugugccccgugcccggccccagagcccagcugcugagaaaguucaucaagcuggccgcccaccugaaggagcagaagaaccugaacagcuucuucgccgugauguucggccugagcaacagcgccaucagcagacuggcccacaccugggagagacugccccacaaggugagaaagcuguacagcgcccuggagagacugcuggaccccagcuggaaccacagaguguacagacuggcccuggccaagcugagcccccccgugauccccuucaugccccugcugcugaaggacaugaccuucauccacgagggcaaccacacccugguggagaaccugaucaacuucgagaagaugagaaugauggccagagccgccagaaugcugcaccacugcagaagccacaaccccgugccccugagcccccugagaagcagagugagccaccugcacgaggacagccagguggccagaaucagcaccugcagcgagcagagccugagcaccagaagccccgccagcaccugggccuacgugcagcagcugaaggugaucgacaaccagagagagcugagcagacugagcagagagcuggagcccuaa

SEQ ID NO: 22420 - RNA, 2604 nt, Artificial Sequence
  RAPGEF4__Homo_sapiens__NP_001093867
augcuguacaagaaguacagacaguacauggccggccugcuggccccccccuacggcgugauggagaccggcagcaacaacgacagaauccccgacaaggagaacaccccccugaucgagccccacgugccccugagacccgccaacaccaucaccaaggugcccagcgagaagauccugagagccggcaagauccugagaaacgccauccugagcagagccccccacaugaucagagacagaaaguaccaccugaagaccuacagacagugcugcgugggcaccgagcugguggacuggaugaugcagcagacccccugcgugcacagcagaacccaggccgugggcauguggcaggugcugcuggaggacggcgugcugaaccacguggaccaggagcaccacuuccaggacaaguaccuguucuacagauuccuggacgacgagcacgaggacgccccccugcccaccgaggaggagaagaaggagugcgacgaggagcugcaggacaccaugcugcugcugagccagaugggccccgacgcccacaugagaaugauccugagaaagccccccggccagagaaccguggacgaccuggagaucaucuacgaggagcugcugcacaucaaggcccugagccaccugagcaccaccgugaagagagagcuggccggcgugcugaucuucgagagccacgccaagggcggcaccgugcuguucaaccagggcgaggagggcaccagcugguacaucauccugaagggcagcgugaacguggugaucuacggcaagggcguggugugcacccugcacgagggcgacgacuucggcaagcuggcccuggugaacgacgcccccagagccgccagcaucgugcugagagaggacaacugccacuuccugagaguggacaaggaggacuucaacagaauccugagagacguggaggccaacaccgugagacugaaggagcacgaccaggacgugcuggugcuggagaaggugcccgccggcaacagagccagcaaccagggcaacagccagccccagcagaaguacaccgugaugagcggcacccccgagaagauccuggagcacuuccuggagaccaucagacuggaggccacccugaacgaggccaccgacagcgugcugaacgacuucaucaugaugcacugcguguucaugcccaacacccagcugugccccgcccugguggcccacuaccacgcccagcccagccagggcaccgagcaggagaagauggacuacgcccugaacaacaagagaagagugaucagacuggugcugcagugggccgccauguacggcgaccugcugcaggaggacgacgugagcauggccuuccuggaggaguucuacgugagcgugagcgacgacgccagaaugaucgccgcccugaaggagcagcugcccgagcuggagaagaucgugaagcagaucagcgaggacgccaaggccccccagaagaagcacaaggugcugcugcagcaguucaacaccggcgacgagagagcccagaagagacagcccaucagaggcagcgacgaggugcuguucaagguguacugcauggaccacaccuacaccaccaucagagugcccguggccaccagcgugaaggaggugaucagcgccguggccgacaagcugggcagcggcgagggccugaucaucgugaagaugagcagcggcggcgagaagguggugcugaagcccaacgacgugagcguguucaccacccugaccaucaacggcagacuguucgccugccccagagagcaguucgacagccugaccccccugcccgagcaggagggccccaccgugggcaccgugggcaccuucgagcugaugagcagcaaggaccuggccuaccagaugaccaucuacgacugggagcuguucaacugcgugcacgagcuggagcugaucuaccacaccuucggcagacacaacuucaagaagaccaccgccaaccuggaccuguuccugagaagauucaacgagauccaguucuggguggugaccgagaucugccugugcagccagcugagcaagagagugcagcugcugaagaaguucaucaagaucgccgcccacugcaaggaguacaagaaccugaacagcuucuucgccaucgugaugggccugagcaacguggccgugagcagacuggcccugaccugggagaagcugcccagcaaguucaagaaguucuacgccgaguucgagagccugauggaccccagcagaaaccacagagccuacagacugaccguggccaagcuggagcccccccugauccccuucaugccccugcugaucaaggacaugaccuucacccacgagggcaacaagaccuucaucgacaaccuggugaacuucgagaagaugagaaugaucgccaacaccgccagaaccgugagauacuacagaagccagcccuucaaccccgacgccgcccaggccaacaagaaccaccaggacgugagaagcuacgugagacagcugaacgugaucgacaaccagagaacccugagccagaugagccacagacuggagcccagaagacccuaa

SEQ ID NO: 22421 - RNA, 2193 nt, Artificial Sequence
  RAPGEF5__Homo_sapiens__NP_036426
auggccaucggcguguggcagcugcugcuggacaugggcaucaugcugagcguggaccagcaccuguacuuccaggacaccuacguguucuaccaguucagcagcgacgagugcagcuaccuguacugcgaguucgagagagaggaggaguggcagaacggcgugaagcugcugcugcagcuggugccccugauccccgccagaggcggcaucugcgagcugagccaccagaagaucgaggacagcgaggagagcagcgacgagauccuggugagacugaccagcgccgugcagagagagcuggccgccgugaucgcccugaaggccagaaagagcgccaucgagcaggacgaggagaacaacgacaagcacguggccgugaccgaggccgagagcgugcccgacagccaggccggcgugaugugcaagcugcaggagagagacgagaucggcagaaucgagcuggugcagaagcuggccaaggagaacuaccaguuccugcagaccgacaagaaggagcaggagaagagcgagcaccaggacgacgaggugaccaccgugcaggugaaggagcaggaccagagcgugcuggugcugaagaaggugcagugcugcggccccgcccccaccgccggcagcgccgagagccacuggagauacgugguggugagcggcacccccgagaagauccuggagcaccugcugaacgaccugcaccuggaggaggugcaggacaaggagaccgagacccugcuggacgacuuccugcugaccuacaccguguucaugaccaccgacgaccugugccaggcccugcugagacacuacagcgccaagaaguaccagggcaaggaggagaacagcgacgugcccagaagaaagagaaaggugcugcaccuggugagccaguggaucgcccuguacaaggacuggcugcccgaggacgagcacagcaagauguuccugaagaccaucuacagaaacgugcuggacgacguguacgaguaccccauccuggagaaggagcugaaggaguuccagaagauccugggcaugcacagaagacacaccguggacgaguacagcccccagaagaagaacaaggcccuguuccaccaguucagccugaaggagaacuggcugcagcacagaggcaccgugaccgagaccgaggagaucuucugccacguguacaucaccgagcacagcuacgugagcgugaaggccaaggugagcagcaucgcccaggagauccugaaggugguggccgagaagauccaguacgccgaggaggaccuggcccugguggccaucaccuucagcggcgagaagcacgagcugcagcccaacgaccuggugaucagcaagagccuggaggccagcggcagaaucuacguguacagaaaggaccuggccgacacccugaaccccuucgccgagaacgaggagagccagcagagaagcaugagaauccugggcaugaacaccugggaccuggcccuggagcugaugaacuucgacuggagccuguucaacagcauccacgagcaggagcugaucuacuucaccuucagcagacagggcagcggcgagcacaccgccaaccugagccugcugcugcagagaugcaacgaggugcagcuguggguggccaccgagauccugcugugcagccagcugggcaagagagugcagcuggugaagaaguucaucaagaucgccgcccacugcaaggcccagagaaaccugaacagcuucuucgccaucgugaugggccugaacaccgccagcgugagcagacugagccagaccugggagaagauccccggcaaguucaagaagcuguucagcgagcuggagagccugaccgaccccagccugaaccacaaggccuacagagacgccuucaagaagaugaagccccccaagauccccuucaugccccugcugcugaaggacgugaccuucauccacgagggcaacaagaccuuccuggacaaccuggugaacuucgagaagcugcacaugaucgccgacaccgugagaacccugagacacugcagaaccaaccaguucggcgaccugagccccaaggagcaccaggagcugaagagcuacgugaaccaccuguacgugaucgacagccagcaggcccuguucgagcugagccacagaaucgagcccagaguguaa

SEQ ID NO: 22422 - RNA, 1935 nt, Artificial Sequence
  RAPH1__Homo_sapiens__NP_976241
auggagcagcugagcgacgaggagaucgaccacggcgccgaggaggacagcgacaaggaggaccaggaccuggacaagauguucggcgccuggcugggcgagcuggacaagcugacccagagccuggacagcgacaagcccauggagcccgugaagagaagcccccugagacaggagaccaacauggccaacuucagcuacagauucagcaucuacaaccugaacgaggcccugaaccagggcgagaccguggaccuggacgcccugauggccgaccugugcagcaucgagcaggagcugagcagcaucggcagcggcaacagcaagagacagaucaccgagaccaaggccacccagaagcugcccgugagcagacacacccugaagcacggcacccugaagggccugagcagcagcagcaacagaaucgccaagcccagccacgccagcuacagccuggacgacgugaccgcccagcuggagcaggccagccugagcauggacgaggccgcccagcagagcgugcuggaggacaccaagccccuggugaccaaccagcacagaagaaccgccagcgccggcaccgugagcgacgccgaggugcacagcaucagcaacagcagccacagcagcaucaccagcgccgccagcagcauggacagccuggacaucgacaaggugaccagaccccaggagcuggaccugacccaccagggccagcccaucaccgagcacgccaucagccugagaugcagcagcaagcaggccaagagacacaucgacuucaccgaggagcaggccgagcugaccccccacagcuaccuggacagagagaccagccugcugcugagaaacaucgccggcaagcccagccaccugcugaccaaggaggagcaggccgccaagcugaaggccgagaagaucagaguggcccuggagaagaucaaggaggcccaggugaagaagcuggugaucagagugcacaugagcgacgacagcagcaagaccaugaugguggacgagagacagaccgugagacaggugcuggacaaccugauggacaagagccacugcggcuacagccuggacuggagccugguggagaccgugagcgagcugcagauggagagaaucuucgaggaccacgagaaccugguggagaaccugcugaacuggaccagagacagccagaacaagcugaucuucauggagagaaucgagaaguacgcccuguucaagaacccccagaacuaccugcugggcaagaaggagaccgccgagauggccgacagaaacaaggaggugcugcuggaggagugcuucugcggcagcagcgugaccgugcccgagaucgagggcgugcuguggcugaaggacgacggcaagaagagcuggaagaagagauacuuccugcugagagccagcggcaucuacuacgugcccaagggcaaggccaaggugagcagagaccuggugugcuuccugcagcuggaccacgugaacguguacuacggccaggacuacagaaacaaguacaaggcccccaccgacuacugccuggugcugaagcacccccagauccagaagaagagccaguacaucaaguaccugugcugcgacgacgugagaacccugcaccagugggugaacggcaucagaaucgccaaguacggcaagcagcuguacaugaacuaccaggaggcccugaagagaaccgagagcgccuacgacuggaccagccugagcagcagcagcaucaagagcggcagcagcagcagcagcauccccgagagccagagcaaccacagcaaccagagcgacagcggcgugagcgacacccagcccgccggccacgugagaagccagagcaucgugagcagcguguucagcgaggccuggaagagaggcacccagcuggaggagagcagcaaguaa

SEQ ID NO: 22423 - RNA, 1239 nt, Artificial Sequence
  RAPSN__Homo_sapiens__NP_005046
augggccaggaccagaccaagcagcagaucgagaagggccugcagcuguaccagagcaaccagaccgagaaggcccugcagguguggaccaaggugcuggagaagagcagcgaccugaugggcagauucagagugcugggcugccuggugaccgcccacagcgagaugggcagauacaaggagaugcugaaguucgccguggugcagaucgacaccgccagagagcuggaggacgccgacuuccugcuggagagcuaccugaaccuggccagaagcaacgagaagcugugcgaguuccacaagaccaucagcuacugcaagaccugccugggccugcccggcaccagagccggcgcccagcugggcggccaggugagccugagcaugggcaacgccuuccugggccugagcguguuccagaaggcccuggagagcuucgagaaggcccugagauacgcccacaacaacgacgacgccaugcuggagugcagagugugcugcagccugggcagcuucuacgcccaggugaaggacuacgagaaggcccuguucuuccccugcaaggccgccgagcuggugaacaacuacggcaagggcuggagccugaaguacagagccaugagccaguaccacauggccguggccuacagacugcugggcagacugggcagcgccauggagugcugcgaggagagcaugaagaucgcccugcagcacggcgacagaccccugcaggcccugugccugcugugcuucgccgacauccacagaagcagaggcgaccuggagaccgccuuccccagauacgacagcgccaugagcaucaugaccgagaucggcaacagacugggccaggugcaggcccugcugggcguggccaagugcuggguggccagaaaggcccuggacaaggcccuggacgccaucgagagagcccaggaccuggccgaggaggugggcaacaagcugagccagcugaagcugcacugccugagcgagagcaucuacagaagcaagggccugcagagagagcugagagcccacguggugagauuccacgagugcguggaggagaccgagcuguacugcggccugugcggcgagagcaucggcgagaagaacagcagacugcaggcccugcccugcagccacaucuuccaccugagaugccugcagaacaacggcaccagaagcugccccaacugcagaagaagcagcaugaagcccggcuucguguaa

SEQ ID NO: 22424 - RNA, 1374 nt, Artificial Sequence
  RARA__Homo_sapiens__NP_001019980
auguacgagagcguggaggugggcggccccacccccaaccccuuccuggugguggacuucuacaaccagaacagagccugccugcugcccgagaagggccugcccgcccccggccccuacagcaccccccugagaaccccccuguggaacggcagcaaccacagcaucgagacccagagcagcagcagcgaggagaucgugcccagcccccccagcccccccccccugcccagaaucuacaagcccugcuucgugugccaggacaagagcagcggcuaccacuacggcgugagcgccugcgagggcugcaagggcuucuucagaagaagcauccagaagaacaugguguacaccugccacagagacaagaacugcaucaucaacaaggugaccagaaacagaugccaguacugcagacugcagaagugcuucgaggugggcaugagcaaggagagcgugagaaacgacagaaacaagaagaagaaggaggugcccaagcccgagugcagcgagagcuacacccugacccccgaggugggcgagcugaucgagaaggugagaaaggcccaccaggagaccuuccccgcccugugccagcugggcaaguacaccaccaacaacagcagcgagcagagagugagccuggacaucgaccugugggacaaguucagcgagcugagcaccaagugcaucaucaagaccguggaguucgccaagcagcugcccggcuucaccacccugaccaucgccgaccagaucacccugcugaaggccgccugccuggacauccugauccugagaaucugcaccagauacacccccgagcaggacaccaugaccuucagcgacggccugacccugaacagaacccagaugcacaacgccggcuucggcccccugaccgaccugguguucgccuucgccaaccagcugcugccccuggagauggacgacgccgagaccggccugcugagcgccaucugccugaucugcggcgacagacaggaccuggagcagcccgacagaguggacaugcugcaggagccccugcuggaggcccugaagguguacgugagaaagagaagacccagcagaccccacauguuccccaagaugcugaugaagaucaccgaccugagaagcaucagcgccaagggcgccgagagagugaucacccugaagauggagauccccggcagcaugcccccccugauccaggagaugcuggagaacagcgagggccuggacacccugagcggccagcccggcggcggcggcagagacggcggcggccuggcccccccccccggcagcugcagccccagccugagccccagcagcaacagaagcagccccgccacccacagccccuaa

SEQ ID NO: 22425 - RNA, 1347 nt, Artificial Sequence
  RARB__Homo_sapiens__NP_000956
auguucgacugcauggacgugcugagcgugagccccggccagauccuggacuucuacaccgccagccccagcagcugcaugcugcaggagaaggcccugaaggccugcuucagcggccugacccagaccgaguggcagcacagacacaccgcccagagcaucgagacccagagcaccagcagcgaggagcuggugcccagcccccccagcccccugcccccccccagaguguacaagcccugcuucgugugccaggacaagagcagcggcuaccacuacggcgugagcgccugcgagggcugcaagggcuucuucagaagaagcauccagaagaacaugaucuacaccugccacagagacaagaacugcgugaucaacaaggugaccagaaacagaugccaguacugcagacugcagaagugcuucgaggugggcaugagcaaggagagcgugagaaacgacagaaacaagaagaagaaggagaccagcaagcaggagugcaccgagagcuacgagaugaccgccgagcuggacgaccugaccgagaagaucagaaaggcccaccaggagaccuuccccagccugugccagcugggcaaguacaccaccaacagcagcgccgaccacagagugagacuggaccugggccugugggacaaguucagcgagcuggccaccaagugcaucaucaagaucguggaguucgccaagagacugcccggcuucaccggccugaccaucgccgaccagaucacccugcugaaggccgccugccuggacauccugauccugagaaucugcaccagauacacccccgagcaggacaccaugaccuucagcgacggccugacccugaacagaacccagaugcacaacgccggcuucggcccccugaccgaccugguguucaccuucgccaaccagcugcugccccuggagauggacgacaccgagaccggccugcugagcgccaucugccugaucugcggcgacagacaggaccuggaggagcccaccaagguggacaagcugcaggagccccugcuggaggcccugaagaucuacaucagaaagagaagacccagcaagccccacauguuccccaagauccugaugaagaucaccgaccugagaagcaucagcgccaagggcgccgagagagugaucacccugaagauggagauccccggcagcaugcccccccugauccaggagaugcuggagaacagcgagggccacgagccccugacccccagcagcagcggcaacaccgccgagcacagccccagcaucagccccagcagcguggagaacagcggcgugagccagagcccccuggugcaguaa

SEQ ID NO: 22426 - RNA, 1332 nt, Artificial Sequence
  RARG__Homo_sapiens__NP_001036193
auguacgacugcauggagaccuucgcccccggccccagaagacuguacggcgccgccggccccggcgccggccugcugagaagagccaccggcggcagcugcuucgccggccuggagagcuucgccuggccccagcccgccagccugcagagcguggagacccagagcaccagcagcgaggagauggugcccagcagccccagccccccccccccccccagaguguacaagcccugcuucgugugcaacgacaagagcagcggcuaccacuacggcgugagcagcugcgagggcugcaagggcuucuucagaagaagcauccagaagaacaugguguacaccugccacagagacaagaacugcaucaucaacaaggugaccagaaacagaugccaguacugcagacugcagaagugcuucgaggugggcaugagcaaggaggccgugagaaacgacagaaacaagaagaagaaggaggugaaggaggagggcagccccgacagcuacgagcugagcccccagcuggaggagcugaucaccaaggugagcaaggcccaccaggagaccuuccccagccugugccagcugggcaaguacaccaccaacagcagcgccgaccacagagugcagcuggaccugggccugugggacaaguucagcgagcuggccaccaagugcaucaucaagaucguggaguucgccaagagacugcccggcuucaccggccugagcaucgccgaccagaucacccugcugaaggccgccugccuggacauccugaugcugagaaucugcaccagauacacccccgagcaggacaccaugaccuucagcgacggccugacccugaacagaacccagaugcacaacgccggcuucggcccccugaccgaccugguguucgccuucgccggccagcugcugccccuggagauggacgacaccgagaccggccugcugagcgccaucugccugaucugcggcgacagaauggaccuggaggagcccgagaagguggacaagcugcaggagccccugcuggaggcccugagacuguacgccagaagaagaagacccagccagcccuacauguuccccagaaugcugaugaagaucaccgaccugagaggcaucagcaccaagggcgccgagagagccaucacccugaagauggagauccccggccccaugcccccccugaucagagagaugcuggagaaccccgagauguucgaggacgacagcagccagcccggcccccaccccaacgccagcagcgaggacgaggugcccggcggccagggcaagggcggccugaagagccccgccuaa

SEQ ID NO: 22427 - RNA, 687 nt, Artificial Sequence
  RARRES1__Homo_sapiens__NP_002879
augcagcccagaagacagagacugcccgcccccuggagcggccccagaggccccagacccaccgccccccugcuggcccugcugcugcugcuggcccccguggccgcccccgccggcagcggcgaccccgacgaccccggccagccccaggacgccggcgugcccagaagacugcugcagcaggccgccagagccgcccugcacuucuucaacuucagaagcggcagccccagcgcccugagagugcuggccgaggugcaggagggcagagccuggaucaaccccaaggagggcugcaaggugcacgugguguucagcaccgagagauacaaccccgagagccugcugcaggagggcgagggcagacugggcaagugcagcgccagaguguucuucaagaaccagaagcccagacccaccaucaacgugaccugcaccagacugaucgagaagaagaagagacagcaggaggacuaccugcuguacaagcagaugaagcagcugaagaacccccuggagaucgugagcauccccgacaaccacggccacaucgaccccagccugagacugaucugggaccuggccuuccugggcagcagcuacgugaugugggagaugaccacccaggugagccacuacuaccuggcccagcugaccagcgugagacagugggugagaaagaccuaa

SEQ ID NO: 22428 - RNA, 492 nt, Artificial Sequence
  RARRES2__Homo_sapiens__NP_002880
augagaagacugcugaucccccuggcccuguggcugggcgccgugggcgugggcguggccgagcugaccgaggcccagagaagaggccugcagguggcccuggaggaguuccacaagcacccccccgugcagugggccuuccaggagaccagcguggagagcgccguggacacccccuuccccgccggcaucuucgugagacuggaguucaagcugcagcagaccagcugcagaaagagagacuggaagaagcccgagugcaaggugagacccaacggcagaaagagaaagugccuggccugcaucaagcugggcagcgaggacaaggugcugggcagacuggugcacugccccaucgagacccaggugcugagagaggccgaggagcaccaggagacccagugccugagagugcagagagccggcgaggacccccacagcuucuacuuccccggccaguucgccuucagcaaggcccugcccagaagcuaa

SEQ ID NO: 22429 - RNA, 495 nt, Artificial Sequence
  RARRES3__Homo_sapiens__NP_004576
auggccagcccccaccaggagcccaagcccggcgaccugaucgagaucuucagacugggcuacgagcacugggcccuguacaucggcgacggcuacgugauccaccuggccccccccagcgaguaccccggcgccggcagcagcagcguguucagcgugcugagcaacagcgccgaggugaagagagagagacuggaggacguggugggcggcugcugcuacagagugaacaacagccuggaccacgaguaccagcccagacccguggaggugaucaucagcagcgccaaggagauggugggccagaagaugaaguacagcaucgugagcagaaacugcgagcacuucgugacccagcugagauacggcaagagcagaugcaagcagguggagaaggccaagguggaggugggcguggccaccgcccugggcauccuggugguggccggcugcagcuucgccaucagaagauaccagaagaaggccaccgccuaa

SEQ ID NO: 22430 - RNA, 1737 nt, Artificial Sequence
  RARS2__Homo_sapiens__NP_064716
auggccugcggcuucagaagagccaucgccugccagcugagcagagugcugaaccugccccccgagaaccugaucaccagcaucagcgccgugcccaucagccagaaggaggagguggccgacuuccagcugagcguggacagccugcuggagaaggacaacgaccacagcagacccgacauccaggugcaggccaagagacuggccgagaagcugagaugcgacaccguggugagcgagaucagcaccggccagagaaccgugaacuucaagaucaacagagagcugcugaccaagaccgugcugcagcaggugaucgaggacggcagcaaguacggccugaagagcgagcuguucagcggccugccccagaagaagaucgugguggaguucagcagccccaacguggccaagaaguuccacgugggccaccugagaagcaccaucaucggcaacuucaucgccaaccugaaggaggcccugggccaccaggugaucagaaucaacuaccugggcgacuggggcaugcaguucggccugcugggcaccggcuuccagcuguucggcuacgaggagaagcugcagagcaacccccugcagcaccuguucgagguguacgugcaggugaacaaggaggccgccgacgacaagagcguggccaaggccgcccaggaguucuuccagagacuggagcugggcgacgugcaggcccugagccuguggcagaaguucagagaccugagcaucgaggaguacaucagaguguacaagagacugggcguguacuucgacgaguacagcggcgagagcuucuacagagagaagagccaggaggugcugaagcugcuggagagcaagggccugcugcugaagaccaucaagggcaccgccgugguggaccugagcggcaacggcgaccccagcagcaucugcaccgugaugagaagcgacggcaccagccuguacgccaccagagaccuggccgccgccaucgacagaauggacaaguacaacuucgacaccaugaucuacgugaccgacaagggccagaagaagcacuuccagcagguguuccagaugcugaagaucaugggcuacgacugggccgagagaugccagcacgugcccuucggcguggugcagggcaugaagaccagaagaggcgacgugaccuuccuggaggacgugcugaacgagauccagcugagaaugcugcagaacauggccagcaucaagaccaccaaggagcugaagaacccccaggagaccgccgagagagugggccuggccgcccugaucauccaggacuucaagggccugcugcugagcgacuacaaguucagcugggacagaguguuccagagcagaggcgacaccggcguguuccugcaguacacccacgccagacugcacagccuggaggagaccuucggcugcggcuaccugaacgacuucaacaccgccugccugcaggagccccagagcgugagcauccugcagcaccugcugagauucgacgaggugcuguacaagagcagccaggacuuccagcccagacacaucgugagcuaccugcugacccugagccaccuggccgccguggcccacaagacccugcagaucaaggacagcccccccgagguggccggcgccagacugcaccuguucaaggccgugagaagcgugcuggccaacggcaugaagcugcugggcaucacccccgugugcagaauguaa

SEQ ID NO: 22431 - RNA, 1983 nt, Artificial Sequence
  RARS__Homo_sapiens__NP_002878
auggacgugcuggugagcgagugcagcgccagacugcugcagcaggaggaggagaucaagagccugaccgccgagaucgacagacugaagaacugcggcugccugggcgccagccccaaccuggagcagcugcaggaggagaaccugaagcugaaguacagacugaacauccugagaaagagccugcaggccgagagaaacaagcccaccaagaacaugaucaacaucaucagcagacugcaggagguguucggccacgccaucaaggccgccuaccccgaccuggagaaccccccccugcuggugacccccagccagcaggccaaguucggcgacuaccagugcaacagcgccaugggcaucagccagaugcugaagaccaaggagcagaaggugaaccccagagagaucgccgagaacaucaccaagcaccugcccgacaacgagugcaucgagaagguggagaucgccggccccggcuucaucaacgugcaccugagaaaggacuucgugagcgagcagcugaccagccugcuggugaacggcgugcagcugcccgcccugggcgagaacaagaaggugaucguggacuucagcagccccaacaucgccaaggagaugcacgugggccaccugagaagcaccaucaucggcgagagcaucagcagacuguucgaguucgccggcuacgacgugcugagacugaaccacgugggcgacuggggcacccaguucggcaugcugaucgcccaccugcaggacaaguuccccgacuaccugaccgugagcccccccaucggcgaccugcagguguucuacaaggagagcaagaagagauucgacaccgaggaggaguucaagaagagagccuaccagugcguggugcugcugcagggcaagaaccccgacaucaccaaggccuggaagcugaucugcgacgugagcagacaggagcugaacaagaucuacgacgcccuggacgugagccugaucgagagaggcgagagcuucuaccaggacagaaugaacgacaucgugaaggaguucgaggacagaggcuucgugcagguggacgacggcagaaagaucguguucgugcccggcugcagcaucccccugaccaucgugaagagcgacggcggcuacaccuacgacaccagcgaccuggccgccaucaagcagagacuguucgaggagaaggccgacaugaucaucuacgugguggacaacggccagagcgugcacuuccagaccaucuucgccgccgcccagaugaucggcugguacgaccccaaggugaccagaguguuccacgccggcuucggcguggugcugggcgaggacaagaagaaguucaagaccagaagcggcgagaccgugagacugauggaccugcugggcgagggccugaagagaagcauggacaagcugaaggagaaggagagagacaaggugcugaccgccgaggagcugaacgccgcccagaccagcguggccuacggcugcaucaaguacgccgaccugagccacaacagacugaacgacuacaucuucagcuucgacaagaugcuggacgacagaggcaacaccgccgccuaccugcuguacgccuucaccagaaucagaagcaucgccagacuggccaacaucgacgaggagaugcugcagaaggccgccagagagaccaagauccugcuggaccacgagaaggaguggaagcugggcagaugcauccugagauuccccgagauccugcagaagauccuggacgaccuguuccugcacacccugugcgacuacaucuacgagcuggccaccgccuucaccgaguucuacgacagcugcuacugcguggagaaggacagacagaccggcaagauccugaaggugaacauguggagaaugcugcugugcgaggccguggccgccgugauggccaagggcuucgacauccugggcaucaagcccgugcagagaauguaa

SEQ ID NO: 22432 - RNA, 3144 nt, Artificial Sequence
  RASA1__Homo_sapiens__NP_002881
augauggccgccgaggccggcagcgaggagggcggccccgugaccgccggcgccggcggcggcggcgccgccgccggcagcagcgccuaccccgccgugugcagagugaagauccccgccgcccugcccguggccgccgcccccuaccccggccugguggagaccggcguggccggcacccugggcggcggcgccgcccugggcagcgaguuccugggcgccggcagcguggccggcgcccugggcggcgccggccugaccggcggcggcaccgccgccggcguggccggcgccgccgccggcguggccggcgccgccguggccggccccagcggcgacauggcccugaccaagcugcccaccagccugcuggccgagacccugggccccggcggcggcuuccccccccugccccccccccccuaccugcccccccugggcgccggccugggcaccguggacgagggcgacagccuggacggccccgaguacgaggaggaggagguggccaucccccugaccgccccccccaccaaccagugguaccacggcaagcuggacagaaccaucgccgaggagagacugagacaggccggcaagagcggcagcuaccugaucagagagagcgacagaagacccggcagcuucgugcugagcuuccugagccagaugaacguggugaaccacuucagaaucaucgccaugugcggcgacuacuacaucggcggcagaagauucagcagccugagcgaccugaucggcuacuacagccacgugagcugccugcugaagggcgagaagcugcuguaccccguggccccccccgagcccguggaggacagaagaagagugagagccauccugcccuacaccaaggugcccgacaccgacgagaucagcuuccugaagggcgacauguucaucgugcacaacgagcuggaggacggcuggaugugggugaccaaccugagaaccgacgagcagggccugaucguggaggaccugguggaggaggugggcagagaggaggacccccacgagggcaagaucugguuccacggcaagaucagcaagcaggaggccuacaaccugcugaugaccgugggccaggugugcagcuuccuggugagacccagcgacaacacccccggcgacuacagccuguacuucagaaccaacgagaacauccagagauucaagaucugccccacccccaacaaccaguucaugaugggcggcagauacuacaacagcaucggcgacaucaucgaccacuacagaaaggagcagaucguggagggcuacuaccugaaggagcccgugcccaugcaggaccaggagcaggugcugaacgacaccguggacggcaaggagaucuacaacaccaucagaagaaagaccaaggacgccuucuacaagaacaucgugaagaagggcuaccugcugaagaagggcaagggcaagagauggaagaaccuguacuucauccuggagggcagcgacgcccagcugaucuacuucgagagcgagaagagagccaccaagcccaagggccugaucgaccugagcgugugcagcguguacguggugcacgacagccuguucggcagacccaacugcuuccagaucguggugcagcacuucagcgaggagcacuacaucuucuacuucgccggcgagacccccgagcaggccgaggacuggaugaagggccugcaggccuucugcaaccugagaaagagcagccccggcaccagcaacaagagacugagacaggugagcagccuggugcugcacaucgaggaggcccacaagcugcccgugaagcacuucaccaaccccuacugcaacaucuaccugaacagcgugcagguggccaagacccacgccagagagggccagaaccccguguggagcgaggaguucguguucgacgaccugccccccgacaucaacagauucgagaucacccugagcaacaagaccaagaagagcaaggaccccgacauccuguucaugagaugccagcugagcagacugcagaagggccacgccaccgacgagugguuccugcugagcagccacaucccccugaagggcaucgagcccggcagccugagagugagagccagauacagcauggagaagaucaugcccgaggaggaguacagcgaguucaaggagcugauccugcagaaggagcugcacgugguguacgcccugagccacgugugcggccaggacagaacccugcuggccagcauccugcugagaaucuuccugcacgagaagcuggagagccugcugcugugcacccugaacgacagagagaucagcauggaggacgaggccaccacccuguucagagccaccacccuggccagcacccugauggagcaguacaugaaggccaccgccacccaguucgugcaccacgcccugaaggacagcauccugaagaucauggagagcaagcagagcugcgagcugagccccagcaagcuggagaagaacgaggacgugaacaccaaccugacccaccugcugaacauccugagcgagcugguggagaagaucuucauggccagcgagauccugccccccacccugagauacaucuacggcugccugcagaagagcgugcagcacaaguggcccaccaacaccaccaugagaaccagaguggugagcggcuucguguuccugagacugaucugccccgccauccugaaccccagaauguucaacaucaucagcgacagccccagccccaucgccgccagaacccugauccugguggccaagagcgugcagaaccuggccaaccugguggaguucggcgccaaggagcccuacauggagggcgugaaccccuucaucaagagcaacaagcacagaaugaucauguuccuggacgagcugggcaacgugcccgagcugcccgacaccaccgagcacagcagaaccgaccugagcagagaccuggccgcccugcacgagaucugcguggcccacagcgacgagcugagaacccugagcaacgagagaggcgcccagcagcacgugcugaagaagcugcuggccaucaccgagcugcugcagcagaagcagaaccaguacaccaagaccaacgacgugagauaa

SEQ ID NO: 22433 - RNA, 2553 nt, Artificial Sequence
  RASA2__Homo_sapiens__NP_001290174
auggccgccgccgcccccgccgccgccgccgccagcagcgaggcccccgccgccagcgccaccgccgagcccgaggccggcgaccaggacagcagagaggugagagugcugcagagccugagaggcaagaucugcgaggccaagaaccugcugcccuaccugggcccccacaagaugagagacugcuucugcaccaucaaccuggaccaggaggagguguacagaacccaggugguggagaagagccugagccccuucuucagcgaggaguucuacuucgagauccccagaaccuuccaguaccugagcuucuacguguacgacaagaacgugcugcagagagaccugagaaucggcaagguggccaucaagaaggaggaccugugcaaccacagcggcaaggagaccugguucagccugcagcccguggacagcaacagcgaggugcagggcaaggugcaccuggagcugaagcugaacgagcugaucaccgagaacggcaccgugugccagcagcugguggugcacaucaaggccugccacggccugccccugaucaacggccagagcugcgaccccuacgccaccgugagccuggugggccccagcagaaacgaccagaagaagaccaaggugaagaagaagaccagcaacccccaguucaacgagaucuucuacuucgaggugaccagaagcagcagcuacaccagaaagagccaguuccagguggaggaggaggacaucgagaagcuggagaucagaaucgaccuguggaacaacggcaaccuggugcaggacguguuccugggcgagaucaaggugcccgugaacgugcugagaaccgacagcagccaccaggccugguaccugcugcagcccagagacaacggcaacaagagcagcaagaccgacgaccugggcagccugagacugaacaucugcuacaccgaggacuacgugcugcccagcgaguacuacggcccccugaagacccugcugcugaagagccccgacgugcagcccaucagcgccagcgccgccuacauccugagcgagaucugcagagacaagaacgacgccgugcugccccuggugagacugcugcugcaccacgacaagcuggugcccuucgccaccgccguggccgagcuggaccugaaggacacccaggacgccaacaccaucuucagaggcaacagccuggccaccagaugccuggacgagaugaugaagaucgugggcggccacuaccugaaggugacccugaagcccauccuggacgagaucugcgacagcagcaagagcugcgagaucgaccccaucaagcugaaggagggcgacaacguggagaacaacaaggagaaccugagauacuacguggacaagcuguucaacaccaucgugaagagcagcaugagcugccccaccgugaugugcgacaucuucuacagccugagacagauggccacccagagauuccccaacgacccccacgugcaguacagcgccgugagcagcuucguguuccugagauucuucgccguggccguggugagcccccacaccuuccaccugagaccccaccaccccgacgcccagaccaucagaacccugacccugaucagcaagaccauccagacccugggcagcuggggcagccugagcaagagcaagagcagcuucaaggagaccuucaugugcgaguucuucaagauguuccaggaggagggcuacaucaucgccgugaagaaguuccuggacgagaucagcagcaccgagaccaaggagagcagcggcaccagcgagcccgugcaccugaaggagggcgagauguacaagagagcccagggcagaaccagaaucggcaagaagaacuucaagaagagaugguucugccugaccagcagagagcugaccuaccacaagcagcccggcagcaaggacgccaucuacaccauccccgugaagaacauccuggccguggagaagcuggaggagagcagcuucaacaagaagaacauguuccaggugauccacaccgagaagccccuguacgugcaggccaacaacugcguggaggccaacgaguggaucgacgugcugugcagagugagcagaugcaaccagaacagacugagcuucuaccaccccagcguguaccugaacggcaacuggcugugcugccaggagaccggcgagaacacccugggcugcaagcccugcaccgccggcgugcccgccgacauccagaucgacaucgacgaggacagagagaccgagagaaucuacagccuguucacccugagccugcugaagcugcagaagauggaggaggccugcggcaccaucgccguguaccagggcccccagaaggagcccgacgacuacagcaacuucgugaucgaggacagcgugaccaccuucaagaccauccagcagaucaagagcaucaucgagaagcuggacgagccccacgagaaguacagaaagaagagaagcagcagcgccaaguacggcagcaaggagaaccccaucgugggcaaggccagcuaa

SEQ ID NO: 22434 - RNA, 2421 nt, Artificial Sequence
  RASAL1__Homo_sapiens__NP_001180449
auggccaagagcagcagccugaacgugagagugguggagggcagagcccugcccgccaaggacgugagcggcagcagcgaccccuacugccuggugaagguggacgacgaggugguggccagaaccgccaccguguggagaagccugggccccuucuggggcgaggaguacaccgugcaccugccccuggacuuccaccagcuggccuucuacgugcuggacgaggacaccgugggccacgacgacaucaucggcaagaucagccugagcagagaggccaucaccgccgaccccagaggcaucgacagcuggaucaaccugagcagaguggaccccgacgccgaggugcagggcgagaucugccugagcgugcagaugcuggaggacggccagggcagaugccugagaugccacgugcugcaggccagagaccuggcccccagagacaucagcggcaccagcgaccccuucgccagaguguucuggggcagccagagccuggagaccagcaccaucaagaagaccagauucccccacugggacgaggugcuggagcugagagagaugcccggcgcccccagcccccugagaguggagcugugggacugggacauggugggcaagaacgacuuccugggcaugguggaguucagccccaagacccugcagcagaagccccccaagggcugguucagacugcugcccuuccccagagccgaggaggacagcggcggcaaccugggcgcccugagagugaaggugagacugaucgaggacagagugcugcccagccagugcuaccagccccugauggagcugcugauggagagcgugcagggccccgccgaggaggacaccgccagcccccuggcccugcuggaggagcugacccugggcgacugcagacaggaccuggccaccaagcuggugaagcuguuccugggcagaggccuggccggcagauuccuggacuaccugaccagaagagagguggccagaaccauggaccccaacacccuguucagaagcaacagccuggccagcaagagcauggagcaguucaugaagcuggugggcaugcccuaccugcacgaggugcugaagcccgugaucagcagaguguucgaggagaagaaguacauggagcuggaccccugcaagauggaccugggcagaaccagaagaaucagcuucaagggcgcccugagcgaggagcagaugagagagaccagccugggccugcugaccggcuaccugggccccaucguggacgccaucgugggcagcgugggcagaugcccccccgccaugagacuggccuucaagcagcugcacagaagaguggaggagagauucccccaggccgagcaccagcaggacgugaaguaccuggccaucagcggcuuccuguuccugagauucuucgcccccgccauccugacccccaagcuguucgaccugagagaccagcacgccgacccccagaccagcagaagccugcugcugcuggccaaggccgugcagagcaucggcaaccugggccagcagcugggccagggcaaggagcuguggauggccccccugcaccccuuccugcugcagugcgugagcagagugagagacuuccuggacagacugguggacguggacggcgacgaggaggccggcgugcccgccagagcccuguucccccccagcgccaucgugagagagggcuaccugcugaagagaaaggaggagcccgccggccuggccaccagauucgccuucaagaagagauacguguggcugagcggcgagacccugagcuucagcaagagccccgaguggcagaugugccacagcauccccgugagccacaucagagccguggagagaguggacgagggcgccuuccagcugccccacgugaugcagguggugacccaggacggcaccggcgcccugcacaccaccuaccugcagugcaagaacgugaacgagcugaaccaguggcugagcgcccugagaaaggccagcgcccccaaccccaacaagcuggccgccugccaccccggcgccuucagaagcgccagauggaccugcugccugcaggccgagagaagcgccgccggcugcagcagaacccacagcgccgugacccugggcgacuggagcgacccccuggaccccgacgccgaggcccagaccguguacagacagcugcugcugggcagagaccagcugagacugaagcugcuggaggacagcaacauggacaccacccuggaggccgacaccggcgccugccccgaggugcuggccagacagagagccgccaccgccagacugcuggaggugcuggccgaccuggacagagcccacgaggaguuccagcagcaggagagaggcaaggccgcccugggcccccugggccccuaa

SEQ ID NO: 22435 - RNA, 3420 nt, Artificial Sequence
  RASAL2__Homo_sapiens__NP_004832
augcagacccccgaggugcccgccgagagaagccccagaagaagaagcaucagcggcaccagcaccagcgagaagcccaacagcauggacaccgccaacaccagccccuucaaggugcccggcuucuucagcaagagacugaagggcagcaucaagagaaccaagagccagagcaagcuggacagaaacaccagcuucagacugcccagccugagaagcaccgacgacagaagcagaggccugcccaagcugaaggagagcagaagccacgagagccugcugagccccugcagcaccguggagugccuggaccugggcagaggcgagcccgugagcgugaagccccugcacagcagcauccugggccaggacuucugcuucgaggugaccuaccugagcggcagcaagugcuucagcugcaacagcgccagcgagagagacaaguggauggagaaccugagaagaaccgugcagcccaacaaggacaacugcagaagagccgagaacgugcugagacuguggaucaucgaggccaaggaccuggcccccaagaagaaguacuucugcgagcugugccuggacgacacccuguucgccagaaccaccagcaagaccaaggccgacaacaucuucuggggcgagcacuucgaguucuucagccugcccccccugcacagcaucaccgugcacaucuacaaggacguggagaagaagaagaagaaggacaagaacaacuacgugggccuggugaacauccccaccgccagcgugaccggcagacaguucguggagaagugguaccccgugagcacccccacccccaacaagggcaagaccggcggccccagcaucagaaucaagagcagauuccagaccaucaccauccugcccauggagcaguacaaggaguucgccgaguucgugaccagcaacuacaccaugcugugcagcgugcuggagcccgugaucagcgugagaaacaaggaggagcuggccugcgcccuggugcacauccugcagagcaccggcagagccaaggacuuccugaccgaccuggugaugagcgagguggacagaugcggcgagcacgacgugcugaucuucagagagaacaccaucgccaccaagagcaucgaggaguaccugaagcuggugggccagcaguaccugcacgacgcccugggcgaguucaucaaggcccuguacgagagcgacgagaacugcgagguggaccccagcaagugcagcagcagcgagcugaucgaccaccagagcaaccugaagaugugcugcgagcuggccuucugcaagaucaucaacagcuacugcguguuccccagagagcugaaggagguguucgccagcuggaagcagcagugccugaacagaggcaagcaggacaucagcgagagacugaucagcgccagccuguuccugagauuccugugccccgccaucaugagccccagccuguucaaccugaugcaggaguaccccgacgacagaaccagcagaacccugacccugaucgccaaggugauccagaaccuggccaacuucgccaaguucggcaacaaggaggaguacauggccuucaugaacgacuuccuggagcacgaguggggcggcaugaagagauuccugcuggagaucagcaaccccgacaccaucagcaacacccccggcuucgacggcuacaucgaccugggcagagagcugagcgugcugcacagccugcugugggagguggugagccagcuggacaagggcgagaacagcuuccugcaggccaccguggccaagcugggcccccugcccagagugcuggccgacaucaccaagagccugaccaaccccacccccauccagcagcagcugagaagauucaccgagcacaacagcagccccaacgugagcggcagccugagcagcggccugcagaagaucuucgaggaccccaccgacagcgaccugcacaagcugaagagccccagccaggacaacaccgacagcuacuucagaggcaagacccugcugcuggugcagcaggccagcagccagagcaugaccuacagcgagaaggacgagagagagagcagccugcccaacggcagaagcgugagccugauggaccugcaggacacccacgccgcccagguggagcacgccagcgugaugcuggacgugcccaucagacugaccggcagccagcugagcaucacccagguggccagcaucaagcagcugagagagacccagagcaccccccagagcgccccccaggugagaagaccccugcaccccgcccugaaccagcccggcggccugcagccccugagcuuccagaaccccguguaccaccugaacaaccccauccccgccaugcccaaggccagcaucgacagcagccuggagaaccugagcaccgccagcagcagaagccagagcaacagcgaggacuucaagcugagcggccccagcaacagcagcauggaggacuucaccaagagaagcacccagagcgaggacuucagcagaagacacaccgugcccgacagacacaucccccuggcccugcccagacagaacagcaccggccaggcccagaucagaaagguggaccagggcggccugggcgccagagccaaggccccccccagccugccccacagcgccagccugagaagcaccggcagcaugagcguggugagcgccgcccugguggccgagcccgugcagaacggcagcagaagcagacagcagagcagcagcagcagagagagccccgugcccaaggugagagccauccagagacagcagacccagcaggugcagagccccguggacagcgccaccaugagccccguggagagaaccgccgccugggugcugaacaacggccaguacgaggaggacguggaggagaccgagcagaaccuggacgaggccaagcacgccgagaaguacgagcaggagaucaccaagcugaaggagagacugagagugagcagcagaagacuggaggaguacgagagaagacugcuggugcaggagcagcagaugcagaagcugcugcuggaguacaaggccagacuggaggacagcgaggagagacugagaagacagcaggaggagaaggacagccagaugaagagcaucaucagcagacugauggccguggaggaggagcugaagaaggaccacgccgagaugcaggccgugaucgacgccaagcagaagaucaucgacgcccaggagaagagaaucgugagccuggacagcgccaacaccagacugaugagcgcccugacccaggugaaggagagauacagcaugcaggugagaaacggcaucagccccaccaaccccaccaagcugagcaucaccgagaacggcgaguucaagaacagcagcugcuaa

SEQ ID NO: 22436 - RNA, 369 nt, Artificial Sequence
  RASD1__Homo_sapiens__NP_001186918
augaagcuggccgccaugaucaagaagaugugccccagcgacagcgagcugagcauccccgccaagaacugcuacagaauggugauccugggcagcagcaaggugggcaagaccgccaucgugagcagauuccugaccggcagauucgaggacgccuacacccccaccaucgaggacuuccacagaaaguucuacagcaucagaggcgagguguaccagcuggacauccuggacaccagcggcaaccaccccuuccccgccaugagaagacugagcauccugaccgaccccagacaccaggugcugccccaggagcagaaccagggcgagagaggcagagcccccggccaccugagacagcagggcuaa

SEQ ID NO: 22437 - RNA, 801 nt, Artificial Sequence
  RASD2__Homo_sapiens__NP_055125
augaugaagacccugagcagcggcaacugcacccugagcgugcccgccaagaacagcuacagaaugguggugcugggcgccagcagagugggcaagagcagcaucgugagcagauuccugaacggcagauucgaggaccaguacacccccaccaucgaggacuuccacagaaagguguacaacaucagaggcgacauguaccagcuggacauccuggacaccagcggcaaccaccccuuccccgccaugagaagacugagcauccugaccggcgacguguucauccugguguucagccuggacaacagagagagcuucgacgaggugaagagacugcagaagcagauccuggaggugaagagcugccugaagaacaagaccaaggaggccgccgagcugcccauggugaucugcggcaacaagaacgaccacggcgagcugugcagacaggugcccaccaccgaggccgagcugcuggugagcggcgacgagaacugcgccuacuucgaggugagcgccaagaagaacaccaacguggacgagauguucuacgugcuguucagcauggccaagcugccccacgagaugagccccgcccugcacagaaagaucagcgugcaguacggcgacgccuuccaccccagacccuucugcaugagaagagugaaggagauggacgccuacggcauggugagccccuucgccagaagacccagcgugaacagcgaccugaaguacaucaaggccaaggugcugagagagggccaggccagagagagagacaagugcaccauccaguaa

SEQ ID NO: 22438 - RNA, 2223 nt, Artificial Sequence
  RASEF__Homo_sapiens__NP_689786
auggaggccgacggcgacggcgaggagcuggccagacugagaagcguguucgccgccugcgacgccaacagaagcggcagacuggagagagaggaguucagagcccugugcaccgagcugagagugagacccgccgacgccgaggccguguuccagagacuggacgccgacagagacggcgccaucaccuuccaggaguucgccagaggcuuccugggcagccugagaggcggcagaagaagagacuggggcccccuggaccccgcccccgccgugagcgaggccggccccgagacccacgacagcgaggaggacgagggcgacgaggacgccgccgccgcccuggccaccagcugcggccccgccagccccggcagagccuggcaggacuuccaggccagacugggcgacgaggccaaguucauccccagagaggagcaggugagcacccuguaccagaacaucaaccugguggagcccagacugauccagcccuacgagcacgugaucaagaacuucaucagagagaucagacugcagagcaccgagauggagaaccuggccaucgccgugaagagagcccaggacaaggccgccaugcagcugagcgagcuggaggaggagauggaccagagaauccaggccgccgagcacaagaccagaaaggacgagaagagaaaggccgaggaggcccugagcgaccugagaagacaguacgagaccgaggugggcgaccugcaggugaccaucaagaagcugagaaagcuggaggagcagagcaagagagugagccagaaggaggacguggccgcccugaagaagcagaucuacgaccugagcauggagaaccagaaggugaagaaggaccugcuggaggcccagaccaacaucgccuuccugcagagcgagcuggacgcccugaagagcgacuacgccgaccagagccugaacaccgagagagaccuggagaucaucagagccuacaccgaggacagaaacagccuggagagacagaucgagauccugcagaccgccaacagaaagcugcacgacagcaacgacggccugagaagcgcccuggagaacagcuacagcaaguucaacagaagccugcacaucaacaacaucagccccggcaacaccaucagcagaagcagccccaaguucaucggccacagcccccagccccugggcuacgacagaagcagcagaagcagcuacguggacgaggacugcgacagccuggcccugugcgacccccugcagagaaccaacugcgagguggacagccugcccgagagcugcuucgacagcggccugagcacccugagagaccccaacgaguacgacagcgagguggaguacaagcaccagagaggcuuccagagaagccacggcgugcaggagagcuucggcggcgacgccagcgacaccgacgugcccgacaucagagacgaggagaccuucggccuggaggacguggccagcgugcuggacuggaagccccagggcagcgugagcgagggcagcaucgugagcagcagcagaaagcccaucagcgcccugagcccccagaccgaccugguggacgacaacgccaagagcuucagcagccagaaggccuacaagaucgugcuggccggcgacgccgccgugggcaagagcagcuuccugaugagacugugcaagaacgaguucagagagaacaucagcgccacccugggcguggacuuccagaugaagacccugaucguggacggcgagagaaccgugcugcagcugugggacaccgccggccaggagagauucagaagcaucgccaagagcuacuucagaaaggccgacggcgugcugcugcuguacgacgugaccugcgagaagagcuuccugaacaucagagaguggguggacaugaucgaggacgccgcccacgagaccgugcccaucaugcuggugggcaacaaggccgacaucagagacaccgccgccaccgagggccagaagugcgugcccggccacuucggcgagaagcuggccaugaccuacggcgcccuguucugcgagaccagcgccaaggacggcagcaacaucguggaggccgugcugcaccuggccagagaggugaagaagagaaccgacaaggacgacagcagaagcaucaccaaccugaccggcaccaacagcaagaagagcccccagaugaagaacugcugcaacggcuaa

SEQ ID NO: 22439 - RNA, 1470 nt, Artificial Sequence
  RASGEF1A__Homo_sapiens__NP_001269791
auguuccuggagccccaggagaccaugccccagaccagcgugguguucagcagcauccugggccccagcugcagcggccaggugcagcccggcaugggcgagagaggcggcggcgccggcggcggcagcggcgaccugaucuuccaggacggccaccugaucagcggcagccuggaggcccugauggagcaccuggugcccaccguggacuacuaccccgacagaaccuacaucuucaccuuccugcugagcagcagaguguucaugcccccccacgaccugcuggccagagugggccagaucugcguggagcagaagcagcagcuggaggccggccccgagaaggccaagcugaagagcuucagcgccaagaucgugcagcugcugaaggaguggaccgaggccuuccccuacgacuuccaggacgagaaggccauggccgagcugaaggccaucacccacagagugacccagugcgacgaggagaacggcaccgugaagaaggccaucgcccagaugacccagagccugcugcugagccuggccgccagaagccagcugcaggagcugagagagaagcugagaccccccgccguggacaagggccccauccugaagaccaagccccccgccgcccagaaggacauccugggcgugugcugcgacccccuggugcuggcccagcagcugacccacaucgagcuggacagagugagcagcaucuaccccgaggaccugaugcagaucgugagccacauggacagccuggacaaccacagaugcagaggcgaccugaccaagaccuacagccuggaggccuacgacaacugguucaacugccugagcaugcugguggccaccgaggugugcagaguggugaagaagaagcacagaaccagaaugcuggaguucuucaucgacguggccagagagugcuucaacaucggcaacuucaacagcaugauggccaucaucagcggcaugaaccugagccccguggccagacugaagaagaccuggagcaaggugaagaccgccaaguucgacgugcuggagcaccacauggaccccagcagcaacuucugcaacuacagaaccgcccugcagggcgccacccagagaagccagauggccaacagcagcagagagaagaucgugauccccguguucaaccuguucgugaaggacaucuacuuccugcacaagauccacaccaaccaccugcccaacggccacaucaacuucaagaaguucugggagaucagcagacagauccacgaguucaugaccuggacccagguggagugccccuucgagaaggacaagaagauccagagcuaccugcugaccgcccccaucuacagcgaggaggcccuguucguggccagcuucgagagcgagggccccgagaaccacauggagaaggacagcuggaagacccugagaaccacccugcugaacagagccuaa

SEQ ID NO: 22440 - RNA, 1401 nt, Artificial Sequence
  RASGEF1C__Homo_sapiens__NP_778232
augccccagacccugagcgccagcgacauggugacccccggcagccugagccccccccccaccgagcccaccgacggcgagcaggccggccagccccugcuggacggcgcccccagcagcgccagccuggagacccugauccagcaccuggugcccaccgccgacuacuaccccgagaaggccuacaucuucaccuuccugcugagcagcagacuguucaucgagcccagagagcugcuggccagagugugccaccugugcaucgagcagcagcagcuggacaagcccgugcuggacaaggccagagugagaaaguucggccccaagcugcugcagcugcuggccgaguggaccgagaccuuccccagagacuuccaggaggagagcaccaucggccaccugaaggacguggugggcagaaucgcccccugcgacgaggccuacagaaagagaaugcaccagcugcugcaggcccugcaccagaagcuggccgcccugagacagggccccgagggccuggugggcgccgacaagcccaucagcuacagaaccaagccccccgccagcauccacagagagcugcugggcgugugcagcgaccccuacacccuggcccagcagcugacccacguggagcuggagagacugagacacaucggccccgaggaguucgugcaggccuucgugaacaaggacccccuggccagcaccaagcccugcuucagcgacaagaccagcaaccuggaggccuacgugaagugguucaacagacugugcuaccugguggccaccgagaucugcaugcccgccaagaagaagcagagagcccaggugaucgaguucuucaucgacguggccagagagugcuucaacaucggcaacuucaacagccugauggccaucaucagcggcaugaacaugagccccgugagcagacugaagaagaccugggccaaggugagaaccgccaaguucuucauccuggagcaccagauggaccccaccggcaacuucugcaacuacagaaccgcccugagaggcgccgcccacagaagccugaccgcccacagcagcagagagaagaucgugauccccuucuucagccugcugaucaaggacaucuacuuccugaacgagggcugcgccaacagacugcccaacggccacgugaacuucgagaaguuccuggagcuggccaagcaggugggcgaguucaucaccuggaagcagguggagugccccuucgagcaggacgccagcaucacccacuaccuguacaccgcccccaucuucagcgaggacggccuguaccuggccagcuacgagagcgagagccccgagaaccagaccgagaaggagagauggaaggcccugagaagcagcauccugggcaagaccuaa

SEQ ID NO: 22441 - RNA, 3774 nt, Artificial Sequence
  RASGRF1__Homo_sapiens__NP_001139120
augcagaagggcaucagacugaacgacggccacguggccagccugggccugcuggccagaaaggacggcaccagaaagggcuaccugagcaagagaagcagcgacaacaccaaguggcagaccaagugguucgcccugcugcagaaccugcuguucuacuucgagagcgacagcagcagcagacccagcggccuguaccugcuggagggcugcgugugcgacagagcccccagccccaagcccgcccugagcgccaaggagccccuggagaagcagcacuacuucaccgugaacuucagccacgagaaccagaaggcccuggagcugagaaccgaggacgccaaggacugcgacgaguggguggccgccaucgcccacgccagcuacagaacccuggccaccgagcacgaggcccugaugcagaaguaccugcaccugcugcagaucguggagaccgagaagaccguggccaagcagcugagacagcagaucgaggacggcgagaucgagaucgagagacugaaggccgagaucaccagccugcugaaggacaacgagagaauccagagcacccagaccguggcccccaacgacgaggacagcgacaucaagaagaucaagaaggugcagagcuuccugagaggcuggcugugcagaagaaaguggaagaccaucauccaggacuacaucagaagcccccacgccgacagcaugagaaagagaaaccaggugguguucagcaugcuggaggccgaggccgaguacgugcagcagcugcacauccuggugaacaacuuccugagaccccugagaauggccgccagcagcaagaagccccccaucacccacgacgacgugagcagcaucuuccugaacagcgagaccaucauguuccugcaccagaucuucuaccagggccugaaggccagaaucagcagcuggcccacccuggugcuggccgaccuguucgacauccugcugcccaugcugaacaucuaccaggaguucgugagaaaccaccaguacagccugcagauccuggcccacugcaagcagaacagagacuucgacaagcugcugaagcacuacgaggccaagcccgacugcgaggagagaacccuggagaccuuccugaccuaccccauguuccagauccccagauacauccugacccugcacgagcugcuggcccacaccccccacgagcacguggagagaaacagccuggacuacgccaagagcaagcuggaggagcugagcagaaucaugcacgacgaggugagcgagaccgagaacaucagaaagaaccuggccaucgagagaaugaucaucgagggcugcgagauccugcuggacaccagccagaccuucgugagacagggcagccugauccaggugcccaugagcgagaagggcaagaucaccagaggcagacugggcagccugagccugaagaaggagggcgagagacagugcuuccuguucagcaagcaccugaucaucugcaccagaggcagcggcggcaagcugcaccugaccaagaacggcgugaucagccugaucgacugcacccugcuggaggagcccgagagcaccgaggaggaggccaagggcagcggccaggacaucgaccaccuggacuucaagaucggcguggagcccaaggacagcccccccuucaccgugauccugguggccagcagcagacaggagaaggccgccuggaccagcgacaucagccagugcguggacaacaucagaugcaacggccugaugaugaacgccuucgaggagaacagcaaggugaccgugccccagaugaucaagagcgacgccagccuguacugcgacgacguggacaucagauucagcaagaccaugaacagcugcaaggugcugcagaucagauacgccagcguggagagacugcuggagagacugaccgaccugagauuccugagcaucgacuuccugaacaccuuccugcacagcuacagaguguucaccaccgccaucguggugcuggacaagcugaucaccaucuacaagaagcccaucagcgccauccccgccagaagccuggagcugcuguucgccagcggccagaacaacaagcugcuguacggcgagccccccaagagccccagagccaccagaaaguucagcagcccccccccccugagcaucaccaagaccagcagccccagcagaagaagaaagcugagccugaacauccccaucaucaccggcggcaaggcccuggaccuggccgcccugagcugcaacagcaacggcuacaccagcauguacagcgccaugagccccuucagcaaggccacccuggacaccagcaagcuguacgugagcagcagcuucaccaacaagauccccgacgagggcgacaccacccccgagaagcccgaggaccccagcgcccugagcaagcagagcagcgaggugagcaugagagaggagagcgacaucgaccagaaccagagcgacgacggcgacaccgagaccagccccaccaagagccccaccacccccaagagcgugaagaacaagaacagcagcgaguucccccuguucagcuacaacaacggcguggugaugaccagcugcagagagcuggacaacaacagaagcgcccugagcgccgccagcgccuucgccaucgccaccgccggcgccaacgagggcacccccaacaaggagaaguacagaagaaugagccuggccagcgccggcuucccccccgaccagagaaacggcgacaaggaguucgugaucagaagagccgccaccaacagagugcugaacgugcugagacacugggugagcaagcacagccaggacuucgagaccaacgacgagcugaagugcaaggugaucggcuuccuggaggaggugaugcacgaccccgagcugcugacccaggagagaaaggccgccgccaacaucaucagaacccugacccaggaggaccccggcgacaaccagaucacccuggaggagaucacccagauggccgagggcgugaaggccgagcccuucgagaaccacagcgcccuggagaucgccgagcagcugacccugcuggaccaccugguguucaagaagauccccuacgaggaguucuucggccagggcuggaugaagcuggagaagaacgagagaacccccuacaucaugaagaccaccaagcacuucaacgacaucagcaaccugaucgccagcgagaucaucagaaacgaggacaucaacgccagagugagcgccaucgagaaguggguggccguggccgacaucugcagaugccugcacaacuacaacgccgugcuggagaucaccagcagcaugaacagaagcgccaucuucagacugaagaagaccuggcugaaggugagcaagcagaccaaggcccugaucgacaagcugcagaagcuggugagcagcgagggcagauucaagaaccugagagaggcccugaagaacugcgacccccccugcgugcccuaccugggcauguaccugaccgaccuggccuucaucgaggagggcacccccaacuacaccgaggacggccuggugaacuucagcaagaugagaaugaucagccacaucaucagagagaucagacaguuccagcagaccgccuacaagaucgagcaccaggccaaggugacccaguaccugcuggaccagagcuucgugauggacgaggagagccuguacgagagcagccugagaaucgagcccaagcugcccaccuaa

SEQ ID NO: 22442 - RNA, 3714 nt, Artificial Sequence
  RASGRF2__Homo_sapiens__NP_008840
augcagaagagcgugagauacaacgagggccacgcccuguaccuggccuuccuggccagaaaggagggcaccaagagaggcuuccugagcaagaagaccgccgaggccagcagauggcacgagaagugguucgcccuguaccagaacgugcuguucuacuucgagggcgagcagagcugcagacccgccggcauguaccugcuggagggcugcagcugcgagagaacccccgccccccccagagccggcgccggccagggcggcgugagagacgcccuggacaagcaguacuacuucaccgugcuguucggccacgagggccagaagccccuggagcugagaugcgaggaggagcaggacggcaaggaguggauggaggccauccaccaggccagcuacgccgacauccugaucgagagagaggugcugaugcagaaguacauccaccuggugcagaucguggagaccgagaagaucgccgccaaccagcugagacaccagcuggaggaccaggacaccgagaucgagagacugaagagcgagaucaucgcccugaacaagaccaaggagagaaugagacccuaccagagcaaccaggaggacgaggaccccgacaucaagaagaucaagaaggugcagagcuucaugagaggcuggcugugcagaagaaaguggaagaccaucgugcaggacuacaucugcagcccccacgccgagagcaugagaaagagaaaccagaucguguucaccaugguggaggccgagagcgaguacgugcaccagcuguacauccuggugaacggcuuccugagaccccugagaauggccgccagcagcaagaagccccccaucagccacgacgacgugagcagcaucuuccugaacagcgagaccaucauguuccugcacgagaucuuccaccagggccugaaggccagaaucgccaacuggcccacccugauccuggccgaccuguucgacauccugcugcccaugcugaacaucuaccaggaguucgugagaaaccaccaguacagccugcaggugcuggccaacugcaagcagaacagagacuucgacaagcugcugaagcaguacgaggccaaccccgccugcgagggcagaaugcuggagaccuuccugaccuaccccauguuccagauccccagauacaucaucacccugcacgagcugcuggcccacaccccccacgagcacguggagagaaagagccuggaguucgccaagagcaagcuggaggagcugagcagagugaugcacgacgaggugagcgacaccgagaacaucagaaagaaccuggccaucgagagaaugaucguggagggcugcgacauccugcuggacaccagccagaccuucaucagacagggcagccugauccaggugcccagcguggagagaggcaagcugagcaaggugagacugggcagccugagccugaagaaggagggcgagagacagugcuuccuguucaccaagcacuuccugaucugcaccagaagcagcggcggcaagcugcaccugcugaagaccggcggcgugcugagccugaucgacugcacccugaucgaggagcccgacgccagcgacgacgacagcaagggcagcggccagguguucggccaccuggacuucaagaucgugguggagccccccgacgccgccgccuucaccguggugcugcuggcccccagcagacaggagaaggccgccuggaugagcgacaucagccagugcguggacaacaucagaugcaacggccugaugaccaucguguucgaggagaacagcaaggugaccgugccccacaugaucaagagcgacgccagacugcacaaggacgacaccgacaucugcuucagcaagacccugaacagcugcaaggugccccagaucagauacgccagcguggagagacugcuggagagacugaccgaccugagauuccugagcaucgacuuccugaacaccuuccugcacaccuacagaaucuucaccaccgccgccguggugcugggcaagcugagcgacaucuacaagagacccuucaccagcauccccgugagaagccuggagcuguucuucgccaccagccagaacaacagaggcgagcaccugguggacggcaagagccccagacugugcagaaaguucagcagcccccccccccuggccgugagcagaaccagcagccccgugagagccagaaagcugagccugaccagcccccugaacagcaagaucggcgcccuggaccugaccaccagcagcagccccaccaccaccacccagagccccgccgccagcccccccccccacaccggccagaucccccuggaccugagcagaggccugagcagccccgagcagagccccggcaccguggaggagaacguggacaaccccagaguggaccugugcaacaagcugaagagaagcauccagaaggccgugcuggagagcgcccccgccgacagagccggcguggagagcagccccgccgccgacaccaccgagcugagccccugcagaagccccagcacccccagacaccugagauacagacagcccggcggccagaccgccgacaacgcccacugcagcgugagccccgccagcgccuucgccaucgccaccgccgccgccggccacggcagcccccccggcuucaacaacaccgagagaaccugcgacaaggaguucaucaucagaagaaccgccaccaacagagugcugaacgugcugagacacugggugagcaagcacgcccaggacuucgagcugaacaacgagcugaagaugaacgugcugaaccugcuggaggaggugcugagagaccccgaccugcugccccaggagagaaaggccgccgccaacauccugagagcccugagccaggacgaccaggacgacauccaccugaagcuggaggacaucauccagaugaccgacugcaugaaggccgagugcuucgagagccugagcgccauggagcuggccgagcagaucacccugcuggaccacgugaucuucagaagcauccccuacgaggaguuccugggccagggcuggaugaagcuggacaagaacgagagaacccccuacaucaugaagaccagccagcacuucaacgacaugagcaaccugguggccagccagaucaugaacuacgccgacgugagcagcagagccaacgccaucgagaaguggguggccguggccgacaucugcagaugccugcacaacuacaacggcgugcuggagaucaccagcgcccugaacagaagcgccaucuacagacugaagaagaccugggccaaggugagcaagcagaccaaggcccugauggacaagcugcagaagaccgugagcagcgagggcagauucaagaaccugagagagacccugaagaacugcaacccccccgccgugcccuaccugggcauguaccugaccgaccuggccuucaucgaggagggcacccccaacuucaccgaggagggccuggugaacuucagcaagaugagaaugaucagccacaucaucagagagaucagacaguuccagcagaccagcuacagaaucgaccaccagcccaagguggcccaguaccugcuggacaaggaccugaucaucgacgaggacacccuguacgagcugagccugaagaucgagcccagacugcccgccuaa

SEQ ID NO: 22443 - RNA, 2289 nt, Artificial Sequence
  RASGRP1__Homo_sapiens__NP_001122074
augggcacccugggcaaggccagagaggcccccagaaagcccagccacggcugcagagccgccagcaaggccagacuggaggccaagcccgccaacagccccuuccccagccaccccagccuggcccacaucacccaguucagaaugauggugagccugggccaccuggccaagggcgccagccuggacgaccugaucgacagcugcauccagagcuucgacgccgacggcaaccugugcagaagcaaccagcugcugcaggugaugcugaccaugcacagaaucgugaucagcagcgccgagcugcugcagaaggugaucacccuguacaaggacgcccuggccaagaacagccccggccugugccugaagaucugcuacuucgugagauacuggaucaccgaguucugggugauguucaagauggacgccagccugaccgacaccauggaggaguuccaggagcuggugaaggccaagggcgaggagcugcacugcagacugaucgacaccacccagaucaacgccagagacuggagcagaaagcugacccagagaaucaagagcaacaccagcaagaagagaaaggugagccugcuguucgaccaccuggagcccgaggagcugagcgagcaccugaccuaccuggaguucaagagcuucagaagaaucagcuucagcgacuaccagaacuaccuggugaacagcugcgugaaggagaaccccaccauggagagaagcaucgcccugugcaacggcaucagccagugggugcagcugauggugcugagcagacccaccccccagcugagagccgagguguucaucaaguucauccagguggcccagaagcugcaccagcugcagaacuucaacacccugauggccgugaucggcggccugugccacagcagcaucagcagacugaaggagaccagcagccacgugccccacgagaucaacaaggugcugggcgagaugaccgagcugcugagcagcagcagaaacuacgacaacuacagaagagccuacggcgagugcaccgacuucaagauccccauccugggcgugcaccugaaggaccugaucagccuguacgaggccaugcccgacuaccuggaggacggcaaggugaacgugcacaagcugcuggcccuguacaaccacaucagcgagcuggugcagcugcaggagguggcccccccccuggaggccaacaaggaccuggugcaccugcugacccugagccuggaccuguacuacaccgaggacgagaucuacgagcugagcuacgccagagagcccagaaaccacagagcccccagcguguucaagaacuacgaccacgaccaggacggcuacaucagccaggaggaguucgagaagaucgccgccagcuuccccuucagcuucugcgugauggacaaggacagagagggccugaucagcagagacgagaucaccgccuacuucaugagagccagcagcaucuacagcaagcugggccugggcuucccccacaacuuccaggagaccaccuaccugaagcccaccuucugcgacaacugcgccggcuuccuguggggcgugaucaagcagggcuacagaugcaaggacugcggcaugaacugccacaagcagugcaaggaccuggugguguucgagugcaagaagagagccaagaaccccguggcccccaccgagaacaacaccagcgugggccccgugagcaaccugugcagccugggcgccaaggaccugcugcacgcccccgaggagggccccuucaccuuccccaacggcgaggccguggagcacggcgaggagagcaaggacagaaccaucaugcugaugggcgugagcagccagaagaucagccugagacugaagagagccguggcccacaaggccacccagaccgagagccagcccuggaucggcagcgagggccccagcggccccuucgugcugagcagccccagaaagaccgcccaggacacccuguacgugcugcccagccccaccagccccugccccagccccgugcuggugagaaagagagccuucgugaagugggagaacaaggacagccugaucaagagcaaggaggagcugagacaccugagacugcccaccuaccaggagcuggagcaggagaucaacacccugaaggccgacaacgacgcccugaagauccagcugaaguacgcccagaagaagaucgagagccugcagcuggagaagagcaaccacgugcuggcccagauggagcagggcgacugcagcuaa

SEQ ID NO: 22444 - RNA, 1830 nt, Artificial Sequence
  RASGRP2__Homo_sapiens__NP_001092141
auggccggcacccuggaccuggacaagggcugcaccguggaggagcugcugagaggcugcaucgaggccuucgacgacagcggcaaggugagagacccccagcuggugagaauguuccugaugaugcaccccugguacauccccagcagccagcuggccgccaagcugcugcacaucuaccagcagagcagaaaggacaacagcaacagccugcaggugaagaccugccaccuggugagauacuggaucagcgccuuccccgccgaguucgaccugaaccccgagcuggccgagcagaucaaggagcugaaggcccugcuggaccaggagggcaacagaagacacagcagccugaucgacaucgacagcgugcccaccuacaaguggaagagacaggugacccagagaaaccccgugggccagaagaagagaaagaugagccugcuguucgaccaccuggagcccauggagcuggccgagcaccugaccuaccuggaguacagaagcuucugcaagauccuguuccaggacuaccacagcuucgugacccacggcugcaccguggacaaccccgugcuggagagauucaucagccuguucaacagcgugagccagugggugcagcugaugauccugagcaagcccaccgccccccagagagcccuggugaucacccacuucgugcacguggccgagaagcugcugcagcugcagaacuucaacacccugauggccguggugggcggccugagccacagcagcaucagcagacugaaggagacccacagccacgugagccccgagaccaucaagcugugggagggccugaccgagcuggugaccgccaccggcaacuacggcaacuacagaagaagacuggccgccugcgugggcuucagauuccccauccugggcgugcaccugaaggaccugguggcccugcagcuggcccugcccgacuggcuggaccccgccagaaccagacugaacggcgccaagaugaagcagcuguucagcauccuggaggagcuggccauggugaccagccugagaccccccgugcaggccaaccccgaccugcugagccugcugaccgugagccuggaccaguaccagaccgaggacgagcuguaccagcugagccugcagagagagcccagaagcaagagcagccccaccagccccaccagcugcacccccccccccagaccccccgugcuggaggaguggaccagcgccgccaagcccaagcuggaccaggcccuggugguggagcacaucgagaagaugguggagagcguguucagaaacuucgacguggacggcgacggccacaucagccaggaggaguuccagaucaucagaggcaacuuccccuaccugagcgccuucggcgaccuggaccagaaccaggacggcugcaucagcagagaggagauggugagcuacuuccugagaagcagcagcgugcugggcggcagaaugggcuucgugcacaacuuccaggagagcaacagccugagacccguggccugcagacacugcaaggcccugauccugggcaucuacaagcagggccugaagugcagagccugcggcgugaacugccacaagcagugcaaggacagacugagcguggagugcagaagaagagcccagagcgugagccuggagggcagcgcccccagccccagccccaugcacagccaccaccacagagccuucagcuucagccugcccagacccggcagaagaggcagcagaccccccgagaucagagaggaggaggugcagaccguggaggacggcguguucgacauccaccuguaa

SEQ ID NO: 22445 - RNA, 2070 nt, Artificial Sequence
  RASGRP3__Homo_sapiens__NP_056191
augggcagcagcggccugggcaaggccgccacccuggacgagcugcugugcaccugcaucgagauguucgacgacaacggcgagcuggacaacagcuaccugcccagaaucgugcugcugaugcacagaugguaccugagcagcaccgagcuggccgagaagcugcugugcauguacagaaacgccaccggcgagagcugcaacgaguucagacugaagaucugcuacuucaugagauacuggauccugaaguuccccgccgaguucaaccuggaccugggccugaucagaaugaccgaggaguucagagagguggccagccagcugggcuacgagaagcacgugagccugaucgacaucagcagcauccccagcuacgacuggaugagaagagugacccagagaaagaaggugagcaagaagggcaaggccugccugcuguucgaccaccuggagcccaucgagcuggccgagcaccugaccuuccuggagcacaagagcuucagaagaaucagcuucaccgacuaccagagcuacgugauccacggcugccuggagaacaaccccacccuggagagaagcaucgcccuguucaacggcaucagcaagugggugcagcugauggugcugagcaagcccaccccccagcagagagccgaggugaucaccaaguucaucaacguggccaagaagcugcugcagcugaagaacuucaacacccugauggccguggugggcggccugagccacagcagcaucagcagacugaaggagacccacagccaccugagcagcgaggugaccaagaacuggaacgagaugaccgagcuggugagcagcaacggcaacuacugcaacuacagaaaggccuucgccgacugcgacggcuucaagauccccauccugggcgugcaccugaaggaccugaucgccgugcacgugaucuuccccgacuggaccgaggagaacaaggugaacaucgugaagaugcaccagcugagcgugacccugagcgagcuggugagccugcagaacgccagccaccaccuggagcccaacauggaccugaucaaccugcugacccugagccuggaccuguaccacaccgaggacgacaucuacaagcugagccuggugcuggagcccagaaacagcaagagccccaccagccccaccacccccaacaagcccguggugccccuggagugggcccugggcgugaugcccaagcccgaccccaccgugaucaacaagcacaucagaaagcugguggagagcguguucagaaacuacgaccacgaccacgacggcuacaucagccaggaggacuucgagagcaucgccgccaacuuccccuuccuggacagcuucugcgugcuggacaaggaccaggacggccugaucagcaaggacgagaugauggccuacuuccugagagccaagagccagcugcacugcaagaugggccccggcuucauccacaacuuccaggagaugaccuaccugaagcccaccuucugcgagcacugcgccggcuuccuguggggcaucaucaagcagggcuacaagugcaaggacugcggcgccaacugccacaagcagugcaaggaccugcuggugcuggccugcagaagauucgccagagcccccagccugagcagcggccacggcagccugcccggcagccccagccugccccccgcccaggacgagguguucgaguuccccggcgugaccgccggccacagagaccuggacagcagagccaucacccuggugaccggcagcagcagaaagaucagcgugagacugcagagagccaccaccagccaggccacccagaccgagcccguguggagcgaggccggcuggggcgacagcggcagccacaccuuccccaagaugaagagcaaguuccacgacaaggccgccaaggacaagggcuucgccaagugggagaacgagaagcccagagugcacgccggcguggacgugguggacagaggcaccgaguucgagcuggaccaggacgagggcgaggagaccagacaggacggcgaggacggcuaa

SEQ ID NO: 22446 - RNA, 1980 nt, Artificial Sequence
  RASGRP4__Homo_sapiens__NP_001139674
augaacagaaaggacagcaagagaaagagccaccaggagugcaccggcaagaucggcggcagaggcagacccagacaggugagaagacacaagaccugccccagccccagagagaucagcaaggugauggccagcaugaaccugggccugcugagcgagggcggcugcagcgaggacgagcugcuggagaagugcauccagagcuucgacagcgccggcagccugugccacgaggaccacaugcugaacauggugcuggccaugcacagcugggugcugcccagcgccgaccuggccgccagacugcugaccagcuaccagaaggccaccggcgacacccaggagcugagaagacugcagaucugccaccuggugagauacuggcugaugagacaccccgaggugaugcaccaggacccccagcuggaggaggugaucggcagauucugggccaccguggccagagagggcaacagcgcccagagaagacugggcgacagcagcgaccugcccggccugggcaagaagagaaaggugagccugcuguucgaccaccuggagaccggcgagcuggcccagcaccugaccuaccuggaguucagaagcuuccaggccaucaccccccaggaccugagaagcuacgugcugcagggcagcgugagaggcugccccgcccuggagggcagcgugggccugagcaacagcgugagcagaugggugcaggugauggugcugagcagacccggcccccugcagagagcccaggugcuggacaaguucauccacguggcccagagacugcaccagcugcagaacuucaacacccugauggccgugaccggcggccugugccacagcgccaucagcagacugaaggacagccacgcccaccugagccccgacagcaccaaggcccugcuggagcugaccgagcugcuggccagccacaacaacuacgccagauacagaagaaccugggccggcugcgccggcuucagacugcccgugcugggcgugcaccugaaggaccuggugagccugcacgaggcccagcccgacagacugcccgacggcagacugcaccugcccaagcugaacaaccuguaccugagacugcaggagcugguggcccugcagggccagcacccccccugcagcgccaacgaggaccugcugcaccugcugacccugagccuggaccuguucuacaccgaggacgagaucuacgagcugagcuacgccagagagcccagaugccccaagagccugccccccagccccuucaacgccccccuggugguggagugggcccccggcgugacccccaagcccgacagagugacccugggcagacacguggagcagcugguggagagcguguucaagaacuacgaccccgagggcagaggcaccaucagccaggaggacuucgagagacugagcggcaacuuccccuucgccugccacggccugcaccccccccccagacagggcagaggcagcuucagcagagaggagcugaccggcuaccugcugagagccagcgccaucugcagcaagcugggccuggccuuccugcacaccuuccacgaggugaccuucagaaagcccaccuucugcgacagcugcagcggcuuccuguggggcgugaccaagcagggcuacagaugcagagagugcggccugugcugccacaagcacugcagagaccaggugaagguggagugcaagaagagacccggcgccaagggcgacgccggcccccccggcgcccccgugcccagcacccccgccccccacgccagcugcggcagcgaggagaaccacagcuacacccugagccuggagcccgagaccggcugccagcugagacacgccuggacccagaccgagagcccccaccccagcugggagaccgacaccgugcccugccccgugauggacccccccagcaccgccagcagcaagcuggacagcuaa

SEQ ID NO: 22447 - RNA, 2892 nt, Artificial Sequence
  RASIP1__Homo_sapiens__NP_060275
augcugagcggcgagagaaaggagggcggcagccccagauucggcaagcugcaccugcccgugggccuguggaucaacagccccagaaagcagcuggccaagcugggcagaagauggcccagcgccgccagcgugaagagcagcagcagcgacaccggcagcagaagcagcgagccccugccccccccccccccccacguggagcugagaagagugggcgccgugaaggccgccggcggcgccagcggcagcagagccaagagaaucagccagcuguucagaggcagcggcaccggcaccaccggcagcagcggcgccggcggccccggcacccccggcggcgcccagagaugggccagcgagaagaagcugcccgagcuggccgccggcguggcccccgagcccccccuggccaccagagccaccgccccccccggcgugcugaagaucuucggcgccggccuggccagcggcgccaacuacaagagcgugcuggccaccgccagaagcaccgccagagagcugguggccgaggcccuggagagauacggccuggccggcagccccggcggcggccccggcgagagcagcugcguggacgccuucgcccugugcgacgcccugggcagacccgccgccgccggcgugggcagcggcgaguggagagccgagcaccugagagugcugggcgacagcgagagaccccugcuggugcaggagcuguggagagccagacccggcugggccagaagauucgagcugagaggcagagaggaggccagaagacuggagcaggaggccuucggcgccgccgacagcgagggcaccggcgcccccagcuggagaccccagaagaacagaagcagagccgccagcggcggcgccgcccuggccagccccggccccggcaccggcagcggcgcccccgccggcagcggcggcaaggagagaagcgagaaccugagccugagaagaagcgugagcgagcugagccugcagggcagaagaagaagacagcaggagagaagacagcaggcccugagcauggcccccggcgccgccgacgcccagaucggcaccgccgaccccggcgacuucgaccagcugacccagugccugauccaggcccccagcaacagacccuacuuccugcugcugcagggcuaccaggacgcccaggacuucgugguguacgugaugaccagagagcagcacguguucggcagaggcggcaacagcagcggcagaggcggcagccccgcccccuacguggacaccuuccugaacgcccccgacauccugcccagacacugcaccgugagagccggccccgagcaccccgccauggugagacccagcagaggcgcccccgugacccacaacggcugccugcugcugagagaggccgagcugcaccccggcgaccugcugggccugggcgagcacuuccuguucauguacaaggaccccagaaccggcggcagcggccccgccagaccccccuggcugcccgccagacccggcgccaccccccccggccccggcugggccuucagcugcagacugugcggcagaggccugcaggagagaggcgaggcccuggccgccuaccuggacggcagagagcccgugcugagauucagacccagagaggaggaggcccugcugggcgagaucgugagagccgccgccgccggcagcggcgaccugcccccccugggccccgccacccugcuggcccugugcgugcagcacagcgccagagagcuggagcugggccaccugcccagacugcugggcagacuggccagacugaucaaggaggccgugugggagaagaucaaggagaucggcgacagacagcccgagaaccaccccgagggcgugcccgaggugccccugacccccgaggccgugagcguggagcugagaccccugaugcuguggauggccaacaccaccgagcugcugagcuucgugcaggagaaggugcuggagauggagaaggaggccgaccaggaggacccccagcugugcaacgaccuggagcugugcgacgaggccauggcccugcuggacgaggugaucaugugcaccuuccagcagagcguguacuaccugaccaagacccuguacagcacccugcccgcccugcuggacagcaaccccuucaccgccggcgccgagcugcccggccccggcgccgagcugggcgccaugccccccggccugagacccacccugggcguguuccaggccgcccuggagcugaccagccagugcgagcugcaccccgaccuggugagccagaccuucggcuaccuguucuucuucagcaacgccagccugcugaacagccugauggagagaggccagggcagacccuucuaccaguggagcagagccgugcagaucagaaccaaccuggaccuggugcuggacuggcugcagggcgccggccugggcgacaucgccaccgaguucuucagaaagcugagcauggccgugaaccugcugugcgugcccagaaccagccugcugaaggccagcuggagcagccugagaaccgaccaccccacccugacccccgcccagcugcaccaccugcugagccacuaccagcugggccccggcagaggcccccccgccgccugggaccccccccccgccgagagagaggccguggacaccggcgacaucuucgagagcuucagcagccaccccccccugauccugccccugggcagcagcagacugagacugaccggccccgugaccgacgacgcccugcacagagagcugagaagacugagaagacugcugugggaccuggagcagcaggagcugcccgccaacuacagacacggcccccccguggccaccagccccuaa

SEQ ID NO: 22448 - RNA, 612 nt, Artificial Sequence
  RASL10A__Homo_sapiens__NP_006468
augggcggcagccugagaguggccgugcugggcgcccccggcgugggcaagaccgccaucaucagacaguuccuguucggcgacuaccccgagagacacagacccaccgacggccccagacuguacagacccgccgugcugcuggacggcgccguguacgaccugagcaucagagacggcgacguggccggccccggcagcagccccggcggccccgaggaguggcccgacgccaaggacuggagccugcaggacaccgacgccuucgugcugguguacgacaucugcagccccgacagcuucgacuacgugaaggcccugagacagagaaucgccgagaccagacccgccggcgcccccgaggcccccauccugguggugggcaacaagagagacagacagagacugagauucggccccagaagagcccuggccgcccuggugagaagaggcuggagaugcggcuaccuggagugcagcgccaaguacaacuggcacgugcugagacuguucagagagcugcugagaugcgcccuggugagagccagacccgcccaccccgcccugagacugcagggcgcccugcaccccgccagaugcagccugauguaa

SEQ ID NO: 22449 - RNA, 612 nt, Artificial Sequence
  RASL10B__Homo_sapiens__NP_201572
auggugagcaccuacagaguggccgugcugggcgccagaggcgugggcaagagcgccaucgugagacaguuccuguacaacgaguucagcgaggugugcgugcccaccaccgccagaagacuguaccugcccgccguggugaugaacggccacgugcacgaccugcagauccuggacuucccccccaucagcgccuuccccgugaacacccugcaggagugggccgacaccugcugcagaggccugagaagcgugcacgccuacauccugguguacgacaucugcugcuucgacagcuucgaguacgugaagaccaucagacagcagauccuggagaccagagugaucggcaccagcgagacccccaucaucaucgugggcaacaagagagaccugcagagaggcagagugauccccagauggaacgugagccaccuggugagaaagaccuggaagugcggcuacguggagugcagcgccaaguacaacuggcacauccugcugcuguucagcgagcugcugaagagcgugggcugcgccagaugcaagcacgugcacgccgcccugagauuccagggcgcccugagaagaaacagaugcgccaucauguaa

SEQ ID NO: 22450 - RNA, 729 nt, Artificial Sequence
  RASL11A__Homo_sapiens__NP_996563
augagaccccugagcaugagcggccacuuccugcuggcccccauccccgagagcagcagcgacuaccugcugcccaaggacaucaagcuggccgugcugggcgccggcagagugggcaagagcgccaugaucgugagauuccugaccaagagauucaucggcgacuacgagcccaacaccggcaagcuguacagcagacugguguacguggagggcgaccagcugagccugcagauccaggacacccccggcggcgugcagauccaggacagccugccccaggugguggacagccugagcaagugcgugcagugggccgagggcuuccugcugguguacagcaucaccgacuacgacagcuaccugagcaucagaccccuguaccagcacaucagaaaggugcaccccgacagcaaggcccccgugaucaucgugggcaacaagggcgaccugcugcacgccagacaggugcagacccaggacggcauccagcuggccaacgagcugggcagccuguuccuggagaucagcaccagcgagaacuacgaggacgugugcgacguguuccagcaccugugcaaggaggugagcaagaugcacggccugagcggcgagagaagaagagccagcaucauccccagacccagaagccccaacaugcaggaccugaagagaagauucaagcaggcccugagccccaaggugaaggcccccagcgcccugggcuaa

SEQ ID NO: 22451 - RNA, 747 nt, Artificial Sequence
  RASL11B__Homo_sapiens__NP_076429
augagacugauccagaacaugugcaccaucgccgaguaccccgcccccggcaacgccgccgccagcgacugcugcgugggcgccgccggcagaagacuggugaagaucgccguggugggcgccagcggcgugggcaagaccgcccugguggugagauuccugaccaagagauucaucggcgacuacgagagaaacgccggcaaccuguacaccagacaggugcagaucgagggcgagacccuggcccugcaggugcaggacacccccggcauccaggugcacgagaacagccugagcugcagcgagcagcugaacagaugcaucagaugggccgacgccguggugaucguguucagcaucaccgacuacaagagcuacgagcugaucagccagcugcaccagcacgugcagcagcugcaccugggcaccagacugcccgugguggugguggccaacaaggccgaccugcugcacaucaagcagguggacccccagcugggccugcagcuggccagcaugcugggcugcagcuucuacgaggugagcgugagcgagaacuacaacgacguguacagcgccuuccacgugcugugcaaggaggugagccacaagcagcagcccagcagcacccccgagaagagaagaaccagccugauccccagacccaagagccccaacaugcaggaccugaagagaagauucaagcaggcccugagcgccaaggugagaaccgugaccagcguguaa

SEQ ID NO: 22452 - RNA, 801 nt, Artificial Sequence
  RASL12__Homo_sapiens__NP_057647
augagcagcguguucggcaagcccagagccggcagcggcccccagagcgccccccuggaggugaaccuggccauccugggcagaagaggcgccggcaagagcgcccugaccgugaaguuccugaccaagagauucaucagcgaguacgaccccaaccuggaggacaccuacagcagcgaggagaccguggaccaccagcccgugcaccugagagugauggacaccgccgaccuggacacccccagaaacugcgagagauaccugaacugggcccacgccuuccuggugguguacagcguggacagcagacagagcuucgacagcagcagcagcuaccuggagcugcuggcccugcacgccaaggagacccagagaagcauccccgcccugcugcugggcaacaagcuggacauggcccaguacagacaggugaccaaggccgagggcguggcccuggccggcagauucggcugccuguucuucgaggugagcgccugccuggacuucgagcacgugcagcacguguuccacgaggccgugagagaggccagaagagagcuggagaagagcccccugaccagaccccuguucaucagcgaggagagagcccugccccaccaggccccccugaccgccagacacggccuggccagcugcaccuucaacacccugagcaccaucaaccugaaggagaugcccaccguggcccaggccaagcuggugaccgugaagagcagcagagcccagagcaagagaaaggcccccacccugacccugcugaagggcuucaagaucuucuaa

SEQ ID NO: 22453 - RNA, 570 nt, Artificial Sequence
  RASSF1__Homo_sapiens__NP_001193886
augagccugaacaaggacggcagcuacaccggcuucaucaaggugcagcugaagcuggugagacccgugagcgugcccagcagcaagaagccccccagccugcaggacgccagaagaggccccggcagaggcaccagcgugagaagaagaaccagcuucuaccugcccaaggacgccgugaagcaccugcacgugcugagcagaaccagagccagagaggugaucgaggcccugcugagaaaguuccuggugguggacgaccccagaaaguucgcccuguucgagagagccgagagacacggccagguguaccugagaaagcugcuggacgacgagcagccccugagacugagacugcuggccggccccagcgacaaggcccugagcuucgugcugaaggagaacgacagcggcgaggugaacugggacgccuucagcaugcccgagcugcacaacuuccugagaauccugcagagagaggaggaggagcaccugagacagauccugcagaaguacagcuacugcagacagaagauccaggaggcccugcacgccugcccccugggcuaa

SEQ ID NO: 22454 - RNA, 981 nt, Artificial Sequence
  RASSF2__Homo_sapiens__NP_055552
auggacuacagccaccagaccagccuggugcccugcggccaggacaaguacaucagcaagaacgagcugcugcugcaccugaagaccuacaaccuguacuacgagggccagaaccugcagcugagacacagagaggaggaggacgaguucaucguggagggccugcugaacaucagcuggggccugagaagacccaucagacugcagaugcaggacgacaacgagagaaucagacccccccccagcagcagcagcuggcacagcggcugcaaccugggcgcccagggcaccacccugaagccccugaccgugcccaaggugcagaucagcgagguggacgccccccccgagggcgaccagaugcccagcagcaccgacagcagaggccugaagccccugcaggaggacaccccccagcugaugagaaccagaagcgacgugggcgugagaagaagaggcaacgugagaacccccagcgaccagagaagaaucagaagacacagauucagcaucaacggccacuucuacaaccacaagaccagcguguucacccccgccuacggcagcgugaccaacgugagaaucaacagcaccaugaccaccccccaggugcugaagcugcugcugaacaaguucaagaucgagaacagcgccgaggaguucgcccuguacguggugcacaccagcggcgagaagcagaagcugaaggccaccgacuacccccugaucgccagaauccugcagggccccugcgagcagaucagcaagguguuccugauggagaaggaccagguggaggaggugaccuacgacguggcccaguacaucaaguucgagaugcccgugcugaagagcuucauccagaagcugcaggaggaggaggacagagaggugaagaagcugaugagaaaguacaccgugcugagacugaugaucagacagagacuggaggagaucgccgagacccccgccaccaucuaa

SEQ ID NO: 22455 - RNA, 717 nt, Artificial Sequence
  RASSF3__Homo_sapiens__NP_835463
augagcagcggcuacagcagccuggaggaggacgccgaggacuucuucuucaccgccagaaccagcuucuucagaagagccccccagggcaagcccagaagcggccagcaggacguggagaaggagaaggagacccacagcuaccugagcaaggaggagaucaaggagaaggugcacaaguacaaccuggccgugaccgacaagcugaagaugacccugaacagcaacggcaucuacaccggcuucaucaaggugcagauggagcugugcaagcccccccagaccagccccaacagcggcaagcugagccccagcagcaacggcugcaugaacacccugcacaucagcagcaccaacaccgugggcgaggugaucgaggcccugcugaagaaguuccuggugaccgagagccccgccaaguucgcccuguacaagagaugccacagagaggaccagguguacgccugcaagcugagcgacagagagcacccccuguaccugagacugguggccggccccagaaccgacacccugagcuucgugcugagagagcacgagaucggcgagugggaggccuucagccugcccgagcugcagaacuuccugagaauccuggacaaggaggaggacgagcagcugcagaaccugaagagaagauacaccgccuacagacagaagcuggaggaggcccugagagagguguggaagcccgacuaa

SEQ ID NO: 22456 - RNA, 966 nt, Artificial Sequence
  RASSF4__Homo_sapiens__NP_114412
augaaggaggacugccugcccagcagccacgugcccaucagcgacagcaagagcauccagaagagcgagcugcugggccugcugaagaccuacaacugcuaccacgagggcaagagcuuccagcugagacacagagaggaggagggcacccugaucaucgagggccugcugaacaucgccuggggccugagaagacccaucagacugcagaugcaggacgacagagagcaggugcaccugcccagcaccagcuggaugcccagaagacccagcugcccccugaaggagcccagcccccagaacggcaacaucaccgcccagggccccagcauccagcccgugcacaaggccgagagcagcaccgacagcagcggcccccuggaggaggccgaggaggccccccagcugaugagaaccaagagcgacgccagcugcaugagccagagaagacccaagugcagagcccccggcgaggcccagagaaucagaagacacagauucagcaucaacggccacuucuacaaccacaagaccagcguguucacccccgccuacggcagcgugaccaacgugagagugaacagcaccaugaccacccugcaggugcugacccugcugcugaacaaguucagaguggaggacggccccagcgaguucgcccuguacaucgugcacgagagcggcgagagaaccaagcugaaggacugcgaguacccccugaucagcagaauccugcacggccccugcgagaagaucgccagaaucuuccugauggaggccgaccugggcguggaggugccccacgagguggcccaguacaucaaguucgagaugcccgugcuggacagcuucguggagaagcugaaggaggaggaggagagagagaucaucaagcugaccaugaaguuccaggcccugagacugaccaugcugcagagacuggagcagcugguggaggccaaguaa

SEQ ID NO: 22457 - RNA, 1257 nt, Artificial Sequence
  RASSF5__Homo_sapiens__NP_872604
auggccauggccagccccgccaucggccagagacccuacccccugcugcuggaccccgagccccccagauaccugcagagccugagcggccccgagcugcccccccccccccccgacagaagcagcagacugugcgugcccgccccccugagcaccgcccccggcgccagagagggcagaagcgccagaagagccgccagaggcaaccuggagcccccccccagagccagcagacccgccagaccccugagacccggccugcagcagagacugagaagaagacccggcgcccccagacccagagacgugagaagcaucuucgagcagccccaggaccccagagugcccgccgagagaggcgagggccacugcuucgccgagcuggugcugcccggcggccccggcuggugcgaccugugcggcagagaggugcugagacaggcccugagaugcaccaacugcaaguucaccugccaccccgagugcagaagccugauccagcuggacugcagccagcaggagggccugagcagagacagacccagccccgagagcacccugaccgugaccuucagccagaacgugugcaagcccguggaggagacccagagaccccccacccugcaggagaucaagcagaagaucgacagcuacaacaccagagagaagaacugccugggcaugaagcugagcgaggacggcaccuacaccggcuucaucaaggugcaccugaagcugagaagacccgugaccgugcccgccggcaucagaccccagagcaucuacgacgccaucaaggaggugaaccuggccgccaccaccgacaagagaaccagcuucuaccugccccuggacgccaucaagcagcugcacaucagcagcaccaccaccgugagcgaggugauccagggccugcugaagaaguucauggugguggacaacccccagaaguucgcccuguucaagagaauccacaaggacggccaggugcuguuccagaagcugagcaucgccgacagaccccuguaccugagacugcuggccggccccgacaccgaggugcugagcuucgugcugaaggagaacgagaccggcgagguggagugggacgccuucagcauccccgagcugcagaacuuccugaccauccuggagaaggaggagcaggacaagauccagcaggugcagaagaaguacgacaaguucagacagaagcuggaggaggcccugagagagagccagggcaagcccggcuaa

SEQ ID NO: 22458 - RNA, 912 nt, Artificial Sequence
  RASSF6__Homo_sapiens__NP_001257320
augaccaugauggcccaccaguaccccagcuggaucuucaucaacgagaagaccuucaucaccagagagcagcugaacagccugcugaagaccuacaacaucuucuacgagaaccagaagaaccugcacauccuguacggcgagaccgaggacggcaagcugaucguggagggcaugcuggacaucuucuggggcgugaagagacccauccagcugaagauccaggacgagaagcccuucagcagcuucaccagcaugaagagcagcgacguguucagcagcaagggcaugaccagauggggcgaguucgacgaccuguacagaaucagcgagcuggacagaacccagauccccaugagcgagaagagaaacagccaggaggacuaccugagcuaccacagcaacacccugaagccccacgccaaggacgagcccgacagccccgugcuguacagaaccaugagcgaggccgcccuggugagaaagagaaugaagccccugaugauggacagaaaggagagacagaagaacagagccagcaucaacggccacuucuacaaccacgagaucgagaacagcccccaggacuucgcccugcacaucaucuucgccaccggcgagcagagaagacugaagaagaccgacaucccccugcugcagagacugcugcagggccccagcgagaagaacgccagaaucuuccugauggacaaggacgccgaggagaucagcagcgacguggcccaguacaucaacuuccacuucagccugcuggagagcauccugcagagacugaacgaggaggagaagagagagauccagagaaucgugaccaaguucaacaaggagaaggccaucauccugaagugccugcagaacaagcuggugaucaagaccgagaccaccguguaa

SEQ ID NO: 22459 - RNA, 1014 nt, Artificial Sequence
  RASSF7__Homo_sapiens__NP_001137465
augcugcugggccuggccgccauggagcugaagguguggguggacggcauccagagaguggugugcggcgugagcgagcagaccaccugccaggagguggugaucgcccuggcccaggccaucggccagaccggcagauucgugcuggugcagagacugagagagaaggagagacagcugcugccccaggagugccccgugggcgcccaggccaccugcggccaguucgccagcgacgugcaguucgugcugagaagaaccggccccagccuggccggcagacccagcagcgacagcugccccccccccgagagaugccugaucagagccagccugcccgugaagcccagagccgcccugggcugcgagcccagaaagacccugacccccgagcccgcccccagccugagcagacccggccccgccgcccccgugacccccacccccggcugcugcaccgaccugagaggccuggagcugagagugcagagaaacgccgaggagcugggccacgaggccuucugggagcaggagcugagaagagagcaggccagagagagagagggccaggccagacugcaggcccugagcgccgccaccgccgagcacgccgccagacugcaggcccuggacgcccaggccagagcccuggaggccgagcugcagcuggccgccgaggcccccggcccccccagccccauggccagcgccaccgagagacugcaccaggaccuggccgugcaggagagacagagcgccgaggugcagggcagccuggcccuggugagcagagcccuggaggccgccgagagagcccugcaggcccaggcccaggagcuggaggagcugaacagagagcugagacagugcaaccugcagcaguucauccagcagaccggcgccgcccugccccccccccccagacccgacagaggcccccccggcacccaggugggcguggugcugggcggcggcugggaggugagaaccuggcccagccccacccccagcuaa

SEQ ID NO: 22460 - RNA, 1260 nt, Artificial Sequence
  RASSF8__Homo_sapiens__NP_001158219
auggagcugaagguguggguggacggcgugcagagaaucgugugcggcgugaccgaggugaccaccugccaggagguggugaucgcccuggcccaggccaucggcagaaccggcagauacacccugaucgagaaguggagagacaccgagagacaccuggccccccacgagaaccccaucaucagccugaacaaguggggccaguacgccagcgacgugcagcugauccugagaagaaccggccccagccugagcgagagacccaccagcgacagcguggccagaauccccgagagaacccuguacagacagagccugcccccccuggccaagcugagaccccagaucgacaagagcaucaagagaagagagcccaagagaaagagccugaccuucaccggcggcgccaagggccugauggacaucuucggcaagggcaaggagaccgaguucaagcagaaggugcugaacaacugcaagaccaccgccgacgagcugaagaagcugaucagacugcagaccgagaagcugcagagcaucgagaagcagcuggagagcaacgagaucgagaucagauucugggagcagaaguacaacagcaaccuggaggaggagaucgugagacuggagcagaagaucaagagaaacgacguggagaucgaggaggaggaguucugggagaacgagcugcagaucgagcaggagaacgagaagcagcugaaggaccagcugcaggagaucagacagaagaucaccgagugcgagaacaagcugaaggacuaccuggcccagaucagaaccauggagagcggccuggaggccgagaagcugcagagagaggugcaggaggcccaggugaacgaggaggaggugaagggcaagaucggcaaggugaagggcgagaucgacauccagggccagcagagccugagacuggagaacggcaucaaggccguggagagaagccugggccaggccaccaagagacugcaggacaaggagcaggagcuggagcagcugaccaaggagcugagacaggugaaccugcagcaguucauccagcagaccggcaccaaggugaccgugcugcccgccgagcccaucgagaucgaggccagccacgccgacaucgagagagaggcccccuuccagagcggcagccugaagagacccggcagcagcagacagcugcccagcaaccugagaauccugcagaaccccaucagcagcggcuucaaccccgagggcaucuacguguaa

SEQ ID NO: 22461 - RNA, 555 nt, Artificial Sequence
  RAX2__Homo_sapiens__NP_116142
auguuccugagccccggcgagggccccgccaccgagggcggcggccugggccccggcgaggaggcccccaagaagaagcacagaagaaacagaaccaccuucaccaccuaccagcugcaccagcuggagagagccuucgaggccagccacuaccccgacguguacagcagagaggagcuggccgccaaggugcaccugcccgaggugagagugcaggugugguuccagaacagaagagccaaguggagaagacaggagagacuggagagcggcagcggcgccguggccgcccccagacugcccgaggcccccgcccugcccuucgccagaccccccgccaugagccugccccuggagcccuggcugggccccggcccccccgccgugcccggccugcccagacugcugggccccggccccggccugcaggccagcuucggcccccacgccuucgcccccaccuucgccgacggcuucgcccuggaggaggccagccugagacugcuggccaaggagcacgcccaggcccuggacagagccuggccccccgccuaa

SEQ ID NO: 22462 - RNA, 1041 nt, Artificial Sequence
  RAX__Homo_sapiens__NP_038463
augcaccugcccggcugcgcccccgccauggccgacggcagcuucagccuggccggccaccugcugagaagccccggcggcagcaccagcagacugcacagcaucgaggccauccugggcuucaccaaggacgacggcauccugggcaccuuccccgccgagagaggcgccagaggcgccaaggagagagacagaagacugggcgccagacccgccugccccaaggcccccgaggagggcagcgagcccagccccccccccgcccccgcccccgcccccgaguacgaggcccccagacccuacugccccaaggagcccggcgaggccagacccagccccggccugcccgugggccccgccaccggcgaggccaagcugagcgaggaggagcagcccaagaagaagcacagaagaaacagaaccaccuucaccaccuaccagcugcacgagcuggagagagccuucgagaagagccacuaccccgacguguacagcagagaggagcuggccggcaaggugaaccugcccgaggugagagugcaggugugguuccagaacagaagagccaaguggagaagacaggagaagcuggaggugagcagcaugaagcugcaggacagcccccugcugagcuucagcagaagcccccccagcgccacccugagcccccugggcgccggccccggcagcggcggcggccccgccggcggcgcccugccccuggagagcuggcugggccccccccugcccggcggcggcgccaccgcccugcagagccugcccggcuucggcccccccgcccagagccugcccgccagcuacacccccccccccccccccccccccuuccugaacagccccccccugggccccggccugcagccccuggccccccccccccccagcuaccccugcggccccggcuucggcgacaaguucccccuggacgaggccgaccccagaaacagcagcaucgccgcccugagacugaaggccaaggagcacauccaggccaucggcaagcccuggcaggcccuguaa

SEQ ID NO: 22463 - RNA, 4776 nt, Artificial Sequence
  RB1CC1__Homo_sapiens__NP_001077086
augaagcuguacguguuccuggugaacaccggcaccacccugaccuucgacaccgagcugaccgugcagaccguggccgaccugaagcacgccauccagagcaaguacaagaucgccauccagcaccaggugcugguggugaacggcggcgagugcauggccgccgacagaagagugugcaccuacagcgccggcaccgacaccaaccccaucuuccuguucaacaaggagaugauccugugcgacagaccccccgccauccccaagaccaccuucagcaccgagaacgacauggagaucaagguggaggagagccugaugaugcccgccguguuccacaccguggccagcagaacccagcuggcccuggagauguacgagguggccaagaagcugugcagcuucugcgagggccuggugcacgacgagcaccugcagcaccagggcugggccgccaucauggccaaccuggaggacugcagcaacagcuaccagaagcugcuguucaaguucgagagcaucuacagcaacuaccugcagagcaucgaggacaucaagcugaagcugacccaccugggcaccgccgugagcgugauggccaagaucccccugcuggagugccugaccagacacagcuacagagagugccugggcagacuggacagccugcccgagcacgaggacagcgagaaggccgagaugaagagaagcaccgagcuggugcugagccccgacaugcccagaaccaccaacgagagccugcugaccagcuuccccaagagcguggagcacgugagccccgacaccgccgacgccgagagcggcaaggagaucagagagagcugccagagcaccgugcaccagcaggacgagaccaccaucgacaccaaggacggcgaccugcccuucuucaacgugagccugcuggacuggaucaacgugcaggacagacccaacgacguggagagccuggugagaaagugcuucgacagcaugagcagacuggaccccagaaucaucagacccuucaucgccgagugcagacagaccaucgccaagcuggacaaccagaacaugaaggccaucaagggccuggaggacagacuguacgcccuggaccagaugaucgccagcugcggcagacuggugaacgagcagaaggagcuggcccagggcuuccuggccaaccagaagagagccgagaaccugaaggacgccagcgugcugcccgaccugugccugagccacgccaaccagcugaugaucaugcugcagaaccacagaaagcugcuggacaucaagcagaagugcaccaccgccaagcaggagcuggccaacaaccugcacgugagacugaaguggugcugcuucgugaugcugcacgccgaccaggacggcgagaagcugcaggcccugcugagacuggugaucgagcugcuggagagagugaagaucguggaggcccugagcaccgugccccagauguacugccuggccgugguggagguggugagaagaaagauguucaucaagcacuacagagagugggccggcgcccuggugaaggacggcaagagacuguacgaggccgagaagagcaagagagagagcuucggcaagcuguucagaaagagcuuccugagaaacagacuguucagaggccuggacagcuggccccccagcuucugcacccagaagcccagaaaguucgacugcgagcugcccgacaucagccugaaggaccugcaguuccugcagagcuucugccccagcgaggugcagcccuuccugagagugccccugcugugcgacuucgagccccugcaccagcacgugcuggcccugcacaaccuggugaaggccgcccagagccuggacgagaugagccagaccaucaccgaccugcugagcgagcagaaggccagcgugagccagaccagcccccagagcgccagcagccccagaauggagagcaccgccggcaucaccaccaccaccagccccagaaccccccccccccugaccgugcaggacccccugugccccgccgugugcccccuggaggagcugagccccgacagcaucgacgcccacaccuucgacuucgagaccaucccccaccccaacaucgagcagaccauccaccaggugagccuggaccuggacagccuggccgagagccccgagagcgacuucaugagcgccgugaacgaguucgugaucgaggagaaccugagcagccccaaccccaucagcgacccccagagccccgagaugaugguggagagccuguacagcagcgugaucaacgccaucgacagcagaagaaugcaggacaccaacgugugcggcaaggaggacuucggcgaccacaccagccugaacgugcagcuggagagaugcagagugguggcccaggacagccacuucagcauccagaccaucaaggaggaccugugccacuucagaaccuucgugcagaaggagcagugcgacuucagcaacagccugaagugcaccgccguggagaucagaaacaucaucgagaaggugaagugcagccuggagaucacccugaaggagaagcaccagaaggagcugcugagccugaagaacgaguacgagggcaagcuggacggccugaucaaggagaccgaggagaacgagaacaagaucaagaagcugaagggcgagcuggugugccuggaggaggugcugcagaacaaggacaacgaguucgcccuggugaagcacgagaaggaggccgugaucugccugcagaacgagaaggaccagaagcugcuggagauggagaacaucaugcacagccagaacugcgagaucaaggagcugaagcagagcagagagaucgugcuggaggaccugaagaagcugcacguggagaacgacgagaagcugcagcugcugagagccgagcugcagagccuggagcagagccaccugaaggagcuggaggacacccugcaggugagacacauccaggaguucgagaaggugaugaccgaccacagagugagccuggaggagcugaagaaggagaaccagcagaucaucaaccagauccaggagagccacgccgagaucauccaggagaaggagaagcagcugcaggagcugaagcugaaggugagcgaccugagcgacaccagaugcaagcuggagguggagcuggcccugaaggaggccgagaccgacgagaucaagauccugcuggaggagagcagagcccagcagaaggagacccugaagagccugcuggagcaggagaccgagaaccugagaaccgagaucagcaagcugaaccagaagauccaggacaacaacgagaacuaccaggugggccuggccgagcugagaacccugaugaccaucgagaaggaccagugcaucagcgagcugaucagcagacacgaggaggagagcaacauccugaaggccgagcugaacaaggugaccagccugcacaaccaggccuucgagaucgagaagaaccugaaggagcagaucaucgagcugcagagcaagcuggacagcgagcugagcgcccuggagagacagaaggacgagaagaucacccagcaggaggagaaguacgaggccaucauccagaaccuggagaaggacagacagaagcuggugagcagccaggagcaggacagagagcagcugauccagaagcugaacugcgagaaggacgaggccauccagaccgcccugaaggaguucaagcuggagagagaggugguggagaaggagcugcuggagaaggugaagcaccuggagaaccagaucgccaagagccccgccaucgacagcaccagaggcgacagcagcagccugguggccgagcugcaggagaagcugcaggaggagaaggccaaguuccuggagcagcuggaggagcaggagaagagaaagaacgaggagaugcagaacgugagaaccagccugaucgccgagcagcagaccaacuucaacaccgugcugaccagagagaagaugagaaaggagaacaucaucaacgaccugagcgacaagcugaagagcaccaugcagcagcaggagagagacaaggaccugaucgagagccugagcgaggacagagccagacugcuggaggagaagaagaagcuggaggaggaggugagcaagcugagaagcagcagcuucgugcccagccccuacguggccaccgcccccgagcuguacggcgccugcgcccccgagcugcccggcgagagcgacagaagcgccguggagaccgccgacgagggcagaguggacagcgccauggagaccagcaugaugagcgugcaggagaacauccacaugcugagcgaggagaagcagagaaucaugcugcuggagagaacccugcagcugaaggaggaggagaacaagagacugaaccagagacugaugagccagagcaugagcagcgugagcagcagacacagcgagaagaucgccaucagagacuuccaggugggcgaccuggugcugaucauccuggacgagagacacgacaacuacgugcuguucaccgugagccccacccuguacuuccugcacagcgagagccugcccgcccuggaccugaagcccgccagcggcgccagcagaagacccugggugcugggcaaggugauggagaaggaguacugccaggccaagaaggcccagaacagauucaaggugccccugggcaccaaguucuacagagugaaggccgugagcuggaacaagaagguguaa

SEQ ID NO: 22464 - RNA, 2787 nt, Artificial Sequence
  RB1__Homo_sapiens__NP_000312
augccccccaagacccccagaaagaccgccgccaccgccgccgccgccgccgccgagccccccgcccccccccccccccccccccccgaggaggaccccgagcaggacagcggccccgaggaccugccccuggugagacuggaguucgaggagaccgaggagcccgacuucaccgcccugugccagaagcugaagauccccgaccacgugagagagagagccuggcugaccugggagaaggugagcagcguggacggcgugcugggcggcuacauccagaagaagaaggagcuguggggcaucugcaucuucaucgccgccguggaccuggacgagaugagcuucaccuucaccgagcugcagaagaacaucgagaucagcgugcacaaguucuucaaccugcugaaggagaucgacaccagcaccaagguggacaacgccaugagcagacugcugaagaaguacgacgugcuguucgcccuguucagcaagcuggagagaaccugcgagcugaucuaccugacccagcccagcagcagcaucagcaccgagaucaacagcgcccuggugcugaaggugagcuggaucaccuuccugcuggccaagggcgaggugcugcagauggaggacgaccuggugaucagcuuccagcugaugcugugcgugcuggacuacuucaucaagcugagcccccccaugcugcugaaggagcccuacaagaccgccgugauccccaucaacggcagccccagaacccccagaagaggccagaacagaagcgccagaaucgccaagcagcuggagaacgacaccagaaucaucgaggugcugugcaaggagcacgagugcaacaucgacgaggugaagaacguguacuucaagaacuucauccccuucaugaacagccugggccuggugaccagcaacggccugcccgagguggagaaccugagcaagagauacgaggagaucuaccugaagaacaaggaccuggacgccagacuguuccuggaccacgacaagacccugcagaccgacagcaucgacagcuucgagacccagagaacccccagaaagagcaaccuggacgaggaggugaacgugauccccccccacacccccgugagaaccgugaugaacaccauccagcagcugaugaugauccugaacagcgccagcgaccagcccagcgagaaccugaucagcuacuucaacaacugcaccgugaaccccaaggagagcauccugaagagagugaaggacaucggcuacaucuucaaggagaaguucgccaaggccgugggccagggcugcguggagaucggcagccagagauacaagcugggcgugagacuguacuacagagugauggagagcaugcugaagagcgaggaggagagacugagcauccagaacuucagcaagcugcugaacgacaacaucuuccacaugagccugcuggccugcgcccuggagguggugauggccaccuacagcagaagcaccagccagaaccuggacagcggcaccgaccugagcuuccccuggauccugaacgugcugaaccugaaggccuucgacuucuacaaggugaucgagagcuucaucaaggccgagggcaaccugaccagagagaugaucaagcaccuggagagaugcgagcacagaaucauggagagccuggccuggcugagcgacagcccccuguucgaccugaucaagcagagcaaggacagagagggccccaccgaccaccuggagagcgccugcccccugaaccugccccugcagaacaaccacaccgccgccgacauguaccugagccccgugagaagccccaagaagaagggcagcaccaccagagugaacagcaccgccaacgccgagacccaggccaccagcgccuuccagacccagaagccccugaagagcaccagccugagccuguucuacaagaagguguacagacuggccuaccugagacugaacacccugugcgagagacugcugagcgagcaccccgagcuggagcacaucaucuggacccuguuccagcacacccugcagaacgaguacgagcugaugagagacagacaccuggaccagaucaugaugugcagcauguacggcaucugcaaggugaagaacaucgaccugaaguucaagaucaucgugaccgccuacaaggaccugccccacgccgugcaggagaccuucaagagagugcugaucaaggaggaggaguacgacagcaucaucguguucuacaacagcguguucaugcagagacugaagaccaacauccugcaguacgccagcaccagaccccccacccugagccccaucccccacauccccagaagccccuacaaguuccccagcagcccccugagaauccccggcggcaacaucuacaucagcccccugaagagccccuacaagaucagcgagggccugcccacccccaccaagaugacccccagaagcagaauccuggugagcaucggcgagagcuucggcaccagcgagaaguuccagaagaucaaccagauggugugcaacagcgacagagugcugaagagaagcgccgagggcagcaacccccccaagccccugaagaagcugagauucgacaucgagggcagcgacgaggccgacggcagcaagcaccugcccggcgagagcaaguuccagcagaagcuggccgagaugaccagcaccagaaccagaaugcagaagcagaagaugaacgacagcauggacaccagcaacaaggaggagaaguaa

SEQ ID NO: 22465 - RNA, 2145 nt, Artificial Sequence
  RBAK__Homo_sapiens__NP_066986
augaacacccugcagggccccgugagcuucaaggacguggccguggacuucacccaggaggaguggcagcagcuggaccccgacgagaagaucaccuacagagacgugaugcuggagaacuacagccaccuggugagcgugggcuacgacaccaccaagcccaacgugaucaucaagcuggagcagggcgaggagcccuggaucaugggcggcgaguuccccugccagcacagccccgaggccuggagaguggacgaccugaucgagagaauccaggagaacgaggacaagcacagcagacaggccgccugcaucaacagcaagacccugaccgaggagaaggagaacaccuucagccagaucuacauggagaccagccuggugcccagcagcaucaucgcccacaacugcgugagcugcggcaagaaccuggagagcaucagccagcugaucagcagcgacggcagcuacgccagaaccaagcccgacgagugcaacgagugcggcaagaccuaccacggcgagaagaugugcgaguucaaccagaacggcgacaccuacagccacaacgaggagaacauccugcagaagaucagcauccuggagaagcccuucgaguacaacgagugcauggaggcccuggacaacgaggccguguucaucgcccacaagagagccuacaucggcgagaagcccuacgaguggaacgacagcggccccgacuucauccagaugagcaacuucaacgccuaccagagaagccagauggagaugaagcccuucgagugcagcgagugcggcaagagcuucugcaagaagagcaaguucaucauccaccagagagcccacaccggcgagaagcccuacgagugcaacgugugcggcaagagcuucagccagaagggcacccugaccgugcacagaagaagccaccuggaggagaagcccuacaagugcaacgagugcggcaagaccuucugccagaagcugcaccugacccagcaccugagaacccacagcggcgagaagcccuacgagugcagcgagugcggcaagaccuucugccagaagacccaccugacccugcaccagagaaaccacagcggcgagagacccuaccccugcaacgagugcggcaagagcuucagcagaaagagcgcccugagcgaccaccagagaacccacaccggcgagaagcuguacaagugcaacgagugcggcaagagcuacuacagaaagagcacccugaucacccaccagagaacccacaccggcgagaagcccuaccagugcagcgagugcggcaaguucuucagcagagugagcuaccugaccauccacuacagaagccaccuggaggagaagcccuacgagugcaacgagugcggcaagaccuucaaccugaacagcgccuucaucagacacagaaaggugcacaccgaggagaagagccacgagugcagcgagugcggcaaguucagccagcuguaccugaccgaccaccacaccgcccaccuggaggagaagcccuacgagugcaacgagugcggcaagaccuuccuggugaacagcgccuucgacggccaccagccccugcccaagggcgagaagagcuacgagugcaacgugugcggcaagcuguucaacgagcugagcuacuacaccgagcacuacagaagccacagcgaggagaagcccuacggcugcagcgagugcggcaagaccuucagccacaacagcagccuguucagacaccagagagugcacaccggcgagaagcccuacgagugcuacgagugcggcaaguucuucagccagaagagcuaccugaccauccaccacagaauccacagcggcgagaagcccuacgagugcagcaagugcggcaagguguucagcagaaugagcaaccugaccgugcacuacagaagccacagcggcgagaagcccuacgagugcaacgagugcggcaagguguucagccagaagagcuaccugaccgugcacuacagaacccacagcggcgagaagcccuacgagugcaacgagugcggcaagaaguuccaccacagaagcgccuucaacagccaccagagaauccacagaagaggcaacaugaacgugcuggacguggagaaccuguaa

SEQ ID NO: 22466 - RNA, 1503 nt, Artificial Sequence
  RBBP5__Homo_sapiens__NP_001180201
augaaccuggagcugcuggagagcuucggccagaacuaccccgaggaggccgacggcacccuggacugcaucagcauggcccugaccugcaccuucaacagauggggcacccugcuggccgugggcugcaacgacggcagaaucgugaucugggacuuccugaccagaggcaucgccaagaucaucagcgcccacauccaccccgugugcagccugugcuggagcagagacggccacaagcuggugagcgccagcaccgacaacaucgugagccagugggacgugcugagcggcgacugcgaccagagauucagauuccccagccccauccugaaggugcaguaccaccccagagaccagaacaaggugcuggugugccccaugaagagcgcccccgugaugcugacccugagcgacagcaagcacguggugcugcccguggacgacgacagcgaccugaacgugguggccagcuucgacagaagaggcgaguacaucuacaccggcaacgccaagggcaagauccuggugcugaagaccgacagccaggaccugguggccagcuucagagugaccaccggcaccagcaacaccaccgccaucaagagcaucgaguucgccagaaagggcagcugcuuccugaucaacaccgccgacagaaucaucagaguguacgacggcagagagauccugaccugcggcagagacggcgagcccgagcccaugcagaagcugcaggaccuggugaacagaacccccuggaagaagugcugcuucagcggcgacggcgaguacaucguggccggcagcgccagacagcacgcccuguacaucugggagaagagcaucggcaaccuggugaagauccugcacggcaccagaggcgagcugcugcuggacguggccuggcaccccgugagacccaucaucgccagcaucagcagcggcguggugagcaucugggcccagaaccagguggagaacuggagcgccuucgcccccgacuucaaggagcuggacgagaacguggaguacgaggagagagagagcgaguucgacaucgaggacgaggacaagagcgagcccgagcagaccggcgccgacgccgccgaggacgaggagguggacgugaccagcguggaccccaucgccgccuucugcagcagcgacgaggagcuggaggacagcaaggcccugcuguaccugcccaucgcccccgagguggaggaccccgaggagaaccccuacggccccccccccgacgccgugcagaccagccugauggacgagggcgccagcagcgagaagaagagacagagcagcgccgacggcagccagccccccaagaagaagcccaagaccaccaacaucgagcugcagggcgugcccaacgacgaggugcacccccugcugggcgugaagggcgacggcaagagcaagaagaagcaggccggcagacccaagggcagcaaggccggcggcgccaucagcgagcugcuguaa

SEQ ID NO: 22467 - RNA, 5379 nt, Artificial Sequence
  RBBP6__Homo_sapiens__NP_008841
augagcugcgugcacuacaaguucagcagcaagcugaacuacgacaccgugaccuucgacggccugcacaucagccugugcgaccugaagaagcagaucaugggcagagagaagcugaaggccgccgacugcgaccugcagaucaccaacgcccagaccaaggaggaguacaccgacgacaacgcccugauccccaagaacagcagcgugaucgugagaagaauccccaucggcggcgugaagagcaccagcaagaccuacgugaucagcagaaccgagcccgccauggccaccaccaaggccaucgacgacagcagcgccagcaucagccuggcccagcugaccaagaccgccaaccuggccgaggccaacgccagcgaggaggacaagaucaaggccaugaugagccagagcggccacgaguacgaccccaucaacuacaugaagaagccccugggcccccccccccccagcuacaccugcuucagaugcggcaagcccggccacuacaucaagaacugccccaccaacggcgacaagaacuucgagagcggccccagaaucaagaagagcaccggcauccccagaagcuucaugauggaggugaaggaccccaacaugaagggcgccaugcugaccaacaccggcaaguacgccauccccaccaucgacgccgaggccuacgccaucggcaagaaggagaagccccccuuccugcccgaggagcccagcagcagcagcgaggaggacgaccccauccccgacgagcugcugugccugaucugcaaggacaucaugaccgacgccguggugauccccugcugcggcaacagcuacugcgacgagugcaucagaaccgcccugcuggagagcgacgagcacaccugccccaccugccaccagaacgacgugagccccgacgcccugaucgccaacaaguuccugagacaggccgugaacaacuucaagaacgagaccggcuacaccaagagacugagaaagcagcugccccccccccccccccccauccccccccccagaccccugauccagagaaaccugcagccccugaugagaagccccaucagcagacagcaggacccccugaugauccccgugaccagcagcagcacccaccccgcccccagcaucagcagccugaccagcaaccagagcagccuggccccccccgugagcggcaaccccagcagcgcccccgcccccgugcccgacaucaccgccaccgugagcaucagcgugcacagcgagaagagcgacggccccuucagagacagcgacaacaagauccugcccgccgccgcccuggccagcgagcacagcaagggcaccagcagcaucgccaucaccgcccugauggaggagaagggcuaccaggugcccgugcugggcacccccagccugcugggccagagccugcugcacggccagcugauccccaccaccggccccgugagaaucaacaccgccagacccggcggcggcagacccggcugggagcacagcaacaagcugggcuaccuggugagccccccccagcagaucagaagaggcgagagaagcugcuacagaagcaucaacagaggcagacaccacagcgagagaagccagagaacccagggccccagccugcccgccacccccguguucgugcccgugcccccccccccccuguaccccccccccccccacacccugccccugccccccggcgugccccccccccaguucagcccccaguucccccccggccagcccccccccgccggcuacagcgugcccccccccggcuucccccccgcccccgccaaccugagcacccccugggugagcagcggcgugcagaccgcccacagcaacaccauccccaccacccaggcccccccccugagcagagaggaguucuacagagagcagagaagacugaaggaggaggagaagaagaagagcaagcuggacgaguucaccaacgacuucgccaaggagcugauggaguacaagaagauccagaaggagagaagaagaagcuucagcagaagcaagagccccuacagcggcagcagcuacagcagaagcagcuacaccuacagcaagagcagaagcggcagcaccagaagcagaagcuacagcagaagcuucagcagaagccacagcagaagcuacagcagaagcccccccuaccccagaagaggcagaggcaagagcagaaacuacagaagcagaagcagaagccacggcuaccacagaagcagaagcagaagcccccccuacagaagauaccacagcagaagcagaagcccccaggccuucagaggccagagccccaacaagagaaacgugccccagggcgagaccgagagagaguacuucaacagauacagagaggugcccccccccuacgacaugaaggccuacuacggcagaagcguggacuucagagaccccuucgagaaggagagauacagagagugggagagaaaguacagagagugguacgagaaguacuacaagggcuacgccgccggcgcccagcccagacccagcgccaacagagagaacuucagccccgagagauuccugccccugaacaucagaaacagccccuucaccagaggcagaagagaggacuacgugggcggccagagccacagaagcagaaacaucggcagcaacuaccccgagaagcugagcgccagagacggccacaaccagaaggacaacaccaagagcaaggagaaggagagcgagaacgcccccggcgacggcaagggcaacaagcacaagaagcacagaaagagaagaaagggcgaggagagcgagggcuuccugaaccccgagcugcuggagaccagcagaaagagcagagagcccaccggcguggaggagaacaagaccgacagccuguucgugcugcccagcagagacgacgccacccccgugagagacgagcccauggacgccgagagcaucaccuucaagagcgugagcgagaaggacaagagagagagagacaagcccaaggccaagggcgacaagaccaagagaaagaacgacggcagcgccgugagcaagaaggagaacaucgugaagcccgccaagggcccccaggagaagguggacggcgagagagagagaagccccagaagcgagccccccaucaagaaggccaaggaggagacccccaagaccgacaacaccaagagcagcagcagcagccagaaggacgagaagaucaccggcacccccagaaaggcccacagcaagagcgccaaggagcaccaggagaccaagcccgugaaggaggagaaggugaagaaggacuacagcaaggacgugaagagcgagaagcugaccaccaaggaggagaaggccaagaagcccaacgagaagaacaagccccuggacaacaagggcgagaagagaaagagaaagaccgaggagaagggcguggacaaggacuucgagagcagcagcaugaagaucagcaagcuggaggugaccgagaucgugaagcccagccccaagagaaagauggagcccgacaccgagaagauggacagaacccccgagaaggacaagaucagccugagcgcccccgccaagaagaucaagcugaacagagagaccggcaagaagaucggcagcaccgagaacaucagcaacaccaaggagcccagcgagaagcuggagagcaccagcagcaaggugaagcaggagaaggugaagggcaaggugagaagaaaggugaccggcaccgagggcagcagcagcacccugguggacuacaccagcaccagcagcaccggcggcagccccgugagaaagagcgaggagaagaccgacaccaagagaaccgugaucaagaccauggaggaguacaacaacgacaacaccgcccccgccgaggacgugaucaucaugauccaggugccccagagcaagugggacaaggacgacuucgagagcgaggaggaggacgugaagagcacccagcccaucagcagcgugggcaagcccgccagcgugaucaagaacgugagcaccaagcccagcaacaucgugaaguaccccgagaaggagagcgagcccagcgagaagauccagaaguucaccaaggacgugagccacgagaucauccagcacgaggugaagagcagcaagaacagcgccagcagcgagaagggcaagaccaaggacagagacuacagcgugcuggagaaggagaaccccgagaagagaaagaacagcacccagcccgagaaggagagcaaccuggacagacugaacgagcagggcaacuucaagagccugagccagagcagcaaggaggccagaaccagcgacaagcacgacagcaccagagccagcagcaacaaggacuucacccccaacagagacaagaagaccgacuacgacaccagagaguacagcagcagcaagagaagagacgagaagaacgagcugaccagaagaaaggacagccccagcagaaacaaggacagcgccagcggccagaagaacaagcccagagaggagagagaccugcccaagaagggcaccggcgacagcaagaagagcaacagcagccccagcagagacagaaagccccacgaccacaaggccaccuacgacaccaagagacccaacgaggagaccaagagcguggacaagaaccccugcaaggacagagagaagcacgugcuggaggccagaaacaacaaggagagcagcggcaacaagcugcuguacauccugaacccccccgagacccagguggagaaggagcagaucaccggccagaucgacaagagcaccgugaagcccaagccccagcugagccacagcagcagacugagcagcgaccugaccagagagaccgacgaggccgccuucgagcccgacuacaacgagagcgacagcgagagcaacgugagcgugaaggaggaggagagcagcggcaacaucagcaaggaccugaaggacaagaucguggagaaggccaaggagagccuggacaccgccgccguggugcaggugggcaucagcagaaaccagagccacagcagccccagcgugagccccagcagaagccacagccccagcggcagccagaccagaagccacagcagcagcgccagcagcgccgagagccaggacagcaagaagaagaagaagaagaaggagaagaagaagcacaagaagcacaagaagcacaagaagcacaagaagcacgccggcaccgagguggagcuggagaagagccagaagcacaagcacaagaagaagaagagcaagaagaacaaggacaaggagaaggagaaggagaaggacgaccagaaggugaagagcgugaccguguaa

SEQ ID NO: 22468 - RNA, 1410 nt, Artificial Sequence
  RBBP7__Homo_sapiens__NP_001185648
auggccgccgaggccggcguggugggcgccggcgccagccccgacggcgacuggagagaccaggccugcggccugcugcugcacgugcaccugagcagcagacugggcagagccgcccccgugagaaccggcagacaccugagaaccguguucgaggacaccguggaggagagagugaucaacgaggaguacaagaucuggaagaagaacacccccuuccuguacgaccuggugaugacccacgcccugcaguggcccagccugaccgugcaguggcugcccgaggugaccaagcccgagggcaaggacuacgcccugcacuggcuggugcugggcacccacaccagcgacgagcagaaccaccuggugguggccagagugcacauccccaacgacgacgcccaguucgacgccagccacugcgacagcgacaagggcgaguucggcggcuucggcagcgugaccggcaagaucgagugcgagaucaagaucaaccacgagggcgaggugaacagagccagauacaugccccagaacccccacaucaucgccaccaagacccccagcagcgacgugcugguguucgacuacaccaagcaccccgccaagcccgaccccagcggcgagugcaaccccgaccugagacugagaggccaccagaaggagggcuacggccugagcuggaacagcaaccugagcggccaccugcugagcgccagcgacgaccacaccgugugccugugggacaucaacgccggccccaaggagggcaagaucguggacgccaaggccaucuucaccggccacagcgccgugguggaggacguggccuggcaccugcugcacgagagccuguucggcagcguggccgacgaccagaagcugaugaucugggacaccagaagcaacaccaccagcaagcccagccaccugguggacgcccacaccgccgaggugaacugccugagcuucaaccccuacagcgaguucauccuggccaccggcagcgccgacaagaccguggcccugugggaccugagaaaccugaagcugaagcugcacaccuucgagagccacaaggacgagaucuuccaggugcacuggagcccccacaacgagaccauccuggccagcagcggcaccgacagaagacugaacgugugggaccugagcaagaucggcgaggagcagagcgccgaggacgccgaggacggcccccccgagcugcuguucauccacggcggccacaccgccaagaucagcgacuucagcuggaaccccaacgagcccugggugaucugcagcgugagcgaggacaacaucaugcagaucuggcagauggccgagaacaucuacaacgacgaggagagcgacgugaccaccagcgagcuggagggccagggcagcuaa

SEQ ID NO: 22469 - RNA, 2604 nt, Artificial Sequence
  RBBP8__Homo_sapiens__NP_976037
augaacaucagcggcagcagcugcggcagccccaacagcgccgacaccagcagcgacuucaaggaccuguggaccaagcugaaggagugccacgacagagaggugcagggccugcaggugaaggugaccaagcugaagcaggagagaauccuggacgcccagagacuggaggaguucuucaccaagaaccagcagcugagagagcagcagaaggugcugcacgagaccaucaaggugcuggaggacagacugagagccggccugugcgacagaugcgccgugaccgaggagcacaugagaaagaagcagcaggaguucgagaacaucagacagcagaaccugaagcugaucaccgagcugaugaacgagagaaacacccugcaggaggagaacaagaagcugagcgagcagcugcagcagaagaucgagaacgaccagcagcaccaggccgccgagcuggagugcgaggaggacgugauccccgacagccccaucaccgccuucagcuucagcggcgugaacagacugagaagaaaggagaacccccacgugagauacaucgagcagacccacaccaagcuggagcacagcgugugcgccaacgagaugagaaaggugagcaagagcagcacccacccccagcacaaccccaacgagaacgagauccugguggccgacaccuacgaccagagccagagccccauggccaaggcccacggcaccagcagcuacacccccgacaagagcagcuucaaccuggccaccgugguggccgagacccugggccugggcgugcaggaggagagcgagacccagggccccaugagcccccugggcgacgagcuguaccacugccuggagggcaaccacaagaagcagcccuucgaggagagcaccagaaacaccgaggacagccugagauucagcgacagcaccagcaagacccccccccaggaggagcugcccaccagagugagcagccccguguucggcgccaccagcagcaucaagagcggccuggaccugaacaccagccugagccccagccugcugcagcccggcaagaagaagcaccugaagacccugcccuucagcaacaccugcaucagcagacuggagaagaccagaagcaagagcgaggacagcgcccuguucacccaccacagccugggcagcgaggugaacaagaucaucauccagagcagcaacaagcagauccugaucaacaagaacaucagcgagagccugggcgagcagaacagaaccgaguacggcaaggacagcaacaccgacaagcaccuggagccccugaagagccugggcggcagaaccagcaagagaaagaagaccgaggaggagagcgagcacgaggugagcugcccccaggccagcuucgacaaggagaacgccuuccccuuccccauggacaaccaguucagcaugaacggcgacugcgugauggacaagccccuggaccugagcgacagauucagcgccauccagagacaggagaagagccagggcagcgagaccagcaagaacaaguucagacaggugacccuguacgaggcccugaagaccauccccaagggcuucagcagcagcagaaaggccagcgacggcaacugcacccugcccaaggacagccccggcgagcccugcagccaggagugcaucauccugcagccccugaacaagugcagccccgacaacaagcccagccugcagaucaaggaggagaacgccguguucaagaucccccugagacccagagagagccuggagaccgagaacgugcuggacgacaucaagagcgccggcagccacgagcccaucaagauccagaccagaagcgaccacggcggcugcgagcuggccagcgugcugcagcugaaccccugcagaaccggcaagaucaagagccugcagaacaaccaggacgugagcuucgagaacauccaguggagcaucgaccccggcgccgaccugagccaguacaagauggacgugaccgugaucgacaccaaggacggcagccagagcaagcugggcggcgagaccguggacauggacugcacccuggugagcgagaccgugcugcugaagaugaagaagcaggagcagaagggcgagaagagcagcaacgaggagagaaagaugaacgacagccuggaggacauguucgacagaaccacccacgaggaguacgagagcugccuggccgacagcuucagccaggccgccgacgaggaggaggagcugagcaccgccaccaagaagcugcacacccacggcgacaagcaggacaaggugaagcagaaggccuucguggagcccuacuucaagggcgacgagagcaucaugcagaucugccagcagaagaaggagaagagaaacuggcugcccgcccaggacaccgacagcgccaccuuccaccccacccaccagagaaucuucggcaagcugguguuccugccccugagacugguguggaaggaggugauccugagaaagauccugauccuggugcuggugcagaaggacgugagccugaccacccaguacuuccugcagaaggccagaagcagaagacacagaagauaa

SEQ ID NO: 22470 - RNA, 561 nt, Artificial Sequence
  RBBP9__Homo_sapiens__NP_006597
auggccagccccagcaaggccgugaucgugcccggcaacggcggcggcgacgugaccacccacggcugguacggcugggugaagaaggagcuggagaagauccccggcuuccagugccuggccaagaacaugcccgaccccaucaccgccagagagagcaucuggcugcccuucauggagaccgagcugcacugcgacgagaagaccaucaucaucggccacagcagcggcgccaucgccgccaugagauacgccgagacccacagaguguacgccaucgugcuggugagcgccuacaccagcgaccugggcgacgagaacgagagagccagcggcuacuucaccagacccuggcagugggagaagaucaaggccaacugccccuacaucgugcaguucggcagcaccgacgaccccuuccugcccuggaaggagcagcaggagguggccgacagacuggagaccaagcugcacaaguucaccgacugcggccacuuccagaacaccgaguuccacgagcugaucaccguggugaagagccugcugaaggugcccgccuaa

SEQ ID NO: 22471 - RNA, 1407 nt, Artificial Sequence
  RBCK1__Homo_sapiens__NP_006453
augggcaccgccacccccgacggcagagaggaccaggagagacugugggugagcguggaggacgcccagaugcacaccgugaccaucuggcugaccgugagacccgacaugaccguggccagccugaaggacaugguguuccuggacuacggcuucccccccgugcugcagcagugggugaucggccagagacuggccagagaccaggagacccugcacagccacggcgugagacagaacggcgacagcgccuaccuguaccugcugagcgccagaaacaccagccugaacccccaggagcugcagagagagagacagcugagaaugcuggaggaccugggcuucaaggaccugacccugcagcccagaggcccccuggagcccggcccccccaagcccggcgugccccaggagcccggcagaggccagcccgacgccgugcccgagcccccccccgugggcuggcagugccccggcugcaccuucaucaacaagcccaccagacccggcugcgagaugugcugcagagccagacccgaggccuaccaggugcccgccagcuaccagcccgacgaggaggagagagccagacuggccggcgaggaggaggcccugagacaguaccagcagagaaagcagcagcagcaggagggcaacuaccugcagcacgugcagcuggaccagagaagccuggugcugaacaccgagcccgccgagugccccgugugcuacagcgugcuggcccccggcgaggccguggugcugagagagugccugcacaccuucugcagagagugccugcagggcaccaucagaaacagccaggaggccgaggugagcugccccuucaucgacaacaccuacagcugcagcggcaagcugcuggagagagagaucaaggcccugcugacccccgaggacuaccagagauuccuggaccugggcaucagcaucgccgagaacagaagcgccuucagcuaccacugcaagacccccgacugcaagggcuggugcuucuucgaggacgacgugaacgaguucaccugccccgugugcuuccacgugaacugccugcugugcaaggccauccacgagcagaugaacugcaaggaguaccaggaggaccuggcccugagagcccagaacgacguggccgccagacagaccaccgagaugcugaaggugaugcugcagcagggcgaggccaugagaugcccccagugccagaucguggugcagaagaaggacggcugcgacuggaucagaugcaccgugugccacaccgagaucugcugggugaccaagggccccagauggggccccggcggccccggcgacaccagcggcggcugcagaugcagagugaacggcauccccugccaccccagcugccagaacugccacuaa

SEQ ID NO: 22472 - RNA, 1113 nt, Artificial Sequence
  RBFOX1__Homo_sapiens__NP_001135805
augaacugcgagagagagcagcugagaggcaaccaggaggccgccgccgcccccgacaccauggcccagcccuacgccagcgcccaguucgcccccccccagaacggcauccccgccgaguacaccgccccccacccccaccccgcccccgaguacaccggccagaccaccgugcccgagcacacccugaaccuguacccccccgcccagacccacagcgagcagagccccgccgacaccagcgcccagaccgugagcggcaccgccacccagaccgacgacgccgcccccaccgacggccagccccagacccagcccagcgagaacaccgagaacaagagccagcccaagagacugcacgugagcaacauccccuucagauucagagaccccgaccugagacagauguucggccaguucggcaagauccuggacguggagaucaucuucaacgagagaggcagcaagggcuucggcuucgugaccuucgagaacagcgccgacgccgacagagccagagagaagcugcacggcaccgugguggagggcagaaagaucgaggugaacaacgccaccgccagagugaugaccaacaagaagaccgugaaccccuacaccaacggcuggaagcugaaccccguggugggcgccguguacagccccgaguucuacgccgugcccggcuuccccuaccccgccgccaccgccgccgccgccuacagaggcgcccaccugagaggcagaggcagaaccguguacaacaccuucagagccgccgccccccccccccccauccccgccuacggcggcgugguguaccaggacggcuucuacggcgccgacaucuacggcggcuacgccgccuacagauacgcccagcccacccccgccaccgccgccgccuacagcgacagcuacggcagaguguacgccgccgaccccuaccaccacgcccuggcccccgcccccaccuacggcgugggcgccaugaacgccuucgccccccugaccgacgccaagaccagaagccacgccgacgacgugggccuggugcugagcagccugcaggccagcaucuacagaggcggcuacaacagauucgcccccuacuaa

SEQ ID NO: 22473 - RNA, 1143 nt, Artificial Sequence
  RBFOX2__Homo_sapiens__NP_001026865
auggagaagaagaagauggugacccagggcaaccaggagcccaccaccacccccgacgccauggugcagcccuucaccaccauccccuuccccccccccccccagaacggcauccccaccgaguacggcgugccccacacccaggacuacgccggccagaccggcgagcacaaccugacccuguacggcagcacccaggcccacggcgagcagagcagcaacagccccagcacccagaacggcagccugaccaccgagggcggcgcccagaccgacggccagcagagccagacccagagcagcgagaacagcgagagcaagagcacccccaagagacugcacgugagcaacauccccuucagauucagagaccccgaccugagacagauguucggccaguucggcaagauccuggacguggagaucaucuucaacgagagaggcagcaagggcuucggcuucgugaccuucgagaacagcgccgacgccgacagagccagagagaagcugcacggcaccgugguggagggcagaaagaucgaggugaacaacgccaccgccagagugaugaccaacaagaagauggugacccccuacgccaacggcuggaagcugagccccguggugggcgccguguacggccccgagcuguacgccgccagcagcuuccaggccgacgugagccugggcaacgacgccgccgugccccugagcggcagaggcggcaucaacaccuacaucccccugaucagccugccccuggugcccggcuuccccuaccccaccgccgccaccaccgccgccgccuucagaggcgcccaccugagaggcagaggcagaaccguguacggcgccgugagagccgugccccccaccgccauccccgccuaccccggcgugguguaccaggacggcuucuacggcgccgaccuguacggcggcuacgccgccuacagauacgcccagcccgccaccgccaccgccgccaccgccgccgccgccgccgccgccgccuacagcgacggcuacggcagaguguacaccgccgaccccuaccacgcccuggcccccgccgccagcuacggcgugggcgccguggccagccuguacagaggcggcuacagcagauucgcccccuacuaa

SEQ ID NO: 22474 - RNA, 939 nt, Artificial Sequence
  RBFOX3__Homo_sapiens__NP_001076044
auggcccagcccuacccccccgcccaguaccccccccccccccagaacggcauccccgccgaguacgcccccccccccccccaccccacccaggacuacagcggccagacccccgugcccaccgagcacggcaugacccuguacacccccgcccagacccaccccgagcagcccggcagcgaggccagcacccagcccaucgccggcacccagaccgugccccagaccgacgaggccgcccagaccgacagccagccccugcaccccagcgaccccaccgagaagcagcagcccaagagacugcacgugagcaacauccccuucagauucagagaccccgaccugagacagauguucggccaguucggcaagauccuggacguggagaucaucuucaacgagagaggcagcaagggcuucggcuucgugaccuucgagaccagcagcgacgccgacagagccagagagaagcugaacggcaccaucguggagggcagaaagaucgaggugaacaacgccaccgccagagugaugaccaacaagaagaccggcaaccccuacaccaacggcuggaagcugaaccccguggugggcgccguguacggccccgaguucuacgccgugaccggcuuccccuaccccaccaccggcaccgccguggccuacagaggcgcccaccugagaggcagaggcagagccguguacaacaccuucagagccgcccccccccccccccccauccccaccuacggcgccgugguguaccaggacggcuucuacggcgccgagaucuacggcggcuacgccgccuacagauacgcccagcccgccgccgccgccgccgccuacagcgacagcuacggcagaguguacgccgccgccgaccccuaccaccacaccaucggccccgccgccaccuacagcaucggcaccauguaa

SEQ ID NO: 22475 - RNA, 3207 nt, Artificial Sequence
  RBL1__Homo_sapiens__NP_002886
auguucgaggacaagccccacgccgagggcgccgccgugguggccgccgccggcgaggcccugcaggcccugugccaggagcugaaccuggacgagggcagcgccgccgaggcccuggacgacuucaccgccaucagaggcaacuacagccuggagggcgaggugacccacuggcuggccugcagccuguacguggccugcagaaagagcaucauccccaccgugggcaagggcaucauggagggcaacugcgugagccugaccagaauccugagaagcgccaagcugagccugauccaguucuucagcaagaugaagaaguggauggacaugagcaaccugccccaggaguucagagagagaaucgagagacuggagagaaacuucgaggugagcaccgugaucuucaagaaguacgagcccaucuuccuggacaucuuccagaaccccuacgaggagccccccaagcugcccagaagcagaaagcagagaagaauccccugcagcgugaaggaccuguucaacuucugcuggacccuguucguguacaccaagggcaacuucagaaugaucggcgacgaccuggugaacagcuaccaccugcugcugugcugccuggaccugaucuucgccaacgccaucaugugccccaacagacaggaccugcugaaccccagcuucaagggccugcccagcgacuuccacaccgccgacuucaccgccagcgaggagccccccugcaucaucgccgugcugugcgagcugcacgacggccugcugguggaggccaagggcaucaaggagcacuacuucaagcccuacaucagcaagcuguucgacagaaagauccugaagggcgagugccugcuggaccugagcagcuucaccgacaacagcaaggccgugaacaaggaguacgaggaguacgugcugaccgugggcgacuucgacgagagaaucuuccugggcgccgacgccgaggaggagaucggcacccccagaaaguucaccagagacaccccccugggcaagcugaccgcccaggccaacguggaguacaaccugcagcagcacuucgagaagaagagaagcuucgcccccagcaccccccugaccggcagaagauaccugagagagaaggaggccgugaucacccccguggccagcgccacccagagcgugagcagacugcagagcaucguggccggccugaagaacgcccccagcgaccagcugaucaacaucuucgagagcugcgugagaaaccccguggagaacaucaugaagauccugaagggcaucggcgagaccuucugccagcacuacacccagagcaccgacgagcagcccggcagccacaucgacuucgccgugaacagacugaagcuggccgagauccuguacuacaagauccuggagaccgugauggugcaggagaccagaagacugcacggcauggacaugagcgugcugcuggagcaggacaucuuccacagaagccugauggccugcugccuggagaucgugcuguucgccuacagcagccccagaaccuuccccuggaucaucgaggugcugaaccugcagcccuucuacuucuacaaggugaucgagguggugaucagaagcgaggagggccugagcagagacauggugaagcaccugaacagcaucgaggagcagauccuggagagccuggccuggagccacgacagcgcccugugggaggcccugcaggugagcgccaacaaggugcccaccugcgaggaggugaucuuccccaacaacuucgagaccggcaacggcggcaacgugcagggccaccugccccugaugcccaugagcccccugaugcaccccagagugaaggaggugagaaccgacagcggcagccugagaagagacaugcagccccugagccccaucagcgugcacgagagauacagcagccccaccgccggcagcgccaagagaagacuguucggcgaggacccccccaaggagaugcugauggacaagaucaucaccgagggcaccaagcugaagaucgcccccagcagcagcaucaccgccgagaacgugagcauccugcccggccagacccugcugaccauggccaccgcccccgugaccggcaccaccggccacaaggugaccaucccccugcacggcguggccaacgacgccggcgagaucacccugaucccccugagcaugaacaccaaccaggagagcaaggugaagagccccgugagccugaccgcccacagccugaucggcgccagccccaagcagaccaaccugaccaaggcccaggaggugcacagcaccggcaucaacagacccaagagaaccggcagccuggcccuguucuacagaaagguguaccaccuggccagcgugagacugagagaccugugccugaagcuggacgugagcaacgagcugagaagaaagaucuggaccugcuucgaguucacccuggugcacugccccgaccugaugaaggacagacaccuggaccagcugcugcugugcgccuucuacaucauggccaaggugaccaaggaggagagaaccuuccaggagaucaugaagagcuacagaaaccagccccaggccaacagccacguguacagaagcgugcugcugaagagcauccccagagaggugguggccuacaacaagaacaucaacgacgacuucgagaugaucgacugcgaccuggaggacgccaccaagacccccgacugcagcagcggccccgugaaggaggagagaggcgaccugaucaaguucuacaacaccaucuacgugggcagagugaagagcuucgcccugaaguacgaccuggccaaccaggaccacaugauggacgcccccccccugagccccuucccccacaucaagcagcagcccggcagccccagaagaaucagccagcagcacagcaucuacaucagcccccacaagaacggcagcggccugacccccagaagcgcccugcuguacaaguucaacggcagccccagcaagagccugaaggacaucaacaacaugaucagacagggcgagcagagaaccaagaagagagugaucgccaucgacagcgacgccgagagccccgccaagagagugugccaggagaacgacgacgugcugcugaagagacugcaggacguggugagcgagagagccaaccacuaa

SEQ ID NO: 22476 - RNA, 3198 nt, Artificial Sequence
  RBL2__Homo_sapiens__XP_005256140
augcagagccugaccaagggcaacgaccugcacuggcuggccugcgcccuguacguggccugcagaaagagcgugcccaccgugagcaagggcaccguggagggcaacuacgugagccugaccagaauccugaagugcagcgagcagagccugaucgaguucuucaacaagaugaagaagugggaggacauggccaaccugcccccccacuucagagagagaaccgagagacuggagagaaacuucaccgugagcgccgugaucuucaagaaguacgagcccaucuuccaggacaucuucaaguacccccaggaggagcagcccagacagcagagaggcagaaagcagagaagacagcccugcaccgugagcgagaucuuccacuucugcugggugcuguucaucuacgccaagggcaacuuccccaugaucagcgacgaccuggugaacagcuaccaccugcugcugugcgcccuggaccugguguacggcaacgcccugcagugcagcaacagaaaggagcuggugaaccccaacuucaagggccugagcgaggacuuccacgccaaggacagcaagcccagcagcgacccccccugcaucaucgagaagcugugcagccugcacgacggccuggugcuggaggccaagggcaucaaggagcacuucuggaagcccuacaucagaaagcuguacgagaagaagcugcugaagggcaaggaggagaaccugaccggcuuccuggagcccggcaacuucggcgagagcuucaaggccaucaacaaggccuacgaggaguacgugcugagcgugggcaaccuggacgagagaaucuuccugggcgaggacgccgaggaggagaucggcacccugagcagaugccugaacgccggcagcggcaccgagaccgccgagagagugcagaugaagaacauccugcagcagcacuucgacaagagcaaggcccugagaaucagcaccccccugaccggcgugagauacaucaaggagaacagccccugcgugacccccgugagcaccgccacccacagccugagcagacugcacaccaugcugaccggccugagaaacgcccccagcgagaagcuggagcagauccugagaaccugcagcagagaccccacccaggccaucgccaacagacugaaggagauguucgagaucuacagccagcacuuccagcccgacgaggacuucagcaacugcgccaaggagaucgccagcaagcacuucagauucgccgagaugcuguacuacaaggugcuggagagcgugaucgagcaggagcagaagagacugggcgacauggaccugagcggcauccuggagcaggacgccuuccacagaagccugcuggccugcugccuggagguggugaccuucagcuacaagccccccggcaacuuccccuucaucaccgagaucuucgacgugccccuguaccacuucuacaaggugaucgagguguucaucagagccgaggacggccugugcagagagguggugaagcaccugaaccagaucgaggagcagauccuggaccaccuggccuggaagcccgagagcccccugugggagaagaucagagacaacgagaacagagugcccaccugcgaggaggugaugcccccccagaaccuggagagagccgacgagaucugcaucgccggcagcccccugacccccagaagagugaccgaggugagagccgacaccggcggccugggcagaagcaucaccagccccaccacccuguacgacagauacagcagcccccccgccagcaccaccagaagaagacuguucguggagaacgacagccccagcgacggcggcacccccggcagaaugcccccccagccccuggugaacgccgugcccgugcagaacgugagcggcgagaccgugagcgugacccccgugcccggccagacccuggugaccauggccaccgccaccgugaccgccaacaacggccagaccgugaccauccccgugcagggcaucgccaacgagaacggcggcaucaccuucuuccccgugcaggugaacgugggcggccaggcccaggccgugaccggcagcauccagccccugagcgcccaggcccuggccggcagccugagcagccagcaggugaccggcaccacccugcaggugcccggccagguggccauccagcagaucagccccggcggccagcagcagaagcagggccagagcgugaccagcagcagcaacagacccagaaagaccagcagccugagccuguucuucagaaagguguaccaccuggccgccgugagacugagagaccugugcgccaagcuggacaucagcgacgagcugagaaagaagaucuggaccugcuucgaguucagcaucauccagugccccgagcugaugauggacagacaccuggaccagcugcugaugugcgccaucuacgugauggccaaggugaccaaggaggacaagagcuuccagaacaucaugagaugcuacagaacccagccccaggccagaagccagguguacagaagcgugcugaucaagggcaagagaaagagaagaaacagcggcagcagcgacagcagaagccaccagaacagccccaccgagcugaacaaggacagaaccagcagagacagcagccccgugaugagaagcagcagcacccugcccgugccccagcccagcagcgccccccccacccccaccagacugaccggcgccaacagcgacauggaggaggaggagagaggcgaccugauccaguucuacaacaacaucuacaucaagcagaucaagaccuucgccaugaaguacagccaggccaacauggacgcccccccccugagccccuaccccuucgugagaaccggcagccccagaagaauccagcugagccagaaccaccccguguacaucagcccccacaagaacgagaccaugcugagccccagagagaagaucuucuacuacuucagcaacagccccagcaagagacugagagagaucaacagcaugaucagaaccggcgagacccccaccaagaagagaggcauccugcuggaggacggcagcgagagccccgccaagagaaucugccccgagaaccacagcgcccugcugagaagacugcaggacguggccaacgacagaggcagccacuaa

SEQ ID NO: 22477 - RNA, 2988 nt, Artificial Sequence
  RBM10__Homo_sapiens__NP_001191397
augagcggcagccccagccugaccgccagagccgagaaggugagcguggacgccggcagaggcggcggcgagagccugcaggaggccagccccagacuggccgaccacggcagcagcagcggcggcggcugggaggugaagagaagccagagacugagaagaggccccagcagccccagaagacccuaccaggacauggaguacgagagaagaggcggcagaggcgacagaaccggcagauacggcgccaccgacagaagccaggacgacggcggcgagaacagaagcagagaccacgacuacagagacauggacuacagaagcuaccccagagaguacggcagccaggagggcaagcacgacuacgacgacagcagcgaggagcagagcgccgaggacagcuacgaggccagccccggcagcgagacccagagaagaagaagaagaagacacagacacagccccaccggcccccccggcuuccccagagacggcgacuacagagaccaggacuacagaaccgagcagggcgaggaggaggaggaggaggaggacgaggaggaggaggagaaggccagcaacaucgugaugcugagaaugcugccccaggccgccaccgaggacgacaucagaggccagcugcagagccacggcgugcaggccagagaggugagacugaugagaaacaagagcagcggccagagcagaggcuucgccuucguggaguucagccaccugcaggacgccaccagauggauggaggccaaccagcacagccugaacauccugggccagaaggugagcaugcacuacagcgaccccaagcccaagaucaacgaggacuggcugugcaacaagugcggcgugcagaacuucaagagaagagagaagugcuucaagugcggcgugcccaagagcgaggccgagcagaagcugccccugggcaccagacuggaccagcagacccugccccugggcggcagagagcugagccagggccugcugccccugccccagcccuaccaggcccagggcgugcuggccagccaggcccugagccagggcagcgagcccagcagcgagaacgccaacgacaccaucauccugagaaaccugaacccccacagcaccauggacagcauccugggcgcccuggcccccuacgccgugcugagcagcagcaacgugagagugaucaaggacaagcagacccagcugaacagaggcuucgccuucauccagcugagcaccaucguggaggccgcccagcugcugcagauccugcaggcccugcaccccccccugaccaucgacggcaagaccaucaacguggaguucgccaagggcagcaagagagacauggccagcaacgagggcagcagaaucagcgccgccagcguggccagcaccgccaucgccgccgcccagugggccaucagccaggccagccagggcggcgagggcaccugggccaccagcgaggagccccccguggacuacagcuacuaccagcaggacgagggcuacggcaacagccagggcaccgagagcagccuguacgcccacggcuaccugaagggcaccaagggccccggcaucaccggcaccaagggcgaccccaccggcgccggccccgaggccagccuggagcccggcgccgacagcgugagcaugcaggccuucagcagagcccagcccggcgccgcccccggcaucuaccagcagagcgccgaggccagcagcagccagggcaccgccgccaacagccagagcuacaccaucaugagccccgccgugcugaagagcgagcugcagagccccacccaccccagcagcgcccugccccccgccaccagccccaccgcccaggagagcuacagccaguaccccgugcccgacgugagcaccuaccaguacgacgagaccagcggcuacuacuacgacccccagaccggccuguacuacgaccccaacagccaguacuacuacaacgcccagagccagcaguaccuguacugggacggcgagagaagaaccuacgugcccgcccuggagcagagcgccgacggccacaaggagaccggcgcccccagcaaggagggcaaggagaagaaggagaagcacaagaccaagaccgcccagcagaucgccaaggacauggagagaugggccagaagccugaacaagcagaaggagaacuucaagaacagcuuccagcccaucagcagccugagagacgacgagagaagagagagcgccaccgccgacgccggcuacgccauccuggagaagaagggcgcccuggccgagagacagcacaccagcauggaccugcccaagcuggccagcgacgacagacccagcccccccagaggccugguggccgccuacagcggcgagagcgacagcgaggaggagcaggagagaggcggccccgagagagaggagaagcugaccgacuggcagaagcuggccugccugcugugcagaagacaguuccccagcaaggaggcccugaucagacaccagcagcugagcggccugcacaagcagaaccuggagauccacagaagagcccaccugagcgagaacgagcuggaggcccuggagaagaacgacauggagcagaugaaguacagagacagagccgccgagagaagagagaaguacggcauccccgagccccccgagcccaagagaagaaaguacggcggcaucagcaccgccagcguggacuucgagcagcccaccagagacggccugggcagcgacaacaucggcagcagaaugcugcaggccaugggcuggaaggagggcagcggccugggcagaaagaagcagggcaucgugacccccaucgaggcccagaccagagugagaggcagcggccugggcgccagaggcagcagcuacggcgugaccagcaccgagagcuacaaggagacccugcacaagaccauggugaccagauucaacgaggcccaguaa

SEQ ID NO: 22478 - RNA, 2799 nt, Artificial Sequence
  RBM12__Homo_sapiens__NP_001185769
auggccguggugaucagacugcagggccugcccaucguggccggcaccauggacaucagacacuucuucagcggccugaccauccccgacggcggcgugcacaucgugggcggcgagcugggcgaggccuucaucguguucgccaccgacgaggacgccagacugggcaugaugagaaccggcggcaccaucaagggcagcaaggugacccugcugcugagcagcaagaccgagaugcagaacaugaucgagcugagcagaagaagauucgagaccgccaaccuggacaucccccccgccaacgccagcagaagcggccccccccccagcagcggcaugagcagcagagugaaccugcccaccaccgugagcaacuucaacaaccccagccccagcguggugaccgccaccaccagcgugcacgagagcaacaagaacauccagaccuucagcaccgccagcgugggcaccgccccccccaacaugggcgccagcuucggcagccccaccuucagcagcaccgugcccagcaccgccagccccaugaacaccgugccccccccccccaucccccccauccccgccaugcccagccugccccccaugcccagcaucccccccauccccgugcccccccccgugcccacccugccccccgugccccccgugccccccaucccccccgugcccagcgugccccccaugaccccccugccccccaugagcggcaugcccccccugaaccccccccccguggccccccugcccgccggcaugaacggcagcggcgcccccaugaaccugaacaacaaccugaaccccauguuccugggcccccugaaccccgugaaccccauccagaugaacagccagagcagcgugaagccccugcccaucaaccccgacgaccuguacgugagcgugcacggcaugcccuucagcgccauggagaacgacgugagagacuucuuccacggccugagaguggacgccgugcaccugcugaaggaccacgugggcagaaacaacggcaacggccuggugaaguuccugagcccccaggacaccuucgaggcccugaagagaaacagaaugcugaugauccagagauacguggaggugagccccgccaccgagagacaguggguggccgccggcggccacaucaccuucaagcagaacaugggccccagcggccagacccacccccccccccagacccugcccagaagcaagagccccagcggccagaagagaagcagaagcagaagcccccacgaggccggcuucugcguguaccugaagggccugcccuucgaggccgagaacaagcacgugaucgacuucuucaagaagcuggacaucguggaggacagcaucuacaucgccuacggccccaacggcaaggccaccggcgagggcuucguggaguucagaaacgaggccgacuacaaggccgcccugugcagacacaagcaguacaugggcaacagauucauccaggugcaccccaucaccaagaagggcaugcuggagaagaucgacaugaucagaaagagacugcagaacuucagcuacgaccagagagagaugauccugaaccccgagggcgacgugaacagcgccaaggugugcgcccacaucaccaacauccccuucagcaucaccaagauggacgugcugcaguuccuggagggcauccccguggacgagaacgccgugcacgugcugguggacaacaacggccagggccugggccaggcccuggugcaguucaagaacgaggacgacgccagaaagagcgagagacugcacagaaagaagcugaacggcagagaggccuucgugcacguggugacccuggaggacaugagagagaucgagaagaacccccccgcccagggcaagaagggccugaagaugcccgugcccggcaaccccgccgugcccggcaugcccaacgccggccugcccggcgugggccugcccagcgccggccugcccggcgccggccugcccagcaccggccugcccggcagcgccaucaccagcgccggccugcccggcgccggcaugcccagcgccggcauccccagcgccggcggcgaggagcacgccuuccugaccgugggcagcaaggaggccaacaacggcccccccuucaacuuccccggcaacuucggcggcagcaacgccuucggcccccccauccccccccccggccugggcggcggcgccuucggcgacgccagacccggcaugcccagcgugggcaacagcggccugcccggccugggccuggacgugcccggcuucggcggcggccccaacaaccugagcggccccagcggcuucggcggcggcccccagaacuucggcaacggccccggcagccugggcggcccccccggcuucggcagcggcccccccggccugggcagcgcccccggccaccugggcggcccccccgccuucggccccggccccggccccggccccggccccggccccauccacaucggcggcccccccggcuucgccagcagcagcggcaagcccggccccaccgugaucaaggugcagaacaugcccuucaccgugagcaucgacgagauccuggacuucuucuacggcuaccaggugauccccggcagcgugugccugaaguacaacgagaagggcaugcccaccggcgaggccaugguggccuucgagagcagagacgaggccaccgccgccgugaucgaccugaacgacagacccaucggcagcagaaaggugaagcuggugcugggcuaa

SEQ ID NO: 22479 - RNA, 471 nt, Artificial Sequence
  RBM14__Homo_sapiens__NP_001185765
augaagaucuucgugggcaacguggacggcgccgacaccacccccgaggagcuggccgcccuguucgcccccuacggcaccgugaugagcugcgccgugaugaagcaguucgccuucgugcacaugagagagaacgccggcgcccugagagccaucgaggcccugcacggccacgagcugagacccggcagagcccuggugguggagaugagcagacccagaccccugaacaccuggaagaucuucgugggcaacgugagcgccgccugcaccagccaggagcugagaagccuguucgagagaagaggcagagugaucgagugcgacguggugaaggacuacgccuucgugcacauggagaaggaggccgacgccaaggccgccaucgcccagcugaacggcaaggaggugaagggcaagagaaucaacguggagcugagcaccaagggcauggugcccaccggcguguaa

SEQ ID NO: 22480 - RNA, 1020 nt, Artificial Sequence
  RBM14-RBM4__Homo_sapiens__NP_001185774
augaagaucuucgugggcaacguggacggcgccgacaccacccccgaggagcuggccgcccuguucgcccccuacggcaccgugaugagcugcgccgugaugaagcaguucgccuucgugcacaugagagagaacgccggcgcccugagagccaucgaggcccugcacggccacgagcugagacccggcagagcccuggugguggagaugagcagacccagaccccugaacaccuggaagaucuucgugggcaacgugagcgccgccugcaccagccaggagcugagaagccuguucgagagaagaggcagagugaucgagugcgacguggugaagggcaagagaaugcacgugcagcugagcaccagcagacugagaaccgcccccggcaugggcgaccagagcggcugcuacagaugcggcaaggagggccacuggagcaaggagugccccaucgacagaagcggcagaguggccgaccugaccgagcaguacaacgagcaguacggcgccgugagaacccccuacaccaugagcuacggcgacagccuguacuacaacaacgccuacggcgcccuggacgccuacuacaagagaugcagagccgccagaagcuacgaggccguggccgccgccgccgccagcguguacaacuacgccgagcagacccugagccagcugccccaggugcagaacaccgccauggccagccaccugaccagcaccagccuggaccccuacgacagacaccugcugcccaccagcggcgccgccgccaccgccgccgccgccgccgccgccgccgccgccgugaccgccgccagcaccagcuacuacggcagagacagaagcccccugagaagagccaccgcccccgugcccaccgugggcgagggcuacggcuacggccacgagagcgagcugagccaggccagcgccgccgccagaaacagccuguacgacauggccagauacgagagagagcaguacgccgacagagccagauacagcgccuucuaa

SEQ ID NO: 22481 - RNA, 2934 nt, Artificial Sequence
  RBM15__Homo_sapiens__XP_011540270
augagaaccgccggcagagaccccgugcccagaagaagccccagauggagaagagccgugccccugugcgagaccagcgccggcagaagagugacccagcugagaggcgacgaccugagaagacccgccaccaugaagggcaaggagagaagccccgugaaggccaagagaagcagaggcggcgaggacagcaccagcagaggcgagagaagcaagaagcugggcggcagcggcggcagcaacggcagcagcagcggcaagaccgacagcggcggcggcagcagaagaagccugcaccuggacaagagcagcagcagaggcggcagcagagaguacgacaccggcggcggcagcagcagcagcagacugcacagcuacagcagccccagcaccaagaacagcagcggcggcggcgagagcagaagcagcagcagaggcggcggcggcgagagcagaagcagcggcgccgccagcagcgcccccggcggcggcgacggcgccgaguacaagacccugaagaucagcgagcugggcagccagcugagcgacgaggccguggaggacggccuguuccacgaguucaagagauucggcgacgugagcgugaagaucagccaccugagcggcagcggcagcggcgacgagagaguggccuucgugaacuucagaagacccgaggacgccagagccgccaagcacgccagaggcagacuggugcuguacgacagaccccugaagaucgaggccguguacgugagcagaagaagaagcagaagcccccuggacaaggacaccuacccccccagcgccagcguggugggcgccagcgugggcggccacagacacccccccggcggcggcggcggccagagaagccugagccccggcggcgccgcccugggcuacagagacuacagacugcagcagcuggcccugggcagacugccccccccccccccccccccccugcccagagaccuggagagagagagagacuaccccuucuacgagagagugagacccgccuacagccuggagcccagagugggcgccggcgccggcgccgcccccuucagagagguggacgagaucagccccgaggacgaccagagagccaacagaacccuguuccugggcaaccuggacaucaccgugaccgagagcgaccugagaagagccuucgacagauucggcgugaucaccgagguggacaucaagagacccagcagaggccagaccagcaccuacggcuuccugaaguucgagaaccuggacaugagccacagagccaagcuggccaugagcggcaagaucaucaucagaaaccccaucaagaucggcuacggcaaggccacccccaccaccagacugugggugggcggccugggccccugggugccccuggccgcccuggccagagaguucgacagauucggcaccaucagaaccaucgacuacagaaagggcgacagcugggccuacauccaguacgagagccuggacgccgcccacgccgccuggacccacaugagaggcuucccccugggcggccccgacagaagacugagaguggacuucgccgacaccgagcacagauaccagcagcaguaccugcagccccugccccugacccacuacgagcuggugaccgacgccuucggccacagagcccccgacccccugagaggcgccagagacagaacccccccccugcuguacagagacagagacagagaccuguaccccgacagcgacugggugcccccccccccccccgugagagagagaagcaccagaaccgccgccaccagcgugcccgccuacgagccccuggacagccuggacagaagaagagacggcuggagccuggacagagacagaggcgacagagaccugcccagcagcagagaccagcccagaaagagaagacugcccgaggagagcggcggcagacaccuggacagaagccccgagagcgacagacccagaaagagacacugcgcccccagccccgacagaagccccgagcugagcagcagcagagacagauacaacagcgacaacgacagaagcagcagacugcugcuggagagacccagccccaucagagacagaagaggcagccuggagaagagccagggcgacaagagagacagaaagaacagcgccagcgccgagagagacagaaagcacagaaccaccgcccccaccgagggcaagagcccccugaagaaggaggacagaagcgacggcagcgcccccagcaccagcaccgccagcagcaagcugaagagccccagccagaagcaggacggcggcaccgcccccguggccagcgccagccccaagcugugccuggccuggcagggcaugcugcugcugaagaacagcaacuuccccagcaacaugcaccugcugcagggcgaccugcagguggccagcagccugcugguggagggcagcaccggcggcaagguggcccagcugaagaucacccagagacugagacuggaccagcccaagcuggacgaggugaccagaagaaucaagguggccggccccaacggcuacgccauccugcuggccgugcccggcagcagcgacagcagaagcagcagcagcagcgccgccagcgacaccgccaccagcacccagagaccccugagaaaccuggugagcuaccugaagcagaagcaggccgccggcgugaucagccugcccgugggcggcaacaaggacaaggagaacaccggcgugcugcacgccuucccccccugcgaguucagccagcaguuccuggacagccccgccaaggcccuggccaagagcgaggaggacuaccuggugaugaucaucgugagaggcuucggcuuccagaucggcgugagauacgagaacaagaagagagagaaccuggcccugacccugcuguaa

SEQ ID NO: 22482 - RNA, 1206 nt, Artificial Sequence
  RBM17__Homo_sapiens__NP_001139019
augagccuguacgacgaccugggcguggagaccagcgacagcaagaccgagggcuggagcaagaacuucaagcugcugcagagccagcugcaggugaagaaggccgcccugacccaggccaagagccagagaaccaagcagagcaccgugcuggcccccgugaucgaccugaagagaggcggcagcagcgacgacagacagaucguggacacccccccccacguggccgccggccugaaggaccccgugcccagcggcuucagcgccggcgaggugcugaucccccuggccgacgaguacgaccccauguuccccaacgacuacgagaagguggugaagagacagagagaggagagacagagacagagagagcuggagagacagaaggagaucgaggagagagagaagagaagaaaggacagacacgaggccagcggcuucgccagaagacccgaccccgacagcgacgaggacgaggacuacgagagagagagaagaaagagaagcaugggcggcgccgccaucgccccccccaccagccugguggagaaggacaaggagcugcccagagacuuccccuacgaggaggacagcagacccagaagccagagcagcaaggccgccauccccccccccguguacgaggagcaggacagacccagaagccccaccggccccagcaacagcuuccuggccaacaugggcggcaccguggcccacaagaucaugcagaaguacggcuucagagagggccagggccugggcaagcacgagcagggccugagcaccgcccugagcguggagaagaccagcaagagaggcggcaagaucaucgugggcgacgccaccgagaaggacgccagcaagaagagcgacagcaacccccugaccgagauccugaagugccccaccaagguggugcugcugagaaacauggugggcgccggcgagguggacgaggaccuggagguggagaccaaggaggagugcgagaaguacggcaaggugggcaagugcgugaucuucgagauccccggcgcccccgacgacgaggccgugagaaucuuccuggaguucgagagaguggagagcgccaucaaggccgugguggaccugaacggcagauacuucggcggcagaguggugaaggccugcuucuacaaccuggacaaguucagagugcuggaccuggccgagcagguguaa

SEQ ID NO: 22483 - RNA, 3684 nt, Artificial Sequence
  RBM20__Homo_sapiens__NP_001127835
auggugcuggccgccgccaugagccaggacgccgaccccagcggccccgagcagcccgacagaguggccugcagcgugcccggcgccagagccagccccgcccccagcggccccagaggcaugcagcagccccccccccccccccagccccccccccccccccaggccggccugccccagaucauccagaacgccgccaagcugcuggacaagaaccccuucagcgugagcaaccccaacccccugcugcccagccccgccagccugcagcuggcccagcugcaggcccagcugacccugcacagacugaagcuggcccagaccgccgugaccaacaacaccgccgccgccaccgugcugaaccaggugcugagcaagguggccaugagccagccccuguucaaccagcugagacaccccagcgugaucaccggcccccacggccacgccggcgugccccagcacgccgccgccauccccagcaccagauuccccagcaacgccaucgccuucagcccccccagccagaccagaggccccggccccagcaugaaccugcccaaccagccccccagcgccauggugaugcaccccuucaccggcgugaugccccagacccccggccagcccgccgugauccugggcaucggcaagaccggccccgcccccgccaccgccggcuucuacgaguacggcaaggccagcagcggccagaccuacggccccgagaccgacggccagcccggcuuccugcccagcagcgccagcaccagcggcagcgugaccuacgagggccacuacagccacaccggccaggacggccaggccgccuucagcaaggacuucuacggccccaacagccagggcagccacguggccagcggcuuccccgccgagcaggccggcggccugaagagcgaggugggcccccugcugcagggcaccaacagccagugggagagcccccacggcuucagcggccagagcaagcccgaccugaccgccggccccauguggccccccccccacaaccagcccuacgagcuguacgaccccgaggagcccaccagcgacagaaccccccccagcuucggcggcagacugaacaacagcaagcagggcuucaucggcgccggcagaagagccaaggaggaccaggcccugcugagcgugagaccccugcaggcccacgagcugaacgacuuccacggcguggccccccugcaccugccccacaucugcagcaucugcgacaagaagguguucgaccugaaggacugggagcugcacgugaagggcaagcugcacgcccagaagugccugguguucagcgagaacgccggcaucagaugcauccugggcagcgccgagggcacccugugcgccagccccaacagcaccgccguguacaaccccgccggcaacgaggacuacgccagcaaccugggcaccagcuacgugcccauccccgccagaagcuucacccagagcagccccaccuucccccuggccagcgugggcaccaccuucgcccagagaaagggcgccggcagaguggugcacaucugcaaccugcccgagggcagcugcaccgagaacgacgugaucaaccugggccugcccuucggcaaggugaccaacuacauccugaugaagagcaccaaccaggccuuccuggagauggccuacaccgaggccgcccaggccauggugcaguacuaccaggagaagagcgccgugaucaacggcgagaagcugcugaucagaaugagcaagagauacaaggagcugcagcugaagaagcccggcaaggccguggccgccaucauccaggacauccacagccagagagagagagacauguucagagaggccgacagauacggccccgagagacccagaagcagaagccccgugagcagaagccugagccccagaagccacacccccagcuucaccagcugcagcagcagccacagcccccccggccccagcagagccgacuggggcaacggcagagacagcugggagcacagccccuacgccagaagagaggaggagagagaccccgcccccuggagagacaacggcgacgacaagagagacagaauggaccccugggcccacgacagaaagcaccaccccagacagcuggacaaggccgagcuggacgagagacccgagggcggcagaccccacagagagaaguaccccagaagcggcagccccaaccugccccacagcgugagcagcuacaagagcagagaggacggcuacuacagaaaggagcccaaggccaagagcgacaaguaccugaagcagcagcaggacgcccccggcagaagcagaagaaaggacgaggccagacugagagagagcagacacccccaccccgacgacagcggcaaggaggacggccugggccccaaggugaccagagcccccgagggcgccaaggccaagcagaacgagaagaacaagaccaagagaaccgacagagaccaggagggcgccgacgacagaaaggagaacaccauggccgagaacgaggccggcaaggaggagcaggagggcauggaggagagcccccagagcgugggcagacaggagaaggaggccgaguucagcgaccccgagaacaccagaaccaagaaggagcaggacugggagagcgagagcgaggccgagggcgagagcugguaccccaccaacauggaggagcuggugaccguggacgaggugggcgaggaggaggacuucaucguggagcccgacauccccgagcuggaggagaucgugcccaucgaccagaaggacaagaucugccccgagaccugccugugcgugaccaccacccuggaccuggaccuggcccaggacuuccccaaggagggcgugaaggccgugggcaacggcgccgccgagaucagccugaagagccccagagagcugcccagcgccagcaccagcugccccagcgacauggacguggagaugcccggccugaaccuggacgccgagagaaagcccgccgagagcgagaccggccugagccuggaggacagcgacugcuacgagaaggaggccaagggcguggagagcagcgacgugcaccccgcccccaccgugcagcagaugagcagccccaagcccgccgaggagagagccagacagcccagccccuucguggacgacugcaagaccagaggcacccccgaggacggcgccugcgagggcagcccccuggaggagaaggccagcccccccaucgagaccgaccugcagaaccaggccugccaggaggugcugacccccgagaacagcagauacguggagaugaagagccuggaggugagaagccccgaguacaccgagguggagcugaagcagccccugagccugcccagcugggagcccgaggacguguucagcgagcugagcaucccccugggcguggaguucguggugcccagaaccggcuucuacugcaagcugugcggccuguucuacaccagcgaggagaccgccaagaugagccacugcagaagcgccgugcacuacagaaaccugcagaaguaccugagccagcuggccgaggagggccugaaggagaccgagggcgccgacagccccagacccgaggacagcggcaucgugcccagauucgagagaaagaagcuguaa

SEQ ID NO: 22484 - RNA, 2532 nt, Artificial Sequence
  RBM25__Homo_sapiens__XP_011535346
augagcuuccccccccaccugaacagaccccccaugggcauccccgcccugccccccggcaucccccccccccaguuccccggcuuccccccccccgugccccccggcacccccaugauccccgugcccaugagcaucauggcccccgcccccaccgugcuggugcccaccgugagcauggugggcaagcaccugggcgccagaaaggaccaccccggccugaaggccaaggagaacgacgagaacugcggccccaccaccaccguguucgugggcaacaucagcgagaaggccagcgacaugcugaucagacagcugcuggccaagugcggccuggugcugagcuggaagagagugcagggcgccagcggcaagcugcaggccuucggcuucugcgaguacaaggagcccgagagcacccugagagcccugagacugcugcacgaccugcagaucggcgagaagaagcugcuggugaagguggacgccaagaccaaggcccagcuggacgaguggaaggccaagaagaaggccagcaacggcaacgccagacccgagaccgugaccaacgacgacgaggaggcccuggacgaggagaccaagagaagagaccagaugaucaagggcgccaucgaggugcugaucagagaguacagcagcgagcugaacgcccccagccaggagagcgacagccaccccagaaagaagaagaaggagaagaaggaggacaucuucagaagauuccccguggccccccugauccccuacccccugaucaccaaggaggacaucaacgccaucgagauggaggaggacaagagagaccugaucagcagagagaucagcaaguucagagacacccacaagaagcuggaggaggagaagggcaagaaggagaaggagagacaggagaucgagaaggagagaagagagagagagagagagagagagagagagagagagagaagagagagagagagagagagagagagagagagagagagagagaaggagaaggagagagagagagagagagagagagacagagacagagacagaaccaaggagagagacagagacagagacagagagagagacagagacagagacagagagagaagcagcgacagaaacaaggacagaagcagaagcagagagaagagcagagacagagagagagagagagagagagagagagagagagagagagagagagagagagagagagagagagagagagagagagagagagagagagagagagagagagagagagagaaggacaagaagagagacagagaggaggacgaggaggacgccuacgagagaagaaagcuggagagaaagcugagagagaaggaggccgccuaccaggagagacugaagaacugggagaucagagagagaaagaagaccagagaguacgagaaggaggccgagagagaggaggagagaagaagagagauggccaaggaggccaagagacugaaggaguuccuggaggacuacgacgacgacagagacgaccccaaguacuacagaggcagcgcccugcagaagagacugagagacagagagaaggagauggaggccgacgagagagacagaaagagagagaaggaggagcuggaggagaucagacagagacugcuggccgagggccaccccgaccccgacgccgagcugcagagaauggagcaggaggccgagagaagaagacagccccagaucaagcaggagcccgagagcgaggaggaggaggaggagaagcaggagaaggaggagaagagagaggagcccauggaggaggaggaggagcccgagcagaagcccugccugaagcccacccugagacccaucagcagcgcccccagcgugagcagcgccagcggcaacgccacccccaacacccccggcgacgagagccccugcggcaucaucaucccccacgagaacagccccgaccagcagcagcccgaggagcacagacccaagaucggccugagccugaagcugggcgccagcaacagccccggccagcccaacagcgugaagagaaagaagcugcccguggacagcguguucaacaaguucgaggacgaggacagcgacgacgugcccagaaagagaaagcuggugccccuggacuacggcgaggacgacaagaacgccaccaagggcaccgugaacaccgaggagaagagaaagcacaucaagagccugaucgagaagauccccaccgccaagcccgagcuguucgccuacccccuggacuggagcaucguggacagcauccugauggagagaagaaucagacccuggaucaacaagaagaucaucgaguacaucggcgaggaggaggccacccugguggacuucgugugcagcaaggugauggcccacagcagcccccagagcauccuggacgacguggccauggugcuggacgaggaggccgagguguucaucgugaagauguggagacugcugaucuacgagaccgaggccaagaagaucggccuggugaaguaa

SEQ ID NO: 22485 - RNA, 2952 nt, Artificial Sequence
  RBM26__Homo_sapiens__NP_001273561
auggugagcaagaugaucaucgagaacuucgaggcccugaagagcuggcugagcaagacccuggagcccaucugcgacgccgaccccagcgcccuggccaaguacgugcuggcccuggugaagaaggacaagagcgagaaggagcugaaggcccugugcaucgaccagcuggacguguuccugcagaaggagacccagaucuucguggagaagcuguucgacgccgugaacaccaagagcuaccugcccccccccgagcagcccagcagcggcagccugaagguggaguucuucccccaccaggagaaggacaucaagaaggaggagaucaccaaggaggaggagagagagaagaaguucagcagaagacugaaccacagccccccccagagcagcagcagauacagagagaacagaagcagagacgagagaaagaaggacgacagaagcagaaagagagacuacgacagaaacccccccagaagagacagcuacagagacagauacaacagaagaagaggcagaagcagaagcuacagcagaagcagaagcagaagcuggagcaaggagagacugagagagagagacagagacagaagcagaaccagaagcagaagcagaaccagaagcagagagagagaccuggugaagcccaaguacgaccuggacagaaccgacccccuggagaacaacuacacccccgugagcagcgugcccagcaucagcagcggccacuaccccgugcccacccugagcagcaccaucaccgugaucgcccccacccaccacggcaacaacaccaccgagagcuggagcgaguuccacgaggaccagguggaccacaacagcuacgugagaccccccaugcccaagaagagaugcagagacuacgacgagaagggcuucugcaugagaggcgacaugugccccuucgaccacggcagcgaccccguggugguggaggacgugaaccugcccggcaugcugcccuuccccgcccagccccccgugguggagggcccccccccccccggccugcccccccccccccccauccugacccccccccccgugaaccugagaccccccgugcccccccccggcccccugccccccagccugccccccgugaccggccccccccccccccugcccccccugcagcccagcggcauggacgccccccccaacagcgccaccagcagcgugcccaccguggugaccaccggcauccaccaccagcccccccccgccccccccagccuguucaccgccgacaccuacgacaccgacggcuacaaccccgaggcccccagcaucaccaacaccagcagacccauguacagacacagagugcacgcccagagacccaaccugaucggccugaccagcggcgacauggaccugccccccagagagaagccccccaacaagagcagcaugagaaucgugguggacagcgagagcagaaagagaaccaucggcagcggcgagcccggcgugcccaccaagaagaccugguucgacaagcccaacuucaacagaaccaacagccccggcuuccagaagaaggugcaguucggcaacgagaacaccaagcuggagcugagaaaggugccccccgagcugaacaacaucagcaagcugaacgagcacuucagcagauucggcacccuggugaaccugcagguggccuacaacggcgaccccgagggcgcccugauccaguucgccaccuacgaggaggccaagaaggccaucagcagcaccgaggccgugcugaacaacagauucaucaagguguacuggcacagagagggcagcacccagcagcugcagaccaccagccccaaggugaugcagccccuggugcagcagcccauccugcccguggugaagcagagcgugaaggagagacugggccccgugcccagcagcaccaucgagcccgccgaggcccagagcgccagcagcgaccugccccaggugcugagcaccagcaccggccugaccaagaccguguacaaccccgccgcccugaaggccgcccagaagacccugcuggugagcaccagcgccguggacaacaacgaggcccagaagaagaagcaggaggcccugaagcugcagcaggacgugagaaagagaaagcaggagauccuggagaagcacaucgagacccagaagaugcugaucagcaagcuggagaagaacaagaccaugaagagcgaggacaaggccgagaucaugaagacccuggaggugcugaccaagaacaucaccaagcugaaggacgaggugaaggccgccagccccggcagaugccugcccaagagcaucaagaccaagacccagaugcagaaggagcugcuggacaccgagcuggaccuguacaagaagaugcaggccggcgaggaggugaccgagcugagaagaaaguacaccgagcugcagcuggaggccgccaagagaggcauccugagcagcggcagaggcagaggcauccacagcagaggcagaggcgccgugcacggcagaggcagaggcagaggcagaggcagaggcgugcccggccacgccgugguggaccacagacccagagcccuggagaucagcgccuucaccgagagcgacagagaggaccugcugccccacuucgcccaguacggcgagaucgaggacugccagaucgacgacagcagccugcacgccgugaucaccuucaagaccagagccgaggccgaggccgccgccgugcacggcgccagauucaagggccaggaccugaagcuggccuggaacaagcccgugaccaacaucagcgccguggagaccgaggagguggagcccgacgaggaggaguuccaggaggagagccugguggacgacagccugcugcaggacgacgacgaggaggaggaggacaacgagagcagaagcuggagaagauaa

SEQ ID NO: 22486 - RNA, 3183 nt, Artificial Sequence
  RBM27__Homo_sapiens__NP_061862
augcugaucgaggacguggacgcccugaagagcuggcuggccaagcugcuggagcccaucugcgacgccgaccccagcgcccuggccaacuacgugguggcccuggugaagaaggacaagcccgagaaggagcugaaggccuucugcgccgaccagcuggacguguuccugcagaaggagaccagcggcuucguggacaagcuguucgagagccuguacaccaagaacuaccugccccugcuggagcccgugaagcccgagcccaagccccuggugcaggagaaggaggagaucaaggaggagguguuccaggagcccgccgaggaggagagagacggcagaaagaagaaguaccccagcccccagaagaccagaagcgagagcagcgagagaagaaccagagagaagaagagagaggacggcaaguggagagacuacgacagauacuacgagagaaacgagcuguacagagagaaguacgacuggagaagaggcagaagcaagagcagaagcaagagcagaggccugagcagaagcagaagcagaagcagaggcagaagcaaggacagagaccccaacagaaacguggagcacagagagagaagcaaguucaagagcgagagaaacgaccuggagagcagcuacgugcccgugagcgcccccccccccaacagcagcgagcaguacagcagcggcgcccagagcauccccagcaccgugaccgugaucgcccccgcccaccacagcgagaacaccaccgagagcuggagcaacuacuacaacaaccacagcagcagcaacagcuucggcagaaaccugccccccaagagaagaugcagagacuacgacgagagaggcuucugcgugcugggcgaccugugccaguucgaccacggcaacgacccccuggugguggacgagguggcccugcccagcaugauccccuuccccccccccccccccggccugccccccccccccccccccggcaugcugaugccccccaugcccggccccggccccggccccggccccggccccggccccggccccggccccggccccggccccggccacagcaugagacugcccgugccccagggccacggccagcccccccccagcguggugcugcccauccccagaccccccaucacccagagcagccugaucaacagcagagaccagcccggcaccagcgccgugcccaaccuggccagcgugggcaccagacugccccccccccugccccagaaccugcuguacaccgugagcgagagacagcccauguacagcagagagcacggcgccgccgccagcgagagacugcagcugggcaccccccccccccugcuggccgccagacuggugccccccagaaaccugaugggcagcagcaucggcuaccacaccagcgugagcagccccaccccccuggugcccgacaccuacgagcccgacggcuacaaccccgaggcccccagcaucaccagcagcggcagaagccaguacagacaguucuucagcagaacccagacccagagacccaaccugaucggccugaccagcggcgacauggacgugaaccccagagccgccaacaucgugauccagaccgagccccccgugcccgugagcaucaacagcaacaucaccagaguggugcuggagcccgacagcagaaagagagccaugagcggccuggagggcccccugaccaagaagcccuggcugggcaagcagggcaacaacaaccagaacaagcccggcuuccugagaaagaaccaguacaccaacaccaagcuggaggugaagaagaucccccaggagcugaacaacaucaccaagcugaacgagcacuucagcaaguucggcaccaucgugaacauccagguggccuucaagggcgaccccgaggccgcccugauccaguaccugaccaacgaggaggccagaaaggccaucagcagcaccgaggccgugcugaacaacagauucaucagagugcuguggcacagagagaacaacgagcagcccacccugcagagcagcgcccagcugcugcugcagcagcagcagacccugagccaccugagccagcagcaccaccaccugccccagcaccugcaccagcagcaggugcugguggcccagagcgcccccagcaccgugcacggcggcauccagaagaugaugagcaagccccagaccagcggcgccuacgugcugaacaaggugcccgugaagcacagacugggccacgccggcggcaaccagagcgacgccagccaccugcugaaccagagcggcggcgccggcgaggacugccagaucuucagcacccccggccaccccaagaugaucuacagcagcagcaaccugaagacccccagcaagcugugcagcggcagcaagagccacgacgugcaggaggugcugaagaagaagcaggaggccaugaagcugcagcaggacaugagaaagaagagacaggaggugcuggagaagcagaucgagugccagaagaugcugaucagcaagcuggagaagaacaagaacaugaagcccgaggagagagccaacaucaugaagacccugaaggagcugggcgagaagaucagccagcugaaggacgagcugaagaccagcagcgccgugagcacccccagcaaggugaagaccaagaccgaggcccagaaggagcugcuggacaccgagcuggaccugcacaagagacugagcagcggcgaggacaccaccgagcugagaaagaagcugagccagcugcagguggaggccgccagacugggcauccugcccgugggcagaggcaagaccaugagcagccagggcagaggcagaggcagaggcagaggcggcagaggcagaggcagccugaaccacauggugguggaccacagacccaaggcccugaccgugggcggcuucaucgaggaggagaaggaggaccugcugcagcacuucagcaccgccaaccagggccccaaguucaaggacagaagacugcagaucagcuggcacaagcccaaggugcccagcaucagcaccgagaccgaggaggaggaggugaaggaggaggagaccgagaccagcgaccuguuccugcccgacgacgacgacgaggacgaggacgaguacgagagcagaagcuggagaagauaa

SEQ ID NO: 22487 - RNA, 1857 nt, Artificial Sequence
  RBM28__Homo_sapiens__NP_001159607
auggccggccugacccuguucgugggcagacugccccccagcgccagaagcgagcagcuggaggagcuguucagccaggugggccccgugaagcagugcuucguggugaccgagaagggcagaaccguggccguggacugggccguggccaaggacaaguacaaggacacccagagcgugagcgccaucggcgaggagaagagccacgagagcaagcaccaggagagcgugaagaagaagggcagagaggaggaggacauggaggaggaggagaacgacgacgacgacgacgacgacgacgaggaggacggcguguucgacgacgaggacgaggaggaggagaacaucgagagcaaggugaccaagcccgugcagauccagaagagagccgugaagagacccgcccccgccaagagcagcgaccacagcgaggaggacagcgaccuggaggagagcgacagcaucgacgacggcgaggagcuggcccagagcgacaccagcaccgaggagcaggaggacaaggccgugcaggugagcaacaagaagaagagaaagcugcccagcgacgugaacgagggcaagaccguguucaucagaaaccugagcuucgacagcgaggaggaggagcugggcgagcugcugcagcaguucggcgagcugaaguacgugagaaucgugcugcaccccgacaccgagcacagcaagggcugcgccuucgcccaguucaugacccaggaggccgcccagaagugccugcuggccgccagccccgagaacgaggccggcggccugaagcuggacggcagacagcugaagguggaccuggccgugaccagagacgaggccgccaagcugcagaccaccaaggugaagaagcccaccggcaccagaaaccuguaccuggccagagagggccugaucagagccggcaccaaggccgccgagggcgugagcgccgccgacauggccaagagagagagauucgagcugcugaagcaccagaagcugaaggaccagaacaucuucgugagcagaaccagacugugccugcacaaccugcccaaggccguggacgacaagcagcugagaaagcugcugcugagcgccaccagcggcgagaagggcgugagaaucaaggagugcagagugaugagagaccugaagggcgugcacggcaacaugaagggccagagccugggcuacgccuucgccgaguuccaggagcacgagcacgcccugaaggcccugagacugaucaacaacaaccccgagaucuucggcccccugaagagacccaucguggaguucagccuggaggacagaagaaagcugaagaugaaggagcugagaauccagagaagccugcagaagaugagaagcaagcccgccaccggcgagccccagaagggccagcccgagcccgccaaggaccagcagcagaaggccgcccagcaccacaccgaggagcagagcaaggugccccccgagcagaagagaaaggccggcagcaccagcuggaccggcuuccagaccaaggccgagguggagcagguggagcugcccgacggcaagaagagaagaaaggugcuggcccugcccagccacagaggccccaagaucagacugagagacaagggcaaggugaagcccgugcaccccaagaagcccaagccccagaucaaccaguggaagcaggagaagcagcagcugagcagcgagcaggugagcagaaagaaggccaagggcaacaagaccgagaccagauucaaccagcugguggagcaguacaagcagaagcugcugggccccagcaagggcgccccccuggccaagagaagcaagugguucgacagcuaa

SEQ ID NO: 22488 - RNA, 816 nt, Artificial Sequence
  RBM38__Homo_sapiens__NP_001278709
augcugcugcagcccgcccccugcgcccccagcgccggcuuccccagaccccuggccgcccccggcgccaugcacggcagccagaaggacaccaccuucaccaagaucuucgugggcggccugcccuaccacaccaccgacgccagccugagaaaguacuucgagggcuucggcgacaucgaggaggccguggugaucaccgacagacagaccggcaagagcagaggcuacggcuucggcaucaucuucgugcuggagggccacaucagccaggcccugaacuucgacggcagaagcuggaaccccggcggcaucuucgugggcgagccccaggugaccauggccgacagagccgccgccgagagagccugcaaggaccccaaccccaucaucgacggcagaaaggccaacgugaaccuggccuaccugggcgccaagcccagaagccugcagaccggcuucgccaucggcgugcagcagcugcaccccacccugauccagagaaccuacggccugaccccccacuacaucuacccccccgccaucgugcagcccagcguggugauccccgccgcccccgugcccagccugagcagccccuacaucgaguacacccccgccagccccgccuacgcccaguacccccccgccaccuacgaccaguaccccuacgccgccagccccgccaccgccgccagcuucgugggcuacagcuaccccgccgccgugccccaggcccugagcgccgccgcccccgccggcaccaccuucgugcaguaccaggccccccagcugcagcccgacagaaugcaguaa

SEQ ID NO: 22489 - RNA, 1527 nt, Artificial Sequence
  RBM39__Homo_sapiens__NP_001229528
auggccgacgacaucgacaucgaggccaugcuggaggcccccuacaagaaggacgagaacaagcugagcagcgccaacggccacgaggagagaagcaagaagagaaagaagagcaagagcagaagcagaagccacgagagaaagagaagcaagagcaaggagagaaagagaagcagagacagagagagaaagaagagcaagagcagagagagaaagagaagcagaagcaaggagagaagaagaagcagaagcagaagcagagacagaagauucagaggcagauacagaagccccuacagaagaagaagcagaagcaagagccccuucagaaaggacaagagccccgugagagagcccaucgacaaccugacccccgaggagagagacgccagaaccguguucugcaugcagcuggccgccagaaucagacccagagaccuggaggaguucuucagcaccgugggcaaggugagagacgugagaaugaucagcgacagaaacagcagaagaagcaagggcaucgccuacguggaguucguggacgugagcagcgugccccuggccaucggccugaccggccagagagugcugggcgugcccaucaucgugcaggccagccaggccgagaagaacagagccgccgccauggccaacaaccugcagaagggcagcgccggccccaugagacuguacgugggcagccugcacuucaacaucaccgaggacaugcugagaggcaucuucgagcccuucggcagaaucgagagcauccagcugaugauggacagcgagaccggcagaagcaagggcuacggcuucaucaccuucagcgacagcgagugcgccaagaaggcccuggagcagcugaacggcuucgagcuggccggcagacccaugaaggugggccacgugaccgagagaaccgacgccagcagcgccagcagcuuccuggacagcgacgagcuggagagaaccggcaucgaccugggcaccaccggcagacugcagcugauggccagacuggccgagggcaccggccugcagaucccccccgccgcccagcaggcccugcagaugagcggcagccuggccuucggcgccguggccgaguucagcuucgugaucgaccugcagaccagacugagccagcagaccgaggccagcgcccuggccgccgccgccagcgugcagccccuggccacccagugcuuccagcugagcaacauguucaacccccagaccgaggaggaggugggcugggacaccgagaucaaggacgacgugaucgaggagugcaacaagcacggcggcgugauccacaucuacguggacaagaacagcgcccagggcaacguguacgugaagugccccagcaucgccgccgccaucgccgccgugaacgcccugcacggcagaugguucgccggcaagaugaucaccgccgccuacgugccccugcccaccuaccacaaccuguuccccgacagcaugaccgccacccagcugcuggugcccagcagaagauaa

SEQ ID NO: 22490 - RNA, 474 nt, Artificial Sequence
  RBM3__Homo_sapiens__NP_006734
augagcagcgaggagggcaagcuguucgugggcggccugaacuucaacaccgacgagcaggcccuggaggaccacuucagcagcuucggccccaucagcgagguggugguggugaaggacagagagacccagagaagcagaggcuucggcuucaucaccuucaccaaccccgagcacgccagcguggccaugagagccaugaacggcgagagccuggacggcagacagaucagaguggaccacgccggcaagagcgccagaggcaccagaggcggcggcuucggcgcccacggcagaggcagaagcuacagcagaggcggcggcgaccagggcuacggcagcggcagauacuacgacagcagacccggcggcuacggcuacggcuacggcagaagcagagacuacaacggcagaaaccagggcggcuacgacagauacagcggcggcaacuacagagacaacuacgacaacuaa

SEQ ID NO: 22491 - RNA, 1425 nt, Artificial Sequence
  RBM45__Homo_sapiens__NP_694453
auggacgaggccggcagcagcgccagcggcggcggcuucagacccggcguggacagccuggacgagccccccaacagcagaaucuuccuggugaucagcaaguacacccccgagagcgugcugagagagagauucagccccuucggcgacauccaggacaucuggguggugagagacaagcacaccaaggagagcaagggcaucgccuucgugaaguucgccagaagcagccaggccugcagagccauggaggagaugcacggccagugccugggccccaacgacaccaagcccaucaagguguucaucgcccagagcagaagcagcggcagccacagagacguggaggacgaggagcugaccagaaucuucgugaugauccccaagagcuacaccgaggaggaccugagagagaaguucaagguguacggcgacaucgaguacugcagcaucaucaagaacaaggugaccggcgagagcaagggccugggcuacgugagauaccugaagcccagccaggccgcccaggccaucgagaacugcgacagaagcuucagagccauccuggccgagcccaagaacaaggccagcgagagcagcgagcaggacuacuacagcaacaugagacaggaggcccugggccacgagcccagagugaacauguuccccuucgagcagcagagcgaguucagcagcuucgacaagaacgacagcagaggccaggaggccaucagcaagagacugagcguggugagcagagugcccuucaccgaggagcagcuguucagcaucuucgacaucgugcccggccuggaguacugcgaggugcagagagaccccuacagcaacuacggccacggcguggugcaguacuucaacguggccagcgccaucuacgccaaguacaagcugcacggcuuccaguacccccccggcaacagaaucggcgugagcuucaucgacgacggcagcaacgccaccgaccugcugagaaagauggccacccagaugguggccgcccagcuggccagcaugguguggaacaaccccagccagcagcaguucaugcaguucggcggcagcagcggcagccagcugccccagauccagaccgacguggugcugcccagcugcaagaagaaggcccccgccgagacccccgugaaggagagacuguucaucguguucaacccccacccccugccccuggacgugcuggaggacaucuucugcagauucggcaaccugaucgagguguaccuggugagcggcaagaacgugggcuacgccaaguacgccgacagaaucagcgccaacgacgccaucgccacccugcacggcaagauccugaacggcgugagacugaaggugaugcuggccgacagccccagagaggagagcaacaagagacagagaaccuacuaa

SEQ ID NO: 22492 - RNA, 1602 nt, Artificial Sequence
  RBM46__Homo_sapiens__NP_659416
augaacgaggagaacaucgacggcaccaacggcugcagcaaggugagaaccggcauccagaacgaggccgcccugcuggcccugauggagaagaccggcuacaacauggugcaggagaacggccagagaaaguucggcggccccccccccggcugggagggcccccccccccccagaggcugcgagguguucgugggcaagauccccagagacauguacgaggacgagcuggugcccguguucgagagagccggcaagaucuacgaguucagacugaugauggaguucagcggcgagaacagaggcuacgccuucgugauguacaccaccaaggaggaggcccagcuggccaucagaauccugaacaacuacgagaucagacccggcaaguucaucggcgugugcgugagccuggacaacugcagacuguucaucggcgccauccccaaggagaagaagaaggaggagauccuggacgagaugaagaaggugaccgagggcgugguggacgugaucguguaccccagcgccaccgacaagaccaagaacagaggcuucgccuucguggaguacgagagccacagagccgccgccauggccagaagaaagcugauccccggcaccuuccagcuguggggccacaccauccagguggacugggccgaccccgagaaggagguggacgaggagaccaugcagagagugaaggugcuguacgugagaaaccugaugaucagcaccaccgaggagaccaucaaggccgaguucaacaaguucaagcccggcgccguggagagagugaagaagcugagagacuacgccuucgugcacuucuucaacagagaggacgccguggccgccaugagcgugaugaacggcaagugcaucgacggcgccagcaucgaggugacccuggccaagcccgugaacaaggagaacaccuggagacagcaccugaacggccagaucagccccaacagcgagaaccugaucguguucgccaacaaggaggagagccaccccaagacccugggcaagcugcccacccugcccgccagacugaacggccagcacagccccagcccccccgagguggagagaugcaccuaccccuucuaccccggcaccaagcugacccccaucagcauguacagccugaagagcaaccacuucaacagcgccgugaugcaccuggacuacuacugcaacaagaacaacugggccccccccgaguacuaccuguacagcaccaccagccaggacggcaaggugcugcugguguacaagaucgugauccccgccaucgccaacggcagccagagcuacuucaugcccgacaagcugugcaccacccuggaggacgccaaggagcuggccgcccaguucacccugcugcaccuggacuacaacuuccacagaagcagcaucaacagccugagccccgugagcgccacccugagcagcggcacccccagcgugcugcccuacaccagcagacccuacagcuaccccggcuacccccugagccccaccaucagccuggccaacggcagccacgugggccagagacugugcaucagcaaccaggccagcuucuucuaa

SEQ ID NO: 22493 - RNA, 1782 nt, Artificial Sequence
  RBM47__Homo_sapiens__NP_001092104
augaccgccgaggacagcaccgccgccaugagcagcgacagcgccgccggcagcagcgccaaggugcccgagggcguggccggcgcccccaacgaggccgcccugcuggcccugauggagagaaccggcuacagcauggugcaggagaacggccagagaaaguacggcggccccccccccggcugggagggcccccacccccagagaggcugcgagguguucgugggcaagauccccagagacguguacgaggacgagcuggugcccguguucgaggccgugggcagaaucuacgagcugagacugaugauggacuucgacggcaagaacagaggcuacgccuucgugauguacugccacaagcacgaggccaagagagccgugagagagcugaacaacuacgagaucagacccggcagacugcugggcgugugcugcagcguggacaacugcagacuguucaucggcggcauccccaagaugaagaagagagaggagauccuggaggagaucgccaaggugaccgagggcgugcuggacgugaucguguacgccagcgccgccgacaagaugaagaacagaggcuucgccuucguggaguacgagagccacagagccgccgccauggccagaagaaagcugaugcccggcagaauccagcuguggggccaccagaucgccguggacugggccgagcccgagaucgacguggacgaggacgugauggagaccgugaagauccuguacgugagaaaccugaugaucgagaccaccgaggacaccaucaagaagagcuucggccaguucaaccccggcugcguggagagagugaagaagaucagagacuacgccuucgugcacuucaccagcagagaggacgccgugcacgccaugaacaaccugaacggcaccgagcuggagggcagcugccuggaggugacccuggccaagcccguggacaaggagcaguacagcagauaccagaaggccgccagaggcggcggcgccgccgaggccgcccagcagcccagcuacguguacagcugcgaccccuacacccuggccuacuacggcuaccccuacaacgcccugaucggccccaacagagacuacuucgugaaggccggcagcaucagaggcagaggcagaggcgccgccggcaacagagcccccggccccagaggcagcuaccugggcggcuacagcgccggcagaggcaucuacagcagauaccacgagggcaagggcaagcagcaggagaagggcuacgagcuggugcccaaccuggagauccccaccgugaaccccguggccaucaagcccggcaccguggccauccccgccaucggcgcccaguacagcauguuccccgccgcccccgcccccaagaugaucgaggacggcaagauccacaccguggagcacaugaucagccccaucgccgugcagcccgaccccgccagcgccgccgccgccgccgccgccgccgccgccgccgccgccgccgugauccccaccgugagcacccccccccccuuccagggcagacccaucacccccguguacaccguggcccccaacgugcagagaauccccaccgccggcaucuacggcgccagcuacgugcccuucgccgcccccgccaccgccaccaucgccacccugcagaagaacgccgccgccgccgccgccauguacggcggcuacgccggcuacaucccccaggccuuccccgccgccgccauccaggugcccauccccgacguguaccagaccuacuaa

SEQ ID NO: 22494 - RNA, 432 nt, Artificial Sequence
  RBM4__Homo_sapiens__NP_001185772
auggugaagcuguucaucggcaaccugcccagagaggccaccgagcaggagaucagaagccuguucgagcaguacggcaaggugcuggagugcgacaucaucaagaacuacggcuucgugcacaucgaggacaagaccgccgccgaggacgccaucagaaaccugcaccacuacaagcugcacggcgugaacaucaacguggaggccagcaagaacaagagcaagaccagcaccaagcugcacgugggcaacaucagccccaccugcaccaacaaggagcugagagccaaguucgaggaguacggccccgugaucgagugcgacaucgugaaggacuacgccuucgugcacauggagagagccgaggacgccguggaggccaucagaggccuggacaacaccgaguuccagggcggcaugugcgugggcuaa

SEQ ID NO: 22495 - RNA, 2448 nt, Artificial Sequence
  RBM5__Homo_sapiens__NP_005769
augggcagcgacaagagagugagcagaaccgagagaagcggcagauacggcagcaucaucgacagagacgacagagacgagagagagagcagaagcagaagaagagacagcgacuacaagagaagcagcgacgacagaagaggcgacagauacgacgacuacagagacuacgacagccccgagagagagagagagagaagaaacagcgacagaagcgaggacggcuaccacagcgacggcgacuacggcgagcacgacuacagacacgacaucagcgacgagagagagagcaagaccaucaugcugagaggccugcccaucaccaucaccgagagcgacaucagagagaugauggagagcuucgagggcccccagcccgccgacgugagacugaugaagagaaagaccggcgugagcagaggcuucgccuucguggaguucuaccaccugcaggacgccaccagcuggauggaggccaaccagaagaagcuggugauccagggcaagcacaucgccaugcacuacagcaaccccagacccaaguucgaggacuggcugugcaacaagugcugccugaacaacuucagaaagagacugaagugcuucagaugcggcgccgacaaguucgacagcgagcaggaggugccccccggcaccaccgagagcgugcagagcguggacuacuacugcgacaccaucauccugagaaacaucgccccccacaccgugguggacagcaucaugaccgcccugagccccuacgccagccuggccgugaacaacaucagacugaucaaggacaagcagacccagcagaacagaggcuucgccuucgugcagcugagcagcgccauggacgccagccagcugcugcagauccugcagagccugcaccccccccugaagaucgacggcaagaccaucggcguggacuucgccaagagcgccagaaaggaccuggugcugagcgacggcaacagagugagcgccuucagcguggccagcaccgccaucgccgccgcccaguggagcagcacccagagccagagcggcgagggcggcagcguggacuacagcuaccugcagcccggccaggacggcuacgcccaguacgcccaguacagccaggacuaccagcaguucuaccagcagcaggccggcggccuggagagcgacgccagcagcgccagcggcaccgccgugaccaccaccagcgccgccguggugagccagagcccccagcuguacaaccagaccagcaacccccccggcagccccaccgaggaggcccagcccagcaccagcaccagcacccaggcccccgccgccagccccaccggcguggugcccggcaccaaguacgccgugcccgacaccagcaccuaccaguacgacgagagcagcggcuacuacuacgaccccaccaccggccuguacuacgaccccaacagccaguacuacuacaacagccugacccagcaguaccuguacugggacggcgagaaggagaccuacgugcccgccgccgagagcagcagccaccagcagagcggccugccccccgccaaggagggcaaggagaagaaggagaagcccaagagcaagaccgcccagcagaucgccaaggacauggagagaugggccaagagccugaacaagcagaaggagaacuucaagaacagcuuccagcccgugaacagccugagagaggaggagagaagagagagcgccgccgccgacgccggcuucgcccuguucgagaagaagggcgcccuggccgagagacagcagcugauccccgagcuggugagaaacggcgacgaggagaacccccugaagagaggccugguggccgccuacagcggcgacagcgacaacgaggaggagcugguggagagacuggagagcgaggaggagaagcuggccgacuggaagaagauggccugccugcugugcagaagacaguuccccaacaaggacgcccuggugagacaccagcagcugagcgaccugcacaagcagaacauggacaucuacagaagaagcagacugagcgagcaggagcuggaggcccuggagcugagagagagagagaugaaguacagagacagagccgccgagagaagagagaaguacggcauccccgagccccccgagcccaagagaaagaagcaguucgacgccggcaccgugaacuacgagcagcccaccaaggacggcaucgaccacagcaacaucggcaacaagaugcugcaggccaugggcuggagagagggcagcggccugggcagaaagugccagggcaucaccgcccccaucgaggcccaggugagacugaagggcgccggccugggcgccaagggcagcgccuacggccugagcggcgccgacagcuacaaggacgccgugagaaaggccauguucgccagauucaccgagauggaguaa

SEQ ID NO: 22496 - RNA, 3372 nt, Artificial Sequence
  RBM6__Homo_sapiens__NP_005768
auguggggcgacagcagacccgccaacagaaccggccccuucagaggcagccaggaggagagauucgcccccggcuggaacagagacuaccccccccccccccugaagagccacgcccaggagagacacagcggcaacuuccccggcagagacagccugcccuucgacuuccagggccacagcggcccccccuucgccaacguggaggagcacagcuucagcuacggcgccagagacggcccccacggcgacuacagaggcggcgagggccccggccacgacuucagaggcggcgacuucagcagcagcgacuuccagagcagagacagcagccagcuggacuucagaggcagagacauccacagcggcgacuucagagacagagagggcccccccauggacuacagaggcggcgacggcaccagcauggacuacagaggcagagaggccccccacaugaacuacagagacagagacgcccacgccguggacuucagaggcagagacgccccccccagcgacuucagaggcagaggcaccuacgaccuggacuucagaggcagagacggcagccacgccgacuucagaggcagagaccugagcgaccuggacuucagagccagagagcagagcagaagcgacuucagaaacagagacgugagcgaccuggacuucagagacaaggacggcacccagguggacuucagaggcagaggcagcggcaccaccgaccuggacuucagagacagagacaccccccacagcgacuucagaggcagacacagaagcagaaccgaccaggacuucagaggcagagagaugggcagcugcauggaguucaaggacagagagaugccccccguggaccccaacauccuggacuacauccagcccagcacccaggacagagagcacagcggcaugaacgugaacagaagagaggagagcacccacgaccacaccaucgagagacccgccuucggcauccagaagggcgaguucgagcacagcgagaccagagagggcgagacccagggcguggccuucgagcacgagagccccgccgacuuccagaacagccagagccccgugcaggaccaggacaagagccagcugagcggcagagaggagcagagcagcgacgccggccuguucaaggaggagggcggccuggacuuccugggcagacaggacaccgacuacagaagcauggaguacagagacguggaccacagacugcccggcagccagauguucggcuacggccagagcaagagcuuccccgagggcaagaccgccagagacgcccagagagaccugcaggaccaggacuacagaaccggccccagcgaggagaagcccagcagacugaucagacugagcggcgugcccgaggacgccaccaaggaggagauccugaacgccuucagaacccccgacggcaugcccgugaagaaccugcagcugaaggaguacaacaccggcuacgacuacggcuacgugugcguggaguucagccugcuggaggacgccaucggcugcauggaggccaaccagggcacccugaugauccaggacaaggaggugacccuggaguacgugagcagccuggacuucugguacugcaagagaugcaaggccaacaucggcggccacagaagcagcugcagcuucugcaagaaccccagagaggugaccgaggccaagcaggagcugaucaccuacccccagccccagaagaccagcauccccgccccccuggagaagcagcccaaccagccccugagacccgccgacaaggagcccgagcccagaaagagagaggagggccaggagagcagacugggccaccagaagagagaggccgagagauaccugccccccagcagaagagagggccccaccuucagaagagacagagagagagagagcuggagcggcgagaccagacaggacggcgagagcaagaccaucaugcugaagagaaucuacagaagcaccccccccgaggugaucguggaggugcuggagcccuacgugagacugaccaccgccaacgugagaaucaucaagaacagaaccggccccaugggccacaccuacggcuucaucgaccuggacagccacgccgaggcccugagaguggugaagauccugcagaaccuggacccccccuucagcaucgacggcaagaugguggccgugaaccuggccaccggcaagagaagaaacgacagcggcgaccacagcgaccacaugcacuacuaccagggcaagaaguacuucagagacagaagaggcggcggcagaaacagcgacuggagcagcgacaccaacagacagggccagcagagcagcagcgacugcuacaucuacgacagcgccaccggcuacuacuacgacccccuggccggcaccuacuacgaccccaacacccagcaggagguguacgugccccaggaccccggccugcccgaggaggaggagaucaaggagaagaagcccaccagccagggcaagagcagcagcaagaaggagaugagcaagagagacggcaaggagaagaaggacagaggcgugaccagauuccaggagaacgccagcgagggcaaggcccccgccgaggacguguucaagaagccccugccccccaccgugaagaaggaggagagcccccccccccccaagguggugaacccccugaucggccugcugggcgaguacggcggcgacagcgacuacgaggaggaggaggaggaggagcagaccccccccccccagcccagaaccgcccagccccagaagagagaggagcagaccaagaaggagaacgaggaggacaagcugaccgacuggaacaagcuggccugccugcugugcagaagacaguuccccaacaaggaggugcugaucaagcaccagcagcugagcgaccugcacaagcagaaccuggagauccacagaaagaucaagcagagcgagcaggagcuggccuaccuggagagaagagagagagagggcaaguucaagggcagaggcaacgacagaagagagaagcugcagagcuucgacagccccgagagaaagagaaucaaguacagcagagagaccgacagcgacagaaagcugguggacaaggaggacaucgacaccagcagcaagggcggcugcgugcagcaggccaccggcuggagaaagggcaccggccugggcuacggccaccccggccuggccagcagcgaggaggccgagggcagaaugagaggccccagcgugggcgccagcggcagaaccagcaagagacagagcaacgagaccuacagagacgccgugagaagagugauguucgccagauacaaggagcuggacuaa

SEQ ID NO: 22497 - RNA, 801 nt, Artificial Sequence
  RBM7__Homo_sapiens__NP_057174
augggcgccgccgccgccgaggccgacagaacccuguucgugggcaaccuggagaccaaggugaccgaggagcugcuguucgagcuguuccaccaggccggccccgugaucaaggugaagauccccaaggacaaggacggcaagcccaagcaguucgccuucgugaacuucaagcacgaggugagcgugcccuacgccaugaaccugcugaacggcaucaagcuguacggcagacccaucaagauccaguucagaagcggcagcagccacgccccccaggacgugagccugagcuacccccagcaccacgugggcaacagcagccccaccagcaccagccccagcagauacgagagaaccauggacaacaugaccagcagcgcccagaucauccagagaagcuucagcagccccgagaacuuccagagacaggccgugaugaacagcgcccugagacagaugagcuacggcggcaaguucggcagcagcccccuggaccagagcggcuucagccccagcgugcagagccacagccacagcuucaaccagagcagcagcagccaguggagacagggcacccccagcagccagagaaaggugagaaugaacagcuaccccuaccuggccgacagacacuacagcagagagcagagauacaccgaccacggcagcgaccaccacuacagaggcaagagagacgacuucuucuacgaggacagaaaccacgacgacuggagccacgacuacgacaacagaagagacagcagcagagacggcaaguggagaagcagcagacacuaa

SEQ ID NO: 22498 - RNA, 1212 nt, Artificial Sequence
  RBMS1__Homo_sapiens__NP_002888
augggcaagguguggaagcagcagauguacccccaguacgccaccuacuacuacccccaguaccugcaggccaagcagagccuggugcccgcccaccccauggccccccccagccccagcaccaccagcagcaacaacaacagcagcagcagcagcaacagcggcugggaccagcugagcaagaccaaccuguacaucagaggccugcccccccacaccaccgaccaggaccuggugaagcugugccagcccuacggcaagaucgugagcaccaaggccauccuggacaagaccaccaacaagugcaagggcuacggcuucguggacuucgacagccccgccgccgcccagaaggccgugagcgcccugaaggccagcggcgugcaggcccagauggccaagcagcaggagcaggaccccaccaaccuguacaucagcaaccugccccugagcauggacgagcaggagcuggagaacaugcugaagcccuucggccaggugaucagcaccagaauccugagagacagcagcggcaccagcagaggcgugggcuucgccagaauggagagcaccgagaagugcgaggccgugaucggccacuucaacggcaaguucaucaagaccccccccggcgugagcgcccccaccgagccccugcugugcaaguucgccgacggcggccagaagaagagacagaaccccaacaaguacauccccaacggcagacccuggcacagagagggcgaggccggcaugacccugaccuacgaccccaccaccgccgccauccagaacggcuucuaccccagccccuacagcaucgccaccaacagaaugaucacccagaccagcaucacccccuacaucgccagccccgugagcgccuaccaggugcagagccccagcuggaugcagccccagcccuacauccugcagcaccccggcgccgugcugacccccagcauggagcacaccaugagccugcagcccgccagcaugaucagcccccuggcccagcagaugagccaccugagccugggcagcaccggcaccuacaugcccgccaccagcgccaugcagggcgccuaccugccccaguacgcccacaugcagaccaccgccgugcccguggaggaggccagcggccagcagcagguggccguggagaccagcaacgaccacagccccuacaccuuccagcccaacaaguaa

SEQ ID NO: 22499 - RNA, 1224 nt, Artificial Sequence
  RBMS2__Homo_sapiens__NP_002889
augcugcugagcgugaccagcagacccggcaucagcaccuucggcuacaacagaaacaacaagaagcccuacgugagccuggcccagcagauggccccccccagccccagcaacagcacccccaacagcagcagcggcagcaacggcaacgaccagcugagcaagaccaaccuguacaucagaggccugcagcccggcaccaccgaccaggaccuggugaagcugugccagcccuacggcaagaucgugagcaccaaggccauccuggacaagaccaccaacaagugcaagggcuacggcuucguggacuucgacagccccagcgccgcccagaaggccgugaccgcccugaaggccagcggcgugcaggcccagauggccaagcagcaggagcaggaccccaccaaccuguacaucagcaaccugccccugagcauggacgagcaggagcuggagggcaugcugaagcccuucggccaggugaucagcaccagaauccugagagacaccagcggcaccagcagaggcgugggcuucgccagaauggagagcaccgagaagugcgaggccaucaucacccacuucaacggcaaguacaucaagaccccccccggcgugcccgcccccagcgacccccugcugugcaaguucgccgacggcggccccaagaagagacagaaccagggcaaguucgugcagaacggcagagccuggcccagaaacgccgacaugggcgugauggcccugaccuacgaccccaccaccgcccugcagaacggcuucuaccccgcccccuacaacaucacccccaacagaaugcuggcccagagcgcccugagccccuaccugagcagccccgugagcagcuaccagagagugacccagaccagcccccugcaggugcccaaccccagcuggaugcaccaccacagcuaccugaugcagcccagcggcagcgugcugacccccggcauggaccaccccaucagccugcagcccgccagcaugaugggcccccugacccagcagcugggccaccugagccugagcagcaccggcaccuacaugcccaccgccgccgccaugcagggcgccuacaucagccaguacacccccgugcccagcagcagcgugagcguggaggagagcagcggccagcagaaccagguggccguggacgcccccagcgagcacggcguguacagcuuccaguucaacaaguaa

SEQ ID NO: 22500 - RNA, 1260 nt, Artificial Sequence
  RBMS3__Homo_sapiens__NP_001003792
augggcaagagacuggaccagccccagauguacccccaguacaccuacuacuacccccacuaccugcagaccaagagcuacgcccccgccccccaccccauggccccccccagccccagcaccaacagcagcagcaacaacagcagcaacaacagcagcggcgagcagcugagcaagaccaaccuguacaucagaggccugccccccggcaccaccgaccaggaccugaucaagcugugccagcccuacggcaagaucgugagcaccaaggccauccuggacaagaacaccaaccagugcaagggcuacggcuucguggacuucgacagccccgccgccgcccagaaggccguggccagccugaaggccaacggcgugcaggcccagauggccaagcagcaggagcaggaccccaccaaccuguacaucagcaaccugcccaucagcauggacgagcaggagcuggagaacaugcugaagcccuucggccacgugaucagcaccagaauccugagagacgccaacggcgugagcagaggcgugggcuucgccagaauggagagcaccgagaagugcgagguggugauccagcacuucaacggcaaguaccugaagaccccccccggcauccccgcccccagcgagccccugcugugcaaguucgccgacggcggccagaagaagagacagaaccagagcaaguacacccagaacggcagacccuggcccagagagggcgaggccggcauggcccugaccuacgaccccaccgccgccauccagaacggcuucuacagcagccccuacagcaucgccaccaacagaaugaucccccagaccagcaucacccccuucaucgccgccagccccgugagcaccuaccagggcgccgugaucacccccaccauggaccaccccaugagcaugcagcccgccaacaugaugggcccccugacccagcagaugaaccaccugagccugggcaccaccggcaccauccagagccaggacagaaucaugauccugcaccagcugcugugccaguacaugaccgccgccgcccccaugcagggcaccuacaucccccaguacacccccgugccccccaccgccgugagcaucgagggcgugguggccgacaccagcccccagaccguggcccccagcagccaggacaccagcggccagcagcagcagaucgccguggacaccagcaacgagcacgcccccgccuacagcuaccagcagagcaagcccuaa

SEQ ID NO: 22501 - RNA, 969 nt, Artificial Sequence
  RBMX2__Homo_sapiens__NP_057108
augaacccccugaccaaggugaagcugaucaacgagcugaacgagagagaggugcagcugggcguggccgacaaggugagcuggcacagcgaguacaaggacagcgccuggaucuuccugggcggccugcccuacgagcugaccgagggcgacaucaucugcguguucagccaguacggcgagaucgugaacaucaaccuggugagagacaagaagaccggcaagagcaagggcuucugcuuccugugcuacgaggaccagagaagcaccauccuggccguggacaacuucaacggcaucaagaucaagggcagaaccaucagaguggaccacgugagcaacuacagagcccccaaggacagcgaggagaucgacgacgugaccagacagcugcaggagaagggcugcggcgccagaacccccagccccagccugagcgagagcagcgaggacgagaagcccaccaagaagcacaagaaggacaagaaggagaagaagaagaagaagaaggagaaggagaaggccgacagagaggugcaggccgagcagcccagcagcagcagccccagaagaaagaccgugaaggagaaggacgacaccggccccaagaagcacagcagcaagaacagcgagagagcccagaagagcgagcccagagagggccagaagcugcccaagagcagaaccgccuacagcggcggcgccgaggaccuggagagagagcugaagaaggagaagcccaagcacgagcacaagagcagcagcagaagagaggccagagaggagaagaccagaaucagagacagaggcagaagcagcgacgcccacagcagcugguacaacggcagaagcgagggcagaagcuacagaagcagaagcagaagcagagacaagagccacagacacaagagagccagaagaagcagagagagagagagcagcaaccccagcgacagauggagacacuaa

SEQ ID NO: 22502 - RNA, 591 nt, Artificial Sequence
  RBMX__Homo_sapiens__NP_001158275
augguggaggccgacagacccggcaagcuguucaucggcggccugaacaccgagaccaacgagaaggcccuggaggccguguucggcaaguacggcagaaucguggaggugcugcugaugaaggacagagagaccaacaagagcagaggcuucgccuucgugaccuucgagagccccgccgacgccaaggacgccgccagagacaugaacggcaagcugcuguaccacguggaggagaucgugauggaggugcaccuggagggcaacagaugcccccugguggagauguucaucugcccccaggagaugaugggcauccugcugaagaccgccauccaggccgagaucacccaggugcuggugauccuggagaucaugcaccaccaccacgagaucauccugaccgugaucauggugauccccgugcacgugaugaccauccaccaggaggacaucgccaucgagauggacaugguggugaucgugaccauccagaucauccagguggaggugcccaccgagauccacaugagagugauggugggcgacuucgcccacuacggcagaggcgugcugaucgacagccaguaa

SEQ ID NO: 22503 - RNA, 1179 nt, Artificial Sequence
  RBMXL2__Homo_sapiens__NP_055284
augguggaggccgacagacccggcaagcuguucaucggcggccugaaccuggagaccgacgagaaggcccuggaggccgaguucggcaaguacggcagaaucguggaggugcugcugaugaaggacagagagaccaacaagagcagaggcuucgccuucgugaccuucgagagccccgccgacgccaaggccgccgccagagacaugaacggcaagagccuggacggcaaggccaucaagguggcccaggccaccaagcccgccuucgagagcagcagaagaggcccccccccccccagaagcagaggcagacccagauuccugagaggcaccagaggcggcggcggcggccccagaagaagccccagcagaggcggccccgacgacgacggcggcuacaccgccgacuucgaccugagacccagcagagcccccaugcccaugaagagaggccccccccccagaagagugggccccccccccaagagagccgcccccagcggccccgccagaagcagcggcggcggcaugagaggcagagcccuggccgugagaggcagagacggcuacagcggcccccccagaagagagccccugccccccagaagagaccccuaccugggccccagagacgagggcuacagcagcagagacggcuacagcagcagagacuacagagagcccagaggcuucgcccccagccccggcgaguacacccacagagacuacggccacagcagcgugagagacgacugcccccugagaggcuacagcgacagagacggcuacggcggcagagacagagacuacggcgaccaccugagcagaggcagccacagagagcccuucgagagcuacggcgagcugagaggcgccgcccccggcagaggcaccccccccagcuacggcggcggcggcagauacgaggaguacagaggcuacagccccgacgccuacagcggcggcagagacagcuacagcagcagcuacggcagaagcgacagauacagcagaggcagacacagagugggcagacccgacagaggccugagccugagcauggagagaggcugccccccccagagagacagcuacagcagaagcggcugcagagugcccagaggcggcggcagacugggcggcagacuggagagaggcggcggcagaagcagauacuaa

SEQ ID NO: 22504 - RNA, 1491 nt, Artificial Sequence
  RBMY1A1__Homo_sapiens__XP_011529738
augguggaggccgaccaccccggcaagcuguucaucggcggccugaacagagagaccaacgagaagaugcugaaggccguguucggcaagcacggccccaucagcgaggugcugcugaucaaggacagaaccagcaagagcagaggcuucgccuucaucaccuucgagaaccccgccgacgccaagaacgccgccaaggacaugaacggcaagagccugcacggcaaggccaucaagguggagcaggccaagaagcccagcuuccagagcggcggcagaagaagaccccccgccagcagcagaaacagaagccccagcggcagccugagaagcgccagaggcagcagaggcggcaccagaggcuggcugcccagccacgagggccaccuggacgacggcggcuacacccccgaccugaagaugagcuacagcagaggccugauccccgugaagagaggccccagcagcagaagcggcggccccccccccaagaagagcgcccccagcgccguggccagaagcaacagcuggaugggcagccagggccccaugagccagagaagagagaacuacggcgugccccccagaagagccaccaucagcagcuggagaaacgacagaaugagcaccagacacgacggcuacgccaccaacgacggcaaccaccccagcugccaggagaccagagacuacgccccccccagcagaggcuacgccuacagagacaacggccacagcaacagagacgagcacagcagcagaggcuacagaaaccacagaagcagcagagagaccagagacuacgccccccccagcagaggccacgccuacagagacuacggccacagcagaagagacgagagcuacagcagaggcuacagaaacagaagaagcagcagagagaccagagaguacgccccccccagcagaggccacggcuacagagacuacggccacagcagaagacacgagagcuacagcagaggcuacagaaaccaccccagcagcagagagaccagagacuacgcccccccccacagagacuacgccuacagagacuacggccacagcagcugggacgagcacagcagcagaggcuacagcuaccacgacggcuacggcgaggcccugggcagagaccacagcgagcaccugagcggcagcagcuacagagacgcccugcagagauacggcaccagccacggcgccccccccgccagaggccccagaaugagcuacggcggcagcaccugccacgccuacagcaacaccagagacagauacggcagaagcugggagagcuacagcagcugcggcgacuuccacuacugcgacagagagcacgugugcagaaaggaccagagaaacccccccagccugggcagagugcugcccgaccccagagaggccugcggcagcagcagcuacguggccagcaucguggacggcggcgagagcagaagcgagaagggcgacagcagcagauacuaa

SEQ ID NO: 22505 - RNA, 474 nt, Artificial Sequence
  RBP1__Homo_sapiens__NP_001124464
auggacccccccgccggcuucgugagagccggcaaccccgccguggccgccccccagagcccccugagccccgagggcgcccacuucagagccgcccaccaccccagaagcaccggcagcagaugccccggcagccugcagcccagcagaccccugguggccaacuggcugcagagccugcccgagaugcccguggacuucaccggcuacuggaagaugcuggugaacgagaacuucgaggaguaccugagagcccuggacgugaacguggcccugagaaagaucgccaaccugcugaagcccgacaaggagaucgugcaggacggcgaccacaugaucaucagaacccugagcaccuucagaaacuacaucauggacuuccaggugggcaaggaguucgaggaggaccugaccggcaucgacgacagaaagugcauggccggcgugcagagcagagaccugagcagccuguaa

SEQ ID NO: 22506 - RNA, 405 nt, Artificial Sequence
  RBP2__Homo_sapiens__NP_004155
augaccagagaccagaacggcaccugggagauggagagcaacgagaacuucgagggcuacaugaaggcccuggacaucgacuucgccaccagaaagaucgccgugagacugacccagaccaaggugaucgaccaggacggcgacaacuucaagaccaagaccaccagcaccuucagaaacuacgacguggacuucaccgugggcguggaguucgacgaguacaccaagagccuggacaacagacacgugaaggcccuggugaccugggagggcgacgugcuggugugcgugcagaagggcgagaaggagaacagaggcuggaagcaguggaucgagggcgacaagcuguaccuggagcugaccugcggcgaccaggugugcagacagguguucaagaagaaguaa

SEQ ID NO: 22507 - RNA, 3744 nt, Artificial Sequence
  RBP3__Homo_sapiens__NP_002891
augaugagagagugggugcugcugaugagcgugcugcugugcggccuggccggccccacccaccuguuccagcccagccuggugcuggacauggccaaggugcugcuggacaacuacugcuuccccgagaaccugcugggcaugcaggaggccauccagcaggccaucaagagccacgagauccugagcaucagcgacccccagacccuggccagcgugcugaccgccggcgugcagagcagccugaacgaccccagacuggugaucagcuacgagcccagcacccccgagccccccccccaggugcccgcccugaccagccugagcgaggaggagcugcuggccuggcugcagagaggccugagacacgaggugcuggagggcaacgugggcuaccugagaguggacagcgugcccggccaggaggugcugagcaugaugggcgaguuccugguggcccacguguggggcaaccugaugggcaccagcgcccuggugcuggaccugagacacugcaccggcggccaggugagcggcauccccuacaucaucagcuaccugcaccccggcaacaccauccugcacguggacaccaucuacaacagacccagcaacaccaccaccgagaucuggacccugccccaggugcugggcgagagauacggcgccgacaaggacgugguggugcugaccagcagccagaccagaggcguggccgaggacaucgcccacauccugaagcagaugagaagagccaucguggugggcgagagaaccggcggcggcgcccuggaccugagaaagcugagaaucggcgagagcgacuucuucuucaccgugcccgugagcagaagccugggcccccugggcggcggcagccagaccugggagggcagcggcgugcugcccugcgugggcacccccgccgagcaggcccuggagaaggcccuggccauccugacccugagaagcgcccugcccggcguggugcacugccugcaggaggugcugaaggacuacuacacccugguggacagagugcccacccugcugcagcaccuggccagcauggacuucagcaccguggugagcgaggaggaccuggugaccaagcugaacgccggccugcaggccgccagcgaggaccccagacugcuggugagagccaucggccccaccgagacccccagcuggcccgcccccgacgccgccgccgaggacagccccggcguggcccccgagcugcccgaggacgaggccaucagacaggcccugguggacagcguguuccaggugagcgugcugcccggcaacgugggcuaccugagauucgacagcuucgccgacgccagcgugcugggcgugcuggcccccuacgugcugagacaggugugggagccccugcaggacaccgagcaccugaucauggaccugagacacaaccccggcggccccagcagcgccgugccccugcugcugagcuacuuccagggccccgaggccggccccgugcaccuguucaccaccuacgacagaagaaccaacaucacccaggagcacuucagccacauggagcugcccggccccagauacagcacccagagaggcguguaccugcugaccagccacagaaccgccaccgccgccgaggaguucgccuuccugaugcagagccugggcugggccacccuggugggcgagaucaccgccggcaaccugcugcacaccagaaccgugccccugcuggacacccccgagggcagccuggcccugaccgugcccgugcugaccuucaucgacaaccacggcgaggccuggcugggcggcggcguggugcccgacgccaucgugcuggccgaggaggcccuggacaaggcccaggaggugcuggaguuccaccagagccugggcgcccugguggagggcaccggccaccugcuggaggcccacuacgccagacccgagguggugggccagaccagcgcccugcugagagccaagcuggcccagggcgccuacagaaccgccguggaccuggagagccuggccagccagcugaccgccgaccugcaggaggugagcggcgaccacagacugcugguguuccacagccccggcgagcuggugguggaggaggcccccccccccccccccgccgugcccagccccgaggagcugaccuaccugaucgaggcccuguucaagaccgaggugcugcccggccagcugggcuaccugagauucgacgccauggccgagcuggagaccgugaaggccgugggcccccagcuggugagacugguguggcagcagcugguggacaccgccgcccuggugaucgaccugagauacaaccccggcagcuacagcaccgccaucccccugcugugcagcuacuucuucgaggccgagcccagacagcaccuguacagcguguucgacagagccaccagcaaggugaccgagguguggacccugccccagguggccggccagagauacggcagccacaaggaccuguacauccugaugagccacaccagcggcagcgccgccgaggccuucgcccacaccaugcaggaccugcagagagccaccgugaucggcgagcccaccgccggcggcgcccugagcgugggcaucuaccaggugggcagcagcccccuguacgccagcaugcccacccagauggccaugagcgccaccaccggcaaggccugggaccuggccggcguggagcccgacaucaccgugcccaugagcgaggcccugagcaucgcccaggacaucguggcccugagagccaaggugcccaccgugcugcagaccgccggcaagcugguggccgacaacuacgccagcgccgagcugggcgccaagauggccaccaagcugagcggccugcagagcagauacagcagagugaccagcgagguggcccuggccgagauccugggcgccgaccugcagaugcugagcggcgacccccaccugaaggccgcccacauccccgagaacgccaaggacagaauccccggcaucgugcccaugcagauccccagccccgagguguucgaggagcugaucaaguucagcuuccacaccaacgugcuggaggacaacaucggcuaccugagauucgacauguucggcgacggcgagcugcugacccaggugagcagacugcugguggagcacaucuggaagaagaucaugcacaccgacgccaugaucaucgacaugagauucaacaucggcggccccaccagcagcauccccauccugugcagcuacuucuucgacgagggcccccccgugcugcuggacaagaucuacagcagacccgacgacagcgugagcgagcuguggacccacgcccagguggugggcgagagauacggcagcaagaagagcauggugauccugaccagcagcgugaccgccggcaccgccgaggaguucaccuacaucaugaagagacugggcagagcccuggugaucggcgaggugaccagcggcggcugccagcccccccagaccuaccacguggacgacaccaaccuguaccugaccauccccaccgccagaagcgugggcgccagcgacggcagcagcugggagggcgugggcgugaccccccacgugguggugcccgccgaggaggcccuggccagagccaaggagaugcugcagcacaaccagcugagagugaagagaagccccggccugcaggaccaccuguaa

SEQ ID NO: 22508 - RNA, 606 nt, Artificial Sequence
  RBP4__Homo_sapiens__NP_006735
augaagugggugugggcccugcugcugcuggccgcccugggcagcggcagagccgagagagacugcagagugagcagcuucagagugaaggagaacuucgacaaggccagauucagcggcaccugguacgccauggccaagaaggaccccgagggccuguuccugcaggacaacaucguggccgaguucagcguggacgagaccggccagaugagcgccaccgccaagggcagagugagacugcugaacaacugggacgugugcgccgacauggugggcaccuucaccgacaccgaggaccccgccaaguucaagaugaaguacuggggcguggccagcuuccugcagaagggcaacgacgaccacuggaucguggacaccgacuacgacaccuacgccgugcaguacagcugcagacugcugaaccuggacggcaccugcgccgacagcuacagcuucguguucagcagagaccccaacggccugccccccgaggcccagaagaucgugagacagagacaggaggagcugugccuggccagacaguacagacugaucgugcacaacggcuacugcgacggcagaagcgagagaaaccugcuguaa

SEQ ID NO: 22509 - RNA, 1503 nt, Artificial Sequence
  RBPJ__Homo_sapiens__NP_005340
auggaccacaccgagggcagccccgccgaggagccccccgcccacgcccccagccccggcaaguucggcgagagacccccccccaagagacugaccagagaggccaugagaaacuaccugaaggagagaggcgaccagaccgugcugauccugcacgccaagguggcccagaagagcuacggcaacgagaagagauucuucugccccccccccugcguguaccugaugggcagcggcuggaagaagaagaaggagcagauggagagagacggcugcagcgagcaggagagccagcccugcgccuucaucggcaucggcaacagcgaccaggagaugcagcagcugaaccuggagggcaagaacuacugcaccgccaagacccuguacaucagcgacagcgacaagagaaagcacuucaugcugagcgugaagauguucuacggcaacagcgacgacaucggcguguuccugagcaagagaaucaaggugaucagcaagcccagcaagaagaagcagagccugaagaacgccgaccugugcaucgccagcggcaccaagguggcccuguucaacagacugagaagccagaccgugagcaccagauaccugcacguggagggcggcaacuuccacgccagcagccagcaguggggcgccuucuucauccaccugcuggacgacgacgagagcgagggcgaggaguucaccgugagagacggcuacauccacuacggccagaccgugaagcuggugugcagcgugaccggcauggcccugcccagacugaucaucagaaagguggacaagcagaccgcccugcuggacgccgacgaccccgugagccagcugcacaagugcgccuucuaccugaaggacaccgagagaauguaccugugccugagccaggagagaaucauccaguuccaggccacccccugccccaaggagcccaacaaggagaugaucaacgacggcgccagcuggaccaucaucagcaccgacaaggccgaguacaccuucuacgagggcaugggccccgugcuggcccccgugacccccgugcccgugguggagagccugcagcugaacggcggcggcgacguggccaugcuggagcugaccggccagaacuucacccccaaccugagagugugguucggcgacguggaggccgagaccauguacagaugcggcgagagcaugcugugcguggugcccgacaucagcgccuucagagagggcuggagaugggugagacagcccgugcaggugcccgugacccuggugagaaacgacggcaucaucuacagcaccagccugaccuucaccuacacccccgagcccggccccagaccccacugcagcgccgccggcgccauccugagagccaacagcagccaggugccccccaacgagagcaacaccaacagcgagggcagcuacaccaacgccagcaccaacagcaccagcgugaccagcagcaccgccaccguggugagcuaa

SEQ ID NO: 22510 - RNA, 630 nt, Artificial Sequence
  RBPMS2__Homo_sapiens__NP_919248
augagcaaccugaagcccgacggcgagcacggcggcagcaccggcaccggcagcggcgccggcagcggcggcgcccuggaggaggaggugagaacccuguucgugagcggccugcccguggacaucaagcccagagagcuguaccugcuguucagacccuucaagggcuacgagggcagccugaucaagcugaccgccagacagcccgugggcuucgugaucuucgacagcagagccggcgccgaggccgccaagaacgcccugaacggcaucagauucgaccccgagaacccccagacccugagacuggaguucgccaaggccaacaccaagauggccaagagcaagcugauggccacccccaaccccagcaacgugcaccccgcccugggcgcccacuucaucgccagagaccccuacgaccugaugggcgccgcccugauccccgccagccccgaggccugggcccccuacccccuguacaccaccgagcugacccccgccaucagccacgccgccuucaccuaccccaccgccaccgccgccgccgccgcccugcacgcccaggugagaugguaccccagcagcgacaccacccagcagggcuggaaguacagacaguucugcuaa

SEQ ID NO: 22511 - RNA, 2355 nt, Artificial Sequence
  RBSN__Homo_sapiens__NP_001289307
auggccagccuggacgaccccggcgaggugagagagggcuuccugugcccccugugccugaaggaccugcagagcuucuaccagcugcacagccacuacgaggaggagcacagcggcgaggacagagacgugaagggccagaucaagagccuggugcagaaggccaagaaggccaaggacagacugcugaagagagagggcgacgacagagccgagagcggcacccagggcuacgagagcuucagcuacggcggcguggaccccuacaugugggagccccaggagcugggcgccgugagaagccaccugagcgacuucaagaagcacagagccgccagaaucgaccacuacgugguggaggugaacaagcugaucaucagacuggagaagcugaccgccuucgacagaaccaacaccgagagcgccaagaucagagccaucgagaagagcguggugcccugggugaacgaccaggacgugcccuucugccccgacugcggcaacaaguucagcaucagaaacagaagacaccacugcagacugugcggcagcaucaugugcaagaagugcauggagcugaucagccugccccuggccaacaagcugaccagcgccagcaaggagagccugagcacccacaccagccccagccagagccccaacagcgugcacggcagcagaagaggcagcaucagcagcaugagcagcgugagcagcgugcuggacgagaaggacgacgacagaaucagaugcugcacccacugcaaggacacccugcugaagagagagcagcagaucgacgagaaggagcacacccccgacaucgugaagcuguacgagaagcugagacugugcauggagaagguggaccagaaggcccccgaguacaucagaauggccgccagccugaacgccggcgagaccaccuacagccuggagcacgccagcgaccugagaguggaggugcagaagguguacgagcugaucgacgcccugagcaagaagauccugacccugggccugaaccaggacccccccccccaccccagcaaccugagacugcagagaaugaucagauacagcgccacccuguucgugcaggagaagcugcugggccugaugagccugcccaccaaggagcaguucgaggagcugaagaagaagagaaaggaggagauggagagaaagagagccguggagagacaggccgcccuggagagccagagaagacuggaggagagacagagcggccuggccagcagagccgccaacggcgagguggccagccugagaagaggccccgccccccugagaaaggccgagggcuggcugccccugagcggcggccagggccagagcgaggacagcgacccccugcugcagcagauccacaacaucaccagcuucaucagacaggccaaggccgccggcagaauggacgaggugagaacccugcaggagaaccugagacagcugcaggacgaguacgaccagcagcagaccgagaaggccaucgagcugagcagaagacaggccgaggaggaggaccugcagagagagcagcugcagaugcugagagagagagagcuggagagagagagagagcaguucagaguggccagccugcacaccagaaccagaagccuggacuucagagagaucggccccuuccagcuggagcccagcagagagcccagaacccaccuggccuacgcccuggaccugggcagcagccccgugcccagcagcaccgcccccaagacccccagccugagcagcacccagcccaccagaguguggagcggcccccccgccgugggccaggagagacugccccagagcagcaugccccagcagcacgagggccccagccugaaccccuucgacgaggaggaccugagcagccccauggaggaggccaccaccggcccccccgccgccggcgugagccuggaccccagcgccagaauccugaaggaguacaaccccuucgaggaggaggacgaggaggaggaggccguggccggcaaccccuucauccagcccgacagccccgcccccaaccccuucagcgaggaggacgagcacccccagcagagacugagcagcccccuggugcccggcaaccccuucgaggagcccaccugcaucaaccccuucgagauggacagcgacagcggccccgaggccgaggagcccaucgaggaggagcugcugcugcagcagaucgacaacaucaaggccuacaucuucgacgccaagcagugcggcagacuggacgagguggaggugcugaccgagaaccugagagagcugaagcacacccuggccaagcagaagggcggcaccgacuaa

SEQ ID NO: 22512 - RNA, 327 nt, Artificial Sequence
  RBX1__Homo_sapiens__NP_055063
auggccgccgccauggacguggacacccccagcggcaccaacagcggcgccggcaagaagagauucgaggugaagaaguggaacgccguggcccugugggccugggacaucgugguggacaacugcgccaucugcagaaaccacaucauggaccugugcaucgagugccaggccaaccaggccagcgccaccagcgaggagugcaccguggccuggggcgugugcaaccacgccuuccacuuccacugcaucagcagauggcugaagaccagacaggugugcccccuggacaacagagagugggaguuccagaaguacggccacuaa

SEQ ID NO: 22513 - RNA, 3378 nt, Artificial Sequence
  RC3H1__Homo_sapiens__NP_001287780
augcccgugcaggccccccaguggaccgacuuccugagcugccccaucugcacccagaccuucgacgagaccaucagaaagcccaucagccugggcugcggccacaccgugugcaagaugugccugaacaagcugcacagaaaggccugccccuucgaccagaccaccaucaacaccgacaucgagcugcugcccgugaacagcgcccugcugcagcuggugggcgcccaggugcccgagcagcagcccaucacccugugcagcggcguggaggacaccaagcacuacgaggaggccaagaagugcguggaggagcuggcccuguaccugaagccccugagcagcgccagaggcgugggccugaacagcaccacccagagcgugcugagcagacccaugcagagaaagcuggugacccuggugcacugccagcugguggaggaggagggcagaaucagagccaugagagccgccagaagccugggcgagagaaccgugaccgagcugauccugcagcaccagaacccccagcagcugagcagcaaccugugggccgccgugagagccagaggcugccaguuccugggccccgccaugcaggaggaggcccugaagcuggugcugcuggcccuggaggacggcagcgcccugagcagaaaggugcuggugcuguucguggugcagagacuggagcccagauucccccaggccagcaagaccagcaucggccacguggugcagcugcuguacagagccagcugcuucaaggugaccaagagagacgaggacagcagccugaugcagcugaaggaggaguucagaaccuacgaggcccugagaagagagcacgacagccagaucgugcagaucgccauggaggccggccugagaaucgcccccgaccaguggagcagccugcuguacggcgaccagagccacaagagccacaugcagagcaucaucgacaagcugcagacccccgccagcuucgcccagagcgugcaggagcugaccaucgcccugcagagaaccggcgaccccgccaaccugaacagacugagaccccaccuggagcugcuggccaacaucgaccccagccccgacgcccccccccccaccugggagcagcuggagaacggccugguggccgugagaaccguggugcacggccugguggacuacauccagaaccacagcaagaagggcgccgaccagcagcagcccccccagcacagcaaguacaagaccuacaugugcagagacaugaagcagagaggcggcugccccagaggcgccagcugcaccuucgcccacagccaggaggagcuggagaaguucagaaagaugaacaagagacuggugcccagaagaccccugagcgccagccugggccagcugaacgaggugggccugcccagcgccgccauccugcccgacgagggcgccguggaccugcccagcagaaagccccccgcccugcccaacggcaucgugagcaccggcaacaccgugacccagcugauccccagaggcaccgaccccagcuacgacagcagccugaagcccggcaagaucgaccaccugagcagcagcgcccccggcagcccccccgaccugcuggagagcgugcccaagagcaucagcgcccugcccgugaacccccacagcaucccccccagaggccccgccgaccugccccccaugcccgugaccaagccccugcagauggugcccagaggcagccagcuguaccccgcccagcagaccgacguguacuaccaggaccccagaggcgccgccccccccuucgagcccgcccccuaccagcagggcauguacuacaccccccccccccagugcgugagcagauucgugagacccccccccagcgcccccgagcccgccccccccuaccuggaccacuacccccccuaccugcaggagagaguggugaacagccaguacggcacccagccccagcaguacccccccaucuaccccagccacuacgacggcagaagaguguaccccgcccccagcuacaccagagaggagaucuucagagagagccccauccccaucgagaucccccccgccgccgugcccagcuacgugcccgagagcagagagagauaccagcagaucgagagcuacuaccccguggccccccaccccacccagaucagacccagcuaccugagagagccccccuacagcagacugcccccccccccccagccccaccccagccuggacgagcugcacagaagaagaaaggagaucauggcccagcuggaggagagaaaggugaucagccccccccccuucgcccccagccccacccugccccccaccuuccaccccgaggaguuccuggacgaggaccugaagguggccggcaaguacaagggcaacgacuacagccaguacagccccuggagcugcgacaccaucggcagcuacaucggcaccaaggacgccaagcccaaggacgugguggccgccggcagcguggagaugaugaacguggagagcaagggcaugagagaccagagacuggaccugcagagaagagccgccgagaccagcgacgacgaccugauccccuucggcgacagacccaccgugagcagauucggcgccaucagcagaaccagcaagaccaucuaccagggcgccggccccaugcaggccauggccccccagggcgcccccaccaagagcaucaacaucagcgacuacagccccuacggcacccacggcggcuggggcgccagccccuacagcccccaccagaacauccccagccagggccacuucagcgagagagagagaaucagcaugagcgagguggccagccacggcaagccccugcccagcgccgagagagagcagcugagacuggagcugcagcagcugaaccaccagaucagccagcagacccagcugagaggccuggagagagaggccaacacccuggccggccagagccagcccccccccccccccccccccaaguggcccggcaugaucagcagcgagcagcugagccuggagcugcaccagguggagagagagaucggcaagagaaccagagagcugagcauggagaaccagugcagccuggacaugaagagcaagcugaacaccagcaagcaggccgagaacggccagcccgagccccagaacaaggugcccgccgaggaccugacccugaccuucagcagcgacgugcccaacggcagcgcccugacccaggagaacaucagccugcugagcaacaagaccagcagccugaaccugagcgaggaccccgagggcggcggcgacaacaacgacagccagagaagcggcgugacccccagcagcgcccccuaa

SEQ ID NO: 22514 - RNA, 516 nt, Artificial Sequence
  RCAN1__Homo_sapiens__NP_001272318
augguguacgccaaguucgagagccuguucagaaccuacgacaaggacaucaccuuccaguacuucaagagcuucaagagagugagaaucaacuucagcaaccccuucagcgccgccgacgccagacugcagcugcacaagaccgaguuccugggcaaggagaugaagcuguacuucgcccagacccugcacaucggcagcagccaccuggccccccccaaccccgacaagcaguuccugaucagcccccccgccagcccccccgugggcuggaagcagguggaggacgccacccccgugaucaacuacgaccugcuguacgccaucagcaagcugggccccggcgagaaguacgagcugcacgccgccaccgacaccacccccagcgugguggugcacgugugcgagagcgaccaggagaaggaggaggaggaggagauggagagaaugagaagacccaagcccaagaucauccagaccagaagacccgaguacacccccauccaccugagcuaa

SEQ ID NO: 22515 - RNA, 594 nt, Artificial Sequence
  RCAN2__Homo_sapiens__NP_005813
augcccgcccccagcauggacugcgacgugagcacccugguggccugcgugguggacguggagguguucaccaaccaggaggugaaggagaaguucgagggccuguucagaaccuacgacgacugcgugaccuuccagcuguucaagagcuucagaagagugagaaucaacuucagcaaccccaagagcgccgccagagccagaaucgagcugcacgagacccaguucagaggcaagaagcugaagcuguacuucgcccaggugcagacccccgagaccgacggcgacaagcugcaccuggcccccccccagcccgccaagcaguuccugaucagcccccccagcagcccccccgugggcuggcagcccaucaacgacgccacccccgugcugaacuacgaccugcuguacgccguggccaagcugggccccggcgagaaguacgagcugcacgccggcaccgagagcacccccagcgugguggugcacgugugcgacagcgacaucgaggaggaggaggaccccaagaccagccccaagcccaagaucauccagaccagaagacccggccugccccccagcgugagcaacuaa

SEQ ID NO: 22516 - RNA, 1596 nt, Artificial Sequence
  RCBTB1__Homo_sapiens__XP_005266498
augguggacgugggcaaguggcccaucuucacccugcugagcccccaggagaucgccagcaucagaaaggccugcguguucggcaccagcgccagcgaggcccuguacgugaccgacaacgacgagguguucguguucggccugaacuacagcaacugccugggcaccggcgacaaccagagcacccuggugcccaagaagcuggagggccugugcggcaagaagaucaagagccugagcuacggcagcggcccccacgugcugcugagcaccgaggacggcgugguguacgccuggggccacaacggcuacagccagcugggcaacggcaccaccaaccagggcaucgcccccgugcaggugugcaccaaccugcugaucaagcaggugguggagguggccugcggcagccaccacagcauggcccuggccgccgacggcgagguguucgccuggggcuacaacaacugcggccaggugggcagcggcagcaccgccaaccagcccacccccagaaaggugaccaacugccugcacaucaagagaguggugggcaucgccugcggccagaccagcagcauggccgugcuggacaacggcgagguguacggcuggggcuacaacggcaacggccagcugggccugggcaacaacggcaaccagcugacccccgugagaguggccgcccugcacagcgugugcgugaaccagaucgugugcggcuacgcccacacccuggcccugaccgacgagggccugcuguacgccuggggcgccaacaccuacggccagcugggcaccggcaacaagaacaaccugcugagccccgcccacaucaugguggagaaggagagagugguggagaucgccgccugccacagcgcccacaccagcgccgccaagacccagggcggccacguguacauguggggccagugcagaggccagagcgugauccugccccaccugacccacuucagcugcaccgacgacguguucgccugcuucgccacccccgccgugagcuggagacugcugagcguggagcacgaggacuuccugaccguggccgagagccugaagaaggaguucgacagccccgagaccgccgaccugaaguucagaaucgacggcaaguacauccacgugcacaaggccgugcugaagaucagaugcgagcacuucagaagcauguuccagagcuacuggaacgaggacaugaaggaggugaucgagaucgaccaguucagcuaccccguguacagagccuuccugcaguaccuguacaccgacaccguggaccugccccccgaggacgccaucggccugcuggaccuggccaccagcuacugcgagaacagacugaagaagcugugccagcacaucaucaagagaggcaucaccguggagaacgccuucagccuguucagcgccgccgugagauacgacgccgaggaccuggaggaguucugcuucaaguucugcaucaaccaccugaccgaggugacccagaccgccgccuucuggcagauggacggcccccugcugaaggaguucaucgccaaggccagcaagugcggcgccuucaagaacuaa

SEQ ID NO: 22517 - RNA, 1671 nt, Artificial Sequence
  RCBTB2__Homo_sapiens__NP_001273759
augagcgcccugcccagagaccuggagcugagcaaccccagagagaagcugaccaagcccgugcaggccacccugagcagccugaagaugcuggacgugggcaaguggcccaucuucagccugugcagcgaggaggagcugcagcugaucagacaggccugcguguucggcagcgccggcaacgaggugcuguacaccaccgugaacgacgagaucuucgugcugggcaccaacugcugcggcugccugggccugggcgacgugcagagcaccaucgagcccagaagacuggacagccugaacggcaagaagaucgccugccugagcuacggcagcggcccccacaucgugcuggccaccaccgagggcgagguguucaccuggggccacaacgccuacagccagcugggcaacggcaccaccaaccacggccuggugcccugccacaucagcaccaaccugagcaacaagcaggugaucgagguggccugcggcagcuaccacagccuggugcugaccagcgacggcgagguguucgccuggggcuacaacaacagcggccaggugggcagcggcagcaccgugaaccagcccauccccagaagagugaccggcugccugcagaacaaggugguggugaccaucgccugcggccagaugugcugcauggccgugguggacaccggcgagguguacguguggggcuacaacggcaacggccagcugggccugggcaacagcggcaaccagcccacccccugcagaguggccgcccugcagggcaucagagugcagagaguggccugcggcuacgcccacacccuggugcugaccgacgagggccagguguacgccuggggcgccaacagcuacggccagcugggcaccggcaacaagagcaaccagagcuaccccacccccgugaccguggagaaggacagaaucaucgagaucgccgccugccacagcacccacaccagcgccgccaagacccagggcggccacguguacauguggggccagugcagaggccagagcgugauccugccccaccugacccacuucagcugcaccgacgacguguucgccugcuucgccacccccgccgugaccuggagacugcugagcguggagcccgacgaccaccugaccguggccgagagccugaagagagaguucgacaaccccgacaccgccgaccugaaguuccugguggacggcaaguacaucuacgcccacaaggugcugcugaagaucagaugcgagcacuucagaagcagccuggaggacaacgaggacgacaucguggagaugagcgaguucagcuaccccguguacagagccuuccuggaguaccuguacaccgacagcaucagccugagccccgaggaggccgugggccugcuggaccuggccaccuucuacagagagaacagacugaagaagcugugccagcagaccaucaagcagggcaucugcgaggagaacgccaucgcccugcugagcgccgccgugaaguacgacgcccaggaccuggaggaguucugcuucagauucugcaucaaccaccugaccguggugacccagaccagcggcuucgccgagauggaccacgaccugcugaagaacuucaucagcaaggccagcagagugggcgccuucaagaacuaa

SEQ ID NO: 22518 - RNA, 759 nt, Artificial Sequence
  RCHY1__Homo_sapiens__NP_001009922
auggccgccaccgccagagaggacggcgccagcggccaggagagaggccagagaggcugcgagcacuacgacagaggcugccugcugaaggcccccugcugcgacaagcuguacaccugcagacugugccacgacaacaacgaggaccaccagcuggacagauucaaggugaaggaggugcagugcaucaacugcgagaagauccagcacgcccagcagaccugcgaggagugcagcacccuguucggcgaguacuacugcgacaucugccaccuguucgacaaggacaagaagcaguaccacugcgagaacugcggcaucugcagaaucggccccaaggaggacuucuuccacugccugaagugcaaccugugccuggccaugaaccugcagggcagacacaagugcaucgagaacgugagcagacagaacugccccaucugccuggaggacauccacaccagcagagugguggcccacgugcugcccugcggccaccugcugcacagaggcuacagaugcccccugugcaugcacagcgcccuggacaugaccagauacuggagacagcuggacgacgagguggcccagacccccaugcccagcgaguaccagaacaugaccguggacauccugugcaacgacugcaacggcagaagcaccgugcaguuccacauccugggcaugaagugcaagaucugcgagagcuacaacaccgcccaggccggcggcagaagaaucagccuggaccagcaguaa

SEQ ID NO: 22519 - RNA, 648 nt, Artificial Sequence
  RCL1__Homo_sapiens__NP_001273629
augccccccggcggcggcggcgaggugguguucagcugccccgugagaaaggugcugaagcccauccagcugaccgaccccggcaagaucaagagaaucagaggcauggccuacagcgugagagugagcccccagauggccaacagaaucguggacagcgccagaagcauccugaacaaguucauccccgacaucuacaucuacaccgaccacaugaagggcgugaacagcggcaagagccccggcuucggccugagccugguggccgagaccaccagcggcaccuuccugagcgccgagcuggccagcaacccccagggccagggcgccgccgugcugcccgaggaccugggcagaaacugcgccagacugcugcuggaggagaucuacagaggcggcugcguggacagcaccaaccagagccuggcccugcugcugaugacccugggccagcaggacgugagcaaggugcugcugggcccccugagccccuacaccaucgaguuccugagacaccugaagagcuucuuccagaucauguucaagaucgagaccaagcccugcggcgaggagcugaagggcggcgacaaggugcugaugaccugcgugggcaucggcuucagcaaccugagcaagacccugaaguaa

SEQ ID NO: 22520 - RNA, 996 nt, Artificial Sequence
  RCN1__Homo_sapiens__NP_002892
auggccagaggcggcagaggcagaagacugggccuggcccugggccugcugcuggcccuggugcuggcccccagagugcugagagccaagcccaccgugagaaaggagagaguggugagacccgacagcgagcugggcgagagaccccccgaggacaaccagagcuuccaguacgaccacgaggccuuccugggcaaggaggacagcaagaccuucgaccagcugacccccgacgagagcaaggagagacugggcaagaucguggacagaaucgacaacgacggcgacggcuucgugaccaccgaggagcugaagaccuggaucaagagagugcagaagagauacaucuucgacaacguggccaagguguggaaggacuacgacagagacaaggacgacaagaucagcugggaggaguacaagcaggccaccuacggcuacuaccugggcaaccccgccgaguuccacgacagcagcgaccaccacaccuucaagaagaugcugcccagagacgagagaagauucaaggccgccgaccugaacggcgaccugaccgccaccagagaggaguucaccgccuuccugcaccccgaggaguucgagcacaugaaggagaucguggugcuggagacccuggaggacaucgacaagaacggcgacggcuucguggaccaggacgaguacaucgccgacauguucagccacgaggagaacggccccgagcccgacugggugcugagcgagagagagcaguucaacgaguucagagaccugaacaaggacggcaagcuggacaaggacgagaucagacacuggauccugccccaggacuacgaccacgcccaggccgaggccagacaccugguguacgagagcgacaagaacaaggacgagaagcugaccaaggaggagauccuggagaacuggaacauguucgugggcagccaggccaccaacuacggcgaggaccugaccaagaaccacgacgagcuguaa

SEQ ID NO: 22521 - RNA, 954 nt, Artificial Sequence
  RCN2__Homo_sapiens__NP_002893
augagacugggccccagaaccgccgcccugggccugcugcugcugugcgccgccgccgccggcgccggcaaggccgaggagcugcacuacccccugggcgagagaagaagcgacuacgacagagaggcccugcugggcgugcaggaggacguggacgaguacgugaagcugggccacgaggagcagcagaagagacugcaggccaucaucaagaagaucgaccuggacagcgacggcuuccugaccgagagcgagcugagcagcuggauccagaugagcuucaagcacuacgccaugcaggaggccaagcagcaguucguggaguacgacaagaacagcgacgacaccgugaccugggacgaguacaacauccagauguacgacagagugaucgacuucgacgagaacaccgcccuggacgacgccgaggaggagagcuucagaaagcugcaccugaaggacaagaagagauucgagaaggccaaccaggacagcggccccggccugagccuggaggaguucaucgccuucgagcaccccgaggagguggacuacaugaccgaguucgugauccaggaggcccuggaggagcacgacaagaacggcgacggcuucgugagccuggaggaguuccugggcgacuacagaugggaccccaccgccaacgaggaccccgaguggauccugguggagaaggacagauucgugaacgacuacgacaaggacaacgacggcagacuggacccccaggagcugcugcccuggguggugcccaacaaccagggcaucgcccaggaggaggcccugcaccugaucgacgagauggaccugaacggcgacaagaagcugagcgaggaggagauccuggagaaccccgaccuguuccugaccagcgaggccaccgacuacggcagacagcugcacgacgacuacuucuaccacgacgagcuguaa

SEQ ID NO: 22522 - RNA, 1458 nt, Artificial Sequence
  RCOR1__Homo_sapiens__NP_055971
augcccgccaugguggagaagggccccgaggugagcggcaagagaagaggcagaaacaacgccgccgccagcgccagcgccgccgccgccagcgccgccgccagcgccgccugcgccagccccgccgccaccgccgccagcggcgccgccgccagcagcgccagcgccgccgccgccagcgccgccgccgcccccaacaacggccagaacaagagccuggccgccgccgcccccaacggcaacagcagcagcaacagcugggaggagggcagcagcggcagcagcagcgacgaggagcacggcggcggcggcaugagagugggcccccaguaccaggccguggugcccgacuucgaccccgccaagcuggccagaagaagccaggagagagacaaccugggcaugcugguguggagccccaaccagaaccugagcgaggccaagcuggacgaguacaucgccaucgccaaggagaagcacggcuacaacauggagcaggcccugggcaugcuguucuggcacaagcacaacaucgagaagagccuggccgaccugcccaacuucacccccuuccccgacgaguggaccguggaggacaaggugcuguucgagcaggccuucagcuuccacggcaagaccuuccacagaauccagcagaugcugcccgacaagagcaucgccagccuggugaaguucuacuacagcuggaagaagaccagaaccaagaccagcgugauggacagacacgccagaaagcagaagagagagagagaggagagcgaggacgagcuggaggaggccaacggcaacaaccccaucgacaucgagguggaccagaacaaggagagcaagaaggaggugccccccaccgagaccgugccccaggugaagaaggagaagcacagcacccaggccaagaacagagccaagagaaagccccccaagggcauguuccugagccaggaggacguggaggccgugagcgccaacgccaccgccgccaccaccgugcugagacagcuggacauggagcuggugagcgugaagagacagauccagaacaucaagcagaccaacagcgcccugaaggagaagcuggacggcggcaucgagcccuacagacugcccgaggugauccagaagugcaacgccagauggaccaccgaggagcagcugcuggccgugcaggccaucagaaaguacggcagagacuuccaggccaucagcgacgugaucggcaacaagagcguggugcaggugaagaacuucuucgugaacuacagaagaagauucaacaucgacgaggugcugcaggagugggaggccgagcacggcaaggaggagaccaacggccccagcaaccagaagcccgugaagagccccgacaacagcaucaagaugcccgaggaggaggacgaggcccccgugcuggacgugagauacgccagcgccagcuaa

SEQ ID NO: 22523 - RNA, 1251 nt, Artificial Sequence
  RCSD1__Homo_sapiens__NP_443094
auggaggagagacccgccgagaccaacgccaacguggacaacagcgccagccccagcguggcccagcuggccggcagauucagagagcaggccgccgccgccaaggagacccccgccagcaagcccaccagaagaaagccccccugcagccugccccuguucccccccaagguggaccugggccagaacggcgaggagaagagcccccccaacgccagccacccccccaaguucaaggugaagagcagcccccugaucgagaagcugcaggccaaccugaccuucgaccccgccgcccugcugcccggcgccagccccaagagccccggccugaaggccauggugagccccuuccacagcccccccagcacccccagcagccccggcgugagaagcagacccagcgaggccgaggaggugcccgugagcuucgaccagccccccgagggcagccaccugcccugcuacaacaaggugagaaccagaggcagcaucaagagaagaccccccagcagaagauucagaagaagccagagcgacugcggcgagcugggcgacuucagagccguggagagcagccagcagaacggcgccaaggaggaggacggcgacgaggugcugcccagcaagagcaaggcccccggcagcccccugagcagcgagggcgccgccggcgagggcgugagaacccugggccccgccgagaagcccccccugagaagaagccccagcagaaccgagaagcaggaggaggacagagccaccgaggaggccaagaacggcgagaaggccagaagaagcagcgaggagguggacggccagcaccccgcccaggaggaggugcccgagagcccccagaccagcggccccgaggccgagaacagaugcggcagccccagagaggagaagcccgccggcgaggaggccgagauggagaaggccaccgaggugaagggcgagagagugcagaacgaggaggugggccccgagcacgacagccaggagaccaagaagcuggaggagggcgccgccgugaaggagaccccccacagcccccccggcggcgugaagggcggcgacgugcccaagcaggagaagggcaaggagaagcagcaggagggcgccgugcuggagcccggcugcagcccccagaccggccccgcccagcuggagaccagcagcgaggugcagagcgagcccgccgugcccaagcccgaggacgacacccccgugcaggacaccaagauguaa

SEQ ID NO: 22524 - RNA, 603 nt, Artificial Sequence
  RCVRN__Homo_sapiens__NP_002894
augggcaacagcaagagcggcgcccugagcaaggagauccuggaggagcugcagcugaacaccaaguucagcgaggaggagcugugcagcugguaccagagcuuccugaaggacugccccaccggcagaaucacccagcagcaguuccagagcaucuacgccaaguucuuccccgacaccgaccccaaggccuacgcccagcacguguucagaagcuucgacagcaaccuggacggcacccuggacuucaaggaguacgugaucgcccugcacaugaccaccgccggcaagaccaaccagaagcuggagugggccuucagccuguacgacguggacggcaacggcaccaucagcaagaacgaggugcuggagaucgugauggccaucuucaagaugaucacccccgaggacgugaagcugcugcccgacgacgagaacacccccgagaagagagccgagaagaucuggaaguacuucggcaagaacgacgacgacaagcugaccgagaaggaguucaucgagggcacccuggccaacaaggagauccugagacugauccaguucgagccccagaaggugaaggagaagaugaagaacgccuaa

SEQ ID NO: 22525 - RNA, 588 nt, Artificial Sequence
  RD3__Homo_sapiens__NP_001158160
augagccugaucagcuggcugagauggaacgaggcccccagcagacugagcaccagaagccccgccgagauggugcuggagacccugaugauggagcugaccggccagaugagagaggccgagagacagcagagagagagaagcaacgccgugagaaaggugugcaccggcguggacuacagcuggcuggccagcacccccagaagcaccuacgaccugagccccaucgagagacugcagcuggaggacgugugcgugaagauccaccccagcuacugcggccccgccauccugagauucagacagcugcuggccgagcaggagcccgaggugcaggaggugagccagcuguucagaagcgugcugcaggaggugcuggagagaaugaagcaggaggaggaggcccacaagcugaccagacaguggagccugagacccagaggcagccuggccaccuucaagaccagagccagaaucagccccuucgccagcgacaucagaaccaucagcgaggacguggagagagacaccccccccccccugagaagcuggagcaugcccgaguucagagcccccaaggccgacuaa

SEQ ID NO: 22526 - RNA, 1026 nt, Artificial Sequence
  RDH10__Homo_sapiens__NP_742034
augaacaucgugguggaguucuucguggugaccuucaaggugcugugggccuucgugcuggccgccgccagauggcuggugagacccaaggagaagagcguggccggccaggugugccugaucaccggcgccggcagcggccugggcagacuguucgcccuggaguucgccagaagaagagcccugcuggugcugugggacaucaacacccagagcaacgaggagaccgccggcauggugagacacaucuacagagaccuggaggccgccgacgccgccgcccugcaggccggcaacggcgaggaggagauccugccccacugcaaccugcagguguucaccuacaccugcgacgugggcaagagagagaacguguaccugaccgccgagagagugagaaaggaggugggcgaggugagcgugcuggugaacaacgccggcguggugagcggccaccaccugcuggagugccccgacgagcugaucgagagaaccaugauggugaacugccacgcccacuucuggaccaccaaggccuuccugcccaccaugcuggagaucaaccacggccacaucgugaccguggccagcagccugggccuguucagcaccgccggcguggaggacuacugcgccagcaaguucggcguggugggcuuccacgagagccugagccacgagcugaaggccgccgagaaggacggcaucaagaccacccuggugugccccuaccugguggacaccggcauguucagaggcugcagaaucagaaaggagaucgagcccuuccugcccccccugaagcccgacuacugcgugaagcaggccaugaaggccauccugaccgaccagcccaugaucugcacccccagacugauguacaucgugaccuucaugaagagcauccugcccuucgaggccguggugugcauguacagauuccugggcgccgacaagugcauguaccccuucaucgcccagagaaagcaggccaccaacaacaacgaggccaagaacggcaucuaa

SEQ ID NO: 22527 - RNA, 957 nt, Artificial Sequence
  RDH11__Homo_sapiens__NP_057110
augguggagcugauguucccccugcugcugcugcugcugcccuuccugcuguacauggccgccccccagaucagaaagaugcugagcagcggcgugugcaccagcaccgugcagcugcccggcaagguggugguggugaccggcgccaacaccggcaucggcaaggagaccgccaaggagcuggcccagagaggcgccagaguguaccuggccugcagagacguggagaagggcgagcugguggccaaggagauccagaccaccaccggcaaccagcaggugcuggugagaaagcuggaccugagcgacaccaagagcaucagagccuucgccaagggcuuccuggccgaggagaagcaccugcacgugcugaucaacaacgccggcgugaugaugugccccuacagcaagaccgccgacggcuucgagaugcacaucggcgugaaccaccugggccacuuccugcugacccaccugcugcuggagaagcugaaggagagcgcccccagcagaaucgugaacgugagcagccuggcccaccaccugggcagaauccacuuccacaaccugcagggcgagaaguucuacaacgccggccuggccuacugccacagcaagcuggccaacauccuguucacccaggagcuggccagaagacugaagggcagcggcgugaccaccuacagcgugcaccccggcaccgugcagagcgagcuggugagacacagcagcuucaugagauggaugugguggcuguucagcuucuucaucaagaccccccagcagggcgcccagaccagccugcacugcgcccugaccgagggccuggagauccugagcggcaaccacuucagcgacugccacguggccugggugagcgcccaggccagaaacgagaccaucgccagaagacugugggacgugagcugcgaccugcugggccugcccaucgacuaa

SEQ ID NO: 22528 - RNA, 951 nt, Artificial Sequence
  RDH12__Homo_sapiens__NP_689656
augcuggugacccugggccugcugaccagcuucuucagcuuccuguacaugguggcccccagcaucagaaaguucuucgccggcggcgugugcagaaccaacgugcagcugcccggcaaggugguggugaucaccggcgccaacaccggcaucggcaaggagaccgccagagagcuggccagcagaggcgccagaguguacaucgccugcagagacgugcugaagggcgagagcgccgccagcgagaucagaguggacaccaagaacagccaggugcuggugagaaagcuggaccugagcgacaccaagagcaucagagccuucgccgagggcuuccuggccgaggagaagcagcugcacauccugaucaacaacgccggcgugaugaugugccccuacagcaagaccgccgacggcuucgagacccaccugggcgugaaccaccugggccacuuccugcugaccuaccugcugcuggagagacugaaggugagcgcccccgccagaguggugaacgugagcagcguggcccaccacaucggcaagauccccuuccacgaccugcagagcgagaagagauacagcagaggcuucgccuacugccacagcaagcuggccaacgugcuguucaccagagagcuggccaagagacugcagggcaccggcgugaccaccuacgccgugcaccccggcguggugagaagcgagcuggugagacacagcagccugcugugccugcuguggagacuguucagccccuucgugaagaccgccagagagggcgcccagaccagccugcacugcgcccuggccgagggccuggagccccugagcggcaaguacuucagcgacugcaagagaaccugggugagccccagagccagaaacaacaagaccgccgagagacuguggaacgugagcugcgagcugcugggcaucagaugggaguaa

SEQ ID NO: 22529 - RNA, 1011 nt, Artificial Sequence
  RDH14__Homo_sapiens__NP_065956
auggccguggccaccgccgccgccgugcuggccgcccugggcggcgcccuguggcuggccgccagaagauucgugggccccagagugcagagacugagaagaggcggcgaccccggccugaugcacggcaagaccgugcugaucaccggcgccaacagcggccugggcagagccaccgccgccgagcugcugagacugggcgccagagugaucaugggcugcagagacagagccagagccgaggaggccgccggccagcugagaagagagcugagacaggccgccgagugcggccccgagcccggcgugagcggcgugggcgagcugaucgugagagagcuggaccuggccagccugagaagcgugagagccuucugccaggagaugcugcaggaggagcccagacuggacgugcugaucaacaacgccggcaucuuccagugccccuacaugaagaccgaggacggcuucgagaugcaguucggcgugaaccaccugggccacuuccugcugaccaaccugcugcugggccugcugaagagcagcgcccccagcagaaucgugguggugagcagcaagcuguacaaguacggcgacaucaacuucgacgaccugaacagcgagcagagcuacaacaagagcuucugcuacagcagaagcaagcuggccaacauccuguucaccagagagcuggccagaagacuggagggcaccaacgugaccgugaacgugcugcaccccggcaucgugagaaccaaccugggcagacacauccacaucccccugcuggugaagccccuguucaaccuggugagcugggccuucuucaagacccccguggagggcgcccagaccagcaucuaccuggccagcagccccgagguggagggcgugagcggcagauacuucggcgacugcaaggaggaggagcugcugcccaaggccauggacgagagcguggccagaaagcugugggacaucagcgaggugauggugggccugcugaaguaa

SEQ ID NO: 22530 - RNA, 954 nt, Artificial Sequence
  RDH16__Homo_sapiens__NP_003699
auguggcuguaccuggccguguucgugggccuguacuaccugcugcacugguacagagagagacaggugcugagccaccugagagacaaguacguguucaucaccggcugcgacagcggcuucggcaagcugcuggccagacagcuggacgccagaggccugagagugcuggccgccugccugaccgagaagggcgccgagcagcugagaggccagaccagcgacagacuggagaccgugacccuggacgugaccaagaccgagagcguggccgccgccgcccagugggugaaggagugcgugagagacaagggccuguggggccuggugaacaacgccggcaucagccugcccaccgcccccaacgagcugcugaccaagcaggacuucgugaccauccuggacgugaaccugcugggcgugaucgacgugacccugagccugcugccccuggugagaagagccagaggcagaguggugaacgugagcagcgugaugggcagagugagccuguucggcggcggcuacugcaucagcaaguacggcguggaggccuucagcgacagccugagaagagagcugagcuacuucggcgugaagguggccaugaucgagcccggcuacuucaagaccgccgugaccagcaaggagagauuccugaagagcuuccuggagaucugggacagaagcagccccgaggugaaggaggccuacggcgagaaguucguggccgacuacaagaagagcgccgagcagauggagcagaagugcacccaggaccugagccuggugaccaacugcauggagcacgcccugaucgccugccaccccagaaccagauacagcgccggcugggacgccaagcugcuguaccugcccaugagcuacaugcccaccuuccugguggacgccaucauguacugggugagccccagccccgccaaggcccuguaa

SEQ ID NO: 22531 - RNA, 957 nt, Artificial Sequence
  RDH5__Homo_sapiens__NP_002896
auguggcugccccugcugcugggcgcccugcugugggccgugcuguggcugcugagagacagacagagccugcccgccagcaacgccuucguguucaucaccggcugcgacagcggcuucggcagacugcuggcccugcagcuggaccagagaggcuucagagugcuggccagcugccugacccccagcggcgccgaggaccugcagagaguggccagcagcagacugcacaccacccugcuggacaucaccgacccccagagcgugcagcaggccgccaaguggguggagaugcacgugaaggaggccggccuguucggccuggugaacaacgccggcguggccggcaucaucggccccacccccuggcugaccagagacgacuuccagagagugcugaacgugaacaccaugggccccaucggcgugacccuggcccugcugccccugcugcagcaggccagaggcagagugaucaacaucaccagcgugcugggcagacuggccgccaacggcggcggcuacugcgugagcaaguucggccuggaggccuucagcgacagccugagaagagacguggcccacuucggcaucagagugagcaucguggagcccggcuucuucagaacccccgugaccaaccuggagagccuggagaagacccugcaggccugcugggccagacugccccccgccacccaggcccacuacggcggcgccuuccugaccaaguaccugaagaugcagcagagaaucaugaaccugaucugcgaccccgaccugaccaaggugagcagaugccuggagcacgcccugaccgccagacaccccagaaccagauacagccccggcugggacgccaagcugcuguggcugcccgccagcuaccugcccgccagccugguggacgccgugcugaccugggugcugcccaagcccgcccaggccguguacuaa

SEQ ID NO: 22532 - RNA, 996 nt, Artificial Sequence
  RDH8__Homo_sapiens__NP_056540
augaacggccagagccaggugcugcccggcggcggccacgagagcagagagggcaucaacauggccgccgcccccagaaccgugcugaucagcggcugcagcagcggcaucggccuggagcuggccgugcagcuggcccacgaccccaagaagagauaccaggugguggccaccaugagagaccugggcaagaaggagacccuggaggccgccgccggcgaggcccugggccagacccugaccguggcccagcuggacgugugcagcgacgagagcguggcccagugccugagcugcauccagggcgagguggacgugcuggugaacaacgccggcaugggccuggugggcccccuggagggccugagccuggccgccaugcagaacguguucgacaccaacuucuucggcgccgugagacuggugaaggccgugcugcccggcaugaagagaagaagacagggccacaucguggugaucagcagcgugaugggccugcagggcgugaucuucaacgacguguacgccgccagcaaguucgcccuggagggcuucuucgagagccuggccauccagcugcugcaguucaacaucuucaucagccugguggagcccggccccguggugaccgaguucgagggcaagcugcuggcccaggugagcauggccgaguuccccggcaccgaccccgagacccugcacuacuucagagaccuguaccugcccgccagcagaaagcuguucugcagcgugggccagaacccccaggacguggugcaggccaucgugaacgugaucagcagcaccagacccccccugagaagacagaccaacaucagauacagcccccugaccacccugaagaccguggacagcagcggcagccuguacgugagaaccacccacagacugcuguucagaugccccagacugcugaaccugggccugcagugccugagcugcggcugccugcccaccagagugagacccagauaa

SEQ ID NO: 22533 - RNA, 711 nt, Artificial Sequence
  RDM1__Homo_sapiens__NP_001030008
auggccgagcuggugcccuucgccgugcccaucgagagcgacaagacccugcuggugugggagcugagcagcggccccaccgccgaggcccugcaccacagccuguucaccgccuucagccaguucggccugcuguacagcgugagaguguuccccaacgccgccguggcccaccccggcuucuacgccgugaucaaguucuacagcgccagagccgcccacagagcccagaaggccugcgacagaaagcagcuguuccagaagagccccgugaaggugagacugggcaccagacacaaggccgugcagcaccaggcccuggcccugaacagcagcaagugccaggagcuggccaacuacuacuucggcuucaacggcugcagcaagagaaucaucaagcugcaggagcugagcgaccuggaggagagagagaacgaggacagcauggugccccugcccaagcagagccugaaguucuucugcgcccuggagguggugcugcccagcugcgacugcagaagccccggcaucggccugguggaggagcccauggacaagguggaggagggcccccugagcuuccugaugaagagaaagaccgcccagaagcuggccauccagaaggcccugagcgacgccuuccagaagcugcugaucguggugcugggcaagaccgugcugaucauccuggaggugcugcaguuccaguaa

SEQ ID NO: 22534 - RNA, 1815 nt, Artificial Sequence
  RDX__Homo_sapiens__NP_001247421
augcccaagcccaucaacgugagagugaccaccauggacgccgagcuggaguucgccauccagcccaacaccaccggcaagcagcuguucgaccagguggugaagaccgugggccugagagaggugugguucuucggccugcaguacguggacagcaagggcuacagcaccuggcugaagcugaacaagaaggugacccagcaggacgugaagaaggagaacccccugcaguucaaguucagagccaaguucuuccccgaggacgugagcgaggagcugauccaggagaucacccagagacuguucuuccugcaggugaaggaggccauccugaacgacgagaucuacugcccccccgagaccgccgugcugcuggccagcuacgccgugcaggccaaguacggcgacuacaacaaggagauccacaagcccggcuaccuggccaacgacagacugcugccccagagagugcuggagcagcacaagcugaccaaggagcagugggaggagagaauccagaacuggcacgaggagcacagaggcaugcugagagaggacagcaugauggaguaccugaagaucgcccaggaccuggagauguacggcgugaacuacuucgagaucaagaacaagaagggcaccgagcuguggcugggcguggacgcccugggccugaacaucuacgagcacgacgacaagcugacccccaagaucggcuuccccuggagcgagaucagaaacaucagcuucaacgacaagaaguucgugaucaagcccaucgacaagaaggcccccgacuucguguucuacgcccccagacugagaaucaacaagagaauccuggcccugugcaugggcaaccacgagcuguacaugagaagaagaaagcccgacaccaucgaggugcagcagaugaaggcccaggccagagaggagaagcaccagaagcagcuggagagagcccagcuggagaacgagaagaagaagagagagaucgccgagaaggagaaggagagaaucgagagagagaaggaggagcugauggagagacugaagcagaucgaggagcagaccaucaaggcccagaaggagcuggaggagcagaccagaaaggcccuggagcuggaccaggagagaaagagagccaaggaggaggccgagagacuggagaaggagagaagagccgccgaggaggccaagagcgccaucgccaagcaggccgccgaccagaugaagaaccaggagcagcuggccgccgagcuggccgaguucaccgccaagaucgcccugcuggaggaggccaagaagaagaaggaggaggaggccaccgaguggcagcacaaggccuucgccgcccaggaggaccuggagaagaccaaggaggagcugaagaccgugaugagcgccccccccccccccccccccccccccgugaucccccccaccgagaacgagcacgacgagcacgacgagaacaacgccgaggccagcgccgagcugagcaacgagggcgugaugaaccacagaagcgaggaggagagagugaccgagacccagaagaacgagagagugaagaagcagcugcaggcccugagcagcgagcuggcccaggccagagacgagaccaagaagacccagaacgacgugcugcacgccgagaacgugaaggccggcagagacaaguacaagacccugagacagaucagacagggcaacaccaagcagagaaucgacgaguucgaggccauguggggccccaagcuguacgcccuguuccagaugagaagcugccagagcagcaucaagcagauguaa

SEQ ID NO: 22535 - RNA, 1644 nt, Artificial Sequence
  REC8__Homo_sapiens__NP_001041670
auguucuacuaccccaacgugcugcagagacacaccggcugcuucgccaccaucuggcuggccgccaccagaggcagcagacuggugaagagagaguaccugagagugaacguggugaagaccugcgaggagauccugaacuacgugcuggugagagugcagcccccccagcccggccugcccagacccagauucagccuguaccugagcgcccagcugcagaucggcgugaucagaguguacagccagcagugccaguaccugguggaggacauccagcacauccuggagagacugcacagagcccagcugcagaucagaaucgacauggagaccgagcugcccagccugcugcugcccaaccaccuggccaugauggagacccuggaggacgcccccgaccccuucuucggcaugaugagcguggaccccagacugcccagccccuucgacaucccccagaucagacaccugcuggaggccgccauccccgagagaguggaggagaucccccccgaggugcccaccgagcccagagagcccgagagaauccccgugaccgugcugccccccgaggccaucaccauccuggaggccgagcccaucagaaugcuggagaucgagggcgagagagagcugcccgaggugagcagaagagagcuggaccugcugaucgccgaggaggaggaggccauccugcuggagauccccagacugcccccccccgcccccgccgagguggagggcaucggcgaggcccugggccccgaggagcugagacugaccggcugggagcccggcgcccugcugauggaggugaccccccccgaggagcugagacugcccgccccccccagccccgagagaagaccccccgugccccccccccccagaagaagaagaagaagaagacugcuguucugggacaaggagacccagaucagccccgagaaguuccaggagcagcugcagaccagagcccacugcugggagugccccauggugcagccccccgagagaaccaucagaggccccgccgagcuguucagaacccccacccugagcggcuggcugccccccgagcugcugggccuguggacccacugcgcccagcccccccccaaggcccugagaagagagcugcccgaggaggccgccgccgaggaggagagaagaaagaucgaggugcccagcgagaucgaggugcccagagaggcccuggagcccagcgugccccugauggugagccuggagaucagccuggaggccgccgaggaggagaagagcagaaucagccugaucccccccgaggagagaugggccuggcccgagguggaggcccccgaggcccccgcccugcccguggugcccgagcugcccgaggugcccauggagaugccccuggugcugccccccgagcuggagcugcugagccuggaggccgugcacagagccguggcccuggagcugcaggccaacagagagcccgacuucagcagccuggugagcccccugagccccagaagaauggccgccagaguguucuaccugcugcuggugcugagcgcccagcagauccugcacgugaagcaggagaagcccuacggcagacugcugauccagcccggccccagauuccacuaa

SEQ ID NO: 22536 - RNA, 2916 nt, Artificial Sequence
  RECK__Homo_sapiens__NP_066934
auggccaccgugagagccagccugagaggcgcccugcugcugcugcuggccguggccggcguggccgagguggccggcggccuggcccccggcagcgccggcgcccugugcugcaaccacagcaaggacaaccagaugugcagagacgugugcgagcagaucuucagcagcaagagcgagagcagacugaagcaccugcugcagagagcccccgacuacugccccgagaccaugguggagaucuggaacugcaugaacagcagccugcccggcguguucaagaagagcgacggcugggugggccugggcugcugcgagcuggccaucgcccuggagugcagacaggccugcaagcaggccagcagcaagaacgacaucagcaaggugugcagaaaggaguacgagaacgcccuguucagcugcaucagcagaaacgagaugggcagcgugugcugcagcuacgccggccaccacaccaacugcagagaguacugccaggccaucuucagaaccgacagcagccccggccccagccagaucaaggccguggagaacuacugcgccagcaucagcccccagcugauccacugcgugaacaacuacacccagagcuaccccaugagaaaccccaccgacagccuguacugcugcgacagagccgaggaccacgccugccagaacgccugcaagagaauccugaugagcaagaagaccgagauggagaucguggacggccugaucgagggcugcaagacccagccccugccccaggacccccuguggcagugcuuccuggagagcagccagagcgugcaccccggcgugaccgugcaccccccccccagcaccggccuggacggcgccaagcugcacugcugcagcaaggccaacaccagcaccugcagagagcugugcaccaagcuguacagcaugagcuggggcaacacccagagcuggcaggaguucgacagauucugcgaguacaaccccguggaggugagcaugcugaccugccuggccgacgugagagagcccugccagcugggcugcagaaaccugaccuacugcaccaacuucaacaacagacccaccgagcuguucagaagcugcaacgcccagagcgaccagggcgccaugaacgacaugaagcugugggagaagggcagcaucaagaugcccuucaucaacauccccgugcuggacaucaagaagugccagcccgagauguggaaggccaucgccugcagccugcagaucaagcccugccacagcaagagcagaggcagcaucaucugcaagagcgacugcguggagauccugaagaagugcggcgaccagaacaaguuccccgaggaccacaccgccgagagcaucugcgagcugcugagccccaccgacgaccugaagaacugcaucccccuggacaccuaccugagacccagcacccugggcaacaucguggaggaggugacccaccccugcaaccccaaccccugccccgccaacgagcugugcgaggugaacagaaagggcugccccagcggcgaccccugccugcccuacuucugcgugcagggcugcaagcugggcgaggccagcgacuucaucgugagacagggcacccugauccaggugcccagcagcgccggcgaggugggcugcuacaagaucugcagcugcggccagagcggccugcuggagaacugcauggagaugcacugcaucgaccugcagaagagcugcaucgugggcggcaagagaaagagccacggcaccagcuucagcaucgacugcaacgugugcagcugcuucgccggcaaccuggugugcagcaccagacugugccugagcgagcacagcagcgaggacgacagaagaaccuucaccggccugcccugcaacugcgccgaccaguucgugcccgugugcggccagaacggcagaaccuaccccagcgccugcaucgccagaugcgugggccugcaggaccaccaguucgaguucggcagcugcaugagcaaggaccccugcaaccccaaccccugccagaagaaccagagaugcauccccaagccccaggugugccugaccaccuucgacaaguucggcugcagccaguacgagugcgugcccagacagcuggccugcgaccaggugcaggaccccgugugcgacaccgaccacauggagcacaacaaccugugcacccuguaccagagaggcaagagccugagcuacaagggccccugccagcccuucugcagagccaccgagcccgugugcggccacaacggcgagaccuacagcagcgugugcgccgccuacagcgacagaguggccguggacuacuacggcgacugccaggccgugggcgugcugagcgagcacagcagcguggccgagugcgccagcgugaagugccccagccugcuggccgccggcugcaagcccaucaucccccccggcgccugcugcccccugugcgccggcaugcugagagugcuguucgacaaggagaagcuggacaccaucgccaaggugaccaacaagaagcccaucaccgugcuggagauccugcagaagaucagaaugcacgugagcgugccccagugcgacguguucggcuacuucagcaucgagagcgagaucgugauccugaucauccccguggaccacuaccccaaggcccugcagaucgaggccugcaacaaggaggccgagaagaucgagagccugaucaacagcgacagccccacccuggccagccacgugccccugagcgcccugaucaucagccaggugcaggugagcagcagcgugcccagcgccggcgugagagccagacccagcugccacagccugcugcugccccugagccugggccuggcccugcaccugcuguggaccuacaacuaa

SEQ ID NO: 22537 - RNA, 1308 nt, Artificial Sequence
  RECQL5__Homo_sapiens__NP_001003715
augagcagccaccacaccaccuuccccuucgaccccgagagaagagugagaagcacccugaagaagguguucggcuucgacagcuucaagaccccccugcaggagagcgccaccauggccguggugaagggcaacaaggacguguucgugugcaugcccaccggcgccggcaagagccugugcuaccagcugcccgcccugcuggccaagggcaucaccaucguggugagcccccugaucgcccugauccaggaccagguggaccaccugcugacccugaaggugagagugagcagccugaacagcaagcugagcgcccaggagagaaaggagcugcuggccgaccuggagagagagaagccccagaccaagauccuguacaucacccccgagauggccgccagcagcagcuuccagcccacccugaacagccuggugagcagacaccugcugagcuaccuggugguggacgaggcccacugcgugagccaguggggccacgacuucagacccgacuaccugagacugggcgcccugagaagcagacugggccacgcccccugcguggcccugaccgccaccgccaccccccaggugcaggaggacguguucgccgcccugcaccugaagaagcccguggccaucuucaagacccccugcuucagagccaaccuguucuacgacgugcaguucaaggagcugaucagcgaccccuacggcaaccugaaggacuucugccugaaggcccugggccaggaggccgacaagggccugagcggcugcggcaucguguacugcagaaccagagaggccugcgagcagcuggccaucgagcugagcugcagaggcgugaacgccaaggccuaccacgccggccugaaggccagcgagagaacccuggugcagaacgacuggauggaggagaaggugcccgugaucguggccaccaucagcuucggcaugggcguggacaaggccaacgugagauucguggcccacuggaacaucgccaagagcauggccggcuacuaccaggagagcggcagagccggcagagacggcaagcccagcuggugcagacuguacuacagcagaaacgacagagaccaggugagcuuccugaucagaaaggagguggccaagcugcaggagaagagaggcaacaaggccagcgacaaggccaccaucauggccuucgacgcccuggugaccuucugcgaggagcugggcagauggggcagaggccacggcaagagccugagagccgccuggugcagccagguggugagcagacacgccgagcuguaa

SEQ ID NO: 22538 - RNA, 1950 nt, Artificial Sequence
  RECQL__Homo_sapiens__XP_006719196
auggccagcgugagcgcccugaccgaggagcuggacagcaucaccagcgagcugcacgccguggagauccagauccaggagcugaccgagagacagcaggagcugauccagaagaagaaggugcugaccaagaagaucaagcagugccuggaggacagcgacgccggcgccagcaacgaguacgacagcagccccgccgccuggaacaaggaggacuuccccuggagcggcaaggugaaggacauccugcagaacguguucaagcuggagaaguucagaccccugcagcuggagaccaucaacgugaccauggccggcaaggagguguuccuggugaugcccaccggcggcggcaagagccugugcuaccagcugcccgcccugugcagcgacggcuucacccuggugaucugcccccugaucagccugauggaggaccagcugauggugcugaagcagcugggcaucagcgccaccaugcugaacgccagcagcagcaaggagcacgugaagugggugcacgccgagauggugaacaagaacagcgagcugaagcugaucuacgugacccccgagaagaucgccaagagcaagauguucaugagcagacuggagaaggccuacgaggccagaagauucaccagaaucgccguggacgaggugcacugcugcagccaguggggccacgacuucagacccgacuacaaggcccugggcauccugaagagacaguuccccaacgccagccugaucggccugaccgccaccgccaccaaccacgugcugaccgacgcccagaagauccugugcaucgagaagugcuucaccuucaccgccagcuucaacagacccaaccuguacuacgaggugagacagaagcccagcaacaccgaggacuucaucgaggacaucgugaagcugaucaacggcagauacaagggccagagcggcaucaucuacugcuucagccagaaggacagcgagcaggugaccgugagccugcagaaccugggcauccacgccggcgccuaccacgccaaccuggagcccgaggacaagaccaccgugcacagaaaguggagcgccaacgagauccagguggugguggccaccguggccuucggcaugggcaucgacaagcccgacgugagauucgugauccaccacagcaugagcaagagcauggagaacuacuaccaggagagcggcagagccggcagagacgacaugaaggccgacugcauccuguacuacggcuucggcgacaucuucagaaucagcagcaugguggugauggagaacgugggccagcagaagcuguacgagauggugagcuacugccagaacaucagcaagugcagaagagugcugauggcccagcacuucgacgagguguggaacagcgaggccugcaacaagaugugcgacaacugcugcaaggacagcgccuucgagagaaagaacaucaccgaguacugcagagaccugaucaagauccugaagcaggccgaggagcugaacgagaagcugaccccccugaagcugaucgacagcuggaugggcaagggcgccgccaagcugagaguggccggcgugguggcccccacccugcccagagaggaccuggagaagaucaucgcccacuuccugauccagcaguaccugaaggaggacuacagcuucaccgccuacgccaccaucagcuaccugaagaucggccccaaggccaaccugcugaacaacgaggcccacgccaucaccaugcaggugaccaagagcacccagaacagcuucagagccgagagcagccagaccugccacagcgagcagggcgacaagaagauggaggagaagaacagcggcaacuuccagaagaaggccgccaacaugcugcagcagagcggcagcaagaacaccggcgccaagaagagaaagaucgacgacgccuaa

SEQ ID NO: 22539 - RNA, 627 nt, Artificial Sequence
  REEP1__Homo_sapiens__NP_001158202
augcagaaggugcugagcaacggccagaccgaggaggugagaagcggcagcagacugaucuucggcacccuguaccccgccuacuacagcuacaaggccgugaagagcaaggacaucaaggaguacgugaaguggaugauguacuggaucaucuucgcccuguucaccaccgccgagaccuucaccgacaucuuccugugcugguuccccuucuacuacgagcugaagaucgccuucguggccuggcugcugagccccuacaccaagggcagcagccugcuguacagaaaguucgugcaccccacccugagcagcaaggagaaggagaucgacgacugccuggugcaggccaaggacagaagcuacgacgcccuggugcacuucggcaagagaggccugaacguggccgccaccgccgccgugauggccgccagcaagggccagggcgcccugagcgagagacugagaagcuucagcaugcaggaccugaccaccaucagaggcgacggcgcccccgcccccagcggcccccccccccccggcagcggcagagccagcggcaagcacggccagcccaagaugagcagaagcgccagcgagagcgccagcagcagcggcaccgccuaa

SEQ ID NO: 22540 - RNA, 765 nt, Artificial Sequence
  REEP2__Homo_sapiens__NP_001258732
auggugagcuggaucaucagcagacugguggugcugaucuucggcacccuguaccccgccuacagcagcuacaaggccgugaagaccaagaacgugaaggaguacgugaaguggaugauguacuggaucguguucgccuucuucaccaccgccgagacccugaccgacaucgugcugagcugguuccccuucuacuucgagcugaagaucgccuucgugaucuggcugcugagccccuacaccaagggcagcagcgugcuguacagaaaguucgugcaccccacccugagcaacaaggagaaggagaucgacgaguacaucacccaggccagagacaagagcuacgagaccaugaugagagugggcaagagaggccugaaccuggccgccaacgccgccgugaccgccgccgccaagggccagggcgugcugagcgagaagcugagaagcuucagcaugcaggaccugacccugaucagagacgaggacgcccugccccugcagagacccgacggcagacugagacccagccccggcagccugcuggacaccaucgaggaccugggcgacgaccccgcccugagccugagaagcagcaccaaccccgccgacagcagaaccgaggccagcgaggacgacaugggcgacaaggcccccaagagagccaagcccaucaagaaggcccccaaggccgagccccuggccagcaagacccugaagaccagacccaagaagaagaccagcggcggcggcgacagcgccuaa

SEQ ID NO: 22541 - RNA, 768 nt, Artificial Sequence
  REEP3__Homo_sapiens__NP_001001330
auggugagcuggaugaucagcagagccguggugcugguguucggcaugcuguaccccgccuacuacagcuacaaggccgugaagaccaagaacgugaaggaguacgugagauggaugauguacuggaucguguucgcccuguacaccgugaucgagaccguggccgaccagaccguggccugguucccccuguacuacgagcugaagaucgccuucgugaucuggcugcugagccccuacaccaagggcgccagccugaucuacagaaaguuccugcacccccugcugagcagcaaggagagagagaucgacgacuacaucgugcaggccaaggagagaggcuacgagaccauggugaacuucggcagacagggccugaaccuggccgccaccgccgccgugaccgccgccgugaagagccagggcgccaucaccgagagacugagaagcuucagcaugcacgaccugaccaccauccagggcgacgagcccgugggccagagacccuaccagccccugcccgaggccaagaagaagagcaagcccgcccccagcgagagcgccggcuacggcaucccccugaaggacggcgacgagaagaccgacgaggaggccgagggccccuacagcgacaacgagaugcugacccacaagggccugagaagaagccagagcaugaagagcgugaagaccaccaagggcagaaaggaggugagauacggcagccugaaguacaaggugaagaagagaccccagguguacuucuaa

SEQ ID NO: 22542 - RNA, 570 nt, Artificial Sequence
  REEP5__Homo_sapiens__NP_005660
augagcgccgccaugagagagagauucgacagauuccugcacgagaagaacugcaugaccgaccugcuggccaagcuggaggccaagaccggcgugaacagaagcuucaucgcccugggcgugaucggccugguggcccuguaccugguguucggcuacggcgccagccugcugugcaaccugaucggcuucggcuaccccgccuacaucagcaucaaggccaucgagagccccaacaaggaggacgacacccaguggcugaccuacugggugguguacggcguguucagcaucgccgaguucuucagcgacaucuuccugagcugguuccccuucuacuacaugcugaagugcggcuuccugcuguggugcauggcccccagccccagcaacggcgccgagcugcuguacaagagaaucaucagacccuucuuccugaagcacgagagccagauggacagcguggugaaggaccugaaggacaaggccaaggagaccgccgacgccaucaccaaggaggccaagaaggccaccgugaaccugcugggcgaggagaagaagagcaccuaa

SEQ ID NO: 22543 - RNA, 555 nt, Artificial Sequence
  REEP6__Homo_sapiens__NP_612402
auggacggccugagacagagaguggagcacuuccuggagcagagaaaccuggugaccgaggugcugggcgcccuggaggccaagaccggcguggagaagagauaccuggccgccggcgccgugacccugcugagccuguaccugcuguucggcuacggcgccagccugcugugcaaccugaucggcuucguguaccccgccuacgccagcaucaaggccaucgagagccccagcaaggacgacgacaccguguggcugaccuacugggugguguacgcccuguucggccuggccgaguucuucagcgaccugcugcugagcugguuccccuucuacuacgugggcaagugcgccuuccugcuguucugcauggcccccagacccuggaacggcgcccugaugcuguaccagagaguggugagaccccuguuccugagacaccacggcgccguggacagaaucaugaacgaccugagcggcagagcccuggacgccgccgccggcaucaccagaaacgugaagcccagccagaccccccagcccaaggacaaguaa

SEQ ID NO: 22544 - RNA, 501 nt, Artificial Sequence
  REG1A__Homo_sapiens__NP_002900
auggcccagaccagcagcuacuucaugcugaucagcugccugauguuccugagccagagccagggccaggaggcccagaccgagcugccccaggccagaaucagcugccccgagggcaccaacgccuacagaagcuacugcuacuacuucaacgaggacagagagaccuggguggacgccgaccuguacugccagaacaugaacagcggcaaccuggugagcgugcugacccaggccgagggcgccuucguggccagccugaucaaggagagcggcaccgacgacuucaacguguggaucggccugcacgaccccaagaagaacagaagauggcacuggagcagcggcagccuggugagcuacaagagcuggggcaucggcgcccccagcagcgugaaccccggcuacugcgugagccugaccagcagcaccggcuuccagaaguggaaggacgugcccugcgaggacaaguucagcuucgugugcaaguucaagaacuaa

SEQ ID NO: 22545 - RNA, 501 nt, Artificial Sequence
  REG1B__Homo_sapiens__NP_006498
auggcccagaccaacagcuucuucaugcugaucagcagccugauguuccugagccugagccagggccaggagagccagaccgagcugcccaaccccagaaucagcugccccgagggcaccaacgccuacagaagcuacugcuacuacuucaacgaggaccccgagaccuggguggacgccgaccuguacugccagaacaugaacagcggcaaccuggugagcgugcugacccaggccgagggcgccuucguggccagccugaucaaggagagcagcaccgacgacagcaacguguggaucggccugcacgaccccaagaagaacagaagauggcacuggagcagcggcagccuggugagcuacaagagcugggacaccggcagccccagcagcgccaacgccggcuacugcgccagccugaccagcugcagcggcuucaagaaguggaaggacgagagcugcgagaagaaguucagcuucgugugcaaguucaagaacuaa

SEQ ID NO: 22546 - RNA, 528 nt, Artificial Sequence
  REG3A__Homo_sapiens__NP_620355
augcugccccccauggcccugcccagcgugagcuggaugcugcugagcugccugaugcugcugagccaggugcagggcgaggagccccagagagagcugcccagcgccagaaucagaugccccaagggcagcaaggccuacggcagccacugcuacgcccuguuccugagccccaagagcuggaccgacgccgaccuggccugccagaagagacccagcggcaaccuggugagcgugcugagcggcgccgagggcagcuucgugagcagccuggugaagagcaucggcaacagcuacagcuacguguggaucggccugcacgaccccacccagggcaccgagcccaacggcgagggcugggaguggagcagcagcgacgugaugaacuacuucgccugggagagaaaccccagcaccaucagcagccccggccacugcgccagccugagcagaagcaccgccuuccugagauggaaggacuacaacugcaacgugagacugcccuacgugugcaaguucaccgacuaa

SEQ ID NO: 22547 - RNA, 1647 nt, Artificial Sequence
  RELA__Homo_sapiens__NP_001138610
auggacgagcuguucccccugaucuuccccgccgagcccgcccaggccagcggccccuacguggagaucaucgagcagcccaagcagagaggcaugagauucagauacaagugcgagggcagaagcgccggcagcauccccggcgagagaagcaccgacaccaccaagacccaccccaccaucaagaucaacggcuacaccggccccggcaccgugagaaucagccuggugaccaaggaccccccccacagaccccacccccacgagcuggugggcaaggacugcagagacggcuucuacgaggccgagcugugccccgacagaugcauccacagcuuccagaaccugggcauccagugcgugaagaagagagaccuggagcaggccaucagccagagaauccagaccaacaacaaccccuuccaggaggagcagagaggcgacuacgaccugaacgccgugagacugugcuuccaggugaccgugagagaccccagcggcagaccccugagacugccccccgugcugagccaccccaucuucgacaacagagcccccaacaccgccgagcugaagaucugcagagugaacagaaacagcggcagcugccugggcggcgacgagaucuuccugcugugcgacaaggugcagaaggaggacaucgagguguacuucaccggccccggcugggaggccagaggcagcuucagccaggccgacgugcacagacagguggccaucguguucagaaccccccccuacgccgaccccagccugcaggcccccgugagagugagcaugcagcugagaagacccagcgacagagagcugagcgagcccauggaguuccaguaccugcccgacaccgacgacagacacagaaucgaggagaagagaaagagaaccuacgagaccuucaagagcaucaugaagaagagccccuucagcggccccaccgaccccagacccccccccagaagaaucgccgugcccagcagaagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucaccagacuggugaccggcgcccagagaccccccgaccccgcccccgccccccugggcgcccccggccugcccaacggccugcugagcggcgacgaggacuucagcagcaucgccgacauggacuucagcgcccugcugagccagaucagcagcuaa

SEQ ID NO: 22548 - RNA, 1740 nt, Artificial Sequence
  RELB__Homo_sapiens__NP_006500
augcugagaagcggccccgccagcggccccagcgugcccaccggcagagccaugcccagcagaagaguggccagaccccccgccgcccccgagcugggcgcccugggcagccccgaccugagcagccugagccuggccgugagcagaagcaccgacgagcuggagaucaucgacgaguacaucaaggagaacggcuucggccuggacggcggccagcccggccccggcgagggccugcccagacuggugagcagaggcgccgccagccugagcaccgugacccugggccccguggccccccccgccacccccccccccuggggcugcccccugggcagacuggugagccccgcccccggccccggcccccagccccaccuggugaucaccgagcagcccaagcagagaggcaugagauucagauacgagugcgagggcagaagcgccggcagcauccugggcgagagcagcaccgaggccagcaagacccugcccgccaucgagcugagagacugcggcggccugagagagguggaggugaccgccugccugguguggaaggacuggccccacagagugcacccccacagccuggugggcaaggacugcaccgacggcaucugcagagugagacugagaccccacgugagccccagacacagcuucaacaaccugggcauccagugcgugagaaagaaggagaucgaggccgccaucgagagaaagauccagcugggcaucgaccccuacaacgccggcagccugaagaaccaccaggagguggacaugaacguggugagaaucugcuuccaggccagcuacagagaccagcagggccagaugagaagaauggaccccgugcugagcgagcccguguacgacaagaagagcaccaacaccagcgagcugagaaucugcagaaucaacaaggagagcggccccugcaccggcggcgaggagcuguaccugcugugcgacaaggugcagaaggaggacaucagcgugguguucagcagagccagcugggagggcagagccgacuucagccaggccgacgugcacagacagaucgccaucguguucaagaccccccccuacgaggaccuggagaucguggagcccgugaccgugaacguguuccugcagagacugaccgacggcgugugcagcgagccccugcccuucaccuaccugcccagagaccacgacagcuacggcguggacaagaagagaaagagaggcaugcccgacgugcugggcgagcugaacagcagcgacccccacggcaucgagagcaagagaagaaagaagaagcccgccauccuggaccacuuccugcccaaccacggcagcggccccuuccugccccccagcgcccugcugcccgaccccgacuucuucagcggcaccgugagccugcccggccuggagccccccggcggccccgaccugcuggacgacggcuucgccuacgaccccaccgcccccacccuguucaccaugcuggaccugcugccccccgcccccccccacgccagcgccguggugugcagcggcggcgccggcgccguggugggcgagacccccggccccgagccccugacccuggacagcuaccaggcccccggccccggcgacggcggcaccgccagccuggugggcagcaacauguuccccaaccacuacagagaggccgccuucggcggcggccugcugagccccggccccgaggccaccuaa

SEQ ID NO: 22549 - RNA, 1764 nt, Artificial Sequence
  REL__Homo_sapiens__NP_001278675
auggccagcggcgccuacaaccccuacaucgagaucaucgagcagcccagacagagaggcaugagauucagauacaagugcgagggcagaagcgccggcagcauccccggcgagcacagcaccgacaacaacagaaccuaccccagcauccagaucaugaacuacuacggcaagggcaaggugagaaucacccuggugaccaagaacgaccccuacaagccccacccccacgaccuggugggcaaggacugcagagacggcuacuacgaggccgaguucggccaggagagaagaccccuguucuuccagaaccugggcaucagaugcgugaagaagaaggaggugaaggaggccaucaucaccagaaucaaggccggcaucaaccccuucaacgugcccgagaagcagcugaacgacaucgaggacugcgaccugaacguggugagacugugcuuccagguguuccugcccgacgagcacggcaaccugaccaccgcccugccccccguggugagcaaccccaucuacgacaacagagcccccaacaccgccgagcugagaaucugcagagugaacaagaacugcggcagcgugagaggcggcgacgagaucuuccugcugugcgacaaggugcagaaggacgacaucgaggugagauucgugcugaacgacugggaggccaagggcaucuucagccaggccgacgugcacagacagguggccaucguguucaagaccccccccuacugcaaggccaucaccgagcccgugaccgugaagaugcagcugagaagacccagcgaccaggaggugagcgagagcauggacuucagauaccugcccgacgagaaggacaccuacggcaacaaggccaagaagcagaagaccacccugcuguuccagaagcugugccaggaccacgugaacuuccccgagagacccagacccggccugcugggcagcaucggcgagggcagauacuucaagaaggagcccaaccuguucagccacgacgccguggugagagagaugcccaccggcgugagcagccaggccgagagcuacuaccccagccccggccccaucagcagcggccugagccaccacgccagcauggccccccugcccagcagcagcuggagcagcguggcccaccccacccccagaagcggcaacaccaacccccugagcagcuucagcaccagaacccugcccagcaacagccagggcaucccccccuuccugagaauccccgugggcaacgaccugaacgccagcaacgccugcaucuacaacaacgccgacgacaucgugggcauggaggccagcagcaugcccagcgccgaccuguacggcaucagcgaccccaacaugcugagcaacugcagcgugaacaugaugaccaccagcagcgacagcaugggcgagaccgacaaccccagacugcugagcaugaaccuggagaaccccagcugcaacagcgugcuggaccccagagaccugagacagcugcaccagaugagcagcagcagcaugagcgccggcgccaacagcaacaccaccguguucgugagccagagcgacgccuucgagggcagcgacuucagcugcgccgacaacagcaugaucaacgagagcggccccagcaacagcaccaaccccaacagccacggcuucgugcaggacagccaguacagcggcaucggcagcaugcagaacgagcagcugagcgacagcuuccccuacgaguucuuccagguguaa

SEQ ID NO: 22550 - RNA, 10383 nt, Artificial Sequence
  RELN__Homo_sapiens__NP_005036
auggagagaagcggcugggccagacagaccuuccugcuggcccugcugcugggcgccacccugagagccagagccgccgccggcuacuaccccagauucagccccuucuucuuccugugcacccaccacggcgagcuggagggcgacggcgagcagggcgaggugcugaucagccugcacaucgccggcaaccccaccuacuacgugcccggccaggaguaccacgugaccaucagcaccagcaccuucuucgacggccugcuggugaccggccuguacaccagcaccagcgugcaggccagccagagcaucggcggcagcagcgccuucggcuucggcaucaugagcgaccaccaguucggcaaccaguucaugugcagcgugguggccagccacgugagccaccugcccaccaccaaccugagcuucaucuggaucgccccccccgccggcaccggcugcgugaacuucauggccaccgccacccacagaggccaggugaucuucaaggacgcccuggcccagcagcugugcgagcagggcgcccccaccgacgugaccgugcacccccaccuggccgagauccacagcgacagcaucauccugagagacgacuucgacagcuaccaccagcugcagcugaaccccaacaucuggguggagugcaacaacugcgagaccggcgagcagugcggcgccaucaugcacggcaacgccgugaccuucugcgagcccuacggccccagagagcugaucaccaccggccugaacaccaccaccgccagcgugcugcaguucagcaucggcagcggcagcugcagauucagcuacagcgaccccagcaucaucgugcuguacgccaagaacaacagcgccgacuggauccagcuggagaagaucagagcccccagcaacgugagcaccaucauccacauccuguaccugcccgaggacgccaagggcgagaacgugcaguuccaguggaagcaggagaaccugagagugggcgagguguacgaggccugcugggcccuggacaacauccugaucaucaacagcgcccacagacagguggugcuggaggacagccuggaccccguggacaccggcaacuggcuguucuuccccggcgccaccgugaagcacagcugccagagcgacggcaacagcaucuacuuccacggcaacgagggcagcgaguucaacuucgccaccaccagagacguggaccugagcaccgaggacauccaggagcaguggagcgaggaguucgagagccagcccaccggcugggacgugcugggcgccgugaucggcaccgagugcggcaccaucgagagcggccugagcaugguguuccugaaggacggcgagagaaagcugugcacccccagcauggacaccaccggcuacggcaaccugagauucuacuucgugaugggcggcaucugcgaccccggcaacagccacgagaacgacaucauccuguacgccaagaucgagggcagaaaggagcacaucacccuggacacccugagcuacagcagcuacaaggugcccagccuggugagcguggugaucaaccccgagcugcagacccccgccaccaaguucugccugagacagaagaaccaccagggccacaacagaaacgugugggccguggacuucuuccacgugcugcccgugcugcccagcaccaugagccacaugauccaguucagcaucaaccugggcugcggcacccaccagcccggcaacagcgugagccuggaguucagcaccaaccacggcagaagcuggagccugcugcacaccgagugccugcccgagaucugcgccggcccccaccugccccacagcaccguguacagcagcgagaacuacagcggcuggaacagaaucaccaucccccugcccaacgccgcccugaccagaaacaccagaaucagauggagacagaccggccccauccugggcaacaugugggccaucgacaacguguacaucggccccagcugccugaaguucugcagcggcagaggccagugcaccagacacggcugcaagugcgaccccggcuucagcggccccgccugcgagauggccagccagaccuuccccauguucaucagcgagagcuucggcagcagcagacugagcagcuaccacaacuucuacagcaucagaggcgccgaggugagcuucggcugcggcgugcuggccagcggcaaggcccugguguucaacaaggacggcagaagacagcugaucaccagcuuccuggacagcagccagagcagauuccugcaguucacccugagacugggcagcaagagcgugcugagcaccugcagagcccccgaccagcccggcgagggcgugcugcugcacuacagcuacgacaacggcaucaccuggaagcugcuggagcacuacagcuaccugagcuaccacgagcccagaaucaucagcguggagcugcccggcgacgccaagcaguucggcauccaguucagaugguggcagcccuaccacagcagccagagagaggacgugugggccaucgacgagaucaucaugaccagcgugcuguucaacagcaucagccuggacuucaccaaccugguggaggugacccagagccugggcuucuaccugggcaacgugcagcccuacugcggccacgacuggacccugugcuucaccggcgacagcaagcuggccagcagcaugagauacguggagacccagagcaugcagaucggcgccagcuacaugauccaguucagccuggugaugggcugcggccagaaguacaccccccacauggacaaccaggugaagcuggaguacagcaccaaccacggccugaccuggcaccuggugcaggaggagugccugcccagcaugcccagcugccaggaguucaccagcgccagcaucuaccacgccagcgaguucacccaguggagaagagugaucgugcugcugccccagaagaccuggagcagcgccaccagauucagauggagccagagcuacuacaccgcccaggacgagugggcccuggacagcaucuacaucggccagcagugccccaacaugugcagcggccacggcagcugcgaccacggcaucugcagaugcgaccagggcuaccagggcaccgagugccaccccgaggccgcccugcccagcaccaucaugagcgacuucgagaaccagaacggcugggagagcgacuggcaggaggugaucggcggcgagaucgugaagcccgagcagggcugcggcgugaucagcagcggcagcagccuguacuucagcaaggccggcaagagacagcuggugagcugggaccuggacaccagcuggguggacuucgugcaguucuacauccagaucggcggcgagagcgccagcugcaacaagcccgacagcagagaggagggcgugcugcugcaguacagcaacaacggcggcauccaguggcaccugcuggccgagauguacuucagcgacuucagcaagcccagauucguguaccuggagcugcccgccgccgccaagacccccugcaccagauucagaugguggcagcccguguucagcggcgaggacuacgaccagugggccguggacgacaucaucauccugagcgagaagcagaagcagaucauccccgugaucaaccccacccugccccagaacuucuacgagaagcccgccuucgacuaccccaugaaccagaugagcguguggcugaugcuggccaacgagggcauggugaagaacgagaccuucugcgccgccacccccagcgccaugaucuucggcaagagcgacggcgacagauucgccgugaccagagaccugacccugaagcccggcuacgugcugcaguucaagcugaacaucggcugcgccaaccaguucagcagcaccgcccccgugcugcugcaguacagccacgacgccggcaugagcugguuccuggugaaggagggcugcuaccccgccagcgccggcaagggcugcgagggcaacagcagagagcugagcgagcccaccauguaccacaccggcgacuucgaggaguggaccagaaucaccaucgugauccccagaagccuggccagcagcaagaccagauucagauggauccaggagagcagcagccagaagaacgugccccccuucggccuggacggcguguacaucagcgagcccugccccagcuacugcagcggccacggcgacugcaucagcggcgugugcuucugcgaccugggcuacaccgccgcccagggcaccugcgugagcaacgugcccaaccacaacgagauguucgacagauucgagggcaagcugagcccccugugguacaagaucaccggcgcccaggugggcaccggcugcggcacccugaacgacggcaagagccuguacuucaacggccccggcaagagagaggccagaaccgugccccuggacaccagaaacaucagacuggugcaguucuacauccagaucggcagcaagaccagcggcaucaccugcaucaagcccagaaccagaaacgagggccugaucgugcaguacagcaacgacaacggcauccuguggcaccugcugagagagcuggacuucaugagcuuccuggagccccagaucaucagcaucgaccugccccaggacgccaagacccccgccaccgccuucagaugguggcagccccagcacggcaagcacagcgcccagugggcccuggacgacgugcugaucggcaugaacgacagcagccagaccggcuuccaggacaaguucgacggcagcaucgaccugcaggccaacugguacagaauccagggcggccagguggacaucgacugccugagcauggacaccgcccugaucuucaccgagaacaucggcaagcccagauacgccgagaccugggacuuccacgugagcgccagcaccuuccugcaguucgagaugagcaugggcugcagcaagcccuucagcaacagccacagcgugcagcugcaguacagccugaacaacggcaaggacuggcaccuggugaccgaggagugcgugccccccaccaucggcugccugcacuacaccgagagcagcaucuacaccagcgagagauuccagaacuggaagagaaucaccguguaccugccccugagcaccaucagccccagaaccagauucagauggauccaggccaacuacaccgugggcgccgacagcugggccaucgacaacguggugcuggccagcggcugccccuggaugugcagcggcagaggcaucugcgacgccggcagaugcgugugcgacagaggcuucggcggccccuacugcgugcccguggugccccugcccagcauccugaaggacgacuucaacggcaaccugcaccccgaccuguggcccgagguguacggcgccgagagaggcaaccugaacggcgagaccaucaagagcggcaccagccugaucuucaagggcgagggccugagaaugcugaucagcagagaccuggacugcaccaacaccauguacgugcaguucagccugagauucaucgccaagagcacccccgagagaagccacagcauccugcugcaguucagcaucagcggcggcaucaccuggcaccugauggacgaguucuacuucccccagaccaccaacauccuguucaucaacgugccccugcccuacaccgcccagaccaacgccaccagauucagacuguggcagcccuacaacaacggcaagaaggaggagaucuggaucguggacgacuucaucaucgacggcaacaacgugaacaaccccgugaugcugcuggacaccuucgacuucggccccagagaggacaacugguucuucuaccccggcggcaacaucggccuguacugccccuacagcagcaagggcgcccccgaggaggacagcgccaugguguucgugagcaacgaggugggcgagcacagcaucaccaccagagaccugaacgugaacgagaacaccaucauccaguucgagaucaacgugggcugcagcaccgacagcagcagcgccgaccccgugagacuggaguucagcagagacuucggcgccaccuggcaccugcugcugccccugugcuaccacagcagcagccacgugagcagccugugcagcaccgagcaccaccccagcagcaccuacuacgccggcaccaugcagggcuggagaagagagguggugcacuucggcaagcugcaccugugcggcagcgugagauucagaugguaccagggcuucuaccccgccggcagccagcccgugaccugggccaucgacaacguguacaucggcccccagugcgaggagaugugcaacggccagggcagcugcaucaacggcaccaagugcaucugcgaccccggcuacagcggccccaccugcaagaucagcaccaagaaccccgacuuccugaaggacgacuucgagggccagcuggagagcgacagauuccugcugaugagcggcggcaagcccagcagaaagugcggcauccugagcagcggcaacaaccuguucuucaacgaggacggccugagaaugcugaugaccagagaccuggaccugagccacgccagauucgugcaguucuucaugagacugggcugcggcaagggcgugcccgaccccagaagccagcccgugcugcugcaguacagccugaacggcggccugagcuggagccugcugcaggaguuccuguucagcaacagcagcaacgugggcagauacaucgcccuggagaucccccugaaggccagaagcggcagcaccagacugagaugguggcagcccagcgagaacggccacuucuacagccccugggugaucgaccagauccugaucggcggcaacaucagcggcaacaccgugcuggaggacgacuucaccacccuggacagcagaaaguggcugcugcaccccggcggcaccaagaugcccgugugcggcagcaccggcgacgcccugguguucaucgagaaggccagcaccagauacguggugagcaccgacguggccgugaacgaggacagcuuccugcagaucgacuucgccgccagcugcagcgugaccgacagcugcuacgccaucgagcuggaguacagcguggaccugggccugagcuggcacccccuggugagagacugccugcccaccaacguggagugcagcagauaccaccugcagagaauccuggugagcgacaccuucaacaaguggaccagaaucacccugccccugccccccuacaccagaagccaggccaccagauucagauggcaccagcccgcccccuucgacaagcagcagaccugggccaucgacaacguguacaucggcgacggcugcaucgacaugugcagcggccacggcagaugcauccagggcaacugcgugugcgacgagcaguggggcggccuguacugcgacgaccccgagaccagccugcccacccagcugaaggacaacuucaacagagcccccagcagccagaacuggcugaccgugaacggcggcaagcugagcaccgugugcggcgccguggccagcggcauggcccugcacuucagcggcggcugcagcagacugcuggugaccguggaccugaaccugaccaacgccgaguucauccaguucuacuucauguacggcugccugaucacccccaacaacagaaaccagggcgugcugcuggaguacagcgugaacggcggcaucaccuggaaccugcugauggagaucuucuacgaccaguacagcaagcccggcuucgugaacauccugcugccccccgacgccaaggagaucgccaccagauucagaugguggcagcccagacacgacggccuggaccagaacgacugggccaucgacaacgugcugaucagcggcagcgccgaccagagaaccgugaugcuggacaccuucagcagcgcccccgugccccagcacgagagaagccccgccgacgccggccccgugggcagaaucgccuucgacauguucauggaggacaagaccagcgugaacgagcacuggcuguuccacgacgacugcaccguggagagauucugcgacagccccgacggcgugaugcugugcggcagccacgacggcagagagguguacgccgugacccacgaccugacccccaccgagggcuggaucaugcaguucaagaucagcgugggcugcaaggugagcgagaagaucgcccagaaccagauccacgugcaguacagcaccgacuucggcgugagcuggaacuaccuggugccccagugccugcccgccgaccccaagugcagcggcagcgugagccagcccagcguguucuuccccaccaagggcuggaagagaaucaccuacccccugcccgagagccuggugggcaaccccgugagauucagauucuaccagaaguacagcgacaugcagugggccaucgacaacuucuaccugggccccggcugccuggacaacugcagaggccacggcgacugccugagagagcagugcaucugcgaccccggcuacagcggccccaacugcuaccugacccacacccugaagaccuuccugaaggagagauucgacagcgaggagaucaagcccgaccuguggaugagccuggagggcggcagcaccugcaccgagugcggcauccuggccgaggacaccgcccuguacuucggcggcagcaccgugagacaggccgugacccaggaccuggaccugagaggcgccaaguuccugcaguacuggggcagaaucggcagcgagaacaacaugaccagcugccacagacccaucugcagaaaggagggcgugcugcuggacuacagcaccgacggcggcaucaccuggacccugcugcacgagauggacuaccagaaguacaucagcgugagacacgacuacauccugcugcccgaggacgcccugaccaacaccaccagacugagaugguggcagcccuucgugaucagcaacggcaucguggugagcggcguggagagagcccagugggcccuggacaacauccugaucggcggcgccgagaucaaccccagccagcugguggacaccuucgacgacgagggcaccagccacgaggagaacuggagcuucuaccccaacgccgugagaaccgccggcuucugcggcaaccccagcuuccaccuguacuggcccaacaagaagaaggacaagacccacaacgcccugagcagcagagagcugaucauccagcccggcuacaugaugcaguucaagaucguggugggcugcgaggccaccagcugcggcgaccugcacagcgugaugcuggaguacaccaaggacgccagaagcgacagcuggcagcuggugcagacccagugccugcccagcagcagcaacagcaucggcugcagccccuuccaguuccacgaggccaccaucuacaacagcgugaacagcagcagcuggaagagaaucaccauccagcugcccgaccacgugagcagcagcgccacccaguucagauggauccagaagggcgaggagaccgagaagcagagcugggccaucgaccacguguacaucggcgaggccugccccaagcugugcagcggccacggcuacugcaccaccggcgccaucugcaucugcgacgagagcuuccagggcgacgacugcagcguguucagccacgaccugcccagcuacaucaaggacaacuucgagagcgccagagugaccgaggccaacugggagaccauccagggcggcgugaucggcagcggcugcggccagcuggcccccuacgcccacggcgacagccuguacuucaacggcugccagaucagacaggccgccaccaagccccuggaccugaccagagccagcaagaucauguucgugcugcagaucggcagcaugagccagaccgacagcugcaacagcgaccugagcggcccccacgccguggacaaggccgugcugcugcaguacagcgugaacaacggcaucaccuggcacgugaucgcccagcaccagcccaaggacuucacccaggcccagagagugagcuacaacgugccccuggaggccagaaugaagggcgugcugcugagaugguggcagcccagacacaacggcaccggccacgaccagugggcccuggaccacguggagguggugcuggugagcaccagaaagcagaacuacaugaugaacuucagcagacagcacggccugagacacuucuacaacagaagaagaagaagccugagaagauaccccuaa

SEQ ID NO: 22551 - RNA, 897 nt, Artificial Sequence
  REM1__Homo_sapiens__NP_054731
augacccugaacaccgagcaggaggccaagaccccccugcacagaagagccagcaccccccugccccugagccccagaggccaccagcccggcagacugagcaccgugcccagcacccagagccagcaccccagacugggccagagcgccagccugaacccccccacccagaagcccagccccgcccccgacgacuggagcagcgagagcagcgacagcgagggcagcugggaggcccuguacagaguggugcugcugggcgaccccggcgugggcaagaccagccuggccagccuguucgccggcaagcaggagagagaccugcacgagcagcugggcgaggacguguacgagagaacccugaccguggacggcgaggacaccacccugguggugguggacaccugggaggccgagaagcuggacaagagcuggagccaggagagcugccugcagggcggcagcgccuacgugaucguguacagcaucgccgacagaggcagcuucgagagcgccagcgagcugagaauccagcugagaagaacccaccaggccgaccacgugcccaucauccuggugggcaacaaggccgaccuggccagaugcagagaggugagcguggaggagggcagagccugcgccgugguguucgacugcaaguucaucgagaccagcgccacccugcagcacaacguggccgagcuguucgagggcguggugagacagcugagacugagaagaagagacagcgccgccaaggagccccccgcccccagaagacccgccagccuggcccagagagccagaagauuccuggccagacugaccgccagaagcgccagaagaagagcccugaaggccagaagcaagagcugccacaaccuggccgugcuguaa

SEQ ID NO: 22552 - RNA, 1284 nt, Artificial Sequence
  RENBP__Homo_sapiens__NP_002901
augagcaagggccugcccgccagacaggacauggagaaggagagagagacccugcaggccuggaaggagagagugggccaggagcuggacagagugguggccuucuggauggagcacagccacgaccaggagcacggcggcuucuucaccugccugggcagagagggcagaguguacgacgaccugaaguacguguggcugcagggcagacagguguggauguacugcagacuguacagaaccuucgagagauucagacacgcccagcugcuggacgccgccaaggccggcggcgaguuccugcugagauacgccagaguggccccccccggcaagaagugcgccuucgugcugaccagagacggcagacccgugaaggugcagagaaccaucuucagcgagugcuucuacaccauggccaugaacgagcuguggagagccaccggcgaggugagauaccagaccgaggccguggagaugauggaccagaucgugcacugggugcaggaggacgccagcggccugggcagaccccagcugcagggcgcccccgccgccgagcccauggccgugcccaugaugcugcugaaccugguggagcagcugggcgaggccgacgaggagcuggccggcaaguacgccgagcugggcgacuggugcgccagaagaauccugcagcacgugcagagagacggccaggccgugcuggagaacgugagcgagggcggcaaggagcugcccggcugccugggcagacagcagaaccccggccacacccuggaggccggcugguuccugcugagacacugcaucagaaagggcgaccccgagcugagagcccacgugaucgacaaguuccugcugcugcccuuccacagcggcugggaccccgaccacggcggccuguucuacuuccaggacgccgacaacuucugccccacccagcuggagugggccaugaagcugugguggccccacagcgaggccaugaucgccuuccugaugggcuacagcgacagcggcgaccccgugcugcugagacuguucuaccagguggccgaguacaccuucagacaguucagagaccccgaguacggcgagugguucggcuaccugagcagagagggcaagguggcccugagcaucaagggcggccccuucaagggcugcuuccacgugcccagaugccuggccaugugcgaggagaugcugggcgcccugcugagcagacccgcccccgcccccagccccgcccccacccccgccugcagaggcgccgaguaa

SEQ ID NO: 22553 - RNA, 1221 nt, Artificial Sequence
  REN__Homo_sapiens__NP_000528
auggacggcuggagaagaaugcccagauggggccugcugcugcugcuguggggcagcugcaccuucggccugcccaccgacaccaccaccuucaagagaaucuuccugaagagaaugcccagcaucagagagagccugaaggagagaggcguggacauggccagacugggccccgaguggagccagcccaugaagagacugacccugggcaacaccaccagcagcgugauccugaccaacuacauggacacccaguacuacggcgagaucggcaucggcacccccccccagaccuucaaggugguguucgacaccggcagcagcaacgugugggugcccagcagcaagugcagcagacuguacaccgccugcguguaccacaagcuguucgacgccagcgacagcagcagcuacaagcacaacggcaccgagcugacccugagauacagcaccggcaccgugagcggcuuccugagccaggacaucaucaccgugggcggcaucaccgugacccagauguucggcgaggugaccgagaugcccgcccugcccuucaugcuggccgaguucgacggcguggugggcaugggcuucaucgagcaggccaucggcagagugacccccaucuucgacaacaucaucagccagggcgugcugaaggaggacguguucagcuucuacuacaacagagacagcgagaacagccagagccugggcggccagaucgugcugggcggcagcgacccccagcacuacgagggcaacuuccacuacaucaaccugaucaagaccggcguguggcagauccagaugaagggcgugagcgugggcagcagcacccugcugugcgaggacggcugccuggcccugguggacaccggcgccagcuacaucagcggcagcaccagcagcaucgagaagcugauggaggcccugggcgccaagaagagacuguucgacuacguggugaagugcaacgagggccccacccugcccgacaucagcuuccaccugggcggcaaggaguacacccugaccagcgccgacuacguguuccaggagagcuacagcagcaagaagcugugcacccuggccauccacgccauggacauccccccccccaccggccccaccugggcccugggcgccaccuucaucagaaaguucuacaccgaguucgacagaagaaacaacagaaucggcuucgcccuggccagauaa

SEQ ID NO: 22554 - RNA, 2310 nt, Artificial Sequence
  REPS1__Homo_sapiens__NP_001122089
auggagggccugacccugagcgacgccgagcagaaguacuacagcgaccuguucagcuacugcgacaucgagagcaccaagaaggugguggugaacggcagagugcuggagcuguucagagccgcccagcugcccaacgacguggugcugcagaucauggagcugugcggcgccaccagacugggcuacuucggcagaagccaguucuacaucgcccugaagcugguggccguggcccagagcggcuucccccugagaguggagagcaucaacaccgugaaggaccugccccugcccagauucguggccagcaagaacgagcaggagagcagacacgccgccagcuacagcagcgacagcgagaaccagggcagcuacagcggcgugaucccccccccccccggcagaggccaggugaagaagggcagcgugagccacgacaccgugcagcccagaaccagcgccgacgcccaggagcccgccagccccguggugagcccccagcagagcccccccaccagcccccacaccuggagaaagcacagcagacaccccagcggcggcaacagcgagagaccccuggccggccccggccccuucuggagccccuucggcgaggcccagagcggcagcagcgccggcgacgccguguggagcggccacagccccccccccccccaggagaacugggugagcuucgccgacaccccccccaccagcacccugcugaccaugcaccccgccagcgugcaggaccagaccaccgugagaaccguggccagcgccaccaccgccaucgagaucagaagacagagcagcagcuacgacgaccccuggaagaucaccgacgagcagagacaguacuacgugaaccaguucaagaccauccagcccgaccugaacggcuucauccccggcagcgccgccaaggaguucuucaccaagagcaagcugcccauccuggagcugagccacaucugggagcugagcgacuucgacaaggacggcgcccugacccuggacgaguucugcgccgccuuccaccuggugguggccagaaagaacggcuacgaccugcccgagaagcugcccgagagccugaugcccaagcugaucgaccuggaggacagcgccgacgugggcgaccagcccggcgaggugggcuacagcggcagccccgccgaggccccccccagcaagagccccagcaugcccagccugaaccagaccuggcccgagcugaaccagagcagcgaggacaccgccaucgugcaccccgugcccaucagaaugacccccagcaagauccacaugcaggagauggagcugaagagaaccggcagcgaccacaccaaccccaccagcccccugcuggugaagcccagcgaccugcuggaggagaacaagaucaacagcagcgugaaguucgccagcggcaacaccguggccgacggcuacagcagcagcgacagcuucaccagcgaccccgagcagaucggcagcaacgugaccagacagagaagccacagcggcaccagccccgacaacaccgccccccccccccccccccccagaccccagcccagccacagcagaagcagcagccuggacaugaacagaaccuucaccgugaccaccggccagcagcaggccggcgugguggcccacccccccgccgugccccccagaccccagcccagccaggcccccggccccgccgugcacagacccguggacgccgacggccugaucacccacaccagcaccagcccccagcagauccccgagcagcccaacuucgccgacuucagccaguucgagguguucgccgccagcaacgugaacgacgagcaggacgacgaggccgagaagcaccccgaggugcugcccgccgagaaggccagcgaccccgccagcagccugagaguggccaagaccgacagcaagaccgaggagaagaccgccgccagcgcccccgccaacgugagcaagggcaccaccccccuggcccccccccccaagcccgugagaagaagacugaagagcgaggacgagcugagacccgagguggacgagcacacccagaagaccggcgugcuggccgccgugcuggccagccagcccagcauccccagaagcgugggcaaggacaagaaggccauccaggccagcaucagaagaaacaaggagaccaacaccgugcuggccagacugaacagcgagcugcagcagcagcugaaggacgugcuggaggagagaaucagccuggaggugcagcuggagcagcugagacccuucagccaccuguaa

SEQ ID NO: 22555 - RNA, 1980 nt, Artificial Sequence
  REPS2__Homo_sapiens__NP_001074444
auggaggccgccgccgccgccgccgccgccgccgccgccgccgccgccgccggcggcggcugcggcagcggcccccccccccugcugcugagcgagggcgagcagcagugcuacagcgagcuguucgccagaugcgccggcgccgccggcggcggccccggcagcggcccccccgaggccgccagaguggcccccggcaccgccaccgccgccgccggccccguggccgaccuguucagagccagccagcugcccgccgagacccugcaccagaucaccgagcugugcggcgccaagagagugggcuacuucggccccacccaguucuacaucgcccugaagcugaucgccgccgcccagagcggccugcccgugagaaucgagagcaucaagugcgagcugccccugcccagauucaugaugagcaagaacgacggcgagaucagauucggcaaccccgccgagcugcacggcaccaaggugcagauccccuaccugaccaccgagaagaacagcuucaagagaauggacgacgaggacaagcaggagacccagagccccaccaugagcccccuggccagcccccccagcagccccccccacuaccagagagugccccugagccacggcuacagcaagcugagaagcagcgccgagcagaugcaccccgcccccuacgaggccagacagccccuggugcagcccgagggcagcagcagcggcggccccggcaccaagccccugagacaccaggccagccugaucagaagcuucagcguggagagagagcugcaggacaacagcagcuaccccgacgagcccuggagaaucaccgaggagcagagagaguacuacgugaaccaguucagaagccugcagcccgaccccagcagcuucaucagcggcagcguggccaagaacuucuucaccaagagcaagcugagcauccccgagcugagcuacaucugggagcugagcgacgccgacugcgacggcgcccugacccugcccgaguucugcgccgccuuccaccugaucguggccagaaagaacggcuacccccugcccgagggccugccccccacccugcagcccgaguaccugcaggccgccuuccccaagcccaagugggacugccagcuguucgacagcuacagcgagagccugcccgccaaccagcagcccagagaccugaacagaauggagaagaccagcgugaaggacauggccgaccugcccgugcccaaccaggacgugaccagcgacgacaagcaggcccugaagagcaccaucaacgaggcccugcccaaggacgugagcgaggaccccgccacccccaaggacagcaacagccugaaggccagacccagaagcagaagcuacagcagcaccagcaucgaggaggccaugaagagaggcgaggacccccccacccccccccccagaccccagaagacccacagcagagccagcagccuggaccugaacaagguguuccagcccagcgugcccgccaccaagagcggccugcugccccccccccccgcccugccccccagacccugccccagccagagcgagcaggugagcgaggccgagcugcugccccagcugagcagagcccccagccaggccgccgagagcagccccgccaagaaggacgugcuguacagccagccccccagcaagcccaucagaagaaaguucagacccgagaaccaggccaccgagaaccaggagcccagcaccgccgccagcggccccgccagcgccgccaccaugaagccccaccccaccgugcagaagcagagcagcaagcagaagaaggccauccagaccgccaucagaaagaacaaggaggccaacgccgugcuggccagacugaacagcgagcugcagcagcagcugaaggaggugcaccaggagagaaucgcccuggagaaccagcuggagcagcugagacccgugaccgugcuguaa

SEQ ID NO: 22556 - RNA, 543 nt, Artificial Sequence
  RERG__Homo_sapiens__NP_001177655
auggccaagagcgccgaggugaagcuggccaucuucggcagagccggcgugggcaagagcgagagcaccuacagacaccaggccaccaucgacgacgagguggugagcauggagauccuggacaccgccggccaggaggacaccauccagagagagggccacaugagauggggcgagggcuucgugcugguguacgacaucaccgacagaggcagcuucgaggaggugcugccccugaagaacauccuggacgagaucaagaagcccaagaacgugacccugauccuggugggcaacaaggccgaccuggaccacagcagacaggugagcaccgaggagggcgagaagcuggccaccgagcuggccugcgccuucuacgagugcagcgccugcaccggcgagggcaacaucaccgagaucuucuacgagcugugcagagaggugagaagaagaagaauggugcagggcaagaccagaagaagaagcagcaccacccacgugaagcaggccaucaacaagaugcugaccaagaucagcagcuaa

SEQ ID NO: 22557 - RNA, 618 nt, Artificial Sequence
  RERGL__Homo_sapiens__NP_079006
augagcaacuuccugcaccugaaguacaacgagaagagcgugagcgugaccaaggcccugaccgugagauuccugaccaagagauucaucggcgaguacgccagcaacuucgagagcaucuacaagaagcaccugugccuggagagaaagcagcugaaccuggagaucuacgaccccugcagccagacccagaaggccaaguucagccugaccagcgagcugcacugggccgacggcuucgugaucguguacgacaucagcgacagaagcagcuucgccuucgccaaggcccugaucuacagaaucagagagccccagaccagccacugcaagagagccguggagagcgccguguuccuggugggcaacaagagagaccugugccacgugagagaggugggcugggaggagggccagaagcuggcccuggagaacagaugccaguucugcgagcugagcgccgccgagcagagccuggagguggagaugauguucaucagaaucaucaaggacauccugaucaacuucaagcugaaggagaagagaagacccagcggcagcaagagcauggccaagcugaucaacaacguguucggcaagagaagaaagagcguguaa

SEQ ID NO: 22558 - RNA, 3294 nt, Artificial Sequence
  REST__Homo_sapiens__NP_001180437
auggccacccaggugaugggccagagcagcggcggcggcggccuguucaccagcagcggcaacaucggcauggcccugcccaacgacauguacgaccugcacgaccugagcaaggccgagcuggccgccccccagcugaucaugcuggccaacguggcccugaccggcgaggugaacggcagcugcugcgacuaccuggugggcgaggagagacagauggccgagcugaugcccgugggcgacaacaacuucagcgacagcgaggagggcgagggccuggaggagagcgccgacaucaagggcgagccccacggccuggagaacauggagcugagaagccuggagcugagcgugguggagccccagcccguguucgaggccagcggcgcccccgacaucuacagcagcaacaaggaccugccccccgagacccccggcgccgaggacaagggcaagagcagcaagaccaagcccuucagaugcaagcccugccaguacgaggccgagagcgaggagcaguucgugcaccacaucagagugcacagcgccaagaaguucuucguggaggagagcgccgagaagcaggccaaggccagagagagcggcagcagcaccgccgaggagggcgacuucagcaagggccccaucagaugcgacagaugcggcuacaacaccaacagauacgaccacuacaccgcccaccugaagcaccacaccagagccggcgacaacgagagaguguacaagugcaucaucugcaccuacaccaccgugagcgaguaccacuggagaaagcaccugagaaaccacuuccccagaaagguguacaccugcggcaagugcaacuacuucagcgacagaaagaacaacuacgugcagcacgugagaacccacaccggcgagagacccuacaagugcgagcugugccccuacagcagcagccagaagacccaccugaccagacacaugagaacccacagcggcgagaagcccuucaagugcgaccagugcagcuacguggccagcaaccagcacgaggugaccagacacgccagacaggugcacaacggccccaagccccugaacugcccccacugcgacuacaagaccgccgacagaagcaacuucaagaagcacguggagcugcacgugaaccccagacaguucaacugccccgugugcgacuacgccgccagcaagaagugcaaccugcaguaccacuucaagagcaagcaccccaccugccccaacaagaccauggacgugagcaaggugaagcugaagaagaccaagaagagagaggccgaccugcccgacaacaucaccaacgagaagaccgagaucgagcagaccaagaucaagggcgacguggccggcaagaagaacgagaagagcgugaaggccgagaagagagacgugagcaaggagaagaagcccagcaacaacgugagcgugauccaggugaccaccagaaccagaaagagcgugaccgaggugaaggagauggacgugcacaccggcagcaacagcgagaaguucagcaagaccaagaagagcaagagaaagcuggagguggacagccacagccugcacggccccgugaacgacgaggagagcagcaccaagaagaagaagaagguggagagcaagagcaagaacaacagccaggaggugcccaagggcgacagcaagguggaggagaacaagaagcagaacaccugcaugaagaagagcaccaagaagaagacccugaagaacaagagcagcaagaagagcagcaagcccccccagaaggagcccguggagaagggcagcgcccagauggaccccccccagaugggccccgcccccaccgaggccgugcagaagggccccgugcagguggagccccccccccccauggagcacgcccagauggagggcgcccagaucagacccgcccccgacgagcccgugcagauggagguggugcaggagggccccgcccagaaggagcugcugccccccguggagcccgcccagauggugggcgcccagaucgugcuggcccacauggagcugcccccccccauggagaccgcccagaccgagguggcccagaugggccccgcccccauggagcccgcccagauggagguggcccagguggagagcgcccccaugcagguggugcagaaggagcccgugcagauggagcugagcccccccauggagguggugcagaaggagcccgugcagaucgagcugagcccccccauggagguggugcagaaggagcccgugaagaucgagcugagcccccccaucgagguggugcagaaggagcccgugcagauggagcugagcccccccaugggcguggugcagaaggagcccgcccagagagagccccccccccccagagagcccccccugcacauggagcccaucagcaagaagcccccccugagaaaggacaagaaggagaagagcaacaugcagagcgagagagccagaaaggagcaggugcugaucgaggugggccuggugcccgugaaggacagcuggcugcugaaggagagcgugagcaccgaggaccugagcccccccagccccccccugcccaaggagaaccugagagaggaggccagcggcgaccagaagcugcugaacaccggcgagggcaacaaggaggccccccugcagaaggugggcgccgaggaggccgacgagagccugcccggccuggccgccaacaucaacgagagcacccacaucagcagcagcggccagaaccugaacacccccgagggcgagacccugaacggcaagcaccagaccgacagcaucgugugcgagaugaagauggacaccgaccagaacaccagagagaaccugaccggcaucaacagcaccguggaggagcccgugagccccaugcugccccccagcgccguggaggagagagaggccgugagcaagaccgcccuggccagcccccccgccaccauggccgccaacgagagccaggagaucgacgaggacgagggcauccacagccacgagggcagcgaccugagcgacaacaugagcgagggcagcgacgacagcggccugcacggcgccagacccgugccccaggagagcagcagaaagaacgccaaggaggcccuggccgugaaggccgccaagggcgacuucgugugcaucuucugcgacagaagcuucagaaagggcaaggacuacagcaagcaccugaacagacaccuggugaacguguacuaccuggaggaggccgcccagggccaggaguaa

SEQ ID NO: 22559 - RNA, 3219 nt, Artificial Sequence
  RET__Homo_sapiens__NP_065681
auggccaaggccaccagcggcgccgccggccugagacugcugcugcugcugcugcugccccugcugggcaagguggcccugggccuguacuucagcagagacgccuacugggagaagcuguacguggaccaggccgccggcaccccccugcuguacgugcacgcccugagagacgcccccgaggaggugcccagcuucagacugggccagcaccuguacggcaccuacagaaccagacugcacgagaacaacuggaucugcauccaggaggacaccggccugcuguaccugaacagaagccuggaccacagcagcugggagaagcugagcgugagaaacagaggcuucccccugcugaccguguaccugaagguguuccugagccccaccagccugagagagggcgagugccaguggcccggcugcgccagaguguacuucagcuucuucaacaccagcuuccccgccugcagcagccugaagcccagagagcugugcuuccccgagaccagacccagcuucagaaucagagagaacagaccccccggcaccuuccaccaguucagacugcugcccgugcaguuccugugccccaacaucagcguggccuacagacugcuggagggcgagggccugcccuucagaugcgcccccgacagccuggaggugagcaccagaugggcccuggacagagagcagagagagaaguacgagcugguggccgugugcaccgugcacgccggcgccagagaggagguggugauggugcccuuccccgugaccguguacgacgaggacgacagcgcccccaccuuccccgccggcguggacaccgccagcgccgugguggaguucaagagaaaggaggacaccgugguggccacccugagaguguucgacgccgacguggugcccgccagcggcgagcuggugagaagauacaccagcacccugcugcccggcgacaccugggcccagcagaccuucagaguggagcacuggcccaacgagaccagcgugcaggccaacggcagcuucgugagagccaccgugcacgacuacagacuggugcugaacagaaaccugagcaucagcgagaacagaaccaugcagcuggccgugcuggugaacgacagcgacuuccagggccccggcgccggcgugcugcugcugcacuucaacgugagcgugcugcccgugagccugcaccugcccagcaccuacagccugagcgugagcagaagagccagaagauucgcccagaucggcaaggugugcguggagaacugccaggccuucagcggcaucaacgugcaguacaagcugcacagcagcggcgccaacugcagcacccugggcguggugaccagcgccgaggacaccagcggcauccuguucgugaacgacaccaaggcccugagaagacccaagugcgccgagcugcacuacauggugguggccaccgaccagcagaccagcagacaggcccaggcccagcugcuggugaccguggagggcagcuacguggccgaggaggccggcugcccccugagcugcgccgugagcaagagaagacuggagugcgaggagugcggcggccugggcagccccaccggcagaugcgaguggagacagggcgacggcaagggcaucaccagaaacuucagcaccugcagccccagcaccaagaccugccccgacggccacugcgacgugguggagacccaggacaucaacaucugcccccaggacugccugagaggcagcaucgugggcggccacgagcccggcgagcccagaggcaucaaggccggcuacggcaccugcaacugcuuccccgaggaggagaagugcuucugcgagcccgaggacauccaggacccccugugcgacgagcugugcagaaccgugaucgccgccgccgugcuguucagcuucaucgugagcgugcugcugagcgccuucugcauccacugcuaccacaaguucgcccacaagccccccaucagcagcgccgagaugaccuucagaagacccgcccaggccuuccccgugagcuacagcagcagcggcgccagaagacccagccuggacagcauggagaaccaggugagcguggacgccuucaagauccuggaggaccccaagugggaguuccccagaaagaaccuggugcugggcaagacccugggcgagggcgaguucggcaagguggugaaggccaccgccuuccaccugaagggcagagccggcuacaccaccguggccgugaagaugcugaaggagaacgccagccccagcgagcugagagaccugcugagcgaguucaacgugcugaagcaggugaaccacccccacgugaucaagcuguacggcgccugcagccaggacggcccccugcugcugaucguggaguacgccaaguacggcagccugagaggcuuccugagagagagcagaaaggugggccccggcuaccugggcagcggcggcagcagaaacagcagcagccuggaccaccccgacgagagagcccugaccaugggcgaccugaucagcuucgccuggcagaucagccagggcaugcaguaccuggccgagaugaagcuggugcacagagaccuggccgccagaaacauccugguggccgagggcagaaagaugaagaucagcgacuucggccugagcagagacguguacgaggaggacagcuacgugaagagaagccagggcagaauccccgugaaguggauggccaucgagagccuguucgaccacaucuacaccacccagagcgacguguggagcuucggcgugcugcugugggagaucgugacccugggcggcaaccccuaccccggcaucccccccgagagacuguucaaccugcugaagaccggccacagaauggagagacccgacaacugcagcgaggagauguacagacugaugcugcagugcuggaagcaggagcccgacaagagacccguguucgccgacaucagcaaggaccuggagaagaugauggugaagagaagagacuaccuggaccuggccgccagcacccccagcgacagccugaucuacgacgacggccugagcgaggaggagaccccccugguggacugcaacaacgccccccugcccagagcccugcccagcaccuggaucgagaacaagcuguacggcagaaucagccacgccuucaccagauucuaa

SEQ ID NO: 22560 - RNA, 327 nt, Artificial Sequence
  RETN__Homo_sapiens__NP_001180303
augaaggcccugugccugcugcugcugcccgugcugggccugcuggugagcagcaagacccugugcagcauggaggaggccaucaacgagagaauccaggagguggccggcagccugaucuucagagccaucagcagcaucggccuggagugccagagcgugaccagcagaggcgaccuggccaccugccccagaggcuucgccgugaccggcugcaccugcggcagcgccugcggcagcugggacgugagagccgagaccaccugccacugccagugcgccggcauggacuggaccggcgccagaugcugcagagugcagcccuaa

SEQ ID NO: 22561 - RNA, 336 nt, Artificial Sequence
  RETNLB__Homo_sapiens__NP_115968
augggccccagcagcugccugcugcugauccugaucccccugcugcagcugaucaaccccggcagcacccagugcagccuggacagcgugauggacaagaagaucaaggacgugcugaacagccuggaguacagccccagccccaucagcaagaagcugagcugcgccagcgugaagagccagggcagacccagcagcugccccgccggcauggccgugaccggcugcgccugcggcuacggcugcggcagcugggacgugcagcuggagaccaccugccacugccagugcagcgugguggacuggaccaccgccagaugcugccaccugaccuaa

SEQ ID NO: 22562 - RNA, 1833 nt, Artificial Sequence
  RETSAT__Homo_sapiens__NP_060220
auguggcugccccuggugcugcugcuggccgugcugcugcuggccgugcugugcaagguguaccugggccuguucagcggcagcagccccaaccccuucagcgaggacgugaagagaccccccgccccccuggugaccgacaaggaggccagaaagaaggugcugaagcaggccuucagcgccaaccaggugcccgagaagcuggacgugguggugaucggcagcggcuucggcggccuggccgccgccgccauccuggccaaggccggcaagagagugcuggugcuggagcagcacaccaaggccggcggcugcugccacaccuucggcaagaacggccuggaguucgacaccggcauccacuacaucggcagaauggaggagggcagcaucggcagauucauccuggaccagaucaccgagggccagcuggacugggccccccugagcagccccuucgacaucauggugcuggagggccccaacggcagaaaggaguaccccauguacagcggcgagaaggccuacauccagggccugaaggagaaguucccccaggaggaggccaucaucgacaaguacaucaagcuggugaagguggugagcagcggcgccccccacgccauccugcugaaguuccugccccugcccguggugcagcugcuggacagaugcggccugcugaccagauucagccccuuccugcaggccagcacccagagccuggccgaggugcugcagcagcugggcgccagcagcgagcugcaggccgugcugagcuacaucuuccccaccuacggcgugacccccaaccacagcgccuucagcaugcacgcccugcuggugaaccacuacaugaagggcggcuucuaccccagaggcggcagcagcgagaucgccuuccacaccauccccgugauccagagagccggcggcgccgugcugaccaaggccaccgugcagagcgugcugcuggacagcgccggcaaggccugcggcgugagcgugaagaagggccacgagcuggugaacaucuacugccccaucguggugagcaacgccggccuguucaacaccuacgagcaccugcugcccggcaacgccagaugccugcccggcgugaagcagcagcugggcaccgugagacccggccugggcaugaccagcguguucaucugccugagaggcaccaaggaggaccugcaccugcccagcaccaacuacuacguguacuacgacaccgacauggaccaggccauggagagauacgugagcaugcccagagaggaggccgccgagcacaucccccugcuguucuucgccuuccccagcgccaaggaccccaccugggaggacagauuccccggcagaagcaccaugaucaugcugauccccaccgccuacgagugguucgaggaguggcaggccgagcugaagggcaagagaggcagcgacuacgagaccuucaagaacagcuucguggaggccagcaugagcguggugcugaagcuguucccccagcuggagggcaagguggagagcgugaccgccggcagcccccugaccaaccaguucuaccuggccgcccccagaggcgccugcuacggcgccgaccacgaccugggcagacugcaccccugcgugauggccagccugagagcccagagccccauccccaaccuguaccugaccggccaggacaucuucaccugcggccuggugggcgcccugcagggcgcccugcugugcagcagcgccauccugaagagaaaccuguacagcgaccugaagaaccuggacagcagaaucagagcccagaagaagaagaacuaa

SEQ ID NO: 22563 - RNA, 3753 nt, Artificial Sequence
  REV1__Homo_sapiens__NP_001032961
augagaagaggcggcuggagaaagagagccgagaacgacggcugggagaccuggggcggcuacauggccgccaaggugcagaagcuggaggagcaguucagaagcgacgccgccaugcagaaggacggcaccagcagcaccaucuucagcggcguggccaucuacgugaacggcuacaccgaccccagcgccgaggagcugagaaagcugaugaugcugcacggcggccaguaccacguguacuacagcagaagcaagaccacccacaucaucgccaccaaccugcccaacgccaagaucaaggagcugaagggcgagaaggugaucagacccgaguggaucguggagagcaucaaggccggcagacugcugagcuacauccccuaccagcuguacaccaagcagagcagcgugcagaagggccugagcuucaaccccgugugcagacccgaggacccccugcccggccccagcaacaucgccaagcagcugaacaacagagugaaccacaucgugaagaagaucgagaccgagaacgaggugaaggugaacggcaugaacagcuggaacgaggaggacgagaacaacgacuucagcuucguggaccuggagcagaccagccccggcagaaagcagaacggcaucccccaccccagaggcagcaccgccaucuucaacggccacacccccagcagcaacggcgcccugaagacccaggacugccuggugcccauggugaacagcguggccagcagacugagccccgccuucagccaggaggaggacaaggccgagaagagcagcaccgacuucagagacugcacccugcagcagcugcagcagagcaccagaaacaccgacgcccugagaaacccccacagaaccaacagcuucagccugagcccccugcacagcaacaccaagaucaacggcgcccaccacagcaccgugcagggccccagcagcaccaagagcaccagcagcgugagcaccuucagcaaggccgcccccagcgugcccagcaagcccagcgacugcaacuucaucagcaacuucuacagccacagcagacugcaccacaucagcauguggaagugcgagcugaccgaguucgugaacacccugcagagacagagcaacggcaucuuccccggcagagagaagcugaagaagaugaagaccggcagaagcgcccugguggugaccgacaccggcgacaugagcgugcugaacagccccagacaccagagcugcaucaugcacguggacauggacugcuucuucgugagcgugggcaucagaaacagacccgaccugaagggcaagcccguggccgugaccagcaacagaggcaccggcagagccccccugagacccggcgccaacccccagcuggaguggcaguacuaccagaacaagauccugaagggcaaggccgacauccccgacagcagccugugggagaaccccgacagcgcccaggccaacggcaucgacagcgugcugagcagagccgagaucgccagcugcagcuacgaggccagacagcugggcaucaagaacggcauguucuucggccacgccaagcagcugugccccaaccugcaggccgugcccuacgacuuccacgccuacaaggagguggcccagacccuguacgagacccuggccagcuacacccacaacaucgaggccgugagcugcgacgaggcccugguggacaucaccgagauccuggccgagaccaagcugacccccgacgaguucgccaacgccgugagaauggagaucaaggaccagaccaagugcgccgccagcgugggcaucggcagcaacauccugcuggccagaauggccaccagaaaggccaagcccgacggccaguaccaccugaagcccgaggagguggacgacuucaucagaggccagcuggugaccaaccugcccggcgugggccacagcauggagagcaagcuggccagccugggcaucaagaccugcggcgaccugcaguacaugaccauggccaagcugcagaaggaguucggccccaagaccggccagaugcuguacagauucugcagaggccuggacgacagacccgugagaaccgagaaggagagaaagagcgugagcgccgagaucaacuacggcaucagauucacccagcccaaggaggccgaggccuuccugcugagccugagcgaggagauccagagaagacuggaggccaccggcaugaagggcaagagacugacccugaagaucauggugagaaagcccggcgcccccguggagaccgccaaguucggcggccacggcaucugcgacaacaucgccagaaccgugacccuggaccaggccaccgacaacgccaagaucaucggcaaggccaugcugaacauguuccacaccaugaagcugaacaucagcgacaugagaggcgugggcauccacgugaaccagcuggugcccaccaaccugaaccccagcaccugccccagcagacccagcgugcagagcagccacuuccccagcggcagcuacagcgugagagacguguuccaggugcagaaggccaagaagagcaccgaggaggagcacaaggagguguucagagccgccguggaccuggagaucagcagcgccagcagaaccugcaccuuccugccccccuuccccgcccaccugcccaccagccccgacaccaacaaggccgagagcagcggcaaguggaacggccugcacacccccgugagcgugcagagcagacugaaccugagcaucgaggugcccagccccagccagcuggaccagagcgugcuggaggcccugccccccgaccugagagagcagguggagcaggugugcgccgugcagcaggccgagagccacggcgacaagaagaaggagcccgugaacggcugcaacaccggcauccugccccagcccgugggcaccgugcugcugcagauccccgagccccaggagagcaacagcgacgccggcaucaaccugaucgcccugcccgccuucagccagguggaccccgagguguucgccgcccugcccgccgagcugcagagagagcugaaggccgccuacgaccagagacagagacagggcgagaacagcacccaccagcagagcgccagcgccagcgugcccaagaacccccugcugcaccugaaggccgccgugaaggagaagaagagaaacaagaagaagaagaccaucggcagccccaagagaauccagagcccccugaacaacaagcugcugaacagccccgccaagacccugcccggcgccugcggcagcccccagaagcugaucgacggcuuccugaagcacgagggcccccccgccgagaagccccuggaggagcugagcgccagcaccagcggcgugcccggccugagcagccugcagagcgaccccgccggcugcgugagaccccccgcccccaaccuggccggcgccguggaguucaacgacgugaagacccugcugagagaguggaucaccaccaucagcgaccccauggaggaggacauccugcagguggugaaguacugcaccgaccugaucgaggagaaggaccuggagaagcuggaccuggugaucaaguacaugaagagacugaugcagcagagcguggagagcguguggaacauggccuucgacuucauccuggacaacgugcagguggugcugcagcagaccuacggcagcacccugaaggugaccuaa

SEQ ID NO: 22564 - RNA, 9159 nt, Artificial Sequence
  REV3L__Homo_sapiens__NP_001273361
auggccuucagcaucgacagagcccugaacguggcccugggcaaccccagcagcaccgcccagcacguguucaaggugagccuggugagcggcaugcccuucuacggcuaccacgagaaggagagacacuucaugaagaucuaccuguacaaccccaccauggugaagagaaucugcgagcugcugcagagcggcgccaucaugaacaaguucuaccagccccacgaggcccacauccccuaccugcugcagcuguucaucgacuacaaccuguacggcaugaaccugaucaaccuggccgccgugaaguucagaaaggccagaagaaagagcaacacccugcacgccaccggcagcugcaagaaccaccugagcggcaacagccuggccgacacccuguucagaugggagcaggacgagauccccagcagccugauccuggagggcguggagccccagagcaccugcgagcuggagguggacgccguggccgccgacauccugaacagacuggacaucgaggcccagaucggcggcaaccccggccugcaggccaucugggaggacgagaagcagagaagaagaaacagaaacgagaccagccagaugagccagcccgagagccaggaccacagauucgugcccgccaccgagagcgagaagaaguuccagaagagacugcaggagauccugaagcagaacgacuucagcgugacccugagcggcagcguggacuacagcgacggcagccaggaguucagcgccgagcugacccugcacagcgaggugcugagccccgagaugcugcagugcacccccgccaacaugguggaggugcacaaggacaaggagagcagcaagggccacaccagacacaagguggaggaggcccugaucaacgaggaggccauccugaaccugauggagaacagccagaccuuccagccccugacccagagacugagcgagagccccguguucauggacagcagccccgacgaggcccuggugcaccugcuggccggccuggagagcgacggcuacagaggcgagagaaacagaaugcccagccccugcagaagcuucggcaacaacaaguacccccagaacagcgacgacgaggagaacgagccccagaucgagaaggaggagauggagcugagccuggugaugagccagagaugggacagcaacaucgaggagcacugcgccaagaagagaagccugugcagaaacacccacagaagcagcaccgaggacgacgacagcagcagcggcgaggagauggaguggagcgacaacagccugcugcuggccagccugagcaucccccagcuggacggcaccgccgacgagaacagcgacaacccccugaacaacgagaacagcagaacccacagcagcgugaucgccaccagcaagcugagcgugaagcccagcaucuuccacaaggacgccgccacccuggagcccagcagcagcgccaagaucaccuuccagugcaagcacaccagcgcccugagcagccacgugcugaacaaggaggaccugaucgaggaccugagccagaccaacaagaacaccgagaagggccuggacaacagcgugaccagcuucaccaacgagagcaccuacagcaugaaguaccccggcagccugagcagcaccgugcacagcgagaacagccacaaggagaacagcaagaaggagauccugcccgugagcagcugcgagagcagcaucuucgacuacgaggaggacauccccagcgugaccagacaggugcccagcagaaaguacaccaacaucagaaagaucgagaaggacagccccuucauccacaugcacagacaccccaacgagaacacccugggcaagaacagcuucaacuucagcgaccugaaccacagcaagaacaaggugagcagcgagggcaacgagaagggcaacagcaccgcccugagcagccuguuccccagcagcuucaccgagaacugcgagcugcugagcugcagcggcgagaacagaaccauggugcacagccugaacagcaccgccgacgagagcggccugaacaagcugaagaucagauacgaggaguuccaggagcacaagaccgagaagcccagccugagccagcaggccgcccacuacauguucuuccccagcguggugcugagcaacugccugaccagaccccagaagcugagccccgugaccuacaagcugcagcccggcaacaagcccagcagacugaagcugaacaagagaaagcuggccggccaccaggagaccagcaccaagagcagcgagaccggcagcaccaaggacaacuucauccagaacaaccccugcaacagcaaccccgagaaggacaacgcccuggccagcgaccugaccaagaccaccagaggcgccuucgagaacaagacccccaccgacggcuucaucgacugccacuucggcgacggcacccuggagaccgagcagagcuucggccuguacggcaacaaguacacccugagagccaagagaaaggugaacuacgagaccgaggacagcgagagcagcuucgugacccacaacagcaagaucagccugccccaccccauggagaucggcgagagccuggacggcacccugaagagcagaaagagaagaaagaugagcaagaagcugccccccgugaucaucaaguacaucaucaucaacagauucagaggcagaaagaacaugcuggugaagcugggcaagaucgacagcaaggagaagcaggugauccugaccgaggagaagauggagcuguacaagaagcuggccccccugaaggacuucuggcccaaggugcccgacagccccgccaccaaguaccccaucuacccccugacccccaagaagagccacagaagaaagagcaagcacaagagcgccaagaagaagaccggcaagcagcagagaaccaacaacgagaacaucaagagaacccugagcuucagaaagaagagaagccacgccauccugagcccccccagccccagcuacaacgccgagaccgaggacugcgaccugaacuacagcgacgugaugagcaagcugggcuuccugagcgagagaagcaccagccccaucaacagcagcccccccagaugcuggagccccaccgaccccagagccgaggagaucauggccgccgccgagaaggaggccaugcuguucaagggccccaacguguacaagaagaccgugaacagcagaaucggcaagaccagcagagccagagcccagaucaagaagagcaaggccaagcuggccaaccccagcaucgugaccaagaagagaaacaagagaaaccagaccaacaagcugguggacgacggcaagaagaagcccagagccaagcagaagaccaacgagaagggcaccagcagaaagcacaccacccugaaggacgagaagaucaagagccagagcggcgccgaggugaaguucgugcugaagcaccagaacgugagcgaguucgccagcagcagcggcggcagccagcugcuguucaagcagaaggacaugccccugaugggcagcgccguggaccacccccugagcgccagccugcccaccggcaucaacgcccagcagaagcugagcggcugcuucagcagcuuccuggagagcaagaagagcguggaccugcagaccuuccccagcagcagagacgaccugcaccccagcguggugugcaacagcaucggccccggcgugagcaagaucaacgugcagagaccccacaaccagagcgccauguucacccugaaggagagcacccugauccagaagaacaucuucgaccugagcaaccaccugagccagguggcccagaacacccagaucagcagcggcaugagcagcaagaucgaggacaacgccaacaacauccagagaaacuaccugagcagcaucggcaagcugagcgaguacagaaacagccuggagagcaagcuggaccaggccuacacccccaacuuccugcacugcaaggacagccagcagcagaucgugugcaucgccgagcagagcaagcacagcgagaccugcagccccggcaacaccgccagcgaggagagccagaugcccaacaacugcuucgugaccagccugagaagccccaucaagcagaucgccugggagcagaagcagagaggcuucauccuggacaugagcaacuucaagcccgagagagugaagcccagaagccugagcgaggccaucagccagaccaaggcccugagccagugcaagaacagaaacgugagcacccccagcgccuucggcgagggccagagcggccuggccgugcugaaggagcugcugcagaagagacagcagaaggcccagaacgccaacaccacccaggacccccugagcaacaagcaccagcccaacaagaacaucagcggcagccuggagcacaacaaggccaacaagagaaccagaagcgugaccagccccagaaagcccagaacccccagaagcaccaagcagaaggagaagauccccaagcugcugaagguggacagccugaaccugcagaacagcagccagcuggacaacagcgugagcgacgacagccccaucuucuucagcgaccccggcuucgagagcugcuacagccuggaggacagccugagccccgagcacaacuacaacuucgacaucaacaccaucggccagaccggcuucugcagcuucuacagcggcagccaguucgugcccgccgaccagaaccugccccagaaguuccugagcgacgccgugcaggaccuguuccccggccaggccaucgagaagaacgaguuccugagccacgacaaccagaagugcgacgaggacaagcaccacaccaccgacagcgccagcuggaucagaagcggcacccugagccccgagaucuucgagaagagcaccaucgacagcaacgagaacagaagacacaaccaguggaagaacagcuuccacccccugaccaccagaagcaacagcaucauggacagcuucugcgugcagcaggccgaggacugccugagcgagaagagcagacugaacagaagcagcgugagcaaggagguguuccugagccugccccagcccaacaacagcgacuggauccagggccacaccagaaaggagaugggccagagccuggacagcgccaacaccagcuucaccgccauccugagcagccccgacggcgagcugguggacguggccugcgaggaccuggagcuguacgugagcagaaacaacgacaugcugacccccacccccgacagcagccccagaagcaccagcagccccagccagagcaagaacggcagcuucacccccagaaccgccaacauccugaagccccugaugagcccccccagcagagaggagaucauggccacccugcuggaccacgaccugagcgagaccaucuaccaggagcccuucugcagcaaccccagcgacgugcccgagaagcccagagagaucggcggcagacugcugaugguggagaccagacuggccaacgaccuggccgaguucgagggcgacuucagccuggagggccugagacuguggaagaccgccuucagcgccaugacccagaaccccagacccggcagcccccugagaagcggccagggcguggugaacaagggcagcagcaacagccccaagaugguggaggacaagaagaucgugaucaugcccugcaagugcgcccccagcagacagcuggugcagguguggcugcaggccaaggaggaguacgagagaagcaagaagcugcccaagaccaagcccaccggcguggugaagagcgccgagaacuucagcagcagcgugaaccccgacgacaagcccguggugccccccaagauggacgugagccccugcauccugcccaccaccgcccacaccaaggaggacguggacaacagccagaucgcccugcaggcccccaccaccggcugcagccagaccgccagcgagagccagaugcugccccccguggccagcgccagcgaccccgagaaggacgaggacgacgacgacaacuacuacaucagcuacagcagccccgacagccccgugaucccccccuggcagcagcccaucagccccgacagcaaggcccugaacggcgacgacagacccagcagccccguggaggagcugcccagccuggccuucgagaacuuccugaagcccaucaaggacggcauccagaagagccccugcagcgagccccaggagccccuggugaucagccccaucaacaccagagccagaaccggcaagugcgagagccugugcuuccacagcacccccaucauccagagaaagcugcuggagagacugcccgaggcccccggccugagcccccugagcaccgagcccaagacccagaagcugagcaacaagaagggcagcaacaccgacacccugagaagagugcugcugacccaggccaagaaccaguucgccgccgugaacaccccccagaaggagaccagccagaucgacggccccagccugaacaacaccuacggcuucaaggugagcauccagaaccugcaggaggccaaggcccugcacgagauccagaaccugacccugaucagcguggagcugcacgccagaaccagaagagaccuggagcccgaccccgaguucgaccccaucugcgcccuguucuacugcaucagcagcgacaccccccugcccgacaccgagaagaccgagcugaccggcgugaucgugaucgacaaggacaagaccguguucagccaggacaucagauaccagaccccccugcugaucagaagcggcaucaccggccuggaggugaccuacgccgccgacgagaaggcccuguuccacgagaucgccaacaucaucaagagauacgaccccgacauccugcugggcuacgagauccagaugcacagcuggggcuaccugcugcagagagccgccgcccugagcaucgaccugugcagaaugaucagcagagugcccgacgacaagaucgagaacagauucgccgccgagagagacgaguacggcagcuacaccaugagcgagaucaacaucgugggcagaaucacccugaaccuguggagaaucaugagaaacgagguggcccugaccaacuacaccuucgagaacgugagcuuccacgugcugcaccagagauucccccuguucaccuucagagugcugagcgacugguucgacaacaagaccgaccuguacagauggaagaugguggaccacuacgugagcagagugagaggcaaccugcagaugcuggagcagcuggaccugaucggcaagaccagcgagauggccagacuguucggcauccaguuccugcacgugcugaccagaggcagccaguacagaguggagagcaugaugcugagaaucgccaagcccaugaacuacauccccgugacccccagcgugcagcagagaagccagaugagagccccccagugcgugccccugaucauggagcccgagagcagauucuacagcaacagcgugcuggugcuggacuuccagagccuguaccccagcaucgugaucgccuacaacuacugcuucagcaccugccugggccacguggagaaccugggcaaguacgacgaguucaaguucggcugcaccagccugagagugccccccgaccugcuguaccaggugagacacgacaucaccgugagccccaacggcguggccuucgugaagcccagcgugagaaagggcgugcugcccagaaugcuggaggagauccugaagaccagauucauggugaagcagagcaugaaggccuacaagcaggacagagcccugagcagaaugcuggacgccagacagcugggccugaagcugaucgccaacgugaccuucggcuacaccagcgccaacuucagcggcagaaugcccugcaucgaggugggcgacagcaucgugcacaaggccagagagacccuggagagagccaucaagcuggugaacgacaccaagaaguggggcgccagagugguguacggcgacaccgacagcauguucgugcugcugaagggcgccaccaaggagcagagcuucaagaucggccaggagaucgccgaggccgugaccgccaccaaccccaagcccgugaagcugaaguucgagaagguguaccugcccugcgugcugcagaccaagaagagauacgugggcuacauguacgagacccuggaccagaaggaccccguguucgacgccaagggcaucgagaccgugagaagagacagcugccccgccgugagcaagauccuggagagaagccugaagcugcuguucgagaccagagacaucagccugaucaagcaguacgugcagagacagugcaugaagcugcuggagggcaaggccagcauccaggacuucaucuucgccaaggaguacagaggcagcuucagcuacaagcccggcgccugcgugcccgcccuggagcugaccagaaagaugcugaccuacgacagaagaagcgagccccaggugggcgagagagugcccuacgugaucaucuacggcacccccggcgugccccugauccagcuggugagaagacccguggaggugcugcaggaccccacccugagacugaacgccaccuacuacaucaccaagcagauccugcccccccuggccagaaucuucagccugaucggcaucgacguguucagcugguaccacgagcugcccagaauccacaaggccaccagcagcagcagaagcgagcccgagggcagaaagggcaccaucagccaguacuucaccacccugcacugccccgugugcgacgaccugacccagcacggcaucugcagcaagugcagaagccagccccagcacguggccgugauccugaaccaggagaucagagagcuggagagacagcaggagcagcuggugaagaucugcaagaacugcaccggcugcuucgacagacacauccccugcgugagccugaacugccccgugcuguucaagcugagcagagugaacagagagcugagcaaggcccccuaccugagacagcugcuggaccaguucuaa

SEQ ID NO: 22565 - RNA, 3666 nt, Artificial Sequence
  REXO1__Homo_sapiens__NP_065746
augcugagaagcaccggcuucuucagagccaucgacugccccuacuggagcggcgcccccggcggccccugcagaagacccuacugccacuucagacacagaggcgccagaggcagcggcgcccccggcgacggcggcgaggccccccccgccgccggccugggcuacgaccccuacaaccccgagcugcccaagccccccgcccagagagagaacggcacccugggccugggcgaggagcccagacccgacgugcuggagcuggagcuggugaaccaggccaucgaggccgugagaagcgagguggagcuggagcagagaagauacagagagcugcuggagaccaccagagagcacagaagcgccgaggcccccgcccuggcccccagaggccccaacgccagccccaccgugggccccgacgaggacgccuucccccuggccuucgacuacagccccggcagccacggccugcugagccccgacgccggcuaccagcccaccccccuggccgcccccgccgagcccggcagcaaguacagccuggccagccuggacagaggccagggcagaggcggcggcggcggcggcgcccuggaguacgugcccaaggccgugagccagcccagaagacacagcagacccgugcccagcggcaaguacgugguggacaacagcagaccccccaccgaccuggaguacgacccccugagcaacuacagcgccagacaccugagcagagccagcagcagagacgagagagccgccaagagacccagaggcagcagaggcagcgagcccuacacccccgcccccaagaagcugugcgaccccuucggcagcugcgacgccagauucagcgacagcgaggacgaggccgccaccgugcccggcaacgagcccaccaccgccagcacccccaaggccagagccgaccccgagaucaaggccaccggccagccccccagcaaggagggccuggaggccgagggcggcggccugagagagaccaaggagaccgccgugcagugcgacgugggcgaccugcagcccccccccgccaagcccgccagccccgcccaggugcagagcagccaggacggcggcugccccaaggagggcaagcccaagaagaagaagaccggcgccccccccgcccccagcugcaaggacggcgcccagggcaaggacaagaccaaggacaagggcagaggcagacccguggagaagcccagagccgacaagaagggcccccaggccagcagccccagaagaaaggccgagagacccgagggcaccaagaagaagcccagcagcgccacccccguggccaccagcggcaagggcagacccgacagacccgccagaagacccagccccaccagcggcgacagcagacccgccgccggcagaggcccccccagaccccugcagcugcccgacagaaagagcaccaaggcccccagcggcaagcugguggagagaaaggccagaagccuggacgagggcgccagccaggacgcccccaagcugaagaagagagcccugagccacgccgaccuguucggcgacgagagcgaggacgaggccgccggccccggcgugcccagcguguggcccagcgcccugcccagccugagcagcgacagcgacagcgacagcgacagcagccugggcuuccccgaggcccagggcccccccaagagacugaaggccagccccccccccagccccgcccccagcagcagcagcagcagcagcagcagcaccagcagcgccggcgccgacguggacuacagcgcccuggagaaggagguggacuucgacagcgaccccauggaggagugccugagaaucuucaacgagagcaccagcgugaagaccgaggacagaggcagacuggccagacagccccccaaggaggagaagagcgaggagaagggccugagcggccugaccacccuguuccccggccagaagagaagaaucagccaccugagcaagcagggccaggagguggagccccccagaagaggccccgccgugccccccgccagaccccccaccgcccaggaggugugcuaccugagagcccagcaggcccagagagccagcgccagccugcugcaggcccccgccagacuggccgagaagagccccagcgugcacaucagcgcccccggcgagaagagaagaaucgcccacauccccaaccccagacuggccgccgcccccaccggcgccaagagaacccuggccgccagcggcagccagagcagcaacggccccgagcccggcggccagcagcugaagaccagaacccugagcggcauggccagcaagaccaccaccaccaucauccccaagagaaucgcccacagccccagccugcagagccugaagaagcccaucauccccaaggaguucggcggcaaggugcccaccgugaucagacagagauaccugaaccuguucaucgaggagugccugaaguucugcaccagcaaccaggaggccaucgagaaggcccugaacgaggagaagguggccuacgacagaagccccagcaagaacaucuaccugaacguggccgugaacacccugaagaagcugagaggccuggcccccagcgccgugcccggccugagcaagaccagcggcagaagaguggugagccacgagguggugcugggcggcagacuggccgccaagaccagcuucagccugagcagacccagcagccccagaguggaggaccugaagggcgccgcccuguacagcagacugagagaguaccugcugacccaggaccagcugaaggagaacggcuaccccuucccccaccccgagagacccggcggcgccaucaucuucaccgccgaggagaagagacccaaggacagcagcugcagaaccugcugcagaugcggcaccgaguaccuggugagcagcagcggcagaugcaucagagacgaggagugcuacuaccacuggggcagacugagaagaaacagaguggccggcggcugggagacccaguacaugugcugcagcgccgccgccggcagcgugggcugccagguggccaagcagcacgugcaggacggcagaaaggagagacuggagggcuucgugaagaccuucgagaaggagcugagcggcgacacccaccccggcaucuacgcccuggacugcgagaugagcuacaccaccuacggccuggagcugaccagagugaccgugguggacaccgacgugcacgugguguacgacaccuucgugaagcccgacaacgagaucguggacuacaacaccagauucagcggcgugaccgaggccgaccuggccgacaccagcgugacccugagagacgugcaggccgugcugcugagcauguucagcgccgacaccauccugaucggccacagccuggagagcgaccugcuggcccugaaggugauccacagcaccgugguggacaccagcgugcuguucccccacagacugggccugcccuacaagagaagccugagaaaccugauggccgacuaccugagacagaucauccaggacaacguggacggccacagcagcagcgaggacgccggcgccugcaugcaccuggugaucuggaaggugagagaggacgccaagaccaagagauaa

SEQ ID NO: 22566 - RNA, 714 nt, Artificial Sequence
  REXO2__Homo_sapiens__NP_056338
augcugggcggcagccugggcagcagacugcugagaggcgugggcggcagccacggcagauucggcgccagaggcgugagagagggcggcgccgccauggccgccggcgagagcauggcccagagaaugguguggguggaccuggagaugaccggccuggacaucgagaaggaccagaucaucgagauggccugccugaucaccgacagcgaccugaacauccuggccgagggccccaaccugaucaucaagcagcccgacgagcugcuggacagcaugagcgacuggugcaaggagcaccacggcaagagcggccugaccaaggccgugaaggagagcaccaucacccugcagcaggccgaguacgaguuccugagcuucgugagacagcagaccccccccggccugugcccccuggccggcaacagcgugcacgaggacaagaaguuccuggacaaguacaugccccaguucaugaagcaccugcacuacagaaucaucgacgugagcaccgugaaggagcugugcagaagaugguaccccgaggaguacgaguucgcccccaagaaggccgccagccacagagcccuggacgacaucagcgagagcaucaaggagcugcaguucuacagaaacaacaucuucaagaagaagaucgacgagaagaagagaaagaucaucgagaacggcgagaacgagaagaccgugagcuaa

SEQ ID NO: 22567 - RNA, 753 nt, Artificial Sequence
  REXO4__Homo_sapiens__NP_001266278
augggcaaggccaaggugcccgccagcaagagagcccccagcagccccguggccaagcccggccccgugaagacccugaccagaaagaagaacaagaagaagaagagauucuggaagagcaaggccagagaggugagcaagaagcccgccagcggccccggcgccguggugagaccccccaaggcccccgaggacuucagccagaacuggaaggcccugcaggaggugcccagauggaccggcggcagacaguaccuggcccccagacccguggagcagagcaccaucagaaaggagcccagaaagggccagauggugauccuguuccagaacgagggcaccagcagcaucagaagcggcaagcugagaagacagccccagccccacccccccagagaggagcuggagguggugcagaaggagguggccgagaugcugaagggcagaauccuggugggccacgcccugcacaacgaccugaaggugcuguuccuggaccaccccaagaagaagaucagagacacccagaaguacaagcccuucaagagccaggugaagagcggcagacccagccugagacugcugagcgagaagauccugggccugcaggugcagcaggccgagcacugcagcauccaggacgcccaggccgccaugagacuguacgugauggugaagaaggagugggagagcauggccagagacagaagaccccugcugaccgcccccgaccacugcagcgacgacgccuaa

SEQ ID NO: 22568 - RNA, 3447 nt, Artificial Sequence
  RFC1__Homo_sapiens__NP_001191676
auggacaucagaaaguucuucggcgugauccccagcggcaagaagcuggugagcgagaccgugaagaagaacgagaagaccaagagcgacgaggagacccugaaggccaagaagggcaucaaggagaucaaggugaacagcagcagaaaggaggacgacuucaagcagaagcagcccagcaagaagaagagaaucaucuacgacagcgacagcgagagcgaggagacccugcaggugaagaacgccaagaagccccccgagaagcugcccgugagcagcaagcccggcaagaucagcagacaggaccccgugaccuacaucagcgagaccgacgaggaggacgacuucaugugcaagaaggccgccagcaagagcaaggagaacggcagaagcaccaacagccaccugggcaccagcaacaugaagaagaacgaggagaacaccaagaccaagaacaagccccugagccccaucaagcugacccccaccagcgugcuggacuacuucggcaccggcagcgugcagagaagcaacaagaagaugguggccagcaagagaaaggagcugagccagaacaccgacgagagcggccugaacgacgaggccaucgccaagcagcugcagcuggacgaggacgccgagcuggagagacagcugcacgaggacgaggaguucgccagaacccuggccaugcuggacgaggagcccaagaccaagaaggccagaaaggacaccgaggccggcgagaccuucagcagcgugcaggccaaccugagcaaggccgagaagcacaaguacccccacaaggugaagaccgcccaggugagcgacgagagaaagagcuacagccccagaaagcagagcaaguacgagagcagcaaggagagccagcagcacagcaagagcagcgccgacaagaucggcgaggugagcagccccaaggccagcagcaagcuggccaucaugaagagaaaggaggagagcagcuacaaggagaucgagcccguggccagcaagagaaaggagaacgccaucaagcugaagggcgagaccaagacccccaagaagaccaagagcagccccgccaagaaggagagcgugagccccgaggacagcgagaagaagagaaccaacuaccaggccuacagaagcuaccugaacagagagggccccaaggcccugggcagcaaggagauccccaagggcgccgagaacugccuggagggccugaucuucgugaucaccggcgugcuggagagcaucgagagagacgaggccaagagccugaucgagagauacggcggcaaggugaccggcaacgugagcaagaagaccaacuaccuggugaugggcagagacagcggccagagcaagagcgacaaggccgccgcccugggcaccaagaucaucgacgaggacggccugcugaaccugaucagaaccaugcccggcaagaagagcaaguacgagaucgccguggagaccgagaugaagaaggagagcaagcuggagagaaccccccagaagaacgugcagggcaagagaaagaucagccccagcaagaaggagagcgagagcaagaagagcagacccaccagcaagagagacagccuggccaagaccaucaagaaggagaccgacguguucuggaagagccuggacuucaaggagcagguggccgaggagaccagcggcgacagcaaggccagaaaccuggccgacgacagcagcgagaacaagguggagaaccugcuguggguggacaaguacaagcccaccagccugaagaccaucaucggccagcagggcgaccagagcugcgccaacaagcugcugagauggcugagaaacuggcagaagagcagcagcgaggacaagaagcacgccgccaaguucggcaaguucagcggcaaggacgacggcagcagcuucaaggccgcccugcugagcggcccccccggcgugggcaagaccaccaccgccagccuggugugccaggagcugggcuacagcuacguggagcugaacgccagcgacaccagaagcaagagcagccugaaggccaucguggccgagagccugaacaacaccagcaucaagggcuucuacagcaacggcgccgccagcagcgugagcaccaagcacgcccugaucauggacgagguggacggcauggccggcaacgaggacagaggcggcauccaggagcugaucggccugaucaagcacaccaagauccccaucaucugcaugugcaacgacagaaaccaccccaagaucagaagccuggugcacuacugcuucgaccugagauuccagagacccagaguggagcagaucaagggcgccaugaugagcaucgccuucaaggagggccugaagauccccccccccgccaugaacgagaucauccugggcgccaaccaggacaucagacaggugcugcacaaccugagcauguggugcgccagaagcaaggcccugaccuacgaccaggccaaggccgacagccacagagccaagaaggacaucaagaugggccccuucgacguggccagaaagguguucgccgccggcgaggagaccgcccacaugagccugguggacaagagcgaccuguucuuccacgacuacagcaucgccccccuguucgugcaggagaacuacauccacgugaagcccguggccgccggcggcgacaugaagaagcaccugaugcugcugagcagagccgccgacagcaucugcgacggcgaccugguggacagccagaucagaagcaagcagaacuggagccugcugcccgcccaggccaucuacgccagcgugcugcccggcgagcugaugagaggcuacaugacccaguuccccaccuuccccagcuggcugggcaagcacagcagcaccggcaagcacgacagaaucgugcaggaccuggcccugcacaugagccugagaaccuacagcagcaagagaaccgugaacauggacuaccugagccugcugagagacgcccuggugcagccccugaccagccagggcguggacggcgugcaggacgugguggcccugauggacaccuacuaccugaugaaggaggacuucgagaacaucauggagaucagcagcuggggcggcaagcccagccccuucagcaagcuggaccccaaggugaaggccgccuucaccagagccuacaacaaggaggcccaccugacccccuacagccugcaggccaucaaggccagcagacacagcaccagccccagccuggacagcgaguacaacgaggagcugaacgaggacgacagccagagcgacgagaaggaccaggacgccaucgagaccgacgccaugaucaagaagaagaccaagagcagcaagcccagcaagcccgagaaggacaaggagcccagaaagggcaagggcaagagcagcaagaaguaa

SEQ ID NO: 22569 - RNA, 963 nt, Artificial Sequence
  RFC2__Homo_sapiens__NP_002905
auggagguggaggccgugugcggcggcgccggcgagguggaggcccaggacagcgaccccgcccccgccuucagcaaggcccccggcagcgccggccacuacgagcugcccuggguggagaaguacagacccgugaagcugaacgagaucgugggcaacgaggacaccgugagcagacuggagguguucgccagagagggcaacgugcccaacaucaucaucgccggcccccccggcaccggcaagaccaccagcauccugugccuggccagagcccugcugggccccgcccugaaggacgccaugcuggagcugaacgccagcaacgacagcaugaccgacggcgcccagcaggcccugagaagaaccauggagaucuacagcaagaccaccagauucgcccuggccugcaacgccagcgacaagaucaucgagcccauccagagcagaugcgccgugcugagauacaccaagcugaccgacgcccagauccugaccagacugaugaacgugaucgagaaggagagagugcccuacaccgacgacggccuggaggccaucaucuucaccgcccagggcgacaugagacaggcccugaacaaccugcagagcaccuucagcggcuucggcuucaucaacagcgagaacguguucaaggugugcgacgagccccacccccugcuggugaaggagaugauccagcacugcgugaacgccaacaucgacgaggccuacaagauccuggcccaccuguggcaccugggcuacagccccgaggacaucaucggcaacaucuucagagugugcaagaccuuccagauggccgaguaccugaagcuggaguucaucaaggagaucggcuacacccacaugaagaucgccgagggcgugaacagccugcugcagauggccggccugcuggccagacugugccagaagaccauggcccccguggccagcuaa

SEQ ID NO: 22570 - RNA, 1071 nt, Artificial Sequence
  RFC3__Homo_sapiens__NP_002906
augagccuguggguggacaaguacagacccugcagccugggcagacuggacuaccacaaggagcaggccgcccagcugagaaaccuggugcagugcggcgacuucccccaccugcugguguacggccccagcggcgccggcaagaagaccagaaucaugugcauccugagagagcuguacggcgugggcguggagaagcugagaaucgagcaccagaccaucaccacccccagcaagaagaagaucgagaucagcaccaucgccagcaacuaccaccuggaggugaaccccagcgacgccggcaacagcgacagaguggugauccaggagaugcugaagaccguggcccagagccagcagcuggagaccaacagccagagagacuucaagguggugcugcugaccgagguggacaagcugaccaaggacgcccagcacgcccugagaagaaccauggagaaguacaugagcaccugcagacugauccugugcugcaacagcaccagcaaggugaucccccccaucagaagcagaugccuggccgugagagugcccgcccccagcaucgaggacaucugccacgugcugagcaccgugugcaagaaggagggccugaaccugcccagccagcuggcccacagacuggccgagaagagcugcagaaaccugagaaaggcccugcugaugugcgaggccugcagagugcagcaguaccccuucaccgccgaccaggagauccccgagaccgacugggagguguaccugagagagaccgccaacgccaucgugagccagcagaccccccagagacugcuggaggugagaggcagacuguacgagcugcugacccacugcaucccccccgagaucaucaugaagggccugcugagcgagcugcugcacaacugcgacggccagcugaagggcgagguggcccagauggccgccuacuacgagcacagacugcagcugggcagcaaggccaucuaccaccuggaggccuucguggccaaguucauggcccuguacaagaaguucauggaggacggccuggagggcaugauguucuaa

SEQ ID NO: 22571 - RNA, 1092 nt, Artificial Sequence
  RFC4__Homo_sapiens__NP_853551
augcaggccuuccugaagggcaccagcaucagcaccaagcccccccugaccaaggacagaggcguggccgccagcgccggcagcagcggcgagaacaagaaggccaagcccgugcccuggguggagaaguacagacccaagugcguggacgagguggccuuccaggaggaggugguggccgugcugaagaagagccuggagggcgccgaccugcccaaccugcuguucuacggcccccccggcaccggcaagaccagcaccauccuggccgccgccagagagcuguucggccccgagcuguucagacugagagugcuggagcugaacgccagcgacgagagaggcauccagguggugagagagaaggugaagaacuucgcccagcugaccgugagcggcagcagaagcgacggcaagcccugcccccccuucaagaucgugauccuggacgaggccgacagcaugaccagcgccgcccaggccgcccugagaagaaccauggagaaggagagcaagaccaccagauucugccugaucugcaacuacgugagcagaaucaucgagccccugaccagcagaugcagcaaguucagauucaagccccugagcgacaagauccagcagcagagacugcuggacaucgccaagaaggagaacgugaagaucagcgacgagggcaucgccuaccuggugaaggugagcgagggcgaccugagaaaggccaucaccuuccugcagagcgccaccagacugaccggcggcaaggagaucaccgagaaggugaucaccgacaucgccggcgugauccccgccgagaagaucgacggcguguucgccgccugccagagcggcagcuucgacaagcuggaggccguggugaaggaccugaucgacgagggccacgccgccacccagcuggugaaccagcugcacgacguggugguggagaacaaccugagcgacaagcagaagagcaucaucaccgagaagcuggccgagguggacaagugccuggccgacggcgccgacgagcaccugcagcugaucagccugugcgccaccgugaugcagcagcugagccagaacugcuaa

SEQ ID NO: 22572 - RNA, 768 nt, Artificial Sequence
  RFC5__Homo_sapiens__NP_001123584
auggugcuggagcugaacgccagcgacgacagaggcaucgacaucaucagaggccccauccugagcuucgccagcaccagaaccaucuucaagaagggcuucaagcuggugauccuggacgaggccgacgccaugacccaggacgcccagaacgcccugagaagagugaucgagaaguucaccgagaacaccagauucugccugaucugcaacuaccugagcaagaucauccccgcccugcagagcagaugcaccagauucagauucggcccccugacccccgagcugauggugcccagacuggagcacgugguggaggaggagaagguggacaucagcgaggacggcaugaaggcccuggugacccugagcagcggcgacaugagaagagcccugaacauccugcagagcaccaacauggccuucggcaaggugaccgaggagaccguguacaccugcaccggccacccccugaagagcgacaucgccaacauccuggacuggaugcugaaccaggacuucaccaccgccuacagaaacaucaccgagcugaagacccugaagggccuggcccugcacgacauccugaccgagauccaccuguucgugcacagaguggacuuccccagcagcgugagaauccaccugcugaccaagauggccgacaucgaguacagacugagcgugggcaccaacgagaagauccagcugagcagccugaucgccgccuuccaggugaccagagaccugaucguggccgaggccuaa

SEQ ID NO: 22573 - RNA, 1092 nt, Artificial Sequence
  RFFL__Homo_sapiens__NP_001017368
augugggccaccugcugcaacugguucugccuggacggccagcccgaggaggugccccccccccagggcgccagaaugcaggccuacagcaaccccggcuacagcagcuuccccagccccaccggccuggagcccagcugcaagagcugcggcgcccacuucgccaacaccgccagaaagcagaccugccuggacugcaagaagaacuucugcaugaccugcagcagccaggugggcaacggccccagacugugccugcugugccagagauucagagccaccgccuuccagagagaggagcugaugaagaugaaggugaaggaccugagagacuaccugagccugcacgacaucagcaccgagaugugcagagagaaggaggagcuggugcugcuggugcugggccagcagcccgugaucagccaggaggacagaaccagagccagcacccugagccccgacuuccccgagcagcaggccuuccugacccagccccacagcagcauggugccccccaccagccccaaccugcccagcagcagcgcccaggccaccagcgugccccccgcccaggugcaggagaaccagcaggccaacggccacgugagccaggaccaggaggagcccguguaccuggagagcguggccagagugcccgccgaggacgagacccagagcaucgacagcgaggacagcuucgugcccggcagaagagccagccugagcgaccugaccgaccuggaggacaucgagggccugaccgugagacagcugaaggagauccuggccagaaacuucgugaacuacaagggcugcugcgagaagugggagcugauggagagagugaccagacuguacaaggaccagaagggccugcagcaccuggugagcggcgccgaggaccagaacggcggcgccgugcccagcggccuggaggagaaccugugcaagaucugcauggacagccccaucgacugcgugcugcuggagugcggccacauggugaccugcaccaagugcggcaagagaaugaacgagugccccaucugcagacaguacgugaucagagccgugcacguguucagaagcuaa

SEQ ID NO: 22574 - RNA, 468 nt, Artificial Sequence
  RFK__Homo_sapiens__NP_060809
augagacaccugcccuacuucugcagaggccagguggugagaggcuucggcagaggcagcaagcagcugggcauccccaccgccaacuuccccgagcaggugguggacaaccugcccgccgacaucagcaccggcaucuacuacggcugggccagcgugggcagcggcgacgugcacaagaugguggugagcaucggcuggaaccccuacuacaagaacaccaagaagagcauggagacccacaucaugcacaccuucaaggaggacuucuacggcgagauccugaacguggccaucgugggcuaccugagacccgagaagaacuucgacagccuggagagccugaucagcgccauccagggcgacaucgaggaggccaagaagagacuggagcugcccgagcaccugaagaucaaggaggacaacuucuuccaggugagcaagagcaagaucaugaacggccacuaa

SEQ ID NO: 22575 - RNA, 954 nt, Artificial Sequence
  RFPL1__Homo_sapiens__NP_066306
augaagagacugagccuggugaccaccaacagacugagcccccacggcaacuuccugccccugugcaccuucccccuggccguggacauggccgcccuguuccaggaggccagcagcugccccgugugcagcgacuaccuggagaagcccaugagccuggagugcggcugcgccgugugcuucaagugcaucaacagccugcagaaggagccccacggcgaggaccugcugugcugcugcugcagcauggugagccagaagaacaagaucagacccagcuggcagcuggagagacuggccagccacaucaaggagcuggagcccaagcugaagaagauccugcagaugaaccccagaaugagaaaguuccagguggacaugacccuggacgccgacaccgccaacaacuuccugcugaucagcgacgaccugagaagcgugagaagcggcugcaucacccagaacagacaggaccuggccgagagauucgacgugagcaucugcauccugggcagccccagauucaccugcggcagacacuacugggagguggacgugggcaccagcaccgagugggaccugggcgugugcagagagagcgugcacagaaagggcagaauccaccugaccaccgagagaggcuucuggaccgugagccugagagacggcagcagacugagcgccagcaccgugccccugaccuuccuguucguggacagaaagcugcagagagugggcaucuuccuggacaugggcaugcagaacgugagcuucuucgacgccgagggcggcagccacguguacaccuucagaagcgugagcgccgaggagccccugcaccuguucuucgccccccccagcccccccaacggcgacaagagcgugcugagcaucugccccgugaucaaccccggcaccaccgacgcccccgugcaccccggcgaggccaaguaa

SEQ ID NO: 22576 - RNA, 1626 nt, Artificial Sequence
  RFT1__Homo_sapiens__NP_443091
augggcagccaggaggugcugggccacgccgccagacuggccagcagcggccugcugcugcaggugcuguucagacugaucaccuucgugcugaacgccuucauccugagauuccugagcaaggagaucgugggcguggugaacgugagacugacccugcuguacagcaccacccuguuccuggccagagaggccuucagaagagccugccugagcggcggcacccagagagacuggagccagacccugaaccugcuguggcugaccgugccccugggcguguucuggagccuguuccugggcuggaucuggcugcagcugcuggaggugcccgaccccaacguggugccccacuacgccaccggcguggugcuguucggccugagcgccgugguggagcugcugggcgagcccuucugggugcuggcccaggcccacauguucgugaagcugaaggugaucgccgagagccugagcgugauccugaagagcgugcugaccgccuuccuggugcuguggcugccccacuggggccuguacaucuucagccuggcccagcuguucuacaccaccgugcuggugcugugcuacgugaucuacuucaccaagcugcugggcagccccgagagcaccaagcugcagacccugcccgugagcagaaucaccgaccugcugcccaacaucaccagaaacggcgccuucaucaacuggaaggaggccaagcugaccuggagcuucuucaagcagagcuuccugaagcagauccugaccgagggcgagagauacgugaugaccuuccugaacgugcugaacuucggcgaccagggcguguacgacaucgugaacaaccugggcagccugguggccagacugaucuuccagcccaucgaggagagcuucuacaucuucuucgccaaggugcuggagagaggcaaggacgccacccugcagaagcaggaggacguggccguggccgccgccgugcuggagagccugcugaagcuggcccugcuggccggccugaccaucaccguguucggcuucgccuacagccagcuggcccuggacaucuacggcggcaccaugcugagcagcggcagcggccccgugcugcugagaagcuacugccuguacgugcugcugcuggccaucaacggcgugaccgagugcuucaccuucgccgccaugagcaaggaggagguggacagauacaacuucgugaugcuggcccugagcagcagcuuccuggugcugagcuaccugcugaccagauggugcggcagcgugggcuucauccuggccaacugcuucaacaugggcaucagaaucacccagagccugugcuucauccacagauacuacagaagaagcccccacagaccccuggccggccugcaccugagccccgugcugcugggcaccuucgcccugagcggcggcgugaccgccgugagcgagguguuccugugcugcgagcagggcuggcccgccagacuggcccacaucgccgugggcgccuucugccugggcgccacccugggcaccgccuuccugaccgagaccaagcugauccacuuccugagaacccagcugggcgugcccagaagaaccgacaagaugaccuaa

SEQ ID NO: 22577 - RNA, 1737 nt, Artificial Sequence
  RFTN1__Homo_sapiens__NP_055965
augggcugcggccugaacaagcuggagaagagagacgagaagagacccggcaacaucuacagcacccugaagagaccccagguggagaccaagaucgacgugagcuacgaguacagauuccuggaguucaccacccugagcgccgccgagcugcccggcagcagcgccgugagacuggccagccugagagaccugcccgcccagcugcuggagcuguaccagcagggcuucagccuggccgcccugcaccccuucgugcagcccacccacgagagagagaagaccccccuggagcacaucuucagagccauccugaucaagaagaccgacagaagccagaagaccgaccugcacaacgagggcuacauccuggagcuggacugcugcagcagccuggaccaccccaccgaccagaagcugauccccgaguucaucaagaagauccaggaggccgccagccagggccugaaguucgugggcgugaucccccaguaccacagcagcgugaacagcgccggcagcagcgcccccgugagcaccgccaacagcaccgaggacgccagagacgccaagaacgccagaggcgaccacgccagccuggagaacgagaagcccggcaccggcgacgugugcagcgcccccgccggcagaaaccagagccccgagcccagcagcggccccagaggcgaggugccccuggccaagcagcccagcagccccagcggcgagggcgacggcggcgagcugagcccccagggcgugagcaagacccuggacggccccgagagcaacccccuggaggugcacgaggagccccugagcggcaagauggagaucuucacccuguucaacaagcccaagagccaccagaagugcagacaguacuaccccgugaccaucccccugcacgugagcaagaacggccagaccgugagcggccuggacgccaacuggcuggagcacaugagcgaccacuucagaaagggcggcaugcuggugaacgccguguucuaccugggcaucgugaacgacagccugcacggccugaccgacggcguguucaucuucgaggccgugagcaccgaggacagcaagaccauccagggcuacgacgccaucgugguggagcaguggaccgugcuggagggcguggaggugcagaccgacuacgugccccugcugaacagccuggccgccuacggcuggcagcugaccugcgugcugcccacccccguggugaagaccaccagcgagggcagcgugagcaccaagcagaucguguuccugcagagacccugccugccccagaagaucaagaagaaggagagcaaguuccaguggagauucagcagagaggagaugcacaacagacagaugagaaagagcaagggcaagcugagcgccagagacaagcagcaggccgaggagaacgagaagaaccuggaggaccagagcagcaaggccggcgacaugggcaacugcgugagcggccagcagcaggagggcggcgugagcgaggagaugaagggccccgugcaggaggacaagggcgagcagcugagccccggcggccugcugugcggcgugggcguggagggcgaggccgugcagaacggccccgccagccacagcagagcccuggugggcaucugcaccggccacagcaaccccggcgaggacgccagagacggcgacgccgaggaggugagagagcugggcaccguggaggagaacuaa

SEQ ID NO: 22578 - RNA, 1506 nt, Artificial Sequence
  RFTN2__Homo_sapiens__NP_653230
augggcugcggccugagaaagcuggaggaccccgacgacagcagccccggcaagaucuucagcacccugaagagaccccagguggagaccaagaccgaguucgccuacgaguacgugcugcuggacuucacccugcaggccagcagcaaccccgaggugaucaagaucaacagcauccuggacaucgugaccaagguggagaacuacuaccugaagggcuacaucgugggcgccauccaccccgugauccagcccgugggccagagaaagcaccugcccgccagcuaccuguacagaguggugcugcugagacugaagcugagccccaagaacagcgccgcccccagcggccagagaagacccagacuggugaucgaggagugcccccugaccagcgaggcccagaccaacgacgccgccaaggagcugaucgagaagaucaacguggccgccaagagaggcaugaaguucgugggcuucaucagccagcacuacagccccagcaaguucugcaacggcaccaaccacgacggcgacaucgagagcaugcugcacgugagacacggcagcgacgagaacugcagaagcuggaacgagggcacccugagcggccagagcagcgagagcggcaucgaggaggagcugcaccacgagagcggccaguaccagauggagcagaacggcagccccaccagcagcaagagcagaaagggcgaggccagcgacaacaagcuguacaccguguucaacgccuucgacgacgacagcaccagcugggccuaccaggagggcauccugagcaugaaggugaccagaaagggcagcgugaucagcacccuggacgccgacuggcuggagcugaccaccuucuacuacaagcagggccugagccugaucgacagcuucguguucugggagaccagcaagggcgagcaccugcccaagagccuggagggcuucuucaucuacgaggaggagggcagcggcgugcccggcagcagcagaaagggcaacgacgccaucgugguggagcaguggaccgugaucgagggcugcgagaucaagaccgacuacggcccccugcugcacacccuggccgaguucggcuggcugcugaccagcgugcugcccacccccgugcugagacacgacagcgagggcaaccuggccaccaagcagaucguguuccugcagagacccgugauguggaacagcgccgcccagacccccgacaagaaggccagcagacacaucaagggcgaggacaagaacaaggccaccagcagaagcaucggccuggacaccaccagcagccagcccgccgagagcagacaccugcccgaggagugcagacugagccccagcagagagugcuggaccaaggagggcagacuggcccagcacaacagcuucagcggcuucagcagcagcgacaacgugcugagagagcuggacgacggccaguucgaccaggaggacggcgugacccaggugaccugcauguaa

SEQ ID NO: 22579 - RNA, 2124 nt, Artificial Sequence
  RFWD2__Homo_sapiens__NP_001001740
augagcggcagcagacaggccggcagcggcagcgccggcaccagccccggcagcagcgccgccagcagcgugaccagcgccagcagcagccugagcagcagccccagcccccccagcguggccgugagcgccgccgcccuggugagcggcggcguggcccaggccgccggcagcggcggccugggcggccccgugagacccgugcugguggcccccgccgugagcggcagcggcggcggcgccgugagcaccggccugagcagacacagcugcgccgccagacccagcgccggcgugggcggcagcagcagcagccugggcagcggcagcagaaagagaccccugcuggccccccugugcaacggccugaucaacagcuacgaggacaagagcaacgacuucgugugccccaucugcuucgacaugaucgaggaggccuacaugaccaagugcggccacagcuucugcuacaagugcauccaccagagccuggaggacaacaacagaugccccaagugcaacuacgugguggacaacaucgaccaccuguaccccaacuuccuggugaacgagcugauccugaagcagaagcagagauucgaggagaagagauucaagcuggaccacagcaacggccacagauggcagaucuuccaggacuggcugggcaccgaccaggacaaccuggaccuggccaacgugaaccugaugcuggagcugcuggugcagaagaagaagcagcuggaggccgagagccacgccgcccagcugcagauccugauggaguuccugaagguggccagaagaaacaagagagaggagaugagcggccuguacagccccgugagcgaggacagcaccgugccccaguucgaggcccccagccccagccacagcagcaucaucgacagcaccgaguacagccagccccccggcuucagcggcagcagccagaccaagaagcagcccugguacaacagcacccuggccagcagaagaaagagacugaccgcccacuucgaggaccuggagcagugcuacuucagcaccagaaugagcagaaucagcgacgacagcagaaccgccagccagcuggacgaguuccaggagugccugagcaaguucaccagauacaacagcgugagaccccuggccacccugagcuacgccagcgaccuguacaacggcagcagcaucgugagcagcaucgaguucgacagagacugcgacuacuucgccaucgccggcgugaccaagaagaucaagguguacgaguacgacaccgugauccaggacgccguggacauccacuaccccgagaacgagaugaccugcaacagcaagaucagcugcaucagcuggagcagcuaccacaagaaccugcuggccagcagcgacuacgagggcaccgugauccugugggacggcuucaccggccagagaagcaagguguaccaggagcacgagaagagaugcuggagcguggacuucaaccugauggaccccaagcugcuggccagcggcagcgacgacgccaaggugaagcuguggagcaccaaccuggacaacagcguggccagcaucgaggccaaggccaacgugugcugcgugaaguucagccccagcagcagauaccaccuggccuucggcugcgccgaccacugcgugcacuacuacgaccugagaaacaccaagcagcccaucaugguguucaagggccacagaaaggccgugagcuacgccaaguucgugagcggcgaggagaucgugagcgccagcaccgacagccagcugaagcuguggaacgugggcaagcccuacugccugagaagcuucaagggccacaucaacgagaagaacuucgugggccuggccagcaacggcgacuacaucgccugcggcagcgagaacaacagccuguaccuguacuacaagggccugagcaagacccugcugaccuucaaguucgacaccgugaagagcgugcuggacaaggacagaaaggaggacgacaccaacgaguucgugagcgccgugugcuggagagcccugcccgacggcgagagcaacgugcugaucgccgccaacagccagggcaccaucaaggugcuggagcugguguaa

SEQ ID NO: 22580 - RNA, 2325 nt, Artificial Sequence
  RFWD3__Homo_sapiens__NP_060594
auggcccacgaggccauggaguacgacgugcaggugcagcugaaccacgccgagcagcagcccgcccccgccggcauggccagcagccagggcggccccgcccugcugcagcccgugcccgccgacguggugagcagccagggcgugcccagcauccugcagcccgcccccgccgaggugaucagcagccaggccacccccccccugcugcagcccgccccccagcugagcguggaccugaccgagguggaggugcugggcgaggacaccguggagaacaucaaccccagaaccagcgagcagcacagacagggcagcgacggcaaccacaccauccccgccagcagccugcacagcaugaccaacuucaucagcggccugcagagacugcacggcaugcuggaguuccugagacccagcagcagcaaccacagcgugggccccaugagaaccagaagaagagugagcgccagcagaagagccagagccggcggcagccagagaaccgacagcgccagacugagagccccccuggacgccuacuuccaggugagcagaacccagcccgaccugcccgccaccaccuacgacagcgagaccagaaaccccgugagcgaggagcugcaggugagcagcagcagcgacagcgacagcgacagcagcgccgaguacggcggcgugguggaccaggccgaggagagcggcgccgugauccuggaggagcagcuggccggcgugagcgccgagcaggaggugaccugcaucgacggcggcaagacccugcccaagcagcccagcccccagaagagcgagccccugcugcccagcgccagcauggacgaggaggagggcgacaccugcaccaucugccuggagcaguggaccaacgccggcgaccacagacugagcgcccugagaugcggccaccuguucggcuacagaugcaucagcaccuggcugaagggccaggugagaaagugcccccagugcaacaagaaggccagacacagcgacaucguggugcuguacgccagaacccugagagcccuggacaccagcgagcaggagagaaugaagagcagccugcugaaggagcagaugcugagaaagcaggccgagcuggagagcgcccagugcagacugcagcugcaggugcugaccgacaagugcaccagacugcagagaagagugcaggaccugcagaagcugaccagccaccagagccagaaccugcagcagcccagaggcagccaggccugggugcugagcugcagccccagcagccagggccagcacaagcacaaguaccacuuccagaagaccuucaccgugagccaggccggcaacugcagaaucauggccuacugcgacgcccugagcugccuggugaucagccagcccagcccccaggccagcuuccugcccggcuucggcgugaagaugcugagcaccgccaacaugaagagcagccaguacauccccaugcacggcaagcagaucagaggccuggccuucagcagcuaccugagaggccugcugcugagcgccagccuggacaacaccaucaagcugaccagccuggagaccaacaccguggugcagaccuacaacgccggcagacccguguggagcugcugcuggugccuggacgaggccaacuacaucuacgccggccuggccaacggcagcauccugguguacgacgugagaaacaccagcagccacgugcaggagcugguggcccagaaggccagaugcccccuggugagccugagcuacaugcccagagccgccagcgccgccuuccccuacggcggcgugcuggccggcacccuggaggacgccagcuucugggagcagaagauggacuucagccacuggccccacgugcugccccuggagcccggcggcugcaucgacuuccagaccgagaacagcagcagacacugccuggugaccuacagacccgacaagaaccacaccaccaucagaagcgugcugauggagaugagcuacagacuggacgacaccggcaaccccaucugcagcugccagcccgugcacaccuucuucggcggccccaccugcaagcugcugaccaagaacgccaucuuccagagccccgagaacgacggcaacauccuggugugcaccggcgacgaggccgccaacagcgcccugcugugggacgccgccagcggcagccugcugcaggaccugcagaccgaccagcccgugcuggacaucugccccuucgaggugaacagaaacagcuaccuggccacccugaccgagaagauggugcacaucuacaagugggaguaa

SEQ ID NO: 22581 - RNA, 2940 nt, Artificial Sequence
  RFX1__Homo_sapiens__NP_002909
auggccacccaggccuacaccgagcugcaggccgcccccccccccagccagcccccccaggcccccccccaggcccagccccagcccccccccccccccccccccgccgccccccagcccccccagccccccaccgccgccgccaccccccagccccaguacgugaccgagcugcagagcccccagccccaggcccagccccccggcggccagaagcaguacgugaccgagcugcccgccgugcccgcccccagccagcccaccggcgcccccacccccagccccgccccccagcaguacaucguggugaccgugagcgagggcgccaugagagccagcgagaccgugagcgaggccagccccggcagcaccgccagccagaccggcgugcccacccagguggugcagcaggugcagggcacccagcagagacugcuggugcagaccagcgugcaggccaagcccggccacgugagcccccugcagcugaccaacauccaggugccccagcaggcccugcccacccagagacugguggugcagagcgccgcccccggcagcaagggcggccaggugagccugaccgugcacggcacccagcaggugcacagcccccccgagcagagccccgugcaggccaacagcagcagcagcaagaccgccggcgcccccaccggcaccgugccccagcagcugcaggugcacggcgugcagcagagcgugcccgugacccaggagagaagcguggugcaggccaccccccaggcccccaagcccggccccgugcagccccugaccgugcagggccugcagcccgugcacguggcccaggaggugcagcagcugcagcaggugcccgugccccacguguacagcagccaggugcaguacguggagggcggcgacgccagcuacaccgccagcgccaucagaagcagcaccuacagcuaccccgagaccccccuguacacccagaccgccagcaccagcuacuacgaggccgccggcaccgccacccaggugagcacccccgccaccagccaggccguggccagcagcggcagcaugcccauguacgugagcggcagccaggugguggccagcagcaccagcaccggcgccggcgccagcaacagcagcggcggcggcggcagcggcggcggcggcggcggcggcggcggcggcggcggcggcggcagcggcagcaccggcggcggcggcagcggcgccggcaccuacgugauccagggcggcuacaugcugggcagcgccagccagagcuacagccacaccaccagagccagccccgccaccgugcaguggcugcuggacaacuacgagaccgccgagggcgugagccugcccagaagcacccuguacugccacuaccugcugcacugccaggagcagaagcuggagcccgugaacgccgccagcuucggcaagcugaucagaagcguguucaugggccugagaaccagaagacugggcaccagaggcaacagcaaguaccacuacuacggccugagaaucaaggccagcagcccccugcugagacugauggaggaccagcagcacauggccaugagaggccagcccuucagccagaagcagagacugaagcccauccagaagauggagggcaugaccaacggcguggccgugggccagcagcccagcaccggccugagcgacaucagcgcccaggugcagcaguaccagcaguuccuggacgccagcagaagccugcccgacuucaccgagcuggaccugcagggcaaggugcugcccgagggcgugggccccggcgacaucaaggccuuccaggugcuguacagagagcacugcgaggccaucguggacgugauggugaaccugcaguucacccugguggagacccuguggaagaccuucuggagauacaaccugagccagcccagcgaggcccccccccuggccgugcacgacgaggccgagaagagacugcccaaggccauccuggugcugcugagcaaguucgagcccgugcugcaguggaccaagcacugcgacaacgugcuguaccagggccugguggagauccugauccccgacgugcugagacccauccccagcgcccugacccaggccaucagaaacuucgccaagagccuggagagcuggcugacccacgccauggugaacauccccgaggagaugcugagagugaagguggccgccgccggcgccuucgcccagacccugagaagauacaccagccugaaccaccuggcccaggccgccagagccgugcugcagaacaccgcccagaucaaccagaugcugagcgaccugaacagaguggacuucgccaacgugcaggagcaggccagcugggugugcagaugcgaggacagaguggugcagagacuggagcaggacuucaaggugacccugcagcagcagaacagccuggagcagugggccgccuggcuggacggcguggugagccaggugcugaagcccuaccagggcagcgccggcuuccccaaggccgccaagcuguuccugcugaaguggagcuucuacagcagcauggugaucagagaccugacccugagaagcgccgccagcuucggcagcuuccaccugaucagacugcuguacgacgaguacauguacuaccugaucgagcacagaguggcccaggccaagggcgagacccccaucgccgugaugggcgaguucgccaaccuggccaccagccugaacccccuggaccccgacaaggacgaggaggaggaggaggaggaggagagcgaggacgagcugccccaggacaucagccuggccgccggcggcgagagccccgcccugggccccgagacccuggagccccccgccaagcuggccagaaccgacgccagaggccuguucgugcaggcccugcccagcagcuaa

SEQ ID NO: 22582 - RNA, 2172 nt, Artificial Sequence
  RFX2__Homo_sapiens__NP_000626
augcagaacagcgagggcggcgccgacagccccgccagcguggcccugagacccagcgccgccgccccccccgugcccgccagcccccagagagugcuggugcaggccgccagcagcaaccccaagggcgcccagaugcagcccaucagccugcccagagugcagcaggugccccagcaggugcagcccgugcagcacguguaccccgcccaggugcaguacguggagggcggcgacgccguguacaccaacggcgccaucagaaccgccuacaccuacaaccccgagccccagauguacgcccccagcagcaccgccagcuacuucgaggcccccggcggcgcccaggugaccguggccgccagcagcccccccgccgugcccagccacagcauggugggcaucaccauggacgugggcggcagccccaucgugagcagcgccggcgccuaccugauccacggcggcauggacagcaccagacacagccuggcccacaccagcagaagcagccccgccacccuggagauggccaucgagaaccugcagaagagcgagggcaucaccagccacaagagcggccugcugaacagccaccugcaguggcugcuggacaacuacgagaccgccgagggcgugagccugcccagaagcagccuguacaaccacuaccugagacacugccaggagcacaagcuggaccccgugaacgccgccagcuucggcaagcugaucagaagcguguucaugggccugagaaccagaagacugggcaccagaggcaacagcaaguaccacuacuacggcaucagacugaagcccgacagcccccugaacagacugcaggaggacacccaguacauggccaugagacagcagcccaugcaccagaagcccagauacagacccgcccagaagaccgacagccugggcgacagcggcagccacagcggccugcacagcacccccgagcagaccauggccgugcagagccagcaccaccagcaguacaucgacgugagccacguguuccccgaguuccccgcccccgaccugggcagcuuccugcugcaggacggcgugacccugcacgacgugaaggcccugcagcugguguacagaagacacugcgaggccaccguggacguggugaugaaccugcaguuccacuacaucgagaagcuguggcugagcuucuggaacagcaaggccagcagcagcgacggccccaccagccugcccgccagcgacgaggaccccgagggcgccgugcugcccaaggacaagcugaucagccugugccagugcgaccccauccugagauggaugagaagcugcgaccacauccuguaccaggcccugguggagauccugauccccgacgugcugagacccgugcccagcacccugacccaggccaucagaaacuucgccaagagccuggagggcuggcugaccaacgccaugagcgacuucccccagcaggugauccagaccaaggugggcguggugagcgccuucgcccagacccugagaagauacaccagccugaaccaccuggcccaggccgccagagccgugcugcagaacaccagccagaucaaccagaugcugagcgaccugaacagaguggacuucgccaacgugcaggagcaggccagcugggugugccagugcgaggagagcguggugcagagacuggagcaggacuucaagcugacccugcagcagcagagcagccuggaccagugggccagcuggcuggacagcguggugacccaggugcugaagcagcacgccggcagccccagcuuccccaaggccgccagacaguuccugcugaaguggagcuucuacagcagcauggugaucagagaccugacccugagaagcgccgccagcuucggcagcuuccaccugaucagacugcuguacgacgaguacauguucuaccugguggagcacagaguggccgaggccaccggcgagacccccaucgccgugaugggcgaguucaacgaccuggccagccugagccugacccugcuggacaaggacgacaugggcgacgagcagagaggcagcgaggccggccccgacgccagaagccugggcgagccccuggugaagagagagagaagcgaccccaaccacagccugcagggcaucuaa

SEQ ID NO: 22583 - RNA, 1242 nt, Artificial Sequence
  RFX3__Homo_sapiens__NP_001269046
augcagaccagcgagaccggcagcgacaccggcagcaccgugacccugcagaccagcguggccagccaggccgccgugcccacccagguggugcagcaggugcccgugcagcagcaggugcagcaggugcagaccgugcagcaggugcagcacguguaccccgcccaggugcaguacguggagggcagcgacaccguguacaccaacggcgccaucagaaccaccaccuaccccuacaccgagacccagauguacagccagaacaccggcggcaacuacuucgacacccagggcagcagcgcccaggugaccaccguggugagcagccacagcauggugggcaccggcggcauccagaugggcgugaccggcggccagcugaucagcagcagcggcggcaccuaccugaucggcaacagcauggagaacagcggccacagcgugacccacaccaccagagccagccccgccaccaucgagauggccaucgagacccugcagaagagcgacggccugagcacccacagaagcagccugcugaacagccaccugcaguggcugcuggacaacuacgagaccgccgagggcgugagccugcccagaagcacccuguacaaccacuaccugagacacugccaggagcacaagcuggaccccgugaacgccgccagcuucggcaagcugaucagaagcaucuucaugggccugagaaccagaagacugggcaccagaggcaacagcaaguaccacuacuacggcaucagagugaagcccgacagcccccugaacagacugcaggaggacaugcaguacauggccaugagacagcagcccaugcagcagaagcagagauacaagcccaugcagaagguggacggcguggccgacggcuucaccggcagcggccagcagaccggcaccagcguggagcagaccgugaucgcccagagccagcaccaccagcaguuccuggacgccagcagagcccugcccgaguucggcgagguggagaucagcagccugcccgacggcaccaccuucgaggacaucaagagccugcagagccuguacagagagcacugcgaggccauccuggacgugguggugaaccugcaguucagccugaucgagaagcuguggcagaccuucuggagauacagccccagcacccccaccgacggcaccaccaucaccgagagcagaagcgagagcaccagcuuccccauccacuuccacggcuaa

SEQ ID NO: 22584 - RNA, 2235 nt, Artificial Sequence
  RFX4__Homo_sapiens__NP_001193620
augaucaagagaagagcccaccccggcgccggcggcgacagaaccagacccagaagaagaagaagcaccgagagcuggaucgagagaugccugaacgagagcgagaacaagagauacagcagccacaccagccugggcaacgugagcaacgacgagaacgaggagaaggagaacaacagagccagcaagccccacagcacccccgccacccugcaguggcuggaggagaacuacgagaucgccgagggcgugugcauccccagaagcgcccuguacaugcacuaccuggacuucugcgagaagaacgacacccagcccgugaacgccgccagcuucggcaagaucaucagacagcaguucccccagcugaccaccagaagacugggcaccagaggccagagcaaguaccacuacuacggcaucgccgugaaggagagcagccaguacuacgacgugauguacagcaagaagggcgccgccugggugagcgagaccggcaagaaggaggugagcaagcagaccguggccuacagccccagaagcaagcugggcacccugcugcccgaguuccccaacgugaaggaccugaaccugcccgccagccugcccgaggagaaggugagcaccuucaucaugauguacagaacccacugccagagaauccuggacaccgugaucagagccaacuucgacgaggugcagagcuuccugcugcacuucuggcagggcaugcccccccacaugcugcccgugcugggcagcagcaccguggugaacaucgugggcgugugcgacagcauccuguacaaggccaucagcggcgugcugaugcccaccgugcugcaggcccugcccgacagccugacccaggugaucagaaaguucgccaagcagcuggacgaguggcugaagguggcccugcacgaccugcccgagaaccugagaaacaucaaguucgagcugagcagaagauucagccagauccugagaagacagaccagccugaaccaccugugccaggccagcagaaccgugauccacagcgccgacaucaccuuccagaugcuggaggacuggagaaacguggaccugaacagcaucaccaagcagacccuguacaccauggaggacagcagagacgagcacagaaagcugaucacccagcuguaccaggaguucgaccaccugcuggaggagcagagccccaucgagagcuacaucgaguggcuggacaccaugguggacagaugcguggugaagguggccgccaagagacagggcagccugaagaagguggcccagcaguuccugcugauguggagcugcuucggcaccagagugaucagagacaugacccugcacagcgcccccagcuucggcagcuuccaccugauccaccugauguucgacgacuacgugcuguaccugcuggagagccugcacugccaggagagagccaacgagcugaugagagccaugaagggcgagggcagcaccgccgaggugagagaggagaucauccugaccgaggccgccgcccccacccccagccccgugcccagcuucagccccgccaagagcgccaccagcguggaggugcccccccccagcagccccgugagcaaccccagccccgaguacaccggccugagcaccaccggcgccaugcagagcuacaccuggagccugaccuacaccgugaccaccgccgccggcagccccgccgagaacagccagcagcugcccugcaugagaaacacccacgugcccagcagcagcgugacccacagaauccccguguacccccacagagaggagcacggcuacaccggcagcuacaacuacggcagcuacggcaaccagcacccccaccccaugcagagccaguaccccgcccugccccacgacaccgccaucagcggcccccugcacuacgcccccuaccacagaagcagcgcccaguaccccuucaacagccccaccagcagaauggagcccugccugaugagcagcacccccagacugcaccccacccccgugacccccagauggcccgaggugcccagcgccaacaccugcuacaccagccccagcgugcacagcgccagauacggcaacagcagcgacauguacaccccccugaccaccagaagaaacagcgaguacgagcacaugcagcacuuccccggcuucgccuacaucaacggcgaggccagcaccggcugggccaaguaa

SEQ ID NO: 22585 - RNA, 1851 nt, Artificial Sequence
  RFX5__Homo_sapiens__NP_001020774
auggccgaggacgagcccgacgccaagagccccaagaccggcggcagagccccccccggcggcgccgaggccggcgagcccaccacccugcugcagagacugagaggcaccaucagcaaggccgugcagaacaagguggagggcauccugcaggacgugcagaaguucagcgacaacgacaagcuguaccuguaccugcagcugcccagcggccccaccaccggcgacaagagcagcgagcccagcacccugagcaacgaggaguacauguacgccuacagauggaucagaaaccaccuggaggagcacaccgacaccugccugcccaagcagagcguguacgacgccuacagaaaguacugcgagagccuggccugcugcagaccccugagcaccgccaacuucggcaagaucaucagagagaucuuccccgacaucaaggccagaagacugggcggcagaggccagagcaaguacugcuacagcggcaucagaagaaagacccuggugagcaugcccccccugcccggccuggaccugaagggcagcgagagccccgagaugggccccgaggugacccccgcccccagagacgagcugguggaggccgccugcgcccugaccugcgacugggccgagagaauccugaagagaagcuucagcagcaucguggagguggccagauuccugcugcagcagcaccugaucagcgccagaagcgcccacgcccacgugcugaaggccaugggccuggccgaggaggacgagcacgcccccagagagagaagcagcaagcccaagaacggccuggagaaccccgagggcggcgcccacaagaagcccgagagacuggcccagccccccaaggaccuggaggccagaaccggcgccggcccccuggccagaggcgagagaaagaagagcgugguggagagcagcgcccccggcgccaacaaccugcaggugaacgcccugguggccagacugccccugcugcugcccagagcccccagaagccugaucccccccauccccgugagcccccccauccuggcccccagacugagcagcggcgcccugaagguggccacccugccccugagcagcagagccggcgccccccccgccgccgugcccaucaucaacaugauccugcccaccgugcccgcccugcccggccccggccccggccccggcagagccccccccggcggccugacccagcccagaggcaccgagaacagagaggugggcaucggcggcgaccagggcccccacgacaagggcgugaagagaaccgccgaggugcccgugagcgaggccagcggccaggccccccccgccaaggccgccaagcaggacaucgaggacaccgccagcgacgccaagagaaagagaggcagacccagaaagaagagcggcggcagcggcgagagaaacagcaccccccugaagagcgccgccgccauggagagcgcccagagcagcagacugcccugggagaccuggggcagcggcggcgagggcaacagcgccggcggcgccgagagacccggccccaugggcgaggccgagaagggcgccgugcuggcccagggccagggcgacggcaccgugagcaagggcggcagaggccccggcagccagcacaccaaggaggccgaggacaagaucccccuggugcccagcaaggugagcgugaucaagggcagcagaagccagaaggaggccuucccccuggccaagggcgagguggacaccgccccccagggcaacaaggaccugaaggagcacgugcugcagagcagccugagccaggagcacaaggaccccaaggccaccccccccuaa

SEQ ID NO: 22586 - RNA, 2787 nt, Artificial Sequence
  RFX6__Homo_sapiens__NP_775831
auggccaaggugcccgagcuggaggacaccuuccugcaggcccagcccgccccccagcugagccccggcauccaggaggacugcugcgugcagcugcugggcaagggccugcugguguaccccgaggagaccguguaccuggccgccgagggccagcccggcggcgagcagggcggcggcgagaagggcgaggaccccgagcugcccggcgccgugaagagcgagaugcaccugaacaacggcaacuucagcagcgaggaggaggacgccgacaaccacgacagcaagaccaaggccgccgaccaguaccugagccagaagaagaccaucacccagaucgugaaggacaagaagaagcagacccagcugacccugcaguggcuggaggagaacuacaucgugugcgagggcgugugccugcccagaugcauccuguacgcccacuaccuggacuucugcagaaaggagaagcuggagcccgccugcgccgccaccuucggcaagaccaucagacagaaguucccccugcugaccaccagaagacugggcaccagaggccacagcaaguaccacuacuacggcaucggcaucaaggagagcagcgccuacuaccacagcguguacagcggcaagggccugaccagauucagcggcagcaagcugaagaacgagggcggcuucaccagaaaguacagccugagcagcaagaccggcacccugcugcccgaguuccccagcgcccagcaccugguguaccagggcugcaucagcaaggacaagguggacacccugaucaugauguacaagacccacugccagugcauccuggacaacgccaucaacggcaacuucgaggagauccagcacuuccugcugcacuucuggcagggcaugcccgaccaccugcugccccugcuggagaaccccgugaucaucgacaucuucugcgugugcgacagcauccuguacaaggugcugaccgacgugcugauccccgccaccaugcaggagaugcccgagagccugcuggccgacaucagaaacuucgccaagaacugggagcaguggguggugagcagccuggagaaccugcccgaggcccugaccgacaagaagauccccaucgugagaagauucgugagcagccugaagagacagaccagcuuccugcaccuggcccagaucgccagacccgcccuguucgaccagcacguggugaacagcauggugagcgacaucgagagaguggaccugaacagcaucggcagccaggcccugcugaccaucagcggcagcaccgacaccgagagcggcaucuacaccgagcacgacagcaucaccguguuccaggagcugaaggaccugcugaagaagaacgccaccguggaggccuucaucgaguggcuggacaccgugguggagcagagagugaucaagaccagcaagcagaacggcagaagccugaagaagagagcccaggacuuccugcugaaguggagcuucuucggcgccagagugaugcacaaccugacccugaacaacgccagcagcuucggcagcuuccaccugaucagaaugcugcuggacgaguacauccugcuggccauggagacccaguucaacaacgacaaggagcaggagcugcagaaccugcuggacaaguacaugaagaacagcgacgccagcaaggccgccuucaccgccagccccagcagcugcuuccuggccaacagaaacaagggcagcauggugagcagcgacgccgugaagaacgagagccacguggagaccaccuaccugccccugcccagcagccagcccggcggccugggccccgcccugcaccaguuccccgccggcaacaccgacaacaugccccugaccggccagauggagcugagccagaucgccggccaccugaugaccccccccaucagccccgccauggccagcagaggcagcgugaucaaccagggccccauggccggcagaccccccagcgugggccccgugcugagcgcccccagccacugcagcaccuaccccgagcccaucuaccccacccugccccaggccaaccacgacuucuacagcaccagcagcaacuaccagaccguguucagagcccagccccacagcaccagcggccuguacccccaccacaccgagcacggcagaugcauggccuggaccgagcagcagcugagcagagacuucuucagcggcagcugcgccggcagccccuacaacagcagaccccccagcagcuacggccccagccugcaggcccaggacagccacaacaugcaguuccugaacaccggcagcuucaacuuccugagcaacaccggcgccgccagcugccagggcgccacccugccccccaacagccccaacggcuacuacggcagcaacaucaacuaccccgagagccacagacugggcagcauggugaaccagcacgugagcgugaucagcagcaucagaagccugccccccuacagcgacauccacgacccccugaacauccuggacgacagcggcagaaagcagaccagcagcuucuacaccgacaccagcagccccguggccugcagaacccccgugcuggccagcagccugcagacccccauccccagcagcagcagccagugcauguacggcaccagcaaccaguaccccgcccaggagacccuggacagccacggcaccagcagcagagagauggugagcagccugccccccaucaacaccguguucaugggcaccgccgccggcggcaccuaa

SEQ ID NO: 22587 - RNA, 1422 nt, Artificial Sequence
  RFX8__Homo_sapiens__NP_001139136
auguacgagaucuacguggagaccugcggccagaacaccgagaaccaggugaaccccgccaccuucggcaagugcgaggaccacagccccaugaagaccgaccccgugggcagcccccugagcgaguucagaagaugccccuuccuggagcaggagcuggccaagaaguacagcugcaacaugauggccuuccuggccgacgaguacugcaacuacugcagagacauccugagaaacguggaggaccugcugaccagcuucuggaagagccugcagcaggacaccgugaugcugaugagccugcccgacgugugccagcuguucaagugcuacgacgugcagcuguacaagggcaucgaggacgugcugcugcacgacuuccuggaggacgugagcauccaguaccugaagagcgugcagcuguucagcaagaaguucaagcuguggcugcugaacgcccuggagggcgugcccgcccugcugcagaucagcaagcugaaggaggugacccuguucgugaagagacugagaagaaagaccuaccugagcaacauggccaagaccaugagaauggugcugaagagcaagagaagagugagcgugcugaagagcgaccugcaggccaucaucaaccagggcacccuggccaccagcaagaaggcccuggccagcgacagaagcggcgccgacgagcuggagaacaaccccgagaugaagugccugagaaaccugaucagccugcugggcaccagcaccgaccugagaguguuccugagcugccugagcagccaccugcaggccuucguguuccagaccagcagaagcaaggaggaguucaccaagcuggccgccagcuuccagcugagauggaaccugcugcugaccgccgugagcaaggccaugacccugugccacagagacagcuucggcagcuggcaccuguuccaccugcugcugcuggaguacaugauccacauccugcagagcugccuggaggaggaggaggaggaggaggacaugggcaccgugaaggagaugcugcccgacgaccccacccugggccagcccgaccaggcccuguuccacagccugaacagcagccugagccaggccugcgccagccccagcauggagccccugggcgugaugcccacccacaugggccagggcagauaccccgugggcgugagcaacauggugcugagaauccugggcuuccugguggacaccgccaugggcaacaagcugauccaggugcugcuggaggacgagaccaccgagagcgccgugaagcugagccugcccaugggccaggaggcccugaucacccugaaggacggccagcaguucgugauccagaucagcgacgugccccagagcagcgaggacaucuacuucagagagaacaacgccaacguguaa

SEQ ID NO: 22588 - RNA, 717 nt, Artificial Sequence
  RFXANK__Homo_sapiens__NP_001265656
auggagcugacccagcccgccgaggaccugauccagacccagcagacccccgccagcgagcugggcgaccccgaggaccccggcgaggaggccgccgacggcagcgacaccguggugcugagccuguuccccugcacccccgagcccgugaaccccgagcccgacgccagcgugagcagcccccaggccggcagcagccugaagcacagcaccacccugaccaacagacagagaggcaacgaggugagcgcccugcccgccacccuggacugcgacaaccuggugaacaagcccgacgagagaggcuucaccccccugaucugggccagcgccuucggcgagaucgagaccgugagauuccugcuggaguggggcgccgacccccacauccuggccaaggagagagagagcgcccugagccuggccagcaccggcggcuacaccgacaucgugggccugcugcuggagagagacguggacaucaacaucuacgacuggaacggcggcaccccccugcuguacgccgugagaggcaaccacgugaagugcguggaggcccugcuggccagaggcgccgaccugaccaccgaggccgacagcggcuacacccccauggaccuggccguggcccugggcuacagaaaggugcagcaggugaucgagaaccacauccugaagcuguuccagagcaaccuggugcccgccgaccccgaguaa

SEQ ID NO: 22589 - RNA, 819 nt, Artificial Sequence
  RFXAP__Homo_sapiens__NP_000529
auggaggcccagggcguggccgagggcgccggccccggcgccgccagcggcgugccccaccccgccgcccuggcccccgccgccgcccccacccuggcccccgccagcguggccgccgccgccagccaguucacccugcuggugaugcagcccugcgccggccaggacgaggccgccgcccccggcggcagcgugggcgccggcaagcccgugagauaccugugcgagggcgccggcgacggcgaggaggaggccggcgaggacgaggccgaccugcuggacaccagcgacccccccggcggcggcgagagcgccgccagccuggaggaccuggaggacgaggagacccacagcggcggcgagggcagcagcggcggcgccagaagaagaggcagcggcggcggcagcaugagcaagaccugcaccuacgagggcugcagcgagaccaccagccagguggccaagcagagaaagcccuggaugugcaagaagcacagaaacaagauguacaaggacaaguacaagaagaagaagagcgaccaggcccugaacugcggcggcaccgccagcaccggcagcgccggcaacgugaagcuggaggagagcgccgacaacauccugagcaucgugaagcagagaaccggcagcuucggcgacagacccgccagacccacccugcuggagcaggugcugaaccagaagagacugagccugcugagaagccccgagguggugcaguuccugcagaagcagcagcagcugcugaaccagcaggugcuggagcagagacagcagcaguuccccggcaccagcauguaa

SEQ ID NO: 22590 - RNA, 414 nt, Artificial Sequence
  RGCC__Homo_sapiens__NP_054778
augaagccccccgccgcccagggcagccccgccgccgccgccgccgccgcccccgcccuggacagcgccgccgccgaggaccugagcgacgcccugugcgaguucgacgccgugcuggccgacuucgccagccccuuccacgagagacacuuccacuacgaggagcaccuggagagaaugaagagaagaagcagcgccagcgugagcgacagcagcggcuucagcgacagcgagagcgccgacagccuguacagaaacagcuucagcuucagcgacgagaagcugaacagccccaccgacagcacccccgcccugcugagcgccaccgugaccccccagaaggccaagcugggcgacaccaaggagcuggaggccuucaucgccgaccuggacaagacccuggccagcauguaa

SEQ ID NO: 22591 - RNA, 2301 nt, Artificial Sequence
  RGL1__Homo_sapiens__NP_001284598
auggaggugaagcccgugggcgagcccacccaggaggugagcaaguucaagcugagcaccaagguggagagcaccggccacuggcugguggaggaccacgugagaaucugggaggugcugaagaccgaggagguggagggcgaccagcugccccccggccacaccgugagccaguacgagaccugcaagaucagaaccaucaaggccggcacccuggagaagcugguggagaaccugcugaccgccuucggcgacaacgacuucaccuacaucagcaucuuccugagcaccuacagaggcuucgccagcaccaaggaggugcuggagcugcugcuggacagauacggcaaccugaccagccccaacugcgaggaggacggcagccagagcagcagcgagagcaagauggugaucagaaacgccaucgccagcauccugagagccuggcuggaccagugcgccgaggacuucagagagcccccccacuuccccugccugcagaagcugcuggacuaccugaccagaaugaugcccggcagcgaccccgagagaagagcccagaaccugcuggagcaguuccagaagcaggagguggagaccgacaacggccugcccaacaccaucagcuucagccuggaggaggaggaggagcuggagggcggcgagagcgccgaguucaccugcuucagcgaggaccugguggccgagcagcugaccuacauggacgcccagcuguucaagaagguggugccccaccacugccugggcugcaucuggagcagaagagacaagaaggagaacaagcaccuggcccccaccaucagagccaccaucagccaguucaacacccugaccaagugcguggugagcaccauccugggcggcaaggagcugaagacccagcagagagccaagaucaucgagaaguggaucaacaucgcccacgagugcagacugcugaagaacuucagcagccugagagccaucgugagcgcccugcagagcaacagcaucuacagacugaagaagaccugggccgccgugcccagagacagaaugcugauguucgaggagcugagcgacaucuucagcgaccacaacaaccaccugaccagcagagagcugcugaugaaggagggcaccagcaaguucgccaaccuggacagcagcgugaaggagaaccagaagagaacccagagaagacugcagcugcagaaggacaugggcgugaugcagggcaccgugcccuaccugggcaccuuccugaccgaccugaccaugcuggacaccgcccugcaggacuacaucgagggcggccugaucaacuucgagaagagaagaagagaguucgaggugaucgcccagaucaagcugcugcagagcgccugcaacagcuacugcaugacccccgaccagaaguucauccagugguuccagagacagcagcugcugaccgaggaggagagcuacgcccugagcugcgagaucgaggccgccgccgacgccagcaccaccagccccaagcccagaaagagcauggugaagagacugagccugcuguuccugggcagcgacaugaucaccagccccacccccaccaaggagcagcccaagagcaccgccagcggcagcagcggcgagagcauggacagcgugagcgugagcagcugcgagagcaaccacagcgaggccgaggagggcagcaucacccccauggacacccccgacgagccccagaagaagcugagcgagagcagcagcagcugcagcagcauccacagcauggacaccaacagcagcggcaugagcagccugaucaacccccugagcagcccccccagcugcaacaacaaccccaagauccacaagagaagcgugagcgugaccagcaucaccagcaccgugcugccccccguguacaaccagcagaacgaggacaccugcaucaucagaaucagcguggaggacaacaacggcaacauguacaagagcaucaugcugaccagccaggacaagacccccgccgugauccagagagccaugcugaagcacaaccuggacagcgaccccgccgaggaguacgagcuggugcaggugaucagcgaggacaaggagcuggugauccccgacagcgccaacguguucuacgccaugaacagccaggugaacuucgacuucauccugagaaagaagaacagcauggaggagcaggugaagcugagaagcagaaccagccugacccugcccagaaccgccaagagaggcugcuggagcaacagacacagcaagaucacccuguaa

SEQ ID NO: 22592 - RNA, 2334 nt, Artificial Sequence
  RGL2__Homo_sapiens__NP_004752
augcugcccagaccccugagacugcugcuggacaccagcccccccggcggcguggugcugagcagcuucagaagcagagaccccgaggagggcggcggccccggcggccugguggugggcggcggccaggaggaggaggaggaggaggaggaggaggcccccgugagcgugugggacgaggaggaggacggcgccguguucaccgugaccagcagacaguacagaccccuggacccccuggugcccaugcccccccccagaagcagcagaagacugagagccggcacccuggaggcccuggugagacaccugcuggacaccagaaccagcggcaccgacgugagcuucaugagcgccuuccuggccacccacagagccuucaccagcacccccgcccugcugggccugauggccgacagacuggaggcccuggagagccaccccaccgacgagcuggagagaaccaccgagguggccaucagcgugcugagcaccuggcuggccagccaccccgaggacuucggcagcgaggccaagggccagcuggacagacuggagagcuuccugcugcagaccggcuacgccgccggcaagggcgugggcggcggcagcgccgaccugaucagaaaccugagaagcagaguggacccccaggcccccgaccugcccaagccccuggcccugcccggcgacccccccgccgaccccaccgacgugcugguguuccuggccgaccaccuggccgagcagcugacccugcuggacgccgagcuguuccugaaccugauccccagccagugccugggcggccuguggggccacagagacagacccggccacagccaccugugccccagcgugagagccaccgugacccaguucaacaagguggccggcgccguggugagcagcgugcugggcgccaccagcaccggcgagggccccggcgaggugaccaucagaccccugagacccccccagagagccagacugcuggagaaguggaucagaguggccgaggagugcagacugcugagaaacuucagcagcguguacgccguggugagcgcccugcagagcagccccauccacagacugagagccgccuggggcgaggccaccagagacagccugagaguguucagcagccugugccagaucuucagcgaggaggacaacuacagccagagcagagagcugcuggugcaggaggugaagcugcagagcccccuggagccccacagcaagaaggcccccagaagcggcagcagaggcggcggcguggugcccuaccugggcaccuuccugaaggaccuggugaugcuggacgccgccagcaaggacgagcuggagaacggcuacaucaacuucgacaagagaagaaaggaguucgccgugcugagcgagcugagaagacugcagaacgagugcagaggcuacaaccugcagcccgaccacgacauccagagauggcugcagggccugagaccccugaccgaggcccagagccacagagugagcugcgagguggagccccccggcagcagcgacccccccgcccccagagugcugagacccacccuggugaucagccaguggaccgaggugcugggcagcgugggcgugcccaccccccuggugagcugcgacagacccagcaccggcggcgacgaggcccccaccacccccgccccccugcugaccagacuggcccagcacaugaaguggcccagcgugagcagccuggacagcgcccuggagagcagccccagccugcacagccccgccgaccccagccaccugagcccccccgccagcagccccagacccagcagaggccacagaagaagcgccagcugcggcagcccccugagcggcggcgccgaggaggccagcggcggcaccggcuacggcggcgagggcagcggccccggcgccagcgacugcagaaucaucagagugcagauggagcugggcgaggacggcagcguguacaagagcauccuggugaccagccaggacaaggcccccagcgugaucagcagagugcugaagaagaacaacagagacagcgccguggccagcgaguacgagcuggugcagcugcugcccggcgagagagagcugaccauccccgccagcgccaacguguucuacgccauggacggcgccagccacgacuuccugcugagacagagaagaagaagcagcaccgccacccccggcgugaccagcggccccagcgccagcggcaccccccccagcgagggcggcggcggcagcuuccccagaaucaaggccaccggcagaaagaucgccagagcccuguucuaa

SEQ ID NO: 22593 - RNA, 1422 nt, Artificial Sequence
  RGL4__Homo_sapiens__NP_705843
augagaaagcugcugaccaaccugcccgccgccgccgugcugagcgcccagguguacagcgccgugcugcagggccugugggaggagaacgugugcggcacccccggcagaaccagagugugcaccgcccugcuguacggccaggugugccccuuccaggacagcaccgacggccugagaaccaucaccagcauccuguucaacuggccccccgagaacaccagcguguacuaccagcccccccagagaagcagcuucagaaucaagcuggccuucagaaaccugagcuggcccggccugggccuggaggaccaccaggagaucgugcugggccagcuggugcugcccgagcccaacgaggccaagcccgacgaccccgcccccagacccggccagcacgcccugaccaugcccgcccuggagcccgcccccccccugcuggccgaccugggccccgcccuggagcccgagagccccgccgcccugggcccccccggcuaccugcacagcgcccccggccccgcccccgcccccggcgagggccccccccccggcaccgugcuggagccccagagcgcccccgagagcagcugccccugcagaggcagcgugaagaaccagcccagcgaggagcugcccgacaugaccaccuucccccccagacugcuggccgagcagcugacccugauggacgccgagcuguucaagaagguggugcugcacgagugccugggcugcaucuggggccagggccaccugaagggcaacgagcacauggcccccaccgugagagccaccaucgcccacuucaacagacugaccaacugcaucaccaccagcugccugggcgaccacagcaugagagccagagacagagccagagugguggagcacuggaucaagguggccagagagugccugagccugaacaacuucagcagcgugcacgugaucgugagcgcccugugcagcaaccccaucggccagcugcacaagaccugggccggcgugagcagcaagagcaugaaggagcugaaggagcugugcaagaaggacaccgccgugaagagagaccugcugaucaaggccggcagcuucaagguggccacccaggagagaaacccccagagagugcagaugagacugagaagacagaagaagggcguggugcccuuccugggcgacuuccugaccgagcugcagagacuggacagcgccauccccgacgaccuggacggcaacaccaacaagagaagcaaggaggugagagugcugcaggagaugcagcugcugcagguggccgccaugaacuacagacugagaccccuggagaaguucgugaccuacuucaccagaauggagcagcugagcgacaaggagagcuacaagcugagcugccagcuggagcccgagaaccccuaa

SEQ ID NO: 22594 - RNA, 1377 nt, Artificial Sequence
  RGMA__Homo_sapiens__NP_001159755
augggcggccugggccccagaagagccggcaccagcagagagagacugguggugaccggcagagccggcuggaugggcaugggcagaggcgccggcagaagcgcccugggcuucuggcccacccuggccuuccugcugugcagcuuccccgccgccaccagccccugcaagauccugaagugcaacagcgaguucuggagcgccaccagcggcagccacgcccccgccagcgacgacacccccgaguucugcgccgcccugagaagcuacgcccugugcaccagaagaaccgccagaaccugcagaggcgaccuggccuaccacagcgccgugcacggcaucgaggaccugaugagccagcacaacugcagcaaggacggccccaccagccagcccagacugagaacccugccccccgccggcgacagccaggagagaagcgacagccccgagaucugccacuacgagaagagcuuccacaagcacagcgccacccccaacuacacccacugcggccuguucggcgacccccaccugagaaccuucaccgacagauuccagaccugcaaggugcagggcgccuggccccugaucgacaacaacuaccugaacgugcaggugaccaacacccccgugcugcccggcagcgccgccaccgccaccagcaagcugaccaucaucuucaagaacuuccaggagugcguggaccagaagguguaccaggccgagauggacgagcugcccgccgccuucguggacggcagcaagaacggcggcgacaagcacggcgccaacagccugaagaucaccgagaaggugagcggccagcacguggagauccaggccaaguacaucggcaccaccaucguggugagacaggugggcagauaccugaccuucgccgugagaaugcccgaggagguggugaacgccguggaggacugggacagccagggccuguaccugugccugagaggcugcccccugaaccagcagaucgacuuccaggccuuccacaccaacgccgagggcaccggcgccagaagacuggccgccgccagccccgcccccaccgcccccgagaccuuccccuacgagaccgccguggccaagugcaaggagaagcugcccguggaggaccuguacuaccaggccugcguguucgaccugcugaccaccggcgacgugaacuucacccuggccgccuacuacgcccuggaggacgugaagaugcugcacagcaacaaggacaagcugcaccuguacgagagaaccagagaccugcccggcagagccgccgccggccugccccuggcccccagaccccugcugggcgcccuggugccccugcuggcccugcugcccguguucugcuaa

SEQ ID NO: 22595 - RNA, 1437 nt, Artificial Sequence
  RGMB__Homo_sapiens__NP_001012779
augaucagaaagaagagaaagagaagcgccccccccggccccugcagaagccacggccccagacccgccaccgcccccgcccccccccccagccccgagcccaccagacccgccuggaccggcaugggccugagagccgcccccagcagcgccgccgccgccgccgccgagguggagcagagaagaagccccggccugugcccccccccccuggagcugcugcugcugcugcuguucagccugggccugcugcacgccggcgacugccagcagcccgcccagugcagaauccagaagugcaccaccgacuucgugagccugaccagccaccugaacagcgccguggacggcuucgacagcgaguucugcaaggcccugagagccuacgccggcugcacccagagaaccagcaaggccugcagaggcaaccugguguaccacagcgccgugcugggcaucagcgaccugaugagccagagaaacugcagcaaggacggccccaccagcagcaccaaccccgaggugacccacgaccccugcaacuaccacagccacgccggcgccagagagcacagaagaggcgaccagaacccccccagcuaccuguucugcggccuguucggcgacccccaccugagaaccuucaaggacaacuuccagaccugcaagguggagggcgccuggccccugaucgacaacaacuaccugagcgugcaggugaccaacgugcccguggugcccggcagcagcgccaccgccaccaacaagaucaccaucaucuucaaggcccaccacgagugcaccgaccagaagguguaccaggccgugaccgacgaccugcccgccgccuucguggacggcaccaccagcggcggcgacagcgacgccaagagccugagaaucguggagagagagagcggccacuacguggagaugcacgccagauacaucggcaccaccguguucgugagacaggugggcagauaccugacccuggccaucagaaugcccgaggaccuggccaugagcuacgaggagagccaggaccugcagcugugcgugaacggcugcccccugagcgagagaaucgacgacggccagggccaggugagcgccauccugggccacagccugcccagaaccagccuggugcaggccuggcccggcuacacccuggagaccgccaacacccagugccacgagaagaugcccgugaaggacaucuacuuccagagcugcguguucgaccugcugaccaccggcgacgccaacuucaccgccgccgcccacagcgcccuggaggacguggaggcccugcaccccagaaaggagagauggcacaucuuccccagcagcggcaacggcacccccagaggcggcagcgaccugagcgugagccugggccugaccugccugauccugaucguguuccuguaa

SEQ ID NO: 22596 - RNA, 900 nt, Artificial Sequence
  RGN__Homo_sapiens__NP_004674
augagcagcaucaagaucgagugcgugcugcccgagaacugcagaugcggcgagagccccgugugggaggaggugagcaacagccugcuguucguggacauccccgccaagaaggugugcagaugggacagcuucaccaagcaggugcagagagugaccauggacgcccccgugagcagcguggcccugagacagagcggcggcuacguggccaccaucggcaccaaguucugcgcccugaacuggaaggagcagagcgccguggugcuggccaccguggacaacgacaagaagaacaacagauucaacgacggcaagguggaccccgccggcagauacuucgccggcaccauggccgaggagaccgcccccgccgugcuggagagacaccagggcgcccuguacagccuguuccccgaccaccacgugaagaaguacuucgaccagguggacaucagcaacggccuggacuggagccuggaccacaagaucuucuacuacaucgacagccugagcuacagcguggacgccuucgacuacgaccugcagaccggccagaucagcaacagaagaagcguguacaagcuggagaaggaggagcagauccccgacggcaugugcaucgacgccgagggcaagcuguggguggccugcuacaacggcggcagagugaucagacuggaccccgugaccggcaagagacugcagaccgugaagcugcccguggacaagaccaccagcugcugcuucggcggcaagaacuacagcgagauguacgugaccugcgccagagacggcauggaccccgagggccugcugagacagcccgaggccggcggcaucuucaagaucaccggccugggcgugaagggcaucgcccccuacagcuacgccggcuaa

SEQ ID NO: 22597 - RNA, 5271 nt, Artificial Sequence
  RGPD2__Homo_sapiens__NP_001071638
augagaagaagcaaggccuacggcgagagauaccuggccagcgugcagggcagcgcccccagccccggcaagaagcugagaggcuucuacuucgccaagcuguacuacgaggccaaggaguacgaccuggccaagaaguacgugugcaccuaccugagcgugcaggagagagaccccagagcccacagauuccugggccugcuguacgagcuggaggagaacaccgagaaggccguggagugcuacagaagaagccuggagcugaaccccccccagaaggaccuggugcugaagaucgccgagcugcugugcaagaacgacgugaccgacggcagagccaaguacuggguggagagagccgccaagcuguuccccggcagccccgccaucuacaagcugaaggagcaccugcuggacugcgagggcgaggacggcuggaacaagcuguucgacuggauccagagcgagcuguacgugagacccgacgacgugcacaugaacaucagacugguggagcuguacagaagcaacaagagacugaaggacgccguggccagaugccacgaggccgagagaaacaucgcccugagaagcagccuggaguggaacagcugcguggugcagacccugaaggaguaccuggagagccugcagugccuggagagcgacaagagcgacuggagagccaccaacaccgaccugcugcuggccuacgccaaccugaugcugcugacccugagcaccagagacgugcaggagagcagagagcugcuggagagcuucgacagcgcccugcagagcgccaagagcagccugggcggcaacgacgagcugagcgccaccuuccuggagaugaagggccacuucuacaugcacgccggcagccugcugcugaagaugggccagcacggcaacaacgugcaguggcaggcccugagcgagcuggccgcccugugcuacgugaucgccuuccaggugcccagacccaagaucaagcugaucaagggcgaggccggccagaaccugcuggagaugauggccugcgacagacugagccagagcggccacaugcugcugaaccugagcagaggcaagcaggacuuccugaaggaggugguggagaccuucgccaacaagagcggccagagcgugcuguacaacgcccuguucagcagccagagcagcaaggacaccagcuuccugggcagcgacgacaucggcaacaucgacgugcaggagcccgagcuggaggaccuggccagauacgacgugggcgccauccaggcccacaacggcagccugcagcaccugaccuggcugggccugcaguggaacagccugcccgcccugcccggcaucagaaaguggcugaagcagcuguuccaccaccugccccaggagaccagcagacuggagaccaacgcccccgagagcaucugcauccuggaccuggagguguuccugcugggcgugguguacaccagccaccugcagcugaaggagaagugcaacagccaccacagcagcuaccagccccugugccugccccugcccgugugcaagagacugugcaccgagagacagaagagcuggugggacgccgugugcacccugauccacagaaaggccgugcccggcaacagcgccgagcugagacugguggugcagcacgagaucaacacccugagagcccaggagaagcacggccugcagcccgcccugcuggugcacugggccaagugccugcagaagaugggcagaggccugaacagcagcuacgaccagcaggaguacaucggcagaagcgugcacuacuggaagaaggugcugccccugcugaagaucaucaagaagaacagcauccccgagcccaucgacccccuguucaagcacuuccacagcguggacauccaggccagcgagaucguggaguacgaggaggacgcccacaucaccuucgccauccuggacgccgugcacggcaacaucgaggacgccgugaccgccuucgagagcaucaagagcguggugagcuacuggaaccuggcccugaucuuccacagaaaggccgaggacaucgagaacgacgccguguuccccgaggagcaggaggagugcaagaacuaccugagaaagaccagagacuaccugaucaagaucaucgacgacagcgacagcaaccugagcguggugaagaagcugcccgugccccuggagagcgugaaggagaugcugaagagcgugaugcaggagcuggaggacuacagcgagggcggcccccuguacaagaacggcagccugagaaacgccgacagcgagaucaagcacagcacccccagccccaccaaguacagccugagccccagcaagagcuacaaguacagccccaagaccccccccagaugggccgaggaccagaacagccugagaaagaugaucugccaggaggugaaggccaucaccaagcugaacagcagcaagagcgccagcagacacagauggcccaccgagaacuacggccccgacagcgugcccgacggcuaccagggcagccagaccuuccacggcgccccccugaccguggccaccaccggccccagcguguacuacagccagagccccgccuacaacagccaguaccugcugagacccgccgccaacgugacccccaccaagggcagcagcaacaccgaguucaagagcaccaaggagggcuucagcaucgccgugagcgccgacggcuucaaguucggcaucagcgagcccggcaaccaggagaagaagagcgagaagccccuggagaacgacaccggcuuccaggcccaggacaucagcggccagaagaacggcagaggcgugaucuucggccagaccagcagcaccuucaccuucgccgacguggccaagagcaccagcggcgagggcuuccaguucggcaagaaggaccccaacuucaagggcuucagcggcgccggcgagaagcuguucagcagccagugcggcaagauggccaacaaggccaacaccagcggcgacuucgagaaggacgacgacgccugcaagaccgaggacagcgacgacauccacuucgagcccguggugcagaugcccgagaagguggagcuggugaccggcgaggagggcgagaaggugcuguacagccagggcgugaagcuguucagauucgacgccgagaucagccaguggaaggagagaggccugggcaaccugaagauccugaagaacgaggugaacggcaagcccagaaugcugaugagaagagaccaggugcugaaggugugcgccaaccacuggaucaccaccaccaugaaccugaagccccugagcggcagcgacagagccuggauguggcuggccagcgacuucagcgacggcgacgccaagcuggagagacuggccgcccaguucaagacccccgagcuggccgaggaguucaagcagaaguucgaggagugccagagacugcugcuggacaucccccugcagaccccccacaagcugguggacaccggcagagccgccaagcugauccagagagccgaggagaugaagagcggccugaaggacuucaagaccuuccugaccaacgaccagaccaaggugaccgaggaggagaacaagggcagcggcaccggcgccgccggcgccagcgacaccaccaucaagcccaaccccgagaacaccggccccacccuggagugggacaacuacgaccugagagaggacgcccuggacgacaacgugagcagcagcagcgugcacgacagcccccuggccagcagccccgugagaaagaacaucuucagauucgacgagagcaccaccggcuucaacuucagcuucaagagcgcccugagccugagcaagagccccgccaagcugaaccagagcggcaccagcgugggcaccgacgaggagagcgacgugacccaggaggaggagagagacggccaguacuucgagcccguggugccccugcccgaccugguggaggugagcagcggcgaggagaacgagcaggugguguucagccacauggccgagcuguacagauacgacaaggacgugggccaguggaaggagagaggcaucggcgacaucaagauccugcagaacuacgacaacaagcaggugagaaucgugaugagaagagaccaggugcugaagcugugcgccaaccacagaaucacccccgacaugagccugcagaacaugaagggcaccgagagaguguggguguggaccgccugcgacuucgccgacggcgagagaaagguggagcaccuggccgugagauucaagcugcaggacguggccgacagcuucaagaagaucuucgacgaggccaagaccgcccaggagaaggacagccugaucaccccccacgugagcagaagcagcacccccagagagagccccugcggcaagaucgccguggccgugcuggaggagaccaccagagagagaaccgacgugauccagggcgacgacguggccgacgccgccagcgagguggaggugagcagcaccagcgagaccaccaccaaggccguggugagcccccccaaguucguguucggcagcgagagcgugaagagaaucuucagcagcgagaagagcaaccccuucgccuucggcaacagcagcgccaccggcagccuguucggcuucagcuucaacgccccccugaagagcaacgacagcgagaccagcagcguggcccagagcggcagcgagagcaagguggagcccaagaagugcgagcugagcaagaacagcgacaucgagcagagcagcgacagcaaggugaagaaccugagcgccagcuuccccauggaggagagcagcaucaacuacaccuucaagacccccgagaaggagcccccccuguggcacgccgaguucaccaaggaggagcuggugcagaagcugagcagcaccaccaagagcgccgaccagcugaacggccugcugagagagaccgaggccaccagcgccgugcugauggagcagaucaagcugcugaagagcgagaucagaagacuggagagaaaccaggaggagagcgccgccaacguggagcaccugaagaacgugcugcugcaguucaucuuccugaagcccggcagcgagagagagagccugcugcccgugaucaacaccaugcugcagcugagccccgaggagaagggcaagcuggccgccguggcccagggccugcaggagaccagcauccccaagaagaaguaa

SEQ ID NO: 22598 - RNA, 876 nt, Artificial Sequence
  RGR__Homo_sapiens__NP_001012738
auggccgagaccagcgcccugcccaccggcuucggcgagcuggaggugcuggccgugggcauggugcugcugguggaggcccugagcggccugagccugaacacccugaccaucuucagcuucugcaagacccccgagcugagaacccccugccaccugcuggugcugagccuggcccuggccgacagcggcaucagccugaacgcccugguggccgccaccagcagccugcugagaagauggcccuacggcagcgacggcugccaggcccacggcuuccagggcuucgugaccgcccuggccagcaucugcagcagcgccgccaucgccuggggcagauaccaccacuacugcaccagaagccagcuggccuggaacagcgccgugagccuggugcuguucguguggcugagcagcgccuucugggccgcccugccccugcugggcuggggccacuacgacuacgagccccugggcaccugcugcacccuggacuacagcaagggcgacagaaacuucaccagcuuccuguucaccaugagcuucuucaacuucgccaugccccuguucaucaccaucaccagcuacagccugauggagcagaagcugggcaagagcggccaccugcaggugaacaccacccugcccgccagaacccugcugcugggcuggggccccuacgccauccuguaccuguacgccgugaucgccgacgugaccagcaucagccccaagcugcagauggugcccgcccugaucgccaagauggugcccaccaucaacgccaucaacuacgcccugggcaacgagauggugugcagaggcaucuggcagugccugagcccccagaagagagagaaggacagaaccaaguaa

SEQ ID NO: 22599 - RNA, 546 nt, Artificial Sequence
  RGS10__Homo_sapiens__NP_001005339
auguucaacagagccgugagcagacugagcagaaagagaccccccagcgacauccacgacagcgacggcagcagcagcagcagccaccagagccugaagagcaccgccaagugggccgccagccuggagaaccugcuggaggaccccgagggcgugaagagauucagagaguuccugaagaaggaguucagcgaggagaacgugcuguucuggcuggccugcgaggacuucaagaagaugcaggacaagacccagaugcaggagaaggccaaggagaucuacaugaccuuccugagcagcaaggccagcagccaggugaacguggagggccagagcagacugaacgagaagauccuggaggagccccacccccugauguuccagaagcugcaggaccagaucuucaaccugaugaaguacgacagcuacagcagauuccugaagagcgaccuguuccugaagcacaagagaaccgaggaggaggaggaggaccugcccgacgcccagaccgccgccaagagagccagcagaaucuacaacaccuaa

SEQ ID NO: 22600 - RNA, 1341 nt, Artificial Sequence
  RGS11__Homo_sapiens__NP_003825
auggagagagugguggugagcaugcaggaccccgaccagggcgugaagaugagaagccagagacugcuggugaccgugaucccccacgccgugaccggcagcgacguggugcaguggcuggcccagaaguucugcgugagcgaggaggaggcccugcaccugggcgccgugcuggugcagcacggcuacaucuacccccugagagaccccagaagccugaugcugagacccgacgagacccccuacagauuccagacccccuacuucuggaccagcacccugagacccgccgccgagcuggacuacgccaucuaccuggccaagaagaacaucagaaagagaggcacccugguggacuacgagaaggacugcuacgacagacugcacaagaagaucaaccacgccugggaccuggugcugaugcaggccagagagcagcugagagccgccaagcagagaagcaagggcgacagacuggugaucgccugccaggagcagaccuacuggcuggugaacagacccccccccggcgcccccgacgugcuggagcagggccccggcagaggcagcugcgccgccagcagagugcugaugaccaagagcgccgacuuccacaagagagagaucgaguacuucagaaaggcccugggcagaaccagagugaagagcagcgugugccuggaggccuaccugagcuucugcggccagagaggcccccacgacccccuggugagcggcugccugcccagcaaccccuggaucagcgacaacgacgccuacugggugaugaacgcccccaccguggccgcccccaccaagcugagaguggagagauggggcuucagcuucagagagcugcuggaggaccccgugggcagagcccacuucauggacuuccugggcaaggaguucagcggcgagaaccugagcuucugggaggccugcgaggagcugagauacggcgcccaggcccaggugcccacccugguggacgccguguacgagcaguuccuggcccccggcgccgcccacugggugaacaucgacagcagaaccauggagcagacccuggagggccugagacagccccacagauacgugcuggacgacgcccagcugcacaucuacaugcugaugaagaaggacagcuaccccagauuccugaagagcgacauguacaaggcccugcuggccgaggccggcaucccccuggagaugaagagaagaguguuccccuucaccuggagacccagacacagcagccccagccccgcccugcugcccacccccguggagcccaccgccgccugcggccccggcggcggcgacggcguggccuaa

SEQ ID NO: 22601 - RNA, 2400 nt, Artificial Sequence
  RGS12__Homo_sapiens__NP_937870
augaaccugggcaaggagcugagcaacgagacccacgugagcaacgaccagcagagcgccaccgugagcgacggcgagcugaccggcgccgaccugaaggacugcgugagcaacaacagccugagcagcaacgccagccugcccagcgugcagagcugcagaagacugagagagagaagaguggccagcugggccgugagcuucgagagacugcugcaggaccccgugggcgugagauacuucagcgacuuccugagaaaggaguucagcgaggagaacauccuguucuggcaggccugcgaguacuucaaccacgugcccgcccacgacaagaaggagcugagcuacagagccagagagaucuucagcaaguuccugugcagcaaggccaccacccccgugaacaucgacagccaggcccagcuggccgacgacgugcugagagccccccaccccgacauguucaaggagcagcagcugcagaucuucaaccugaugaaguucgacagcuacaccagauuccugaagagcccccuguaccaggagugcauccuggccgagguggagggcagagcccugcccgacagccagcaggugcccagcagccccgccagcaagcacagccugggcagcgaccacagcagcgugagcacccccaagaagcugagcggcaagagcaagagcggcagaagccugaacgaggagcugggcgacgaggacagcgagaagaagagaaagggcgccuucuucagcuggagcagaaccagaagcaccggcagaagccagaagaagagagagcacggcgaccacgccgacgacgcccugcacgccaacggcggccugugcagaagagagagccagggcagcgugagcagcgccggcagccuggaccugagcgaggccugcagaacccuggcccccgagaaggacaaggccaccaagcacugcugcauccaccugcccgacggcaccagcugcgugguggccgugaaggccggcuucagcaucaaggacauccugagcggccugugcgagagacacggcaucaacggcgccgccgccgaccuguuccuggugggcggcgacaagccccuggugcugcaccaggacagcagcauccuggagagcagagaccugagacuggagaagagaacccuguucagacuggaccuggugcccaucaacagaagcgugggccugaaggccaagcccaccaagcccgugaccgaggugcugagacccgugguggccagauacggccuggaccugagcggccugcuggugagacugagcggcgagaaggagccccuggaccugggcgcccccaucagcagccuggacggccagagaguggugcuggaggagaaggaccccagcagaggcaaggccagcgccgacaagcagaagggcgugcccgugaagcagaacaccgccgugaacagcagcagcagaaaccacagcgccaccggcgaggagagaacccugggcaagagcaacagcaucaagaucaagggcgagaacggcaagaacgccagagaccccagacugagcaagagagaggagagcaucgccaagaucggcaagaagaaguaccagaagaucaaccuggacgaggccgaggaguucuucgagcugaucagcaaggcccagagcaacagagccgacgaccagagaggccugcugagaaaggaggaccuggugcugcccgaguuccugagacugccccccggcagcaccgagcugacccugcccacccccgccgccguggccaagggcuucagcaagagaagcgccaccggcaacggcagagagagcgccagccagcccggcgagcagugggagcccgugcaggagagcagcgacagccccagcaccagccccggcagcgccagcagcccccccggcccccccggcaccaccccccccggccagaagagccccagcggccccuucugcaccccccagagccccgugagccuggcccaggagggcaccgcccagaucuggaagagacagagccaggagguggaggccggcggcauccagaccguggaggacgagcacguggccgagcugacccugaugggcgagggcgacaucagcagccccaacagcacccugcugcccccccccagcaccccccaggaggugcccggccccagcagacccggcagcggcacccacggcagcagagaccugcccgugaacagaaucaucgacguggaccuggugaccggcagcgcccccggcagagacggcggcaucgccggcgcccaggccggccccggcagaagccaggccagcggcggcccccccaccagcgaccugcccggccugggccccgugcccggcgagcccgccaagcccaagaccagcgcccaccacgccaccuucguguaa

SEQ ID NO: 22602 - RNA, 480 nt, Artificial Sequence
  RGS13__Homo_sapiens__NP_002918
augagcagaagaaacugcuggaucugcaagaugugcagagacgagagcaagagaccccccagcaaccugacccuggaggaggugcugcagugggcccagagcuucgagaaccugauggccaccaaguacggccccgugguguacgccgccuaccugaagauggagcacagcgacgagaacauccaguucuggauggccugcgagaccuacaagaagaucgccagcagauggagcagaaucagcagagccaagaagcuguacaagaucuacauccagccccagagccccagagagaucaacaucgacagcagcaccagagagaccaucaucagaaacauccaggagcccaccgagaccugcuucgaggaggcccagaagaucguguacaugcacauggagagagacagcuaccccagauuccugaagagcgagauguaccagaagcugcugaagaccaugcagagcaacaacagcuucuaa

SEQ ID NO: 22603 - RNA, 1701 nt, Artificial Sequence
  RGS14__Homo_sapiens__NP_006471
augcccggcaagcccaagcaccugggcgugcccaacggcagaauggugcuggccgugagcgacggcgagcugagcagcaccaccggcccccagggccagggcgagggcagaggcagcagccugagcauccacagccugcccagcggccccagcagccccuuccccaccgaggagcagcccguggccagcugggcccugagcuucgagagacugcugcaggacccccugggccuggccuacuucaccgaguuccugaagaaggaguucagcgccgagaacgugaccuucuggaaggccugcgagagauuccagcagauccccgccagcgacacccagcagcuggcccaggaggccagaaacaucuaccaggaguuccugagcagccaggcccugagccccgugaacaucgacagacaggccuggcugggcgaggaggugcuggccgagcccagacccgacauguucagagcccagcagcugcagaucuucaaccugaugaaguucgacagcuacgccagauucgugaagagcccccuguacagagagugccugcuggccgaggccgagggcagaccccugagagagcccggcagcagcagacugggcagccccgacgccaccagaaagaagcccaagcugaagcccggcaagagccugccccugggcguggaggagcugggccagcugccccccguggagggccccggcggcagaccccugagaaagagcuucagaagagagcugggcggcaccgccaacgccgcccugagaagagagagccagggcagccugaacagcagcgccagccuggaccugggcuuccuggccuucgugagcagcaagagcgagagccacagaaagagccugggcagcaccgagggcgagagcgagagcagacccggcaaguacugcugcguguaccugcccgacggcaccgccagccuggcccuggccagacccggccugaccaucagagacaugcuggccggcaucugcgagaagagaggccugagccugcccgacaucaagguguaccuggugggcaacgagcaggcccuggugcuggaccaggacugcaccgugcuggccgaccaggaggugagacuggagaacagaaucaccuucgagcuggagcugaccgcccuggagagaguggugagaaucagcgccaagcccaccaagagacugcaggaggcccugcagcccauccuggagaagcacggccugagcccccuggagguggugcugcacagacccggcgagaagcagccccuggaccugggcaagcuggugagcagcguggccgcccagagacuggugcuggacacccugcccggcgugaagaucagcaaggccagagacaagagccccugcagaagccagggcugcccccccagaacccaggacaaggccacccaccccccccccgccagccccagcagccuggugaaggugcccagcagcgccaccggcaagagacagaccugcgacaucgagggccugguggagcugcugaacagagugcagagcagcggcgcccacgaccagagaggccugcugagaaaggaggaccuggugcugcccgaguuccugcagcugcccgcccagggccccagcagcgaggagacccccccccagaccaagagcgccgcccagcccaucggcggcagccugaacagcaccaccgacagcgcccuguaa

SEQ ID NO: 22604 - RNA, 609 nt, Artificial Sequence
  RGS16__Homo_sapiens__NP_002919
augugcagaacccuggccgccuuccccaccaccugccuggagagagccaaggaguucaagaccagacugggcaucuuccugcacaagagcgagcugggcugcgacaccggcagcaccggcaaguucgaguggggcagcaagcacagcaaggagaacagaaacuucagcgaggacgugcugggcuggagagagagcuucgaccugcugcugagcagcaagaacggcguggccgccuuccacgccuuccugaagaccgaguucagcgaggagaaccuggaguucuggcuggccugcgaggaguucaagaagaucagaagcgccaccaagcuggccagcagagcccaccagaucuucgaggaguucaucugcagcgaggcccccaaggaggugaacaucgaccacgagacccacgagcugaccagaaugaaccugcagaccgccaccgccaccugcuucgacgccgcccagggcaagaccagaacccugauggagaaggacagcuaccccagauuccugaagagccccgccuacagagaccuggccgcccaggccagcgccgccagcgccacccugagcagcugcagccuggacgagcccagccacaccuaa

SEQ ID NO: 22605 - RNA, 666 nt, Artificial Sequence
  RGS17__Homo_sapiens__XP_011534055
augagcagccagcugggccccgagguggccgagaugagaaagagacagcagagccagaacgagggcacccccgccgugagccaggcccccggcaaccagagacccaacaacaccugcugcuucugcuggugcugcugcugcagcugcagcugccugaccgugagaaacgaggagagaggcgagaacgccggcagacccacccacaccaccaagauggagagcauccaggugcuggaggagugccagaaccccaccgccgaggaggugcugagcuggagccagaacuucgacaagaugaugaaggcccccgccggcagaaaccuguucagagaguuccugagaaccgaguacagcgaggagaaccugcuguucuggcuggccugcgaggaccugaagaaggagcagaacaagaaggugaucgaggagaaggccagaaugaucuacgaggacuacaucagcauccugagccccaaggaggugagccuggacagcagagugagagaggugaucaacagaaaccugcuggaccccaacccccacauguacgaggacgcccagcugcagaucuacacccugaugcacagagacagcuuccccagauuccugaacagccagaucuacaagagcuucguggagagcaccgccggcagcagcagcgagagcuaa

SEQ ID NO: 22606 - RNA, 708 nt, Artificial Sequence
  RGS18__Homo_sapiens__NP_570138
auggagaccacccugcuguucuucagccagaucaacaugugcgagagcaaggagaagaccuucuucaagcugauccacggcagcggcaaggaggagaccagcaaggaggccaagaucagagccaaggagaagagaaacagacugagccugcuggugcagaagcccgaguuccacgaggacaccagaagcagcagaagcggccaccuggccaaggagaccagagugagccccgaggaggccgugaaguggggcgagagcuucgacaagcugcugagccacagagacggccuggaggccuucaccagauuccugaagaccgaguucagcgaggagaacaucgaguucuggaucgccugcgaggacuucaagaagagcaagggcccccagcagauccaccugaaggccaaggccaucuacgagaaguucauccagaccgacgcccccaaggaggugaaccuggacuuccacaccaaggaggugaucaccaacagcaucacccagcccacccugcacagcuucgacgccgcccagagcagaguguaccagcugauggagcaggacagcuacaccagauuccugaagagcgacaucuaccuggaccugauggagggcagaccccagagacccaccaaccugagaagaagaagcagaagcuucaccugcaacgaguuccaggacgugcagagcgacguggccaucuggcuguaa

SEQ ID NO: 22607 - RNA, 654 nt, Artificial Sequence
  RGS19__Homo_sapiens__XP_011526788
augcccaccccccacgaggccgagaagcagaucaccggccccgaggaggccgacagaccccccagcaugagcagccacgacaccgccagccccgccgcccccagcagaaaccccugcugccugugcuggugcugcugcugcagcugcagcuggaaccaggagagaagaagagccuggcaggccagcagagagagcaagcugcagccccugcccagcugcgaggugugcgccacccccagccccgaggaggugcagagcugggcccagagcuucgacaagcugaugcacagccccgccggcagaagcguguucagagccuuccugagaaccgaguacagcgaggagaacaugcuguucuggcuggccugcgaggagcugaaggccgaggccaaccagcacgugguggacgagaaggccagacugaucuacgaggacuacgugagcauccugagccccaaggaggugagccuggacagcagagugagagagggcaucaacaagaagaugcaggagcccagcgcccacaccuucgacgacgcccagcugcagaucuacacccugaugcacagagacagcuaccccagauuccugagcagccccaccuacagagcccugcugcugcagggccccagccagagcagcagcgaggccuaa

SEQ ID NO: 22608 - RNA, 630 nt, Artificial Sequence
  RGS1__Homo_sapiens__NP_002913
augagagccgccgccaucagcacccccaagcuggacaagaugcccggcauguucuucagcgccaaccccaaggagcugaagggcaccacccacagccugcuggacgacaagaugcagaagagaagacccaagaccuucggcauggacaugaaggccuaccugagaagcaugaucccccaccuggagagcggcaugaagagcagcaagagcaaggacgugcugagcgccgccgaggugaugcaguggagccagagccuggagaagcugcuggccaaccagaccggccagaacguguucggcagcuuccugaagagcgaguucagcgaggagaacaucgaguucuggcuggccugcgaggacuacaagaagaccgagagcgaccugcugcccugcaaggccgaggagaucuacaaggccuucgugcacagcgacgccgccaagcagaucaacaucgacuucagaaccagagagagcaccgccaagaagaucaaggcccccacccccaccugcuucgacgaggcccagaaggugaucuacacccugauggagaaggacagcuaccccagauuccugaagagcgacaucuaccugaaccugcugaacgaccugcaggccaacagccugaaguaa

SEQ ID NO: 22609 - RNA, 726 nt, Artificial Sequence
  RGS20__Homo_sapiens__NP_003693
augagaaccgccgacggcggcgagcccgccggcgccagcagccccgccggcagaguggacggcggccugcagaugggcagcgagagaauggagaugagaaagagacagaugcccgccgcccaggacacccccggcgccgcccccggccagcccggcgccggcagcagaggcagcaacgccugcugcuucugcuggugcugcugcugcagcugcagcugccugaccgugagaaaccaggaggaccagagacccaccaucgccagccacgagcugagagccgaccugcccaccugggaggagagccccgcccccacccuggaggaggugaacgccugggcccagagcuucgacaagcugauggugacccccgccggcagaaacgccuucagagaguuccugagaaccgaguucagcgaggagaacaugcuguucuggauggccugcgaggagcugaagaaggaggccaacaagaacaucaucgaggagaaggccagaaucaucuacgaggacuacaucagcauccugagccccaaggaggugagccuggacagcagagugagagaggugaucaacagaaacaugguggagcccagccagcacaucuucgacgacgcccagcugcagaucuacacccugaugcacagagacagcuaccccagauucaugaacagcgccguguacaaggaccugcugcagagccugagcgagaagagcaucgaggccuaa

SEQ ID NO: 22610 - RNA, 459 nt, Artificial Sequence
  RGS21__Homo_sapiens__NP_001034241
augcccgugaagugcugcuucuacagaagccccaccgccgagaccaugaccuggagcgagaacauggacacccugcuggccaaccaggccggccuggacgccuucagaaucuuccugaagagcgaguucagcgaggagaacguggaguucuggcuggccugcgaggacuucaagaagaccaagaacgccgacaagaucgccagcaaggccaagaugaucuacagcgaguucaucgaggccgacgcccccaaggagaucaacaucgacuucggcaccagagaccugaucagcaagaacaucgccgagcccacccugaagugcuucgacgaggcccagaagcugaucuacugccugauggccaaggacagcuuccccagauuccugaagagcgagaucuacaagaagcuggugaacagccagcaggugcccaaccacaagaaguggcugcccuuccuguaa

SEQ ID NO: 22611 - RNA, 3759 nt, Artificial Sequence
  RGS22__Homo_sapiens__NP_001273621
augcccgagaagagacugaccgccgagccccccaccaucaccgaggaggaguucgaggacagccuggccaccgacgacuuccugguggacuacuucaacgaguuccugagccugcccaccuucagcgaggccaucagauucaacgccgacuacggcguguucgagguggccaacgacgccccccaguuccuggagaagcagcugaagaagauccugcagaaccagcagcccagaaaccccaucuacgacguggugagaaagggcaagaacgaggugaagcccgugcagaugaacgcccccgacgaggacgagaccaucaacgugaacuacaacaucaugugccugagcagagaggagggcaucaaguggaucaagaaggagagacugcccgccuuccuggagagcgacugcuacuucgaguacagacuggccaagcuggugagccaggugagauggagcaagagcggcaugaacuucaccgugggcagcaacuucagccccuggaucgugaagaagccccccagccugcccccccccgccaccgaggaggacaaccuggccagcuacacccagaccaaggacugguucgcccuggccaagcagagccagcagaccgugagcaccuucagccugcccugcugcgugcccuacaacaagcugaagagccccgccaucagcagcgugagcgagaacuucaucuucgacgacggcgugcaccccagaaccaagaaggaccccagcaagaccaacaagcugaucagcgaguucgaggaggaggagggcgaggaggaggaggugagcgugagccugcaggacacccccagccaggcccugcugagaguguaccuggagaagaagcaggacguggacgagagccugaccaugcacuucagcaccugcgaggaguuccugagcagcuacaucuacuucauccugagaggcgccauccagcagaucgugggcaagcccgugggcgagacccccgacuacaucaacuucaacaacaucaccaaggugagcuucgacgacugcuucgagagcauccacggcaagaacuuccugagcgagcuggugcagaccaccaaggagagaagcgaggagaucgagcagaccagccugagcagcaagaacgagagcgccggccccgagagcagagccgacuggugcaucagccacagaaccuacgacaucggcaacagaaaggaguucgagagauucaagaaguucaucaagggcacccugggcgagagauacugguggcuguggauggacaucgagagacugaaggugcugaaggaccccggcagacaccagagacaccuggagaagaugaagaagugcuaccuggugagcaacggcgacuacuaccugagcgccgagauccugagcaaguucaagcugcuggacggcagccaguggaacgaggagcaccugagaaacauccagagcgaggugcugaagccccugcugcuguacugggcccccagauucugcgugacccacagcgccagcaccaaguacgccagcgccgagcugaaguucuggcaccugagacaggccaagcccagaaaggacaucgaccccuucccccagauggccacccugcugccccugagacccaagagcugcaucccccagauccccgagauccagaaggaggaguucagccugagccagccccccaagagccccaacaagagccccgaggugaagaccgccacccagaagcccuggaagagagagcugcuguaccccggcagcagcaaggacgacgugaucgagaagggcagcaaguacaugagcgagagcagcaaggugauccaccugaccagcuucaccgacaucagcgagugccugaagccccagcuggacagaagauacgccuacaccgaggagcccagagugaagaccgugagcgacgugggcgcccugggcggcagcgacauggagaaccugcugcagagccuguacguggagaacagagccggcuucuucuucaccaaguucugcgagcacagcggcaacaagcuguggaagaacagcguguacuucugguucgaccugcaggccuaccaccagcuguucuaccaggagacccugcagcccuucaaggugugcaagcaggcccaguaccuguucgccaccuacguggcccccagcgccacccuggacaucggccugcagcaggagaagaagaaggagaucuacaugaagauccagccccccuucgaggaccuguucgacaccgccgaggaguacauccugcugcugcugcuggagcccuggaccaagauggugaagagcgaccagaucgccuacaagaagguggagcugguggaggagaccagacagcuggacagcaccuacuucagaaagcugcaggcccugcacaaggagaccuucagcaagaaggccgaggacaccaccugcgagaucggcaccggcauccugagccugagcaacgugagcaagagaaccgaguacugggacaacgugcccgccgaguacaagcacuucaaguucagcgaccugcugaacaacaagcuggaguucgagcacuucagacaguuccuggagacccacagcagcagcauggaccugaugugcuggaccgacaucgagcaguucagaagaaucaccuacagagacagaaaccagagaaaggccaagagcaucuacaucaagaacaaguaccugaacaagaaguacuucuucggccccaacagccccgccagccuguaccagcagaaccaggugaugcaccugagcggcggcuggggcaagauccugcacgagcagcuggacgcccccgugcugguggagauccagaagcacgugcagaacagacuggagaacguguggcugccccuguuccuggccagcgagcaguucgccgccagacagaagaucaaggugcagaugaaggacaucgccgaggagcugcugcugcagaaggccgagaagaagaucggcguguggaagcccguggagagcaaguggaucagcagcagcugcaagaucaucgccuucagaaaggcccugcugaaccccgugaccagcagacaguuccagagauucguggcccugaagggcgaccugcuggagaacggccugcuguucuggcaggaggugcagaaguacaaggaccugugccacagccacugcgacgagagcgugauccagaagaagaucaccaccaucaucaacugcuucaucaacagcagcaucccccccgcccugcagaucgacauccccguggagcaggcccagaagaucaucgagcacagaaaggagcugggccccuacguguucagagaggcccagaugaccaucuucggcgugcuguucaaguucuggccccaguucugcgaguucagaaagaaccugaccgacgagaacaucaugagcgugcuggagagaagacaggaguacaacaagcagaagaagaagcuggccgugcuggaggacgagaagagcggcaaggacggcaucaagcaguacgccaacaccagcgugcccgccaucaagaccgcccugcugagcgacagcuuccugggccugcagcccuacggcagacagcccaccuggugcuacagcaaguacaucgaggcccuggagcaggagagaauccugcugaagauccaggaggagcuggagaagaagcuguucgccggccugcagccccugaccaacuucaaggccagcagcagcaccaugagccugaagaagaacaugagcgcccacagcagccagaaguaa

SEQ ID NO: 22612 - RNA, 636 nt, Artificial Sequence
  RGS2__Homo_sapiens__NP_002914
augcagagcgccauguuccuggccgugcagcacgacugcagacccauggacaagagcgccggcagcggccacaagagcgaggagaagagagagaagaugaagagaacccugcugaaggacuggaagaccagacugagcuacuuccugcagaacagcagcacccccggcaagcccaagaccggcaagaagagcaagcagcaggccuucaucaagcccagccccgaggaggcccagcuguggagcgaggccuucgacgagcugcuggccagcaaguacggccuggccgccuucagagccuuccugaagagcgaguucugcgaggagaacaucgaguucuggcuggccugcgaggacuucaagaagaccaagagcccccagaagcugagcagcaaggccagaaagaucuacaccgacuucaucgagaaggaggcccccaaggagaucaacaucgacuuccagaccaagacccugaucgcccagaacauccaggaggccaccagcggcugcuucaccaccgcccagaagagaguguacagccugauggagaacaacagcuaccccagauuccuggagagcgaguucuaccaggaccugugcaagaagccccagaucaccaccgagccccacgccaccuaa

SEQ ID NO: 22613 - RNA, 1776 nt, Artificial Sequence
  RGS3__Homo_sapiens__NP_001263190
augaacagauucaacggccugugcaaggugugcagcgagagaagauacagacagaucaccauccccagaggcaaggacggcuucggcuucaccaucugcugcgacagccccgugagagugcaggccguggacagcggcggccccgccgagagagccggccugcagcagcuggacaccgugcugcagcugaacgagagacccguggagcacuggaagugcguggagcuggcccacgagaucagaagcugccccagcgagaucauccugcugguguggagaauggugccccaggugaagcccggccccgacggcggcgugcugagaagagccagcugcaagagcacccacgaccugcagagcccccccaacaagagagagaagaacugcacccacggcgugcaggccagacccgagcagagacacagcugccaccuggugugcgacagcagcgacggccugcugcugggcggcugggagagauacaccgagguggccaagagaggcggccagcacacccugcccgcccugagcagagccaccgcccccaccgaccccaacuacaucauccuggccccccugaaccccggcagccagcugcugagacccguguaccaggaggacaccauccccgaggagagcggcagccccagcaagggcaagagcuacaccggccugggcaagaagagcagacugaugaagaccgugcagaccaugaagggccacggcaacuaccagaacugccccguggugagaccccacgccacccacagcagcuacggcaccuacgugacccuggcccccaaggugcugguguuccccguguucgugcagccccuggaccugugcaaccccgccagaacccugcugcugagcgaggagcugcugcuguacgagggcagaaacaaggccgccgaggugacccuguucgccuacagcgaccugcugcuguucaccaaggaggacgagcccggcagaugcgacgugcugagaaacccccuguaccugcagagcgugaagcugcaggagggcagcagcgaggaccugaaguucugcgugcuguaccuggccgagaaggccgagugccuguucacccuggaggcccacagccaggagcagaagaagagagugugcuggugccugagcgagaacaucgccaagcagcagcagcuggccgccagcccccccgacagcaagaugagcggcgccgacaccgugggcgacgacgacgaggccagcagaaagagaaagagcaagaaccuggccaaggacaugaagaacaagcugggcaucuucagaagaagaaacgagagccccggcgccccccccgccggcaaggccgacaagaugaugaagagcuucaagcccaccagcgaggaggcccugaaguggggcgagagccuggagaagcugcuggugcacaaguacggccuggccguguuccaggccuuccugagaaccgaguucagcgaggagaaccuggaguucuggcuggccugcgaggacuucaagaaggugaagagccagagcaagauggccagcaaggccaagaagaucuucgccgaguacaucgccauccaggccugcaaggaggugaaccuggacagcuacaccagagagcacaccaaggacaaccugcagagcgugaccagaggcugcuucgaccuggcccagaagagaaucuucggccugauggagaaggacagcuaccccagauuccugagaagcgaccuguaccuggaccugaucaaccagaagaagaugagccccccccuguaa

SEQ ID NO: 22614 - RNA, 909 nt, Artificial Sequence
  RGS4__Homo_sapiens__NP_001095915
auguacaacaugaugcugcugauccagaagagaaagggcaucggcagccagcugcugagagccggcgaggccgagggcgacagaggcgccggcaccgccgagagaagcagcgacuggcuggacggcagaagcugggccaucaaggagacccccaccggccuggccggcagaagaagcgaggacagcgacaacaucuucaccggcgaggaggccaaguacgcccagagcagaagccacagcagcagcugcagaaucagcuuccugcuggccaacagcaagcugcugaacaagaugugcaagggccuggccggccugcccgccagcugccugagaagcgccaaggacaugaagcacagacugggcuuccugcugcagaagagcgacagcugcgagcacaacagcagccacaacaagaaggacaagguggugaucugccagagagugagccaggaggaggugaagaagugggccgagagccuggagaaccugaucagccacgagugcggccuggccgccuucaaggccuuccugaagagcgaguacagcgaggagaacaucgacuucuggaucagcugcgaggaguacaagaagaucaagagccccagcaagcugagccccaaggccaagaagaucuacaacgaguucaucagcgugcaggccaccaaggaggugaaccuggacagcugcaccagagaggagaccagcagaaacaugcuggagcccaccaucaccugcuucgacgaggcccagaagaagaucuucaaccugauggagaaggacagcuacagaagauuccugaagagcagauucuaccuggaccuggugaaccccagcagcugcggcgccgagaagcagaagggcgccaagagcagcgccgacugcgccagccuggugccccagugcgccuaa

SEQ ID NO: 22615 - RNA, 222 nt, Artificial Sequence
  RGS5__Homo_sapiens__NP_001241677
auggccgagaaggccaagcagaucuacgaggaguucauccagaccgaggcccccaaggaggugaacaucgaccacuucaccaaggacaucaccaugaagaaccugguggagcccagccugagcagcuucgacauggcccagaagagaauccacgcccugauggagaaggacagccugcccagauucgugagaagcgaguucuaccaggagcugaucaaguaa

SEQ ID NO: 22616 - RNA, 1458 nt, Artificial Sequence
  RGS6__Homo_sapiens__NP_001191346
auggcccagggcagcggcgaccagagagccgugggcguggccgaccccgaggagagcagccccaacaugaucguguacugcaagaucgaggacaucaucaccaagaugcaggacgacaagaccggcggcgugcccaucagaaccgugaagagcuuccugagcaagauccccagcguggugaccggcaccgacaucgugcaguggcugaugaagaaccugagcaucgaggaccccguggaggccauccaccugggcagccugaucgccgcccagggcuacaucuuccccaucagcgaccacgugcugaccaugaaggacgacggcaccuucuacagauuccaggcccccuacuucuggcccagcaacugcugggagcccgagaacaccgacuacgccaucuaccugugcaagagaaccaugcagaacaaggccagacuggagcuggccgacuacgaggccgagaaccuggccagacugcagagagccuucgccagaaagugggaguucaucuucaugcaggccgaggcccaggugaagaucgacagaaagaaggacaagaccgagagaaagauccuggacagccaggagagagccuucugggacgugcacagacccgugcccggcugcgugaacaccaccgagauggacaucagaaagugcagaagacugaagaacccccagaaggugaagaagagcguguacggcgugaccgaggagagccaggcccagagccccgugcacgugcugagccagcccaucagaaagaccaccaaggaggacaucagaaagcagaucaccuuccugaacgcccagaucgacagacacugccugaagaugagcaagguggccgagagccugaucgccuacaccgagcaguacguggaguacgacccccugaucacccccgccgagcccagcaaccccuggaucagcgacgacguggcccugugggacaucgagaugagcaaggagcccagccagcagagagugaagagauggggcuucagcuucgacgagauccugaaggaccaggugggcagagaccaguuccugagauuccuggagagcgaguucagcagcgagaaccugagauucuggcuggccgugcaggaccugaagaagcagccccugcaggacguggccaagagaguggaggagaucuggcaggaguuccuggcccccggcgcccccagcgccaucaaccuggacagccacagcuacgagaucaccagccagaacgugaaggacggcggcagauacaccuucgaggacgcccaggagcacaucuacaagcugaugaagagcgacagcuacgccagauuccugagaagcaacgccuaccaggaccugcugcuggccaagaagaagcccgagagcgagcagggcagaagaaccagccuggagaaguucaccagaagcgugcuguacagcaacaccccccuggccaagagacccuaa

SEQ ID NO: 22617 - RNA, 774 nt, Artificial Sequence
  RGS7BP__Homo_sapiens__NP_001025046
augagcagcgcccccaacggcagaaagaagagacccagcagaagcaccagaagcagcaucuuccagaucagcaagcccccccugcagagcggcgacugggagagaagaggcagcggcagcgagagcgcccacaagacccagagagcccuggacgacugcaagaugcuggugcaggaguucaacacccagguggcccuguacagagagcuggugaucagcaucggcgacgugagcgugagcugccccagccugagagccgagaugcacaagaccagaaccaagggcugcgagauggccagacaggcccaccagaagcuggccgccaucagcggccccgaggacggcgagauccaccccgagaucugcagacuguacauccagcugcagugcugccuggagauguacaccaccgagaugcugaagagcaucugccugcugggcagccugcaguuccacagaaagggcaaggagcccggcggcggcaccaagagccuggacugcaagaucgaggagagcgccgagacccccgcccuggaggacagcagcagcagccccguggacagccagcagcacagcuggcaggugagcaccgacaucgagaacaccgagagagacaugagagagaugaagaaccugcugagcaagcugagagagaccaugccccugccccugaagaaccaggacgacagcagccugcugaaccugacccccuacccccuggugagaagaagaaagagaagauucuucggccugugcugccugaucagcagcuaa

SEQ ID NO: 22618 - RNA, 1275 nt, Artificial Sequence
  RGS7__Homo_sapiens__NP_001269702
auggcccagggcaacaacuacggccagaccagcaacggcguggccgacgagagccccaacaugcugguguacagaaagauggaggacgugaucgccagaaugcaggacgagaagaacggcauccccaucagaaccgugaagagcuuccugagcaagauccccagcguguucagcggcagcgacaucgugcaguggcugaucaagaaccugaccaucgaggaccccgccguguaccugugcaagagaaccaugcagaacaaggccagacuggagcuggccgacuacgaggccgagagccuggccagacugcagagagccuucgccagaaagugggaguucaucuucaugcaggccgaggcccaggccaagguggacaagaagagagacaagaucgagagaaagauccuggacagccaggagagagccuucugggacgugcacagacccgugcccggcugcgugaacaccaccgagguggacaucaagaagagcagcagaaugagaaacccccacaagaccagaaagagcguguacggccugcagaacgacaucagaagccacagccccacccacacccccacccccgagaccaagccccccaccgaggacgagcugcagcagcagaucaaguacuggcagauccagcuggacagacacagacugaagaugagcaagguggccgacagccugcugagcuacaccgagcaguaccuggaguacgaccccuuccugcugccccccgaccccagcaaccccuggcugagcgacgacaccaccuucugggagcuggaggccagcaaggagcccagccagcagagagugaagagauggggcuucggcauggacgaggcccugaaggaccccgugggcagagagcaguuccugaaguuccuggagagcgaguucagcagcgagaaccugagauucuggcuggccguggaggaccugaagaagagacccaucaaggaggugcccagcagagugcaggagaucuggcaggaguuccuggcccccggcgcccccagcgccaucaaccuggacagcaagagcuacgacaagaccacccagaacgugaaggagcccggcagauacaccuucgaggacgcccaggagcacaucuacaagcugaugaagagcgacagcuaccccagauucaucagaagcagcgccuaccaggagcugcugcaggccaagaagaagggcagaaacauccccaucuuccccugccacaagaacugcacccccacccugagagccagcaccaaccugcuguaa

SEQ ID NO: 22619 - RNA, 543 nt, Artificial Sequence
  RGS8__Homo_sapiens__XP_005245612
auggccgcccugcugaugcccagaagaaacaagggcaugagaaccagacugggcugccugagccacaagagcgacagcugcagcgacuucaccgccauccugcccgacaagcccaacagagcccugaagagacugagcaccgaggaggccaccagaugggccgacagcuucgacgugcugcugagccacaaguacggcguggccgccuucagagccuuccugaagaccgaguucagcgaggagaaccuggaguucuggcuggccugcgaggaguucaagaagaccagaagcaccgccaagcuggugagcaaggcccacagaaucuucgaggaguucguggacgugcaggcccccagagaggugaacaucgacuuccagaccagagaggccaccagaaagaaccugcaggagcccagccugaccugcuucgaccaggcccagggcaaggugcacagccugauggagaaggacagcuaccccagauuccugagaagcaagauguaccuggaccugcugagccagagccagagaagacugagcuaa

SEQ ID NO: 22620 - RNA, 708 nt, Artificial Sequence
  RGS9BP__Homo_sapiens__NP_997274
auggccagagaggagugcaaggcccugcuggacggccugaacaagaccaccgccugcuaccaccaccuggugcugaccgugggcggcagcgccgacagccagaaccugagacaggagcugcagaagaccagacagaaggcccaggagcuggccgugagcaccugcgccagacugaccgccgugcugagagacagaggccuggccgccgacgagagagccgaguucgagagacuguggguggccuucagcggcugccuggaccugcuggaggccgacaugagaagagcccuggagcugggcgccgccuucccccugcacgcccccagaagaccccuggugagaaccggcguggccggcgccagcagcggcguggccgccagagcccugagcaccagaagccugagacuggaggccgagggcgacuucgacguggccgaccugagagagcuggagagagaggugcugcaggugggcgagaugaucgacaacauggagaugaaggugaacgugcccagauggaccgugcaggccagacaggccgccggcgccgagcugcugagcaccgugagcgccggccccagcagcguggugagccugcaggagagaggcggcggcugcgaccccagaaaggcccuggccgccauccuguucggcgccgugcugcuggccgccguggcccuggccgugugcguggccaagcugagcuaa

SEQ ID NO: 22621 - RNA, 2016 nt, Artificial Sequence
  RGS9__Homo_sapiens__NP_001075424
augaccaucagacaccagggccagcaguacagacccagaauggccuuccugcagaagaucgaggcccuggugaaggacaugcagaaccccgagaccggcgugagaaugcagaaccagagagugcuggugaccagcgugccccacgccaugaccggcagcgacgugcugcaguggaucgugcagagacuguggaucagcagccuggaggcccagaaccugggcaacuucaucgugagauacggcuacaucuacccccugcaggaccccaagaaccugauccugaagcccgacggcagccuguacagauuccagacccccuacuucuggcccacccagcaguggcccgccgaggacaccgacuacgccaucuaccuggccaagagaaacaucaagaagaagggcauccuggaggaguacgagaaggagaacuacaacuuccugaaccagaagaugaacuacaagugggacuucgugaucaugcaggccaaggagcaguacagagccggcaaggagagaaacaaggccgacagauacgcccuggacugccaggagaaggccuacuggcuggugcacagaugcccccccggcauggacaacgugcuggacuacggccuggacagagugaccaaccccaacgaggugaagaagcagaccgugguggccgugaagaaggagaucauguacuaccagcaggcccugaugagaagcaccgugaagagcagcgugagccugggcggcaucgugaaguacagcgagcaguucagcagcaacgacgccaucaugagcggcugccugcccagcaaccccuggaucaccgacgacacccaguucugggaccugaacgccaagcugguggagauccccaccaagaugagaguggagagaugggccuucaacuucagcgagcugaucagagaccccaagggcagacagagcuuccaguacuuccugaagaaggaguucagcggcgagaaccugggcuucugggaggccugcgaggaccugaaguacggcgaccagagcaaggugaaggagaaggccgaggagaucuacaagcuguuccuggcccccggcgccagaagauggaucaacaucgacggcaagaccauggacaucaccgugaagggccugaagcacccccacagauacgugcuggacgccgcccagacccacaucuacaugcugaugaagaaggacagcuacgccagauaccugaagagccccaucuacaaggacaugcuggccaaggccaucgagccccaggagaccaccaagaagagcagcacccugcccuucaugagaagacaccugagaagcagccccagccccgugauccugagacagcuggaggaggaggccaaggccagagaggccgccaacaccguggacaucacccagcccggccagcacauggcccccagcccccaccugaccguguacaccggcaccugcaugccccccagccccagcagccccuucagcagcagcugcagaagccccagaaagcccuucgccagccccagcagauucaucagaagacccagcaccaccaucugccccagccccaucagaguggcccuggagagcagcagcggccuggagcagaagggcgagugcagcggcagcauggcccccagaggccccagcgugaccgagagcagcgaggccagccuggacaccagcuggcccagaagcagacccagagccccccccaaggccagaauggcccugagcuucagcagauuccugagaagaggcugccuggccagccccguguucgccagacugagccccaagugccccgccgugagccacggcagagugcagccccugggcgacgugggccagcagcugcccagacugaagagcaagagaguggccaacuucuuccagaucaagauggacgugcccaccggcagcggcaccugccugauggacagcgaggacgccggcaccggcgagagcggcgacagagccaccgagaaggaggugaucugccccugggagagccuguaa

SEQ ID NO: 22622 - RNA, 3231 nt, Artificial Sequence
  RGSL1__Homo_sapiens__NP_001131141
augagcagcgccgagaucaucggcagcaccaaccugaucauccugcuggaggacgagguguucgccgacuucuucaacaccuuccugagccugcccguguucggccagacccccuucuacaccguggagaacagccaguggagccuguggcccgagauccccugcaaccugaucgccaaguacaagggccugcugaccuggcuggagaagugcagacugcccuucuucugcaagaccaaccugugcuuccacuacauccugugccaggaguucaucagcuucaucaagagccccgagggcggcgaggagcugguggacuucuggauccuggccgagaacauccugagcaucgacgagauggaccuggaggugagagacuacuaccugagccugcugcugaugcugagagccacccaccugcaggagggcagcagaguggugacccugugcaacaugaacaucaagagccugcugaaccugagcaucuggcaccccaaccagagcaccaccagaagagagauccugagccacaugcagaagguggcccuguucaagcugcagagcuacuggcugcccaacuucuacacccacaccaagaugaccauggccaaggaggaggccugccacggccugaugcaggaguacgagaccagacuguacagcgugugcuacacccacaucggcggccugccccugaacaugagcaucaagaagugccaccacuuccagaagagauacagcagcagaaaggccaagagaaagauguggcagcugguggaccccgacagcuggagccuggagauggaccugaagcccgacgccaucggcaugccccugcaggagaccugcccccaggagaagguggugauccagaugcccagccugaagauggccagcagcaaggagaccagaaucagcagccuggagaaggacaugcacuacgccaagaucagcagcauggagaacaaggccaagagccaccugcacauggaggcccccuucgagaccaaggugagcacccaccugagaaccgugauccccaucgugaaccacagcagcaagaugaccauccagaaggccaucaagcagagcuucagccugggcuacauccaccuggcccugugcgccgacgccugcgccggcaaccccuucagagaccaccugaagaagcugaaccugaagguggagauccagcugcuggaccuguggcaggaccugcagcacuuccugagcgugcugcugaacaacaagaagaacggcaacgccaucuucagacaccugcugggcgacagaaucugcgagcuguaccugaacgagcagaucggccccugccugccccugaagagccagaccauccagggccugaaggagcugcugcccagcggcgacgugauccccuggauccccaaggcccagaaggagaucugcaagaugcugagccccugguacgacgaguuccuggacgaggaggacuacugguuccugcuguucaccacccagaacagauucaucagcagcagacagcacaagagagaguucaucggcaaggaggagaacauccugcuguacaagagaauccagcagagccuggagcugagccaggcccuggccgacaugaaggagauggacuacagacaguggagaaagaucgccaccgaggaccugaagcagggcggcagccugcagguggagcugaccagccccguguuccugaccgacaucaccaagaugagcuucgaggagcugugcuacaagaaccccaagauggccauccagaagaucagcgacgacuacaagaucuacugcgagaaggcccccaagaucgacuucaagauggagaucaucaaggagaccaagaccgugagcagaagcaacagaaagaugagccugcugaagagaacccuggugagaaagcccagcaugagacccagaaaccugaccgaggugcugcugaacacccagcaccuggaguucuucagagaguuccugaaggagagaaaggccaagaucccccugcaguuccugaccgccgugcagaagaucagcaucgagaccaacgagaagaucugcaagagccugaucgagaacgugaucaagaccuucuuccagggccagcugagccccgaggagaugcugcagugcgacgcccccaucaucaaggagaucgccagcaugagacacgugaccaccagcacccugcugacccugcagggccacgugaugaagagcaucgaggagaagugguucaaggacuaccaggaccuguuccccccccaccaccaggagguggaggugcagagcgaggugcagaucagcagcagaaagcccagcaagaucgugagcaccuaccugcaggagagccagaagaagggcuggaugagaaugaucagcuucaucagaagcuucugcaaguacagaagauucaugcugaaccccagcaagagacaggaguucgaggacuaccugcaccaggagaugcagaacagcaaggagaacuucaccaccgcccacaacaccagcggcagaagcgccccccccagcaccaacgugagaagcgccgaccaggagaacggcgagaucacccuggugaagagaagaaucuucggccacagaaucaucaccgugaacuucgccaucaacgaccuguacuucuucagcgagauggagaaguucaacgaccuggugagcagcgcccacaugcugcaggugaacagagccuacaacgagaacgacgugauccugaugagaagcaagaugaacaucauccagaagcuguuccugaacagcgacaucccccccaagcugagagugaacgugcccgaguuccagaaggacgccauccuggccgccaucaccgagggcuaccuggacagaagcguguuccacggcgccaucaugagcguguuccccguggugauguacuucuggaagagauucugcuucuggaaggccaccagaagcuaccugcaguacagaggcaagaaguucaaggacagaaagagcccccccaagagcaccgacaaguaccccuucagcagcggcggcgacaacgccauccugagauucacccugcugagaggcaucgaguggcugcagccccagagagaggccaucagcagcgugcagaacagcagcagcagcaagcugacccagcccagacugguggugagcgccaugcagcugcaccccgugcagggccagaagcugagcuacaucaagaaggagaaguaa

SEQ ID NO: 22623 - RNA, 1230 nt, Artificial Sequence
  RHAG__Homo_sapiens__NP_000315
augagauucaccuucccccugauggccaucgugcuggagaucgccaugaucgugcuguucggccuguucguggaguacgagaccgaccagaccgugcuggagcagcugaacaucaccaagcccaccgacaugggcaucuucuucgagcuguacccccuguuccaggacgugcacgugaugaucuucgugggcuucggcuuccugaugaccuuccugaagaaguacggcuucagcagcgugggcaucaaccugcugguggccgcccugggccugcaguggggcaccaucgugcagggcauccugcagagccagggccagaaguucaacaucggcaucaagaacaugaucaacgccgacuucagcgccgccaccgugcugaucagcuucggcgccgugcugggcaagaccagccccacccagaugcugaucaugaccauccuggagaucguguucuucgcccacaacgaguaccuggugagcgagaucuucaaggccagcgacaucggcgccagcaugaccauccacgccuucggcgccuacuucggccuggccguggccggcauccuguacagaagcggccugagaaagggccacgagaacgaggagagcgccuacuacagcgaccuguucgccaugaucggcacccuguuccuguggauguucuggcccagcuucaacagcgccaucgccgagcccggcgacaagcagugcagagccaucgugaacaccuacuucagccuggccgccugcgugcugaccgccuucgccuucagcagccugguggagcacagaggcaagcugaacauggugcacauccagaacgccacccuggccggcggcguggccgugggcaccugcgccgacauggccauccaccccuucggcagcaugaucaucggcagcaucgccggcauggugagcgugcugggcuacaaguuccugaccccccuguucaccaccaagcugagaauccacgacaccugcggcgugcacaaccugcacggccugcccggcguggugggcggccuggccggcaucguggccguggccaugggcgccagcaacaccagcauggccaugcaggccgccgcccugggcagcagcaucggcaccgccguggugggcggccugaugaccggccugauccugaagcugccccuguggggccagcccagcgaccagaacugcuacgacgacagcguguacuggaaggugcccaagaccagauaa

SEQ ID NO: 22624 - RNA, 1095 nt, Artificial Sequence
  RHBDD2__Homo_sapiens__NP_001035546
auggccgccagcggccccggcugcagaagcuggugccugugccccgaggugcccagcgccaccuucuucaccgcccugcugagccugcuggugagcggccccagacuguuccugcugcagcagccccuggcccccagcggccugacccugaagagcgaggcccugagaaacuggcagguguacagacuggugaccuacaucuucguguacgagaaccccaucagccugcugugcggcgccaucaucaucuggagauucgccggcaacuucgagagaaccgugggcaccgugagacacugcuucuucaccgugaucuucgccaucuucagcgccaucaucuuccugagcuucgaggccgugagcagccugagcaagcugggcgagguggaggacgccagaggcuucacccccguggccuucgccaugcugggcgugaccaccgugagaagcagaaugagaagagcccugguguucggcaugguggugcccagcgugcuggugcccuggcugcugcugggcgccagcuggcugaucccccagaccagcuuccugagcaacgugugcggccugagcaucggccuggccuacggccugaccuacugcuacagcaucgaccugagcgagagaguggcccugaagcuggaccagaccuuccccuucagccugaugagaagaaucagcguguucaaguacgugagcggcagcagcgccgagagaagagccgcccagagcagaaagcugaaccccgugcccggcagcuaccccacccagagcugccacccccaccugagccccagccaccccgugagccagacccagcacgccagcggccagaagcuggccagcuggcccagcugcacccccggccacaugcccacccugccccccuaccagcccgccagcggccugugcuacgugcagaaccacuucggccccaaccccaccagcagcagcguguaccccgccagcgccggcaccagccugggcauccagccccccacccccgugaacagccccggcaccguguacagcggcgcccugggcacccccggcgccgccggcagcaaggagagcagcagagugcccaugcccuaa

SEQ ID NO: 22625 - RNA, 1161 nt, Artificial Sequence
  RHBDD3__Homo_sapiens__NP_036397
augcacgccagaggcccccacggccagcugagccccgcccugccccuggccagcagcgugcugaugcugcugaugagcacccuguggcuggugggcgccggccccggccuggugcuggcccccgagcugcugcuggaccccuggcaggugcacagacugcugacccacgcccugggccacaccgcccugcccggccugcugcugagccugcugcugcugcccaccgugggcuggcagcaggagugccaccugggcacccugagauuccugcacgccagcgcccugcuggcccuggccagcggccugcuggccgugcugcuggccggccugggccugagcagcgccgccggcagcugcggcuacaugcccgugcaccuggccaugcuggccggcgagggccacagacccagaagacccagaggcgcccugccccccuggcugagccccuggcugcugcuggcccugaccccccugcugagcagcgagccccccuuccugcagcugcugugcggccugcuggccggccuggccuacgccgccggcgccuucagauggcuggagcccagcgagagaagacugcaggugcugcaggagggcgugcugugcagaacccuggccggcugcuggccccugagacugcuggccacccccggcagccuggccgagcugcccgugacccaccccgccggcgugagaccccccauccccggcccccccuacguggccagccccgaccuguggagccacugggaggacagcgcccugcccccccccagccugagacccgugcagcccaccugggagggcagcagcgaggccggccuggacugggccggcgccagcuucagccccggcacccccaugugggccgcccuggacgagcagaugcugcaggagggcauccaggccagccugcuggacggccccgcccaggagccccagagcgcccccuggcugagcaagagcagcgugagcagccugagacugcagcagcuggagagaaugggcuuccccaccgagcaggccgugguggcccuggccgccaccggcagaguggagggcgccgugagccugcuggugggcggccaggugggcaccgagacccuggugacccacggcaagggcggccccgcccacagcgagggccccggcccccccuaa

SEQ ID NO: 22626 - RNA, 2568 nt, Artificial Sequence
  RHBDF1__Homo_sapiens__NP_071895
augagcgaggccagaagagacagcaccagcagccugcagagaaagaagccccccuggcugaagcuggacauccccagcgccgugccccugaccgccgaggagcccagcuuccugcagccccugagaagacaggccuuccugagaagcgugagcaugcccgccgagaccgcccacaucagcagcccccaccacgagcugagaagacccgugcugcagagacagaccagcaucacccagaccaucagaagaggcaccgccgacugguucggcgugagcaaggacagcgacagcacccagaaguggcagagaaagagcaucagacacugcagccagagauacggcaagcugaagccccaggugcugagagagcuggaccugcccagccaggacaacgugagccugaccagcaccgagaccccccccccccuguacgugggccccugccagcugggcaugcagaagaucaucgacccccuggccagaggcagagccuucagaguggccgacgacaccgccgagggccugagcgccccccacacccccgugacccccggcgccgccagccugugcagcuucagcagcagcagaagcggcuuccacagacugcccagaagaagaaagagagagagcguggccaagaugagcuucagagccgccgccgcccugaugaagggcagaagcgugagagacggcaccuucagaagagcccagagaagaagcuucacccccgccagcuuccuggaggaggacaccaccgacuuccccgacgagcuggacaccagcuucuucgccagagagggcauccugcacgaggagcugagcaccuaccccgacgagguguucgagagccccagcgaggccgcccugaaggacugggagaaggcccccgagcaggccgaccugaccggcggcgcccuggacagaagcgagcuggagagaagccaccugaugcugccccuggagagaggcuggagaaagcagaaggagggcgccgccgccccccagcccaaggugagacugagacaggagguggugagcaccgccggccccagaagaggccagagaaucgccgugcccgugagaaagcuguucgccagagagaagagacccuacggccugggcauggugggcagacugaccaacagaaccuacagaaagagaaucgacagcuucgugaagagacagaucgaggacauggacgaccacagacccuucuucaccuacuggcugaccuucgugcacagccuggugaccauccuggccgugugcaucuacggcaucgcccccgugggcuucagccagcacgagaccguggacagcgugcugagaaacagaggcguguacgagaacgugaaguacgugcagcaggagaacuucuggaucggccccagcagcgaggcccugauccaccugggcgccaaguucagccccugcaugagacaggacccccaggugcacagcuucaucagaagcgccagagagagagagaagcacagcgccugcugcgugagaaacgacagaagcggcugcgugcagaccagcgaggaggagugcagcagcacccuggccgugugggugaaguggcccauccaccccagcgcccccgagcuggccggccacaagagacaguucggcagcgugugccaccaggaccccagagugugcgacgagcccagcagcgaggacccccacgaguggcccgaggacaucaccaaguggcccaucugcaccaagaacagcgccggcaaccacaccaaccacccccacauggacugcgugaucaccggcagacccugcugcaucggcaccaagggcagaugcgagaucaccagcagagaguacugcgacuucaugagaggcuacuuccacgaggaggccacccugugcagccaggugcacugcauggacgacgugugcggccugcugcccuuccugaaccccgaggugcccgaccaguucuacagacuguggcugagccuguuccugcacgccggcauccugcacugccuggugagcaucugcuuccagaugaccgugcugagagaccuggagaagcuggccggcuggcacagaaucgccaucaucuaccugcugagcggcgugaccggcaaccuggccagcgccaucuuccugcccuacagagccgaggugggccccgccggcagccaguucggcauccuggccugccuguucguggagcuguuccagagcuggcagauccuggccagacccuggagagccuucuucaagcugcuggccguggugcuguuccuguucaccuucggccugcugcccuggaucgacaacuucgcccacaucagcggcuucaucagcggccuguuccugagcuucgccuuccugcccuacaucagcuucggcaaguucgaccuguacagaaagagaugccagaucaucaucuuccaggugguguuccugggccugcuggccggccugguggugcuguucuacguguaccccgugagaugcgaguggugcgaguuccugaccugcauccccuucaccgacaaguucugcgagaaguacgagcuggacgcccagcugcacuaa

SEQ ID NO: 22627 - RNA, 2484 nt, Artificial Sequence
  RHBDF2__Homo_sapiens__NP_001005498
auggccagcgccgacaagaacggcggcagcgugagcagcgugagcagcagcagacugcagagcagaaagccccccaaccugagcaucaccauccccccccccgagaaggagacccaggcccccggcgagcaggacagcaugcugcccgagagaaagaaccccgccuaccugaagagcgugagccugcaggagcccagaagcagauggcaggagagcagcgagaagagacccggcuucagaagacaggccagccugagccagagcaucagaaagggcgccgcccagugguucggcgugagcggcgacugggagggccagagacagcaguggcagagaagaagccugcaccacugcagcaugagauacggcagacugaaggccagcugccagagagaccuggagcugcccagccaggaggcccccagcuuccagggcaccgagagccccaagcccugcaagaugcccaagaucguggacccccuggccagaggcagagccuucagacaccccgaggagauggacagaccccacgccccccaccccccccugacccccggcgugcugagccugaccagcuucaccagcgugagaagcggcuacagccaccugcccagaagaaagagaaugagcguggcccacaugagccugcaggccgccgccgcccugcugaagggcagaagcgugcuggacgccaccggccagagaugcagaguggugaagagaagcuucgccuuccccagcuuccuggaggaggacgugguggacggcgccgacaccuucgacagcagcuucuucagcaaggaggagaugagcagcaugcccgacgacguguucgagagccccccccugagcgccagcuacuucagaggcaucccccacagcgccagccccgugagccccgacggcgugcagaucccccugaaggaguacggcagagcccccgugcccggccccagaagaggcaagagaaucgccagcaaggugaagcacuucgccuucgacagaaagaagagacacuacggccugggcguggugggcaacuggcugaacagaagcuacagaagaagcaucagcagcaccgugcagagacagcuggagagcuucgacagccacagacccuacuucaccuacuggcugaccuucgugcacgugaucaucacccugcuggugaucugcaccuacggcaucgcccccgugggcuucgcccagcacgugaccacccagcuggugcugagaaacaagggcguguacgagagcgugaaguacauccagcaggagaacuucugggugggccccagcagcaucgaccugauccaccugggcgccaaguucagccccugcaucagaaaggacggccagaucgagcagcuggugcugagagagagagaccuggagagagacagcggcugcugcgugcagaacgaccacagcggcugcauccagacccagagaaaggacugcagcgagacccuggccaccuucgugaaguggcaggacgacaccggcccccccauggacaagagcgaccugggccagaagagaaccagcggcgccgugugccaccaggaccccagaaccugcgaggagcccgccagcagcggcgcccacaucuggcccgacgacaucaccaaguggcccaucugcaccgagcaggccagaagcaaccacaccggcuuccugcacauggacugcgagaucaagggcagacccugcugcaucggcaccaagggcagcugcgagaucaccaccagagaguacugcgaguucaugcacggcuacuuccacgaggaggccacccugugcagccaggugcacugccuggacaaggugugcggccugcugcccuuccugaaccccgaggugcccgaccaguucuacagacuguggcugagccuguuccugcacgccggcguggugcacugccuggugagcgugguguuccagaugaccauccugagagaccuggagaagcuggccggcuggcacagaaucgccaucaucuucauccugagcggcaucaccggcaaccuggccagcgccaucuuccugcccuacagagccgaggugggccccgccggcagccaguucggccugcuggccugccuguucguggagcuguuccagagcuggccccugcuggagagacccuggaaggccuuccugaaccugagcgccaucgugcuguuccuguucaucugcggccugcugcccuggaucgacaacaucgcccacaucuucggcuuccugagcggccugcugcuggccuucgccuuccugcccuacaucaccuucggcaccagcgacaaguacagaaagagagcccugauccuggugagccugcuggccuucgccggccuguucgccgcccuggugcuguggcuguacaucuaccccaucaacuggcccuggaucgagcaccugaccugcuuccccuucaccagcagauucugcgagaaguacgagcuggaccaggugcugcacuaa

SEQ ID NO: 22628 - RNA, 1122 nt, Artificial Sequence
  RHBDL1__Homo_sapiens__NP_001265649
auggacagaagcagccugcugcagcugauccaggagcagcagcuggaccccgagaacaccggcuucaucggcgccgacaccuucaccggccuggugcacagccacgagcugccccuggaccccgccaagcuggacaugcugguggcccuggcccagagcaacgagcagggccaggugugcuaccaggagcugguggaccugaucagcagcaagagaagcagcagcuucaagagagccaucgccaacggccagagagcccugcccagagacggcccccuggacgagcccggccugggcguguacaagagauucgugagauacguggccuacgagauccugcccugcgagguggacagaagaugguacuucuacagacacagaagcugccccccccccguguucauggccagcgugacccuggcccagaucaucguguuccugugcuacggcgccagacugaacaagugggugcugcagaccuaccaccccgaguacaugaagagcccccugguguaccaccccggccacagagccagagccuggagauuccugaccuacauguucaugcacgugggccuggagcagcugggcuucaacgcccugcugcagcugaugaucggcgugccccuggagauggugcacggccugcugagaaucagccugcuguaccuggccggcgugcuggccggcagccugaccgugagcaucaccgacaugagagcccccguggugggcggcagcggcggcguguacgcccugugcagcgcccaccuggccaacguggugaugaacugggccggcaugagaugccccuacaagcugcugagaauggugcuggcccuggugugcaugagcagcgaggugggcagagccguguggcugagauucagccccccccugcccgccagcggcccccagcccagcuucauggcccaccuggccggcgccguggugggcgugagcaugggccugaccauccugagaagcuacgaggagagacugagagaccagugcggcugguggguggugcugcuggccuacggcaccuuccugcuguucgccguguucuggaacguguucgccuacgaccugcugggcgcccacaucccccccccccccuaa

SEQ ID NO: 22629 - RNA, 1152 nt, Artificial Sequence
  RHBDL2__Homo_sapiens__NP_001291675
augcagcugggcaagagacacaagcugaccaccaagagcgugugccacggcaagggcguggugaucagagugcuggcccugcccggccccagcugggugagaagaagaagagagggcaaggcccuggagagcagcagaugcgccagacagcccagagaggagagacagcccgaggaccugggcccccccgccgugcccugggacagcugccccagcggcgaggagggcggccccagaaccauggccgccgugcacgaccuggagauggagagcaugaaccugaacaugggcagagagaugaaggaggagcuggaggaggaggagaagaugagagaggacggcggcggcaaggacagagccaagagcaagaaggugcacagaaucgugagcaaguggaugcugcccgagaagagcagaggcaccuaccuggagagagccaacugcuuccccccccccguguucaucaucagcaucagccuggccgagcuggccguguucaucuacuacgccguguggaagccccagaagcaguggaucacccuggacaccggcauccuggagagccccuucaucuacagccccgagaagagagaggaggccuggagauucaucagcuacaugcuggugcacgccggcgugcagcacauccugggcaaccugugcaugcagcuggugcugggcaucccccuggagauggugcacaagggccugagagugggccugguguaccuggccggcgugaucgccggcagccuggccagcagcaucuucgacccccugagauaccuggugggcgccagcggcggcguguacgcccugaugggcggcuacuucaugaacgugcuggugaacuuccaggagaugauccccgccuucggcaucuucagacugcugaucaucauccugaucaucgugcuggacaugggcuucgcccuguacagaagauucuucgugcccgaggacggcagccccgugagcuucgccgcccacaucgccggcggcuucgccggcaugagcaucggcuacaccguguucagcugcuucgacaaggcccugcugaaggaccccagauucuggaucgccaucgccgccuaccuggccugcgugcuguucgccguguucuucaacaucuuccugagccccgccaacuaa

SEQ ID NO: 22630 - RNA, 1125 nt, Artificial Sequence
  RHCE__Homo_sapiens__XP_011540191
augcccggcaccgugcuggugggccaggaccugaccgugauggccgcccugggccugggcuuccugaccagcaacuucagaagacacagcuggagcagcguggccuucaaccuguucaugcuggcccugggcgugcagugggccauccugcuggacggcuuccugagccaguucccccccggcaagguggugaucacccuguucagcaucagacuggccaccaugagcgccaugagcgugcugaucagcgccggcgccgugcugggcaaggugaaccuggcccagcugguggugauggugcugguggaggugaccgcccugggcacccugagaauggugaucagcaacaucuucaacaccgacuaccacaugaaccugagacacuucuacguguucgccgccuacuucggccugaccguggccuggugccugcccaagccccugcccaagggcaccgaggacaacgaccagagagccaccauccccagccugagcgccaugcugggcgcccuguuccuguggauguucuggcccagcgugaacagcgcccugcugagaagccccauccagagaaagaacgccauguucaacaccuacuacgcccuggccgugagcguggugaccgccaucagcggcagcagccuggcccacccccagagaaagaucagcaugaccuacgugcacagcgccgugcuggccggcggcguggccgugggcaccagcugccaccugauccccagccccuggcuggccauggugcugggccugguggccggccugaucagcaucggcggcgccaagugccugcccgugugcugcaacagagugcugggcauccaccacaucagcgugaugcacagcaucuucagccugcugggccugcugggcgagaucaccuacaucgugcugcuggugcugcacaccguguggaacggcaacggcaugaucggcuuccaggugcugcugagcaucggcgagcugagccuggccaucgugaucgcccugaccagcggccugcugaccggccugcugcugaaccugaagaucuggaaggccccccacguggccaaguacuucgacgaccagguguucuggaaguucccccaccuggccgugggcuucuaa

SEQ ID NO: 22631 - RNA, 1440 nt, Artificial Sequence
  RHCG__Homo_sapiens__XP_011519965
auggccuggaacaccaaccugagauggagacugccccugaccugccugcugcugcaggugaucauggugauccuguucggcguguucgugagauacgacuucgaggccgacgcccacugguggagcgagagaacccacaagaaccugagcgacauggagaacgaguucuacuacagauaccccagcuuccaggacgugcacgugaugguguucgugggcuucggcuuccugaugaccuuccugcagagauacggcuucagcgccgugggcuucaacuuccugcuggccgccuucggcauccagugggcccugcugaugcagggcugguuccacuuccugcaggacagauacaucguggugggcguggagaaccugaucaacgccgacuucugcguggccagcgugugcguggccuucggcgccgugcugggcaaggugagccccauccagcugcugaucaugaccuucuuccaggugacccuguucgccgugaacgaguucauccugcugaaccugcugaaggugaaggacgccggcggcagcaugaccauccacaccuucggcgccuacuucggccugaccgugaccagaauccuguacagaagaaaccuggagcagagcaaggagagacagaacagcguguaccagagcgaccuguucgccaugaucggcacccuguuccuguggauguacuggcccagcuucaacagcgccaucagcuaccacggcgacagccagcacagagccgccaucaacaccuacugcagccuggccgccugcgugcugaccagcguggccaucagcagcgcccugcacaagaagggcaagcuggacauggugcacauccagaacgccacccuggccggcggcguggccgugggcaccgccgccgagaugaugcugaugcccuacggcgcccugaucaucggcuucgugugcggcaucaucagcacccugggcuucguguaccugacccccuuccuggagagcagacugcacauccaggacaccugcggcaucaacaaccugcacggcauccccggcaucaucggcggcaucgugggcgccgugaccgccgccagcgccagccuggagguguacggcaaggagggccuggugcacagcuucgacuuccagggcuucaacggcgacuggaccgccagaacccagggcaaguuccagaucuacggccugcuggugacccuggccauggcccugaugggcggcaucaucgugggccugauccugagacugcccuucuggggccagcccagcgacgagaacugcuucgaggacgccguguacugggagaugcccgagggcaacagcaccguguacauccccgaggaccccaccuucaagcccagcggccccagcgugcccagcgugcccauggugagcccccugcccauggccagcagcgugccccuggugcccuaa

SEQ ID NO: 22632 - RNA, 555 nt, Artificial Sequence
  RHEB__Homo_sapiens__NP_005605
augccccagagcaagagcagaaagaucgccauccugggcuacagaagcgugggcaagagcagccugaccauccaguucguggagggccaguucguggacagcuacgaccccaccaucgagaacaccuucaccaagcugaucaccgugaacggccaggaguaccaccugcagcugguggacaccgccggccaggacgaguacagcaucuucccccagaccuacagcaucgacaucaacggcuacauccugguguacagcgugaccagcaucaagagcuucgaggugaucaaggugauccacggcaagcugcuggacauggugggcaaggugcagauccccaucaugcuggugggcaacaagaaggaccugcacauggagagagugaucagcuacgaggagggcaaggcccuggccgagagcuggaacgccgccuuccuggagagcagcgccaaggagaaccagaccgccguggacguguucagaagaaucauccuggaggccgagaagauggacggcgccgccagccagggcaagagcagcugcagcgugauguaa

SEQ ID NO: 22633 - RNA, 552 nt, Artificial Sequence
  RHEBL1__Homo_sapiens__NP_653194
augccccuggugagauacagaaagguggugauccugggcuacagaugcgugggcaagaccagccuggcccaccaguucguggagggcgaguucagcgagggcuacgaccccaccguggagaacaccuacagcaagaucgugacccugggcaaggacgaguuccaccugcaccugguggacaccgccggccaggacgaguacagcauccugcccuacagcuucaucaucggcgugcacggcuacgugcugguguacagcgugaccagccugcacagcuuccaggugaucgagagccuguaccagaagcugcacgagggccacggcaagaccagagugcccguggugcuggugggcaacaaggccgaccugagccccgagagagaggugcaggccguggagggcaagaagcuggccgagagcuggggcgccaccuucauggagagcagcgccagagagaaccagcugacccagggcaucuucaccaaggugauccaggagaucgccagaguggagaacagcuacggccaggagagaagaugccaccugauguaa

SEQ ID NO: 22634 - RNA, 717 nt, Artificial Sequence
  RHNO1__Homo_sapiens__NP_001239428
augccccccagaaagaagagaagacagcccagccagaaggccccccugcuguuccaccagcagccccuggagggccccaagcacagcugcgccagcacccagcugcccaucacccacaccagacaggugcccagcaagcccaucgaccacagcaccaucaccagcugggugagccccgacuucgacaccgccgccggcagccuguuccccgccuaccagaagcaccagaacagagccagacacagcagcagaaagcccaccaccagcaaguucccccaccugaccuucgagagcccccagagcagcagcagcgagacccugggcaucccccugaucagagagugccccagcgagagcgagaaggacgugagcagaagaccccuggugcccgugcugagcccccagagcugcggcaacaugagcgugcaggcccugcagagccugcccuacguguucaucccccccgacauccagacccccgagagcagcagcgugaaggaggagcugaucccccaggaccagaaggagaacagccugcugagcugcacccugcacaccggcacccccaacagccccgagcccggccccgugcuggugaaggacacccccgaggacaaguacggcaucaaggugaccuggagaagaagacagcaccugcuggccuaccugagagagagaggcaagcugagcagaagccaguuccuggugaagagcuaa

SEQ ID NO: 22635 - RNA, 591 nt, Artificial Sequence
  RHOB__Homo_sapiens__NP_004031
auggccgccaucagaaagaagcuggugguggugggcgacggcgccugcggcaagaccugccugcugaucguguucagcaaggacgaguuccccgagguguacgugcccaccguguucgagaacuacguggccgacaucgagguggacggcaagcagguggagcuggcccugugggacaccgccggccaggaggacuacgacagacugagaccccugagcuaccccgacaccgacgugauccugaugugcuucagcguggacagccccgacagccuggagaacauccccgagaagugggugcccgaggugaagcacuucugccccaacgugcccaucauccugguggccaacaagaaggaccugagaagcgacgagcacgugagaaccgagcuggccagaaugaagcaggagcccgugagaaccgacgacggcagagccauggccgugagaauccaggccuacgacuaccuggagugcagcgccaagaccaaggagggcgugagagagguguucgagaccgccaccagagccgcccugcagaagagauacggcagccagaacggcugcaucaacugcugcaaggugcuguaa

SEQ ID NO: 22636 - RNA, 2091 nt, Artificial Sequence
  RHOBTB1__Homo_sapiens__XP_011538726
auggacgccgacauggacuacgagagacccaacguggagaccaucaagugcgugguggugggcgacaacgccgugggcaagaccagacugaucugcgccagagccugcaacaccacccugacccaguaccagcugcuggccacccacgugcccaccgugugggccaucgaccaguacagagugugccaggaggugcuggagagaagcagagacgugguggacgaggugagcgugagccugagacugugggacaccuucggcgaccaccacaaggacagaagauucgccuacggcagaagcgacgugguggugcugugcuucagcaucgccaaccccaacagccugaaccacgugaagagcaugugguaccccgagaucaagcacuucugccccagaacccccgugauccuggugggcugccagcuggaccugagauacgccgaccuggaggccgugaacagagccagaagaccccuggccagacccaucaagagaggcgacauccugccccccgagaagggcagagagguggccaaggagcugggccugcccuacuacgagaccagcguguucgaccaguucggcaucaaggacguguucgacaacgccaucagagccgcccugaucagcagaagacaccugcaguucuggaagagccaccugaagaaggugcagaagccccugcugcaggcccccuuccugccccccaaggcccccccccccgugaucaagauccccgagugccccagcaugggcaccaacgaggccgccugccugcuggacaacccccugugcgccgacgugcuguucauccugcaggaccaggagcacaucuucgcccacagaaucuaccuggccaccagcagcagcaaguucuacgaccuguuccugauggagugcgaggagagccccaacggcagcgagggcgccugcgagaaggagaagcagagcagagacuuccagggcagaauccugagcguggaccccgaggaggagagagaggagggcccccccagaaucccccaggccgaccaguggaagagcagcaacaagagccugguggaggcccugggccuggaggccgagggcgccgugcccgagacccagacccugaccggcuggagcaagggcuucaucggcaugcacagagagaugcaggugaaccccaucagcaagagaaugggccccaugaccguggugagaauggacgccagcgugcagcccggccccuucagaacccugcugcaguuccuguacaccggccagcuggacgagaaggagaaggaccuggugggccuggcccagaucgccgaggugcuggagauguucgaccugagaaugaugguggagaacaucaugaacaaggaggccuucaugaaccaggagaucaccaaggccuuccacgugagaaaggccaacagaaucaaggagugccugagcaagggcaccuucagcgacgugaccuucaagcuggacgacggcgccaucagcgcccacaagccccugcugaucugcagcugcgaguggauggccgccauguucggcggcagcuucguggagagcgccaacagcgagguguaccugcccaacaucaacaagaucagcaugcaggccgugcuggacuaccuguacaccaagcagcugagccccaaccuggaccuggacccccuggagcugaucgcccuggccaacagauucugccugccccaccugguggcccuggccgagcagcacgccgugcaggagcugaccaaggccgccaccagcggcgugggcaucgacggcgaggugcugagcuaccuggagcuggcccaguuccacaacgcccaccagcuggccgccuggugccugcaccacaucugcaccaacuacaacagcgugugcagcaaguucagaaaggagaucaagagcaagagcgccgacaaccaggaguacuucgagagacacagauggccccccgugugguaccugaaggaggaggaccacuaccagagagugaagagagagagagagaaggaggacaucgcccugaacaagcacagaagcagaagaaaguggugcuucuggaacagcagccccgccguggccuaa

SEQ ID NO: 22637 - RNA, 2250 nt, Artificial Sequence
  RHOBTB2__Homo_sapiens__NP_001153508
augcaggccuggagaaagggccccgacggcccccagaagaccagcagcgacagcaugagcagacugauggacagcgacauggacuacgagagacccaacguggagaccaucaagugcgugguggugggcgacaacgccgugggcaagaccagacugaucugcgccagagccugcaacgccacccugacccaguaccagcugcuggccacccacgugcccaccgugugggccaucgaccaguacagagugugccaggaggugcuggagagaagcagagacgugguggacgacgugagcgugagccugagacugugggacaccuucggcgaccaccacaaggacagaagauucgccuacggcagaagcgacgugguggugcugugcuucagcaucgccaaccccaacagccugcaccacgugaagaccaugugguaccccgagaucaagcacuucugccccagagcccccgugauccuggugggcugccagcuggaccugagauacgccgaccuggaggccgugaacagagccagaagaccccuggccagacccaucaagcccaacgagauccugccccccgagaagggcagagagguggccaaggagcugggcauccccuacuacgagaccagcgugguggcccaguucggcaucaaggacguguucgacaacgccaucagagccgcccugaucagcagaagacaccugcaguucuggaagagccaccugagaaacgugcagagaccccugcugcaggcccccuuccugccccccaagccccccccccccaucaucguggugcccgacccccccagcagcagcgaggagugccccgcccaccugcuggaggacccccugugcgccgacgugauccuggugcugcaggagagagugagaaucuucgcccacaagaucuaccugagcaccagcagcagcaaguucuacgaccuguuccugauggaccugagcgagggcgagcugggcggccccagcgagcccggcggcacccaccccgaggaccaccagggccacagcgaccagcaccaccaccaccaccaccaccaccacggcagagacuuccugcugagagccgccagcuucgacgugugcgagagcguggacgaggccggcggcagcggccccgccggccugagagccagcaccagcgacggcauccugagaggcaacggcaccggcuaccugcccggcagaggcagagugcugagcagcuggagcagagccuucgugagcauccaggaggagauggccgaggacccccugaccuacaagagcagacugauggugguggugaagauggacagcagcauccagcccggccccuucagagccgugcugaaguaccuguacaccggcgagcuggacgagaacgagagagaccugaugcacaucgcccacaucgccgagcugcuggagguguucgaccugagaaugaugguggccaacauccugaacaacgaggccuucaugaaccaggagaucaccaaggccuuccacgugagaagaaccaacagagugaaggagugccuggccaagggcaccuucagcgacgugaccuucauccuggacgacggcaccaucagcgcccacaagccccugcugaucagcagcugcgacuggauggccgccauguucggcggccccuucguggagagcagcaccagagaggugguguuccccuacaccagcaagagcugcaugagagccgugcuggaguaccuguacaccggcauguucaccagcagccccgaccuggacgacaugaagcugaucauccuggccaacagacugugccugccccaccugguggcccugaccgagcaguacaccgugaccggccugauggaggccacccagaugaugguggacaucgacggcgacgugcugguguuccuggagcuggcccaguuccacugcgccuaccagcuggccgacuggugccugcaccacaucugcaccaacuacaacaacgugugcagaaaguuccccagagacaugaaggccaugagccccgagaaccaggaguacuucgagaagcacagauggccccccgugugguaccugaaggaggaggaccacuaccagagagccagaaaggagagagagaaggaggacuaccugcaccugaagagacagcccaagagaagauggcuguucuggaacagccccagcagccccagcagcagcgccgccagcagcagcagccccagcagcagcagcgccgugguguaa

SEQ ID NO: 22638 - RNA, 1836 nt, Artificial Sequence
  RHOBTB3__Homo_sapiens__NP_055714
augagcauccacaucguggcccugggcaacgagggcgacaccuuccaccaggacaacagacccagcggccugaucagaaccuaccugggcagaagcccccuggugagcggcgacgagagcagccugcugcugaacgccgccagcaccguggccagacccguguucaccgaguaccaggccagcgccuucggcaacgugaagcugguggugcacgacugccccgugugggacaucuucgacagcgacugguacaccagcagaaaccugaucggcggcgccgacaucaucgugaucaaguacaacgugaacgacaaguucagcuuccacgaggugaaggacaacuacauccccgugaucaagagagcccugaacagcgugcccgugaucaucgccgccgugggcaccagacagaacgaggagcugcccugcaccugcccccugugcaccagcgacagaggcagcugcgugagcaccaccgagggcauccagcuggccaaggagcugggcgccaccuaccuggagcugcacagccuggacgacuucuacaucggcaaguacuucggcggcgugcuggaguacuucaugauccaggcccugaaccagaagaccagcgagaagaugaagaagagaaagaugagcaacagcuuccacggcaucagacccccccagcuggagcagcccgagaagaugcccgugcugaaggccgaggccagccacuacaacagcgaccugaacaaccugcuguucugcugccagugcguggacgugguguucuacaaccccaaccugaagaaggugguggaggcccacaagaucgugcugugcgccgugagccacguguucaugcugcuguucaacgugaagagccccaccgacauccaggacagcagcaucaucagaaccacccaggaccuguucgccaucaacagagacaccgccuuccccggcgccagccacgagagcagcggcaaccccccccugagagugaucgugaaggacgcccuguucugcagcugccugagcgacauccugagauucaucuacagcggcgccuuccagugggaggagcuggaggaggacaucagaaagaagcugaaggacagcggcgacgugagcaacgugaucgagaaggugaagugcauccugaagacccccggcaagaucaacugccugagaaacugcaagaccuaccaggccagaaagccccugugguucuacaacaccagccugaaguucuuccugaacaagcccaugcuggccgacgugguguucgagauccagggcaccaccgugcccgcccacagagccauccugguggccagaugcgaggugauggccgccauguucaacggcaacuacauggaggccaagagcgugcugauccccguguacggcgugagcaaggagaccuuccugagcuuccuggaguaccuguacaccgacagcugcugccccgccggcaucuuccaggccaugugccugcugaucugcgccgagauguaccaggugagcagacugcagcacaucugcgagcuguucaucaucacccagcugcagagcaugcccagcagagagcuggccagcaugaaccuggacaucguggaccugcugaagaaggccaaguuccaccacagcgacugccugagcaccuggcugcugcacuucaucgccaccaacuaccugaucuucagccagaagcccgaguuccaggaccugagcguggaggagagaagcuucguggagaagcacagauggcccagcaacauguaccugaagcagcuggccgaguacagaaaguacauccacagcagaaagugcagaugccuggugauguaa

SEQ ID NO: 22639 - RNA, 633 nt, Artificial Sequence
  RHOD__Homo_sapiens__NP_055393
augaccgccgcccaggccgccggcgaggaggccccccccggcgugagaagcgugaagguggugcuggugggcgacggcggcugcggcaagaccagccugcugaugguguucgccgacggcgccuuccccgagagcuacacccccaccguguucgagagauacauggugaaccugcaggugaagggcaagcccgugcaccugcacaucugggacaccgccggccaggacgacuacgacagacugagaccccuguucuaccccgacgccagcgugcugcugcugugcuucgacgugaccagccccaacagcuucgacaacaucuucaacagaugguaccccgaggugaaccacuucugcaagaaggugcccaucaucguggugggcugcaagaccgaccugagaaaggacaagagccuggugaacaagcugagaagaaacggccuggagcccgugaccuaccacagaggccaggagauggccagaagcgugggcgccguggccuaccuggagugcagcgccagacugcacgacaacgugcacgccguguuccaggaggccgccgagguggcccugagcagcagaggcagaaacuucuggagaagaaucacccagggcuucugcguggugaccuaa

SEQ ID NO: 22640 - RNA, 636 nt, Artificial Sequence
  RHOF__Homo_sapiens__NP_061907
auggacgcccccggcgcccuggcccagaccgccgcccccggccccggcagaaaggagcugaagaucgugaucgugggcgacggcggcugcggcaagaccagccugcugaugguguacagccagggcagcuuccccgagcacuacgcccccagcguguucgagaaguacaccgccagcgugaccgugggcagcaaggaggugacccugaaccuguacgacaccgccggccaggaggacuacgacagacugagaccccugagcuaccagaacacccaccuggugcugaucugcuacgacgugaugaaccccaccagcuacgacaacgugcugaucaagugguuccccgaggugacccacuucugcagaggcauccccauggugcugaucggcugcaagaccgaccugagaaaggacaaggagcagcugagaaagcugagagccgcccagcuggagcccaucaccuacaugcagggccugagcgccugcgagcagaucagagccgcccuguaccuggagugcagcgccaaguucagagagaacguggaggacguguucagagaggccgccaagguggcccugagcgcccugaagaaggcccagagacagaagaagagaagacugugccugcugcuguaa

SEQ ID NO: 22641 - RNA, 576 nt, Artificial Sequence
  RHOG__Homo_sapiens__XP_005252973
augcagagcaucaagugcgugguggugggcgacggcgccgugggcaagaccugccugcugaucugcuacaccaccaacgccuuccccaaggaguacauccccaccguguucgacaacuacagcgcccagagcgccguggacggcagaaccgugaaccugaaccugugggacaccgccggccaggaggaguacgacagacugagaacccugagcuacccccagaccaacguguucgugaucugcuucagcaucgccagcccccccagcuacgagaacgugagacacaaguggcaccccgaggugugccaccacugccccgacgugcccauccugcuggugggcaccaagaaggaccugagagcccagcccgacacccugagaagacugaaggagcagggccaggcccccaucaccccccagcagggccaggcccuggccaagcagauccacgccgugagauaccuggagugcagcgcccugcagcaggacggcgugaaggagguguucgccgaggccgugagagccgugcugaaccccacccccaucaagagaggcagaagcugcauccugcuguaa

SEQ ID NO: 22642 - RNA, 576 nt, Artificial Sequence
  RHOH__Homo_sapiens__NP_001265298
augcugagcagcaucaagugcgugcuggugggcgacagcgccgugggcaagaccagccugcuggugagauucaccagcgagaccuuccccgaggccuacaagcccaccguguacgagaacaccggcguggacguguucauggacggcauccagaucagccugggccugugggacaccgccggcaacgacgccuucagaagcaucagaccccugagcuaccagcaggccgacguggugcugaugugcuacagcguggccaaccacaacagcuuccugaaccugaagaacaaguggaucggcgagaucagaagcaaccugcccugcacccccgugcuggugguggccacccagaccgaccagagagagaugggcccccacagagccagcugcgugaacgccauggagggcaagaagcuggcccaggacgugagagccaagggcuaccuggagugcagcgcccugagcaacagaggcgugcagcagguguucgagugcgccgugagaaccgccgugaaccaggccagaagaagaaacagaagaagacuguucagcaucaacgagugcaagaucuucuaa

SEQ ID NO: 22643 - RNA, 1047 nt, Artificial Sequence
  RHO__Homo_sapiens__NP_000530
augaacggcaccgagggccccaacuucuacgugcccuucagcaacgccaccggcguggugagaagccccuucgaguacccccaguacuaccuggccgagcccuggcaguucagcaugcuggccgccuacauguuccugcugaucgugcugggcuuccccaucaacuuccugacccuguacgugaccgugcagcacaagaagcugagaaccccccugaacuacauccugcugaaccuggccguggccgaccuguucauggugcugggcggcuucaccagcacccuguacaccagccugcacggcuacuucguguucggccccaccggcugcaaccuggagggcuucuucgccacccugggcggcgagaucgcccuguggagccugguggugcuggccaucgagagauacgugguggugugcaagcccaugagcaacuucagauucggcgagaaccacgccaucaugggcguggccuucaccugggugauggcccuggccugcgccgcccccccccuggccggcuggagcagauacauccccgagggccugcagugcagcugcggcaucgacuacuacacccugaagcccgaggugaacaacgagagcuucgugaucuacauguucguggugcacuucaccauccccaugaucaucaucuucuucugcuacggccagcugguguucaccgugaaggaggccgccgcccagcagcaggagagcgccaccacccagaaggccgagaaggaggugaccagaauggugaucaucauggugaucgccuuccugaucugcugggugcccuacgccagcguggccuucuacaucuucacccaccagggcagcaacuucggccccaucuucaugaccauccccgccuucuucgccaagagcgccgccaucuacaaccccgugaucuacaucaugaugaacaagcaguucagaaacugcaugcugaccaccaucugcugcggcaagaacccccugggcgacgacgaggccagcgccaccgugagcaagaccgagaccagccagguggcccccgccuaa

SEQ ID NO: 22644 - RNA, 645 nt, Artificial Sequence
  RHOJ__Homo_sapiens__NP_065714
augaacugcaaggagggcaccgacagcagcugcggcugcagaggcaacgacgagaagaagaugcugaagugcgugguggugggcgacggcgccgugggcaagaccugccugcugaugagcuacgccaacgacgccuuccccgaggaguacgugcccaccguguucgaccacuacgccgugaccgugaccgugggcggcaagcagcaccugcugggccuguacgacaccgccggccaggaggacuacaaccagcugagaccccugagcuaccccaacaccgacguguuccugaucugcuucagcguggugaaccccgccagcuaccacaacgugcaggaggagugggugcccgagcugaaggacugcaugccccacgugcccuacgugcugaucggcacccagaucgaccugagagacgaccccaagacccuggccagacugcuguacaugaaggagaagccccugaccuacgagcacggcgugaagcuggccaaggccaucggcgcccagugcuaccuggagugcagcgcccugacccagaagggccugaaggccguguucgacgaggccauccugaccaucuuccaccccaagaagaagaagaagagaugcagcgagggccacagcugcugcagcaucaucuaa

SEQ ID NO: 22645 - RNA, 618 nt, Artificial Sequence
  RHOQ__Homo_sapiens__NP_036381
auggcccacggccccggcgcccugaugcugaagugcgugguggugggcgacggcgccgugggcaagaccugccugcugaugagcuacgccaacgacgccuuccccgaggaguacgugcccaccguguucgaccacuacgccgugagcgugaccgugggcggcaagcaguaccugcugggccuguacgacaccgccggccaggaggacuacgacagacugagaccccugagcuaccccaugaccgacguguuccugaucugcuucagcguggugaaccccgccagcuuccagaacgugaaggaggagugggugcccgagcugaaggaguacgcccccaacgugcccuuccugcugaucggcacccagaucgaccugagagacgaccccaagacccuggccagacugaacgacaugaaggagaagcccaucugcguggagcagggccagaagcuggccaaggagaucggcgccugcugcuacguggagugcagcgcccugacccagaagggccugaagaccguguucgacgaggccaucaucgccauccugacccccaagaagcacaccgugaagaagagaaucggcagcagaugcaucaacugcugccugaucaccuaa

SEQ ID NO: 22646 - RNA, 1980 nt, Artificial Sequence
  RHOT1__Homo_sapiens__NP_001028738
augaagaaggacgugagaauccugcuggugggcgagcccagagugggcaagaccagccugaucaugagccuggugagcgaggaguuccccgaggaggugccccccagagccgaggagaucaccauccccgccgacgugacccccgagagagugcccacccacaucguggacuacagcgaggccgagcagagcgacgagcagcugcaccaggagaucagccaggccaacgugaucugcaucguguacgccgugaacaacaagcacagcaucgacaaggugaccagcagauggaucccccugaucaacgagagaaccgacaaggacagcagacugccccugauccuggugggcaacaagagcgaccugguggaguacagcagcauggagaccauccugcccaucaugaaccaguacaccgagaucgagaccugcguggagugcagcgccaagaaccugaagaacaucagcgagcuguucuacuacgcccagaaggccgugcugcaccccaccggcccccuguacugccccgaggagaaggagaugaagcccgccugcaucaaggcccugaccagaaucuucaagaucagcgaccaggacaacgacggcacccugaacgacgccgagcugaacuucuuccagagaaucugcuucaacaccccccuggccccccaggcccuggaggacgugaagaacguggugagaaagcacaucagcgacggcguggccgacagcggccugacccugaagggcuuccuguuccugcacacccuguucauccagagaggcagacacgagaccaccuggaccgugcugagaagauucggcuacgacgacgaccuggaccugacccccgaguaccuguucccccugcugaagaucccccccgacugcaccaccgagcugaaccaccacgccuaccuguuccugcagagcaccuucgacaagcacgaccuggacagagacugcgcccugagccccgacgagcugaaggaccuguucaagguguuccccuacauccccuggggccccgacgugaacaacaccgugugcaccaacgagagaggcuggaucaccuaccagggcuuccugagccaguggacccugaccaccuaccuggacgugcagagaugccuggaguaccugggcuaccugggcuacagcauccugaccgagcaggagagccaggccagcgccgugaccgugaccagagacaagaagaucgaccugcagaagaagcagacccagagaaacguguucagaugcaacgugaucggcgugaagaacugcggcaagagcggcgugcugcaggcccugcugggcagaaaccugaugagacagaagaagaucagagaggaccacaagagcuacuacgccaucaacaccguguacguguacggccaggagaaguaccugcugcugcacgacaucagcgagagcgaguuccugaccgaggccgagaucaucugcgacguggugugccugguguacgacgugagcaaccccaagagcuucgaguacugcgccagaaucuucaagcagcacuucauggacagcagaauccccugccugaucguggccgccaagagcgaccugcacgaggugaagcaggaguacagcaucagccccaccgacuucugcagaaagcacaagaugccccccccccaggccuucaccugcaacaccgccgacgcccccagcaaggacaucuucgugaagcugaccaccauggccauguacccccacgccagacugagaugcaugugcaccugcaacagaugcaccuucugcaucugccagaacuuccugaacagcgaccugcugcagagcgugaagaacaagaucuucaccgccgugcugaacagacacgugacccaggccgaccugaagagcagcaccuucuggcugagagccagcuucggcgccaccguguucgccgugcugggcuucgccauguacaaggcccugcugaagcagagauaa

SEQ ID NO: 22647 - RNA, 777 nt, Artificial Sequence
  RHOU__Homo_sapiens__NP_067028
augcccccccagcagggcgaccccgccuuccccgacagaugcgaggccccccccgugccccccagaagagagagaggcggcagaggcggcagaggccccggcgagcccggcggcagaggcagagccggcggcgccgagggcagaggcgugaagugcgugcuggugggcgacggcgccgugggcaagaccagccugguggugagcuacaccaccaacggcuaccccaccgaguacauccccaccgccuucgacaacuucagcgccguggugagcguggacggcagacccgugagacugcagcugugcgacaccgccggccaggacgaguucgacaagcugagaccccugugcuacaccaacaccgacaucuuccugcugugcuucagcguggugagccccagcagcuuccagaacgugagcgagaagugggugcccgagaucagaugccacugccccaaggcccccaucauccuggugggcacccagagcgaccugagagaggacgugaaggugcugaucgagcuggacaagugcaaggagaagcccgugcccgaggaggccgccaagcugugcgccgaggagaucaaggccgccagcuacaucgagugcagcgcccugacccagaagaaccugaaggagguguucgacgccgccaucguggccggcauccaguacagcgacacccagcagcagcccaagaagagcaagagcagaacccccgacaagaugaagaaccugagcaagagcugguggaagaaguacugcugcuucguguaa

SEQ ID NO: 22648 - RNA, 711 nt, Artificial Sequence
  RHOV__Homo_sapiens__NP_598378
augccccccagagagcugagcgaggccgagccccccccccugagagcccccacccccccccccagaagaagaagcgccccccccgagcugggcaucaagugcgugcuggugggcgacggcgccgugggcaagagcagccugaucgugagcuacaccugcaacggcuaccccgccagauacagacccaccgcccuggacaccuucagcgugcaggugcugguggacggcgcccccgugagaaucgagcugugggacaccgccggccaggaggacuucgacagacugagaagccugugcuaccccgacaccgacguguuccuggccugcuucagcguggugcagcccagcagcuuccagaacaucaccgagaaguggcugcccgagaucagaacccacaacccccaggcccccgugcugcuggugggcacccaggccgaccugagagacgacgugaacgugcugauccagcuggaccagggcggcagagagggccccgugccccagccccaggcccagggccuggccgagaagaucagagccugcugcuaccuggagugcagcgcccugacccagaagaaccugaaggagguguucgacagcgccauccugagcgccaucgagcacaaggccagacuggagaagaagcugaacgccaagggcgugagaacccugagcagaugcagauggaagaaguucuucugcuucguguaa

SEQ ID NO: 22649 - RNA, 555 nt, Artificial Sequence
  RHOXF1__Homo_sapiens__NP_644811
auggccagaagccuggugcacgacaccguguucuacugccugagcguguaccaggugaagaucagccccaccccccagcugggcgccgccagcagcgccgagggccacgugggccagggcgcccccggccugaugggcaacaugaaccccgagggcggcgugaaccacgagaacggcaugaacagagacggcggcaugauccccgagggcggcggcggcaaccaggagcccagacagcagccccagcccccccccgaggagcccgcccaggccgccauggagggcccccagcccgagaacaugcagcccagaaccagaagaaccaaguucacccugcugcagguggaggagcuggagagcguguucagacacacccaguaccccgacgugcccaccagaagagagcuggccgagaaccugggcgugaccgaggacaaggugagagugugguucaagaacaagagagccagaugcagaagacaccagagagagcugaugcuggccaacgagcugagagccgaccccgacgacugcguguacaucgugguggacuaa

SEQ ID NO: 22650 - RNA, 867 nt, Artificial Sequence
  RHOXF2__Homo_sapiens__NP_115887
auggagccccccgaccagugcagccaguacaugaccagccugcugagccccgccguggacgacgagaaggagcugcaggacaugaacgccauggugcugagccugaccgaggaggugaaggaggaggaggaggacgcccagcccgagcccgagcagggcaccgccgccggcgagaagcugaagagcgccggcgcccagggcggcgaggagaaggacggcggcggcgaggagaaggacggcggcggcgccggcgugcccggccaccugugggagggcgaccuggagggcaccagcggcagcgacggcaacguggaggacagcgaccagagcgagaaggagcccggccagcaguacagcagaccccagggcgccgugggcggccuggagcccggcaacgcccagcagcccaacgugcacgccuucaccccccugcagcugcaggagcuggagagaaucuuccagagagagcaguuccccagcgaguuccugagaagaagacuggccagaagcaugaacgugaccgagcuggccgugcagaucugguucgagaacagaagagccaaguggagaagacaccagagagcccugauggccagaaacaugcugcccuucauggccgugggccagcccgugauggugaccgccgccgaggccaucaccgccccccuguucaucagcggcaugagagacgacuacuucugggaccacagccacagcagcagccugugcuuccccaugccccccuuccccccccccagccugccccugccccugaugcugcugccccccaugccccccgccggccaggccgaguucggccccuuccccuucgugaucgugcccagcuucaccuuccccaacguguaa

SEQ ID NO: 22651 - RNA, 2013 nt, Artificial Sequence
  RHPN1__Homo_sapiens__NP_443156
augauccuggaggagagacccgacggcgccggcgccggcgaggagagccccagacugcagggcugcgacagccugacccagauccagugcggccagcugcagagcagaagagcccagauccaccagcagaucgacaaggagcugcagaugagaaccggcgccgagaaccuguacagagccaccagcaacaacagagugagagagaccguggcccuggagcugagcuacgugaacagcaaccugcagcugcugaaggaggagcuggaggagcugagcggcggcguggaccccggcagacacggcagcgaggccgugaccgugcccaugaucccccugggccugaaggagaccaaggagcuggacuggagcaccccccugaaggagcugaucagcgugcacuucggcgaggacggcgccagcuacgaggccgagaucagagagcuggaggcccugagacaggccaugagaacccccagcagaaacgagagcggccuggagcugcugaccgccuacuacaaccagcugugcuuccuggacgccagauuccugacccccgccagaagccugggccuguucuuccacugguacgacagccugaccggcgugcccgcccagcagagagcccuggccuucgagaagggcagcgugcuguucaacaucggcgcccugcacacccagaucggcgccagacaggacagaagcugcaccgagggcgccagaagagccauggaggccuuccagagagccgccggcgccuucagccugcugagagagaacuucagccacgcccccagccccgacaugagcgccgccagccugugcgcccuggagcagcugaugauggcccaggcccaggagugcguguucgagggccugagcccccccgccagcauggccccccaggacugccuggcccagcugagacuggcccaggaggccgcccagguggccgccgaguacagacuggugcacagaaccauggcccagccccccgugcacgacuacgugcccgugagcuggaccgcccuggugcacgugaaggccgaguacuucagaagccuggcccacuaccacguggccauggcccugugcgacggcagccccgccaccgagggcgagcugcccacccacgagcagguguuccugcagccccccaccagcagcaagcccagaggccccgugcugccccaggagcuggaggagagaagacagcugggcaaggcccaccugaagagagccauccugggccaggaggaggcccugagacugcacgcccugugcagagugcugagagagguggaccugcugagagccgugaucagccagacccugcagagaagccuggccaaguacgccgagcuggacagagaggacgacuucugcgaggccgccgaggcccccgacauccagcccaagacccaccagaagcccgaggccagaaugcccagacugagccagggcaagggccccgacaucuuccacagacugggcccccugagcguguucagcgccaagaacagauggagacuggugggccccgugcaccugaccagaggcgagggcggcuucggccugacccugagaggcgacagccccgugcugaucgccgccgugauccccggcagccaggccgccgccgccggccugaaggagggcgacuacaucgugagcgugaacggccagcccugcagaugguggagacacgccgagguggugaccgagcugaaggccgccggcgaggccggcgccagccugcagguggugagccugcugcccagcagcagacugcccagccugggcgacagaagacccgugcugcugggccccagaggccugcugagaagccagagagagcacggcugcaagacccccgccagcaccugggccagccccagaccccugcugaacuggagcagaaaggcccagcagggcaagaccggcggcugcccccagcccugcgcccccgugaagcccgccccccccagcagccugaagcaccccggcuggcccuaa

SEQ ID NO: 22652 - RNA, 2061 nt, Artificial Sequence
  RHPN2__Homo_sapiens__NP_149094
augaccgacgcccugcugcccgccgccccccagccccuggagaaggagaacgacggcuacuucagaaagggcugcaacccccuggcccagaccggcagaagcaagcugcagaaccagagagccgcccugaaccagcagauccugaaggccgugagaaugagaaccggcgccgagaaccugcugaagguggccaccaacagcaaggugagagagcaggugagacuggagcugagcuucgugaacagcgaccugcagaugcugaaggaggagcuggagggccugaacaucagcgugggcguguaccagaacaccgaggaggccuucaccaucccccugaucccccugggccugaaggagaccaaggacguggacuucgccguggugcugaaggacuucauccuggagcacuacagcgaggacggcuaccuguacgaggacgagaucgccgaccugauggaccugagacaggccugcagaacccccagcagagacgaggccggcguggagcugcugaugaccuacuucauccagcugggcuucguggagagcagauucuucccccccaccagacagaugggccugcuguucaccugguacgacagccugaccggcgugcccgugagccagcagaaccugcugcuggagaaggccagcgugcuguucaacaccggcgcccuguacacccagaucggcaccagaugcgacagacagacccaggccggccuggagagcgccaucgacgccuuccagagagccgccggcgugcugaacuaccugaaggacaccuucacccacacccccagcuacgacaugagccccgccaugcugagcgugcuggugaagaugaugcuggcccaggcccaggagagcguguucgagaagaucagccugcccggcaucagaaacgaguucuucaugcuggugaagguggcccaggaggccgccaaggugggcgagguguaccagcagcugcacgccgccaugagccaggcccccgugaaggagaacauccccuacagcugggccagccuggccugcgugaaggcccaccacuacgccgcccuggcccacuacuucaccgccauccugcugaucgaccaccaggugaagcccggcaccgaccuggaccaccaggagaagugccugagccagcuguacgaccacaugcccgagggccugaccccccuggccacccugaagaacgaccagcagagaagacagcugggcaagagccaccugagaagagccauggcccaccacgaggagagcgugagagaggccagccugugcaagaagcugagaagcaucgaggugcugcagaaggugcugugcgccgcccaggagagaagcagacugaccuacgcccagcaccaggaggaggacgaccugcugaaccugaucgacgcccccagcgugguggccaagaccgagcaggagguggacaucauccugccccaguucagcaagcugaccgugaccgacuucuuccagaagcugggcccccugagcguguucagcgccaacaagagauggaccccccccagaagcaucagauucaccgccgaggagggcgaccugggcuucacccugagaggcaacgcccccgugcaggugcacuuccuggaccccuacugcagcgccagcguggccggcgccagagagggcgacuacaucgugagcauccagcugguggacugcaaguggcugacccugagcgaggugaugaagcugcugaagagcuucggcgaggacgagaucgagaugaagguggugagccugcuggacagcaccagcagcaugcacaacaagagcgccaccuacagcgugggcaugcagaagaccuacagcaugaucugccuggccaucgacgacgacgacaagaccgacaagaccaagaagaucagcaagaagcugagcuuccugagcuggggcaccaacaagaacagacagaagagcgccagcacccugugccugcccagcgugggcgccgccagaccccaggugaagaagaagcugcccagccccuucagccugcugaacagcgacagcagcugguacuaa

SEQ ID NO: 22653 - RNA, 1149 nt, Artificial Sequence
  RIBC2__Homo_sapiens__NP_056468
augggcagccagaccauggccguggcccugcccagagaccugagacaggacgccaaccuggccaagagaagacacgccgagcugugcagacagaagagaguguucaacgccagaaacagaaucaucggcggcgacaccgaggccugggacgugcaggugcacgaccagaagaucaaggaggccaccgagaaggccagacacgagaccuucgccgccgagaugagacagaacgacaagaucaugugcauccuggagaacagaaagaagagagacagaaagaaccugugcagagccaucaacgacuuccagcagagcuuccagaagcccgagaccagaagagaguucgaccugagcgacccccuggcccugaagaaggaccugcccgccagacagagcgacaacgacgugagaaacaccaucagcggcaugcagaaguucaugggcgaggaccugaacuuccacgagagaaagaaguuccaggaggagcagaacagagaguggagccugcagcagcagagagaguggaagaacgccagagccgagcagaagugcgccgaggcccuguacaccgagaccagacugcaguucgacgagaccgccaagcaccugcagaagcuggagagcaccaccagaaaggccgugugcgccagcgugaaggacuucaacaagagccaggccaucgagagcguggagagaaagaagcaggagaagaagcaggagcaggaggacaaccuggccgagaucaccaaccugcugagaggcgaccugcugagcgagaacccccagcaggccgccagcagcuucggcccccacagaguggugcccgacagauggaagggcaugacccaggagcagcuggagcagaucagacuggugcagaagcagcagauccaggagaagcugagacugcaggaggagaagagacagagagaccuggacugggacagaagaagaauccagggcgccagagccacccugcuguucgagagacagcaguggagaagacagagagaccugagaagagcccuggacagcagcaaccugagccuggccaaggagcagcaccugcagaagaaguacaugaacgagguguacaccaaccagcccaccggcgacuacuucacccaguucaacaccggcagcagauaa

SEQ ID NO: 22654 - RNA, 3498 nt, Artificial Sequence
  RIC1__Homo_sapiens__NP_001129392
auguacuuccugagcggcuggcccaagagacugcugugcccccugggcagccccgccgaggcccccuuccacgugcagagcgacccccagagagccuucuucgccgugcuggccgccgccagacugagcaucugguacagcagacccagcgugcugaucgugaccuacaaggagcccgccaagagcagcacccaguucggcagcuacaagcaggccgaguggagacccgacagcaccaugaucgccgugagcaccgccaacggcuacauccuguucuuccacaucaccagcaccagaggcgacaaguaccuguacgagcccguguaccccaagggcagcccccagaugaagggcaccccccacuucaaggaggagcagugcgcccccgcccugaaccuggagaugagaaagauccuggaccugcaggcccccaucaugagccugcagagcgugcuggaggaccugcugguggccaccagcgacggccugcugcaccugauccacugggagggcaugaccaacggcagaaaggccaucaaccugugcaccgugcccuucagcguggaccugcagagcagcagagugggcagcuuccugggcuucaccgacgugcacaucagagacauggaguacugcgccacccuggacggcuucgccgugguguucaacgacggcaaggugggcuucaucacccccgugagcagcagauucaccgccgagcagcugcacggcguguggccccaggacgugguggacggcaccugcguggccgugaacaacaaguacagacugauggccuucggcugcgugagcggcagcgugcagguguacaccaucgacaacagcaccggcgccaugcugcugagccacaagcuggagcugaccgccaagcaguaccccgacaucuggaacaagaccggcgccgugaagcugaugagauggagccccgacaacagcguggugaucgugaccugggaguacggcggccugagccuguggagcguguucggcgcccagcugaucugcacccugggcggcgacuucgccuacagaagcgacggcaccaagaaggacccccugaagaucaacagcaugagcuggggcgccgagggcuaccaccugugggugaucagcggcuucggcagccagaacaccgagaucgagagcgaccugagaagcguggugaagcagcccagcauccugcuguuccaguucaucaagagcgugcugaccgugaaccccugcaugagcaaccaggagcaggugcugcugcagggcgaggacagacuguaccugaacugcggcgaggccagccagacccagaaccccagaagcagcagcacccacagcgagcacaagcccagcagagagaagagccccuucgccgacggcggccuggagagccagggccugagcacccugcugggccacagacacuggcacguggugcagaucagcagcaccuaccuggagagcaacuggcccaucagauucagcgccaucgacaagcugggccagaacaucgccguggugggcaaguucggcuucgcccacuacagccugcugaccaagaaguggaagcuguucggcaacaucacccaggagcagaacaugaucgugaccggcggccuggccugguggaacgacuucauggugcuggccugcuacaacaucaacgacagacaggaggagcugagaguguaccugagaaccagcaaccuggacaacgccuucgcccacgugaccaaggcccaggccgagacccugcugcugagcguguuccaggacauggugaucguguucagagccgacugcagcaucugccuguacagcaucgagagaaagagcgacggccccaacaccaccgccggcauccaggugcugcaggaggugagcaugagcagauacaucccccaccccuuccugguggugagcgugacccugaccagcgugagcaccgagaacggcaucacccugaagaugccccagcaggccagaggcgccgagagcaucaugcugaaccuggccggccagcugaucaugaugcagagagacagaagcggcccccagaucagagagaaggacagcaaccccaacaaccagagaaagcugcugcccuucugcccccccguggugcuggcccagagcguggagaacguguggaccaccugcagagccaacaagcagaagagacaccugcuggaggcccuguggcugagcugcggcggcgccggcaugaagguguggcugccccuguuccccagagaccacagaaagccccacagcuuccugagccagagaaucaugcugcccuuccacaucaacaucuacccccuggccgugcuguucgaggacgcccuggugcugggcgccgugaacgacacccugcuguacgacagccuguacaccagaaacaacgccagagagcagcuggaggugcuguuccccuucugcgugguggagagaaccagccagaucuaccugcaccacauccugagacagcugcuggugagaaaccugggcgagcaggcccugcugcuggcccagagcugcgccacccugcccuacuucccccacgugcuggagcugaugcugcacgaggugcuggaggaggaggccaccagcagagagcccauccccgacccccugcugcccaccguggccaaguucaucaccgaguucccccuguuccugcagaccguggugcacugcgccagaaagaccgaguacgcccuguggaacuaccuguucgccgccgugggcaaccccaaggaccuguucgaggagugccugauggcccaggaccuggacaccgccgccagcuaccugaucauccugcagaacauggaggugcccgccgugagcagacagcacgccacccugcuguucaacaccgcccuggagcagggcaagugggaccugugcagacacaugaucagauuccugaaggccaucggcagcggcgagagcgagaccccccccagcacccccaccgcccaggagcccagcagcagcggcggcuucgaguucuucagaaacagaagcaucagccugagccagagcgccgagaacgugcccgccagcaaguucagccugcagaagacccugagcaugcccagcggccccagcggcaagagauggagcaaggacagcgacugcgccgagaacauguacaucgacaugaugcuguggagacacgccagaagacugcuggaggacgugagacugaaggaccugggcugcuucgccgcccagcugggcuucgagcugaucagcuggcugugcaaggagagaaccagagccgccagaguggacaacuucgugaucgcccugaagagacugcacaaggacuuccuguggccccugcccaucauccccgccagcagcaucagcagccccuucaagaacggcaaguacagaaccggcaacguggacuucaugagccuggugcagggcgagcuguacuucacccccugcaucuacaccuucugcuacuaa

SEQ ID NO: 22655 - RNA, 564 nt, Artificial Sequence
  RIC3__Homo_sapiens__NP_001128581
auggccuacagcaccgugcagagaguggcccuggccagcggccuggugcuggcccugagccugcugcugcccaaggccuuccugagcagaggcaagagacaggagcccccccccacccccgagggcuaccccgaggagaccuaccccaucuacgaccugagcgacugcaucaagagaagacaggagaccauccugguggacuaccccgaccccaaggagcugagcgccgaggagaucgccgagagaaugggcaugaucgaggaggaggagagcgaccaccugggcugggagagccugcccaccgaccccagagcccaggaggacaacagcgugaccagcugcgaccccaagcccgagaccugcagcugcugcuuccacgaggacgaggaccccgccgugcuggccgagaacgccggcuucagcgccgacagcuaccccgagcaggaggagaccaccaaggaggaguggagccaggacuucaaggacgagggccugggcaucagcaccgacaaggccuacaccggcagcaugcugagaaagagaaacccccagggccuggaguaa

SEQ ID NO: 22656 - RNA, 5199 nt, Artificial Sequence
  RICTOR__Homo_sapiens__NP_001272368
auggccgccaucggcagaggcagaagccugaagaaccugagagugagaggcagaaacgacagcggcgaggagaacgugccccuggaccugaccagagagcccagcgacaaccugagagagauccugcagaacguggccagacugcagggcgugagcaacaugagaaagcugggccaccugaacaacuucaccaagcugcugugcgacaucggccacagcgaggagaagcugggcuuccacuacgaggacaucaucaucugccugagacuggcccugcugaacgaggccaaggaggugagagccgccggccugagagcccugagauaccugauccaggacagcagcauccugcagaaggugcugaagcugaagguggacuaccugaucgccagaugcaucgacauccagcagagcaacgagguggagagaacccaggcccugagacuggugagaaagaugaucaccgugaacgccagccuguuccccagcagcgugaccaacagccugaucgccgugggcaacgacggccugcaggagagagacagaauggugagagccugcaucgccaucaucugcgagcuggcccugcagaaccccgaggugguggcccugagaggcggccugaacaccauccugaagaacgugaucgacugccagcugagcagaaucaacgaggcccugaucaccaccauccugcaccugcugaaccaccccaagaccagacaguacgugagagccgacguggagcuggagagaauccuggcccccuacaccgacuuccacuacagacacagccccgacaccgccgagggccagcugaaggaggacagagaggccagauuccuggccagcaagaugggcaucaucgccaccuucagaagcugggccggcaucaucaaccugugcaagcccggcaacagcggcauccagagccugaucggcgugcugugcauccccaacauggagaucagaagaggccugcuggaggugcuguacgacaucuucagacugccccugcccguggugaccgaggaguucaucgaggcccugcugagcguggaccccggcagauuccaggacagcuggagacugagcgacggcuucguggccgccgaggccaagaccauccugccccacagagccagaagcagacccgaccugauggacaacuaccuggcccugauccugagcgccuucaucagaaacggccugcuggagggccugguggaggugaucaccaacagcgacgaccacaucagcgugagagccaccauccugcugggcgagcugcugcacauggccaacaccauccugccccacagccacagccaccaccugcacugccugcccacccugaugaacauggccgccagcuucgacauccccaaggagaagagacugagagccagcgccgcccugaacugccugaagagauuccacgagaugaagaagagaggccccaagcccuacagccugcaccuggaccacaucauccagaaggccaucgccacccaccagaagagagaccaguaccugagagugcagaaggacaucuucauccugaaggacaccgaggaggcccugcugaucaaccugagagacagccaggugcugcagcacaaggagaaccuggaguggaacuggaaccugaucggcaccauccugaaguggcccaacgugaaccugagaaacuacaaggacgagcagcugcacagauucgugagaagacugcuguacuucuacaagcccagcagcaagcuguacgccaaccuggaccuggacuucgccaaggccaagcagcugaccguggugggcugccaguucaccgaguuccugcuggagagcgaggaggacggccagggcuaccuggaggaccuggugaaggacaucgugcaguggcugaacgccagcagcggcaugaagcccgagagaagccugcagaacaacggccugcugaccacccugagccagcacuacuuccuguucaucggcacccugagcugccacccccacggcgugaagaugcuggagaagugcagcguguuccagugccugcugaaccugugcagccugaagaaccaggaccaccugcugaagcugaccgugagcagccuggacuacagcagagacggccuggccagagugauccugagcaagauccugaccgccgccaccgacgccugcagacuguacgccaccaagcaccugagagugcugcugagagccaacguggaguucuucaacaacuggggcaucgagcugcuggugacccagcugcacgacaagaacaagaccaucagcagcgaggcccuggacauccuggacgaggccugcgaggacaaggccaaccugcacgcccugauccagaugaagcccgcccugagccaccugggcgacaagggccugcugcugcugcugagauuccugagcauccccaagggcuucagcuaccugaacgagagaggcuacguggccaagcagcuggagaaguggcacagagaguacaacagcaaguacguggaccugaucgaggagcagcugaacgaggcccugaccaccuacagaaagcccguggacggcgacaacuacgugagaagaagcaaccagagacugcagagaccccacguguaccugcccauccaccuguacggccagcuggugcaccacaagaccggcugccaccugcuggaggugcagaacaucaucaccgagcugugcagaaacgugagaacccccgaccuggacaagugggaggagaucaagaagcugaaggccagccugugggcccugggcaacaucggcagcagcaacuggggccugaaccugcugcaggaggagaacgugauccccgacauccugaagcuggccaagcagugcgaggugcugagcaucagaggcaccugcguguacgugcugggccugaucgccaagaccaagcagggcugcgacauccugaagugccacaacugggacgccgugagacacagcagaaagcaccuguggcccguggugcccgacgacguggagcagcugugcaacgagcugagcagcauccccagcacccugagccugaacagcgagagcaccagcagcagacacaacagcgagagcgagagcgugcccagcagcauguucauccuggaggacgacagauucggcagcagcagcaccagcaccuucuuccuggacaucaacgaggacaccgagcccaccuucuacgacagaagcggccccaucaaggacaagaacagcuuccccuucuucgccagcagcaagcuggugaagaacagaauccugaacagccugacccugcccaacaagaagcacagaagcagcagcgaccccaagggcggcaagcugagcagcgagagcaagaccagcaacagaagaaucagaacccugaccgagcccagcguggacuucaaccacagcgacgacuucacccccaucagcaccgugcagaagacccugcagcuggagaccagcuucaugggcaacaagcacaucgaggacaccggcagcacccccagcaucggcgagaacgaccugaaguucaccaagaacuucggcaccgagaaccacagagagaacaccagcagagagagacuggugguggagagcagcaccagcagccacaugaagaucagaagccagagcuucaacaccgacaccaccaccagcggcaucagcagcaugagcagcagccccagcagagagaccgugggcguggacgccaccaccauggacaccgacugcggcagcaugagcaccguggugagcaccaagaccaucaagaccagccacuaccugaccccccagagcaaccaccugagccugagcaagagcaacagcgugagccuggugccccccggcagcagccacacccugcccagaagagcccagagccugaaggcccccagcaucgccaccaucaagagccuggccgacugcaacuucagcuacaccagcagcagagacgccuucggcuacgccacccugaagagacugcagcagcagagaaugcaccccagccugagccacagcgaggcccuggccagccccgccaaggacgugcuguucaccgacaccaucaccaugaaggccaacagcuucgagagcagacugacccccagcagaaucgacuucaagaagaagcacgugggcggcaucagaagccugagacccaccaucaccaacaaccuguucagauucaugaaggcccugagcuacgccagccuggacaaggaggaccugcugagccccaucaaccagaacacccugcagagaagcagcagcgugagaagcauggugagcagcgccaccuacggcggcagcgacgacuacaucggccuggcccugcccguggacaucaacgacaucuuccaggugaaggacauccccuacuuccagaccaagaacauccccccccacgacgacagaggcgccagagccuucgcccacgacgccggcggccugcccagcggcaccggcggccuggugaagaacagcuuccaccugcugagacagcagaugagccugaccgagaucaugaacagcauccacagcgacgccagccuguuccuggagagcaccgaggacaccggccugcaggagcacaccgacgacaacugccuguacugcgugugcaucgagauccugggcuuccagcccagcaaccagcugagcgccaucugcagccacagcgacuuccaggacauccccuacagcgacuggugcgagcagaccauccacaacccccuggagguggugcccagcaaguucagcggcaucagcggcugcagcgacggcgugagccaggagggcagcgccagcagcaccaagagcaccgagcugcugcugggcgugaagaccauccccgacgacacccccaugugcagaauccugcugagaaaggaggugcugagacuggugaucaaccugagcagcagcgugagcaccaagugccacgagaccggccugcugaccaucaaggagaaguacccccagaccuucgacgacaucugccuguacagcgaggugagccaccugcugagccacugcaccuucagacugcccugcagaagauucauccaggagcuguuccaggacgugcaguuccugcagaugcacgaggaggccgaggccgugcuggccaccccccccaagcagcccaucguggacaccagcgccgagagcuaa

SEQ ID NO: 22657 - RNA, 7341 nt, Artificial Sequence
  RIF1__Homo_sapiens__NP_001171134
augaccgccagaggccagagcccccuggccccccugcuggagacccuggaggaccccagcgccagccacggcggccagaccgacgccuaccugacccugaccagcagaaugaccggcgaggagggcaaggaggugaucaccgagaucgagaagaagcugcccagacuguacaaggugcugaagacccacaucagcagccagaacagcgagcugagcagcgccgcccugcaggcccugggcuucugccuguacaaccccaagaucaccagcgagcugagcgaggccaacgcccuggagcugcugagcaagcugaacgacaccaucaagaacagcgacaagaacgugagaaccagagcccugugggugaucagcaagcagaccuuccccagcgagguggugggcaagauggugagcagcaucaucgacagccuggagauccuguucaacaagggcgagacccacagcgccgugguggacuucgaggcccugaacgugaucgugagacugaucgagcaggcccccauccagaugggcgaggaggccgugagaugggccaagcuggugaucccccugguggugcacagcgcccagaaggugcaccugagaggcgccaccgcccuggagaugggcaugccccugcugcugcagaagcagcaggagaucgccagcaucaccgagcagcugaugaccaccaagcugaucagcgagcugcagaagcuguucaugagcaagaacgagaccuacgugcugaagcuguggccccuguucgugaagcugcugggcagaacccugcacagaagcggcagcuucaucaacagccugcugcagcuggaggagcugggcuucagaagcggcgcccccaugaucaagaagaucgccuucaucgccuggaagagccugaucgacaacuucgcccugaaccccgacauccugugcagcgccaagagacugaagcugcugaugcagccccugagcagcauccacgugagaaccgagacccuggcccugaccaagcuggagguguggugguaccugcugaugagacugggcccccaccugcccgccaacuucgagcaggugugcgugccccugauccagagcaccaucagcaucgacagcaacgccagcccccagggcaacagcugccacguggccaccagccccggccugaaccccaugacccccgugcacaagggcgccagcagccccuacggcgcccccggcacccccagaaugaaccugagcagcaaccugggcggcauggccaccauccccagcauccagcugcugggccuggagaugcugcugcacuuccugcugggccccgaggcccugagcuucgccaagcagaacaagcuggugcugagccuggagccccuggagcacccccugaucagcagccccagcuucuucagcaagcacgccaacacccugaucaccgccgugcacgacagcuucguggccgugggcaaggacgcccccgacgugguggugagcgccaucuggaaggagcugaucagccuggugaagagcgugaccgagagcggcaacaagaaggagaagcccggcagcgaggugcugacccugcugcugaagagccuggagagcaucgugaagagcgagguguuccccgugagcaagacccuggugcugauggagaucaccaucaagggccugccccagaaggugcugggcagccccgccuaccagguggccaacauggacauccugaacggcacccccgcccuguuccugauccagcugaucuucaacaacuuccuggagugcggcgugagcgacgagagauucuuccugagccuggagagccuggugggcugcgugcugagcggccccaccagcccccuggccuucagcgacagcgugcugaacgugaucaaccagaacgccaagcagcuggagaacaaggagcaccuguggaagauguggagcgugaucgugaccccccugaccgagcugaucaaccagaccaacgaggugaaccagggcgacgcccuggagcacaacuucagcgccaucuacggcgcccugacccugcccgugaaccacaucuucagcgagcagagauuccccguggccaccaugaagacccugcugagaaccuggagcgagcuguacagagccuucgccagaugcgccgcccugguggccaccgccgaggagaaccugugcugcgaggagcugagcagcaagaucaugagcagccuggaggacgagggcuucagcaaccugcuguucguggacagaaucaucuacaucaucaccgugaugguggacugcaucgacuucagccccuacaacaucaaguaccagcccaaggugaagagcccccagagacccagcgacuggagcaagaagaagaacgagccccugggcaagcugaccagccuguucaagcugaucgugaaggugaucuacagcuuccacacccugagcuucaaggaggcccacagcgacacccuguucaccaucggcaacagcaucaccggcaucaucagcagcgugcugggccacaucagccugcccagcaugaucagaaagaucuucgccacccugaccagaccccuggcccuguucuacgagaacagcaagcuggacgaggugcccaagguguacagcugccugaacaacaagcuggagaagcugcugggcgagaucaucgccugccugcaguucagcuacaccggcaccuacgacagcgagcugcuggagcagcugagcccccugcugugcaucaucuuccugcacaagaacaagcagaucagaaagcagagcgcccaguucuggaacgccaccuucgccaaggugaugaugcugguguaccccgaggagcugaagcccgugcugacccaggccaagcagaaguuccugcugcugcugcccggccuggagaccguggagaugauggaggagagcagcggccccuacagcgacggcaccgagaacagccagcugaacgugaagaucagcggcauggagagaaagagcaacggcaagagagacagcuuccuggcccagaccaagaacaagaaggagaacaugaagcccgccgccaagcugaagcuggagagcagcagccugaaggugaagggcgagauccugcuggaggaggagaagagcaccgacuucguguucaucccccccgagggcaaggacgccaaggagagaauccugaccgaccaccagaaggaggugcugaagaccaagagaugcgacauccccgccauguacaacaaccuggacgugagccaggacacccuguucacccaguacagccaggaggagcccauggagauccccacccugaccagaaagcccaaggaggacagcaagaugaugaucaccgaggagcagauggacagcgacaucgugaucccccaggacgugaccgaggacugcggcauggccgagcaccuggagaagagcagccugagcaacaacgagugcggcagccuggacaagaccagccccgagaugagcaacagcaacaacgacgagagaaagaaggcccugaucagcagcagaaagaccagcaccgagugcgccagcagcaccgagaacagcuucguggugagcagcagcagcgugagcaacaccaccguggccggcaccccccccuaccccaccagcagaagacagaccuucaucacccuggagaaguucgacggcagcgagaacagacccuucagccccagcccccugaacaacaucagcagcaccgugaccgugaagaacaaccaggagaccaugaucaagaccgacuuccugcccaaggccaagcagagagagggcaccuucagcaagagcgacagcgagaagaucgugaacggcaccaagagaagcagcagaagagccggcaaggccgagcagaccggcaacaagagaagcaagccccugaugagaagcgagcccgagaagaacaccgaggagagcguggagggcaucguggugcuggagaacaacccccccggccugcugaaccagaccgagugcgugagcgacaaccaggugcaccugagcgagagcaccauggagcacgacaacaccaagcugaaggccgccaccguggagaacgccgugcugcuggagaccaacaccguggaggagaagaacguggagaucaaccuggagagcaaggagaacaccccccccguggugaucagcgccgaccagauggugaacgaggacagccaggugcagaucacccccaaccagaagacccugagaagaagcagcagaagaagaagcgaggugguggagagcaccaccgagagccaggacaaggagaacagccaccagaagaaggagagaagaaaggaggaggagaagccccugcagaagagcccccugcacaucaaggacgacgugcugcccaagcagaagcugaucgccgagcagacccugcaggagaaccugaucgagaagggcagcaaccugcacgagaagacccugggcgagaccagcgccaacgccgagaccgagcagaacaagaagaaggccgaccccgagaacaucaagagcgagggcgacggcacccaggacaucguggacaagagcagcgagaagcuggugagaggcagaaccagauaccagaccagaagagccagccagggccugcugagcagcaucgagaacagcgagagcgacagcagcgaggccaaggaggagggcagcagaaagaagagaagcggcaaguggaagaacaagagcaacgagagcguggacauccaggaccaggaggagaagguggugaagcaggagugcaucaaggccgagaaccagagccacgacuacaaggccaccagcgaggaggacgugagcaucaagagccccaucugcgagaagcaggacgagagcaacaccgugaucugccaggacagcaccgugaccagcgaccugcugcaggugcccgacgaccugcccaacgugugcgaggagaagaacgagaccagcaaguacgccgaguacagcuucaccagccugcccgugcccgagagcaaccugagaaccagaaacgccaucaagagacugcacaagagagacagcuucgacaacugcagccugggcgagagcagcaagaucggcaucagcgacaucagcagccugagcgagaagaccuuccagacccuggagugccagcacaagagaagcagaagagugagaagaagcaagggcugcgacugcugcggcgagaagagccagccccaggagaagagccugaucggccugaagaacaccgagaacaacgacguggagaucagcgagaccaagaaggccgacgugcaggcccccgugagccccagcgagaccagccaggccaaccccuacagcgagggccaguuccuggacgagcaccacagcgugaacuuccaccugggccugaaggaggacaacgacaccaucaacgacagccugaucgugagcgagaccaagagcaaggagaacaccaugcaggagagccugcccagcggcaucgugaacuucagagaggagaucugcgacauggacagcagcgaggccaugagccuggagagccaggagagccccaacgagaacuucaagaccgugggccccugccugggcgacagcaagaacgugagccaggagagccuggagaccaaggaggagaagcccgaggagacccccaagauggagcugagccuggagaacgugaccguggagggcaacgccugcaaggugaccgagagcaaccuggagaaggccaagaccauggagcugaacgugggcaacgaggccagcuuccacggccaggagagaaccaagaccggcaucagcgaggaggccgccaucgaggagaacaagagaaacgacgacagcgaggccgacaccgccaagcugaacgccaaggagguggccaccgaggaguucaacagcgacaucagccugagcgacaacaccacccccgugaagcugaacgcccagaccgagaucagcgagcagaccgccgccggcgagcuggacggcggcaacgacgugagcgaccugcacagcagcgaggagaccaacaccaagaugaagaacaacgaggagaugaugaucggcgaggccauggccgagaccggccacgacggcgagaccgagaacgagggcaucaccaccaagaccagcaagcccgacgaggccgagaccaacaugcugaccgccgagauggacaacuucgugugcgacaccguggagaugagcaccgaggagggcaucaucgacgccaacaagaccgagaccaacaccgaguacagcaagagcgaggagaagcuggacaacaaccagauggugauggagagcgacauccugcaggaggaccaccacaccagccagaagguggaggagcccagccagugccuggccagcggcaccgccaucagcgagcugaucaucgaggacaacaacgccagcccccagaagcugagagagcuggaccccagccuggugagcgccaacgacagccccagcggcaugcagaccagaugcguguggagcccccuggccagccccagcaccagcauccugaagagaggccugaagagaagccaggaggacgagaucagcagccccgugaacaaggugagaagagugagcuucgccgaccccaucuaccaggccggccuggccgacgacaucgacagaagaugcagcaucgugagaagccacagcagcaacagcagccccaucggcaagagcgugaagaccagccccaccacccagagcaagaucagcgagauggccaaggagagcauccccugccccaccgagagcguguaccccccccuggugaacugcguggcccccguggacaucauccugccccagaucaccagcaacaugugggccagaggccugggccagcugaucagagccaagaacaucaagaccaucggcgaccugagcacccugaccgccagcgagaucaagacccugcccaucagaagccccaaggugagcaacgugaagaaggcccugagaaucuaccacgagcagcaggugaagaccagaggccuggaggagauccccguguucgacaucagcgagaagaccgugaacggcaucgagaacaagagccugagccccgacgaggagagacuggugagcgacaucaucgaccccguggcccuggagaucccccugagcaagaaccugcuggcccagaucagcgcccuggcccugcagcuggacagcgaggaccugcacaacuacagcggcagccagcuguucgagaugcacgagaagcugagcugcauggccaacagcgugaucaagaaccugcagagcagauggagaagccccagccacgagaacagcaucuaa

SEQ ID NO: 22658 - RNA, 1206 nt, Artificial Sequence
  RILP__Homo_sapiens__NP_113618
auggagcccagaagagccgcccccggcgugcccggcuggggcagcagagaggccgccggcagcgccagcgccgccgagcugguguaccaccuggccggcgcccugggcaccgagcugcaggaccuggccagaagauucggccccgaggccgccgccggccuggugccccugguggugagagcccuggagcugcuggagcaggccgccgugggccccgcccccgacagccugcaggugagcgcccagcccgccgagcaggagcugagaagacugagagaggagaacgagagacugagaagagagcugagagccggcccccaggaggagagagcccugcugagacagcugaaggaggugaccgacagacagagagacgagcugagagcccacaacagagaccugagacagagaggccaggagaccgaggcccugcaggagcagcugcagagacugcugcuggugaacgccgagcugagacacaagcuggccgccaugcagacccagcugagagccgcccaggacagagagagagagagacagcagcccggcgaggccgccaccccccaggccaaggagagagccagaggccaggccggcagacccggccaccagcacggccaggagcccgagugggccaccgccggcgccggcgcccccggcaaccccgaggaccccgccgaggccgcccagcagcugggcagacccagcgaggccggccagugcagauucagcagagaggaguucgagcagauccugcaggagagaaacgagcugaaggccaagguguuccugcugaaggaggagcuggccuacuuccagagagagcugcugaccgaccacagagugcccggccugcugcuggaggccaugaagguggccgugagaaagcagagaaagaagaucaaggccaagaugcugggcacccccgaggaggccgagagcagcgaggacgaggccggccccuggauccugcugagcgacgacaagggcgaccacccccccccccccgagagcaagauccagagcuucuucggccugugguacagaggcaaggccgagagcagcgaggacgagaccagcagccccgcccccagcaagcugggcggcgaggaggaggcccagccccagagccccgcccccgacccccccugcagcgcccugcacgagcaccugugccugggcgccagcgccgcccccgaggccuaa

SEQ ID NO: 22659 - RNA, 1212 nt, Artificial Sequence
  RILPL1__Homo_sapiens__NP_847884
auggaggaggagagaggcagcgcccuggccgccgagagcgcccuggagaagaacguggccgagcugaccgugauggacguguacgacaucgccagccuggugggccacgaguucgagagagugaucgaccagcacggcugcgaggccaucgccagacugaugcccaagguggugagagugcuggagauccuggaggugcuggugagcagacaccacguggcccccgagcuggacgagcugagacuggagcuggacagacugagacuggagagaauggacagaaucgagaaggagagaaagcaccagaaggagcuggagcugguggaggacguguggagaggcgaggcccaggaccugcugagccagaucgcccagcugcaggaggagaacaagcagcugaugaccaaccugagccacaaggacgugaacuucagcgaggaggaguuccagaagcacgagggcaugagcgagagagagagacaggugaugaagaagcugaaggaggugguggacaagcagagagacgagaucagagccaaggacagagagcugggccugaagaacgaggacguggaggcccugcagcagcagcagaccagacugaugaagaucaaccacgaccugagacacagagugaccgugguggaggcccagggcaaggcccugaucgagcagaagguggagcuggaggccgaccugcagaccaaggagcaggagaugggcagccugagagccgagcugggcaagcugagagagagacugcagggcgagcacagccagaacggcgaggaggagcccgagaccgagcccgugggcgaggagagcaucagcgacgccgagaagguggccauggaccugaaggaccccaacagacccagauucacccugcaggagcugagagacgugcugcacgagagaaacgagcugaagagcaagguguuccugcugcaggaggagcuggccuacuacaagagcgaggagauggaggaggagaacagaaucccccagcccccccccaucgcccaccccagaaccagcccccagcccgagagcggcaucaagagacuguucagcuucuucagcagagacaagaagagacuggccaacacccagagaaacgugcacauccaggagagcuucggccagugggccaacacccacagagacgacggcuacaccgagcagggccaggaggcccugcagcaccuguaa

SEQ ID NO: 22660 - RNA, 3159 nt, Artificial Sequence
  RIMBP2__Homo_sapiens__NP_056162
augagagaggccgccgagagaagacagcagcugcagcuggagcacgaccaggcccuggccgugcugagcgccaagcagcaggagaucgaccugcugcagaagagcaaggugagagagcuggaggagaagugcagaacccagagcgagcaguucaaccugcugagcagagaccuggagaaguucagacagcacgccggcaagaucgaccugcugggcggcagcgccguggccccccuggacaucagcaccgcccccagcaagcccuucccccaguucaugaacggccuggccaccagccugggcaagggccaggagagcgccaucggcggcagcagcgccaucggcgaguacaucagaccccugccccagcccggcgacagacccgagccccugagcgccaagcccaccuuccugagcagaagcggcagcgccagaugcagaagcgagagcgacauggagaacgagagaaacagcaacaccagcaagcagagauacagcggcaaggugcaccugugcguggccagauacagcuacaaccccuucgacggccccaacgagaaccccgaggccgagcugccccugaccgccggcaaguaccuguacguguacggcgacauggacgaggacggcuucuacgagggcgagcugcuggacggccagagaggccuggugcccagcaacuucguggacuucgugcaggacaacgagagcagacuggccagcacccugggcaacgagcaggaccagaacuucaucaaccacagcggcaucggccuggagggcgagcacauccuggaccugcacagccccacccacaucgacgccggcaucaccgacaacagcgccggcacccuggacgugaacaucgacgacaucggcgaggacaucgugcccuaccccagaaagaucacccugaucaagcagcuggccaagagcgugaucgugggcugggagccccccgccgugccccccggcuggggcaccgugagcagcuacaacgugcugguggacaaggagaccagaaugaaccugacccugggcagcagaaccaaggcccugaucgagaagcugaacauggccgccugcaccuacagaaucagcgugcagugcgugaccagcagaggcagcagcgacgagcugcagugcacccugcuggugggcaaggacguggugguggcccccagccaccugagaguggacaacaucacccagaucagcgcccagcugagcuggcugcccaccaacagcaacuacagccacgugaucuuccugaacgaggaggaguucgacaucgugaaggccgccagauacaaguaccaguucuucaaccugagacccaacauggccuacaaggugaaggugcuggccaagccccaccagaugcccuggcagcugccccuggagcagagagagaagaaggaggccuucguggaguucagcacccugcccgccggcccccccgcccccccccaggacgugaccgugcaggccggcgugacccccgccaccaucagagugagcuggagaccccccgugcugacccccaccggccugagcaacggcgccaacgugaccggcuacggcguguacgccaagggccagagaguggccgaggugaucuuccccaccgccgacagcaccgccguggagcuggugagacugagaagccuggaggccaagggcgugaccgugagaacccugagcgcccagggcgagagcguggacagcgccguggccgccgugccccccgagcugcuggugccccccaccccccaccccagacccgccccccagagcaagccccuggccagcagcggcgugcccgagaccaaggacgagcaccugggcccccacgccagaauggacgaggccugggagcagagcagagcccccggccccgugcacggccacaugcuggagccccccgugggccccggcagaagaagccccagccccagcagaauccugccccagccccagggcacccccgugagcaccaccguggccaaggccauggccagagaggccgcccagagaguggccgagagcagcagacuggagaagagaagcguguuccuggagagaagcagcgccggccaguacgccgccagcgacgaggaggacgccuacgacagccccgacuucaagagaagaggcgccagcguggacgacuuccugaagggcagcgagcugggcaagcagccccacugcugccacggcgacgaguaccacaccgagagcagcagaggcagcgaccugagcgacaucauggaggaggacgaggaggagcuguacagcgagaugcagcuggaggacggcggcagaagaagacccagcggcaccagccacaacgcccugaagauccugggcaaccccgccagcgccggcagaguggaccacaugggcagaagauuccccagaggcagcgccggcccccagagaagcagacccgugaccgugcccagcaucgacgacuacggcagagacagacugagccccgacuucuacgaggagagcgagaccgaccccggcgccgaggagcugcccgccagaaucuucguggcccuguucgacuacgacccccugaccaugagccccaaccccgacgccgccgaggaggagcugcccuucaaggagggccagaucaucaagguguacggcgacaaggacgccgacggcuucuacagaggcgagaccugcgccagacugggccugauccccugcaacauggugagcgagauccaggccgacgacgaggagaugauggaccagcugcugagacagggcuuccugccccugaacacccccguggagaagaucgagagaagcagaagaagcggcagaagacacagcgugagcaccagaagaaugguggcccuguacgacuacgaccccagagagagcagccccaacguggacguggaggccgagcugaccuucugcaccggcgacaucaucaccguguucggcgagaucgacgaggacggcuucuacuacggcgagcugaacggccagaagggccuggugcccagcaacuuccuggaggaggugcccgacgacguggagguguaccugagcgacgcccccagccacuacagccaggacacccccaugagaagcaaggccaagagaaagaagagcgugcacuucacccccuaa

SEQ ID NO: 22661 - RNA, 4920 nt, Artificial Sequence
  RIMBP3C__Homo_sapiens__NP_001122105
auggccaaggacagccccagcccccugggcgccagccccaagaagcccggcugcagcagccccgccgccgccgugcuggagaaccagagaagagagcuggagaagcugagagccgagcuggaggccgagagagccggcuggagagccgagagaagaagauucgccgccagagagagacagcugagagaggaggccgagagagagagaagacagcuggccgacagacugagaagcaagugggaggcccagagaagcagagagcugagacagcugcaggaggagaugcagagagagagagaggccgagaucagacagcugcugagauggaaggaggccgagcagagacagcugcagcagcugcugcacagagagagagacggcguggugagacaggccagagagcugcagagacagcuggccgaggagcuggugaacagaggccacugcagcagacccggcgccagcgaggugagcgccgcccagugcagaugcagacugcaggaggugcuggcccagcugagauggcagaccgacggcgagcaggccgccagaaucagauaccugcaggccgcccuggagguggagagacagcuguuccugaaguacauccuggcccacuucagaggccaccccgcccugagcggcagccccgacccccaggccgugcacagccuggaggagccccugccccagaccagcagcggcagcugccacgcccccaagcccgccugccagcugggcagccuggacagccugagcgccgaggugggcgugagaagcagaagccugggccuggugagcagcgccugcagcagcagccccgacggccugcugagcacccacgccagcagccuggacugcuucgcccccgccugcagcagaagccuggacagcaccagaagccugcccaaggccagcaagagcgaggagagacccagcagccccgacaccagcacccccggcagcagaagacugagccccccccccagcccccugccccccccccccccccccagcgcccacagaaagcugagcaaccccagaggcggcgagggcagcgagagccagcccugcgaggugcugacccccagcccccccggccugggccaccacgagcugaucaagcugaacuggcugcuggccaaggcccugugggugcuggccagaagaugcuacacccugcaggaggagaacaagcagcugagaagagccggcugccccuaccaggccgacgagaaggugaagagacugaaggugaagagagccgagcugaccggccuggccagaagacuggccgacagagccagagagcugcaggagaccaaccugagagccgugagcgcccccauccccggcgagagcugcgccggccuggagcugugccagguguucgccagacagagagccagagaccugagcgagcaggccagcgccccccuggccaaggacaagcagaucgaggagcugagacaggagugccaccugcugcaggccagaguggccagcggccccugcagcgaccugcacaccggcagaggcggccccugcacccaguggcugaacgugagagaccuggacagacugcagagagagagccagagagaggugcugagacugcagagacagcugaugcugcagcagggcaacggcggcgccuggcccgaggccggcggccagagcgccaccugcgaggaggugagaagacagaugcuggcccuggagagagagcuggaccagagaagaagagagugccaggagcugggcacccaggccgcccccgccagaagaagaggcgaggaggccgagacccagcugcaggccgcccugcugaagaacgccuggcuggccgaggagaacggcagacugcaggccaagaccgacugggugagaaagguggaggccgagaacagcgaggugagaggccaccugggcagagccugccaggagagagacgccagcggccugaucgccgagcagcugcugcagcaggccgccagaggccaggacagacagcagcagcugcagagagacccccagaaggcccugugcgaccugcaccccagcuggaaggagauccaggcccugcagugcagacccggccacccccccgagcagcccugggagaccagccagaugcccgagagccaggugaagggcagcagaagacccaaguuccacgccagacccgaggacuacgccgugagccagcccaacagagacauccaggagaagagagaggccagccuggaggagagccccguggcccugggcgagagcgccagcgugccccaggugagcgagaccgugcccgccagccagccccugagcaagaagaccagcagccagagcaacagcagcagcgagggcagcaugugggccaccgugcccagcagccccacccuggacagagacaccgccagcgagguggacgaccuggagcccgacagcgugagccuggcccuggagaugggcggcagcgccgcccccgccgcccccaagcugaagaucuucauggcccaguacaacuacaaccccuucgagggccccaacgaccaccccgagggcgagcugccccugaccgccggcgacuacaucuacaucuucggcgacauggacgaggacggcuucuacgagggcgagcuggacgacggcagaagaggccuggugcccagcaacuucguggagcagauccccgacagcuacauccccggcugccugcccgccaagagccccgaccugggccccagccagcugcccgccggccaggacgaggcccuggaggaggacagccugcugagcggcaaggcccagggcaugguggacagaggccugugccagauggugagagugggcagcaagaccgagguggccaccgagauccuggacaccaagaccgaggccugccagcugggccugcugcagagcaugggcaagcagggccugagcagaccccugcugggcaccaagggcgugcugagaauggcccccaugcagcugcaccugcagaacgugaccgccaccagcgccaacaucaccuggguguacagcagccacagacacccccacgugguguaccuggacgacagagagcacgcccugacccccgccggcgugagcugcuacaccuuccagggccugugccccggcacccacuacagagugagaguggaggugagacugcccugggaccugcugcagguguacuggggcaccaugagcagcaccgugaccuucgacacccugcuggccggcccccccuaccccccccuggacgugcugguggagagacacgccagccccggcgugcugguggugagcuggcugcccgugaccaucgacagcgccggcagcagcaacggcgugcaggugaccggcuacgccguguacgccgacggccugaaggugugcgagguggccgacgccaccgccggcagcaccgugcuggaguucagccagcugcaggugccccugaccuggcagaaggugagcgugagaaccaugagccugugcggcgagagccuggacagcgugcccgcccagauccccgaggacuucuucaugugccacagauggcccgagaccccccccuucagcuacaccugcggcgaccccagcaccuacagagugaccuuccccgugugcccccagaagcugagccuggccccccccagcgccaaggccagcccccacaaccccggcagcugcggcgagccccaggccaaguuccuggaggccuucuucgaggagccccccagaagacagagccccgugagcaaccugggcagcgagggcgagugccccagcagcggcgccggcagccaggcccaggagcuggccgaggccugggagggcugcagaaaggaccugcuguuccagaagagcccccagaaccacagaccccccagcgugagcgaccagcccggcgagaaggagaacugcuaccagcacaugggcaccagcaagagccccgcccccggcuucauccaccugagaaccgagugcggccccagaaaggagcccugccaggagaaggccgcccuggagagagugcugagacagaagcaggacgcccagggcuucacccccccccagcugggcgccagccagcaguacgccagcgacuuccacaacgugcugaaggaggagcaggaggcccugugccuggaccugagaggcaccgagagaagagaggagagaagagagcccgagccccacagcagacagggccaggcccugggcgugaagagaggcugccagcugcacgagcccagcagcgcccugugccccgcccccagcgccaaggugaucaagaugcccagaggcggcccccagcagcugggcaccggcgccaacacccccgccagaguguucguggcccugagcgacuacaacccccuggugaugagcgccaaccugaaggccgccgaggaggagcugguguuccagaagagacagcugcugagaguguggggcagccaggacacccacgacuucuaccugagcgagugcaacagacaggugggcaacauccccggcagacugguggccgagauggaggugggcaccgagcagaccgacagaagauggagaagccccgcccagggccaccugcccagcguggcccaccuggaggacuuccagggccugaucaucccccagggcagcagccuggugcugcagggcaacagcaagagacugccccuguggacccccaagaucaugaucgccgcccuggacuacgaccccggcgacggccagaugggcggccagggcaagggcagacuggcccugagagccggcgacguggugaugguguacggccccauggacgaccagggcuucuacuacggcgagcugggcggccacagaggccuggugcccgcccaccugcuggaccacaugagccugcacggccacuaa

SEQ ID NO: 22662 - RNA, 3039 nt, Artificial Sequence
  RIMS1__Homo_sapiens__NP_001161879
augugcgcccccggcauccacgugagcagcgagggcugggaggaggugagaagcguggacagcgaggagggcaccaucgaggccagaagagccguggccggcgaccuggacuacuacuggcuggaccccgccaccuggcacagcagagagaccagccccaucagcagccaccccgugaccuggcagcccagcaaggagggcgacagacugaucggcagagugauccugaacaagagaaccaccaugcccaaggacagcggcgcccugcugggccugaagguggugggcggcaagaugaccgaccugggcagacugggcgccuucaucaccaaggugaagaagggcagccuggccgacguggugggccaccugagagccggcgacgaggugcuggaguggaacggcaagccccugcccggcgccaccaacgaggagguguacaacaucauccuggagagcaagagcgagccccagguggagaucaucgugagcagacccaucggcgacauccccagaauccccgagagcagccaccccccccuggagagcagcagcagcagcuucgagagccagaagauggagagacccagcaucagcgugaucagccccaccagccccggcgcccugaaggacgccccccaggugcugcccggccagcugagcgugaagcugugguacgacaaggugggccaccagcugaucgugaacgugcugcaggccaccgaccugcccgccagaguggacggcagacccagaaaccccuacgugaagauguacuuccugcccgacagaagcgacaagagcaagagaagaaccaagaccgugaagaagauccuggagcccaaguggaaccagaccuucguguacagccacgugcacagaagagacuucagagagagaaugcuggagaucaccgugugggaccagcccagagugcaggaggaggagagcgaguuccugggcgagauccugaucgagcuggagaccgcccugcuggacgacgagccccacugguacaagcugcagacccacgacgagagcagccugccccugccccagcccagccccuucaugcccagaagacacauccacggcgagagcagcagcaagaagcugcagagaagccagagaaucagcgacagcgacaucagcgacuacgagguggacgacggcaucggcguggugccccccggcuacagaagcagcgccagagagagcaagagcaccacccugaccgugcccgagcagcagagaaccacccaccacagaagcagaagcgugagcccccacagaggcaacgaccagggcaagcccagaagcagacugcccaacgugccccugcagagaagccuggacgagauccaccccaccagaagaagcagaagccccaccagacaccacgacgccagcagaagccccguggaccacagaaccagagacguggacagccaguaccugagcgagcaggacagcgagcugcugaugcugcccagagccaagagaggcagaagcgccgagugccugcacaccaccagcgagcugcagcccuuccuggacagagccagaagcgccagcaccaacugccugagacccgacaccagccugcacagccccgagagagagagacacagcagaaagagcgagagaagcagcauccagaagcagaccagaaagggcaccgccagcgacgccgagagaaugcacagacagagaagccccacccagagcccccccgccgacaccagcuucagcagcagaagaggcagacagcugccccaggugcccgugagaagcggcagcaucgagcaggccagccuggugguggaggagagaaccagacagaugaagaugaaggugcacagauucaagcagaccaccggcagcggcagcagccaggagcuggacagagagcaguacagcaaguacaacauccacaaggaccaguacagaagcugcgacaacgugagcgccaagagcagcgacagcgacgugagcgacgugagcgccaucagcagaaccagcagcgccagcagacugagcagcaccagcuucaugagcgagcagagcgagagacccagaggcagaaucagcagcuucacccccaagaugcagggcagaagaaugggcaccagcggcagaagcaucaugaagagcaccagcgugagcggcgagauguacacccuggagcacaacgacggcagccagagcgacaccgccgugggcaccgugggcgccggcggcaagaagagaagaagcagccugagcgccaaggugguggccaucgugagcagaagaagcagaagcaccagccagcugagccagaccgagagcggccacaagaagcugaagagcaccauccagagaagcaccgagaccggcauggccgccgagaugagaaagauggugagacagcccagcagagagagcaccgacggcagcaucaacagcuacagcagcgagggcaaccugaucuuccccggcgugagacugggcgccgacagccaguucagcgacuuccuggacggccugggccccgcccagcuggugggcagacagacccuggccacccccgccaugggcgacauccagaucggcauggaggacaagaagggccagcuggagguggaggugaucagagccagaagccugacccagaagcccggcagcaagagcacccccgcccccuacgugaagguguaccugcuggagaacggcgccugcaucgccaagaagaagaccagaaucgccagaaagacccuggacccccuguaccagcagagccugguguucgacgagagcccccagggcaaggugcugcaggugaucguguggggcgacuacggcagaauggaccacaagugcuucaugggcguggcccagauccugcuggaggagcuggaccugagcagcauggugaucggcugguacaagcuguucccccccagcagccugguggaccccacccugaccccccugaccagaagagccagccagagcagccuggagagcagcaccggcccccccugcaucagaagcuaa

SEQ ID NO: 22663 - RNA, 4050 nt, Artificial Sequence
  RIMS2__Homo_sapiens__NP_001093587
augagcgcccccgugggccccagaggcagacuggcccccauccccgccgccagccagcccccccugcagcccgagaugcccgaccugagccaccugaccgaggaggagagaaagaucauccuggccgugauggacagacagaagaaggaggaggagaaggagcagagcgugcugaagaagcugcaccagcaguucgagauguacaaggagcaggugaagaagaugggcgaggagagccagcagcagcaggagcagaagggcgacgcccccaccugcggcaucugccacaagaccaaguucgccgacggcugcggccacaacugcagcuacugccagaccaaguucugcgccagaugcggcggcagagugagccugagaagcaacaaggugaugugggugugcaaccugugcagaaagcagcaggagauccugaccaagagcggcgccugguucuacaacagcggcagcaacaccccccagcagcccgaccagaaggugcugagaggccugagaaacgaggaggccccccaggagaagaagcccaagcugcacgagcagacccaguuccagggccccagcggcgaccugagcgugcccgccguggagaagagcagaagccacggccugaccagacagcacagcaucaagaacggcagcggcgugaagcaccacaucgccagcgacaucgccagcgacagaaagagaagccccagcgugagcagagaccagaacagaagauacgaccagagagaggagagagaggaguacagccaguacgccaccagcgacaccgccaugcccagaagccccagcgacuacgccgacagaagaagccagcacgagccccaguucuacgaggacagcgaccaccugagcuacagagacagcaacagaagaagccacagacacagcaaggaguacaucguggacgacgaggacguggagagcagagacgaguacgagagacagagaagagaggaggaguaccagagcagauacagaagcgaccccaaccuggccagauaccccgugaagccccagcccuacgaggagcagaugagaauccacgccgaggugagcagagccagacacgagagaagacacagcgacgugagccuggccaacgccgaccuggaggacagcagaaucagcaugcugagaauggacagacccagcagacagagaagcaucagcgagagaagagccgccauggagaaccagagaagcuacagcauggagagaaccagagaggcccagggccccagcagcuacgcccagagaaccaccaaccacagcccccccacccccagaagaagcccccugcccaucgacagacccgaccugagaagaaccgacagccugagaaagcagcaccaccuggaccccagcagcgccgugagaaagaccaagagagagaagauggagaccaugcugagaaacgacagccugagcagcgaccagagcgagagcgugagaccccccccccccaagccccacaagagcaagaagggcggcaagaugagacagaucagccugagcagcagcgaggaggagcuggccagcacccccgaguacaccagcugcgacgacguggagaucgagagcgagagcgugagcgagaagggcgacauggacuacaacuggcuggaccacaccagcuggcacagcagcgaggccagccccaugagccugcaccccgugaccuggcagcccagcaaggacggcgacagacugaucggcagaauccugcugaacaagagacugaaggacggcagcgugcccagagacagcggcgccaugcugggccugaagguggugggcggcaagaugaccgagagcggcagacugugcgccuucaucaccaaggugaagaagggcagccuggccgacaccgugggccaccugagacccggcgacgaggugcuggaguggaacggcagacugcugcagggcgccaccuucgaggagguguacaacaucauccuggagagcaagcccgagccccagguggagcugguggugagcagacccaucggcgacauccccagaauccccgacagcacccacgcccagcuggagagcagcagcagcagcuucgagagccagaagauggacagacccagcaucagcgugaccagccccaugagccccggcaugcugagagacgugccccaguuccugagcggccagcugagcagccagagccugagcagaagaaccacccccuucgugcccagagugcagaucaagcugugguucgacaaggugggccaccagcugaucgugaccauccugggcgccaaggaccugcccagcagagaggacggcagacccagaaaccccuacgugaagaucuacuuccugcccgacagaagcgacaagaacaagagaagaaccaagaccgugaagaagacccuggagcccaaguggaaccagaccuucaucuacagccccgugcacagaagagaguucagagagagaaugcuggagaucacccugugggaccaggccagagugagagaggaggagagcgaguuccugggcgagauccugaucgagcuggagaccgcccugcuggacgacgagccccacugguacaagcugcagacccacgacgugagcagccugccccugccccaccccagccccuacaugcccagaagacagcugcacggcgagagccccaccagaagacugcagagaagcaagagaaucagcgacagcgaggugagcgacuacgacugcgacgacggcaucggcguggugagcgacuacagacacgacggcagagaccugcagagcagcacccugagcgugcccgagcaggugaugagcagcaaccacugcagccccagcggcagcccccacagaguggacgugaucggcagaaccagaagcuggagccccagcgugccccccccccagagcagaaacguggagcagggccugagaggcaccagaaccaugaccggccacuacaacaccaucagcagaauggacagacacagagugauggacgaccacuacagccccgacagagacagagacugcgaggccgccgacagacagcccuaccacagaagcagaagcaccgagcagagaccccugcuggagagaaccaccaccagaagcagaagcaccgagagacccgacaccaaccugaugagaagcaugcccagccugaugaccggcagaagcgccccccccagccccgcccugagcagaagccaccccagaaccggcagcgugcagaccagccccagcagcacccccguggccggcagaagaggcagacagcugccccagcugccccccaagggcacccuggacagaaaggccggcggcaagaagcugagaagcaccgugcagagaagcaccgagaccggccuggccguggagaugagaaacuggaugaccagacaggccagcagagagagcaccgacggcagcaugaacagcuacagcagcgagggcaaccugaucuuccccggcgugagacuggccagcgacagccaguucagcgacuuccuggacggccugggccccgcccagcuggugggcagacagacccuggccacccccgccaugggcgacauccaggugggcaugauggacaagaagggccagcuggagguggagaucaucagagccagaggccugguggugaagcccggcagcaagacccugcccgcccccuacgugaagguguaccugcuggacaacggcgugugcaucgccaagaagaagaccaagguggccagaaagacccuggagccccuguaccagcagcugcugagcuucgaggagagcccccagggcaaggugcugcagaucaucguguggggcgacuacggcagaauggaccacaagagcuucaugggcguggcccagauccugcuggacgagcuggagcugagcaacauggugaucggcugguucaagcuguucccccccagcagccugguggaccccacccuggccccccugaccagaagagccagccagagcagccuggagagcagcaccggccccagcuacagcagaagcuaa

SEQ ID NO: 22664 - RNA, 813 nt, Artificial Sequence
  RIMS4__Homo_sapiens__NP_001192246
auggagagaagccagagcagacugagccugagcgccagcuucgaggcccuggccaucuacuuccccugcaugaacagcuucgacgacgaggacgccgagggcgacagcagaagacugaagggcgccauccagagaagcaccgagaccggccuggccguggagaugcccagcagaacccugagacaggccagccacgagagcaucgaggacagcaugaacagcuacggcagcgagggcaaccugaacuacggcggcgugugccuggccagcgacgcccaguucagcgacuuccugggcagcaugggccccgcccaguucgugggcagacagacccuggccaccacccccaugggcgacguggagaucggccugcaggagagaaacggccagcuggagguggacaucauccaggccagaggccugaccgccaagcccggcagcaagacccugcccgccgccuacaucaaggccuaccugcuggagaacggcaucugcaucgccaagaagaagaccaagguggccagaaagagccuggacccccuguacaaccaggugcugcuguuccccgagagcccccagggcaaggugcugcaggugaucguguggggcaacuacggcagaauggagagaaagcaguucaugggcguggccagagugcugcuggaggagcuggaccugaccacccuggccgugggcugguacaagcuguuccccaccagcagcaugguggaccccgccaccggcccccugcugagacaggccagccagcugagccuggagagcaccgugggccccugcggcgagagaagcuaa

SEQ ID NO: 22665 - RNA, 2352 nt, Artificial Sequence
  RIN1__Homo_sapiens__NP_004283
auggagagccccggcgagagcggcgccggcagccccggcgcccccagccccagcagcuucaccaccggccaccuggccagagagaagcccgcccaggacccccuguacgacgugcccaacgccagcggcggccaggccggcggcccccagagacccggcagaguggugagccugagagagagacugcugcugaccagacccguguggcugcagcugcaggccaacgccgccgccgcccugcacaugcugagaaccgagccccccggcaccuuccuggugagaaagagcaacaccagacagugccaggcccugugcaugagacugcccgaggccagcggccccagcuucgugagcagccacuacauccuggagagccccggcggcgugagccuggagggcagcgagcugauguuccccgaccuggugcagcugaucugcgccuacugccacaccagagacauccugcugcugccccugcagcugcccagagccauccaccacgccgccacccacaaggagcuggaggccaucagccaccugggcaucgaguucuggagcagcagccugaacaucaaggcccagagaggccccgccggcggccccgugcugccccagcugaaggccagaagcccccaggagcuggaccagggcaccggcgccgcccugugcuucuucaacccccuguuccccggcgaccugggccccaccaagagagagaaguucaagagaagcuucaaggugagagugagcaccgagaccagcagcccccugagcccccccgccgugccccccccccccgugcccgugcugcccggcgccgugcccagccagaccgagagacugccccccugccagcugcugagaagagagagcagcgugggcuacagagugcccgccggcagcggccccagccugccccccaugcccagccugcaggagguggacugcggcagccccagcagcagcgaggaggagggcgugcccggcagcagaggcagccccgccaccagcccccaccugggcagaagaagaccccugcugagaagcaugagcgccgccuucugcagccugcuggcccccgagagacaggugggcagagccgccgccgcccugaugcaggacagacacaccgccgccggccagcuggugcaggaccugcugacccaggugagagccggccccgagccccaggagcugcagggcaucagacaggcccugagcagagccagagccaugcugagcgccgagcugggccccgagaagcugcugagccccaagagacuggagcacgugcuggagaagagccugcacugcagcgugcugaagccccugagacccauccuggccgccagacugagaagaagacuggccgccgacggcagccugggcagacuggccgagggccugagacuggccagagcccagggccccggcgccuucggcagccaccugagccugcccagccccguggagcuggagcaggugagacagaagcugcugcagcugcugagaaccuacagccccagcgcccaggugaagagacugcugcaggccugcaagcugcuguacauggcccugagaacccaggagggcgagggcgccggcgccgacgaguuccugccccugcugagccuggugcuggcccacugcgaccugcccgagcugcugcuggaggccgaguacaugagcgagcugcuggagcccagccugcugaccggcgagggcggcuacuaccugaccagccugagcgccagccuggcccugcugagcggccugggccaggcccacacccugccccugagccccgugcaggagcugagaagaagccugagccugugggagcagagaagacugcccgccacccacugcuuccagcaccugcugagaguggccuaccaggaccccagcagcggcugcaccagcaagacccuggccgugccccccgaggccagcaucgccacccugaaccagcugugcgccaccaaguucagagugacccagcccaacaccuucggccuguuccuguacaaggagcagggcuaccacagacugccccccggcgcccuggcccacagacugcccaccaccggcuaccugguguacagaagagccgaguggcccgagacccagggcgccgugaccgaggaggagggcagcggccagagcgaggccagaagcagaggcgaggagcagggcugccagggcgacggcgacgccggcgugaaggccagccccagagacaucagagagcagagcgagaccaccgccgagggcggccagggccaggcccaggagggccccgcccagcccggcgagcccgaggccgagggcagcagagccgccgaggaguaa

SEQ ID NO: 22666 - RNA, 2835 nt, Artificial Sequence
  RIN2__Homo_sapiens__NP_001229510
augcuggacagcuucagccaggagagcacccugcccuucagagaggccagaaagagaaccagcuuccagcccgugcagguguggagaaacuucaccgccagccagaccaccgagagccccgccugcagcggcgccagccugggcgagaugaccgccuggaccaugggcgccagaggccuggacaagagaggcagcuucuucaagcugaucgacaccaucgccagcgagaucggcgagcugaagcaggagauggugagaaccgacgugaaccuggagaacggccuggagcccgccgagacccacagcauggugagacacaaggacggcggcuacagcgaggaggaggacgugaagaccugcgccagagacagcggcuacgacagccugagcaacagacugagcauccuggacagacugcugcacacccaccccaucuggcugcagcugagccugagcgaggaggaggccgccgaggugcugcaggcccagccccccggcaucuuccuggugcacaagagcaccaagaugcagaagaaggugcugagccugagacugcccugcgaguucggcgccccccugaaggaguucgccaucaaggagagcaccuacaccuucagccuggagggcagcggcaucagcuucgccgaccuguucagacugaucgccuucuacugcaucagcagagacgugcugcccuucacccugaagcugcccuacgccaucagcaccgccaagagcgaggcccagcuggaggagcuggcccagaugggccugaacuucuggagcagccccgccgacagcaagccccccaaccugccccccccccacagaccccugagcagcgacggcgugugccccgccagccugagacagcugugccugaucaacggcgugcacagcaucaagaccagaacccccagcgagcuggagugcagccagaccaacggcgcccugugcuucaucaacccccuguuccugaaggugcacagccaggaccugagcggcggccugaagagacccagcaccagaacccccaacgccaacggcaccgagagaaccagaagccccccccccagaccccccccccccgccaucaacagccugcacaccagccccagacuggccagaaccgagacccagaccagcaugcccgagaccgugaaccacaacaagcacggcaacguggcccugcccggcaccaagcccacccccauccccccccccagacugaagaagcaggccagcuuccuggaggccgagggcggcgccaagacccugagcggcggcagacccggcgccggccccgagcuggagcugggcaccgccggcagccccggcggcgccccccccgaggccgcccccggcgacugcaccagagcccccccccccagcagcgagagcagaccccccugccacggcggcagacagagacugagcgacaugagcaucagcaccagcagcagcgacagccuggaguucgacagaagcaugccccuguucggcuacgaggccgacaccaacagcagccuggaggacuacgagggcgagagcgaccaggagaccauggccccccccaucaagagcaagaagaagagaagcagcagcuucgugcugcccaagcuggugaagagccagcugcagaaggugagcggcguguucagcagcuucaugacccccgagaagagaauggugagaagaaucgccgagcugagcagagacaagugcaccuacuucggcugccuggugcaggacuacgugagcuuccugcaggagaacaaggagugccacgugagcagcaccgacaugcugcagaccaucagacaguucaugacccaggugaagaacuaccugagccagagcagcgagcuggacccccccaucgagagccugauccccgaggaccagaucgacguggugcuggagaaggccaugcacaagugcauccugaagccccugaagggccacguggaggccaugcugaaggacuuccacauggccgacggcagcuggaagcagcugaaggagaaccugcagcuggugagacagagaaacccccaggagcugggcguguucgcccccacccccgacuucguggacguggagaagaucaaggugaaguucaugaccaugcagaagauguacagccccgagaagaaggugaugcugcugcugagagugugcaagcugaucuacaccgugauggagaacaacagcggcagaauguacggcgccgacgacuuccugcccgugcugaccuacgugaucgcccagugcgacaugcuggagcuggacaccgagaucgaguacaugauggagcugcuggaccccagccugcugcacggcgagggcggcuacuaccugaccagcgccuacggcgcccugagccugaucaagaacuuccaggaggagcaggccgccagacugcugagcagcgagaccagagacacccugagacaguggcacaagagaagaaccaccaacagaaccauccccagcguggacgacuuccagaacuaccugagaguggccuuccaggaggugaacagcggcugcaccggcaagacccugcuggugagacccuacaucaccaccgaggacgugugccagaucugcgccgagaaguucaaggugggcgaccccgaggaguacagccuguuccuguucguggacgagaccuggcagcagcuggccgaggacaccuacccccagaagaucaaggccgagcugcacagcagaccccagccccacaucuuccacuucguguacaagagaaucaagaacgaccccuacggcaucaucuuccagaacggcgaggaggaccugaccaccagcuaa

SEQ ID NO: 22667 - RNA, 2958 nt, Artificial Sequence
  RIN3__Homo_sapiens__NP_079108
augaucagacacgccggcgcccccgccagaggcgaccccaccggccccgugcccguggugggcaagggcgaggaggaggaggaggaggacggcaugagacugugccugcccgccaaccccaagaacugccugccccacagaagaggcaucagcauccuggagaagcugaucaagaccugccccguguggcugcagcugagccugggccaggccgagguggccagaauccugcacagagugguggccggcauguuccuggugagaagagacagcagcagcaagcagcuggugcugugcgugcacuuccccagccugaacgagagcagcgccgaggugcuggaguacaccaucaaggaggagaagagcauccuguaccuggagggcagcgcccugguguucgaggacaucuucagacugaucgccuucuacugcgugagcagagaccugcugcccuucacccugagacugccccaggccauccuggaggccagcagcuucaccgaccuggagaccaucgccaaccugggccugggcuucugggacagcagccugaaccccccccaggagagaggcaagcccgccgagccccccagagacagagcccccggcuucccccuggugagcagccugagacccaccgcccacgacgccaacugcgccugcgagaucgagcugagcgugggcaacgacagacugugguucgugaaccccaucuucaucgaggacugcagcagcgcccugcccaccgaccagcccccccugggcaacugccccgccagaccccugccccccaccagcgacgccaccagccccaccagcagaugggcccccagaagaccccccccccccccccccgugcugccccugcagcccugcagccccgcccagccccccgugcugcccgcccuggcccccgcccccgccugcccccugcccaccagcccccccgugcccgccccccacgugaccccccacgcccccggcccccccgaccaccccaaccagccccccaugaugaccugcgagagacugcccugccccaccgccggccugggcccccugagagaggaggccaugaagcccggcgccgccagcagcccccugcagcaggugcccgcccccccccugcccgccaagaagaaccugcccaccgccccccccagaagaagagugagcgagagagugagccuggaggaccagagccccggcauggccgccgagggcgaccagcugagccugcccccccagggcaccagcgacggccccgaggacacccccagagagagcaccgagcagggccaggacaccgaggugaaggccagcgacccccacagcaugcccgagcugcccagaaccgccaagcagccccccgugcccccccccagaaagaagagaaucagcagacagcuggccagcacccugcccgccccccuggagaacgccgagcugugcacccaggccauggcccuggagacccccacccccggcccccccagagagggccagagccccgccagccaggccggcacccagcacccccccgcccaggccaccgcccacagccagagcagccccgaguucaagggcagccuggccagccugagcgacagccugggcgugagcgugauggccaccgaccaggacagcuacagcaccagcagcaccgaggaggagcuggagcaguucagcagccccagcgugaagaagaagcccagcaugauccugggcaaggccagacacagacugagcuucgccagcuucagcagcauguuccacgccuuccugagcaacaacagaaagcuguacaagaaggugguggagcuggcccaggacaagggcagcuacuucggcagccuggugcaggacuacaagguguacagccuggagaugauggccagacagaccagcagcaccgagaugcugcaggagaucagaaccaugaugacccagcugaagagcuaccugcugcagagcaccgagcugaaggcccugguggaccccgcccugcacagcgaggaggagcuggaggccaucguggagagcgcccuguacaagugcgugcugaagccccugaaggaggccaucaacagcugccugcaccagauccacagcaaggacggcagccugcagcagcugaaggagaaccagcuggugauccuggccaccaccaccaccgaccugggcgugaccaccagcgugcccgaggugcccaugauggagaagauccugcagaaguucaccagcaugcacaaggccuacagccccgagaagaagaucagcauccugcugaagaccugcaagcugaucuacgacagcauggcccugggcaaccccggcaagcccuacggcgccgacgacuuccugcccgugcugauguacgugcuggccagaagcaaccugaccgagaugcugcugaacguggaguacaugauggagcugauggaccccgcccugcagcugggcgagggcagcuacuaccugaccaccaccuacggcgcccuggagcacaucaagagcuacgacaagaucaccgugaccagacagcugagcguggaggugcaggacagcauccacagaugggagagaagaagaacccugaacaaggccagagccagcagaagcagcgugcaggacuucaucugcgugagcuaccuggagcccgagcagcaggccagaacccuggccagcagagccgacacccaggcccaggcccugugcgcccagugcgccgagaaguucgccguggagagaccccaggcccacagacuguucgugcugguggacggcagaugcuuccagcuggccgacgacgcccugccccacugcaucaagggcuaccugcugagaagcgagcccaagagagacuuccacuucguguacagaccccuggacggcggcggcggcggcggcggcggcagcccccccugccugguggugagagagcccaacuuccuguaa

SEQ ID NO: 22668 - RNA, 1221 nt, Artificial Sequence
  RING1__Homo_sapiens__NP_002922
augaccacccccgccaacgcccagaacgccagcaagaccugggagcugagccuguacgagcugcacagaaccccccaggaggccaucauggacggcaccgagaucgccgugagccccagaagccugcacagcgagcugaugugccccaucugccuggacaugcugaagaacaccaugaccaccaaggagugccugcacagauucugcagcgacugcaucgugaccgcccugagaagcggcaacaaggagugccccaccugcagaaagaagcuggugagcaagagaagccugagacccgaccccaacuucgacgcccugaucagcaagaucuaccccagcagagaggaguacgaggcccaccaggacagagugcugaucagacugagcagacugcacaaccagcaggcccugagcagcagcaucgaggagggccugagaaugcaggccaugcacagagcccagagagugagaagacccauccccggcagcgaccagaccaccaccaugagcggcggcgagggcgagcccggcgagggcgagggcgacggcgaggacgugagcagcgacagcgcccccgacagcgcccccggccccgcccccaagagacccagaggcggcggcgccggcggcagcagcgugggcaccggcggcggcggcaccggcggcgugggcggcggcgccggcagcgaggacagcggcgacagaggcggcacccugggcggcggcacccugggcccccccagcccccccggcgcccccagcccccccgagcccggcggcgagaucgagcugguguucagaccccacccccugcugguggagaagggcgaguacugccagaccagauacgugaagaccaccggcaacgccaccguggaccaccugagcaaguaccuggcccugagaaucgcccuggagagaagacagcagcaggaggccggcgagcccggcggccccggcggcggcgccagcgacaccggcggccccgacggcugcggcggcgagggcggcggcgccggcggcggcgacggccccgaggagcccgcccugcccagccuggagggcgugagcgagaagcaguacaccaucuacaucgcccccggcggcggcgccuucaccacccugaacggcagccugacccuggagcuggugaacgagaaguucuggaaggugagcagaccccuggagcugugcuacgcccccaccaaggaccccaaguaa

SEQ ID NO: 22669 - RNA, 2379 nt, Artificial Sequence
  RINT1__Homo_sapiens__NP_068749
augcugcccgccggcgagaucggcgccagccccgccgcccccugcugcagcgagagcggcgacgagagaaagaaccuggaggagaagagcgacaucaacgugaccgugcugaucggcagcaagcaggugagcgagggcaccgacaacggcgaccugcccagcuacgugagcgccuucaucgagaaggaggugggcaacgaccugaagagccugaagaagcuggacaagcugaucgagcagagaaccgugagcaagaugcagcuggaggagcaggugcugaccaucagcagcgagauccccaagagaaucagaagcgcccugaagaacgccgaggagagcaagcaguuccugaaccaguuccuggagcaggagacccaccuguucagcgccaucaacagccaccugcugaccgcccagcccuggauggacgaccugggcaccaugaucagccagaucgaggagaucgagagacaccuggccuaccugaaguggaucagccagaucgaggagcugagcgacaacauccagcaguaccugaugaccaacaacgugcccgaggccgccagcacccuggugagcauggccgagcuggacaucaagcugcaggagagcagcugcacccaccugcugggcuucaugagagccaccgugaaguucuggcacaagauccugaaggacaagcugaccagcgacuucgaggagauccuggcccagcugcacuggcccuucaucgcccccccccagagccagaccgugggccugagcagacccgccagcgcccccgagaucuacagcuaccuggagacccuguucugccagcugcugaagcugcagaccagcgacgagcugcugaccgagcccaagcagcugcccgagaaguacagccugcccgccagccccagcgugauccugcccauccaggugaugcugaccccccugcagaagagauucagauaccacuucagaggcaacagacagaccaacgugcugagcaagcccgagugguaccuggcccaggugcugauguggaucggcaaccacaccgaguuccuggacgagaagauccagcccauccuggacaaggugggcagccuggugaacgccagacuggaguucagcagaggccugaugaugcuggugcuggagaagcuggccaccgacauccccugccugcuguacgacgacaaccuguucugccaccugguggacgaggugcugcuguucgagagagagcugcacagcgugcacggcuaccccggcaccuucgccagcugcaugcacauccugagcgaggagaccugcuuccagagauggcugaccguggagagaaaguucgcccugcagaagauggacagcaugcugagcagcgaggccgccugggugagccaguacaaggacaucaccgacguggacgagaugaaggugcccgacugcgccgagaccuucaugacccugcugcuggugaucaccgacagauacaagaaccugcccaccgccagcagaaagcugcaguuccuggagcugcagaaggaccugguggacgacuucagaaucagacugacccaggugaugaaggaggagaccagagccagccugggcuucagauacugcgccauccugaacgccgugaacuacaucagcaccgugcuggccgacugggccgacaacguguucuuccugcagcugcagcaggccgcccuggagguguucgccgagaacaacacccugagcaagcugcagcugggccagcuggccagcauggagagcagcguguucgacgacaugaucaaccugcuggagagacugaagcacgacaugcugaccagacagguggaccacguguucagagaggugaaggacgccgccaagcuguacaagaaggagagauggcugagccugcccagccagagcgagcaggccgugaugagccugagcagcagcgccugcccccugcugcugacccugagagaccaccugcugcagcuggagcagcagcugugcuucagccuguucaagaucuucuggcagaugcugguggagaagcuggacguguacaucuaccaggagaucauccuggccaaccacuucaacgagggcggcgccgcccagcugcaguucgacaugaccagaaaccuguucccccuguucagccacuacugcaagagacccgagaacuacuucaagcacaucaaggaggccugcaucgugcugaaccugaacgugggcagcgcccugcugcugaaggacgugcugcagagcgccagcggccagcugcccgccaccgccgcccugaacgaggugggcaucuacaagcuggcccagcaggacguggagauccugcugaaccugagaaccaacuggcccaacaccggcaaguaa

SEQ ID NO: 22670 - RNA, 1707 nt, Artificial Sequence
  RIOK1__Homo_sapiens__NP_113668
auggacuacagaagacugcugaugagcagaguggugcccggccaguucgacgacgccgacagcagcgacagcgagaacagagaccugaagaccgugaaggagaaggacgacauccuguucgaggaccugcaggacaacgugaacgagaacggcgagggcgagaucgaggacgaggaggaggagggcuacgacgacgacgacgacgacugggacugggacgagggcgugggcaagcuggccaagggcuacguguggaacggcggcagcaacccccaggccaacagacagaccagcgacagcagcagcgccaagaugagcacccccgccgacaaggugcugagaaaguucgagaacaagaucaaccuggacaagcugaacgugaccgacagcgugaucaacaaggugaccgagaagagcagacagaaggaggccgacauguacagaaucaaggacaaggccgacagagccaccguggagcaggugcuggaccccagaaccagaaugauccuguucaagaugcugaccagaggcaucaucaccgagaucaacggcugcaucagcaccggcaaggaggccaacguguaccacgccagcaccgccaacggcgagagcagagccaucaagaucuacaagaccagcauccugguguucaaggacagagacaaguacgugagcggcgaguucagauucagacacggcuacugcaagggcaaccccagaaagauggugaagaccugggccgagaaggagaugagaaaccugaucagacugaacaccgccgagauccccugccccgagcccaucaugcugagaagccacgugcuggugaugagcuucaucggcaaggacgacaugcccgccccccugcugaagaacgugcagcugagcgagagcaaggccagagagcuguaccugcaggugauccaguacaugagaagaauguaccaggacgccagacuggugcacgccgaccugagcgaguucaacaugcuguaccacggcggcggcguguacaucaucgacgugagccagagcguggagcacgaccacccccacgcccuggaguuccugagaaaggacugcgccaacgugaacgacuucuucaugagacacagcguggccgugaugaccgugagagagcuguucgaguucgugaccgaccccagcaucacccacgagaacauggacgccuaccugagcaaggccauggagaucgccagccagagaaccaaggaggagagaagcagccaggaccacguggacgaggagguguucaagagagccuacauccccagaacccugaacgaggugaagaacuacgagagagacauggacaucaucaugaagcugaaggaggaggacauggccaugaacgcccagcaggacaacauccuguaccagaccgugaccggccugaagaaggaccugagcggcgugcagaaggugcccgcccugcuggagaaccagguggaggagagaaccugcagcgacagcgaggacaucggcagcagcgagugcagcgacaccgacagcgaggagcagggcgaccacgccagacccaagaagcacaccaccgaccccgacaucgacaagaaggagagaaagaagauggugaaggaggcccagagagagaagagaaagaacaagauccccaagcacgugaagaagagaaaggagaagaccgccaagaccaagaagggcaaguaa

SEQ ID NO: 22671 - RNA, 1425 nt, Artificial Sequence
  RIOK2__Homo_sapiens__NP_001153221
augggcaaggugaacguggccaagcugagauacaugagcagagacgacuucagagugcugaccgccguggagaugggcaugaagaaccacgagaucgugcccggcagccugaucgccagcaucgccagccugaagcacggcggcugcaacaaggugcugagagagcuggugaagcacaagcugaucgccugggagagaaccaagaccgugcagggcuacagacugaccaacgccggcuacgacuaccuggcccugaagacccugagcagcagacaggugguggagagcgugggcaaccagaugggcgugggcaaggagagcgacaucuacaucguggccaacgaggagggccagcaguucgcccugaagcugcacagacugggcagaaccagcuucagaaaccugaagaacaagagagacuaccacaagcacagacacaacgugagcuggcuguaccugagcagacugagcgccaugaaggaguucgccuacaugaaggcccuguacgagagaaaguuccccgugcccaagcccaucgacuacaacagacacgccguggugauggagcugaucaacggcuacccccugugccagauccaccacguggaggaccccgccagcguguacgacgaggccauggagcugaucgugaagcuggccaaccacggccugauccacggcgacuucaacgaguucaaccugauccuggacgagagcgaccacaucaccaugaucgacuucccccagauggugagcaccagccaccccaacgccgagugguacuucgacagagacgugaagugcaucaaggacuucuucaugaagagauucagcuacgagagcgagcuguuccccaccuucaaggacaucagaagagaggacacccuggacguggaggugagcgccagcggcuacaccaaggagaugcaggccgacgacgagcugcugcacccccugggccccgacgacaagaacaucgagaccaaggagggcagcgaguucagcuucagcgacggcgagguggccgagaaggccgagguguacggcagcgagaacgagagcgagagaaacugccuggaggagagcgagggcugcuacugcagaagcagcggcgaccccgagcagaucaaggaggacagccugagcgaggagagcgccgacgccagaagcuucgagaugaccgaguucaaccaggcccuggaggagaucaagggccaggugguggagaacaacagcgugaccgaguucagcgaggagaagaacagaaccgagaacuacaacagacaggacggccagagagugcagggcggcgugcccgccggcagcgacgaguacgaggacgagugcccccaccugaucgcccugagcagccugaacagagaguucagacccuucagauacagacugcugagcaucgccuucuaa

SEQ ID NO: 22672 - RNA, 1560 nt, Artificial Sequence
  RIOK3__Homo_sapiens__NP_003822
auggaccuggugggcguggccagccccgagcccggcaccgccgccgccuggggccccagcaagugccccugggccaucccccagaacaccaucagcugcagccuggccgacgugaugagcgagcagcuggccaaggagcugcagcuggaggaggaggccgccguguuccccgagguggccguggccgagggccccuucaucaccggcgagaacaucgacaccagcagcgaccugaugcuggcccagaugcugcagauggaguacgacagagaguacgacgcccagcugagaagagaggagaagaaguucaacggcgacagcaaggugagcaucagcuucgagaacuacagaaaggugcaccccuacgaggacagcgacagcagcgaggacgagguggacuggcaggacaccagagacgaccccuacagacccgccaagcccgugcccacccccaagaagggcuucaucggcaagggcaaggacaucaccaccaagcacgacgagguggugugcggcagaaagaacaccgccagaauggagaacuucgcccccgaguuccaggugggcgacggcaucggcauggaccugaagcugagcaaccacguguucaacgcccugaagcagcacgccuacagcgaggagagaagaagcgccagacugcacgagaagaaggagcacagcaccgccgagaaggccguggaccccaagaccagacugcugauguacaagauggugaacagcggcaugcuggagaccaucaccggcugcaucagcaccggcaaggagagcgugguguuccacgccuacggcggcagcauggaggacgagaaggaggacagcaaggugauccccaccgagugcgccaucaagguguucaagaccacccugaacgaguucaagaacagagacaaguacaucaaggacgacuucagauucaaggacagauucagcaagcugaaccccagaaagaucaucagaaugugggccgagaaggagaugcacaaccuggccagaaugcagagagccggcauccccugccccaccguggugcugcugaagaagcacauccuggugaugagcuucaucggccacgaccaggugcccgcccccaagcugaaggaggugaagcugaacagcgaggagaugaaggaggccuacuaccagacccugcaccugaugagacagcuguaccacgagugcacccuggugcacgccgaccugagcgaguacaacaugcuguggcacgccggcaagguguggcugaucgacgugagccagagcguggagcccacccacccccacggccuggaguuccuguucagagacugcagaaacgugagccaguucuuccagaagggcggcgugaaggaggcccugagcgagagagagcuguucaacgccgugagcggccugaacaucaccgccgacaacgaggccgacuuccuggccgagaucgaggcccuggagaagaugaacgaggaccacgugcagaagaacggcagaaaggccgccagcuuccugaaggacgacggcgaccccccccugcuguacgacgaguaa

SEQ ID NO: 22673 - RNA, 2016 nt, Artificial Sequence
  RIPK1__Homo_sapiens__NP_003795
augcagcccgacaugagccugaacgugaucaagaugaagagcagcgacuuccuggagagcgccgagcuggacagcggcggcuucggcaaggugagccugugcuuccacagaacccagggccugaugaucaugaagaccguguacaagggccccaacugcaucgagcacaacgaggcccugcuggaggaggccaagaugaugaacagacugagacacagcagaguggugaagcugcugggcgugaucaucgaggagggcaaguacagccuggugauggaguacauggagaagggcaaccugaugcacgugcugaaggccgagaugagcaccccccugagcgugaagggcagaaucauccuggagaucaucgagggcaugugcuaccugcacggcaagggcgugauccacaaggaccugaagcccgagaacauccugguggacaacgacuuccacaucaagaucgccgaccugggccuggccagcuucaagauguggagcaagcugaacaacgaggagcacaacgagcugagagagguggacggcaccgccaagaagaacggcggcacccuguacuacauggcccccgagcaccugaacgacgugaacgccaagcccaccgagaagagcgacguguacagcuucgccguggugcugugggccaucuucgccaacaaggagcccuacgagaacgccaucugcgagcagcagcugaucaugugcaucaagagcggcaacagacccgacguggacgacaucaccgaguacugccccagagagaucaucagccugaugaagcugugcugggaggccaaccccgaggccagacccaccuuccccggcaucgaggagaaguucagacccuucuaccugagccagcuggaggagagcguggaggaggacgugaagagccugaagaaggaguacagcaacgagaacgccguggugaagagaaugcagagccugcagcuggacugcguggccgugcccagcagcagaagcaacagcgccaccgagcagcccggcagccugcacagcagccagggccugggcaugggccccguggaggagagcugguucgcccccagccuggagcacccccaggaggagaacgagcccagccugcagagcaagcugcaggacgaggccaacuaccaccuguacggcagcagaauggacagacagaccaagcagcagcccagacagaacguggccuacaacagagaggaggagagaagaagaagagugagccacgaccccuucgcccagcagagacccuacgagaacuuccagaacaccgagggcaagggcaccgccuacagcagcgccgccagccacggcaacgccgugcaccagcccagcggccugaccagccagccccaggugcuguaccagaacaacggccuguacagcagccacggcuucggcaccagaccccuggaccccggcaccgccggccccagagugugguacagacccauccccagccacaugcccagccugcacaacauccccgugcccgagaccaacuaccugggcaacacccccaccaugcccuucagcagccugccccccaccgacgagagcaucaaguacaccaucuacaacagcaccggcauccagaucggcgccuacaacuacauggagaucggcggcaccagcagcagccugcuggacagcaccaacaccaacuucaaggaggagcccgccgccaaguaccaggccaucuucgacaacaccaccagccugaccgacaagcaccuggaccccaucagagagaaccugggcaagcacuggaagaacugcgccagaaagcugggcuucacccagagccagaucgacgagaucgaccacgacuacgagagagacggccugaaggagaagguguaccagaugcugcagaagugggugaugagagagggcaucaagggcgccaccgugggcaagcuggcccaggcccugcaccagugcagcagaaucgaccugcugagcagccugaucuacgugagccagaacuaa

SEQ ID NO: 22674 - RNA, 1623 nt, Artificial Sequence
  RIPK2__Homo_sapiens__NP_003812
augaacggcgaggccaucugcagcgcccugcccaccauccccuaccacaagcuggccgaccugagauaccugagcagaggcgccagcggcaccgugagcagcgccagacacgccgacuggagagugcagguggccgugaagcaccugcacauccacaccccccugcuggacagcgagagaaaggacgugcugagagaggccgagauccugcacaaggccagauucagcuacauccugcccauccugggcaucugcaacgagcccgaguuccugggcaucgugaccgaguacaugcccaacggcagccugaacgagcugcugcacagaaagaccgaguaccccgacguggccuggccccugagauucagaauccugcacgagaucgcccugggcgugaacuaccugcacaacaugacccccccccugcugcaccacgaccugaagacccagaacauccugcuggacaacgaguuccacgugaagaucgccgacuucggccugagcaaguggagaaugaugagccugagccagagcagaagcagcaagagcgcccccgagggcggcaccaucaucuacaugccccccgagaacuacgagcccggccagaagagcagagccagcaucaagcacgacaucuacagcuacgccgugaucaccugggaggugcugagcagaaagcagcccuucgaggacgugaccaacccccugcagaucauguacagcgugagccagggccacagacccgugaucaacgaggagagccugcccuacgacaucccccacagagccagaaugaucagccugaucgagagcggcugggcccagaaccccgacgagagacccagcuuccugaagugccugaucgagcuggagcccgugcugagaaccuucgaggagaucaccuuccuggaggccgugauccagcugaagaagaccaagcugcagagcgugagcagcgccauccaccugugcgacaagaagaagauggagcugagccugaacauccccgugaaccacggcccccaggaggagagcugcggcagcagccagcugcacgagaacagcggcagccccgagaccagcagaagccugcccgccccccaggacaacgacuuccugagcagaaaggcccaggacugcuacuucaugaagcugcaccacugccccggcaaccacagcugggacagcaccaucagcggcagccagagagccgccuucugcgaccacaagaccacccccugcagcagcgccaucaucaacccccugagcaccgccggcaacagcgagagacugcagcccggcaucgcccagcaguggauccagagcaagagagaggacaucgugaaccagaugaccgaggccugccugaaccagagccuggacgcccugcugagcagagaccugaucaugaaggaggacuacgagcuggugagcaccaagcccaccagaaccagcaaggugagacagcugcuggacaccaccgacauccagggcgaggaguucgccaaggugaucgugcagaagcugaaggacaacaagcagaugggccugcagcccuaccccgagauccugguggugagcagaagccccagccugaaccugcugcagaacaagagcauguaa

SEQ ID NO: 22675 - RNA, 1557 nt, Artificial Sequence
  RIPK3__Homo_sapiens__NP_006862
augagcugcgugaagcuguggcccagcggcgcccccgccccccuggugagcaucgaggagcuggagaaccaggagcuggugggcaagggcggcuucggcaccguguucagagcccagcacagaaaguggggcuacgacguggccgugaagaucgugaacagcaaggccaucagcagagaggugaaggccauggccagccuggacaacgaguucgugcugagacuggagggcgugaucgagaaggugaacugggaccaggaccccaagcccgcccuggugaccaaguucauggagaacggcagccugagcggccugcugcagagccagugccccagacccuggccccugcugugcagacugcugaaggagguggugcugggcauguucuaccugcacgaccagaaccccgugcugcugcacagagaccugaagcccagcaacgugcugcuggaccccgagcugcacgugaagcuggccgacuucggccugagcaccuuccagggcggcagccagagcggcaccggcagcggcgagcccggcggcacccugggcuaccuggcccccgagcuguucgugaacgugaacagaaaggccagcaccgccagcgacguguacagcuucggcauccugaugugggccgugcuggccggcagagagguggagcugcccaccgagcccagccugguguacgaggccgugugcaacagacagaacagacccagccuggccgagcugccccaggccggccccgagacccccggccuggagggccugaaggagcugaugcagcugugcuggagcagcgagcccaaggacagacccagcuuccaggagugccugcccaagaccgacgagguguuccagaugguggagaacaacaugaacgccgccgugagcaccgugaaggacuuccugagccagcugagaagcagcaacagaagauucagcauccccgagagcggccagggcggcaccgagauggacggcuucagaagaaccaucgagaaccagcacagcagaaacgacgugauggugagcgaguggcugaacaagcugaaccuggaggagccccccagcagcgugcccaagaagugccccagccugaccaagagaagcagagcccaggaggagcaggugccccaggccuggaccgccggcaccagcagcgacagcauggcccagcccccccagacccccgagaccagcaccuucagaaaccagaugcccagccccaccagcaccggcacccccagccccggccccagaggcaaccagggcgccgagagacagggcaugaacuggagcugcagaacccccgagcccaaccccgugaccggcagaccccuggugaacaucuacaacugcagcggcgugcaggugggcgacaacaacuaccugaccaugcagcagaccaccgcccugcccaccuggggccuggcccccagcggcaagggcagaggccugcagcaccccccccccgugggcagccaggagggccccaaggaccccgaggccuggagcagaccccagggcugguacaaccacagcggcaaguaa

SEQ ID NO: 22676 - RNA, 2355 nt, Artificial Sequence
  RIPK4__Homo_sapiens__NP_065690
auggagggcgacggcggcacccccugggcccuggcccugcugagaaccuucgacgccggcgaguucaccggcugggagaaggugggcagcggcggcuucggccagguguacaaggugagacacgugcacuggaagaccuggcuggccaucaagugcagccccagccugcacguggacgacagagagagaauggagcugcuggaggaggccaagaagauggagauggccaaguucagauacauccugcccguguacggcaucugcagagagcccgugggccuggugauggaguacauggagaccggcagccuggagaagcugcuggccagcgagccccugcccugggaccugagauucagaaucauccacgagaccgccgugggcaugaacuuccugcacugcauggcccccccccugcugcaccuggaccugaagcccgccaacauccugcuggacgcccacuaccacgugaagaucagcgacuucggccuggccaagugcaacggccugagccacagccacgaccugagcauggacggccuguucggcaccaucgccuaccugccccccgagagaaucagagagaagagcagacuguucgacaccaagcacgacguguacagcuucgccaucgugaucuggggcgugcugacccagaagaagcccuucgccgacgagaagaacauccugcacaucauggugaagguggugaagggccacagacccgagcugccccccgugugcagagccagacccagagccugcagccaccugaucagacugaugcagagaugcuggcagggcgaccccagagugagacccaccuuccaggagaucaccagcgagaccgaggaccugugcgagaagcccgacgacgaggugaaggagaccgcccacgaccuggacgugaagagcccccccgagcccagaagcgagguggugcccgccagacugaagagagccagcgcccccaccuucgacaacgacuacagccugagcgagcugcugagccagcuggacagcggcgugagccaggccguggagggccccgaggagcugagcagaagcagcagcgagagcaagcugcccagcagcggcagcggcaagagacugagcggcgugagcagcguggacagcgccuucagcagcagaggcagccugagccugagcuucgagagagagcccagcaccagcgaccugggcaccaccgacgugcagaagaagaagcugguggacgccaucgugagcggcgacaccagcaagcugaugaagauccugcagccccaggacguggaccuggcccuggacagcggcgccagccugcugcaccuggccguggaggccggccaggaggagugcgccaaguggcugcugcugaacaacgccaaccccaaccugagcaacagaagaggcagcaccccccugcacauggccguggagagaagagugagaggcgugguggagcugcugcuggccagaaagaucagcgugaacgccaaggacgaggaccaguggaccgcccugcacuucgccgcccagaacggcgacgagagcagcaccagacugcugcuggagaagaacgccagcgugaacgagguggacuucgagggcagaacccccaugcacguggccugccagcacggccaggagaacaucgugagaauccugcugagaagaggcguggacgugagccugcagggcaaggacgccuggcugccccugcacuacgccgccuggcagggccaccugcccaucgugaagcugcuggccaagcagcccggcgugagcgugaacgcccagacccuggacggcagaaccccccugcaccuggccgcccagagaggccacuacagaguggccagaauccugaucgaccugugcagcgacgugaacgugugcagccugcuggcccagaccccccugcacguggccgccgagaccggccacaccagcaccgccagacugcugcugcacagaggcgccggcaaggaggccaugaccagcgacggcuacaccgcccugcaccuggccgccagaaacggccaccuggccaccgugaagcugcugguggaggagaaggccgacgugcuggccagaggcccccugaaccagaccgcccugcaccuggccgccgcccacggccacagcgaggugguggaggagcuggugagcgccgacgugaucgaccuguucgacgagcagggccugagcgcccugcaccuggccgcccagggcagacacgcccagaccguggagacccugcugagacacggcgcccacaucaaccugcagagccugaaguuccagggcggccacggccccgccgccacccugcugagaagaagcaagaccuaa

SEQ ID NO: 22677 - RNA, 387 nt, Artificial Sequence
  RIPPLY2__Homo_sapiens__NP_001009994
auggagaacgccggcggcgccgagggcaccgagagcggcgccgccgccugcgccgccaccgacggccccaccagaagagccggcgccgacagcggcuacgccggcuucuggagacccuggguggacgccggcggcaagaaggaggaggagacccccaaccacgccgccgaggccaugcccgacggccccggcaugaccgccgccagcggcaagcuguaccaguucagacaccccgugagacuguucuggcccaagagcaagugcuacgacuaccuguaccaggaggccgaggcccugcugaagaacuuccccauccaggccaccaucagcuucuacgaggacagcgacagcgaggacgagaucgaggaccugaccugcgagaacuaa

SEQ ID NO: 22678 - RNA, 552 nt, Artificial Sequence
  RIT1__Homo_sapiens__NP_001243749
augaccaugcaguucaucagccacagauuccccgaggaccacgaccccaccaucgaggacgccuacaagaucagaaucagaaucgacgacgagcccgccaaccuggacauccuggacaccgccggccaggccgaguucaccgccaugagagaccaguacaugagagccggcgagggcuucaucaucugcuacagcaucaccgacagaagaagcuuccacgaggugagagaguucaagcagcugaucuacagagugagaagaaccgacgacacccccguggugcuggugggcaacaagagcgaccugaagcagcugagacaggugaccaaggaggagggccuggcccuggccagagaguucagcugccccuucuucgagaccagcgccgccuacagauacuacaucgacgacguguuccacgcccuggugagagagaucagaagaaaggagaaggaggccgugcuggccauggagaagaagagcaagcccaagaacagcguguggaagagacugaagagccccuucagaaagaagaaggacagcgugaccuaa

SEQ ID NO: 22679 - RNA, 462 nt, Artificial Sequence
  RIT2__Homo_sapiens__NP_001259006
auggagguggagaacgaggccagcugcagccccggcagcgccagcggcggcagcagagaguacaagguggugaugcugggcgccggcggcgugggcaagagcgccaugaccaugcaguucaucagccaccaguuccccgacuaccacgaccccaccaucgaggacgccuacaagacccaggugagaaucgacaacgagcccgccuaccuggacauccuggacaccgccggccaggccgaguucaccgccaugagagagcaguacaugagaggcggcgagggcuucaucaucugcuacagcgugaccgacagacagagcuuccaggaggccgccaaguucaaggagcugaucuuccaggugagacacaccuacgagaucccccuggugcuggugggcaacaagaucgaccuggagcaguucagacagcccacccugaaggaguucggcagagaggaguucuaa

SEQ ID NO: 22680 - RNA, 882 nt, Artificial Sequence
  RITA1__Homo_sapiens__NP_001273144
augcugagagagcccagaaagcagggccuggccggcagagcccaccugcugagccccggcaccaccggcagcaugaagacccccguggagcuggccgugagcggcaugcagacccugggccugcagcacagaugcagaggcggcuacagagugaaggccagaaccagcuacguggacgagacccuguucggcagccccgccggcaccagacccaccccccccgacuucgacccccccuggguggagaaggccaacagaaccagaggcgugggcaaggaggccagcaaggcccugggcgccaagggcagcugcgagaccacccccagcagaggcagcacccccacccugacccccagaaagaagaacaaguacagacccaucagccacacccccagcuacugcgacgagagccuguucggcagcagaagcgagggcgccagcuucggcgcccccagaauggccaagggcgacgccgccaagcugagagcccugcuguggacccccccccccacccccagaggcagccacagccccagacccagagaggccccccugagagccauccaccccgccggccccagcaagaccgagcccggccccgccgccgacagccagaagcugagcaugggcggccugcacagcagcagaccccugaagagaggccugagccacagccugacccaccugaacgugcccagcaccggccaccccgccaccagcgccccccacaccaacggcccccaggaccugagacccagcaccagcggcgugaccuucagaagcccccuggugaccagcagagccagaagcgugagcaucagcgugcccagcacccccagaagaggcggcgccacccagaagcccaagccccccuggaaguaa

SEQ ID NO: 22681 - RNA, 954 nt, Artificial Sequence
  RLBP1__Homo_sapiens__XP_011520172
augagcgagggcgugggcaccuucagaauggugcccgaggaggagcaggagcugagagcccagcuggagcagcugaccaccaaggaccacggccccguguucggccccugcagccagcugcccagacacacccugcagaaggccaaggacgagcugaacgagagagaggagaccagagaggaggccgugagagagcugcaggagauggugcaggcccaggccgccagcggcgaggagcuggccguggccguggccgagagagugcaggagaaggacagcggcuucuuccugagauucaucagagccagaaaguucaacgugggcagagccuacgagcugcugagaggcuacgugaacuucagacugcaguaccccgagcuguucgacagccugagccccgaggccgugagaugcaccaucgaggccggcuaccccggcgugcugagcagcagagacaaguacggcagaguggugaugcuguucaacaucgagaacuggcagagccaggagaucaccuucgacgagauccugcaggccuacugcuucauccuggagaagcugcuggagaacgaggagacccagaucaacggcuucugcaucaucgagaacuucaagggcuucaccaugcagcaggccgccagccugagaaccagcgaccugagaaagaugguggacaugcugcaggacagcuuccccgccagauucaaggccauccacuucauccaccagcccugguacuucaccaccaccuacaacguggugaagcccuuccugaagagcaagcugcuggagagaguguucgugcacggcgacgaccugagcggcuucuaccaggagaucgacgagaacauccugcccagcgacuucggcggcacccugcccaaguacgacggcaaggccguggccgagcagcuguucggcccccaggcccaggccgagaacaccgccuucuaa

SEQ ID NO: 22682 - RNA, 4578 nt, Artificial Sequence
  RLF__Homo_sapiens__XP_011540196
augaaggccagcgugugcaagaccaucgccugccugcugcccgaggaccuggaggugagaagagccugccagcugaccgaguuccugaucgagcccagccuggacggcuucaacaugcuggaggagcuguaccugcagcccgaccagaaguucgacgaggagaacgcccccgugcccaacagccugagaugcgagcugcugcuggcccugaaggcccacuggcccuucgaccccgaguucugggacuggaagacccugaagagacacugccaccagcugcugggccaggaggccagcgacagcgacgacgaccugagcggcuacgagaugagcaucaacgacaccgacgugcuggagagcuuccugagcgacuacgacgagggcaaggaggacaagcaguacagaagaagagaccugaccgaccagcacaaggagaagagagacaagaagcccaucggcagcagcgagagauaccagagauggcugcaguacaaguucuucugccugcugugcaagagagagugcaucgaggccagaauccugcaccacagcaagaugcacauggaggacggcaucuacaccugccccgugugcaucaagaaguucaagagaaaggagauguucgugccccacgugauggagcacgugaagaugccccccagcagaagagacagaagcaagaagaagcugcugcugaagggcagccagaagggcaucugccccaagagccccagcgccauccccgagcagaaccacagccugaacgaccaggccaagggcgagagccacgaguacgugaccuucagcaagcuggaggacugccaccugcaggacagagaccuguaccccugccccggcaccgacugcagcagaguguucaagcaguucaaguaccugagcgugcaccugaaggccgagcaccagaacaacgacgagaacgccaagcacuaccuggacaugaagaacagaagagagaagugcaccuacugcagaagacacuucaugagcgccuuccaccugagagagcacgagcaggugcacugcggcccccagcccuacaugugcgugagcaucgacugcuacgccagauucggcagcgugaacgagcugcugaaccacaagcagaagcacgacgaccugagauacaagugcgagcugaacggcugcaacaucguguucagcgaccugggccagcuguaccaccacgaggcccagcacuucagagacgccagcuacaccugcaacuuccugggcugcaagaaguucuacuacagcaagaucgaguaccagaaccaccugagcaugcacaacguggagaacagcaacggcgacaucaagaagagcgugaagcuggaggagagcgccaccggcgagaagcaggacugcaucaaccagccccaccugcugaaccagaccgacaagagccaccugcccgaggaccuguucugcgccgagagcgccaacagccagaucgacaccgagaccgccgagaaccugaaggagaacagcgacagcaacagcagcgaccagcugagccacagcagcagcgccagcaugaacgaggagcugaucgacacccuggaccacagcgagaccaugcaggacgugcugcugagcaacgagaagguguucggccccagcagccugaaggagaagugcagcagcauggccgugugcuucgacggcaccaaguucaccugcggcuucgacggcugcggcagcaccuacaagaacgccagaggcaugcagaagcaccugagaaaggugcaccccuaccacuucaagcccaagaagaucaagaccaaggaccuguuccccagccugggcaacgagcacaaccagaccaccgagaagcuggacgccgagcccaagcccugcagcgacaccaacagcgacagccccgacgagggccuggaccacaacauccacaucaagugcaagagagagcaccagggcuacagcagcgagagcagcaucugcgccagcaagagacccugcaccgaggacaccaugcuggagcugcugcugagacugaagcaccugagccugaagaacagcaucacccacggcagcuucagcggcagccugcagggcuaccccagcagcggcgccaagagccugcagagcgugagcagcaucagcgaccugaacuuccagaaccaggacgagaacaugcccagccaguaccuggcccagcuggccgccaagcccuucuucugcgagcugcagggcugcaaguacgaguucgugaccagagaggcccugcugaugcacuaccugaagaagcacaacuacagcaaggagaaggugcugcagcugaccauguuccagcacagauacagccccuuccagugccacaucugccagagaagcuucaccagaaagacccaccugagaauccacuacaagaacaagcaccagaucggcagcgacagagccacccacaagcugcuggacaacgagaagugcgaccacgagggccccugcagcguggacagacugaagggcgacugcagcgccgagcugggcggcgaccccagcagcaacagcgagaagccccacugccaccccaagaaggacgagugcagcagcgagaccgaccuggagagcagcugcgaggagaccgagagcaagaccagcgacaucagcagccccaucggcagccacagagaggagcaggagggcagagagggcagaggcagcagaagaaccguggccaagggcaaccugugcuacauccugaacaaguaccacaagcccuuccacugcauccacaagaccugcaacagcagcuucaccaaccugaagggccugaucagacacuacagaaccgugcaccaguacaacaaggagcagcugugccuggagaaggacaaggccagaaccaagagagagcuggugaagugcaagaagaucuucgccugcaaguacaaggagugcaacaagagauuccugugcagcaaggcccuggccaagcacugcagcgacagccacaaccuggaccacaucgaggagcccaaggugcugagcgaggccggcagcgccgccagauucagcugcaaccagccccagugccccgccguguucuacaccuucaacaagcugaagcaccaccugauggagcagcacaacaucgagggcgagauccacagcgacuacgagauccacugcgaccugaacggcugcggccagaucuucacccacagaagcaacuacagccagcacguguacuacagacacaaggacuacuacgacgaccuguucagaagccagaagguggccaacgagagacugcugagaagcgagaaggugugccagaccgccgacacccagggccacgagcaccagaccaccagaagaagcuucaacgccaagagcaagaagugcggccugaucaaggagaagaaggcccccaucagcuucaagaccagagccgaggcccugcacaugugcguggagcacagcgagcacacccaguaccccugcauggugcagggcugccugagcguggugaagcuggagagcagcaucgugagacacuacaagagaacccaccagaugagcagcgccuaccuggagcagcagauggagaaccugguggugugcgugaaguacggcaccaagaucaaggaggagccccccagcgaggccgaccccugcaucaagaaggaggagaacagaagcugcgagagcgagagaaccgagcacagccacagccccggcgacagcagcgcccccauccagaacaccgacugcugccacagcagcgagagagacggcggccagaagggcugcaucgagagcagcagcguguucgacgccgacacccugcuguacagaggcacccugaagugcaaccacagcagcaagaccaccagccuggagcagugcaacaucgugcagccccccccccccugcaagaucgagaacagcauccccaaccccaacggcaccgagagcggcaccuacuucaccagcuuccagcugccccugcccagaaucaaggagagcgagaccagacagcacagcagcggccaggagaacaccgugaagaaccccacccacgugcccaaggagaacuucagaaagcacagccagcccagaagcuucgaccugaagaccuacaagcccaugggcuucgagagcagcuuccugaaguucauccaggagagcgaggagaaggaggacgacuucgacgacugggagcccagcgagcaccugacccugagcaacagcagccagagcagcaacgaccugaccggcaacgugguggccaacaacauggugaacgacagcgagcccgagguggacaucccccacagcagcagcgacagcaccauccacgagaaccugaccgccauccccccccugaucguggccgagaccaccaccgugcccagccuggagaaccugagaguggugcuggacaaggcccugaccgacugcggcgagcuggcccugaagcagcugcacuaccugagacccgugguggugcuggagagaagcaaguucagcacccccauccuggaccuguuccccaccaagaagaccgacgagcugugcgugggcagcagcuaa

SEQ ID NO: 22683 - RNA, 1875 nt, Artificial Sequence
  RLIM__Homo_sapiens__NP_899196
auggagaacagcgacagcaacgacaagggcagcggcgaccagagcgccgcccagagaagaagccagauggacagacuggacagagaggaggccuucuaccaguucgugaacaaccugagcgaggaggacuacagacugaugagagacaacaaccugcugggcacccccggcgagagcaccgaggaggagcugcugagaagacugcagcagaucaaggagggcccccccccccagaacagcgacgagaacagaggcggcgacagcagcgacgacgugagcaacggcgacagcaucaucgacuggcugaacagcgugagacagaccggcaacaccaccagaagcggccagagaggcaaccagagcuggagagccgugagcagaaccaaccccaacagcggcgacuucagauucagccuggagaucaacgugaacagaaacaacggcagccagaacagcgagaacgagaacgagcccagcgccagaagaagcagcggcgagaacguggagaacaacagccagagacagguggagaaccccagaagcgagagcaccagcgccagacccagcagaagcgagagaaacagcaccgaggcccugaccgaggugccccccaccagaggccagagaagagccagaagcagaagccccgaccacagaagaaccagagccagagccgagagaagcagaagcccccugcaccccaugagcgagauccccagaagaagccaccacagcaucagcagccagaccuucgagcacccccuggugaacgagaccgagggcagcagcagaaccagacaccacgugacccugagacagcagaucagcggccccgagcugcugagcagaggccuguucgccgccagcggcaccagaaacgccagccagggcgccggcagcagcgacaccgccgccagcggcgagagcaccggcagcggccagagaccccccaccaucgugcuggaccugcaggugagaagagugagacccggcgaguacagacagagagacagcaucgccagcagaaccagaagcagaagccagacccccaacaacaccgugaccuacgagagcgagagaggcggcuucagaagaaccuucagcagaagcgagagagccggcgugagaaccuacgugagcaccaucagaauccccaucagaagaauccugaacaccggccugagcgagaccaccagcguggccauccagaccaugcugagacagaucaugaccggcuucggcgagcugagcuacuucauguacagcgacagcgacagcgagcccaccggcagcgugagcaacagaaacauggagagagccgagagcagaagcggcagaggcggcagcggcggcggcagcagcagcggcagcagcagcagcagcagcagcagcagcagcagcagcagcagcagcagcagcagcagcagccccagcagcagcagcggcggcgagagcagcgagaccagcagcgaccuguucgagggcagcaacgagggcagcagcagcagcggcagcagcggcgccagaagagagggcagacacagagcccccgugaccuucgacgagagcggcagccugcccuuccugagccuggcccaguucuuccugcugaacgaggacgacgacgaccagcccagaggccugaccaaggagcagaucgacaaccuggccaugagaagcuucggcgagaacgacgcccugaagaccugcagcgugugcaucaccgaguacaccgagggcaacaagcugagaaagcugcccugcagccacgaguaccacgugcacugcaucgacagauggcugagcgagaacagcaccugccccaucugcagaagagccgugcuggccagcggcaacagagagagcgugguguaa

SEQ ID NO: 22684 - RNA, 558 nt, Artificial Sequence
  RLN1__Homo_sapiens__NP_008842
augcccagacuguuccuguuccaccugcuggaguucugccugcugcugaaccaguucagcagagccguggccgccaaguggaaggacgacgugaucaagcugugcggcagagagcuggugagagcccagaucgccaucugcggcaugagcaccuggagcaagagaagccugagccaggaggacgccccccagacccccagacccguggccgagaucgugcccagcuucaucaacaaggacaccgagaccaucaucaucaugcuggaguucaucgccaaccugccccccgagcugaaggccgcccugagcgagagacagcccagccugcccgagcugcagcaguacgugcccgcccugaaggacagcaaccugagcuucgaggaguucaagaagcugaucagaaacagacagagcgaggccgccgacagcaaccccagcgagcugaaguaccugggccuggacacccacagccagaagaagagaagacccuacguggcccuguucgagaagugcugccugaucggcugcaccaagagaagccuggccaaguacugcuaa

SEQ ID NO: 22685 - RNA, 354 nt, Artificial Sequence
  RLN2__Homo_sapiens__NP_005050
augcccagacuguucuucuuccaccugcugggcgugugccugcugcugaaccaguucagcagagccguggccgacagcuggauggaggaggugaucaagcugugcggcagagagcuggugagagcccagaucgccaucugcggcaugagcaccuggagcaagagaagccugagccaggaggacgccccccagacccccagacccguggccggcgacuucauccagaccgugagccugggcaucagccccgacggcggcaaggcccugagaaccggcagcugcuucaccagagaguuccugggcgcccugagcaagcugugccaccccagcagcaccaagauccagaagcccuaa

SEQ ID NO: 22686 - RNA, 429 nt, Artificial Sequence
  RLN3__Homo_sapiens__NP_543140
auggccagauacaugcugcugcugcugcuggccgugugggugcugaccggcgagcuguggcccggcgccgaggccagagccgcccccuacggcgugagacugugcggcagagaguucaucagagccgugaucuucaccugcggcggcagcagauggagaagaagcgacauccuggcccacgaggccaugggcgacaccuuccccgacgccgacgccgacgaggacagccuggccggcgagcuggacgaggccaugggcagcagcgaguggcuggcccugaccaagagcccccaggccuucuacagaggcagacccagcuggcagggcacccccggcgugcugagaggcagcagagacgugcuggccggccugagcagcagcugcugcaaguggggcugcagcaagagcgagaucagcagccugugcuaa

SEQ ID NO: 22687 - RNA, 855 nt, Artificial Sequence
  RMDN1__Homo_sapiens__NP_001273648
auggcccuggccgccagacuguggagacugcugcccuucagaagaggcgccgcccccggcagcagacugcccgccggcaccagcggcagcagaggccacugcggccccugcagauucagaggcuucgaggugaugggcaaccccggcaccuucaagagaggccugcugcugagcgcccugagcuaccugggcuucgagaccuaccaggugaucagccaggccgccguggugcacgccaccgccaagguggaggagauccuggagcaggccgacuaccuguacgagagcggcgagaccgagaagcuguaccagcugcugacccaguacaaggagagcgaggacgccgagcugcuguggagacuggccagagccagcagagacguggcccagcugagcagaaccagcgaggaggagaagaagcugcugguguacgaggcccuggaguacgccaagagagcccuggagaagaacgagagcagcuucgccagccacaagaaggccaucgagcugaaccccaaggacgccaccagcauccaccugaugggcaucuggugcuacaccuucgccgagaugcccugguaccagagaagaaucgccaagaugcuguucgccaccccccccagcagcaccuacgagaaggcccugggcuacuuccacagagccgagcagguggaccccaacuucuacagcaagaaccugcugcugcugggcaagaccuaccugaagcugcacaacaagaagcuggccgccuucuggcugaugaaggccaaggacuaccccgcccacaccgaggaggacaagcagauccagaccgaggccgcccagcugcugaccagcuucagcgagaagaacuaa

SEQ ID NO: 22688 - RNA, 1233 nt, Artificial Sequence
  RMDN2__Homo_sapiens__NP_001164263
augcccuacagcaccaacaaggagcugauccugggcaucauggugggcaccgccggcaucagccugcugcugcugugguaccacaaggugagaaagcccggcaucgccaugaagcugcccgaguuccugagccugggcaacaccuucaacagcaucacccugcaggacgagauccacgacgaccagggcaccaccgugaucuuccaggagagacagcugcagauccuggagaagcugaacgagcugcugaccaacauggaggagcugaaggaggagaucagauuccugaaggaggccauccccaagcuggaggaguacauccaggacgagcugggcggcaagaucaccgugcacaagaucagcccccagcacagagccagaaagagaagacugcccaccauccagagcagcgccaccagcaacagcagcgaggaggccgagagcgagggcggcuacaucaccgccaacaccgacaccgaggagcagagcuuccccgugcccaaggccuucaacaccagaguggaggagcugaaccuggacgugcugcugcagaagguggaccaccugagaaugagcgagagcggcaagagcgagagcuucgagcugcugagagaccacaaggagaaguucagagacgagaucgaguucauguggagauucgccagagccuacggcgacauguacgagcugagcaccaacacccaggagaagaagcacuacgccaacaucggcaagacccugagcgagagagccaucaacagagcccccaugaacggccacugccaccugugguacgccgugcugugcggcuacgugagcgaguucgagggccugcagaacaagaucaacuacggccaccuguucaaggagcaccuggacaucgccaucaagcugcugcccgaggagcccuuccuguacuaccugaagggcagauacugcuacaccgugagcaagcugagcuggaucgagaagaagauggccgccacccuguucggcaagauccccagcagcaccgugcaggaggcccugcacaacuuccugaaggccgaggagcugugccccggcuacagcaaccccaacuacauguaccuggccaagugcuacaccgaccuggaggagaaccagaacgcccugaaguucugcaaccuggcccugcugcugcccaccgugaccaaggaggacaaggaggcccagaaggagaugcagaagaucaugaccagccugaagagauaa

SEQ ID NO: 22689 - RNA, 1413 nt, Artificial Sequence
  RMDN3__Homo_sapiens__NP_001291731
augagcagacugggcgcccugggcggcgccagagccggccugggccugcugcugggcaccgccgccggccugggcuuccugugccugcuguacagccagagauggaagagaacccagagacacggcagaagccagagccugcccaacagccuggacuacacccagaccagcgaccccggcagacacgugaugcugcugagagccgugcccggcggcgccggcgacgccagcgugcugcccagccugcccagagagggccaggagaaggugcuggacagacuggacuucgugcugaccagccugguggcccugagaagagagguggaggagcugagaagcagccugagaggccuggccggcgagaucgugggcgaggugagaugccacauggaggagaaccagagaguggccagaagaagaagauuccccuucgugagagagagaagcgacagcaccggcagcagcagcguguacuucaccgccagcagcggcgccaccuucaccgacgccgagagcgagggcggcuacaccaccgccaacgccgagagcgacaacgagagagacagcgacaaggagagcgaggacggcgaggacgaggugagcugcgagaccgugaagaugggcagaaaggacagccuggaccuggaggaggaggccgccagcggcgccagcagcgcccuggaggccggcggcagcagcggccuggaggacgugcugccccugcugcagcaggccgacgagcugcacagaggcgacgagcagggcaagagagagggcuuccagcugcugcugaacaacaagcugguguacggcagcagacaggacuuccuguggagacuggccagagccuacagcgacaugugcgagcugaccgaggaggugagcgagaagaagagcuacgcccuggacggcaaggaggaggccgaggccgcccuggagaagggcgacgagagcgccgacugccaccugugguacgccgugcugugcggccagcuggccgagcacgagagcauccagagaagaauccagagcggcuucagcuucaaggagcacguggacaaggccaucgcccugcagcccgagaaccccauggcccacuuccugcugggcagauggugcuaccaggugagccaccugagcuggcuggagaagaagaccgccaccgcccugcuggagagcccccugagcgccaccguggaggacgcccugcagagcuuccugaaggccgaggagcugcagcccggcuucagcaaggccggcagaguguacaucagcaagugcuacagagagcugggcaagaacagcgaggccagaugguggaugaagcuggcccuggagcugcccgacgugaccaaggaggaccuggccauccagaaggaccuggaggagcuggaggugauccugagagacuaa

SEQ ID NO: 22690 - RNA, 1878 nt, Artificial Sequence
  RMI1__Homo_sapiens__XP_011517336
augaacgugaccagcaucgcccugagagccgagaccuggcugcuggccgccuggcacgugaaggugccccccauguggcuggaggccugcaucaacuggauccaggaggagaacaacaacgugaaccugagccaggcccagaugaacaagcagguguucgagcaguggcugcugaccgaccugagagaccuggagcacccccugcugcccgacggcauccuggagauccccaagggcgagcugaacggcuucuacgcccugcagaucaacagccugguggacgugagccagcccgccuacagccagauccagaagcugagaggcaagaacaccaccaacgaccuggugaccgccgaggcccaggugacccccaagcccugggaggccaagcccagcagaaugcugaugcugcagcugaccgacggcaucgugcagauccagggcauggaguaccagcccauccccauccugcacagcgaccugccccccggcaccaagauccugaucuacggcaacaucagcuucagacugggcgugcugcugcugaagcccgagaacgugaaggugcugggcggcgagguggacgcccugcuggaggaguacgcccaggagaaggugcuggccagacugaucggcgagcccgaccugguggugagcgugauccccaacaacagcaacgagaacauccccagagugaccgacgugcuggaccccgcccugggccccagcgacgaggagcugcuggccagccuggacgagaacgacgagcugaccgccaacaacgacaccagcagcgagagaugcuucaccaccggcagcagcagcaacaccauccccaccagacagagcagcuucgagcccgaguucgugaucagccccagacccaaggaggagcccagcaaccugagcauccacgugauggacggcgagcuggacgacuucagccuggaggaggcccugcugcuggaggagaccgugcagaaggagcagauggagaccaaggagcugcagccccugaccuucaacagaaacgccgacagaagcaucgagagauucagccacaaccccaacaccaccaacaacuucagccugaccugcaagaacggcaacaacaacuggagcgagaagaacgugagcgagcagaugaccaacgaggacaagagcuucggcugccccagcgugagagaccagaacagaagcaucuucagcgugcacugcaacgugccccuggcccacgacuucaccaacaaggagaagaaccuggagaccgacaacaagaucaagcagaccagcagcagcgacagccacagccugaacaacaagauccugaacagagagguggugaacuacgugcagaagagaaacagccagaucagcaacgagaacgacugcaaccugcagagcugcagccugagaagcagcgagaacagcaucaaccugagcaucgccauggaccuguacagcccccccuucguguaccugagcgugcugauggccagcaagcccaaggaggugaccaccgugaaggugaaggccuucaucgugacccugaccggcaaccugagcagcagcggcggcaucuggagcaucaccgccaaggugagcgacggcaccgccuaccuggacguggacuucguggacgagauccugaccagccugaucggcuucagcgugcccgagaugaagcagagcaagaaggacccccugcaguaccagaaguuccuggagggccugcagaagugccagagagaccugaucgaccugugcugccugaugaccaucagcuucaaccccagccugagcaaggccauggugcuggcccugcaggacgugaacauggagcaccuggagaaccugaagaagagacugaacaaguaa

SEQ ID NO: 22691 - RNA, 444 nt, Artificial Sequence
  RMI2__Homo_sapiens__NP_689521
auggccgccgccgccgacagcuucagcggcggccccgccggcgugagacugcccagaagccccccccugaaggugcuggccgagcagcugagaagagacgccgagggcggccccggcgccuggagacugagcagagccgccgccggcagaggcccccuggaccuggccgccguguggaugcagggcagaguggugauggccgacagaggcgaggccagacugagagaccccagcggcgacuucagcgugagaggccuggagagagugcccagaggcagacccugccuggugcccggcaaguacgugauggugaugggcguggugcaggccugcagccccgagcccugccugcaggccgugaagaugaccgaccugagcgacaaccccauccacgagagcaugugggagcuggagguggaggaccugcacagaaacauccccuaa

SEQ ID NO: 22692 - RNA, 840 nt, Artificial Sequence
  RMND1__Homo_sapiens__NP_001258866
augcacugcaccgccuucgccaccgccgacgaguaccaccugggcaaccugagccaggaccuggccagccacggcuacguggaggugaccagccugcccagagacgccgccaacauccuggugaugggcguggagaacagcgccaaggagggcgaccccggcaccaucuucuucuucagagagggcgccgccguguucuggaacgugaaggacaagaccaugaagcacgugaugaaggugcuggagaagcacgagauccagcccuacgagaucgcccuggugcacugggagaacgaggagcugaacuacaucaagaucgagggccagagcaagcugcacagaggcgagaucaagcugaacagcgagcuggaccuggacgacgccauccuggagaaguucgccuucagcaacgcccugugccugagcgugaagcuggccaucugggaggccagccuggacaaguucaucgagagcauccagagcauccccgaggcccugaaggccggcaagaaggugaagcugagccacgaggaggugaugcagaagaucggcgagcuguucgcccugagacacagaaucaaccugagcagcgacuuccugaucacccccgacuucuacugggacagagagaaccuggagggccuguacgacaagaccugccaguuccugagcaucggcagaagagugaaggugaugaacgagaagcugcagcacugcauggagcugaccgaccugaugagaaaccaccugaacgagaagagagcccugagacuggaguggaugaucgugauccugaucaccaucgaggugauguucgagcugggcagaguguucuucuaa

SEQ ID NO: 22693 - RNA, 600 nt, Artificial Sequence
  RNASE11__Homo_sapiens__NP_660293
auggagaccuucccccugcugcugcugagccugggccuggugcuggccgaggccagcgagagcaccaugaagaucaucaaggaggaguucaccgacgaggagaugcaguacgacauggccaagagcggccaggagaagcagaccaucgagauccugaugaaccccauccugcuggugaagaacaccagccugagcaugagcaaggacgacaugagcagcacccugcugaccuucagaagccugcacuacaacgaccccaagggcaacagcagcggcaacgacaaggagugcugcaacgacaugaccguguggagaaaggugagcgaggccaacggcagcugcaaguggagcaacaacuucaucagaagcagcaccgaggugaugagaagagugcacagagcccccagcugcaaguucgugcagaaccccggcaucagcugcugcgagagccuggagcuggagaacaccgugugccaguucaccaccggcaagcaguuccccagaugccaguaccacagcgugaccagccuggagaagauccugaccgugcugaccggccacagccugaugagcuggcuggugugcggcagcaagcuguaa

SEQ ID NO: 22694 - RNA, 444 nt, Artificial Sequence
  RNASE12__Homo_sapiens__NP_001019993
augaucaucauggugaucaucuuccuggugcugcuguucugggagaacgaggugaacgacgaggccgugaugagcacccuggagcaccugcacguggacuacccccagaacgacgugcccgugcccgccagauacugcaaccacaugaucauccagagagugaucagagagcccgaccacaccugcaagaaggagcacguguucauccacgagagacccagaaagaucaacggcaucugcaucagccccaagaagguggccugccagaaccugagcgccaucuucugcuuccagagcgagaccaaguucaagaugaccgugugccagcugaucgagggcaccagauaccccgccugcagauaccacuacagccccaccgagggcuucgugcuggugaccugcgacgaccugagacccgacagcuuccugggcuacgugaaguaa

SEQ ID NO: 22695 - RNA, 471 nt, Artificial Sequence
  RNASE13__Homo_sapiens__NP_001012264
auggcccccgccgugaccagacugcuguuccugcagcuggugcugggccccacccuggugauggacaucaagaugcagaucggcagcagaaacuucuacacccugagcaucgacuaccccagagugaacuaccccaagggcuucagaggcuacugcaacggccugaugagcuacaugagaggcaagaugcagaacagcgacugccccaagauccacuacgugauccacgcccccuggaaggccauccagaaguucugcaaguacagcgacagcuucugcgagaacuacaacgaguacugcacccugacccaggacagccugcccaucaccgugugcagccugagccaccagcagccccccaccagcugcuacuacaacagcacccugaccaaccagaagcuguaccugcugugcagcagaaaguacgaggccgaccccaucggcaucgccggccuguacagcggcaucuaa

SEQ ID NO: 22696 - RNA, 471 nt, Artificial Sequence
  RNASE1__Homo_sapiens__NP_937875
auggcccuggagaagagccuggugagacugcugcugcuggugcugauccugcuggugcugggcugggugcagcccagccugggcaaggagagcagagccaagaaguuccagagacagcacauggacagcgacagcagccccagcagcagcagcaccuacugcaaccagaugaugagaagaagaaacaugacccagggcagaugcaagcccgugaacaccuucgugcacgagccccugguggacgugcagaacgugugcuuccaggagaaggugaccugcaagaacggccagggcaacugcuacaagagcaacagcagcaugcacaucaccgacugcagacugaccaacggcagcagauaccccaacugcgccuacagaaccagccccaaggagagacacaucaucguggccugcgagggcagccccuacgugcccgugcacuucgacgccagcguggaggacagcaccuaa

SEQ ID NO: 22697 - RNA, 486 nt, Artificial Sequence
  RNASE2__Homo_sapiens__NP_002925
auggugcccaagcuguucaccagccagaucugccugcugcugcugcugggccugcuggccguggagggcagccugcacgugaagcccccccaguucaccugggcccagugguucgagacccagcacaucaacaugaccagccagcagugcaccaacgccaugcaggugaucaacaacuaccagagaagaugcaagaaccagaacaccuuccugcugaccaccuucgccaacguggugaacgugugcggcaaccccaacaugaccugccccagcaacaagaccagaaagaacugccaccacagcggcagccaggugccccugauccacugcaaccugaccacccccagcccccagaacaucagcaacugcagauacgcccagacccccgccaacauguucuacaucguggccugcgacaacagagaccagagaagagaccccccccaguaccccguggugcccgugcaccuggacagaaucaucuaa

SEQ ID NO: 22698 - RNA, 483 nt, Artificial Sequence
  RNASE3__Homo_sapiens__NP_002926
auggugcccaagcuguucaccagccagaucugccugcugcugcugcugggccugaugggcguggagggcagccugcacgccagacccccccaguucaccagagcccagugguucgccauccagcacaucagccugaacccccccagaugcaccaucgccaugagagccaucaacaacuacagauggagaugcaagaaccagaacaccuuccugagaaccaccuucgccaacguggugaacgugugcggcaaccagagcaucagaugcccccacaacagaacccugaacaacugccacagaagcagauucagagugccccugcugcacugcgaccugaucaaccccggcgcccagaacaucagcaacugcaccuacgccgacagacccggcagaagauucuacgugguggccugcgacaacagagaccccagagacagccccagauaccccguggugcccgugcaccuggacaccaccaucuaa

SEQ ID NO: 22699 - RNA, 444 nt, Artificial Sequence
  RNASE4__Homo_sapiens__NP_002928
auggcccugcagagaacccacagccugcugcugcugcugcugcugacccugcugggccugggccuggugcagcccagcuacggccaggacggcauguaccagagauuccugagacagcacgugcaccccgaggagaccggcggcagcgacagauacugcaaccugaugaugcagagaagaaagaugacccuguaccacugcaagagauucaacaccuucauccacgaggacaucuggaacaucagaagcaucugcagcaccaccaacauccagugcaagaacggcaagaugaacugccacgagggcguggugaaggugaccgacugcagagacaccggcagcagcagagcccccaacugcagauacagagccaucgccagcaccagaagaguggugaucgccugcgagggcaacccccaggugcccgugcacuucgacggcuaa

SEQ ID NO: 22700 - RNA, 453 nt, Artificial Sequence
  RNASE6__Homo_sapiens__NP_005606
auggugcugugcuucccccugcugcugcugcugcuggugcuguggggccccgugugcccccugcacgccuggcccaagagacugaccaaggcccacugguucgagauccagcacauccagcccagcccccugcagugcaacagagccaugagcggcaucaacaacuacacccagcacugcaagcaccagaacaccuuccugcacgacagcuuccagaacguggccgccgugugcgaccugcugagcaucgugugcaagaacagaagacacaacugccaccagagcagcaagcccgugaacaugaccgacugcagacugaccagcggcaaguacccccagugcagauacagcgccgccgcccaguacaaguucuucaucguggccugcgaccccccccagaagagcgacccccccuacaagcuggugcccgugcaccuggacagcauccuguaa

SEQ ID NO: 22701 - RNA, 471 nt, Artificial Sequence
  RNASE7__Homo_sapiens__NP_115961
auggcccccgccagagccggcuucugcccccugcugcugcugcugcugcugggccuguggguggccgagauccccgugagcgccaagcccaagggcaugaccagcagccagugguucaagauccagcacaugcagcccagcccccaggccugcaacagcgccaugaagaacaucaacaagcacaccaagagaugcaaggaccugaacaccuuccugcacgagcccuucagcagcguggccgccaccugccagacccccaagaucgccugcaagaacggcgacaagaacugccaccagagccacggcgccgugagccugaccaugugcaagcugaccagcggcaaguaccccaacugcagauacaaggagaagagacagaacaagagcuacgugguggccugcaagcccccccagaagaaggacagccagcaguuccaccuggugcccgugcaccuggacagagugcuguaa

SEQ ID NO: 22702 - RNA, 465 nt, Artificial Sequence
  RNASE8__Homo_sapiens__NP_612204
auggcccccgccagagccggcugcugcccccugcugcugcugcugcugggccuguggguggccgaggugcuggugagagccaagcccaaggacaugaccagcagccagugguucaagacccagcacgugcagcccagcccccaggccugcaacagcgccaugagcaucaucaacaaguacaccgagagaugcaaggaccugaacaccuuccugcacgagcccuucagcagcguggccaucaccugccagacccccaacaucgccugcaagaacagcugcaagaacugccaccagagccacggccccaugagccugaccaugggcgagcugaccagcggcaaguaccccaacugcagauacaaggagaagcaccugaacacccccuacaucguggccugcgaccccccccagcagggcgaccccggcuacccccuggugcccgugcaccuggacaaggugguguaa

SEQ ID NO: 22703 - RNA, 618 nt, Artificial Sequence
  RNASE9__Homo_sapiens__NP_001103826
augaugagaacccugaucaccacccacccccugccccugcugcugcugccccagcagcugcugcagcuggugcaguuccaggagguggacaccgacuucgacuuccccgaggaggacaagaaggaggaguucgaggagugccuggagaaguucuucagcaccggccccgccagaccccccaccaaggagaaggugaagagaagagugcugaucgagcccggcaugccccugaaccacaucgaguacugcaaccacgagaucaugggcaagaacguguacuacaagcacagauggguggccgagcacuacuuccugcugaugcaguacgacgagcugcagaagaucugcuacaacagauucgugcccugcaagaacggcaucagaaagugcaacagaagcaagggccugguggagggcguguacugcaaccugaccgaggccuucgagauccccgccugcaaguacgagagccuguacagaaagggcuacgugcugaucaccugcagcuggcagaacgagaugcagaagagaaucccccacaccaucaacgaccugguggagccccccgagcacagaagcuuccugagcgaggacggcguguucgugaucagccccuaa

SEQ ID NO: 22704 - RNA, 861 nt, Artificial Sequence
  RNASEH1__Homo_sapiens__NP_002927
augagcuggcugcuguuccuggcccacagaguggcccuggccgcccugcccugcagaagaggcagcagaggcuucggcauguucuacgccgugagaagaggcagaaagaccggcguguuccugaccuggaacgagugcagagcccagguggacagauuccccgccgccagauucaagaaguucgccaccgaggacgaggccugggccuucgugagaaagagcgccagccccgaggugagcgagggccacgagaaccagcacggccaggagagcgaggccaaggccagcaagagacugagagagccccuggacggcgacggccacgagagcgccgagcccuacgccaagcacaugaagcccagcguggagcccgccccccccgugagcagagacaccuucagcuacaugggcgacuucguggugguguacaccgacggcugcugcagcagcaacggcagaagaagacccagagccggcaucggcguguacuggggccccggccacccccugaacgugggcaucagacugcccggcagacagaccaaccagagagccgagauccacgccgccugcaaggccaucgagcaggccaagacccagaacaucaacaagcuggugcuguacaccgacagcauguucaccaucaacggcaucaccaacugggugcagggcuggaagaagaacggcuggaagaccagcgccggcaaggaggugaucaacaaggaggacuucguggcccuggagagacugacccagggcauggacauccaguggaugcacgugcccggccacagcggcuucaucggcaacgaggaggccgacagacuggccagagagggcgccaagcagagcgaggacuaa

SEQ ID NO: 22705 - RNA, 900 nt, Artificial Sequence
  RNASEH2A__Homo_sapiens__NP_006388
auggaccugagcgagcuggagagagacaacaccggcagaugcagacugagcagccccgugcccgccgugugcagaaaggagcccugcgugcugggcguggacgaggccggcagaggccccgugcugggccccaugguguacgccaucugcuacugcccccugcccagacuggccgaccuggaggcccugaagguggccgacagcaagacccugcuggagagcgagagagagagacuguucgccaagauggaggacaccgacuucgugggcugggcccuggacgugcugagccccaaccugaucagcaccagcaugcugggcagagugaaguacaaccugaacagccugagccacgacaccgccaccggccugauccaguacgcccuggaccagggcgugaacgugacccagguguucguggacaccgugggcaugcccgagaccuaccaggccagacugcagcagagcuuccccggcaucgaggugaccgugaaggccaaggccgacgcccuguaccccguggugagcgccgccagcaucugcgccaagguggccagagaccaggccgugaagaaguggcaguucguggagaagcugcaggaccuggacaccgacuacggcagcggcuaccccaacgaccccaagaccaaggccuggcugaaggagcacguggagcccguguucggcuucccccaguucgugagauucagcuggagaaccgcccagaccauccuggagaaggaggccgaggacgugaucugggaggacagcgccagcgagaaccaggagggccugagaaagaucaccagcuacuuccugaacgagggcagccaggccagacccagaagcagccacagauacuuccuggagagaggccuggagagcgccaccagccuguaa

SEQ ID NO: 22706 - RNA, 774 nt, Artificial Sequence
  RNASEH2B__Homo_sapiens__NP_001135751
auggccgccggcguggacugcggcgacggcgugggcgccagacagcacguguuccuggugagcgaguaccugaaggacgccagcaagaagaugaagaacggccugauguucgugaagcuggugaaccccugcagcggcgagggcgccaucuaccuguucaacaugugccugcagcagcuguucgaggugaagguguucaaggagaagcaccacagcugguucaucaaccagagcgugcagagcggcggccugcugcacuucgccacccccguggacccccuguuccugcugcugcacuaccugaucaaggccgacaaggagggcaaguuccagccccuggaccagguggugguggacaacguguuccccaacugcauccugcugcugaagcugcccggccuggagaagcugcugcaccacgugaccgaggagaagggcaaccccgagaucgacaacaagaaguacuacaaguacagcaaggagaagacccugaaguggcuggagaagaaggugaaccagaccguggccgcccugaagaccaacaacgugaacgugagcagcagagugcagagcaccgccuucuucagcggcgaccaggccagcaccgacaaggaggaggacuacaucagauacgcccacggccugaucagcgacuacauccccaaggagcugagcgacgaccugagcaaguaccugaagcugcccgagcccagcgccagccugcccaacccccccagcaagauggccgcccagagacagaagagaggcaaguaa

SEQ ID NO: 22707 - RNA, 495 nt, Artificial Sequence
  RNASEH2C__Homo_sapiens__NP_115569
auggagagcggcgacgaggccgccaucgagagacacagagugcaccugagaagcgccacccugagagacgccgugcccgccacccugcaccugcugcccugcgagguggccguggacggccccgcccccgugggcagauucuucacccccgccaucagacagggccccgagggccuggaggugagcuucagaggcagaugccugagaggcgaggagguggccgugccccccggccuggugggcuacgugauggugaccgaggagaagaaggugagcaugggcaagcccgacccccugagagacagcggcaccgacgaccaggaggaggagccccuggagagagacuucgacagauucaucggcgccaccgccaacuucagcagauucacccuguggggccuggagaccauccccggccccgacgccaaggugagaggcgcccugaccuggcccagccuggccgccgccauccacgcccaggugcccgaggacuaa

SEQ ID NO: 22708 - RNA, 414 nt, Artificial Sequence
  RNASEK__Homo_sapiens__NP_001004333
augggcuggcugagacccggccccagaccccugugcccccccgccagagccagcugggccuucagccacagauuccccagcccccuggcccccagaagaagccccacccccuucuucauggccagccugcugugcugcggccccaagcuggccgccugcggcaucgugcugagcgccuggggcgugaucaugcugaucaugcugggcaucuucuucaacgugcacagcgccgugcugaucgaggacgugcccuucaccgagaaggacuucgagaacggcccccagaacaucuacaaccuguacgagcaggugagcuacaacugcuucaucgccgccggccuguaccugcugcugggcggcuucagcuucugccaggugagacugaacaagagaaaggaguacauggugagauaa

SEQ ID NO: 22709 - RNA, 2226 nt, Artificial Sequence
  RNASEL__Homo_sapiens__NP_066956
auggagagcagagaccacaacaacccccaggagggccccaccagcagcagcggcagaagagccgccguggaggacaaccaccugcugaucaaggccgugcagaacgaggacguggaccuggugcagcagcugcuggagggcggcgccaacgugaacuuccaggaggaggagggcggcuggaccccccugcacaacgccgugcagaugagcagagaggacaucguggagcugcugcugagacacggcgccgaccccgugcugagaaagaagaacggcgccacccccuucauccuggccgccaucgccggcagcgugaagcugcugaagcuguuccugagcaagggcgccgacgugaacgagugcgacuucuacggcuucaccgccuucauggaggccgccguguacggcaaggugaaggcccugaaguuccuguacaagagaggcgccaacgugaaccugagaagaaagaccaaggaggaccaggagagacugagaaagggcggcgccaccgcccugauggacgccgccgagaagggccacguggaggugcugaagauccugcuggacgagaugggcgccgacgugaacgccugcgacaacaugggcagaaacgcccugauccacgcccugcugagcagcgacgacagcgacguggaggccaucacccaccugcugcuggaccacggcgccgacgugaacgugagaggcgagagaggcaagaccccccugauccuggccguggagaagaagcaccugggccuggugcagagacugcuggagcaggagcacaucgagaucaacgacaccgacagcgacggcaagaccgcccugcugcuggccguggagcugaagcugaagaagaucgccgagcugcugugcaagagaggcgccagcaccgacugcggcgaccuggugaugaccgccagaagaaacuacgaccacagccuggugaaggugcugcugagccacggcgccaaggaggacuuccacccccccgccgaggacuggaagccccagagcagccacuggggcgccgcccugaaggaccugcacagaaucuacagacccaugaucggcaagcugaaguucuucaucgacgagaaguacaagaucgccgacaccagcgagggcggcaucuaccugggcuucuacgagaagcaggagguggccgugaagaccuucugcgagggcagccccagagcccagagagaggugagcugccugcagagcagcagagagaacagccaccuggugaccuucuacggcagcgagagccacagaggccaccuguucgugugcgugacccugugcgagcagacccuggaggccugccuggacgugcacagaggcgaggacguggagaacgaggaggacgaguucgccagaaacgugcugagcagcaucuucaaggccgugcaggagcugcaccugagcugcggcuacacccaccaggaccugcagccccagaacauccugaucgacagcaagaaggccgcccaccuggccgacuucgacaagagcaucaagugggccggcgacccccaggaggugaagagagaccuggaggaccugggcagacuggugcuguacguggugaagaagggcagcaucagcuucgaggaccugaaggcccagagcaacgaggagguggugcagcugagccccgacgaggagaccaaggaccugauccacagacuguuccaccccggcgagcacgugagagacugccugagcgaccugcugggccaccccuucuucuggaccugggagagcagauacagaacccugagaaacgugggcaacgagagcgacaucaagaccagaaagagcgagagcgagauccugagacugcugcagcccggccccagcgagcacagcaagagcuucgacaaguggaccaccaagaucaacgagugcgugaugaagaagaugaacaaguucuacgagaagagaggcaacuucuaccagaacaccgugggcgaccugcugaaguucaucagaaaccugggcgagcacaucgacgaggagaagcacaagaagaugaagcugaagaucggcgaccccagccuguacuuccagaagaccuuccccgaccuggugaucuacguguacaccaagcugcagaacaccgaguacagaaagcacuucccccagacccacagccccaacaagccccagugcgacggcgccggcggcgccagcggccuggccagccccggcugcuaa

SEQ ID NO: 22710 - RNA, 771 nt, Artificial Sequence
  RNASET2__Homo_sapiens__NP_003721
augagacccgccgcccugagaggcgcccugcugggcugccugugccuggcccugcugugccugggcggcgccgacaagagacugagagacaaccacgaguggaagaagcugaucauggugcagcacuggcccgagaccgugugcgagaagauccagaacgacugcagagacccccccgacuacuggaccauccacggccuguggcccgacaagagcgagggcugcaacagaagcuggcccuucaaccuggaggagaucaaggaccugcugcccgagaugagagccuacuggcccgacgugauccacagcuuccccaacagaagcagauucuggaagcacgagugggagaagcacggcaccugcgccgcccagguggacgcccugaacagccagaagaaguacuucggcagaagccuggagcuguacagagagcuggaccugaacagcgugcugcugaagcugggcaucaagcccagcaucaacuacuaccagguggccgacuucaaggacgcccuggccagaguguacggcgugauccccaagauccagugccugccccccagccaggacgaggaggugcagaccaucggccagaucgagcugugccugaccaagcaggaccagcagcugcagaacugcaccgagcccggcgagcagcccagccccaagcaggagguguggcuggccaacggcgccgccgagagcagaggccugagagugugcgaggacggccccguguucuaccccccccccaagaagaccaagcacuaa

SEQ ID NO: 22711 - RNA, 699 nt, Artificial Sequence
  RND1__Homo_sapiens__NP_055285
augaaggagagaagagccccccagcccgugguggccagaugcaagcuggugcuggugggcgacgugcagugcggcaagaccgccaugcugcaggugcuggccaaggacugcuaccccgagaccuacgugcccaccguguucgagaacuacaccgccugccuggagaccgaggagcagagaguggagcugagccugugggacaccagcggcagccccuacuacgacaacgugagaccccugugcuacagcgacagcgacgccgugcugcugugcuucgacaucagcagacccgagaccguggacagcgcccugaagaaguggagaaccgagauccuggacuacugccccagcaccagagugcugcugaucggcugcaagaccgaccugagaaccgaccugagcacccugauggagcugagccaccagaagcaggcccccaucagcuacgagcagggcugcgccaucgccaagcagcugggcgccgagaucuaccuggagggcagcgccuucaccagcgagaagagcauccacagcaucuucagaaccgccagcaugcugugccugaacaagcccagcccccugccccagaagagccccgugagaagccugagcaagagacugcugcaccugcccagcagaagcgagcugaucagcagcaccuucaagaaggagaaggccaagagcugcagcaucauguaa

SEQ ID NO: 22712 - RNA, 735 nt, Artificial Sequence
  RND3__Homo_sapiens__NP_005159
augaaggagagaagagccagccagaagcugagcagcaagagcaucauggaccccaaccagaacgugaagugcaagaucgugguggugggcgacagccagugcggcaagaccgcccugcugcacguguucgccaaggacugcuuccccgagaacuacgugcccaccguguucgagaacuacaccgccagcuucgagaucgacacccagagaaucgagcugagccugugggacaccagcggcagccccuacuacgacaacgugagaccccugagcuaccccgacagcgacgccgugcugaucugcuucgacaucagcagacccgagacccuggacagcgugcugaagaaguggaagggcgagauccaggaguucugccccaacaccaagaugcugcuggugggcugcaagagcgaccugagaaccgacgugagcacccugguggagcugagcaaccacagacagacccccgugagcuacgaccagggcgccaacauggccaagcagaucggcgccgccaccuacaucgagugcagcgcccugcagagcgagaacagcgugagagacaucuuccacguggccacccuggccugcgugaacaagaccaacaagaacgugaagagaaacaagagccagagagccaccaagagaaucagccacaugcccagcagacccgagcugagcgccguggccaccgaccugagaaaggacaaggccaagagcugcaccgugauguaa

SEQ ID NO: 22713 - RNA, 756 nt, Artificial Sequence
  RNF103-CHMP3__Homo_sapiens__NP_001185883
auggagggcgagcuguacagcgcccugaaggaggaggaggccagcgagagcgugagcagcaccaacuucagcggcgagaugcacuucuacgagcugguggaggacaccaaggacggcaucuggcuggugcaggugaacgaguggagccugaagaucagaaaggagaugagagugguggacagacagaucagagacauccagagagaggaggagaaggugaagagaagcgugaaggacgccgccaagaagggccagaaggacgugugcaucgugcuggccaaggagaugaucagaagcagaaaggccgugagcaagcuguacgccagcaaggcccacaugaacagcgugcugaugggcaugaagaaccagcuggccgugcugagaguggccggcagccugcagaagagcaccgaggugaugaaggccaugcagagccuggugaagauccccgagauccaggccaccaugagagagcugagcaaggagaugaugaaggccggcaucaucgaggagaugcuggaggacaccuucgagagcauggacgaccaggaggagauggaggaggaggccgagauggagaucgacagaauccuguucgagaucaccgccggcgcccugggcaaggcccccagcaaggugaccgacgcccugcccgagcccgagccccccggcgccauggccgccagcgaggacgaggaggaggaggaggaggcccuggaggccaugcagagcagacuggccacccugagaagcuaa

SEQ ID NO: 22714 - RNA, 2046 nt, Artificial Sequence
  RNF103__Homo_sapiens__NP_001185880
augagcagacugagacccagacccccccugauccacggcugcggcggcuucuucgaggccaucgugugguacgagaccggcaucuucgccacccagcugguggaccccguggcccugagcuucaagaagcugaagaccauccuggagugcagaggccugggcuacagcggccugcccgagaagaaggacgugagagagcugguggagaagagcggcgaccugauggagggcgagcuguacagcgcccugaaggaggaggaggccagcgagagcgugagcagcaccaacuucagcggcgagaugcacuucuacgagcugguggaggacaccaaggacggcaucuggcuggugcaggugaucgccaacgacagaagcccccuggugggcaagauccacugggagaagauggugaagaaggugagcagauucggcaucagaaccggcaccuucaacugcagcagcgaccccagauacugcagaagaagaggcugggugagaagcacccugaucaugagcgugccccagaccagcaccagcaagggcaaggugaugcugaaggaguacagcggcagaaagaucgagguggagcacaucuucaaguggaucaccgcccacgccgccagcagaaucaagaccaucuacaacgccgagcaccugaaggaggaguggaacaagagcgaccaguacuggcugaagaucuaccuguucgccaaccuggaccagccccccgccuucuucagcgcccugagcaucaaguucaccggcagaguggaguucaucuucgugaacguggagaacugggacaacaagagcuacaugaccgacaucggcaucuacaacaugcccagcuacauccugagaacccccgagggcaucuacagauacggcaaccacaccggcgaguucaucagccugcaggccauggacagcuuccugagaagccugcagcccgaggugaacgaccuguucgugcugagccuggugcuggugaaccugauggccuggauggaccuguucaucacccagggcgccaccaucaagagauucguggugcugaucagcacccugggcaccuacaacagccugcugaucaucagcuggcugcccgugcugggcuuccugcagcugcccuaccuggacagcuucuacgaguacagccugaagcugcugagauacagcaacaccaccacccuggccagcugggugagagccgacuggauguucuacagcagccaccccgcccuguuccugagcaccuaccugggccacggccugcugaucgacuacuucgagaagaagagaagaagaaacaacaacaacgacgaggugaacgccaacaaccuggaguggcugagcagccugugggacugguacaccagcuaccuguuccaccccaucgccagcuuccagaacuuccccguggagagcgacugggacgaggaccccgaccuguuccuggagagacuggccuuccccgaccuguggcugcacccccugauccccaccgacuacaucaagaaccugcccauguggagauucaagugccugggcgugcagagcgaggaggagaugagcgagggcagccaggacaccgagaacgacagcgagagcgagaacaccgacacccugagcagcgagaaggagguguucgaggacaagcagagcgugcugcacaacagccccggcaccgccagccacugcgacgccgaggccugcagcugcgccaacaaguacugccagaccagccccugcgagagaaagggcagaagcuacggcagcuacaacaccaacgaggacauggagcccgacuggcugaccuggcccgccgacaugcugcacugcaccgagugcguggugugccuggagaacuucgagaacggcugccugcugaugggccugcccugcggccacguguuccaccagaacugcaucgugauguggcuggccggcggcagacacugcugccccgugugcagauggcccagcuacaagaagaagcagcccuacgcccagcaccagccccugagcaacgacgugcccagcuaa

SEQ ID NO: 22715 - RNA, 3081 nt, Artificial Sequence
  RNF111__Homo_sapiens__XP_006720638
augcacguguucagccugaucgacggcagcagcggccuggccgugcugagacugagccugaaguuccccaugagccaguggacccccgaguacaacgagcuguacacccugaagguggacaugaagagcgagauccccagcgacgcccccaagacccaggagagccugaagggcauccugcugcaccccgagcccaucggcgccgccaagagcuuccccgccggcguggagaugaucaacagcaaggugggcaacgaguucagccaccugugcgacgacagccagaagcaggagaaggagaugaacggcaaccagcaggagcaggagaagagccugguggugagaaagaagagaaagagccagcaggccggccccagcuacgugcagaacugcgugaaggagaaccagggcauccugggccugagacagcaccugggcacccccagcgacgaggacaacgacagcagcuucagcgacugccugagcagccccagcagcagccugcacuucggcgacagcgacaccgugaccagcgacgaggacaaggaggugagcgugagacacagccagaccauccugaacgccaagagcagaagccacagcgccagaagccacaaguggcccagaaccgagaccgagagcgugagcggccugcugaugaagagacccugccugcacggcagcagccugagaagacugcccugcagaaagagauucgugaagaacaacagcagccagagaacccagaagcagaaggagagaauccugaugcagagaaagaagagagaggugcuggccagaagaaaguacgcccugcugcccagcagcagcagcagcagcgagaacgaccugagcagcgagagcagcagcagcagcagcaccgagggcgaggaggaccuguucgugagcgccagcgagaaccaccagaacaaccccgccgugcccagcggcagcaucgacgaggacgugguggugaucgaggccagcagcaccccccaggugaccgccaacgaggagaucaacgugaccagcaccgacagcgagguggagaucgugaccgugggcgagagcuacagaagcagaagcacccugggccacagcagaagccacuggagccagggcagcagcagccacgccagcagaccccaggagcccagaaacagaagcagaaucagcaccgugauccagccccugagacagaacgccgccgaggugguggaccugaccguggacgaggacgagcccaccguggugcccaccaccagcgccagaauggagagccaggccaccagcgccagcaucaacaacagcaaccccagcaccagcgagcaggccagcgacaccgccagcgccgugaccagcagccagcccagcaccgugagcgagaccagcgccacccugaccagcaacagcaccaccggcaccagcaucggcgacgacagcagaagaaccaccagcagcgccgugaccgagaccggcccccccgccaugcccagacugcccagcugcugcccccagcacagccccugcggcggcagcagccagaaccaccacgcccugggccacccccacaccagcugcuuccagcagcacggccaccacuuccagcaccaccaccaccaccaccacaccccccaccccgccgugcccgugagccccagcuucagcgaccccgccugccccguggagagacccccccaggugcaggcccccugcggcgccaacagcagcagcggcaccagcuaccacgagcagcaggcccugcccguggaccugagcaacagcggcaucagaagccacggcagcggcagcuuccacggcgccagcgccuucgaccccugcugccccgugagcagcagcagagccgccaucuucggccaccaggccgccgccgccgcccccagccagccccugagcagcaucgacggcuacggcagcagcaugguggcccagccccagccccagccccccccccagcccagccugagcagcugcagacacuacaugcccccccccuacgccagccugaccagaccccugcaccaccaggccagcgccugcccccacagccacggcaacccccccccccagacccagccccccccccagguggacuacgugaucccccaccccgugcacgccuuccacagccagaucagcagccacgccaccagccaccccguggccccccccccccccacccaccuggccagcaccgccgcccccaucccccagcaccugccccccacccaccagcccaucagccaccacauccccgccaccgccccccccgcccagagacugcacccccacgaggugaugcagagaauggaggugcagagaagaagaaugaugcagcaccccaccggccuguucguguucugcgugagcagaagagcccacgagagaccccccccccacccccacagaaugcaccccaacuacggccacggccaccacauccacgugccccagaccaugagcagccaccccagacaggcccccgagagaagcgccugggagcugggcaucgaggccggcgugaccgccgccaccuacacccccggcgcccugcacccccaccuggcccacuaccacgccccccccagacugcaccaccugcagcugggcgcccugccccugauggugcccgacauggccggcuacccccacaucagauacaucagcagcggccuggacggcaccagcuucagaggccccuucagaggcaacuucgaggagcugauccaccuggaggagagacugggcaacgugaacagaggcgccagccagggcaccaucgagagaugcaccuacccccacaaguacaagaaggugaccaccgacugguucagccagagaaagcugcacugcaagcaggacggcgaggagggcaccgaggaggacaccgaggagaagugcaccaucugccugagcauccuggaggagggcgaggacgugagaagacugcccugcaugcaccuguuccaccaggugugcguggaccaguggcugaucaccaacaagaagugccccaucugcagaguggacaucgaggcccagcugcccagcgagagcuaa

SEQ ID NO: 22716 - RNA, 1896 nt, Artificial Sequence
  RNF112__Homo_sapiens__NP_009079
augcccagacccgcccugagcgugaccagcuucugccacagacugggcaagagagagagaaagcagagcuucaugggcaacagcggcaacagcuggagccacacccccuuccccaagcuggagcugggccugggcccccagcccauggcccccagagagcugcccaccugcagcaucugccuggagagacugagagaccccaucagccuggacugcggccacgacuucugcaucagaugcuucagcacccacagacugcccggcugcgagccccccugcugccccgagugcagaaagaucugcaagcagaagagaggccugagaagccugggcgagaagaugaagcugcugccccagagaccccugccccccgcccugcaggagaccugccccgugagagccgagccccugcugcuggugagaaucaacgccagcggcggccugauccugagaaugggcgccaucaacagaugccugaagcacccccuggccagagacacccccgugugccugcuggccgugcugggcgagcagcacagcggcaagagcuuccugcugaaccaccugcugcagggccugcccggccuggagagcggcgagggcggcagacccagaggcggcgaggccagccugcagggcugcagauggggcgccaacggccuggccagaggcaucuggauguggagccaccccuuccugcugggcaaggagggcaagaagguggccguguuccugguggacaccggcgacgccaugagccccgagcugagcagagagaccagaaucaagcugugcgcccugaccaccaugcugagcagcuaccagauccugagcaccagccaggagcugaaggacaccgaccuggacuaccuggagauguucgugcacguggccgaggugaugggcaagcacuacggcauggugcccauccagcaccuggaccugcuggugagagacagcagccaccccaacaaggccggccagggccacgugggcaacaucuuccagagacugagcggcagauaccccaaggugcaggagcugcugcagggcaagagagccagaugcugccugcugcccgcccccggcagaagaagaaugaaccagggccacgccagccccggcgacaccgacgacgacuucagacaccugcugggcgccuacgugagcgacgugcugagcgccgccccccagcacgccaagagcagaugccagggcuacuggaacgagggcagagccguggccagaggcgacagaagacugcugaccggccagcagcuggcccaggagaucaagaaccugagcggcuggaugggcagaaccggccccggcuucaccagccccgacgagauggccgcccagcugcacgaccugagaaagguggaggccgccaagagagaguucgaggaguacgugagacagcaggacguggccaccaagagaaucuucagcgcccugagagugcugcccgacaccaugagaaaccugcugagcacccagaaggacgccauccuggccagacacggcguggcccugcugugcaagggcagagaccagacccuggaggcccuggaggccgagcugcaggccaccgccaaggccuucauggacagcuacaccaugagauucugcggccaccuggccgccgugggcggcgccgugggcgccggccugaugggccuggccggcggcguggugggcgccggcauggccgccgccgcccuggccgccgaggccggcaugguggccgccggcgccgccgugggcgccaccggcgccgccguggugggcggcggcgugggcgccggccuggccgccaccgugggcugcauggagaaggaggaggacgagagacugcuggagggcgacagagagccccugcugcaggaggaguaa

SEQ ID NO: 22717 - RNA, 687 nt, Artificial Sequence
  RNF114__Homo_sapiens__NP_061153
auggccgcccagcagagagacugcggcggcgccgcccagcuggccggccccgccgccgaggccgacccccugggcagauucaccugccccgugugccuggagguguacgagaagcccgugcaggugcccugcggccacguguucugcagcgccugccugcaggagugccugaagcccaagaagcccgugugcggcgugugcagaagcgcccuggcccccggcgugagagccguggagcuggagagacagaucgagagcaccgagaccagcugccacggcugcagaaagaacuucuuccugagcaagaucagaagccacguggccaccugcagcaaguaccagaacuacaucauggagggcgugaaggccaccaucaaggacgccagccugcagcccagaaacgugcccaacagauacaccuuccccugccccuacugccccgagaagaacuucgaccaggagggccugguggagcacugcaagcuguuccacagcaccgacaccaagagcguggugugccccaucugcgccagcaugcccuggggcgaccccaacuacagaagcgccaacuucagagagcacauccagagaagacacagauucagcuacgacaccuucguggacuacgacguggacgaggaggacaugaugaaccaggugcugcagagaagcaucaucgaccaguaa

SEQ ID NO: 22718 - RNA, 3945 nt, Artificial Sequence
  RNF123__Homo_sapiens__NP_071347
auggccagcaagggcgccggcaugagcuucagcagaaagagcuacagacugaccagcgacgccgagaagagcagagugaccggcaucgugcaggagaagcugcugaacgacuaccugaacagaaucuucagcagcagcgagcacgccccccccgccgccaccagcagaaagccccugaacuuccagaaccugcccgagcaccuggaccagcugcugcagguggacaacgaggaggaggagagccagggccagguggagggcagacugggccccagcaccguggugcuggaccacaccggcggcuucgagggccugcugcugguggacgacgaccugcugggcgugaucggccacagcaacuucggcaccaucagaagcaccaccugcguguacaagggcaaguggcuguacgaggugcugaucagcagccagggccugaugcagaucggcuggugcaccaucagcugcagauucaaccaggaggagggcgugggcgacacccacaacagcuacgccuacgacggcaacagagugagaaaguggaacgugaccaccaccaacuacggcaaggccugggccgccggcgacaucgugagcugccugaucgaccuggacgacggcacccugagcuucugccugaacggcgugagccugggcaccgccuucgagaaccugagcagaggccugggcauggccuacuuccccgccaucagccugagcuucaaggagagcguggccuucaacuucggcagcagaccccugagauaccccguggccggcuacagaccccugcaggacccccccagcgccgaccuggugagagcccagagacugcugggcugcuucagagccgugcugagcguggagcuggaccccguggagggcagacugcuggacaaggagagcagcaaguggagacugagaggccagcccaccgugcugcugacccuggcccacaucuuccaccacuucgccccccugcugagaaagguguaccugguggaggccgugcugaugagcuuccugcugggcaucguggagaagggcacccccacccaggcccagagcguggugcaccaggugcuggaccugcuguggcuguucauggaggacuacgaggugcaggacugccugaagcagcugaugaugagccugcugagacuguacagauucagccccaucgugcccgaccugggccugcagauccacuaccugagacugaccaucgccauccugagacacgagaagagcagaaaguuccugcugagcaacgugcuguucgacgugcugagaagcgugguguucuucuacaucaagagcccccugagaguggaggaggccggccugcaggagcugauccccaccaccugguggccccacugcagcagcagagagggcaaggagagcaccgagaugaaggaggagaccgccgaggagagacugagaagaagagccuacgagagaggcugccagagacugagaaagagaaucgaggugguggaggagcugcaggugcagauccugaagcugcugcuggacaacaaggacgacaacggcggcgaggccagcagauacaucuuccugaccaaguucagaaaguuccugcaggagaacgccagcggcagaggcaacaugcccaugcugugcccccccgaguacauggugugcuuccugcacagacugaucagcgcccugagauacuacugggacgaguacaaggccagcaacccccacgccagcuucagcgaggaggccuacauccccccccagguguucuacaacggcaagguggacuacuucgaccugcagagacugggcggccugcugagccaccugagaaagacccugaaggacgaccuggccagcaaggccaacaucgugaucgacccccuggagcugcagagcaccgccauggacgaccuggacgaggacgaggagcccgcccccgccauggcccagagacccaugcaggcccuggccgugggcggcccccugccccugcccagacccggcuggcugagcagccccacccugggcagagccaacagauuccugagcaccgccgccgugagccugaugacccccagaagaccccugagcaccagcgagaaggugaaggugagaacccugagcguggagcagagaaccagagaggacaucgagggcagccacuggaacgagggccugcugcugggcagaccccccgaggagcccgagcagccccugaccgagaacagccugcuggaggugcuggacggcgccgugaugauguacaaccugagcgugcaccagcagcugggcaagauggugggcgugagcgacgacgugaacgaguacgccauggcccugagagacaccgaggacaagcugagaagaugccccaagagaagaaaggacauccuggccgagcugaccaagagccagaagguguucagcgagaagcuggaccaccugagcagaagacuggccugggugcacgccaccguguacagccaggagaagaugcuggacaucuacuggcugcugagagugugccugagaaccaucgagcacggcgacagaaccggcagccuguucgccuucaugcccgaguucuaccugagcguggccaucaacagcuacagcgcccugaagaacuacuucggccccgugcacagcauggaggagcugcccggcuacgaggagacccugaccagacuggccgccauccuggccaagcacuucgccgacgccagaaucgugggcaccgacaucagagacagccugaugcaggcccuggccagcuacgugugcuacccccacagccugagagccguggagagaauccccgaggagcagagaaucgccauggugagaaaccugcuggcccccuacgagcagagacccugggcccagaccaacuggauccuggugagacuguggagaggcugcggcuucggcuacagauacaccagacugccccaccugcugaagaccaagcuggaggacgccaaccugcccagccugcagaagcccugccccagcacccugcugcagcagcacauggccgaccugcugcagcagggccccgacguggcccccagcuuccugaacagcgugcugaaccagcugaacugggccuucagcgaguucaucggcaugauccaggagauccagcaggccgccgagagacuggagagaaacuucguggacagcagacagcugaaggugugcgccaccugcuucgaccugagcgugagccugcugagagugcuggagaugaccaucacccuggugcccgagaucuuccuggacuggaccagacccaccagcgagaugcugcugagaagacuggcccagcugcugaaccaggugcugaacagagugaccgccgagagaaaccuguucgacagaguggugacccugagacugcccggccuggagagcguggaccacuaccccauccugguggccgugaccggcauccuggugcagcugcuggugagaggccccgccagcgagagagagcaggccaccagcgugcugcuggccgaccccugcuuccagcugagaagcaucugcuaccugcugggccagcccgagccccccgcccccggcaccgcccugcccgcccccgacagaaagagauucagccugcagagcuacgccgacuacaucagcgccgacgagcuggcccagguggagcagaugcuggcccaccugaccagcgccagcgcccaggccgccgccgccagccugcccaccagcgaggaggaccugugccccaucugcuacgcccaccccaucagcgccguguuccagcccugcggccacaagagcugcaaggccugcaucaaccagcaccugaugaacaacaaggacugcuucuucugcaagaccaccaucgugagcguggaggacugggagaagggcgccaacaccagcaccaccagcagcgccgccuaa

SEQ ID NO: 22719 - RNA, 699 nt, Artificial Sequence
  RNF125__Homo_sapiens__NP_060301
augggcagcgugcugagcaccgacagcggcaagagcgcccccgccagcgccaccgccagagcccuggagagaagaagagaccccgagcugcccgugaccagcuucgacugcgccgugugccuggaggugcugcaccagcccgugagaaccagaugcggccacguguucugcagaagcugcaucgccaccagccugaagaacaacaaguggaccugccccuacugcagagccuaccugcccagcgagggcgugcccgccaccgacguggccaagagaaugaagagcgaguacaagaacugcgccgagugcgacacccuggugugccugagcgagaugagagcccacaucagaaccugccagaaguacaucgacaaguacggcccccugcaggagcuggaggagaccgccgccagaugcgugugccccuucugccagagagagcuguacgaggacagccugcuggaccacugcaucacccaccacagaagcgagagaagacccguguucugcccccugugcagacugauccccgacgagaaccccagcagcuucagcggcagccugaucagacaccugcaggugagccacacccuguucuacgacgacuucaucgacuucaacaucaucgaggaggcccugaucagaagagugcuggacagaagccugcuggaguacgugaaccacagcaacaccaccuaa

SEQ ID NO: 22720 - RNA, 1209 nt, Artificial Sequence
  RNF128__Homo_sapiens__NP_078815
augaaccaggagaacagaagcagcuucuucuggcugcuggugaucuucaccuuccugcugaagaucaccgccagcuucagcaugagcgccuacgugaccgugaccuacuacaacgagaccagcaacuacaccgccaucgagaccugcgagugcggcguguacggccuggccagccccguggccaacgccaugggcguggugggcauccccaagaacaacaacuaccaggccugcgaccacaacaccgaguucagcaacaccaagaagcccuggaucgcccugaucgagagaggcaacugcaccuucagcgagaagauccagaccgccggcagaagaaacgccgacgccguggugaucuacaacgcccccgagaccggcaaccagaccauccagauggccaacuucggcgccguggacaucguggccaucaugaucggcaaccugaagggcaccaagauccugcagagcauccagagaggcauccaggugaccauggugaucgaggugggcaagaagcacggccccugggugaaccacuacagcaucuucuucgugagcgugagcuucuucaucaucaccgccgccaccgugggcuacuucaucuucuacagcgccagaagacugagaaacgccagagcccagagcagaaagcagagacagcugaaggccgacgccaagaaggccaucggcagacugcagcugagaacccugaagcagggcgacaaggagaucggccccgacggcgacagcugcgccgugugcaucgagcuguacaagcccaacgaccuggugagaauccugaccugcaaccacaucuuccacaagaccugcguggaccccuggcugcuggagcacagaaccugccccaugugcaagugcgacauccugaaggcccugggcaucgagguggacguggaggacggcagcgugagccugcaggugcccgugagcaacgagaucagcaacagcgccagcagccacgaggaggacaacagaagcgagaccgccagcagcggcuacgccagcgugcagggcaccgacgagcccccccuggaggagcacgugcagagcaccaacgagagccugcagcuggugaaccacgaggccaacagcguggccguggacgugaucccccacguggacaaccccaccuucgaggaggacgagacccccaaccaggagaccgccgugagagagaucaagagcuaa

SEQ ID NO: 22721 - RNA, 1260 nt, Artificial Sequence
  RNF130__Homo_sapiens__NP_060904
augagcugcgccggcagagccggccccgccagacuggccgcccuggcccugcugaccugcagccuguggcccgccagagccgacaacgccagccaggaguacuacaccgcccugaucaacgugaccgugcaggagcccggcagaggcgccccccugaccuucagaaucgacagaggcagauacggccuggacagccccaaggccgaggugagaggccaggugcuggccccccugccccugcacggcguggccgaccaccugggcugcgacccccagaccagauucuucgugccccccaacaucaagcaguggaucgcccugcugcagagaggcaacugcaccuucaaggagaagaucagcagagccgccuuccacaacgccguggccguggugaucuacaacaacaagagcaaggaggagcccgugaccaugacccaccccggcaccggcgacaucaucgccgugaugaucaccgagcugagaggcaaggacauccugagcuaccuggagaagaacaucagcgugcagaugaccaucgccgugggcaccagaaugccccccaagaacuucagcagaggcagccugguguucgugagcaucagcuucaucgugcugaugaucaucagcagcgccuggcugaucuucuacuucauccagaagaucagauacaccaacgccagagacagaaaccagagaagacugggcgacgccgccaagaaggccaucagcaagcugaccaccagaaccgugaagaagggcgacaaggagaccgaccccgacuucgaccacugcgccgugugcaucgagagcuacaagcagaacgacguggugagaauccugcccugcaagcacguguuccacaagagcugcguggaccccuggcugagcgagcacugcaccugccccaugugcaagcugaacauccugaaggcccugggcaucgugcccaaccugcccugcaccgacaacguggccuucgacauggagagacugaccagaacccaggccgugaacagaagaagcgcccugggcgaccuggccggcgacaacagccugggccuggagccccugagaaccagcggcaucagcccccugccccaggacggcgagcugacccccagaaccggcgagaucaacaucgccgugaccaaggagugguucaucaucgccagcuucggccugcugagcgcccugacccugugcuacaugaucaucagagccaccgccagccugaacgccaacgagguggagugguucuaa

SEQ ID NO: 22722 - RNA, 861 nt, Artificial Sequence
  RNF135__Homo_sapiens__NP_001171921
auggccggccugggccugggcagcgccgugcccguguggcuggccgaggacgaccugggcugcaucaucugccagggccugcuggacuggcccgccacccugcccugcggccacagcuucugcagacacugccuggaggcccuguggggcgccagagacgccagaagaugggccugccccaccugcagacagggcgccgcccagcagccccaccugagaaagaacacccugcugcaggaccuggccgacaaguacagaagagccgccagagagauccaggccggcagcgaccccgcccacugccccugccccggcagcagcagccugagcagcgccgccgccagacccagaagaagacccgagcugcagagaguggccguggagaagagcaucaccgagguggcccaggagcugaccgagcugguggagcaccugguggacaucgugagaagccugcagaaccagagaccccugagcgagagcggccccgacaacgagcugagcauccugggcaaggccuucagcagcggcguggaccugagcauggccagccccaagcuggugaccagcgacaccgccgccggcaagaucagagacauccugcacgaccuggaggagauccaggagaagcugcaggagagcgugaccuggaaggaggcccccgaggcccagaugcagggcagccugcugcccagacuggagugcagcggcaccaucaccgccgccagcaucagccaggcccaggagaacagcuggaagcccagacugcccccccacgcccacugccugaccagagccacccugcacagcggcgagcugcugggccugcugagcggccccagcauccagccccugaccuaa

SEQ ID NO: 22723 - RNA, 738 nt, Artificial Sequence
  RNF138__Homo_sapiens__NP_057355
auggccgaggaccugagcgccgccaccagcuacaccgaggacgacuucuacugccccgugugccaggaggugcugaagacccccgugagaaccaccgccugccagcacguguucugcagaaagugcuuccugaccgccaugagagagagcggcgcccacugcccccugugcagaggcaacgugaccagaagagagagagccugccccgagagagcccuggaccuggagaacaucaugagaaaguucagcggcagcugcagaugcugcgccaagcagaucaaguucuacagaaugagacaccacuacaagagcugcaagaaguaccaggacgaguacggcgugagcagcaucauccccaacuuccagaucagccaggacagcgugggcaacagcaacagaagcgagaccagcaccagcgacaacaccgagaccuaccaggagaacaccagcagcagcggccaccccaccuucaagugcccccugugccaggagagcaacuucaccagacagagacugcuggaccacugcaacagcaaccaccuguuccagaucgugcccgugaccugccccaucugcgugagccugcccuggggcgaccccagccagaucaccagaaacuucgugagccaccugaaccagagacaccaguucgacuacggcgaguucgugaaccugcagcuggacgaggagacccaguaccagaccgccguggaggagagcuuccaggugaacaucuaa

SEQ ID NO: 22724 - RNA, 1995 nt, Artificial Sequence
  RNF139__Homo_sapiens__NP_009149
auggccgccgugggccccccccagcagcaggugagaauggcccaccagcaggugugggccgcccuggagguggcccugagagugcccugccuguacaucaucgacgccaucuucaacagcuaccccgacagcagccagagcagauucugcaucgugcugcagaucuuccugagacuguucggcguguucgccagcagcaucgugcugauccugagccagagaagccuguucaaguucuacaccuacagcagcgccuuccugcuggccgccaccagcgugcuggugaacuacuacgccagccugcacaucgacuucuacggcgccuacaacaccagcgccuucggcaucgagcugcugcccagaaagggccccagccuguggauggcccugaucgugcugcagcugaccuucggcaucggcuacgugacccugcugcagauccacagcaucuacagccagcugaucauccuggaccugcuggugcccgugaucggccugaucaccgagcugccccugcacaucagagagacccugcuguucaccagcagccugauccugacccugaacaccguguucgugcuggccgugaagcugaagugguucuacuacagcaccagauacguguaccugcuggugagacacauguacagaaucuacggccugcagcugcugauggaggacaccuggaagagaaucagauuccccgacauccugagaguguucuggcugaccagagugaccgcccaggccaccgugcugauguacauccugagaauggccaacgagaccgacagcuucuucaucagcugggacgacuucugggaccugaucugcaaccugaucaucagcggcugcgacagcacccugaccgugcugggcaugagcgccgugaucagcagcguggcccacuaccugggccugggcauccuggccuucaucggcagcaccgaggaggacgacagaagacugggcuucguggcccccgugcuguucuucauccuggcccugcagaccggccugagcggccugagacccgaggagagacugaucagacugagcagaaacaugugccugcugcugaccgccgugcugcacuucauccacggcaugaccgaccccgugcugaugagccugagcgccagccacgugagcagcuucagaagacacuuccccgugcuguucgugagcgccugccuguucauccugcccgugcugcugagcuacgugcuguggcaccacuacgcccugaacaccuggcuguucgccgugaccgccuucugcguggagcugugccugaaggugaucgugagccugaccguguacacccuguucaugaucgacggcuacuacaacgugcugugggagaagcuggacgacuacguguacuacgugagaagcaccggcagcaucaucgaguucaucuucggcguggugauguucggcaacggcgccuacaccaugauguucgagagcggcagcaagaucagagccuucaugaugugccugcacgccuacuucaacaucuaccugcaggccaagaacggcuggaagaccuucaugaacagaagaaccgccgugaagaagaucaacagccugcccgagaucaagggcagcagacugcaggagaucaacgacgugugcgccaucugcuaccacgaguucaccaccagcgccagaaucacccccugcaaccacuacuuccacgcccugugccugagaaaguggcuguacauccaggacaccugccccaugugccaccagaagguguacaucgaggacgacaucaaggacaacagcaacgugagcaacaacaacggcuucaucccccccaacgagacccccgaggaggccgugagagaggccgccgccgagagcgacagagagcugaacgaggacgacagcaccgacugcgacgacgacgugcagagagagagaaacggcgugauccagcacaccggcgccgccgccgaggaguucaacgacgacaccgacuaa

SEQ ID NO: 22725 - RNA, 879 nt, Artificial Sequence
  RNF144A__Homo_sapiens__XP_005246259
augaccaccaccagauacagacccaccugggaccuggcccuggacccccuggugagcugcaagcugugccugggcgaguaccccguggagcagaugaccaccaucgcccagugccagugcaucuucugcacccugugccugaagcaguacguggagcugcugaucaaggagggccuggagaccgccaucagcugccccgacgccgccugccccaagcagggccaccugcaggagaacgagaucgagugcaugguggccgccgagaucaugcagagauacaagaagcugcaguucgagagagaggugcuguucgaccccugcagaaccuggugccccgccagcaccugccaggccgugugccagcugcaggacgugggccugcagaccccccagcccgugcagugcaaggccugcagaauggaguucugcagcaccugcaaggccagcuggcaccccggccagggcugccccgagaccaugcccaucaccuuccugcccggcgagaccagcgccgccuucaagauggaggaggacgacgcccccaucaagagaugccccaagugcaagguguacaucgagagagacgagggcugcgcccagaugaugugcaagaacugcaagcacgccuucugcugguacugccuggagagccuggacgacgacuuccugcugauccacuacgacaagggccccugcagaaacaagcugggccacagcagagccagcgugaucuggcacagaacccagguggugggcaucuucgccggcuucggccugcugcugcugguggccagccccuuccugcugcuggccacccccuucgugcugugcugcaagugcaagugcagcaagggcgacgacgacccccugcccaccuaa

SEQ ID NO: 22726 - RNA, 912 nt, Artificial Sequence
  RNF144B__Homo_sapiens__XP_005249041
augggcagcgccggcagacugcacuaccuggccaugaccgccgagaaccccacccccggcgaccuggcccccgccccccugaucaccugcaagcugugccugugcgagcagagccuggacaagaugaccacccugcaggagugccagugcaucuucugcaccgccugccugaagcaguacaugcagcuggccaucagagagggcugcggcagccccaucaccugccccgacauggugugccugaaccacggcacccugcaggaggccgagaucgccugccuggugcccguggaccaguuccagcuguaccagagacugaaguucgagagagaggugcaccuggaccccuacagaaccuggugccccguggccgacugccagaccgugugccccguggccagcagcgaccccggccagcccgugcugguggagugccccagcugccaccugaaguucugcagcugcugcaaggacgccuggcacgccgaggugagcugcagagacagccagcccaucgugcugcccaccgagcacagagcccuguucggcaccgacgccgaggcccccaucaagcagugccccgugugcagaguguacaucgagagaaacgagggcugcgcccagaugaugugcaagaacugcaagcacaccuucugcugguacugccugcagaaccuggacaacgacaucuuccugagacacuacgacaagggccccugcagaaacaagcugggccacagcagagccagcgugauguggaacagaacccagguggugggcauccuggugggccugggcaucaucgcccuggugaccagcccccugcugcugcuggccagccccugcaucaucugcugcgugugcaagagcugcagaggcaagaagaagaagcacgaccccagcaccaccuaa

SEQ ID NO: 22727 - RNA, 1080 nt, Artificial Sequence
  RNF146__Homo_sapiens__NP_001229778
augauggccggcugcggcgagaucgaccacagcaucaacaugcugcccaccaacagaaaggccaacgagagcugcagcaacaccgcccccagccugaccgugcccgagugcgccaucugccugcagaccugcgugcaccccgugagccugcccugcaagcacguguucugcuaccugugcgugaagggcgccagcuggcugggcaagagaugcgcccugugcagacaggagauccccgaggacuuccuggacaagcccacccugcugagccccgaggagcugaaggccgccagcagaggcaacggcgaguacgccugguacuacgagggcagaaacggcugguggcaguacgacgagagaaccagcagagagcuggaggacgccuucagcaagggcaagaagaacaccgagaugcugaucgccggcuuccuguacguggccgaccuggagaacauggugcaguacagaagaaacgagcacggcagaagaagaaagaucaagagagacaucaucgacauccccaagaagggcguggccggccugagacuggacugcgacgccaacaccgugaaccuggccagagagagcagcgccgacggcgccgacagcgugagcgcccagagcggcgccagcgugcagccccuggugagcagcgugagaccccugaccagcguggacggccagcugaccagccccgccacccccagccccgacgccagcaccagccuggaggacagcuucgcccaccugcagcugagcggcgacaacaccgccgagagaagccacagaggcgagggcgaggaggaccacgagagccccagcagcggcagagugcccgcccccgacaccagcaucgaggagaccgagagcgacgccagcagcgacagcgaggacgugagcgccgugguggcccagcacagccugacccagcagagacugcuggugagcaacgccaaccagaccgugcccgacagaagcgacagaagcggcaccgacagaagcguggccggcggcggcaccgugagcgugagcgugagaagcagaagacccgacggccagugcaccgugaccgagguguaa

SEQ ID NO: 22728 - RNA, 1203 nt, Artificial Sequence
  RNF149__Homo_sapiens__NP_775918
auggccuggagaagaagagaggccagcgugggcgccagaggcgugcuggcccuggcccugcuggcccuggcccugugcgugcccggcgccagaggcagagcccuggagugguucagcgccguggugaacaucgaguacguggacccccagaccaaccugaccguguggagcgugagcgagagcggcagauucggcgacagcagccccaaggagggcgcccacggccuggugggcgugcccugggcccccggcggcgaccuggagggcugcgcccccgacaccagauucuucgugcccgagcccggcggcagaggcgccgcccccuggguggcccugguggccagaggcggcugcaccuucaaggacaaggugcugguggccgccagaagaaacgccagcgccguggugcuguacaacgaggagagauacggcaacaucacccugcccaugagccacgccggcaccggcaacaucguggugaucaugaucagcuaccccaagggcagagagauccuggagcuggugcagaagggcauccccgugaccaugaccaucggcgugggcaccagacacgugcaggaguucaucagcggccagagcgugguguucguggccaucgccuucaucaccaugaugaucaucagccuggccuggcugaucuucuacuacauccagagauuccuguacaccggcagccagaucggcagccagagccacagaaaggagaccaagaaggugaucggccagcugcugcugcacaccgugaagcacggcgagaagggcaucgacguggacgccgagaacugcgccgugugcaucgagaacuucaaggugaaggacaucaucagaauccugcccugcaagcacaucuuccacagaaucugcaucgaccccuggcugcuggaccacagaaccugccccaugugcaagcuggacgugaucaaggcccugggcuacuggggcgagcccggcgacgugcaggagaugcccgcccccgagagcccccccggcagagaccccgccgccaaccugagccuggcccugcccgacgacgacggcagcgacgacagcagcccccccagcgccagccccgccgagagcgagccccagugcgaccccagcuucaagggcgacgccggcgagaacaccgcccugcuggaggccggcagaagcgacagcagacacggcggccccaucagcuaa

SEQ ID NO: 22729 - RNA, 1047 nt, Artificial Sequence
  RNF14__Homo_sapiens__XP_005268598
augcaguuccugaaggaggagacccuggccuaccugaacaucgugagccccuucgagcugaagaucggcagccagaagaaggugcagagaagaaccgcccaggccagccccaacaccgagcuggacuucggcggcgccgccggcagcgacguggaccaggaggagaucguggacgagagagccgugcaggacguggagagccugagcaaccugauccaggagauccuggacuucgaccaggcccagcagaucaagugcuucaacagcaagcuguuccugugcagcaucugcuucugcgagaagcugggcagcgagugcauguacuuccuggagugcagacacguguacugcaaggccugccugaaggacuacuucgagauccagaucagagacggccaggugcagugccugaacugccccgagcccaagugccccagcguggccacccccggccaggugaaggagcugguggaggccgagcuguucgccagauacgacagacugcugcugcagagcagccuggaccugauggccgacgugguguacugccccagacccugcugccagcugcccgugaugcaggagcccggcugcaccaugggcaucugcagcagcugcaacuucgccuucugcacccugugcagacugaccuaccacggcgugagccccugcaaggugaccgccgagaagcugauggaccugagaaacgaguaccugcaggccgacgaggccaacaagagacugcuggaccagagauacggcaagagagugauccagaaggcccuggaggagauggagagcaaggaguggcuggagaagaacagcaagagcugccccugcugcggcacccccaucgagaagcuggacggcugcaacaagaugaccugcaccggcugcaugcaguacuucugcuggaucugcaugggcagccugagcagagccaaccccuacaagcacuucaacgaccccggcagccccugcuucaacagacuguucuacgccguggacguggacgacgacaucugggaggacgagguggaggacuaa

SEQ ID NO: 22730 - RNA, 1317 nt, Artificial Sequence
  RNF150__Homo_sapiens__NP_065775
auggccaugagccugauccaggccugcugcagccuggcccugagcaccuggcugcugagcuucugcuucgugcaccugcugugccuggacuucaccguggccgagaaggaggagugguacaccgccuucgugaacaucaccuacgccgagcccgcccccgaccccggcgccggcgccgccggcggcggcggcgccgagcugcacaccgagaagaccgagugcggcagauacggcgagcacagccccaagcaggacgccagaggcgagguggugauggccagcagcgcccacgacagacuggccugcgaccccaacaccaaguucgccgcccccaccagaggcaagaacuggaucgcccugauccccaagggcaacugcaccuacagagacaagaucagaaacgccuuccugcagaacgccagcgccguggugaucuucaacgugggcagcaacaccaacgagaccaucaccaugccccacgccggcguggaggacaucguggccaucaugauccccgagcccaagggcaaggagaucgugagccugcuggagagaaacaucaccgugaccauguacaucaccaucggcaccagaaaccugcagaaguacgugagcagaaccagcgugguguucgugagcaucagcuucaucgugcugaugaucaucagccuggccuggcugguguucuacuacauccagagauucagauacgccaacgccagagacagaaaccagagaagacugggcgacgccgccaagaaggccaucagcaagcugcagaucagaaccaucaagaagggcgacaaggagaccgagagcgacuucgacaacugcgccgugugcaucgagggcuacaagcccaacgacguggugagaauccugcccugcagacaccuguuccacaagagcugcguggaccccuggcugcuggaccacagaaccugccccaugugcaagaugaacauccugaaggcccugggcaucccccccaacgccgacugcauggacgaccugcccaccgacuucgagggcagccugggcggcccccccaccaaccagaucaccggcgccagcgacaccaccgugaacgagagcagcgugacccuggaccccgccgugagaaccgugggcgcccugcagguggugcaggacaccgaccccaucccccaggagggcgacgugaucuucaccaccaacagcgagcaggagcccgccgugagcagcgacagcgacaucagccugaucauggccauggaggugggccugagcgacguggagcugagcaccgaccaggacugcgaggaggugaagagcuaa

SEQ ID NO: 22731 - RNA, 612 nt, Artificial Sequence
  RNF152__Homo_sapiens__NP_775828
auggagacccugagccaggacagccugcuggagugccagaucugcuucaacuacuacagccccagaagaagacccaagcugcuggacugcaagcacaccugcugcagcgugugccugcagcagaugagaaccagccagaaggacgugagaugccccuggugcagaggcgugaccaagcugccccccggcuucagcgugagccagcugcccgacgaccccgaggugcuggccgugaucgccaucccccacaccagcgagcacacccccguguucaucaagcugcccagcaacggcugcuacaugcugccccugcccaucagcaaggagagagcccugcugcccggcgacaugggcugcagacugcugcccggcagccagcagaagagcgugaccguggugaccauccccgccgagcagcagccccugcagggcggcgccccccaggaggccguggaggaggagcaggacagaagaggcguggugaagagcagcaccuggagcggcgugugcaccgugauccugguggccugcgugcugguguuccugcugggcaucgugcugcacaacaugagcugcaucagcaagagauucaccgugaucagcugcggcuaa

SEQ ID NO: 22732 - RNA, 2040 nt, Artificial Sequence
  RNF157__Homo_sapiens__NP_443148
augggcgcccugaccagcagacagcacgccggcguggaggagguggacauccccagcaacagcguguacagauacccccccaagagcggcagcuacuucgccagccacuucaucaugggcggcgagaaguucgacagcacccaccccgagggcuaccuguucggcgagaacagcgaccugaacuuccugggcaacagacccgugguguuccccuacgccgccccccccccccaggagcccgugaagacccugagaagccuggugaacaucagaaaggacacccugagacuggugaagugcgccgaggaggugaagagccccggcgaggaggccagcaaggccaaggugcacuacaacguggaguucaccuucgacaccgacgccagaguggccaucaccaucuacuaccaggccaccgaggaguuccagaacggcaucgccagcuacauccccaaggacaacagccugcagagcgagaccgugcaguacaagagaggcgugugccagcaguucugccugcccagccacaccguggaccccagcgagugggccgaggaggagcugggcuucgaccuggacagagagguguacccccugguggugcacgccgugguggacgagggcgacgaguacuucggccacugccacgugcugcugggcaccuucgagaagcacaccgacggcaccuucugcgugaagccccugaagcagaagcaggugguggacggcgugagcuaccugcugcaggagaucuacggcaucgagaacaaguacaacacccaggacagcaagguggccgaggacgaggugagcgacaacagcgccgagugcguggugugccugagcgacgugagagacacccugauccugcccugcagacaccugugccugugcaacaccugcgccgacacccugagauaccaggccaacaacugccccaucugcagacugcccuucagagcccugcugcagaucagagccaugagaaagaagcugggcccccugagccccaccagcuucaaccccaucaucagcagccagaccagcgacagcgaggagcaccccagcagcgagaacaucccccccggcuacgagguggugagccugcuggaggcccugaacggcccccugacccccagccccgccgugcccccccugcacgugcugggcgacggccaccugagcggcaugcugcccagcuacggcagcgacggccaccugccccccgugagaaccaucagcccccuggacagacugagcgacagcagcagccagggccugaagcugaagaagagccugagcaagagcaccagccagaacagcagcgugcugcacgaggaggaggacgagcacagcugcagcgagagcgagacccagcugagccagagacccagcgugcagcaccugggcgaggagugcggcgugacccccgagagcgagaaccugacccugagcagcagcggcgccaucgaccagagcagcugcaccggcaccccccugagcagcaccaucagcagccccgagggccccgccagcagcagccuggcccagagcgugaugagcauggccagcagccagaucagcaccgacaccgugagcagcaugagcggcagcuacaucgcccccggcaccgaggaggagggcgaggcccugagcagcccccagcccgccagcagagcccccagcgaggagggcgagggccugcccgccgagagccccgacagcaacuucgccggccugcccgccggcgagcaggacgccgagggcaacgacgugaucgaggaggaggacggcagccccacccaggagggccagagaaccugcgccuuccugggcauggagugcgacaacaacaacgacuucgacaucgccagcgugaaggcccuggacaacaagcugugcagcgaggugugccugcccggcgccuggcaggccgacgacaacgccgugagcagaaacgcccagagaagaagacugagcagcagcagccuggaggacagcgagaccagacccugcguguggggcccccuggccguguaa

SEQ ID NO: 22733 - RNA, 1053 nt, Artificial Sequence
  RNF167__Homo_sapiens__NP_056343
augcaccccgccgccuucccccugcccguggugguggccgccgugcuguggggcgccgcccccaccagaggccugaucagagccaccagcgaccacaacgccagcauggacuucgccgaccugcccgcccuguucggcgccacccugagccaggagggccugcagggcuuccugguggaggcccaccccgacaacgccugcagccccaucgccccccccccccccgcccccgugaacggcagcguguucaucgcccugcugagaagauucgacugcaacuucgaccugaaggugcugaacgcccagaaggccggcuacggcgccgccguggugcacaacgugaacagcaacgagcugcugaacaugguguggaacagcgaggagauccagcagcagaucuggauccccagcguguucaucggcgagagaagcagcgaguaccugagagcccuguucguguacgagaagggcgccagagugcugcuggugcccgacaacaccuucccccugggcuacuaccugauccccuucaccggcaucgugggccugcuggugcuggccaugggcgccgugaugaucgccagaugcauccagcacagaaagagacugcagagaaacagacugaccaaggagcagcugaagcagauccccacccacgacuaccagaagggcgaccaguacgacgugugcgccaucugccuggacgaguacgaggacggcgacaagcugagagugcugcccugcgcccacgccuaccacagcagaugcguggaccccuggcugacccagaccagaaagaccugccccaucugcaagcagcccgugcacagaggccccggcgacgaggaccaggaggaggagacccagggccaggaggagggcgacgagggcgagcccagagaccaccccgccagcgagagaaccccccugcugggcagcagccccacccugcccaccagcuucggcagccuggcccccgccccccugguguuccccggccccagcaccgaccccccccugagcccccccagcagccccgugauccugguguaa

SEQ ID NO: 22734 - RNA, 1716 nt, Artificial Sequence
  RNF168__Homo_sapiens__NP_689830
auggcccugcccaaggacgccauccccagccugagcgagugccagugcggcaucugcauggagauccugguggagcccgugacccugcccugcaaccacacccugugcaagcccugcuuccagagcaccguggagaaggccagccugugcugccccuucugcagaagaagagugagcagcuggaccagauaccacaccagaagaaacagccuggugaacguggagcuguggaccaucauccagaagcacuaccccagagagugcaagcugagagccagcggccaggagagcgaggagguggccgacgacuaccagcccgugagacugcugagcaagcccggcgagcugagaagagaguacgaggaggagaucagcaagguggccgccgagagaagagccagcgaggaggaggagaacaaggccagcgaggaguacauccagagacugcuggccgaggaggaggaggaggagaagagacaggccgagaagagaagaagagccauggaggagcagcugaagagcgacgaggagcuggccagaaagcugagcaucgacaucaacaacuucugcgagggcagcaucagcgccagcccccugaacagcagaaagagcgaccccgugacccccaagagcgagaagaagagcaagaacaagcagagaaacaccggcgacauccagaaguaccugacccccaagagccaguucggcagcgccagccacagcgaggccgugcaggaggugagaaaggacagcgugagcaaggacaucgacagcagcgacagaaagagccccaccggccaggacaccgagaucgaggacaugcccacccugagcccccagaucagccugggcgugggcgagcagggcgccgacagcagcaucgagagccccaugcccuggcugugcgccugcggcgccgagugguaccacgagggcaacgugaagaccagacccagcaaccacggcaaggagcugugcgugcugagccacgagagacccaagaccagagugcccuacagcaaggagaccgccgugaugcccugcggcagaaccgagagcggcugcgcccccaccagcggcgugacccagaccaacggcaacaacaccggcgagaccgagaacgaggagagcugccugcugaucagcaaggagaucagcaagagaaagaaccaggagagcagcuucgaggccgugaaggaccccugcuucagcgccaagagaagaaaggugagccccgagagcagccccgaccaggaggagaccgagaucaacuucacccagaagcugaucgaccuggagcaccugcuguucgagagacacaagcaggaggagcaggacagacugcuggcccugcagcugcagaaggagguggacaaggagcagauggugcccaacagacagaagggcagccccgacgaguaccaccugagagccaccagcagcccccccgacaaggugcugaacggccagagaaagaaccccaaggacggcaacuucaagagacagacccacaccaagcaccccacccccgagagaggcagcagagacaagaacagacaggugagccugaagaugcagcugaagcagagcgugaacagaagaaagaugcccaacagcaccagagaccacugcaaggugagcaagagcgcccacagccugcagcccagcaucagccagaagagcguguuccagauguuccagagaugcaccaaguaa

SEQ ID NO: 22735 - RNA, 777 nt, Artificial Sequence
  RNF170__Homo_sapiens__NP_001153695
auggccaaguaccagggcgaggugcagagccugaagcuggacgacgacagcgugaucgagggcgugagcgaccaggugcugguggccgugguggugagcuucgcccugaucgccacccugguguacgcccuguucagaaacgugcaccagaacauccaccccgagaaccaggagcuggugagagugcugagagagcagcugcagaccgagcaggacgcccccgccgccaccagacagcaguucuacaccgacauguacugccccaucugccugcaccaggccagcuuccccguggagaccaacugcggccaccuguucugcggcgccugcaucaucgccuacuggagauacggcagcuggcugggcgccaucagcugccccaucugcagacagaccgugacccugcugcugaccguguucggcgaggacgaccagagccaggacgugcugagacugcaccaggacaucaacgacuacaacagaagauucagcggccagcccagaagcaucauggagagaaucauggaccugcccacccugcugagacacgccuucagagagauguucagcgugggcggccuguucuggauguucagaaucagaaucauccugugccugaugggcgccuucuucuaccugaucagcccccuggacuucgugcccgaggcccuguucggcauccugggcuuccuggacgacuucuucgugaucuuccugcugcugaucuacaucagcaucauguacagagaggugaucacccagagacugaccagauaa

SEQ ID NO: 22736 - RNA, 1779 nt, Artificial Sequence
  RNF180__Homo_sapiens__NP_001107033
augaagagaagcaaggagcugaucaccaagaaccacagccaggaggagaccagcauccugagaugcuggaagugcagaaagugcaucgccagcagcggcugcuucauggaguaccuggagaaccaggugaucaaggacaaggacgacagcguggacgcccagaacaucugccacguguggcacaugaacguggaggcccugcccgaguggaucagcugccugauccagaaggcccaguggaccgugggcaagcugaacugccccuucugcggcgccagacugggcggcuucaacuucgugagcacccccaagugcagcugcggccagcuggccgccgugcaccugagcaagagcagaaccgacuaccagcccacccaggccggcagacugaugagacccagcgugaaguaccugagccaccccagagugcagagcggcugcgacaaggaggcccugcugaccggcggcggcagcgagaacagaaaccacagacugcugaacauggccagaaacaacaacgaccccggcagacugaccgaggcccugugccuggaggugagacccaccuacuucgagaugaagaacgagaagcugcugagcaaggccagcgagcccaaguaccagcuguucgugccccagcuggugaccggcagaugcgccaccagagccuuccacagaaagagccacagccuggaccugaacaucagcgagaagcugacccugcugcccacccuguacgagauccacagcaagaccaccgccuacagcagacugaacgagacccagcccaucgaccugagcggccugccccugcagagcagcaagaacagcuacagcuuccagaaccccagcagcuucgaccccagcaugcugcugcagagauucagcguggccccccacgagacccagacccagagaggcggcgaguuccagugcggccuggaggccgccagcguguacagcgaccacaccaacaccaacaaccugaccuuccugauggaccugcccagcgccggcagaagcaugcccgaggccagcgaccaggaggagcaccugagcccccuggacuuccugcacagcgccaacuucagccugggcagcaucaaccagagacugaacaagagagagagaagcaagcugaagaaccugagaagaaagcagagaagaagagagagauggcugcagaagcagggcaaguacagcggcgugggccugcuggaccacaugacccugaacaacgagaugagcaccgacgaggacaacgaguacgccgaggagaaggacagcuacaucugcgccgugugccuggacguguacuucaaccccuacaugugcuaccccugccaccacaucuucugcgagcccugccugagaacccuggccaaggacaaccccagcagcacccccugcccccugugcagaaccaucaucagcagaguguucuuccagaccgagcugaacaacgccaccaagaccuucuucaccaaggaguaccugaagaucaagcagagcuuccagaagagcaacagcgccaaguggccccugcccagcugcagaaaggccuuccaccuguucggcggcuucagaagacacgccgcccccgugaccagaagacaguucccccacggcgcccacagaauggacuaccugcacuucgaggacgacagcagaggcuggugguucgacauggacauggugaucaucuacaucuacagcgugaacugggugaucggcuucaucguguucugcuuccugugcuacuucuucuuccccuucuaa

SEQ ID NO: 22737 - RNA, 744 nt, Artificial Sequence
  RNF182__Homo_sapiens__NP_001158506
auggccagccagccccccgaggacaccgccgagagccaggccagcgacgagcuggagugcaagaucugcuacaacagauacaaccugaagcagagaaagcccaaggugcuggagugcugccacagagugugcgccaagugccuguacaagaucaucgacuucggcgacagcccccagggcgugaucgugugccccuucugcagauucgagaccugccugcccgacgacgaggugagcagccugcccgacgacaacaacauccuggugaaccugaccugcggcggcaagggcaagaagugccugcccgagaaccccaccgagcugcugcugacccccaagagacuggccagccuggugagccccagccacaccagcagcaacugccuggugaucaccaucauggaggugcagagagagagcagccccagccugagcagcacccccgugguggaguucuacagacccgccagcuucgacagcgugaccaccgugagccacaacuggaccguguggaacugcaccagccugcuguuccagaccagcaucagagugcugguguggcugcugggccugcuguacuucagcagccugccccugggcaucuaccugcuggugagcaagaaggugacccugggcgugguguucgugagccuggugcccagcagccuggugauccugaugguguacggcuucugccagugcgugugccacgaguuccuggacugcauggccccccccagcuaa

SEQ ID NO: 22738 - RNA, 2517 nt, Artificial Sequence
  RNF19A__Homo_sapiens__XP_005250910
augcaggagcaggagaucggcuucaucagcaaguacaacgagggccugugcgugaacaccgaccccgugagcauccugaccagcauccuggacaugagccugcacagacagaugggcagcgacagagaccugcagagcagcgccagcagcgugagccugcccagcgugaagaaggcccccaagaagagaagaaucagcaucggcagccuguucagaagaaagaaggacaacaagagaaagagcagagagcugaacggcggcguggacggcaucgccagcaucgagagcauccacagcgagaugugcaccgacaagaacagcaucuucagcaccaacaccagcagcgacaacggccugaccagcaucagcaagcagaucggcgacuucaucgagugcccccugugccugcugagacacagcaaggacagauuccccgacaucaugaccugccaccacagaagcugcguggacugccugagacaguaccugagaaucgagaucagcgagagcagagugaacaucagcugccccgagugcaccgagagauucaacccccacgacaucagacugauccugagcgacgacgugcugauggagaaguacgaggaguucaugcugagaagauggcugguggccgaccccgacugcagauggugccccgcccccgacugcggcuacgccgugaucgccuucggcugcgccagcugccccaagcugaccugcggcagagagggcugcggcaccgaguucugcuaccacugcaagcagaucuggcaccccaaccagaccugcgacgccgccagacaggagagagcccagagccugagacugagaaccaucagaagcagcagcaucagcuacagccaggagagcggcgccgccgccgacgacaucaagcccugccccagaugcgccgccuacaucaucaagaugaacgacggcagcugcaaccacaugaccugcgccgugugcggcugcgaguucugcuggcugugcaugaaggagaucagcgaccugcacuaccugagccccagcggcugcaccuucuggggcaagaagcccuggagcagaaagaagaagauccuguggcagcugggcacccuggugggcgcccccgugggcaucgcccugaucgccggcaucgccauccccgccaugaucaucggcauccccguguacgugggcagaaagauccacaacagauacgagggcaaggacgugagcaagcacaagagaaaccuggccaucgccggcggcgugacccugagcgugaucgugagccccgugguggccgccgugaccgugggcaucggcgugcccaucaugcuggccuacguguacggcguggugcccaucagccugugcagaagcggcggcugcggcgugagcgccggcaacggcaagggcgugagaaucgaguucgacgacgagaacgacaucaacgugggcggcaccaacaccgccguggacaccaccagcguggccgaggccagacacaaccccagcaucggcgagggcagcgugggcggccugaccggcagccugagcgccagcggcagccacauggacagaaucggcgccaucagagacaaccugagcgagaccgccagcaccauggcccuggccggcgccagcaucaccggcagccugagcggcagcgccauggugaacugcuucaacagacuggaggugcaggccgacgugcagaaggagagauacagccugagcggcgagagcggcaccgugagccugggcaccgugagcgacaacgccagcaccaaggccauggccggcagcauccugaacagcuacaucccccuggacaaggagggcaacagcauggaggugcagguggacaucgagagcaagcccagcaaguucagacacaacagcggcagcagcagcguggacgacggcagcgccaccagaagccacgccggcggcagcagcagcggccugcccgagggcaagagcagcgccaccaaguggagcaaggaggccaccgccggcaagaagagcaagagcggcaagcugagaaagaagggcaacaugaagaucaacgagaccagagaggacauggacgcccagcugcuggagcagcagagcaccaacagcagcgaguucgaggcccccagccugagcgacagcaugcccagcguggccgacagccacagcagccacuucagcgaguucagcugcagcgaccuggagagcaugaagaccagcugcagccacggcagcagcgacuaccacaccagauucgccaccgugaacauccugcccgagguggagaacgacagacuggagaacagcccccaccagugcagcaucagcguggugacccagaccgccagcugcagcgaggugagccagcugaaccacaucgccgaggagcacggcaacaacggcaucaagcccaacguggaccuguacuucggcgacgcccugaaggagaccaacaacaaccacagccaccagaccauggagcugaagguggccauccagaccgagaucuaa

SEQ ID NO: 22739 - RNA, 2049 nt, Artificial Sequence
  RNF207__Homo_sapiens__XP_011539741
augcccgaggaggccagccccgccggccaccccgaggacaccagaagaggcauccccagagugggcgugagaagaggcagaagaggccacggcagaggcagacccagagccgagugggagcccagccccggcgccggccugaacuuccagggcagacugcugcugggcagagccaccgccagaugccugagagccagacccggcgccgcccugagagcccuggacggcggcagagaggccagaagaaccggcagcagccagcagagcggccccgccgacgugggcagcuaccugagagcccccggcggccccgagcugcccggcugccccgagcacccccccgccggcgugcccgccgugcccagagccgugagagcccccgugagcagcggccuguuccccagacugcugugcagacugcccgccuggcccagagacagaagacccccccaccugcccgccgugcccgacguggagaccaccuacuucugcaacaccugcggccagccccugugcgccagaugcagagacgagacccacagagccagaauguucgccagacacgacaucguggcccugggccagagaagcagagacgugccccagaagugcacccugcacgccgagcccuaccugcuguucagcaccgacaagaagcugcugcugugcaucagaugcuucagagacaugcagaaggagagcagagcccacugcguggaccuggagagcgccuacgugcagggcugcgagagacuggagcaggccgugcuggccgugaaggcccugcagaccgccaccagagaggccaucgcccugcugcaggccaugguggaggaggugagacacagcgccgccgaggaggaggacgccauccacgcccuguucggcagcaugcaggacagacuggccgagagaaaggcccugcugcugcaggccgugcagagccaguacgaggagaaggacaaggccuucaaggagcagcugagccaccuggccacccugcugcccacccugcaggugcaccuggugaucugcagcagcuuccugagccuggccaacaaggccgaguuccuggaccugggcuacgagcugauggagagacugcagggcaucgugaccagaccccaccaccugagacccauccagagcagcaagaucgccagcgaccacagagccgaguucgccagaugccuggagccccugcugcugcugggccccagaagaguggccgccgccgccagcggcgccaacacccuggccggcggccugggccccaaggcccugaccggcccccacugccccagccccgugggcaagaugagcggcagccccgugcagaagcccacccugcacagaagcaucagcaccaaggugcugcuggccgagggcgagaacacccccuucgccgagcacugcagacacuacgaggacagcuacagacaccugcaggccgagaugcagagccugaaggaccaggugcaggagcugcacagagaccugaccaagcaccacagccugaucaaggccgagaucaugggcgacgugcugcacaagagccugcagcuggacgugcagaucgccagcgagcacgccagccuggagggcaugagagugguguuccaggagaucugggaggaggccuaccagagaguggccaacgagcaggagaucuacgaggcccagcugcacgaccugcugcagcugagacaggagaacgccuaccugaccaccaucaccaagcagaucacccccuacgugagaagcaucgccaaggugaaggagagacuggagcccagauuccaggcccccguggacgagcagagcgagagccugcagaacacccacgacgacagcagaaacaacgccgccagcgccagaaacaaccccggcagcgugcccgagaagagagagaagaccagcgagcccaagggcaacagcugggcccccaacggccugagcgaggagccccugcugaagaacauggaccaccacagaagcaagcagaagaacggcggcgacgugcccaccuggagagagcaccccaccuaa

SEQ ID NO: 22740 - RNA, 2928 nt, Artificial Sequence
  RNF20__Homo_sapiens__NP_062538
augagcggcaucggcaacaagagagccgccggcgagcccggcaccagcaugccccccgagaagaaggccgccguggaggacagcggcaccaccguggagaccaucaagcugggcggcgugagcagcaccgaggagcuggacaucagaacccugcagaccaagaacagaaagcuggccgagaugcuggaccagagacaggccaucgaggacgagcugagagagcacaucgagaagcuggagagaagacaggccaccgacgacgccagccugcugaucgugaacagauacuggagccaguucgacgagaacaucagaaucauccugaagagauacgaccuggagcagggccugggcgaccugcugaccgagagaaaggcccugguggugcccgagcccgagcccgacagcgacagcaaccaggagagaaaggacgacagagagagaggcgagggccaggagcccgccuucagcuuccuggccacccuggccagcagcagcagcgaggagauggagagccagcugcaggagagaguggagagcagcagaagagccgugagccagaucgugaccguguacgacaagcugcaggagaagguggagcugcugagcagaaagcugaacagcggcgacaaccugaucguggaggaggccgugcaggagcugaacagcuuccuggcccaggagaacaugagacugcaggagcugaccgaccugcugcaggagaagcacagaaccaugagccaggaguucagcaagcugcagagcaagguggagaccgccgagagcagagugagcgugcuggagagcaugaucgacgaccugcagugggacaucgacaagaucagaaagagagagcagagacugaacagacaccuggccgaggugcuggagagagugaacagcaagggcuacaagguguacggcgccggcagcagccuguacggcggcaccaucaccaucaacgccagaaaguucgaggagaugaacgccgagcuggaggagaacaaggagcuggcccagaacagacugugcgagcuggagaagcugagacaggacuucgaggaggugaccacccagaacgagaagcugaagguggagcugagaagcgccguggagcagguggugaaggagacccccgaguacagaugcaugcagagccaguucagcgugcuguacaacgagagccugcagcugaaggcccaccuggacgaggccagaacccugcugcacggcaccagaggcacccaccagcaccagguggagcugaucgagagagacgaggugagccugcacaagaagcugagaaccgaggugauccagcuggaggacacccuggcccaggugagaaaggaguacgagaugcugagaaucgaguucgagcagacccuggccgccaacgagcaggccggccccaucaacagagagaugagacaccugaucagcagccugcagaaccacaaccaccagcugaagggcgaggugcugagauacaagagaaagcugagagaggcccagagcgaccugaacaagaccagacugagaagcggcagcgcccugcugcagagccagagcagcaccgaggaccccaaggacgagcccgccgagcugaagcccgacagcgaggaccugagcagccagagcagcgccagcaaggccagccaggaggacgccaacgagaucaagagcaagagagacgaggaggagagagagagagagagaagagagaaggagagagagagagagagagagagagagaaggagaaggagagagagagagagaagcagaagcugaaggagagcgagaaggagagagacagcgccaaggacaaggagaagggcaagcacgacgacggcagaaagaaggaggccgagaucaucaagcagcugaagaucgagcugaagaaggcccaggagagccagaaggagaugaagcugcugcuggacauguacagaagcgcccccaaggagcagagagacaaggugcagcugauggccgccgagaagaagagcaaggccgagcuggaggaccugagacagagacugaaggaccuggaggacaaggagaagaaggagaacaagaagauggccgacgaggacgcccugagaaagaucagagccguggaggagcagaucgaguaccugcagaagaagcuggccauggccaagcaggaggaggaggcccugcugagcgagauggacgugaccggccaggccuucgaggacaugcaggagcagaacaucagacugaugcagcagcugagagagaaggacgacgccaacuucaagcugaugagcgagagaaucaagagcaaccagauccacaagcugcugaaggaggagaaggaggagcuggccgaccaggugcugacccugaagacccagguggacgcccagcugcagguggugagaaagcuggaggagaaggagcaccugcugcagagcaacaucggcaccggcgagaaggagcugggccugagaacccaggcccuggagaugaacaagagaaaggccauggaggccgcccagcuggccgacgaccugaaggcccagcuggagcuggcccagaagaagcugcacgacuuccaggacgagaucguggagaacagcgugaccaaggagaaggacauguucaacuucaagagagcccaggaggacaucagcagacugagaagaaagcuggagaccaccaagaagcccgacaacgugcccaagugcgacgagauccugauggaggagaucaaggacuacaaggccagacugaccugccccugcugcaacaugagaaagaaggacgccgugcugaccaagugcuuccacguguucugcuucgagugcgugaagaccagauacgacaccagacagagaaagugccccaagugcaacgccgccuucggcgccaacgacuuccacagaaucuacaucggcuaa

SEQ ID NO: 22741 - RNA, 15624 nt, Artificial Sequence
  RNF213__Homo_sapiens__NP_001243000
auggagugccccagcugccagcacgugagcaaggaggagacccccaaguucugcagccagugcggcgagagacugccccccgccgcccccaucgccgacagcgagaacaacaacagcaccauggccagcgccagcgagggcgagauggagugcggccaggagcugaaggaggagggcggccccugccuguuccccggcagcgacagcuggcaggagaaccccgaggagcccugcagcaaggccagcuggaccgugcaggagagcaagaagaagaagagaaagaagaagaagaagggcaacaagagcgccagcagcgagcuggccagccugccccugagccccgccagccccugccaccugacccugcugagcaaccccuggccccaggacaccgcccugccccacagccaggcccagcagagcggccccaccggccagcccagccagccccccggcaccgccaccaccccccuggagggcgacggccugagcgcccccaccgaggugggcgacagcccccugcaggcccaggcccugggcgaggccggcguggccaccggcagcgaggcccagagcagcccccaguuccaggaccacaccgagggcgaggaccaggacgccagcauccccagcggcggcagaggccugagccaggagggcaccggcccccccaccagcgccggcgagggccacagcagaaccgaggacgccgcccaggagcugcugcugcccgagagcaagggcggcagcagcgagcccggcaccgagcugcagaccaccgagcagcaggccggcgccagcgccagcauggccguggacgccguggccgagcccgccaacgccgugaagggcgccggcaaggagaugaaggagaagacccagagaaugaagcagccccccgccaccaccccccccuucaagacccacugccaggaggccgagaccaagaccaaggacgagauggccgccgccgaggagaaggugggcaagaacgagcagggcgagcccgaggaccugaagaagcccgagggcaagaacagaagcgccgccgccgugaagaacgagaaggagcagaagaaccaggaggccgacgugcaggaggugaaggccagcacccugagccccggcggcggcgugaccguguucuuccacgccaucaucagccugcacuuccccuucaaccccgaccugcacaagguguucaucagaggcggcgaggaguucggcgagagcaagugggacagcaacaucugcgagcugcacuacaccagagaccugggccacgacagagugcugguggagggcaucgugugcaucagcaagaagcaccuggacaaguacauccccuacaaguacgugaucuacaacggcgagagcuucgaguacgaguucaucuacaagcaccagcagaagaagggcgaguacgugaacagaugccuguucaucaagagcagccugcugggcagcggcgacuggcaccaguacuacgacaucguguacaugaagccccacggcagacugcagaaggugaugaaccacaucaccgacggccccagaaaggaccuggugaagggcaagcagaucgccgccgcccugaugcuggacagcaccuucagcauccugcagaccugggacaccaucaaccugaacagcuucuucacccaguucgagcaguucugcuucgugcugcagcagcccaugaucuacgagggccaggcccagcuguggaccgaccugcaguacagagagaaggaggugaagagauaccuguggcagcaccugaagaagcacguggugccccugcccgacggcaagagcaccgacuuccugcccguggacugccccgugagaagcaagcugaagaccggccugaucgugcuguucgugguggagaagaucgagcugcugcuggagggcagccuggacuggcugugccaccugcugaccagcgacgccagcagccccgacgaguuccacagagaccugagccacauccugggcaucccccagagcuggagacuguaccuggugaaccugugccagagaugcauggacaccagaaccuacaccuggcugggcgcccugcccgugcugcacugcugcauggagcuggcccccagacacaaggacgccuggagacagcccgaggacaccugggccgcccuggagggccugagcuucagccccuucagagagcagaugcuggacaccagcagccugcugcaguucaugagagagaagcagcaccugcugagcaucgacgagccccuguucagaagcugguucagccugcugccccugagccaccuggugauguacauggagaacuucaucgagcaccugggcagauuccccgcccacauccuggacugccugagcggcaucuacuacagacugcccggccuggagcaggugcugaacacccaggacgugcaggacgugcagaacgugcagaacauccuggagaugcugcugagacugcuggacaccuacagagacaagauccccgaggaggcccugagccccagcuaccugaccgugugccugaagcugcacgaggccaucugcagcagcaccaagcugcugaaguucuacgagcugcccgcccugagcgccgagaucgugugcagaaugaucagacugcugagccugguggacagcgccggccagagagacgagaccggcaacaacagcgugcagaccguguuccagggcacccuggccgccaccaagagauggcugagagagguguucaccaagaacaugcugaccagcagcggcgccagcuucaccuacgugaaggagaucgagguguggagaagacugguggagauccaguuccccgccgagcacggcuggaaggagagccugcugggcgacauggaguggagacugaccaaggaggagccccugagccagaucaccgccuacugcaacagcugcugggacaccaagggccuggaggacagcguggccaagaccuucgagaagugcaucaucgaggccgugagcagcgccugccagagccagaccagcauccugcagggcuucagcuacagcgaccugagaaaguucggcaucgugcugagcgccgugaucaccaagagcuggcccagaaccgccgacaacuucgacgacauccugaagcaccugcugacccuggccgacgugaagcacguguucagacugugcggcaccgacgagaagauccuggccaacgugaccgaggacgccaagagacugaucgccguggccgacagcgugcugaccaagguggugggcgaccugcugagcggcaccauccuggugggccagcuggagcugaucaucaagcacaagaaccaguuccuggacaucuggcagcugagagagaagagccugagcccccaggacgagcagugcgccguggaggaggcccuggacuggagaagagaggagcugcugcugcugaagaaggagaagagaugcguggacagccugcugaagaugugcggcaacgugaagcaccugauccagguggacuucggcgugcuggccgugagacacagccaggaccugagcagcaagagacugaacgacaccgugaccgugagacugagcaccagcagcaacagccagagagccacccacuaccaccugagcagccaggugcaggagauggccggcaagaucgaccugcugagagacagccacaucuuccagcuguucuggagagaggccgccgagccccugagcgagcccaaggaggaccaggaggccgccgagcugcugagcgagcccgaggaggagagcgagagacacauccuggagcuggaggagguguacgacuaccuguaccagcccagcuacagaaaguucaucaagcugcaccaggaccugaagagcggcgaggugacccuggccgagaucgacgugaucuucaaggacuucgugaacaaguacaccgaccuggacagcgagcugaagaucaugugcaccguggaccaccaggaccagagagacuggaucaaggacagaguggagcagaucaaggaguaccaccaccugcaccaggccgugcacgccgccaaggugauccugcaggugaaggagagccugggccugaacggcgacuucagcgugcugaacacccugcugaacuucaccgacaacuucgacgacuucagaagagagacccuggaccagaucaaccaggagcugauccaggccaagaagcugcugcaggacaucagcgaggccagaugcaagggccugcaggcccugagccugagaaaggaguucaucugcugggugagagaggcccugggcggcaucaacgagcugaagguguucguggaccuggccagcaucagcgccggcgagaacgacaucgacguggacagaguggccugcuuccacgacgccgugcagggcuacgccagccugcuguucaagcuggaccccagcguggacuucagcgccuucaugaagcaccugaagaagcuguggaaggcccuggacaaggaccaguaccugcccagaaagcugugcgacagcgccagaaaccuggaguggcugaagaccgugaacgagagccacggcagcguggagagaagcagccugacccuggccaccgccaucaaccagagaggcaucuacgugauccaggcccccaagggcggccagaagaucagccccgacaccgugcugcaccugauccugcccgagagccccggcagccacgaggagagcagagaguacagccuggaggaggugaaggagcugcugaacaagcugaugcugaugagcggcaagaaggacagaaacaacaccgagguggagagauucagcgagguguucugcagcgugcagagacugagccaggccuucaucgaccugcacagcgccggcaacaugcuguucagaaccuggaucgccauggccuacugcagccccaagcagggcgugagccugcagauggacuucggccuggaccuggugaccgagcugaaggagggcggcgacgugaccgagcugcuggccgcccugugcagacagauggagcacuuccuggacagcuggaagagauucgugacccagaagagaauggagcacuucuaccugaacuucuacaccgccgagcagcugguguaccugagcaccgagcugagaaagcagccccccagcgacgccgcccugaccaugcugagcuucaucaagagcaacugcacccugagagacgugcugagagccagcgugggcugcggcagcgaggccgccagauacagaaugagaagagugauggaggagcugccccugaugcugcugagcgaguucagccugguggacaagcugagaaucaucauggagcagagcaugagaugccugcccgccuuccugcccgacugccuggaccuggagacccugggccacugccuggcccaccuggccggcaugggcggcagccccguggagagaugccugcccagaggccugcaggugggccagcccaaccugguggugugcggccacagcgaggugcugcccgccgcccuggccguguacaugcagacccccagccagccccugcccaccuacgacgaggugcugcugugcacccccgccaccaccuucgaggagguggcccugcugcugagaagaugccugacccugggcagccugggccacaagguguacagccugcuguucgccgaccagcugagcuacgagguggccagacaggccgaggagcuguuccacaaccugugcacccagcagcacagagaggacuaccagcuggugauggugugcgacggcgacugggagcacugcuaccugcccagcgccuucagccagcacaagguguucgugaccccccaggccccccuggaggccauccaggccuaccuggccggccacuacagagugcccaagcagacccugagcgccgccgccguguucaacgacagacugugcgugggcaucguggccagcgagagagccggcgugggcaagagccuguacgugaagagacugcacgacaagaugaagaugcagcugaacgugaagaacgugccccugaagaccaucagacugaucgacccccagguggacgagagcagagugcugggcgcccugcugcccuuccuggacgcccaguaccagaaggugcccgugcuguuccaccuggacgugaccagcagcgugcagaccggcaucuggguguuccuguucaagcugcugauccugcaguaccugauggacaucaacggcaagauguggcugagaaaccccugccaccuguacaucguggagauccuggagagaagaaccagcgugcccagcagaagcagcagcgcccugagaaccagagugccccaguucagcuuccuggacaucuuccccaaggugaccugcagaccccccaaggaggugaucgacauggagcugagcgcccugagaagcgacaccgagcccggcauggaccugugggaguucugcagcgagaccuuccagagacccuaccaguaccugagaagauucaaccagaaccaggaccuggacaccuuccaguaccaggagggcagcguggagggcacccccgaggagugccugcagcacuuccuguuccacugcggcgugaucaaccccagcuggagcgagcugagaaacuucgccagauuccugaacuaccagcugagagacugcgaggccagccuguucugcaaccccagcuucaucggcgacacccugagaggcuucaagaaguucguggugaccuucaugaucuucauggccagagacuucgccacccccagccugcacaccagcgaccagagccccggcaagcacauggugaccauggacggcgugagagaggaggaccuggcccccuucagccugagaaagagaugggagagcgagccccaccccuacguguucuucaacgacgaccacaccaccaugaccuucaucggcuuccaccugcagcccaacaucaacggcagcguggacgccaucagccaccugaccggcaaggugaucaagagagacgugaugaccagagaccuguaccagggccugcugcugcagagagugcccuucaacguggacuucgacaagcugcccagacacaagaagcuggagagacugugccugacccugggcaucccccaggccaccgaccccgacaagaccuacgagcugaccaccgacaacaugcugaagauccuggccaucgagaugagauucagaugcggcauccccgugaucaucaugggcgagaccggcugcggcaagaccagacugaucaaguuccugagcgaccugagaagaggcggcaccaacgccgacaccaucaagcuggugaaggugcacggcggcaccaccgccgacaugaucuacagcagagugagagaggccgagaacguggccuucgccaacaaggaccagcaccagcuggacaccauccuguucuucgacgaggccaacaccaccgaggccaucagcugcaucaaggaggugcugugcgaccacaugguggacggccagccccuggccgaggacagcggccugcacaucaucgccgccugcaaccccuacagaaagcacagcgaggagaugaucugcagacuggagagcgccggccugggcuacagagugagcauggaggagaccgccgacagacugggcagcaucccccugagacagcugguguacagagugcacgcccugccccccagccugaucccccuggugugggacuucggccagcugagcgacguggccgagaagcuguacauccagcagaucgugcagagacugguggagagcaucagccuggacgagaacggcaccagagugaucaccgaggugcugugcgccagccagggcuucaugagaaagaccgaggacgagugcagcuucgugagccugagagacguggagagaugcgugaagguguucagaugguuccacgagcacagcgccaugcugcuggcccagcugaacgccuuccugagcaagagcagcgugagcaagaaccacaccgagagagaccccgugcuguggagccugaugcuggccaucggcgugugcuaccacgccagccuggagaagaaggacagcuacagaaaggccaucgccagauucuuccccaagcccuacgacgacagcagacugcugcuggacgagaucaccagagcccaggaccuguuccuggacggcgugccccugagaaagaccaucgccaagaaccuggcccugaaggagaacguguucaugaugguggugugcaucgagcugaagaucccccuguuccuggugggcaagcccggcagcagcaagagccuggccaagaccaucguggccgacgccaugcagggccccgccgccuacagcgaccuguucagaagccugaagcaggugcaccuggugagcuuccagugcagcccccacagcaccccccagggcaucaucagcaccuucagacagugcgccagauuccagcagggcaaggaccugcagcaguacgugagcgugguggugcuggacgaggugggccuggccgaggacagccccaagaugccccugaagacccugcacccccugcuggaggacggcugcaucgaggacgaccccgccccccacaagaaggugggcuucgugggcaucagcaacugggcccuggaccccgccaagaugaacagaggcaucuucgugagcagaggcagccccaacgagaccgagcugaucgagagcgccaagggcaucugcagcagcgacauccuggugcaggacagagugcagggcuacuucgccagcuucgccaaggccuacgagaccgugugcaagagacaggacaaggaguucuucggccugagagacuacuacagccugaucaagaugguguucgccgccgccaaggccagcaacagaaagcccagcccccaggacaucgcccaggccgugcugagaaacuucagcggcaaggacgacauccaggcccuggacaucuuccuggccaaccugcccgaggccaagugcagcgaggaggugagccccaugcagcugaucaagcagaacaucuucggccccagccagaaggugcccggcggcgagcaggaggacgccgagagcagauaccugcuggugcugaccaagaacuacguggcccugcagauccugcagcagaccuucuucgagggcgaccagcagcccgagaucaucuucggcagcggcuuccccaaggaccaggaguacacccagcugugcagaaacaucaacagagugaagaucugcauggagaccggcaagauggugcugcugcugaaccugcagaaccuguacgagagccuguacgacgcccugaaccaguacuacgugcaccugggcggccagaaguacguggaccugggccugggcacccacagagugaagugcagagugcaccccaacuucagacugaucgugaucgaggagaaggacgugguguacaagcacuuccccaucccccugaucaacagacuggagaagcacuaccuggacaucaacaccgugcuggagaaguggcagaagagcaucguggaggagcugugcgccuggguggagaaguucaucaacgugaaggcccaccacuuccagaagagacacaaguacagccccagcgacguguucaucggcuaccacagcgacgccugcgccagcguggugcugcaggugaucgagagacagggccccagagcccugaccgaggagcugcaccagaaggugagcgaggaggccaagagcauccugcugaacugcgccacccccgacgccguggugagacugagcgccuacagccugggcggcuucgccgccgaguggcugagccaggaguacuuccacagacagagacacaacagcuucgccgacuuccugcaggcccaccugcacaccgccgaccuggagagacacgccaucuucaccgagaucaccaccuucagcagacugcugaccagccacgacugcgagauccuggagagcgaggugaccggcagagcccccaagcccacccugcuguggcugcagcaguucgacaccgaguacagcuuccugaaggaggugagaaacugccugaccaacaccgccaagugcaagauccugaucuuccagaccgacuucgaggacggcaucagaagcgcccagcugaucgccagcgccaaguacagcgugaucaacgagaucaacaagaucagagagaacgaggacagaaucuucguguacuucaucaccaagcugagcagagugggcagaggcaccgccuacgugggcuuccacggcggccuguggcagagcgugcacaucgacgaccugagaagaagcacccugauggugagcgacgugaccagacugcagcacgugaccaucagccagcuguucgcccccggcgaccugcccgagcugggccuggagcacagagccgaggacggccacgaggaggccauggagaccgaggccagcaccagcggcgagguggccgagguggccgaggaggccauggagaccgagagcagcgagaaggugggcaaggagaccagcgagcugggcggcagcgacgugagcauccuggacaccaccagacugcugagaagcugcgugcagagcgccgugggcaugcugagagaccagaacgagagcugcaccagaaacaugagaagaguggugcugcugcugggccugcugaacgaggacgacgccugccacgccagcuuccugagagugagcaagaugagacugagcguguuccugaagaagcaggaggagagccaguuccacccccuggaguggcuggccagagaggccugcaaccaggacgcccugcaggaggccggcaccuucagacacacccuguggaagagagugcagggcgccgugaccccccugcuggccagcaugaucagcuucaucgacagagacggcaaccuggagcugcugaccagacccgacaccccccccugggccagagaccuguggauguucaucuucagcgacaccaugcugcugaacaucccccuggugaugaacaacgagagacacaagggcgagauggccuacaucguggugcagaaccacaugaaccugagcgagaacgccagcaacaacgugcccuucagcuggaagaucaaggacuaccuggaggagcugugggugcaggcccaguacaucaccgacgccgagggccugcccaagaaguucguggacaucuuccagcagaccccccugggcagauuccuggcccagcugcacggcgagccccagcaggagcugcugcagugcuaccugaaggacuucauccugcugaccaugagagugagcaccgaggaggagcugaaguuccugcagauggcccuguggagcugcaccagaaagcugaaggccgccagcgaggcccccgaggaggaggugagccugcccugggugcaccuggccuaccagagauucagaagcagacugcagaacuucagcagaauccugaccaucuacccccaggugcugcacagccugauggaggccagauggaaccacgagcuggccggcugcgagaugacccuggacgccuucgccgccauggccugcaccgagaugcugaccagaaacacccugaagcccagcccccaggccuggcugcagcuggugaagaaccugagcaugccccuggagcugaucugcagcgacgagcacaugcagggcagcggcagccuggcccaggccgugaucagagaggugagagcccaguggagcagaaucuucagcaccgcccuguucguggagcacgugcugcugggcaccgagagcagagugcccgagcugcagggccuggugaccgagcacguguuccugcuggacaagugccugagagagaacagcgacgugaagacccacggccccuucgaggccgugaugagaacccugugcgagugcaaggagaccgccagcaagacccugagcagauucggcauccagcccugcagcaucugccugggcgacgccaaggaccccgugugccugcccugcgaccacgugcacugccugagaugccugagagccugguucgccagcgagcagaugaucugccccuacugccugaccgcccugcccgacgaguucagccccgccgugagccaggcccacagagaggccaucgagaagcacgccagauucagacagaugugcaacagcuucuucguggaccuggugagcaccaucugcuucaaggacaacgccccccccgagaaggaggugaucgagagccugcugagccugcuguucgugcagaagggcagacugagagacgccgcccagagacacugcgagcacaccaagagccugagccccuucaacgacgugguggacaagacccccgugaucagaagcgugauccugaagcugcugcugaaguacagcuuccacgacgugaaggacuacauccaggaguaccugacccugcugaagaagaaggccuucaucaccgaggacaagaccgagcuguacaugcuguucaucaacugccuggaggacagcauccuggagaagaccagcgccuacagcagaaacgacgagcugaaccaccuggaggaggagggcagauuccugaaggccuacagccccgccagcagaggcagagagcccgccaacgaggccagcguggaguaccugcaggagguggccagaaucagacugugccuggacagagccgccgacuuccugagcgagcccgagggcggccccgagauggccaaggagaagcagugcuaccugcagcaggugaagcaguucugcaucagaguggagaacgacuggcacagaguguaccuggugagaaagcugagcagccagagaggcauggaguucgugcagggccugagcaagcccggcagaccccaccaguggguguuccccaaggacguggugaagcagcagggccugagacaggaccaccccggccagauggacagauaccugguguacggcgacgaguacaaggcccugagagacgccguggccaaggccgugcuggagugcaagccccugggcaucaagaccgcccugaaggccugcaagaccccccagagccagcagagcgccuacuuccugcugacccuguucagagagguggccauccuguacagaagccacaacgccagccugcaccccacccccgagcagugcgaggccgugagcaaguucaucggcgagugcaagauccugagcccccccgacaucagcagauucgccaccagccugguggacaacagcgugccccugcugagagccggccccagcgacagcaaccuggacggcaccgugaccgagauggccauccacgccgccgccgugcugcugugcggccagaacgagcugcuggagccccugaagaaccuggccuucagccccgccaccauggcccacgccuuccugcccaccaugcccgaggaccugcuggcccaggccagaagauggaagggccuggagagagugcacugguacaccugccccaacggccaccccugcagcgugggcgagugcggcagacccauggagcagagcaucugcaucgacugccacgcccccaucggcggcaucgaccacaagcccagagacggcuuccaccuggugaaggacaaggccgacagaacccagaccggccacgugcugggcaacccccagagaagagacguggugaccugcgacagaggccugccccccgugguguuccugcugaucagacugcugacccaccuggcccugcugcugggcgccagccagagcagccaggcccugaucaacaucaucaagccccccgugagagaccccaagggcuuccugcagcagcacauccugaaggaccuggagcagcuggccaagaugcugggccacagcgccgacgagaccaucggcguggugcaccuggugcugagaagacugcugcaggagcagcaccagcugagcagcagaagacugcugaacuucgacaccgagcugagcaccaaggagaugagaaacaacugggagaaggagaucgccgccgugaucagccccgagcuggagcaccuggacaagacccugcccaccaugaacaaccugaucagccaggacaagagaaucagcagcaaccccguggccaagaucaucuacggcgaccccgugaccuuccugccccaccugcccagaaagagcguggugcacugcagcaagaucuggagcugcagaaagagaaucaccguggaguaccugcagcacaucguggagcagaagaacggcaaggagagagugcccauccuguggcacuuccugcagaaggaggccgagcugagacuggugaaguuccugcccgagauccuggcccugcagagagaccuggugaagcaguuccagaacgugcagcagguggaguacagcagcaucagaggcuuccugagcaagcacagcagcgacggccugagacagcugcugcacaacagaaucaccguguuccugagcaccuggaacaagcugagaagaagccuggagaccaacggcgagaucaaccugcccaaggacuacugcagcaccgaccuggaccuggacaccgaguucgagauccugcugcccagaagaagaggccugggccugugcgccaccgcccuggugagcuaccugaucagacugcacaacgagaucguguacgccguggagaagcugagcaaggagaacaacagcuacagcguggacgccgccgaggugaccgagcugcacgugaucagcuacgagguggagagagaccugaccccccugauccugagcaacugccaguaccagguggaggagggcagagagaccgugcaggaguucgaccuggagaagauccagagacagaucgugagcagauuccugcagggcaagcccagacugagccugaagggcauccccacccugguguacagacacgacuggaacuacgagcaccuguucauggacaucaagaacaagauggcccaggacagccugcccagcagcgugaucagcgccaucagcggccagcugcagagcuacagcgacgccugcgaggugcugagcgugguggaggugacccugggcuuccugagcaccgccggcggcgaccccaacaugcagcugaacguguacacccaggacauccugcagaugggcgaccagaccauccacgugcugaaggcccugaacagaugccagcugaagcacaccaucgcccuguggcaguuccugagcgcccacaagagcgagcagcugcugagacugcacaaggagcccuucggcgagaucagcagcagauacaaggccgaccugagccccgagaacgccaagcugcugagcaccuuccugaaccagaccggccuggacgccuuccugcuggagcugcacgagaugaucauccugaagcugaagaacccccagacccagaccgaggagagauucagaccccaguggagccugagagacacccuggugagcuacaugcagaccaaggagagcgagauccugcccgagauggccagccaguuccccgaggagauccugcuggccagcugcgugagcguguggaagaccgccgccgugcugaaguggaacagagagaugagauaa

SEQ ID NO: 22742 - RNA, 2112 nt, Artificial Sequence
  RNF214__Homo_sapiens__NP_997226
auggccgccagcgagguggccggcgugguggccaacgcccccagcccccccgagagcagcagccugugcgccagcaagagcgacgagggccugcccgacggccugagcaccaaggacagcgcccagaagcagaagaacagcccccugcugagcgugagcagccagaccaucaccaaggagaacaacagaaacgugcaccuggagcacagcgagcagaaccccggcagcagcgccggcgacaccagcgccgcccaccagguggugcugggcgagaaccugaucgccaccgcccugugccugagcggcagcggcagccagagcgaccugaaggacguggccagcaccgccggcgaggagggcgacaccagccugagagagagccugcaccccgugaccagaagccugaaggccggcugccacaccaagcagcuggccagcagaaacugcagcgaggagaagagcccccagaccagcauccugaaggagggcaacagagacaccagccuggacuucagacccguggugagccccgccaacggcguggagggcgugagaguggaccaggacgacgaccaggacagcagcagccugaagcugagccagaacaucgccgugcagaccgacuucaagaccgccgacagcgaggugaacaccgaccaggacaucgagaagaaccuggacaagaugaugaccgagagaacccugcugaaggagagauaccaggaggugcuggacaagcagagacagguggagaaccagcugcaggugcagcugaagcagcugcagcagagaagagaggaggagaugaagaaccaccaggagauccugaaggccauccaggacgugaccaucaagagagaggagaccaagaagaagaucgagaaggagaagaaggaguuccugcagaaggagcaggaccugaaggccgagaucgagaagcugugcgagaagggcagaagagaggugugggagauggagcuggacagacugaagaaccaggacggcgagaucaacagaaacaucauggaggagaccgagagagccuggaaggccgagauccugagccuggagagcagaaaggagcugcuggugcugaagcuggaggaggccgagaaggaggccgagcugcaccugaccuaccugaagagcaccccccccacccuggagaccgugagaagcaagcaggagugggagaccagacugaacggcgugagaaucaugaagaagaacgugagagaccaguucaacagccacauccagcuggugagaaacggcgccaagcugagcagccugccccagauccccacccccacccugccccccccccccagcgagaccgacuucaugcugcagguguuccagcccagccccagccuggcccccagaaugcccuucagcaucggccaggugaccaugcccauggugaugcccagcgccgaccccagaagccugagcuuccccauccugaaccccgcccugagccagcccagccagcccagcagcccccugcccggcagccacggcagaaacagccccggccugggcagccuggugagcccccacggcccccacaugccccccgccgccagcaucccccccccccccggccugggcggcgugaaggccagcgccgagacccccagaccccagcccguggacaagcuggagaagauccuggagaagcugcugaccagauucccccagugcaacaaggcccagaugaccaacauccugcagcagaucaagaccgccagaaccaccauggccggccugaccauggaggagcugauccagcugguggccgccagacuggccgagcacgagagaguggccgccagcacccagccccugggcagaaucagagcccuguuccccgccccccuggcccagaucagcacccccauguuccugcccagcgcccaggugagcuaccccggcagaagcagccacgcccccgccaccugcaagcugugccugaugugccagaagcuggugcagcccagcgagcugcaccccauggccugcacccacgugcugcacaaggagugcaucaaguucugggcccagaccaacaccaacgacaccugccccuucugccccacccugaaguaa

SEQ ID NO: 22743 - RNA, 2601 nt, Artificial Sequence
  RNF216__Homo_sapiens__NP_996999
auggaggagggcaacaacaacgaggaggugauccaccugaacaacuuccacugccacagaggccaggaguggaucaaccugagagacggccccaucaccaucagcgacagcagcgacgaggagagaauccccaugcuggugacccccgccccccagcagcacgaggaggaggaccuggacgacgacgugauccugaccgaggacgacagcgaggacgacuacggcgaguuccuggaccugggcccccccggcaucagcgaguucaccaagcccagcggccagaccgagagagagcccaagcccggccccagccacaaccaggccgccaacgacaucgugaaccccagaagcgagcagaaggugaucauccuggaggagggcagccugcuguacaccgagagcgacccccuggagacccagaaccagagcagcgaggacagcgagaccgagcugcugagcaaccugggcgagagcgccgcccuggccgacgaccaggccaucgaggaggacugcuggcuggaccaccccuacuuccagagccugaaccagcagcccagagagaucaccaaccagguggugccccaggagagacagcccgaggccgagcugggcagacugcuguuccagcacgaguuccccggccccgccuuccccagacccgagccccagcagggcggcaucagcggccccagcagcccccagcccgcccacccccugggcgaguucgaggaccagcagcuggccagcgacgacgaggagcccggccccgccuuccccaugcaggagagccaggagcccaaccuggagaacaucuggggccaggaggccgccgagguggaccaggagcugguggagcugcuggugaaggagaccgaggccagauuccccgacguggccaacggcuucaucgaggagaucauccacuucaagaacuacuacgaccugaacgugcugugcaacuuccugcuggagaaccccgacuaccccaagagagaggacagaaucaucaucaaccccagcagcagccugcuggccagccaggacgagaccaagcugcccaagaucgacuucuucgacuacagcaagcugaccccccuggaccagagaugcuucauccaggccgccgaccugcugauggccgacuucaaggugcugagcagccaggacaucaagugggcccugcacgagcugaagggccacuacgccaucaccagaaaggcccugagcgacgccaucaagaaguggcaggagcugagccccgagaccagcggcaagagaaagaagagaaagcagaugaaccaguacagcuacaucgacuucaaguucgagcagggcgacaucaagaucgagaagagaauguucuuccuggagaacaagagaagacacugcagaagcuacgacagaagagcccugcugcccgccgugcagcaggagcaggaguucuacgagcagaagaucaaggagauggccgagcacgaggacuuccugcuggcccugcagaugaacgaggagcaguaccagaaggacggccagcugaucgagugcagaugcugcuacggcgaguuccccuucgaggagcugacccagugcgccgacgcccaccuguucugcaaggagugccugaucagauacgcccaggaggccguguucggcagcggcaagcuggagcugagcugcauggagggcagcugcaccugcagcuuccccaccagcgagcuggagaaggugcugccccagaccauccuguacaaguacuacgagagaaaggccgaggaggagguggccgccgccuacgccgacgagcuggugagaugccccagcugcagcuuccccgcccugcuggacagcgacgugaagagauucagcugccccaacccccacugcagaaaggagaccugcagaaagugccagggccuguggaaggagcacaacggccugaccugcgaggagcuggccgagaaggacgacaucaaguacagaaccagcaucgaggagaagaugaccgccgccagaaucagaaagugccacaagugcggcaccggccugaucaagagcgagggcugcaacagaaugagcugcagaugcggcgcccagaugugcuaccugugcagagugagcaucaacggcuacgaccacuucugccagcaccccagaagccccggcgcccccugccaggagugcagcagaugcagccuguggaccgaccccaccgaggacgacgagaagcugaucgaggagauccagaaggaggccgaggaggagcagaagagaaagaacggcgagaacaccuucaagagaaucggccccccccuggagaagcccguggagaaggugcagagaguggaggcccugcccagacccgugccccagaaccugccccagccccagaugccccccuacgccuucgcccacccccccuucccccugccccccgugagacccguguucaacaacuucccccugaacaugggccccauccccgcccccuacgugcccccccugcccaacgugagagugaacuacgacuucggccccauccacaugccccuggagcacaaccugcccaugcacuucggcccccagcccagacacagauucuaa

SEQ ID NO: 22744 - RNA, 447 nt, Artificial Sequence
  RNF24__Homo_sapiens__NP_001127809
augagcagcgacuucccccacuacaacuucagaaugcccaacaucggcuuccagaaccugccccugaacaucuacaucgugguguucggcaccgccaucuucguguucauccugagccugcuguucugcugcuaccugaucagacugagacaccaggcccacaaggaguucuacgccuacaagcaggugauccugaaggagaaggugaaggagcugaaccugcacgagcugugcgccgugugccuggaggacuucaagcccagagacgagcugggcaucugccccugcaagcacgccuuccacagaaagugccugaucaaguggcuggaggugagaaaggugugcccccugugcaacaugcccgugcugcagcuggcccagcugcacagcaagcaggacagaggccccccccagggcccccugcccggcgccgagaacaucguguaa

SEQ ID NO: 22745 - RNA, 864 nt, Artificial Sequence
  RNF2__Homo_sapiens__XP_005245470
augugccccaucugccuggacaugcugaagaacaccaugaccaccaaggagugccugcacagauucugcgccgacugcaucaucaccgcccugagaagcggcaacaaggagugccccaccugcagaaagaagcuggugagcaagagaagccugagacccgaccccaacuucgacgcccugaucagcaagaucuaccccagcagagacgaguacgaggcccaccaggagagagugcuggccagaaucaacaagcacaacaaccagcaggcccugagccacagcaucgaggagggccugaagauccaggccaugaacagacugcagagaggcaagaagcagcagaucgagaacggcagcggcgccgaggacaacggcgacagcagccacugcagcaacgccagcacccacagcaaccaggaggccggccccagcaacaagagaaccaagaccagcgacgacagcggccuggagcuggacaacaacaacgccgccauggccaucgaccccgugauggacggcgccagcgagaucgagcugguguucagaccccaccccacccugauggagaaggacgacagcgcccagaccagauacaucaagaccagcggcaacgccaccguggaccaccugagcaaguaccuggccgugagacuggcccuggaggagcugagaagcaagggcgagagcaaccagaugaaccuggacaccgccagcgagaagcaguacaccaucuacaucgccaccgccagcggccaguucaccgugcugaacggcagcuucagccuggagcuggugagcgagaaguacuggaaggugaacaagcccauggagcuguacuacgcccccaccaaggagcacaaguaa

SEQ ID NO: 22746 - RNA, 3219 nt, Artificial Sequence
  RNF31__Homo_sapiens__NP_060469
augcccggcgaggaggaggagagagccuuccugguggccagagaggagcuggccagcgcccugagaagagacagcggccaggccuucagccuggagcagcugagaccccugcuggccagcagccugccccuggccgccagauaccugcagcuggacgccgccagacuggugagaugcaacgcccacggcgagcccagaaacuaccugaacacccugagcaccgcccugaacauccuggagaaguacggcagaaaccugcugagcccccagagacccagauacuggagaggcgugaaguucaacaaccccguguucagaagcaccguggacgccgugcagggcggcagagacgugcugagacuguacggcuacaccgaggagcagcccgacggccugagcuuccccgagggccaggaggagcccgacgagcaccagguggccaccgugacccuggaggugcugcugcugagaaccgagcugagccugcugcugcagaacacccaccccagacagcaggcccuggagcagcugcuggaggacaagguggaggacgacaugcugcagcugagcgaguucgacccccugcugagagagaucgcccccggcccccugaccacccccagcgugcccggcagcacccccggccccugcuuccugugcggcagcgcccccggcacccugcacugccccagcugcaagcaggcccugugccccgccugcgaccaccuguuccacggccaccccagcagagcccaccaccugagacagacccugcccggcgugcugcagggcacccaccugagccccagccugcccgccagcgcccagcccagaccccagagcaccagccugcuggcccugggcgacagcagccugagcagccccaaccccgccagcgcccaccugcccuggcacugcgccgccugcgccaugcugaacgagcccugggccgugcugugcguggccugcgacagacccagaggcugcaagggccugggccugggcaccgagggcccccagggcaccggcggccuggagcccgaccuggccagaggcagaugggccugccagagcugcaccuucgagaacgaggccgccgccgugcugugcagcaucugcgagagacccagacuggcccagccccccagccuggugguggacagcagagacgccggcaucugccugcagccccugcagcagggcgacgcccugcuggccagcgcccagagccaggugugguacugcauccacugcaccuucugcaacagcagccccggcugggugugcgugaugugcaacagaaccagcagccccauccccgcccagcacgcccccagacccuacgccagcagccuggagaagggcccccccaagcccggcccccccagaagacugagcgccccccugcccagcagcugcggcgaccccgagaagcagagacaggacaagaugagagaggagggccugcagcuggugagcaugaucagagagggcgaggccgccggcgccugccccgaggagaucuucagcgcccugcaguacagcggcaccgaggugccccugcaguggcugagaagcgagcugcccuacgugcuggagaugguggccgagcuggccggccagcaggaccccggccugggcgccuucagcugccaggaggccagaagagccuggcuggacagacacggcaaccuggacgaggccguggaggagugcgugagaaccagaagaagaaaggugcaggagcugcagagccugggcuucggccccgaggagggcagccugcaggcccuguuccagcacggcggcgacgugagcagagcccugaccgagcugcagagacagagacuggagcccuucagacagagacugugggacagcggccccgagcccacccccagcugggacggccccgacaagcagagccuggugagaagacugcuggccguguacgcccugcccagcuggggcagagccgagcuggcccugagccugcugcaggagacccccagaaacuacgagcugggcgacgugguggaggccgugagacacagccaggacagagccuuccugagaagacugcuggcccaggagugcgccgugugcggcugggcccugccccacaacagaaugcaggcccugaccagcugcgagugcaccaucugccccgacugcuucagacagcacuucaccaucgcccugaaggagaagcacaucaccgacauggugugccccgccugcggcagacccgaccugaccgacgacacccagcugcugagcuacuucagcacccuggacauccagcugagagagagccuggagcccgacgccuacgcccuguuccacaagaagcugaccgagggcgugcugaugagagaccccaaguuccuguggugcgcccagugcagcuucggcuucaucuacgagagagagcagcuggaggccaccugcccccagugccaccagaccuucugcgugagaugcaagagacagugggaggagcagcacagaggcagaagcugcgaggacuuccagaacuggaagagaaugaacgaccccgaguaccaggcccagggccuggccauguaccugcaggagaacggcaucgacugccccaagugcaaguucagcuacgcccuggccagaggcggcugcaugcacuuccacugcacccagugcagacaccaguucugcagcggcugcuacaacgccuucuacgccaagaacaagugccccgagcccaacugcagagugaagaagagccugcacggccaccaccccagagacugccuguucuaccugagagacuggaccgcccugagacugcagaagcugcugcaggacaacaacgugauguucaacaccgagccccccgccggcgccagagccgugcccggcggcggcugcagagugaucgagcagaaggaggugcccaacggccugagagacgaggccugcggcaaggagacccccgccggcuacgccggccugugccaggcccacuacaaggaguaccuggugagccugaucaacgcccacagccuggaccccgccacccuguacgagguggaggagcuggagaccgccaccgagagauaccugcacgugagaccccagccccuggccggcgaggacccccccgccuaccaggccagacugcugcagaagcugaccgaggaggugccccugggccagagcauccccagaagaagaaaguaa

SEQ ID NO: 22747 - RNA, 1119 nt, Artificial Sequence
  RNF34__Homo_sapiens__NP_079402
augaaggccggcgccaccagcaugugggccagcugcugcggccugcugaacgaggugaugggcaccggcgccgugagaggccagcagagcgccuucgccggcgccaccggccccuucagauucacccccaaccccgaguucagcaccuacccccccgccgccaccgagggccccaacaucgugugcaaggccugcggccugagcuucagcguguucagaaagaagcacgugugcugcgacugcaagaaggacuucugcagcgugugcagcgugcugcaggagaaccugagaagaugcagcaccugccaccugcugcaggagaccgccuuccagagaccccagcugaugagacugaaggugaaggaccugagacaguaccugauccugagaaacauccccaucgacaccugcagagagaaggaggaccugguggaccuggugcugugccaccacggccugggcagcgaggacgacauggacaccagcagccugaacagcagcagaagccagaccagcagcuucuucaccagaagcuucuucagcaacuacaccgcccccagcgccaccaugagcagcuuccagggcgagcugauggacggcgaccagaccagcagaagcggcgugcccgcccaggugcagagcgagaucaccagcgccaacaccgaggacgacgacgacgacgacgacgaggacgacgacgacgaggaggagaacgccgaggacagaaaccccggccugagcaaggagagagugagagccagccugagcgaccugagcagccuggacgacguggagggcaugagcgugagacagcugaaggagauccuggccagaaacuucgugaacuacagcggcugcugcgagaagugggagcugguggagaaggugaacagacuguacaaggagaacgaggagaaccagaagagcuacggcgagagacugcagcugcaggacgaggaggacgacagccugugcagaaucugcauggacgccgugaucgacugcgugcugcuggagugcggccacauggugaccugcaccaagugcggcaagagaaugagcgagugccccaucugcagacaguacguggugagagccgugcacguguucaagagcuaa

SEQ ID NO: 22748 - RNA, 1263 nt, Artificial Sequence
  RNF39__Homo_sapiens__NP_079512
augugguggagagaccugaccagacugagacuguggcugaagagagaggccauccccggcgagggcagaaaggccgccaaggugaacgccggcgugggcgagaagggcaucuacaccgccagcagcagaggcggcccccccagcgccagaagcaaggccgugaccgugguggccgagggcgccgccagcagaagcuggcugagcauggacgcccccgagcugggccccggccugguggagagacuggagcagcuggccaccugcccccugugcggcggcagcuucgaggaccccgugcugcuggccugcgagcacagcuucugcagagccugccuggccagaagauggggcaccccccccgccaccggcaccgaggccagccccaccgccugccccugcugcggccugcccugccccagaagaagccugagaagcaacgugagacuggccguggaggugagaaucagcagagagcugagagagaagcuggccgagcccggcgccagagccggcagaagaagaggcggcagaauccccaccaugggcugccuggaccugcccggcgaggacaugagaaagaccuggagaagauucgaggugcccaccagcaagagcagcaacagcgaggacgaccugcccgaggacuaccccguggugaagaagaugcugcacagacugaccgccgaccugacccuggaccccggcaccgcccacagaagacugcugaucagcgccgacagaagaagcgugcagcuggccccccccggcacccccgccccccccgacggccccaagagauucgaccagcugcccgccgugcugggcgcccagggcuucggcgccggcagacacugcugggagguggagaccgccgacgccgccagcugcagagacagcagcggcgaggacgccgacgacgaggagagccacuacgccgugggcgccgccggcgagagcgugcagagaaagggcugcgugagacugugccccgccggcgccgugugggccguggagggcagaggcggcagacugugggcccugaccgcccccgagcccacccugcugggcggcguggagcccccccccagaagaaucagaguggaccuggacugggagagaggcagaguggccuucuacgacggcagaagccuggaccugcuguacgccuuccaggcccccggcccccugggcgagagaaucuucccccuguucugcaccugcgaccccagagccccccugagaaucgugcccgccgagagcuaa

SEQ ID NO: 22749 - RNA, 2706 nt, Artificial Sequence
  RNF40__Homo_sapiens__NP_001193963
augagcggccccggcaacaagagagccgccggcgacggcggcagcggcccccccgagaagaagcugagcagagaggagaagaccaccaccacccugaucgagcccaucagacugggcggcaucagcagcaccgaggagauggaccugaaggugcugcaguucaagaacaagaagcuggccgagagacuggagcagagacaggccugcgaggacgagcugagagagagaaucgagaagcuggagaagagacaggccaccgacgacgccacccugcugaucgugaacagauacugggcccagcuggacgagaccguggaggcccugcugagaugccacgagagccagggcgagcugagcagcgcccccgaggcccccggcacccaggagggccccaccugcgacggcaccccccugcccgagcccggcaccagcgagcugagagacccccugcugaugcagcugagacccccccugagcgagcccgcccuggccuucgugguggcccugggcgccagcagcagcgaggagguggagcuggagcugcagggcagaauggaguucagcaaggccgccgugagcagagugguggaggccagcgacagacugcagagaagaguggaggagcugugccagagaguguacagcagaggcgacagcgagccccugagcgaggccgcccaggcccacaccagagagcugggcagagagaacagaagacugcaggaccuggccacccagcugcaggagaagcaccacagaaucagccuggaguacagcgagcugcaggacaaggugaccagcgccgagaccaaggugcuggagauggagaccaccguggaggaccugcagugggacaucgagaagcugagaaagagagagcagaagcugaacaagcaccuggccgaggcccuggagcagcugaacagcggcuacuacgugagcggcagcagcagcggcuuccagggcggccagaucacccugagcaugcagaagagcgacgagcugggccugcagaagaagcugagaaccgaggugauccagcuggaggacacccuggcccaggugagaaaggaguacgagaugcugagaaucgaguucgagcagaaccuggccgccaacgagcaggccggccccaucaacagagagaugagacaccugaucagcagccugcagaaccacaaccaccagcugaagggcgacgcccagagauacaagagaaagcugagagaggugcaggccgagaucggcaagcugagagcccaggccagcggcagcgcccacagcacccccaaccugggccaccccgaggacagcggcgugagcgcccccgcccccggcaaggaggagggcggccccggccccgugagcacccccgacaacagaaaggagauggcccccgugcccggcaccaccaccaccaccaccagcgugaagaaggaggagcuggugcccagcgaggaggacuuccagggcaucacccccggcgcccagggccccagcagcagaggcagagagcccgaggccagacccaagagagagcugagagagagagagggccccagccugggccccccccccguggccagcgcccugagcagagccgacagagagaaggccaagguggaggagaccaagagaaaggagagcgagcugcugaagggccugagagccgagcugaagaaggcccaggagagccagaaggagaugaagcugcugcuggacauguacaagagcgcccccaaggagcagagagacaaggugcagcugauggccgccgagagaaaggccaaggccgagguggacgagcugagaagcagaaucagagagcuggaggagagagacagaagagagagcaagaagaucgccgacgaggacgcccugagaagaaucagacaggccgaggagcagaucgagcaccugcagagaaagcugggcgccaccaagcaggaggaggaggcccugcugagcgagauggacgugaccggccaggccuucgaggacaugcaggagcagaacggcagacugcugcagcagcugagagagaaggacgacgccaacuucaagcugaugagcgagagaaucaaggccaaccagauccacaagcugcugagagaggagaaggacgagcugggcgagcaggugcugggccugaagagccagguggacgcccagcugcugaccgugcagaagcuggaggagaaggagagagcccugcagggcagccugggcggcguggagaaggagcugacccugagaagccaggcccuggagcugaacaagagaaaggccguggaggccgcccagcuggccgaggaccugaaggugcagcuggagcacgugcagaccagacugagagagauccagcccugccuggccgagagcagagccgccagagagaaggagagcuucaaccugaagagagcccaggaggacaucagcagacugagaagaaagcuggagaagcagagaaagguggagguguacgccgacgccgacgagauccugcaggaggagaucaaggaguacaaggccagacugaccugccccugcugcaacaccagaaagaaggacgccgugcugaccaagugcuuccacguguucugcuucgagugcgugagaggcagauacgaggccagacagagaaagugccccaagugcaacgccgccuucggcgcccacgacuuccacagaaucuacaucagcuaa

SEQ ID NO: 22750 - RNA, 954 nt, Artificial Sequence
  RNF41__Homo_sapiens__NP_001229755
augggcuacgacgugaccagauuccagggcgacguggacgaggaccugaucugccccaucugcagcggcgugcuggaggagcccgugcaggccccccacugcgagcacgccuucugcaacgccugcaucacccagugguucagccagcagcagaccugccccguggacagaagcguggugaccguggcccaccugagacccgugcccagaaucaugagaaacaugcugagcaagcugcagaucgccugcgacaacgccguguucggcugcagcgccguggugagacuggacaaccugaugagccaccugagcgacugcgagcacaaccccaagagacccgugaccugcgagcagggcugcggccuggagaugcccaaggacgagcugcccaaccacaacugcaucaagcaccugagaagcguggugcagcagcagcagaccagaaucgccgagcuggagaagaccagcgccgagcacaagcaccagcuggccgagcagaagagagacauccagcugcugaaggccuacaugagagccaucagaagcgugaaccccaaccugcagaaccuggaggagaccaucgaguacaacgagauccuggagugggugaacagccugcagcccgccagagugaccagauggggcggcaugaucagcacccccgacgccgugcugcaggccgugaucaagagaagccugguggagagcggcugccccgccagcaucgugaacgagcugaucgagaacgcccacgagagaagcuggccccagggccuggccacccuggagaccagacagaugaacagaagauacuacgagaacuacguggccaagagaauccccggcaagcaggccgugguggugauggccugcgagaaccagcacaugggcgacgacauggugcaggagcccggccuggugaugaucuucgcccacggcguggaggagaucuaa

SEQ ID NO: 22751 - RNA, 2352 nt, Artificial Sequence
  RNF43__Homo_sapiens__NP_060233
augagcggcggccaccagcugcagcuggccgcccuguggcccuggcugcugauggccacccugcaggccggcuucggcagaaccggccuggugcuggccgccgccguggagagcgagagaagcgccgagcagaaggccaucaucagagugaucccccugaagauggaccccaccggcaagcugaaccugacccuggagggcguguucgccggcguggccgagaucacccccgccgagggcaagcugaugcagagccacccccuguaccugugcaacgccagcgacgacgacaaccuggagcccggcuucaucagcaucgugaagcuggagagccccagaagagcccccagacccugccugagccuggccagcaaggccagaauggccggcgagagaggcgccagcgccgugcuguucgacaucaccgaggacagagccgccgccgagcagcugcagcagccccugggccugaccuggcccguggugcugaucuggggcaacgacgccgagaagcugauggaguucguguacaagaaccagaaggcccacgugagaaucgagcugaaggagccccccgccuggcccgacuacgacguguggauccugaugaccguggugggcaccaucuucgugaucauccuggccagcgugcugagaaucagaugcagacccagacacagcagacccgacccccugcagcagagaaccgccugggccaucagccagcuggccaccagaagauaccaggccagcugcagacaggccagaggcgaguggcccgacagcggcagcagcugcagcagcgcccccgugugcgccaucugccuggaggaguucagcgagggccaggagcugagagugaucagcugccugcacgaguuccacagaaacugcguggaccccuggcugcaccagcacagaaccugcccccugugcauguucaacaucaccgagggcgacagcuucagccagagccugggccccagcagaagcuaccaggagcccggcagaagacugcaccugaucagacagcaccccggccacgcccacuaccaccugcccgccgccuaccugcugggccccagcagaagcgccguggccagaccccccagacccggccccuuccugcccagccaggagcccggcaugggccccagacaccacagauuccccagagccgcccaccccagagcccccggcgagcagcagagacuggccggcgcccagcaccccuacgcccagggcuggggccugagccaccugcagagcaccagccagcaccccgccgccugccccgugccccugagaagagccagaccccccgacagcagcggcagcggcgagagcuacugcaccgagagaagcggcuaccuggccgacggccccgccagcgacagcagcagcggccccugccacggcagcagcagcgacagcguggugaacugcaccgacaucagccugcagggcgugcacggcagcagcagcaccuucugcagcagccugagcagcgacuucgacccccugguguacugcagccccaagggcgacccccagagaguggacaugcagcccagcgugaccagcagacccagaagccuggacagcguggugcccaccggcgagacccaggugagcagccacgugcacuaccacagacacagacaccaccacuacaagaagagauuccaguggcacggcagaaagcccggccccgagaccggcgugccccagagcagaccccccauccccagaacccagccccagcccgagccccccagccccgaccagcaggugaccagaagcaacagcgccgcccccagcggcagacugagcaacccccagugccccagagcccugcccgagcccgcccccggccccguggacgccagcagcaucugccccagcaccagcagccuguucaaccugcagaagagcagccugagcgccagacacccccagagaaagagaagaggcggccccagcgagcccacccccggcagcagaccccaggacgccaccgugcaccccgccugccagaucuucccccacuacacccccagcguggccuaccccuggagccccgaggcccacccccugaucugcggcccccccggccuggacaagagacugcugcccgagacccccggccccugcuacagcaacagccagcccguguggcugugccugacccccagacagccccuggagccccacccccccggcgagggccccagcgaguggagcagcgacaccgccgagggcagacccugccccuacccccacugccaggugcugagcgcccagcccggcagcgaggaggagcuggaggagcugugcgagcaggccguguaa

SEQ ID NO: 22752 - RNA, 1056 nt, Artificial Sequence
  RNF44__Homo_sapiens__XP_005265902
augcugcaccccgccacccagcagagccccuucaugguggaccugcacgagcaggugcaccagggccccgugccccugagcuacaccgugaccaccgugaccacccagggcuucccccugcccaccggccagcacauccccggcugcagcgcccagcagcugcccgccugcagcgugauguucagcggccagcacuacccccugugcugccugccccccccccugauccaggccugcaccaugcagcagcugcccgugcccuaccaggccuacccccaccugaucagcagcgaccacuacauccugcacccccccccccccgccccccccccccagcccacccacauggccccccugggccaguucgugagccugcagacccagcaccccagaaugccccugcagagacuggacaacgacguggaccugagaggcgaccagcccagccugggcagcuucaccuacagcaccagcgcccccggccccgcccugagccccagcgugccccugcacuaccugccccacgacccccugcaccaggagcugagcuucggcgugcccuacagccacaugaugcccagaagacugagcacccagagauacagacugcagcagccccugcccccccccccccccccccccccccccccccccuacuaccccagcuuccugcccuacuuccugagcaugcugcccaugagccccaccgccaugggccccaccaucagccuggaccuggacguggacgacguggagauggagaacuacgaggcccugcugaaccuggccgagagacugggcgacgccaagcccagaggccugaccaaggccgacaucgagcagcugcccagcuacagauucaaccccgacagccaccagagcgagcagacccugugcguggugugcuucagcgacuucgaggccagacagcugcugagagugcugcccugcaaccacgaguuccacaccaagugcguggacaaguggcugaaggccaacagaaccugccccaucugcagagccgacgccagcgaggugcccagagaggccgaguaa

SEQ ID NO: 22753 - RNA, 342 nt, Artificial Sequence
  RNF4__Homo_sapiens__NP_001171939
augagcaccagaaagagaagaggcggcgccaucaacagcagacaggcccagaagagaaccagagaggccaccagcacccccgagaucagccuggaggccgagcccaucgagcugguggagaccgccggcgacgagaucguggaccugaccugcgagagccuggagcccguggugguggaccugacccacaacgacagcguggugaucguggacggcccccaggugcugagcguggugcccagcgccuggaccgacacccagagaagcugcagaauggacgugagcagcuucccccagaacgccgccaugagcagcguggccagcgccagcgugauccccuaa

SEQ ID NO: 22754 - RNA, 543 nt, Artificial Sequence
  RNF5__Homo_sapiens__NP_008844
auggccgccgccgaggaggaggacggcggccccgagggccccaacagagagagaggcggcgccggcgccaccuucgagugcaacaucugccuggagaccgccagagaggccguggugagcgugugcggccaccuguacugcuggcccugccugcaccaguggcuggagaccagacccgagagacaggagugccccgugugcaaggccggcaucagcagagagaagguggugccccuguacggcagaggcagccagaagccccaggaccccagacugaagaccccccccagaccccagggccagagacccgcccccgagagcagaggcggcuuccagcccuucggcgacaccggcggcuuccacuucagcuucggcgugggcgccuuccccuucggcuucuucaccaccguguucaacgcccacgagcccuucagaagaggcaccggcguggaccugggccagggccaccccgccagcagcuggcaggacagccuguuccuguuccuggccaucuucuucuucuucuggcugcugagcaucuaa

SEQ ID NO: 22755 - RNA, 2058 nt, Artificial Sequence
  RNF6__Homo_sapiens__NP_005968
augaaccagagcagaagcagaagcgacggcggcagcgaggagacccugccccaggaccacaaccaccacgagaacgagagaagauggcagcaggagagacugcacagagaggaggccuacuaccaguucaucaacgagcugaacgacgaggacuacagacugaugagagaccacaaccugcugggcacccccggcgagaucaccagcgaggagcugcagcagagacuggacggcgugaaggagcagcuggccagccagcccgaccugagagacggcaccaacuacagagacagcgaggugcccagagagagcagccacgaggacagccugcuggaguggcugaacaccuucagaagaaccggcaacgccaccagaagcggccagaacggcaaccagaccuggagagccgugagcagaaccaaccccaacaacggcgaguucagauucagccuggagauccacgugaaccacgagaacagaggcuucgagauccacggcgaggacuacaccgacaucccccugagcgacagcaacagagaccacaccgccaacagacagcagagaagcaccagccccguggccagaagaaccagaagccagaccagcgugaacuucaacggcagcagcagcaacauccccagaaccagacuggccagcagaggccagaaccccgccgagggcagcuucagcacccugggcagacugagaaacggcaucggcggcgccgccggcauccccagagccaacgccagcagaaccaacuucagcagccacaccaaccagagcggcggcagcgagcugagacagagagagggccagagauucggcgccgcccacgugugggagaacggcgccagaagcaacgugaccgugagaaacaccaaccagagacuggagcccaucagacugagaagcaccagcaacagcagaagcagaagccccauccagagacagagcggcaccguguaccacaacagccagagagagagcagacccgugcagcagaccaccagaagaagcgugagaagaagaggcagaaccagaguguuccuggagcaggacagagagagagagagaagaggcaccgccuacacccccuucagcaacagcagacuggugagcagaaucaccguggaggagggcgaggagagcagcagaagcagcaccgccgugagaagacaccccaccaucacccuggaccugcaggugagaagaaucagacccggcgagaacagagacagagacagcaucgccaacagaaccagaagcagagugggccuggccgagaacaccgugaccaucgagagcaacagcggcggcuucagaagaaccaucagcagacuggagagaagcggcaucagaaccuacgugagcaccaucaccgugccccugagaagaaucagcgagaacgagcugguggagcccagcagcguggcccugagaagcauccugagacagaucaugaccggcuucggcgagcugagcagccugauggaggccgacagcgagagcgagcugcagagaaacggccagcaccugcccgacaugcacagcgagcugagcaaccugggcaccgacaacaacagaagccagcacagagagggcagcagccaggacagacaggcccagggcgacagcaccgagaugcacggcgagaacgagaccacccagccccacaccagaaacagcgacagcagaggcggcagacagcugagaaaccccaacaaccugguggagaccggcacccugcccauccugagacuggcccacuucuuccugcugaacgagagcgacgacgacgacagaaucagaggccugaccaaggagcagaucgacaaccugagcaccagacacuacgagcacaacagcaucgacagcgagcugggcaagaucugcagcgugugcaucagcgacuacgugaccggcaacaagcugagacagcugcccugcaugcacgaguuccacauccacugcaucgacagauggcugagcgagaacugcaccugccccaucugcagacagcccgugcugggcagcaacaucgccaacaacggcuaa

SEQ ID NO: 22756 - RNA, 294 nt, Artificial Sequence
  RNF7__Homo_sapiens__NP_001188299
auggccgacguggaggacggcgaggagaccugcgcccuggccagccacagcggcagcagcggcagcaagagcggcggcgacaagauguucagccugaagaaguggaacgccguggccauguggagcugggacguggagugcgacaccugcgccaucugcagagugcaggugauggugguguggggcgagugcaaccacagcuuccacaacugcugcaugagccugugggugaagcagaacaacagaugcccccugugccagcaggacuggguggugcagagaaucggcaaguaa

SEQ ID NO: 22757 - RNA, 1458 nt, Artificial Sequence
  RNF8__Homo_sapiens__NP_003949
augggcgagcccggcuucuucgugaccggcgacagagccggcggcagaagcuggugccugagaagagugggcaugagcgccggcuggcugcugcuggaggacggcugcgaggugaccgugggcagaggcuucggcgugaccuaccagcuggugagcaagaucugcccccugaugaucagcagaaaccacugcgugcugaagcagaaccccgagggccaguggaccaucauggacaacaagagccugaacggcguguggcugaacagagccagacuggagccccugagaguguacagcauccaccagggcgacuacauccagcugggcgugccccuggagaacaaggagaacgccgaguacgaguacgaggugaccgaggaggacugggagaccaucuaccccugccugagccccaagaacgaccagaugaucgagaagaacaaggagcugagaaccaagagaaaguucagccuggacgagcuggccggccccggcgccgagggccccagcaaccugaagagcaagaucaacaaggugagcugcgagagcggccagcccgugaagagccagggcaagggcgagguggccagcacccccagcgacaaccuggaccccaagcugaccgcccuggagcccagcaagaccaccggcgcccccaucuaccccggcuuccccaaggugaccgaggugcaccacgagcagaaggccagcaacagcagcgccagccagagaagccugcagauguucaaggugaccaugagcagaauccugagacugaagauccagaugcaggagaagcacgaggccgugaugaacgugaagaagcagacccagaagggcaacagcaagaagguggugcagauggagcaggagcugcaggaccugcagagccagcugugcgccgagcaggcccagcagcaggccagaguggagcagcuggagaagaccuuccaggaggaggagcagcaccugcagggccuggagaucgcccagggcgagaaggaccugaagcagcagcuggcccaggcccugcaggagcacugggcccugauggaggagcugaacagaagcaagaaggacuucgaggccaucauccaggccaagaacaaggagcuggagcagaccaaggaggagaaggagaagaugcaggcccagaaggaggaggugcugagccacaugaacgacgugcuggagaacgagcugcagugcaucaucugcagcgaguacuucaucgaggccgugacccugaacugcgcccacagcuucugcagcuacugcaucaacgaguggaugaagagaaagaucgagugccccaucugcagaaaggacaucaagagcaagaccuacagccuggugcuggacaacugcaucaacaagauggugaacaaccugagcagcgaggugaaggagagaagaaucgugcugaucagagagagaaaggccaagagacuguucuaa

SEQ ID NO: 22758 - RNA, 1725 nt, Artificial Sequence
  RNGTT__Homo_sapiens__NP_001273355
auggcccacaacaagaucccccccagauggcugaacugccccagaagaggccagcccguggccggcagauuccugccccugaagaccaugcugggccccagauacgacagccagguggccgaggagaacagauuccaccccagcaugcugagcaacuaccugaagagccugaaggugaagaugggccugcugguggaccugaccaacaccagcagauucuacgacagaaacgacaucgagaaggagggcaucaaguacaucaagcugcagugcaagggccacggcgagugccccaccaccgagaacaccgagaccuucaucagacugugcgagagauucaacgagagaaacccccccgagcugaucggcgugcacugcacccacggcuucaacagaaccggcuuccugaucugcgccuuccugguggagaagauggacuggagcaucgaggccgccguggccaccuucgcccaggccagaccccccggcaucuacaagggcgacuaccugaaggagcuguucagaagauacggcgacaucgaggaggcccccccccccccccugcugcccgacuggugcuucgaggacgacgaggacgaggacgaggacgaggacggcaagaaggagagcgagcccggcagcagcgccagcuucggcaagagaagaaaggagagacugaagcugggcgccaucuuccuggagggcgugaccgugaagggcgugacccaggugaccacccagcccaagcugggcgaggugcagcagaagugccaccaguucugcggcugggagggcagcggcuuccccggcgcccagcccgugagcauggacaagcagaacaucaagcugcuggaccugaagcccuacaaggugagcuggaaggccgacggcaccagauacaugaugcugaucgacggcaccaacgagguguucaugaucgacagagacaacagcguguuccacgugagcaaccuggaguuccccuucagaaaggaccugagaaugcaccugagcaacacccugcuggacggcgagaugaucaucgacagagugaacggccaggccgugcccagauaccugaucuacgacaucaucaaguucaacagccagcccgugggcgacugcgacuucaacgugagacugcagugcaucgagagagagaucaucagccccagacacgagaagaugaagaccggccugaucgacaagacccaggagcccuucagcgugagaaacaagcccuucuucgacaucugcaccagcagaaagaaguacaagcccggcagaugcgacgacauccugaaguggaagccccccagccugaacagcguggacuucagacugaagaucaccagaaugggcggcgagggccugcugccccagaacgugggccugcuguacgugggcggcuacgagagacccuucgcccagaucaaggugaccaaggagcugaagcaguacgacaacaagaucaucgagugcaaguucgagaacaacagcuggguguucaugagacagagaaccgacaagagcuuccccaacgccuacaacaccgccauggccgugugcaacagcaucagcaaccccgugaccaaggagaugcuguucgaguucaucgacagaugcaccgccgccagccagggccagaagagaaagcaccaccuggaccccgacaccgagcugaugcccccccccccccccaagagacccagaccccugaccuaa

SEQ ID NO: 22759 - RNA, 1386 nt, Artificial Sequence
  RNH1__Homo_sapiens__XP_011518565
augagccuggacauccagagccuggacauccagugcgaggagcugagcgacgccagaugggccgagcugcugccccugcugcagcagugccagguggugagacuggacgacugcggccugaccgaggccagaugcaaggacaucagcagcgcccugagagugaaccccgcccuggccgagcugaaccugagaagcaacgagcugggcgacgugggcgugcacugcgugcugcagggccugcagacccccagcugcaagauccagaagcugagccugcagaacugcugccugaccggcgccggcugcggcgugcugagcagcacccugagaacccugcccacccugcaggagcugcaccugagcgacaaccugcugggcgacgccggccugcagcugcugugcgagggccugcuggacccccagugcagacuggagaagcugcagcuggaguacugcagccugagcgccgccagcugcgagccccuggccagcgugcugagagccaagcccgacuucaaggagcugaccgugagcaacaacgacaucaacgaggccggcgugagagugcugugccagggccugaaggacagccccugccagcuggaggcccugaagcuggagagcugcggcgugaccagcgacaacugcagagaccugugcggcaucguggccagcaaggccagccugagagagcuggcccugggcagcaacaagcugggcgacgugggcauggccgagcugugccccggccugcugcaccccagcagcagacugagaacccuguggaucugggagugcggcaucaccgccaagggcugcggcgaccugugcagagugcugagagccaaggagagccugaaggagcugagccuggccggcaacgagcugggcgacgagggcgccagacugcugugcgagacccugcuggagcccggcugccagcuggagagccugugggugaagagcugcagcuucaccgccgccugcugcagccacuucagcagcgugcuggcccagaacagauuccugcuggagcugcagaucagcaacaacagacuggaggacgccggcgugagagagcugugccagggccugggccagcccggcagcgugcugagagugcuguggcuggccgacugcgacgugagcgacagcagcugcagcagccuggccgccacccugcuggccaaccacagccugagagagcuggaccugagcaacaacugccugggcgacgccggcauccugcagcugguggagagcgugagacagcccggcugccugcuggagcagcuggugcuguacgacaucuacuggagcgaggagauggaggacagacugcaggcccuggagaaggacaagcccagccugagagugaucagcuaa

SEQ ID NO: 22760 - RNA, 1029 nt, Artificial Sequence
  RNLS__Homo_sapiens__NP_001026879
auggcccaggugcugaucgugggcgccggcaugaccggcagccugugcgccgcccugcugagaagacagaccagcggcccccuguaccuggccgugugggacaaggccgaggacagcggcggcagaaugaccaccgccugcagcccccacaacccccagugcaccgccgaccugggcgcccaguacaucaccugcaccccccacuacgccaagaagcaccagagauucuacgacgagcugcuggccuacggcgugcugagaccccugagcagccccaucgagggcauggugaugaaggagggcgacugcaacuucguggccccccagggcaucagcagcaucaucaagcacuaccugaaggagagcggcgccgagguguacuucagacacagagugacccagaucaaccugagagacgacaagugggaggugagcaagcagaccggcagccccgagcaguucgaccugaucgugcugaccaugcccgugcccgagauccugcagcugcagggcgacaucaccacccugaucagcgagugccagagacagcagcuggaggccgugagcuacagcagcagauacgcccugggccuguucuacgaggccggcaccaagaucgacgugcccugggccggccaguacaucaccagcaaccccugcaucagauucgugagcaucgacaacaagaagagaaacaucgagagcagcgagaucggccccagccuggugauccacaccaccgugcccuucggcgugaccuaccuggagcacagcaucgaggacgugcaggagcugguguuccagcagcuggagaacauccugcccggccugccccagcccaucgccaccaagugccagaaguggagacacagccaggugaccaacgccgccgccaacugccccggccagaugacccugcaccacaagcccuuccuggccugcggcggcgacggcuucacccagagcaacuucgacggcugcaucaccagcgcccugugcgugcuggaggcccugaagaacuacaucuaa

SEQ ID NO: 22761 - RNA, 1431 nt, Artificial Sequence
  RNMT__Homo_sapiens__NP_003790
auggccaacagcgccaaggccgaggaguacgagaagaugagccuggagcaggccaaggccagcgugaacagcgagaccgagagcagcuucaacaucaacgagaacaccaccgccagcggcaccggccugagcgagaagaccagcgugugcagacagguggacaucgccagaaagagaaaggaguucgaggacgaccuggugaaggagagcagcagcugcggcaaggacacccccagcaagaagagaaagcuggaccccgagaucgugcccgaggagaaggacugcggcgacgccgagggcaacagcaagaagagaaagagagagaccgaggacgugcccaaggacaagagcagcaccggcgacggcacccagaacaagagaaagaucgcccuggaggacgugcccgagaagcagaagaaccuggaggagggccacagcagcaccguggccgcccacuacaacgagcugcaggaggugggccuggagaagagaagccagagcagaaucuucuaccugagaaacuucaacaacuggaugaagagcgugcugaucggcgaguuccuggagaaggugagacagaagaagaagagagacaucaccgugcuggaccugggcugcggcaagggcggcgaccugcugaaguggaagaagggcagaaucaacaagcuggugugcaccgacaucgccgacgugagcgugaagcagugccagcagagauacgaggacaugaagaacagaagagacagcgaguacaucuucagcgccgaguucaucaccgccgacagcagcaaggagcugcugaucgacaaguucagagacccccagaugugcuucgacaucugcagcugccaguucgugugccacuacagcuucgagagcuacgagcaggccgacaugaugcugagaaacgccugcgagagacugagccccggcggcuacuucaucggcaccacccccaacagcuucgagcugaucagaagacuggaggccagcgagaccgagagcuucggcaacgagaucuacaccgugaaguuccagaagaagggcgacuacccccuguucggcugcaaguacgacuucaaccuggagggcgugguggacgugcccgaguuccugguguacuucccccugcugaacgagauggccaagaaguacaacaugaagcugguguacaagaagaccuuccuggaguucuacgaggagaagaucaagaacaacgagaacaagaugcugcugaagagaaugcaggcccuggagcccuaccccgccaacgagagcagcaagcuggugagcgagaagguggacgacuacgagcacgccgccaaguacaugaagaacagccaggugagacugccccugggcacccugagcaagagcgagugggaggccaccagcaucuaccugguguucgccuucgagaagcagcaguaa

SEQ ID NO: 22762 - RNA, 1953 nt, Artificial Sequence
  RNPEP__Homo_sapiens__NP_064601
auggccagcggcgagcacagccccggcagcggcgccgccagaagaccccugcacagcgcccaggccguggacguggccagcgccagcaacuucagagccuucgagcugcugcaccugcaccuggaccugagagccgaguucggcccccccggccccggcgccggcagcagaggccugagcggcaccgccgugcuggaccugagaugccuggagcccgagggcgccgccgagcugagacuggacagccaccccugccuggaggugaccgccgccgcccugagaagagagagacccggcagcgaggagccccccgccgagcccgugagcuucuacacccagcccuucagccacuacggccaggcccugugcgugagcuucccccagcccugcagagccgccgagagacugcaggugcugcugaccuacagagugggcgagggccccggcgugugcuggcuggcccccgagcagaccgccggcaagaagaagcccuucguguacacccagggccaggccgugcugaacagagccuucuuccccugcuucgacacccccgccgugaaguacaaguacagcgcccugaucgaggugcccgacggcuucaccgccgugaugagcgccagcaccugggagaagagaggccccaacaaguucuucuuccagaugugccagcccauccccagcuaccugaucgcccuggccaucggcgaccuggugagcgccgaggugggccccagaagcagagugugggccgagcccugccugaucgacgccgccaaggaggaguacaacggcgugaucgaggaguuccuggccaccggcgagaagcuguucggccccuacguguggggcagauacgaccugcuguucaugccccccagcuuccccuucggcggcauggagaaccccugccugaccuucgugacccccugccugcuggccggcgacagaagccuggccgacgugaucauccacgagaucagccacagcugguucggcaaccuggugaccaacgccaacuggggcgaguucuggcugaacgagggcuucaccauguacgcccagagaagaaucagcaccauccuguucggcgccgccuacaccugccuggaggccgccaccggcagagcccugcugagacagcacauggacaucaccggcgaggagaacccccugaacaagcugagagugaagaucgagcccggcguggaccccgacgacaccuacaacgagacccccuacgagaagggcuucugcuucgugagcuaccuggcccaccuggugggcgaccaggaccaguucgacagcuuccugaaggccuacgugcacgaguucaaguucagaagcauccuggccgacgacuuccuggacuucuaccuggaguacuuccccgagcugaagaagaagagaguggacaucauccccggcuucgaguucgacagauggcugaacacccccggcuggccccccuaccugcccgaccugagccccggcgacagccugaugaagcccgccgaggagcuggcccagcugugggccgccgaggagcuggacaugaaggccaucgaggccguggccaucagccccuggaagaccuaccagcugguguacuuccuggacaagauccugcagaagagcccccugccccccggcaacgugaagaagcugggcgacaccuaccccagcaucagcaacgccagaaacgccgagcugagacugagauggggccagaucgugcugaagaacgaccaccaggaggacuucuggaaggugaaggaguuccugcacaaccagggcaagcagaaguacacccugccccuguaccacgccaugaugggcggcagcgagguggcccagacccuggccaaggagaccuucgccagcaccgccagccagcugcacagcaacguggugaacuacgugcagcagaucguggcccccaagggcagcuaa

SEQ ID NO: 22763 - RNA, 2178 nt, Artificial Sequence
  RNPEPL1__Homo_sapiens__NP_060696
auggccgcccagugcugcugcagacaggcccccggcgccgaggccgcccccgugagacccccccccgagcccccccccgcccuggacguggccagcgccagcagcgcccagcuguucagacugagacaccugcagcugggccuggagcugagacccgaggccagagagcuggccggcugccuggugcuggagcugugcgcccugagacccgcccccagagcccuggugcuggacgcccaccccgcccugagacugcacagcgccgccuucagaagagcccccgccgccgccgccgagacccccugcgccuucgccuucagcgcccccggccccggccccgcccccccccccccccugcccgccuuccccgaggcccccggcagcgagcccgccugcugcccccuggccuucagaguggaccccuucaccgacuacggcagcagccugaccgugacccugccccccgagcugcaggcccaccagcccuuccaggugauccugagauacaccagcaccgacgcccccgccaucugguggcuggaccccgagcugaccuacggcugcgccaagcccuucguguucacccagggccacagcgugugcaacagaagcuucuuccccugcuucgacacccccgccgugaagugcaccuacagcgccguggugaaggcccccagcggcgugcaggugcugaugagcgccaccagaagcgccuacauggaggaggagggcguguuccacuuccacauggagcaccccgugcccgccuaccugguggcccugguggccggcgaccugaagcccgccgacaucggccccagaagcagagugugggccgagcccugccugcugcccaccgccaccagcaagcugagcggcgccguggagcaguggcugagcgccgccgagagacuguacggccccuacauguggggcagauacgacaucguguuccugccccccagcuuccccaucguggccauggagaaccccugccugaccuucaucaucagcagcauccuggagagcgacgaguuccuggugaucgacgugauccacgagguggcccacagcugguucggcaacgccgugaccaacgccaccugggaggagauguggcugagcgagggccuggccaccuacgcccagagaagaaucaccaccgagaccuacggcgccgccuucaccugccuggagaccgccuucagacuggacgcccugcacagacagaugaagcugcugggcgaggacagccccgugagcaagcugcaggugaagcuggagcccggcgugaaccccagccaccugaugaaccuguucaccuacgagaagggcuacugcuucguguacuaccugagccagcugugcggcgacccccagagauucgacgacuuccugagagccuacguggagaaguacaaguucaccagcgugguggcccaggaccugcuggacagcuuccugagcuucuuccccgagcugaaggagcagagcguggacugcagagccggccuggaguucgagagauggcugaacgccaccggccccccccuggccgagcccgaccugagccagggcagcagccugaccagacccguggaggcccuguuccagcuguggaccgccgagccccuggaccaggccgccgccagcgccagcgccaucgacaucagcaaguggagaaccuuccagaccgcccuguuccuggacagacugcuggacggcagcccccugccccaggagguggugaugagccugagcaagugcuacagcagccugcuggacagcaugaacgccgagaucagaaucagauggcugcagaucguggugagaaacgacuacuaccccgaccugcacagagugagaagauuccuggagagccagaugagcagaauguacaccaucccccuguacgaggaccugugcaccggcgcccugaagagcuucgcccuggagguguucuaccagacccagggcagacugcaccccaaccugagaagagccauccagcagauccugagccagggccugggcagcagcaccgagcccgccagcgagcccagcaccgagcugggcaaggccgaggccgacaccgacagcgacgcccaggcccugcugcugggcgacgaggcccccagcagcgccaucagccugagagacgugaacgugagcgccuaa

SEQ ID NO: 22764 - RNA, 849 nt, Artificial Sequence
  RNPS1__Homo_sapiens__NP_001273555
auggcccccagccccaccaagagaaaggacagaagcgacgagaagagcaaggacagaagcaaggacaagggcgccaccaaggagagcagcgagaaggacagaggcagagacaagaccagaaagagaagaagcgccagcagcggcagcagcagcaccagaagcagaagcagcagcaccagcagcagcggcagcagcaccagcaccggcagcagcagcggcagcagcagcagcagcgccagcagcagaagcggcagcagcagcaccagcagaagcagcagcagcagcagcagcagcggcagccccagccccagcagaagaagacacgacaacagaagaagaagcagaagcaagagcaagccccccaagagagacgagaaggagagaaagagaagaagccccagccccaagcccaccaaggugcacaucggcagacugaccagaaacgugaccaaggaccacaucauggagaucuucagcaccuacggcaagaucaagaugaucgacaugcccguggagagaaugcacccccaccugagcaagggcuacgccuacguggaguucgagaaccccgacgaggccgagaaggcccugaagcacauggacggcggccagaucgacggccaggagaucaccgccaccgccgugcuggcccccuggcccagacccccccccagaagauucagcccccccagaagaaugcugccccccccccccauguggagaagaagcccccccagaaugagaagaagaagcagaagccccagaagaagaagccccgugagaagaagaagcagaagccccggcagaagaagacacagaagcagaagcagcagcaacagcagcagauaa

SEQ ID NO: 22765 - RNA, 4656 nt, Artificial Sequence
  ROBO1__Homo_sapiens__NP_001139317
augaucgccgagcccgcccacuucuaccuguucggccugaucugccugugcagcggcagcagacugagacaggaggacuucccccccagaaucguggagcaccccagcgaccugaucgugagcaagggcgagcccgccacccugaacugcaaggccgagggcagacccacccccaccaucgagugguacaagggcggcgagagaguggagaccgacaaggacgaccccagaagccacagaaugcugcugcccagcggcagccuguucuuccugagaaucgugcacggcagaaagagcagacccgacgagggcguguacgugugcguggccagaaacuaccugggcgaggccgugagccacaacgccagccuggagguggccauccugagagacgacuucagacagaaccccagcgacgugaugguggccgugggcgagcccgccgugauggagugccagccccccagaggccaccccgagcccaccaucagcuggaagaaggacggcagcccccuggacgacaaggacgagagaaucaccaucagaggcggcaagcugaugaucaccuacaccagaaagagcgacgccggcaaguacgugugcgugggcaccaacauggugggcgagagagagagcgagguggccgagcugaccgugcuggagagacccagcuucgugaagagacccagcaaccuggccgugaccguggacgacagcgccgaguucaagugcgaggccagaggcgaccccgugcccaccgugagauggagaaaggacgacggcgagcugcccaagagcagauacgagaucagagacgaccacacccugaagaucagaaaggugaccgccggcgacaugggcagcuacaccugcguggccgagaacauggugggcaaggccgaggccagcgccacccugaccgugcaggugggcagcgagcccccccacuucguggugaagcccagagaccaggugguggcccugggcagaaccgugaccuuccagugcgaggccaccggcaacccccagcccgccaucuucuggagaagagagggcagccagaaccugcuguucagcuaccagcccccccagagcagcagcagauucagcgugagccagaccggcgaccugaccaucaccaacgugcagagaagcgacgugggcuacuacaucugccagacccugaacguggccggcagcaucaucaccaaggccuaccuggaggugaccgacgugaucgccgacagacccccccccgugaucagacagggccccgugaaccagaccguggccguggacggcaccuucgugcugagcugcguggccaccggcagccccgugcccaccauccuguggagaaaggacggcgugcuggugagcacccaggacagcagaaucaagcagcuggagaacggcgugcugcagaucagauacgccaagcugggcgacaccggcagauacaccugcaucgccagcacccccagcggcgaggccaccuggagcgccuacaucgaggugcaggaguucggcgugcccgugcagccccccagacccaccgaccccaaccugauccccagcgcccccagcaagcccgaggugaccgacgugagcagaaacaccgugacccugagcuggcagcccaaccugaacagcggcgccacccccaccagcuacaucaucgaggccuucagccacgccagcggcagcagcuggcagaccguggccgagaacgugaagaccgagaccagcgccaucaagggccugaagcccaacgccaucuaccuguuccuggugagagccgccaacgccuacggcaucagcgaccccagccagaucagcgaccccgugaagacccaggacgugcugcccaccagccagggcguggaccacaagcaggugcagagagagcugggcaacgccgugcugcaccugcacaaccccaccgugcugagcagcagcagcaucgaggugcacuggaccguggaccagcagagccaguacauccagggcuacaagauccuguacagacccagcggcgccaaccacggcgagagcgacuggcugguguucgaggugagaacccccgccaagaacagcguggugauccccgaccugagaaagggcgugaacuacgagaucaaggccagacccuucuucaacgaguuccagggcgccgacagcgagaucaaguucgccaagacccuggaggaggcccccagcgcccccccccagggcgugaccgugagcaagaacgacggcaacggcaccgccauccuggugagcuggcagcccccccccgaggacacccagaacggcauggugcaggaguacaagguguggugccugggcaacgagaccagauaccacaucaacaagaccguggacggcagcaccuucagcguggugauccccuuccuggugcccggcaucagauacagcguggagguggccgccagcaccggcgccggcagcggcgugaagagcgagccccaguucauccagcuggacgcccacggcaaccccgugagccccgaggaccaggugagccuggcccagcagaucagcgacguggugaagcagcccgccuucaucgccggcaucggcgccgccugcuggaucauccugaugguguucagcaucuggcuguacagacacagaaagaagagaaacggccugaccagcaccuacgccggcaucagaaaggugaccuaccagagaggcggcgaggccgugagcagcggcggcagacccggccugcugaacaucagcgagcccgccgcccagcccuggcuggccgacaccuggcccaacaccggcaacaaccacaacgacugcagcaucagcugcugcaccgccggcaacggcaacagcgacagcaaccugaccaccuacagcagacccggccagcccacccccuacgccaccacccagcugauccagagcaaccugagcaacaacaugaacaacggcagcggcgacagcggcgagaagcacuggaagccccugggccagcagaagcaggagguggcccccgugcaguacaacaucguggagcagaacaagcugaacaaggacuacagagccaacgacaccgugccccccaccauccccuacaaccagagcuacgaccagaacaccggcggcagcuacaacagcagcgacagaggcagcagcaccagcggcagccagggccacaagaagggcgccagaacccccaaggugcccaagcagggcggcaugaacugggccgaccugcugccccccccccccgcccacccccccccccacagcaacagcgaggaguacaacaucagcguggacgagagcuacgaccaggagaugcccugccccgugccccccgccagaauguaccugcagcaggacgagcuggaggaggaggaggacgagagaggccccaccccccccgugagaggcgccgccagcagccccgccgccgugagcuacagccaccagagcaccgccacccugacccccagcccccaggaggagcugcagcccaugcugcaggacugccccgaggagaccggccacaugcagcaccagcccgacagaagaagacagcccgugagccccccccccccccccagacccaucagccccccccacaccuacggcuacaucagcggcccccuggugagcgacauggacaccgacgcccccgaggaggaggaggacgaggccgacauggagguggccaagaugcagaccagaagacugcugcugagaggccuggagcagacccccgccagcagcgugggcgaccuggagagcagcgugaccggcagcaugaucaacggcuggggcagcgccagcgaggaggacaacaucagcagcggcagaagcagcgugagcagcagcgacggcagcuucuucaccgacgccgacuucgcccaggccguggccgccgccgccgaguacgccggccugaagguggccagaagacagaugcaggacgccgccggcagaagacacuuccacgccagccagugccccagacccaccagccccgugagcaccgacagcaacaugagcgccgccgugaugcagaagaccagacccgccaagaagcugaagcaccagcccggccaccugagaagagagaccuacaccgacgaccugccccccccccccgugcccccccccgccaucaagagccccaccgcccagagcaagacccagcuggaggugagacccgugguggugcccaagcugcccagcauggacgccagaaccgacagaagcagcgacagaaagggcagcagcuacaagggcagagaggugcuggacggcagacaggugguggacaugagaaccaaccccggcgaccccagagaggcccaggagcagcagaacgacggcaagggcagaggcaacaaggccgccaagagagaccugccccccgccaagacccaccugauccaggaggacauccugcccuacugcagacccaccuuccccaccagcaacaaccccagagaccccagcagcagcagcagcaugagcagcagaggcagcggcagcagacagagagagcaggccaacgugggcagaagaaacaucgccgagaugcaggugcugggcggcuacgagagaggcgaggacaacaacgaggagcuggaggagaccgagagcuaa

SEQ ID NO: 22766 - RNA, 4185 nt, Artificial Sequence
  ROBO2__Homo_sapiens__NP_001122401
auggccagaagacacgagagagugaccagaagaauguggaccugggcccccggccugcugaugaugaccgugguguucuggggccaccagggcaacggccagggccagggcagcagacugagacaggaggacuucccccccagaaucguggagcaccccagcgacgugaucgugagcaagggcgagcccaccacccugaacugcaaggccgagggcagacccacccccaccaucgagugguacaaggacggcgagagaguggagaccgacaaggacgaccccagaagccacagaaugcugcugcccagcggcagccuguucuuccugagaaucgugcacggcagaagaagcaagcccgacgagggcagcuacgugugcguggccagaaacuaccugggcgaggccgugagcagaaacgccagccuggagguggcccugcugagagacgacuucagacagaaccccaccgacguggugguggccgccggcgagcccgccauccuggagugccagccccccagaggccaccccgagcccaccaucuacuggaagaaggacaaggugagaaucgacgacaaggaggagagaaucagcaucagaggcggcaagcugaugaucagcaacaccagaaagagcgacgccggcauguacaccugcgugggcaccaacauggugggcgagagagacagcgaccccgccgagcugaccguguucgagagacccaccuuccugagaagacccaucaaccagguggugcuggaggaggaggccguggaguucagaugccaggugcagggcgacccccagcccaccgugagauggaagaaggacgacgccgaccugcccagaggcagauacgacaucaaggacgacuacacccugagaaucaagaagaccaugagcaccgacgagggcaccuacaugugcaucgccgagaacagagugggcaagauggaggccagcgccacccugaccgugagagcccccccccaguucguggugagacccagagaccagaucguggcccagggcagaaccgugaccuuccccugcgagaccaagggcaacccccagcccgccguguucuggcagaaggagggcagccagaaccugcuguuccccaaccagccccagcagcccaacagcagaugcagcgugagccccaccggcgaccugaccaucaccaacauccagagaagcgacgccggcuacuacaucugccaggcccugaccguggccggcagcauccuggccaaggcccagcuggaggugaccgacgugcugaccgacagacccccccccaucauccugcagggccccgccaaccagacccuggccguggacggcaccgcccugcugaagugcaaggccaccggcgacccccugcccgugaucagcuggcugaaggagggcuucaccuuccccggcagagaccccagagccaccauccaggagcagggcacccugcagaucaagaaccugagaaucagcgacaccggcaccuacaccugcguggccaccagcagcagcggcgagaccagcuggagcgccgugcuggacgugaccgagagcggcgccaccaucagcaagaacuacgaccugagcgaccugcccggcccccccagcaagccccaggugaccgacgugaccaagaacagcgugacccugagcuggcagcccggcacccccggcacccugcccgccagcgccuacaucaucgaggccuucagccagagcgugagcaacagcuggcagaccguggccaaccacgugaagaccacccuguacaccgugagaggccugagacccaacaccaucuaccuguucauggugagagccaucaacccccagggccugagcgaccccagccccaugagcgaccccgugagaacccaggacaucagcccccccgcccagggcguggaccacagacaggugcagaaggagcugggcgacgugcuggugagacugcacaaccccguggugcugacccccaccaccgugcaggugaccuggaccguggacagacagccccaguucauccagggcuacagagugauguacagacagaccagcggccugcaggccaccagcagcuggcagaaccuggacgccaaggugcccaccgagagaagcgccgugcuggugaaccugaagaagggcgugaccuacgagaucaaggugagacccuacuucaacgaguuccagggcauggacagcgagagcaagaccgugagaaccaccgaggaggcccccagcgcccccccccagagcgugaccgugcugaccgugggcagcuacaacagcaccagcaucagcgugagcugggacccccccccccccgaccaccagaacggcaucauccaggaguacaagaucuggugccugggcaacgagaccagauuccacaucaacaagaccguggacgccgccaucagaagcgugaucaucggcggccuguuccccggcauccaguacagaguggagguggccgccagcaccagcgccggcgugggcgugaagagcgagccccagcccaucaucaucggcagaagaaacgagguggugaucaccgagaacaacaacagcaucaccgagcagaucaccgacguggugaagcagcccgccuucaucgccggcaucggcggcgccugcugggugauccugaugggcuucagcaucuggcuguacuggagaagaaagaagagaaagggccugagcaacuacgccgugaccuuccagagaggcgacggcggccugaugagcaacggcagcagacccggccugcugaacgccggcgaccccagcuaccccuggcuggccgacagcuggcccgccaccagccugcccgugaacaacagcaacagcggccccaacgagaucggcaacuucggcagaggcgacgugcugccccccgugcccggccagggcgacaagaccgccaccaugcugagcgacggcgccaucuacagcagcaucgacuucaccaccaagaccagcuacaacagcagcagccagaucacccaggccacccccuacgccaccacccagauccugcacagcaacagcauccacgagcuggccguggaccugcccgacccccaguggaagagcagcauccagcagaagaccgaccugaugggcuucggcuacagccugcccgaccagaacaagggcaacaacggcggcaagggcggcaagaagaagaagaacaagaacagcagcaagccccagaagaacaacggcagcaccugggccaacgugccccugccccccccccccgugcagccccugcccggcaccgagcuggagcacuacgccguggagcagcaggagaacggcuacgacagcgacagcuggugccccccccugcccgugcagaccuaccugcaccagggccuggaggacgagcuggaggaggacgacgacagagugcccaccccccccgugagaggcguggccagcagccccgccaucagcuucggccagcagagcaccgccacccugacccccagccccagagaggagaugcagcccaugcugcaggcccaccuggacgagcugaccagagccuaccaguucgacaucgccaagcagaccuggcacauccagagcaacaaccagcccccccagccccccgugcccccccugggcuacgugagcggcgcccugaucagcgaccuggagaccgacguggccgacgacgacgccgacgacgaggaggaggcccuggagauccccagaccccugagagcccuggaccagacccccggcagcagcauggacaaccuggacagcagcgugaccggcaaggccuucaccagcagccagagacccagacccaccagccccuucagcaccgacagcaacaccagcgccgcccugagccagagccagagacccagacccaccaagaagcacaagggcggcagaauggaccagcagcccgcccugccccacagaagagagggcaugaccgacgaggaggcccuggugcccuacagcaagcccagcuuccccagccccggcggccacagcagcagcggcaccgccagcagcaagggcagcaccggccccagaaagaccgaggugcugagagccggccaccagagaaacgccagcgaccugcuggacaucggcuacaugggcagcaacagccagggccaguucaccggcgagcuguaa

SEQ ID NO: 22767 - RNA, 4161 nt, Artificial Sequence
  ROBO3__Homo_sapiens__NP_071765
augcugagauaccugcugaagacccugcugcagaugaaccuguucgccgacagccuggccggcgacaucagcaacagcagcgagcugcugcugggcuucaacagcagccuggccgcccugaaccacacccugcugccccccggcgaccccagccugaacggcagcagagugggccccgaggacgccaugcccagaaucguggagcagccccccgaccugcuggugagcagaggcgagcccgccacccugcccugcagagccgagggcagacccagacccaacaucgagugguacaagaacggcgccagaguggccaccgugagagaggaccccagagcccacagacugcugcugcccagcggcgcccuguucuuccccagaaucgugcacggcagaagagccagacccgacgagggcguguacaccugcguggccagaaacuaccugggcgccgccgccagcagaaacgccagccuggagguggccgugcugagagacgacuucagacagagccccggcaacguggugguggccgugggcgagcccgccgugcuggagugcgugccccccagaggccaccccgagcccagcgugagcuggagaaaggacggcgccagacugaaggaggaggagggcagaaucaccaucagaggcggcaagcugaugaugagccacacccugaagagcgacgccggcauguacgugugcguggccagcaacauggccggcgagagagagagcgccgccgccgaggugauggugcuggagagacccagcuuccugagaagacccgugaaccagguggugcuggccgacgcccccgugaccuuccugugcgaggugaagggcgaccccccccccagacugagauggagaaaggaggacggcgagcugcccaccggcagauacgagaucagaagcgaccacagccuguggaucggccacgugagcgccgaggacgagggcaccuacaccugcguggccgagaacagcgugggcagagccgaggccagcggcagccugagcgugcacgugcccccccagcuggugacccagccccaggaccagauggccgcccccggcgagagcguggccuuccagugcgagaccaagggcaaccccccccccgccaucuucuggcagaaggagggcagccaggugcugcuguuccccagccagagccugcagcccaccggcagauucagcgugagccccagaggccagcugaacaucaccgccgugcagagaggcgacgccggcuacuacgugugccaggccgugagcguggccggcagcauccuggccaaggcccugcuggagaucaagggcgccagccuggacggccugccccccgugauccugcagggccccgccaaccagacccuggugcugggcagcagcguguggcugcccugcagagugaccggcaacccccagcccagcgugagauggaagaaggacggccaguggcugcagggcgacgaccugcaguucaagaccauggccaacggcacccuguacaucgccaacgugcaggagauggacaugggcuucuacagcugcguggccaagagcagcaccggcgaggccaccuggagcggcuggcugaagaugagagaggacuggggcgugagccccgacccccccaccgagcccagcagcccccccggcgcccccagccagcccguggugaccgagaucaccaagaacagcaucacccugaccuggaagcccaacccccagaccggcgccgccgugaccagcuacgugaucgaggccuucagccccgccgccggcaacaccuggagaaccguggccgacggcgugcagcuggagacccacaccgugagcggccugcagcccaacaccaucuaccuguuccuggugagagccgugggcgccuggggccugagcgagcccagccccgugagcgagcccgugagaacccaggacagcagccccagcagacccguggaggaccccuggagaggccagcagggccuggccgagguggccgugagacugcaggagcccaucgugcugggccccagaacccugcaggugagcuggaccguggacggccccgugcagcuggugcagggcuucagagugagcuggagaguggccggccccgagggcggcagcuggaccaugcuggaccugcagagccccagccagcagagcaccgugcugagaggccugccccccggcacccagauccagaucaaggugcaggcccagggccaggagggccugggcgccgagagccugagcgugaccagaagcauccccgaggaggcccccagcggccccccccagggcguggccguggcccugggcggcgacggcaacagcagcaucaccgugagcugggagcccccccugcccagccagcagaacggcgugaucaccgaguaccagaucuggugccugggcaacgagagcagauuccaccugaacagaagcgccgccggcugggccagaagcgccaugcugagaggccuggugcccggccugcuguacagaacccugguggccgccgccaccagcgccggcgugggcgugcccagcgcccccgugcuggugcagcugcccagcccccccgaccuggagcccggccuggaggugggcgccggccuggccgugagacuggccagagugcugagagagcccgccuuccuggccggcagcggcgccgccugcggcgcccugcugcugggccugugcgccgcccuguacuggagaagaaagcagagaaaggagcugagccacuacaccgccagcuucgccuacacccccgccgugagcuucccccacagcgagggccugagcggcgccagcagcagaccccccaugggccugggccccgcccccuacagcuggcuggccgacagcuggccccaccccagcagaagccccagcgcccaggagcccagaggcagcugcugccccagcaaccccgaccccgacgacagauacuacaacgaggccggcaucagccuguaccuggcccagaccgccagaggcaccgccgcccccggcgagggccccguguacagcaccaucgaccccgccggcgaggagcugcagaccuuccacggcggcuucccccagcaccccagcggcgaccugggccccuggagccaguacgccccccccgaguggagccagggcgacagcggcgccaagggcggcaaggugaagcugcugggcaagcccgugcagaugcccagccugaacuggcccgaggcccugcccccccccccccccagcugcgagcugagcugccuggagggccccgaggaggagcuggagggcagcagcgagcccgaggaguggugcccccccaugcccgagagaagccaccugaccgagcccagcagcagcggcggcugccuggugacccccagcagaagagagacccccagccccacccccagcuacggccagcagagcaccgccacccugacccccagcccccccgaccccccccagccccccaccgacaugccccaccugcaccagaugcccagaagagugccccugggccccagcagcccccugagcgugagccagcccaugcugggcaucagagaggccagacccgccggccugggcgccggccccgccgccagcccccaccugagccccagccccgcccccagcaccgccagcagcgcccccggcagaaccuggcagggcaacggcgagaugacccccccccugcagggccccagagccagauucagaaagaagcccaaggcccugcccuacagaagagagaacagccccggcgaccugcccccccccccccugcccccccccgaggaggaggccagcugggcccuggagcugagagccgccggcagcaugagcagccuggagagagagagaagcggcgagagaaaggccgugcaggccgugccccuggccgcccagagagugcugcaccccgacgaggaggccuggcugcccuacagcagacccagcuuccugagcagaggccagggcaccagcaccugcagcaccgccggcagcaacagcagcagaggcagcagcagcagcagaggcagcagaggccccggcagaagcagaagcagaagccagagcagaagccagagccagagacccggccagaagagaagagaggagcccagauaa

SEQ ID NO: 22768 - RNA, 2589 nt, Artificial Sequence
  ROBO4__Homo_sapiens__NP_001288017
augguggccguggugggcgagcaguucacccuggagugcggcccccccuggggccaccccgagcccaccgugagcugguggaaggacggcaagccccuggcccugcagcccggcagacacaccgugagcggcggcagccugcugauggccagagccgagaagagcgacgagggcaccuacaugugcguggccaccaacagcgccggccacagagagagcagagccgccagagugagcauccaggagccccaggacuacaccgagcccguggagcugcuggccgugagaauccagcuggagaacgugacccugcugaaccccgaccccgccgagggccccaagcccagacccgccguguggcugagcuggaaggugagcggccccgccgcccccgcccagagcuacaccgcccuguucagaacccagaccgcccccggcggccagggcgcccccugggccgaggagcugcuggccggcuggcagagcgccgagcugggcggccugcacuggggccaggacuacgaguucaaggugagacccagcagcggcagagccagaggccccgacagcaacgugcugcugcugagacugcccgagaaggugcccagcgcccccccccaggaggugacccugaagcccggcaacggcaccguguucgugagcugggugcccccccccgccgagaaccacaacggcaucaucagaggcuaccagguguggagccugggcaacaccagccugccccccgccaacuggaccguggugggcgagcagacccagcuggagaucgccacccacaugcccggcagcuacugcgugcagguggccgccgugaccggcgccggcgccggcgagcccagcagacccgugugccugcugcuggagcaggccauggagagagccacccaggagcccagcgagcacggccccuggacccuggagcagcugagagccacccugaagagacccgaggugaucgccaccugcggcguggcccuguggcugcugcugcugggcaccgccgugugcauccacagaagaagaagagccagagugcaccugggccccggccuguacagauacaccagcgaggacgccauccugaagcacagaauggaccacagcgacagccaguggcuggccgacaccuggagaagcaccagcggcagcagagaccugagcagcagcagcagccugagcagcagacugggcgccgacgccagagacccccuggacugcagaagaagccugcugagcugggacagcagaagccccggcgugccccugcugcccgacaccagcaccuucuacggcagccugaucgccgagcugcccagcagcacccccgccagacccagcccccaggugcccgccgugagaagacugcccccccagcuggcccagcugagcagccccugcagcagcagcgacagccugugcagcagaagaggccugagcagccccagacugagccuggcccccgccgaggccuggaaggccaagaagaagcaggagcugcagcacgccaacagcagcccccugcugagaggcagccacagccuggagcugagagccugcgagcugggcaacagaggcagcaagaaccugagccagagccccggcgccgugccccaggcccugguggccuggagagcccugggccccaagcugcugagcagcagcaacgagcuggugaccagacaccugccccccgccccccuguucccccacgagaccccccccacccagagccagcagacccagccccccguggccccccaggcccccagcagcauccugcugcccgccgcccccauccccauccugagccccugcagcccccccagcccccaggccagcagccugagcggccccagccccgccagcagcagacugagcagcagcagccugagcagccugggcgaggaccaggacagcgugcugacccccgaggagguggcccugugccuggagcugagcgagggcgaggagacccccagaaacagcgugagccccaugcccagagcccccagcccccccaccaccuacggcuacaucagcgugcccaccgccagcgaguucaccgacaugggcagaaccggcggcggcgugggccccaagggcggcgugcugcugugcccccccagacccugccugacccccacccccagcgagggcagccuggccaacggcuggggcagcgccagcgaggacaacgccgccagcgccagagccagccuggugagcagcagcgacggcagcuuccuggccgacgcccacuucgccagagcccuggccguggccguggacagcuucggcuucggccuggagcccagagaggccgacugcguguucaucgacgccagcagcccccccagccccagagacgagaucuuccugacccccaaccugagccugccccugugggaguggagacccgacuggcuggaggacauggaggugagccacacccagagacugggcagaggcaugccccccuggccccccgacagccagaucagcagccagagaagccagcugcacugcagaaugcccaaggccggcgccagccccguggacuacagcuaa

SEQ ID NO: 22769 - RNA, 4065 nt, Artificial Sequence
  ROCK1__Homo_sapiens__NP_005397
augagcaccggcgacagcuucgagaccagauucgagaagauggacaaccugcugagagaccccaagagcgaggugaacagcgacugccugcuggacggccuggacgcccugguguacgaccuggacuuccccgcccugagaaagaacaagaacaucgacaacuuccugagcagauacaaggacaccaucaacaagaucagagaccugagaaugaaggccgaggacuacgagguggugaaggugaucggcagaggcgccuucggcgaggugcagcuggugagacacaagagcaccagaaagguguacgccaugaagcugcugagcaaguucgagaugaucaagagaagcgacagcgccuucuucugggaggagagagacaucauggccuucgccaacagccccuggguggugcagcuguucuacgccuuccaggacgacagauaccuguacauggugauggaguacaugcccggcggcgaccuggugaaccugaugagcaacuacgacgugcccgagaagugggccagauucuacaccgccgagguggugcuggcccuggacgccauccacagcaugggcuucauccacagagacgugaagcccgacaacaugcugcuggacaagagcggccaccugaagcuggccgacuucggcaccugcaugaagaugaacaaggagggcauggugagaugcgacaccgccgugggcacccccgacuacaucagccccgaggugcugaagagccagggcggcgacggcuacuacggcagagagugcgacugguggagcgugggcguguuccuguacgagaugcuggugggcgacacccccuucuacgccgacagccuggugggcaccuacagcaagaucaugaaccacaagaacagccugaccuuccccgacgacaacgacaucagcaaggaggccaagaaccugaucugcgccuuccugaccgacagagaggugagacugggcagaaacggcguggaggagaucaagagacaccuguucuucaagaacgaccagugggccugggagacccugagagacaccguggcccccguggugcccgaccugagcagcgacaucgacaccagcaacuucgacgaccuggaggaggacaagggcgaggaggagaccuuccccauccccaaggccuucgugggcaaccagcugcccuucgugggcuucaccuacuacagcaacagaagauaccugagcagcgccaaccccaacgacaacagaaccagcagcaacgccgacaagagccugcaggagagccugcagaagaccaucuacaagcuggaggagcagcugcacaacgagaugcagcugaaggacgagauggagcagaagugcagaaccagcaacaucaagcuggacaagaucaugaaggagcuggacgaggagggcaaccagagaagaaaccuggagagcaccgugagccagaucgagaaggagaagaugcugcugcagcacagaaucaacgaguaccagagaaaggccgagcaggagaacgagaagagaagaaacguggagaacgaggugagcacccugaaggaccagcuggaggaccugaagaaggugagccagaacagccagcuggccaacgagaagcugagccagcugcagaagcagcuggaggaggccaacgaccugcugagaaccgagagcgacaccgccgugagacugagaaagagccacaccgagaugagcaagagcaucagccagcuggagagccugaacagagagcugcaggagagaaacagaauccuggagaacagcaagagccagaccgacaaggacuacuaccagcugcaggccauccuggaggccgagagaagagacagaggccacgacagcgagaugaucggcgaccugcaggccagaaucaccagccugcaggaggaggugaagcaccugaagcacaaccuggagaagguggagggcgagagaaaggaggcccaggacaugcugaaccacagcgagaaggagaagaacaaccuggagaucgaccugaacuacaagcugaagagccugcagcagagacuggagcaggaggugaacgagcacaaggugaccaaggccagacugaccgacaagcaccagagcaucgaggaggccaagagcguggccaugugcgagauggagaagaagcugaaggaggagagagaggccagagagaaggccgagaacagaguggugcagaucgagaagcagugcagcaugcuggacguggaccugaagcagagccagcagaagcuggagcaccugaccggcaacaaggagagaauggaggacgaggugaagaaccugacccugcagcuggagcaggagagcaacaagagacugcugcugcagaacgagcugaagacccaggccuucgaggccgacaaccugaagggccuggagaagcagaugaagcaggagaucaacacccugcuggaggccaagagacugcuggaguucgagcuggcccagcugaccaagcaguacagaggcaacgagggccagaugagagagcugcaggaccagcuggaggccgagcaguacuucagcacccuguacaagacccaggugaaggagcugaaggaggagaucgaggagaagaacagagagaaccugaagaagauccaggagcugcagaacgagaaggagacccuggccacccagcuggaccuggccgagaccaaggccgagagcgagcagcuggccagaggccugcuggaggagcaguacuucgagcugacccaggagagcaagaaggccgccagcagaaacagacaggagaucaccgacaaggaccacaccgugagcagacuggaggaggccaacagcaugcugaccaaggacaucgagauccugagaagagagaacgaggagcugaccgagaagaugaagaaggccgaggaggaguacaagcuggagaaggaggaggagaucagcaaccugaaggccgccuucgagaagaacaucaacaccgagagaacccugaagacccaggccgugaacaagcuggccgagaucaugaacagaaaggacuucaagaucgacagaaagaaggccaacacccaggaccugagaaagaaggagaaggagaacagaaagcugcagcuggagcugaaccaggagagagagaaguucaaccagaugguggugaagcaccagaaggagcugaacgacaugcaggcccagcugguggaggagugcgcccacagaaacgagcugcagaugcagcuggccagcaaggagagcgacaucgagcagcugagagccaagcugcuggaccugagcgacagcaccagcguggccagcuuccccagcgccgacgagaccgacggcaaccugcccgagagcagaaucgagggcuggcugagcgugcccaacagaggcaacaucaagagauacggcuggaagaagcaguacgugguggugagcagcaagaagauccuguucuacaacgacgagcaggacaaggagcagagcaaccccagcauggugcuggacaucgacaagcuguuccacgugagacccgugacccagggcgacguguacagagccgagaccgaggagauccccaagaucuuccagauccuguacgccaacgagggcgagugcagaaaggacguggagauggagcccgugcagcaggccgagaagaccaacuuccagaaccacaagggccacgaguucauccccacccuguaccacuuccccgccaacugcgacgccugcgccaagccccuguggcacguguucaagcccccccccgcccuggagugcagaagaugccacgugaagugccacagagaccaccuggacaagaaggaggaccugaucugccccugcaaggugagcuacgacgugaccagcgccagagacaugcugcugcuggccugcagccaggacgagcagaagaagugggugacccaccuggugaagaagauccccaagaacccccccagcggcuucgugagagccagccccagaacccugagcaccagaagcaccgccaaccagagcuucagaaagguggugaagaacaccagcggcaagaccagcuaa

SEQ ID NO: 22770 - RNA, 4167 nt, Artificial Sequence
  ROCK2__Homo_sapiens__NP_004841
augagcagacccccccccaccggcaagaugcccggcgcccccgagaccgcccccggcgacggcgccggcgccagcagacagagaaagcuggaggcccugaucagagaccccagaagccccaucaacguggagagccugcuggacggccugaacagccuggugcuggaccuggacuuccccgcccugagaaagaacaagaacaucgacaacuuccugaacagauacgagaagaucgugaagaagaucagaggccugcagaugaaggccgaggacuacgacguggugaaggugaucggcagaggcgccuucggcgaggugcagcuggugagacacaaggccagccagaagguguacgccaugaagcugcugagcaaguucgagaugaucaagagaagcgacagcgccuucuucugggaggagagagacaucauggccuucgccaacagccccuggguggugcagcuguucuacgccuuccaggacgacagauaccuguacauggugauggaguacaugcccggcggcgaccuggugaaccugaugagcaacuacgacgugcccgagaagugggccaaguucuacaccgccgagguggugcuggcccuggacgccauccacagcaugggccugauccacagagacgugaagcccgacaacaugcugcuggacaagcacggccaccugaagcuggccgacuucggcaccugcaugaagauggacgagaccggcauggugcacugcgacaccgccgugggcacccccgacuacaucagccccgaggugcugaagagccagggcggcgacggcuucuacggcagagagugcgacugguggagcgugggcguguuccuguacgagaugcuggugggcgacacccccuucuacgccgacagccuggugggcaccuacagcaagaucauggaccacaagaacagccugugcuuccccgaggacgccgagaucagcaagcacgccaagaaccugaucugcgccuuccugaccgacagagaggugagacugggcagaaacggcguggaggagaucagacagcaccccuucuucaagaacgaccaguggcacugggacaacaucagagagaccgccgcccccguggugcccgagcugagcagcgacaucgacagcagcaacuucgacgacaucgaggacgacaagggcgacguggagaccuuccccauccccaaggccuucgugggcaaccagcugcccuucaucggcuucaccuacuacagagagaaccugcugcugagcgacagccccagcugcagagagaccgacagcauccagagcagaaagaacgaggagagccaggagauccagaagaagcuguacacccuggaggagcaccugagcaacgagaugcaggccaaggaggagcuggagcagaagugcaagagcgugaacaccagacuggagaagaccgccaaggagcuggaggaggagaucacccugagaaagagcguggagagcgcccugagacagcuggagagagagaaggcccugcugcagcacaagaacgccgaguaccagagaaaggccgaccacgaggccgacaagaagagaaaccuggagaacgacgugaacagccugaaggaccagcuggaggaccugaagaagagaaaccagaacagccagaucagcaccgagaaggugaaccagcugcagagacagcuggacgagaccaacgcccugcugagaaccgagagcgacaccgccgccagacugagaaagacccaggccgagagcagcaagcagauccagcagcuggagagcaacaacagagaccugcaggacaagaacugccugcuggagaccgccaagcugaagcuggagaaggaguucaucaaccugcagagcgcccuggagagcgagagaagagacagaacccacggcagcgagaucaucaacgaccugcagggcagaaucugcggccuggaggaggaccugaagaacggcaagauccugcuggccaagguggagcuggagaagagacagcugcaggagagauucaccgaccuggagaaggagaagagcaacauggagaucgacaugaccuaccagcugaaggugauccagcagagccuggagcaggaggaggccgagcacaaggccaccaaggccagacuggccgacaagaacaagaucuacgagagcaucgaggaggccaagagcgaggccaugaaggagauggagaagaagcugcuggaggagagaacccugaagcagaagguggagaaccugcugcuggaggccgagaagagaugcagccugcuggacugcgaccugaagcagagccagcagaagaucaacgagcugcugaagcagaaggacgugcugaacgaggacgugagaaaccugacccugaagaucgagcaggagacccagaagagaugccugacccagaacgaccugaagaugcagacccagcaggugaacacccugaagaugagcgagaagcagcugaagcaggagaacaaccaccugauggagaugaagaugaaccuggagaagcagaacgccgagcugagaaaggagagacaggacgccgacggccagaugaaggagcugcaggaccagcuggaggccgagcaguacuucagcacccuguacaagacccaggugagagagcugaaggaggagugcgaggagaagaccaagcugggcaaggagcugcagcagaagaagcaggagcugcaggacgagagagacagccuggccgcccagcuggagaucacccugaccaaggccgacagcgagcagcuggccagaagcaucgccgaggagcaguacagcgaccuggagaaggagaagaucaugaaggagcuggagaucaaggagaugauggccagacacaagcaggagcugaccgagaaggacgccaccaucgccagccuggaggagaccaacagaacccugaccagcgacguggccaaccuggccaacgagaaggaggagcugaacaacaagcugaaggacgugcaggagcagcugagcagacugaaggacgaggagaucagcgccgccgccaucaaggcccaguucgagaagcagcugcugaccgagagaacccugaagacccaggccgugaacaagcuggccgagaucaugaacagaaaggagcccgugaagagaggcaacgacaccgacgugagaagaaaggagaaggagaacagaaagcugcacauggagcugaagagcgagagagagaagcugacccagcagaugaucaaguaccagaaggagcugaacgagaugcaggcccagaucgccgaggagagccagaucagaaucgagcugcagaugacccuggacagcaaggacagcgacaucgagcagcugagaagccagcugcaggcccugcacaucggccuggacagcagcagcaucggcagcggccccggcgacgccgaggccgacgacggcuuccccgagagcagacuggagggcuggcugagccugcccgugagaaacaacaccaagaaguucggcugggugaagaaguacgugaucgugagcagcaagaagauccuguucuacgacagcgagcaggacaaggagcagagcaaccccuacauggugcuggacaucgacaagcuguuccacgugagacccgugacccagaccgacguguacagagccgacgccaaggagauccccagaaucuuccagauccuguacgccaacgagggcgagagcaagaaggagcaggaguuccccguggagcccgugggcgagaagagcaacuacaucugccacaagggccacgaguucauccccacccuguaccacuuccccaccaacugcgaggccugcaugaagccccuguggcacauguucaagcccccccccgcccuggagugcagaagaugccacaucaagugccacaaggaccacauggacaagaaggaggagaucaucgcccccugcaagguguacuacgacaucagcaccgccaagaaccugcugcugcuggccaacagcaccgaggagcagcagaagugggugagcagacuggugaagaagauccccaagaagccccccgcccccgaccccuucgccagaagcagccccagaaccagcaugaagauccagcagaaccagagcaucagaagacccagcagacagcuggcccccaacaagcccagcuaa

SEQ ID NO: 22771 - RNA, 864 nt, Artificial Sequence
  ROGDI__Homo_sapiens__NP_078865
auggccaccgugauggccgccaccgccgccgagagagccgugcuggaggaggaguucagauggcugcugcacgacgaggugcacgccgugcugaagcagcugcaggacauccugaaggaggccagccugagauucacccugcccggcagcggcaccgagggccccgccaagcaggagaacuucauccugggcagcugcggcaccgaccaggugaagggcgugcugacccugcagggcgacgcccugagccaggccgacgugaaccugaagaugcccagaaacaaccagcugcugcacuucgccuucagagaggacaagcaguggaagcugcagcagauccaggacgccagaaaccacgugagccaggccaucuaccugcugaccagcagagaccagagcuaccaguucaagaccggcgccgaggugcugaagcugauggacgccgugaugcugcagcugaccagagccagaaacagacugaccacccccgccacccugacccugcccgagaucgccgccagcggccugaccagaauguucgcccccgcccugcccagcgaccugcuggugaacguguacaucaaccugaacaagcugugccugaccguguaccagcugcacgcccugcagcccaacagcaccaagaacuucagacccgccggcggcgccgugcugcacagccccggcgccauguucgaguggggcagccagagacuggaggugagccacgugcacaagguggagugcgugauccccuggcugaacgacgcccugguguacuucaccgugagccugcagcugugccagcagcugaaggacaagaucagcguguucagcagcuacuggagcuacagacccuucuaa

SEQ ID NO: 22772 - RNA, 1056 nt, Artificial Sequence
  ROM1__Homo_sapiens__NP_000318
auggcccccgugcugccccuggugcugccccugcagcccagaaucagacuggcccagggccuguggcugcugagcuggcugcuggcccuggccggcggcgugauccugcugugcagcggccaccugcuggugcagcugagacaccugggcaccuuccuggcccccagcugccaguuccccgugcugccccaggccgcccuggccgccggcgccguggcccugggcaccggccuggugggcgugggcgccagcagagccagccugaacgccgcccuguacccccccuggagaggcgugcugggcccccugcugguggccggcaccgccggcggcggcggccugcuggugguggcccugggccuggcccuggcccugcccggcagccuggacgaggcccuggaggagggccuggugaccgcccuggcccacuacaaggacaccgaggugcccggccacugccaggccaagagacugguggacgagcugcagcugagauaccacugcugcggcagacacggcuacaaggacugguucggcgugcagugggugagcagcagauaccuggaccccggcgacagagacguggccgacagaauccagagcaacguggagggccuguaccugaccgacggcgugcccuucagcugcugcaacccccacagccccagacccugccugcagaacagacugagcgacagcuacgcccacccccuguucgaccccagacagcccaaccagaaccugugggcccagggcugccacgaggugcugcuggagcaccugcaggaccuggccggcacccugggcagcaugcuggccgugaccuuccugcugcaggcccuggugcugcugggccugagauaccugcagaccgcccuggagggccugggcggcgugaucgacgccggcggcgagacccagggcuaccuguuccccagcggccugaaggacaugcugaagaccgccuggcugcagggcggcguggccugcagacccgcccccgaggaggccccccccggcgaggccccccccaaggaggaccugagcgaggccuaa

SEQ ID NO: 22773 - RNA, 363 nt, Artificial Sequence
  ROPN1B__Homo_sapiens__XP_005247195
auguggaagguggugaaccugcccaccgaccuguucaacagcgugaugaacgugggcagauucaccgaggagaucgaguggcugaaguuccuggcccuggccugcagcgcccugggcgugaccaucaccaagacccugaagaucgugugcgaggugcugagcugcgaccacaacggcggccugcccagaauccccuucagcaccuuccaguuccuguacaccuacaucgccgagguggacggcgagaucugcgccagccacgugagcagaaugcugaacuacaucgagcaggaggugaucggccccgacggccugaucaccgugaacgacuucacccagaaccccagaguguggcuggaguaa

SEQ ID NO: 22774 - RNA, 441 nt, Artificial Sequence
  ROPN1__Homo_sapiens__XP_011511238
auggcccagaccgacaagcccaccugcaucccccccgagcugcccaagaugcugaaggaguucgccaaggccgccaucagagugcagccccaggaccugauccagugggccgccgacuacuucgaggcccugagcagaggcgagaccccccccgugagagagagaagcgagagaguggcccugugcaacagagccgagcugacccccgagcugcugaagauccugcacagccagguggccggcagacugaucaucagagccgaggagcuggcccagauguggaagguggugaaccugcccaccgaccuguucaacagcgugaugaacgugggcagauucaccgaggagaucgaguggcugaaguuccuggcccuggccugcagcgcccugggcgugagacagcccagagccgacugcagaaagagacugcccgacaccuaa

SEQ ID NO: 22775 - RNA, 693 nt, Artificial Sequence
  ROPN1L__Homo_sapiens__NP_114122
augccccugcccgacaccauguucugcgcccagcagauccacaucccccccgagcugcccgacauccugaagcaguucaccaaggccgccaucagaacccagcccgccgacgugcugagauggagcgccggcuacuucagcgcccugagcagaggcgacccccugcccgugaaggacagaauggagaugcccaccgccacccagaagaccgacaccggccugacccagggccugcugaaggugcugcacaagcagugccaccacaagagauacguggagcugaccgaccuggagcagaaguggaagaaccugugccugcccaaggagaaguucaaggcccugcugcagcuggaccccugcgagaacaagaucaaguggaucaacuuccuggcccugggcugcagcaugcugggcggcagccugaacaccgcccugaagcaccugugcgagauccugaccgacgaccccgagggcggccccgccagaauccccuucaagaccuucagcuacguguacagauaccuggccagacuggacagcgacgugagcccccuggagaccgagagcuaccuggccagccugaaggagaacaucgacgccagaaagaacggcaugaucggccugagcgacuucuucuuccccaagagaaagcugcuggagagcaucgagaacagcgaggacgugggccacuaa

SEQ ID NO: 22776 - RNA, 2625 nt, Artificial Sequence
  ROR1__Homo_sapiens__XP_011539828
augaacaacaucaccaccagccugggccagaccgccgagcugcacugcaaggugagcggcaaccccccccccaccaucagaugguucaagaacgacgcccccguggugcaggagcccagaagacugagcuucagaagcaccaucuacggcagcagacugagaaucagaaaccuggacaccaccgacaccggcuacuuccagugcguggccaccaacggcaaggagguggugagcagcaccggcgugcuguucgugaaguucggccccccccccaccgccagccccggcuacagcgacgaguacgaggaggacggcuucugccagcccuacagaggcaucgccugcgccagauucaucggcaacagaaccguguacauggagagccugcacaugcagggcgagaucgagaaccagaucaccgccgccuucaccaugaucggcaccagcagccaccugagcgacaagugcagccaguucgccauccccagccugugccacuacgccuuccccuacugcgacgagaccagcagcgugcccaagcccagagaccugugcagagacgagugcgagauccuggagaacgugcugugccagaccgaguacaucuucgccagaagcaaccccaugauccugaugagacugaagcugcccaacugcgaggaccugccccagcccgagagccccgaggccgccaacugcaucagaaucggcauccccauggccgaccccaucaacaagaaccacaagugcuacaacagcaccggcguggacuacagaggcaccgugagcgugaccaagagcggcagacagugccagcccuggaacagccaguacccccacacccacaccuucaccgcccugagauuccccgagcugaacggcggccacagcuacugcagaaaccccggcaaccagaaggaggcccccuggugcuucacccuggacgagaacuucaagagcgaccugugcgacauccccgccugcgacagcaaggacagcaaggagaagaacaagauggagauccuguacauccuggugcccagcguggccaucccccuggccaucgcccugcuguucuucuucaucugcgugugcagaaacaaccagaagagcagcagcgcccccgugcagagacagcccaagcacgugagaggccagaacguggagaugagcaugcugaacgccuacaagcccaagagcaaggccaaggagcugccccugagcgccgugagauucauggaggagcugggcgagugcgccuucggcaagaucuacaagggccaccuguaccugcccggcauggaccacgcccagcugguggccaucaagacccugaaggacuacaacaacccccagcaguggaccgaguuccagcaggaggccagccugauggccgagcugcaccaccccaacaucgugugccugcugggcgccgugacccaggagcagcccgugugcaugcuguucgaguacaucaaccagggcgaccugcacgaguuccugaucaugagaagcccccacagcgacgugggcugcagcagcgacgaggacggcaccgugaagagcagccuggaccacggcgacuuccugcacaucgccauccagaucgccgccggcauggaguaccugagcagccacuucuucgugcacaaggaccuggccgccagaaacauccugaucggcgagcagcugcacgugaagaucagcgaccugggccugagcagagagaucuacagcgccgacuacuacagagugcagagcaagagccugcugcccaucagauggaugccccccgaggccaucauguacggcaaguucagcagcgacagcgacaucuggagcuucggcguggugcugugggagaucuucagcuucggccugcagcccuacuacggcuucagcaaccaggaggugaucgagauggugagaaagagacagcugcugcccugcagcgaggacugcccccccagaauguacagccugaugaccgagugcuggaacgagauccccagcagaagacccagauucaaggacauccacgugagacugagaagcugggagggccugagcagccacaccagcagcaccacccccagcggcggcaacgccaccacccagaccaccagccugagcgccagccccgugagcaaccugagcaaccccagauaccccaacuacauguuccccagccagggcaucaccccccagggccagaucgccggcuucaucggcccccccaucccccagaaccagagauucauccccaucaacggcuaccccaucccccccggcuacgccgccuuccccgccgcccacuaccagcccaccggcccccccagagugauccagcacugccccccccccaagagcagaagccccagcagcgccagcggcagcaccagcaccggccacgugaccagccugcccagcagcggcagcaaccaggaggccaacaucccccugcugccccacaugagcauccccaaccaccccggcggcaugggcaucaccguguucggcaacaagagccagaagcccuacaagaucgacagcaagcaggccagccugcugggcgacgccaacauccacggccacaccgagagcaugaucagcgccgagcuguaa

SEQ ID NO: 22777 - RNA, 2832 nt, Artificial Sequence
  ROR2__Homo_sapiens__NP_004551
auggccagaggcagcgcccugcccagaagaccccugcugugcauccccgccgugugggccgccgccgcccugcugcugagcgugagcagaaccagcggcgagguggaggugcuggaccccaacgacccccugggcccccuggacggccaggacggccccauccccacccugaagggcuacuuccugaacuuccuggagcccgugaacaacaucaccaucgugcagggccagaccgccauccugcacugcaagguggccggcaaccccccccccaacgugagauggcugaagaacgacgcccccguggugcaggagcccagaagaaucaucaucagaaagaccgaguacggcagcagacugagaauccaggaccuggacaccaccgacaccggcuacuaccagugcguggccaccaacggcaugaagaccaucaccgccaccggcgugcuguucgugagacugggccccacccacagccccaaccacaacuuccaggacgacuaccacgaggacggcuucugccagcccuacagaggcaucgccugcgccagauucaucggcaacagaaccaucuacguggacagccugcagaugcagggcgagaucgagaacagaaucaccgccgccuucaccaugaucggcaccagcacccaccugagcgaccagugcagccaguucgccauccccagcuucugccacuucguguucccccugugcgacgccagaagcagaacccccaagcccagagagcugugcagagacgagugcgaggugcuggagagcgaccugugcagacaggaguacaccaucgccagaagcaacccccugauccugaugagacugcagcugcccaagugcgaggcccugcccaugcccgagagccccgacgccgccaacugcaugagaaucggcauccccgccgagagacugggcagauaccaccagugcuacaacggcagcggcauggacuacagaggcaccgccagcaccaccaagagcggccaccagugccagcccugggcccugcagcacccccacagccaccaccugagcagcaccgacuuccccgagcugggcggcggccacgccuacugcagaaaccccggcggccagauggagggccccuggugcuucacccagaacaagaacgugagaauggagcugugcgacgugcccagcugcagccccagagacagcagcaagaugggcauccuguacauccuggugcccagcaucgccaucccccuggugaucgccugccuguucuuccuggugugcaugugcagaaacaagcagaaggccagcgccagcaccccccagagaagacagcugauggccagccccagccaggacauggagaugccccugaucaaccagcacaagcaggccaagcugaaggagaucagccugagcgccgugagauucauggaggagcugggcgaggacagauucggcaagguguacaagggccaccuguucggccccgcccccggcgagcagacccaggccguggccaucaagacccugaaggacaaggccgagggcccccugagagaggaguucagacacgaggccaugcugagagccagacugcagcaccccaacguggugugccugcugggcguggugaccaaggaccagccccugagcaugaucuucagcuacugcagccacggcgaccugcacgaguuccuggugaugagaagcccccacagcgacgugggcagcaccgacgacgacagaaccgugaagagcgcccuggagccccccgacuucgugcaccugguggcccagaucgccgccggcauggaguaccugagcagccaccacguggugcacaaggaccuggccaccagaaacgugcugguguacgacaagcugaacgugaagaucagcgaccugggccuguucagagagguguacgccgccgacuacuacaagcugcugggcaacagccugcugcccaucagauggauggcccccgaggccaucauguacggcaaguucagcaucgacagcgacaucuggagcuacggcguggugcugugggagguguucagcuacggccugcagcccuacugcggcuacagcaaccaggacgugguggagaugaucagaaacagacaggugcugcccugccccgacgacugccccgccuggguguacgcccugaugaucgagugcuggaacgaguuccccagcagaagacccagauucaaggacauccacagcagacugagagccuggggcaaccugagcaacuacaacagcagcgcccagaccagcggcgccagcaacaccacccagaccagcagccugagcaccagccccgugagcaacgugagcaacgccagauacgugggccccaagcagaaggccccccccuucccccagccccaguucauccccaugaagggccagaucagacccauggugccccccccccagcuguacgugcccgugaacggcuaccagcccgugcccgccuacggcgccuaccugcccaacuucuaccccgugcagauccccaugcagauggccccccagcaggugcccccccagauggugcccaagcccagcagccaccacagcggcagcggcagcaccagcaccggcuacgugaccaccgcccccagcaacaccagcauggccgacagagccgcccugcugagcgagggcgccgacgacacccagaacgcccccgaggacggcgcccagagcaccgugcaggaggccgaggaggaggaggagggcagcgugcccgagaccgagcugcugggcgacugcgacacccugcagguggacgaggcccaggugcagcuggaggccuaa

SEQ ID NO: 22778 - RNA, 1647 nt, Artificial Sequence
  RORA__Homo_sapiens__NP_002934
augaacgagggcgcccccggcgacagcgaccuggagaccgaggccagagugcccuggagcaucaugggccacugccugagaaccggccaggccagaaugagcgccacccccacccccgccggcgagggcgccagaagcagcagcaccugcagcagccugagcagacuguucuggagccagcuggagcacaucaacugggacggcgccaccgccaagaacuucaucaaccugagagaguucuucagcuuccugcugcccgcccugagaaaggcccagaucgagaucauccccugcaagaucugcggcgacaagagcagcggcauccacuacggcgugaucaccugcgagggcugcaagggcuucuucagaagaagccagcagagcaacgccaccuacagcugccccagacagaagaacugccugaucgacagaaccagcagaaacagaugccagcacugcagacugcagaagugccuggccgugggcaugagcagagacgccgugaaguucggcagaaugagcaagaagcagagagacagccuguacgccgaggugcagaagcacagaaugcagcagcagcagagagaccaccagcagcagcccggcgaggccgagccccugacccccaccuacaacaucagcgccaacggccugaccgagcugcacgacgaccugagcaacuacaucgacggccacacccccgagggcagcaaggccgacagcgccgugagcagcuucuaccuggacauccagcccagccccgaccagagcggccuggacaucaacggcaucaagcccgagcccaucugcgacuacacccccgccagcggcuucuuccccuacugcagcuucaccaacggcgagaccagccccaccgugagcauggccgagcuggagcaccuggcccagaacaucagcaagagccaccuggagaccugccaguaccugagagaggagcugcagcagaucaccuggcagaccuuccugcaggaggagaucgagaacuaccagaacaagcagagagaggugauguggcagcugugcgccaucaagaucaccgaggccauccaguacgugguggaguucgccaagagaaucgacggcuucauggagcugugccagaacgaccagaucgugcugcugaaggccggcagccuggaggugguguucaucagaaugugcagagccuucgacagccagaacaacaccguguacuucgacggcaaguacgccagccccgacguguucaagagccugggcugcgaggacuucaucagcuucguguucgaguucggcaagagccugugcagcaugcaccugaccgaggacgagaucgcccuguucagcgccuucgugcugaugagcgccgacagaagcuggcugcaggagaaggugaagaucgagaagcugcagcagaagauccagcuggcccugcagcacgugcugcagaagaaccacagagaggacggcauccugaccaagcugaucugcaaggugagcacccugagagcccugugcggcagacacaccgagaagcugauggccuucaaggccaucuaccccgacaucgugagacugcacuuccccccccuguacaaggagcuguucaccagcgaguucgagcccgccaugcagaucgacggcuaa

SEQ ID NO: 22779 - RNA, 1380 nt, Artificial Sequence
  RORB__Homo_sapiens__NP_008845
augagagcccagaucgaggugauccccugcaagaucugcggcgacaagagcagcggcauccacuacggcgugaucaccugcgagggcugcaagggcuucuucagaagaagccagcagaacaacgccagcuacagcugccccagacagagaaacugccugaucgacagaaccaacagaaacagaugccagcacugcagacugcagaagugccuggcccugggcaugagcagagacgccgugaaguucggcagaaugagcaagaagcagagagacagccuguacgccgaggugcagaagcaccagcagagacugcaggagcagagacagcagcagagcggcgaggccgaggcccuggccagaguguacagcagcagcaucagcaacggccugagcaaccugaacaacgagaccagcggcaccuacgccaacggccacgugaucgaccugcccaagagcgagggcuacuacaacguggacagcggccagcccagccccgaccagagcggccuggacaugaccggcaucaagcagaucaagcaggagcccaucuacgaccugaccagcgugcccaaccuguucaccuacagcagcuucaacaacggccagcuggcccccggcaucaccaugaccgagaucgacagaaucgcccagaacaucaucaagagccaccuggagaccugccaguacaccauggaggagcugcaccagcuggccuggcagacccacaccuacgaggagaucaaggccuaccagagcaagagcagagaggcccuguggcagcagugcgccauccagaucacccacgccauccaguacgugguggaguucgccaagagaaucaccggcuucauggagcugugccagaacgaccagauccugcugcugaagagcggcugccuggagguggugcuggugagaaugugcagagccuucaacccccugaacaacaccgugcuguucgagggcaaguacggcggcaugcagauguucaaggcccugggcagcgacgaccuggugaacgaggccuucgacuucgccaagaaccugugcagccugcagcugaccgaggaggagaucgcccuguucagcagcgccgugcugaucagccccgacagagccuggcugaucgagcccagaaaggugcagaagcugcaggagaagaucuacuucgcccugcagcacgugauccagaagaaccaccuggacgacgagacccuggccaagcugaucgccaagauccccaccaucaccgccgugugcaaccugcacggcgagaagcugcagguguucaagcagagccaccccgagaucgugaacacccuguuccccccccuguacaaggagcuguucaaccccgacugcgccaccggcugcaaguaa

SEQ ID NO: 22780 - RNA, 1494 nt, Artificial Sequence
  RORC__Homo_sapiens__NP_001001523
augagaacccagaucgaggugauccccugcaagaucugcggcgacaagagcagcggcauccacuacggcgugaucaccugcgagggcugcaagggcuucuucagaagaagccagagaugcaacgccgccuacagcugcaccagacagcagaacugccccaucgacagaaccagcagaaacagaugccagcacugcagacugcagaagugccuggcccugggcaugagcagagacgccgugaaguucggcagaaugagcaagaagcagagagacagccugcacgccgaggugcagaagcagcugcagcagagacagcagcagcagcaggagcccguggugaagaccccccccgccggcgcccagggcgccgacacccugaccuacacccugggccugcccgacggccagcugccccugggcagcagccccgaccugcccgaggccagcgccugcccccccggccugcugaaggccagcggcagcggccccagcuacagcaacaaccuggccaaggccggccugaacggcgccagcugccaccuggaguacagccccgagagaggcaaggccgagggcagagagagcuucuacagcaccggcagccagcugacccccgacagaugcggccugagauucgaggagcacagacaccccggccugggcgagcugggccagggccccgacagcuacggcagccccagcuucagaagcacccccgaggcccccuacgccagccugaccgagaucgagcaccuggugcagagcgugugcaagagcuacagagagaccugccagcugagacuggaggaccugcugagacagagaagcaacaucuucagcagagaggaggugaccggcuaccagagaaagagcaugugggagaugugggagagaugcgcccaccaccugaccgaggccauccaguacgugguggaguucgccaagagacugagcggcuucauggagcugugccagaacgaccagaucgugcugcugaaggccggcgccauggagguggugcuggugagaaugugcagagccuacaacgccgacaacagaaccguguucuucgagggcaaguacggcggcauggagcuguucagagcccugggcugcagcgagcugaucagcagcaucuucgacuucagccacagccugagcgcccugcacuucagcgaggacgagaucgcccuguacaccgcccuggugcugaucaacgcccacagacccggccugcaggagaagagaaagguggagcagcugcaguacaaccuggagcuggccuuccaccaccaccugugcaagacccacagacagagcauccuggccaagcugccccccaagggcaagcugagaagccugugcagccagcacguggagagacugcagaucuuccagcaccugcaccccaucguggugcaggccgccuuccccccccuguacaaggagcuguucagcaccgagaccgagagccccgugggccugagcaaguaa

SEQ ID NO: 22781 - RNA, 7044 nt, Artificial Sequence
  ROS1__Homo_sapiens__NP_002935
augaagaacaucuacugccugauccccaagcuggugaacuucgccacccugggcugccuguggaucagcguggugcagugcaccgugcugaacagcugccugaagagcugcgugaccaaccugggccagcagcuggaccugggcaccccccacaaccugagcgagcccugcauccagggcugccacuucuggaacagcguggaccagaagaacugcgcccugaagugcagagagagcugcgaggugggcugcagcagcgccgagggcgccuacgaggaggaggugcuggagaacgccgaccugcccaccgcccccuucgccagcagcaucggcagccacaacaugacccugagauggaagagcgccaacuucagcggcgugaaguacaucauccaguggaaguacgcccagcugcugggcagcuggaccuacaccaagaccgugagcagacccagcuacguggugaagccccugcaccccuucaccgaguacaucuucagagugguguggaucuucaccgcccagcugcagcuguacagcccccccagccccagcuacagaacccacccccacggcgugcccgagaccgccccccugaucagaaacaucgagagcagcagccccgacaccguggaggugagcugggaccccccccaguuccccggcggccccauccugggcuacaaccugagacugaucagcaagaaccagaagcuggacgccggcacccagagaaccagcuuccaguucuacagcacccugcccaacaccaucuacagauucagcaucgccgccgugaacgaggugggcgagggccccgaggccgagagcagcaucaccaccagcagcagcgccgugcagcaggaggagcaguggcuguuccugagcagaaagaccagccugagaaagagaagccugaagcaccugguggacgaggcccacugccugagacuggacgccaucuaccacaacaucaccggcaucagcguggacgugcaccagcagaucguguacuucagcgagggcacccugaucugggccaagaaggccgccaacaugagcgacgugagcgaccugagaaucuucuacagaggcagcggccugaucagcagcaucagcaucgacuggcuguaccagagaauguacuucaucauggacgagcuggugugcgugugcgaccuggagaacugcagcaacaucgaggagaucaccccccccagcaucagcgccccccagaagaucguggccgacagcuacaacggcuacguguucuaccugcugagagacggcaucuacagagccgaccugcccgugcccagcggcagaugcgccgaggccgugagaaucguggagagcugcacccugaaggacuucgccaucaagccccaggccaagagaaucaucuacuucaacgacaccgcccagguguucaugagcaccuuccuggacggcagcgccagccaccugauccugcccagaauccccuucgccgacgugaagagcuucgccugcgagaacaacgacuuccuggugaccgacggcaaggugaucuuccagcaggacgcccugagcuucaacgaguucaucgugggcugcgaccugagccacaucgaggaguucggcuucggcaaccuggugaucuucggcagcagcagccagcugcacccccugcccggcagaccccaggagcugagcgugcuguucggcagccaccaggcccuggugcaguggaagccccccgcccuggccaucggcgccaacgugauccugaucagcgacaucaucgagcuguucgagcugggccccagcgccuggcagaacuggaccuacgaggugaaggugagcacccaggacccccccgaggugacccacaucuuccugaacaucagcggcaccaugcugaacgugcccgagcugcagagcgccaugaaguacaaggugagcgugagagccagcagccccaagagacccggccccuggagcgagcccagcgugggcaccacccuggugcccgccagcgagccccccuucaucauggccgugaaggaggacggccuguggagcaagccccugaacagcuucggccccggcgaguuccugagcagcgacaucggcaacgugagcgacauggacugguacaacaacagccuguacuacagcgacaccaagggcgacguguucguguggcugcugaacggcaccgacaucagcgagaacuaccaccugcccagcaucgccggcgccggcgcccuggccuucgaguggcugggccacuuccuguacugggccggcaagaccuacgugauccagagacagagcgugcugaccggccacaccgacaucgugacccacgugaagcugcuggugaacgacauggugguggacagcgugggcggcuaccuguacuggaccacccuguacagcguggagagcaccagacugaacggcgagagcagccuggugcugcagacccagcccugguucagcggcaagaaggugaucgcccugacccuggaccugagcgacggccugcuguacuggcuggugcaggacagccagugcauccaccuguacaccgccgugcugagaggccagagcaccggcgacaccaccaucaccgaguucgccgccuggagcaccagcgagaucagccagaacgcccugauguacuacagcggcagacuguucuggaucaacggcuucagaaucaucaccacccaggagaucggccagaagaccagcgugagcgugcuggagcccgccagauucaaccaguucaccaucauccagaccagccugaagccccugcccggcaacuucagcuucacccccaaggugauccccgacagcgugcaggagagcagcuucagaaucgagggcaacgccagcagcuuccagauccuguggaacggcccccccgccguggacuggggcgugguguucuacagcguggaguucagcgcccacagcaaguuccuggccagcgagcagcacagccugcccguguucaccguggagggccuggagcccuacgcccuguucaaccugagcgugacccccuacaccuacuggggcaagggccccaagaccagccugagccugagagcccccgagaccgugcccagcgcccccgagaaccccagaaucuucauccugcccagcggcaagugcugcaacaagaacgagguggugguggaguucagauggaacaagcccaagcacgagaacggcgugcugaccaaguucgagaucuucuacaacaucagcaaccagagcaucaccaacaagaccugcgaggacuggaucgccgugaacgugacccccagcgugaugagcuuccagcuggagggcaugagccccagaugcuucaucgccuuccaggugagagccuucaccagcaagggccccggccccuacgccgacguggugaagagcaccaccagcgagaucaaccccuucccccaccugaucacccugcugggcaacaagaucguguuccuggacauggaccagaaccaggugguguggaccuucagcgccgagagagugaucagcgccgugugcuacaccgccgacaacgagaugggcuacuacgccgagggcgacagccuguuccugcugcaccugcacaacagaagcagcagcgagcuguuccaggacagccugguguucgacaucaccgugaucaccaucgacuggaucagcagacaccuguacuucgcccugaaggagagccagaacggcaugcagguguucgacguggaccuggagcacaaggugaaguaccccagagaggugaagauccacaacagaaacagcaccaucaucagcuucagcguguacccccugcugagcagacuguacuggaccgaggugagcaacuucggcuaccagauguucuacuacagcaucaucagccacacccugcacagaauccugcagcccaccgccaccaaccagcagaacaagagaaaccagugcagcugcaacgugaccgaguucgagcugagcggcgccauggccaucgacaccagcaaccuggagaagccccugaucuacuucgccaaggcccaggagaucugggccauggaccuggagggcugccagugcuggagagugaucaccgugcccgccaugcuggccggcaagacccuggugagccugaccguggacggcgaccugaucuacuggaucaucaccgccaaggacagcacccagaucuaccaggccaagaagggcaacggcgccaucgugagccaggugaaggcccugagaagcagacacauccuggccuacagcagcgugaugcagcccuuccccgacaaggccuuccugagccuggccagcgacaccguggagcccaccauccugaacgccaccaacaccagccugaccaucagacugccccuggccaagaccaaccugaccugguacggcaucaccagccccacccccaccuaccugguguacuacgccgaggugaacgacagaaagaacagcagcgaccugaaguacagaauccuggaguuccaggacagcaucgcccugaucgaggaccugcagcccuucagcaccuacaugauccagaucgccgugaagaacuacuacagcgacccccuggagcaccugccccccggcaaggagaucuggggcaagaccaagaacggcgugcccgaggccgugcagcugaucaacaccaccgugagaagcgacaccagccugaucaucagcuggagagagagccacaagcccaacggccccaaggagagcgugagauaccagcuggccaucagccaccuggcccugauccccgagaccccccugagacagagcgaguuccccaacggcagacugacccugcuggugaccagacugagcggcggcaacaucuacgugcugaaggugcuggccugccacagcgaggagauguggugcaccgagagccaccccgugaccguggagauguucaacacccccgagaagcccuacagccuggugcccgagaacaccagccugcaguucaacuggaaggccccccugaacgugaaccugaucagauucuggguggagcugcagaaguggaaguacaacgaguucuaccacgugaagaccagcugcagccagggccccgccuacgugugcaacaucaccaaccugcagcccuacaccagcuacaacgugagagugguggugguguacaagaccggcgagaacagcaccagccugcccgagagcuucaagaccaaggccggcgugcccaacaagcccggcauccccaagcugcuggagggcagcaagaacagcauccagugggagaaggccgaggacaacggcugcagaaucaccuacuacauccuggagaucagaaagagcaccagcaacaaccugcagaaccagaaccugagauggaagaugaccuucaacggcagcugcagcagcgugugcaccuggaagagcaagaaccugaagggcaucuuccaguucagagugguggccgccaacaaccugggcuucggcgaguacagcggcaucagcgagaacaucauccuggugggcgacgacuucuggauccccgagaccagcuucauccugaccaucaucgugggcaucuuccugguggugaccaucccccugaccuucguguggcacagaagacugaagaaccagaagagcgccaaggagggcgugaccgugcugaucaacgaggacaaggagcuggccgagcugagaggccuggccgccggcgugggccuggccaacgccugcuacgccauccacacccugcccacccaggaggagaucgagaaccugcccgccuuccccagagagaagcugacccugagacugcugcugggcagcggcgccuucggcgagguguacgagggcaccgccguggacauccugggcgugggcagcggcgagaucaagguggccgugaagacccugaagaagggcagcaccgaccaggagaagaucgaguuccugaaggaggcccaccugaugagcaaguucaaccaccccaacauccugaagcagcugggcgugugccugcugaacgagccccaguacaucauccuggagcugauggagggcggcgaccugcugaccuaccugagaaaggccagaauggccaccuucuacggcccccugcugacccugguggaccugguggaccugugcguggacaucagcaagggcugcguguaccuggagagaaugcacuucauccacagagaccuggccgccagaaacugccuggugagcgugaaggacuacaccagccccagaaucgugaagaucggcgacuucggccuggccagagacaucuacaagaacgacuacuacagaaagagaggcgagggccugcugcccgugagauggauggcccccgagagccugauggacggcaucuucaccacccagagcgacguguggagcuucggcauccugaucugggagauccugacccugggccaccagcccuaccccgcccacagcaaccuggacgugcugaacuacgugcagaccggcggcagacuggagccccccagaaacugccccgacgaccuguggaaccugaugacccagugcugggcccaggagcccgaccagagacccaccuuccacagaauccaggaccagcugcagcuguucagaaacuucuuccugaacagcaucuacaagagcagagacgaggccaacaacagcggcgugaucaacgagagcuucgagggcgaggacggcgacgugaucugccugaacagcgacgacaucaugcccguggcccugauggagaccaagaacagagagggccugaacuacauggugcuggccaccgagugcggccagggcgaggagaagagcgagggcccccugggcagccaggagagcgagagcugcggccugagaaaggaggagaaggagccccacgccgacaaggacuucugccaggagaagcagguggccuacugccccagcggcaagcccgagggccugaacuacgccugccugacccacagcggcuacggcgacggcagcgacuaa

SEQ ID NO: 22782 - RNA, 6471 nt, Artificial Sequence
  RP1__Homo_sapiens__NP_006260
augagcgacacccccagcaccggcuucagcaucauccaccccaccagcagcgagggccaggugcccccccccagacaccugagccugacccaccccgugguggccaagagaaucagcuucuacaagagcggcgacccccaguucggcggcgugagagugguggugaaccccagaagcuucaagagcuucgacgcccugcuggacaaccugagcagaaaggugccccugcccuucggcgugagaaacaucagcacccccagaggcagacacagcaucaccagacuggaggagcuggaggacggcgagagcuaccugugcagccacggcagaaaggugcagcccguggaccuggacaaggccagaagaagacccagacccuggcugagcagcagagccaucagcgcccacagccccccccaccccguggccguggccgcccccggcaugcccagaccccccagaagccuggugguguucagaaacggcgaccccaagaccagaagagccgugcugcugagcagaagagugacccagagcuucgaggccuuccugcagcaccugaccgaggugaugcagagacccguggugaagcuguacgccaccgacggcagaagagugcccagccugcaggccgugauccugagcagcggcgccgugguggccgccggcagagagcccuucaagcccggcaacuacgacauccagaaguaccugcugcccgccagacugcccggcaucagccagagaguguaccccaagggcaacgccaagagcgagagcagaaagaucagcacccacaugagcagcagcagcagaagccagaucuacagcgugagcagcgagaagacccacaacaacgacugcuaccuggacuacagcuucgugcccgagaaguaccuggcccuggagaagaacgacagccagaaccugcccaucuaccccagcgaggacgacaucgagaagagcaucaucuucaaccaggacggcaccaugaccguggagaugaaggugagauucagaaucaaggaggaggagaccaucaaguggaccaccaccgugagcaagaccggccccagcaacaacgacgagaagagcgagaugagcuuccccggcagaaccgagagcagaagcagcggccugaagcuggccgccugcagcuucagcgccgacgugagccccauggagagaagcagcaaccaggagggcagccuggccgaggagaucaacauccagaugaccgaccagguggccgagaccugcagcagcgccagcugggagaacgccaccguggacaccgacaucauccagggcacccaggaccaggccaagcacagauucuacagaccccccacccccggccugagaagagugagacagaagaagagcgugaucggcagcgugacccuggugagcgagaccgaggugcaggagaagaugaucggccaguucagcuacagcgaggagagagagagcggcgagaacaagagcgaguaccacauguucacccacagcugcagcaagaugagcagcgugagcaacaagcccgugcuggugcagaucaacaacaacgaccagauggaggagagcagccuggagagaaagaaggagaacagccugcugaagagcagcgccaucagcgccggcgugaucgagaucaccagccagaagaugcuggagaugagccacaacaacggccugcccagcaccaucagcaacaacagcaucguggaggaggacgugguggacugcguggugcuggacaacaagaccggcaucaagaacuucaagaccuacggcaacaccaacgacagauucagccccaucagcgccgacgccacccacuucagcagcaacaacagcggcaccgacaagaacaucagcgaggcccccgccagcgaggccagcagcaccgugaccgccagaaucgacagacugaucaacgaguucgcccagugcggccugaccaagcugcccaagaacgagaagaagauccugagcagcguggccagcaagaagaagaagaagagcagacagcaggccaucaacagcagauaccaggacggccagcuggccaccaagggcauccugaacaagaacgagagaaucaacaccaagggcagaaucaccaaggagaugaucgugcaggacagcgacagcccccugaagggcggcauccugugcgaggaggaccugcagaagagcgacaccgugaucgagagcaacaccuucugcagcaagagcaaccugaacagcaccaucagcaagaacuuccacagaaacaagcugaacaccacccagaacagcaaggugcagggccugcugaccaagagaaagagcagaagccugaacaagaucagccugggcgcccccaagaagagagagaucggccagagagacaagguguucccccacaacgagagcaaguacugcaagagcaccuucgagaacaagagccuguuccacguguucaacauccuggagcagaagcccaaggacuucuacgccccccagagccaggccgagguggccagcggcuaccugagaggcauggccaagaagagccuggugagcaaggugaccgacagccacaucacccugaagagccagaagaagagaaagggcgacaaggugaaggccagcgccauccugagcaagcagcacgccaccaccagagccaacagccuggccagccugaagaagcccgacuuccccgaggccaucgcccaccacagcauccagaacuacauccagagcuggcugcagaacaucaaccccuaccccacccugaagcccaucaagagcgcccccgugugcagaaacgagaccagcguggugaacugcagcaacaacagcuucagcggcaacgacccccacaccaacagcggcaagaucagcaacuucgugauggagagcaacaagcacaucaccaagaucgccggccugaccggcgacaaccugugcaaggagggcgacaagagcuucaucgccaacgacaccggcgaggaggaccugcacgagacccaggugggcagccugaacgacgccuaccuggugccccugcacgagcacugcacccugagccagagcgccaucaacgaccacaacaccaagagccacaucgccgccgagaagagcggccccgagaagaagcugguguaccaggagaucaaccuggccagaaagagacagagcguggaggccgccauccagguggaccccaucgaggaggagacccccaaggaccugcugcccgugcugaugcugcaccagcugcaggccagcgugcccggcauccacaagacccagaacggcguggugcagaugcccggcagccuggccggcgugcccuuccacagcgccaucugcaacagcagcaccaaccugcugcuggccuggcugcuggugcugaaccugaagggcagcaugaacagcuucugccagguggacgcccacaaggccaccaacaagagcagcgagacccuggcccugcuggagauccugaagcacaucgccaucaccgaggaggccgacgaccugaaggccgccguggccaaccugguggagagcaccaccagccacuucggccugagcgagaaggagcaggacauggugcccaucgaccugagcgccaacugcagcaccgugaacauccagagcgugcccaagugcagcgagaacgagagaacccagggcaucagcagccuggacggcggcugcagcgccagcgaggccugcgcccccgaggugugcgugcuggaggugaccugcagccccugcgagaugugcaccgugaacaaggccuacagccccaaggagaccugcaaccccagcgacaccuucuuccccagcgacggcuacggcguggaccagaccagcaugaacaaggccugcuuccugggcgaggugugcagccugaccgacaccguguucagcgacaaggccugcgcccagaaggagaaccacaccuacgagggcgccugccccaucgacgagaccuacgugcccgugaacgugugcaacaccaucgacuuccugaacagcaaggagaacaccuacaccgacaaccuggacagcaccgaggagcuggagagaggcgacgacauccagaaggaccugaacauccugaccgaccccgaguacaagaacggcuucaacacccuggugagccaccagaacgugagcaaccugagcagcugcggccugugccugagcgagaaggaggccgagcuggacaagaagcacagcagccuggacgacuucgagaacugcagccugagaaaguuccaggacgagaacgccuacaccagcuucgacauggaggagcccagaaccagcgaggagcccggcagcaucaccaacagcaugaccagcagcgagagaaacaucagcgagcuggagagcuucgaggagcuggagaaccacgacaccgacaucuucaacaccguggugaacggcggcgagcaggccaccgaggagcugauccaggaggagguggaggccagcaagacccuggagcugaucgacaucagcagcaagaacaucauggaggagaagagaaugaacggcaucaucuacgagaucaucagcaagagacuggccaccccccccagccuggacuucugcuacgacagcaagcagaacagcgagaaggagaccaacgagggcgagaccaagauggugaagaugauggugaagaccauggagaccggcagcuacagcgagagcagccccgaccugaagaagugcaucaagagccccgugaccagcgacuggagcgacuacagacccgacagcgacagcgagcagcccuacaagaccagcagcgacgaccccaacgacagcggcgagcugacccaggagaaggaguacaacaucggcuucgugaagagagccaucgagaagcuguacggcaaggccgacaucaucaagcccagcuucuuccccggcagcaccagaaagagccaggugugccccuacaacagcguggaguuccagugcagcagaaaggccagccuguacgacagcgagggccagagcuucggcagcagcgagcaggugagcagcagcagcagcaugcugcaggaguuccaggaggagagacaggacaagugcgacgugagcgccgugagagacaacuacugcagaggcgacaucguggagcccggcaccaagcagaacgacgacagcagaauccugaccgacaucgaggagggcgugcugaucgacaagggcaaguggcugcugaaggagaaccaccugcugagaaugagcagcgagaaccccggcaugugcggcaacgccgacaccaccagcguggacacccugcuggacaacaacagcagcgaggugcccuacagccacuucggcaaccuggcccccggccccaccauggacgagcugagcagcagcgagcuggaggagcugacccagccccuggagcugaagugcaacuacuucaacaugccccacggcagcgacagcgagcccuuccacgaggaccugcuggacgugagaaacgagaccugcgccaaggagagaaucgccaaccaccacaccgaggagaagggcagccaccagagcgagagagugugcaccagcgugacccacagcuucaucagcgccggcaacaagguguaccccgugagcgacgacgccaucaagaaccagccccugcccggcagcaacaugauccacggcacccugcaggaggccgacagccuggacaagcuguacgcccugugcggccagcacugccccauccugaccgugaucauccagcccaugaacgaggaggacagaggcuucgccuacagaaaggagagcgacaucgagaacuuccugggcuucuaccuguggaugaagauccaccccuaccugcugcagaccgacaagaacguguucagagaggagaacaacaaggccagcaugagacagaaccugaucgacaacgccaucggcgacaucuucgaccaguucuacuucagcaacaccuucgaccugaugggcaagagaagaaagcagaagagaaucaacuuccugggccuggaggaggagggcaaccugaagaaguuccagcccgaccugaaggagagauucugcaugaacuuccugcacaccagccugcugguggugggcaacguggacagcaacacccaggaccugagcggccagaccaacgagaucuucaaggccguggacgagaacaacaaccugcugaacaacagauuccagggcagcagaaccaaccugaaccagguggugagagagaacaucaacugccacuacuucuucgagaugcugggccaggccugccugcuggacaucugccagguggagaccagccugaacaucagcaacagaaacauccuggagcugugcauguucgagggcgagaaccuguucaucugggaggaggaggacauccugaaccugaccgaccuggagagcagcagagagcaggaggaccuguaa

SEQ ID NO: 22783 - RNA, 7203 nt, Artificial Sequence
  RP1L1__Homo_sapiens__NP_849188
augaacagcacccccagaaacgcccaggcccccagccacagagagugcuuccugcccagcguggccagaacccccagcgugaccaaggugacccccgccaagaagaucaccuuccugaagagaggcgaccccagauucgccggcgugagacuggccgugcaccagagagccuucaagaccuucagcgcccugauggacgagcugagccagagagugccccugagcuucggcgugagaagcgugaccacccccagaggccugcacagccugagcgcccuggagcagcuggaggacggcggcugcuaccugugcagcgacaagaagccccccaagacccccagcggccccggcagaccccaggagagaaaccccaccgcccagcagcugagagacguggagggccagagagaggcccccggcaccagcagcagcagaaagagccugaagacccccagaagaauccugcugaucaagaacauggaccccagacugcagcagaccguggugcugagccacagaaacaccagaaaccuggccgccuuccugggcaaggccagcgaccugcugagauuccccgugaagcagcuguacaccaccagcggcaagaagguggacagccugcaggcccugcugcacagccccagcgugcuggugugcgccggccacgaggccuucagaacccccgccaugaagaacgccagaagaagcgaggccgagacccugagcggccugaccagcagaaacaagaacggcagcuggggccccaagaccaagcccagcgugauccacagcagaagcccccccggcagcacccccagacugcccgagagacccggccccagcaacccccccgugggccccgcccccggcagacacccccaggacacccccgcccagagcggcccccugguggccggcgacgacaugaagaagaaggugagaaugaacgaggacggcagccugagcguggagaugaaggugagauuccaccuggugggcgaggacacccugcuguggagcagaagaaugggcagagccagcgcccugaccgccgccagcggcgaggaccccgugcugggcgagguggacccccugugcugcgugugggagggcuaccccuggggcuucagcgagcccggcguguggggccccagacccugcagagugggcugcagagagguguucggcagaggcggccagcccggccccaaguacgagaucuggaccaacccccugcacgccagccagggcgagagaguggccgccagaaagagauggggccuggcccagcacgugagaugcagcggccuguggggccacggcaccgccggcagagagagaugcagccaggacagcgccagccccgccagcagcaccggccugcccgagggcagcgagcccgagagcagcugcugccccagaacccccgaggacggcguggacagcgccagccccagcgcccagaucggcgccgagagaaaggccggcggcagccugggcgaggaccccggccugugcaucgacggcgccggccugggcggccccgagcagggcggcagacugacccccagagccagaagcgaggagggcgccagcagcgacagcagcgccagcaccggcagccacgagggcagcagcgaguggggcggcagaccccagggcugccccggcaaggccagagccgagaccagccagcaggaggccagcgagggcggcgaccccgccagccccgcccugagccugagcagccugagaagcgacgaccugcaggccgagacccagggccagggcaccgagcaggccaccggcgccgccgugaccagagagccccuggugcugggccugagcugcagcugggacagcgagggcgccagcagcacccccagcaccugcaccagcagccagcagggccagagaagacacagaagcagagccagcgccaugagcagccccagcagccccggccugggcagaguggcccccagaggccaccccagacacagccacuacagaaaggacacccacagcccccuggacagcagcgugaccaagcaggugcccagaccccccgagagaagaagagccugccaggacggcagcgugcccagauacagcggcagcagcagcagcaccagaacccaggccagcggcaaccugagaccccccagcagcggcagccugcccagccaggaccugcugggcaccagcagcgccaccgugacccccgccgugcacagcgacuucgugagcggcgugagcccccacaacgcccccagcgccggcugggccggcgacgccggcagcagaaccugcagccccgcccccauccccccccacaccagcgacagcugcagcaagagcggcgccgccagccugggcgaggaggccagagacaccccccagcccagcagcccccuggugcugcaggugggcagacccgagcagggcgccgugggcccccacagaagccacugcugcagccagcccggcacccagcccgcccaggaggcccagagaggccccagccccgaggccagcuggcugugcggcagauacugccccaccccccccagaggcagacccugcccccagagaagaagcagcagcugcggcagcaccggcagcagccaccagagcaccgccagaggccccggcggcagcccccaggagggcaccagacagcccggccccacccccagccccggccccaacagcggcgccagcagaagaagcagcgccagccagggcgccggcagcagaggccugagcgaggagaagacccugagaagcggcggcggcccccagggccaggaggaggccagcggcgugagccccagcagccugcccagaagcagccccgaggccguggugagagaguggcuggacaacauccccgaggagcccauccugaugaccuacgagcuggccgacgagaccaccggcgccgccggcggcggccugagaggccccgagguggaccccggcgacgaccacagccuggagggccugggcgagcccgcccaggccggccagcagagccuggagggcgaccccggccaggaccccgagcccgagggcgcccugcugggcagcagcgacaccggcccccagagcggcgagggcgugccccagggcgccgcccccgagggcgugagcgaggcccccgccgaggccggcgccgacagagaggcccccgccggcugcagagugagccugagagcccugcccggcagagugagcgccagcacccagaucaugagagcccugaugggcagcaagcagggcagacccagcagcgugcccgaggugagcagacccauggccagaagacugagcugcagcgccggcgcccugaucaccugccuggccagccugcagcuguucgaggaggaccugggcagccccgccagcaaggugagauucaaggacagccccagauaccaggagcugcugagcaucagcaaggaccuguggcccggcugcgacgugggcgaggaccagcuggacagcggccugugggagcugaccuggagccaggcccugcccgaccugggcagccacgccaugaccgagaacuucacccccaccagcagcagcggcguggacaucagcagcggcagcggcggcagcggcgagagcagcgugcccugcgccauggacggcacccuggugacccagggcaccgagcugccccugaagaccagcaaccagagacccgacagcagaaccuacgagagccccggcgaccuggagaaccagcagcagugcugcuuccccaccuuccugaacgccagagccugcgccugcgccaccaacgaggacgaggccgagagagacagcgaggagcagagagccagcagcaaccuggagcagcuggccgagaacaccgugcaggaggaggugcagcuggaggagaccaaggagggcaccgagggcgagggccugcaggaggaggccgugcagcuggaggagaccaagaccgaggagggccugcaggaggagggcgugcagcuggaggagaccaaggagaccgagggcgagggccagcaggaggaggaggcccagcuggaggagaucgaggagaccggcggcgagggccugcaggaggagggcgugcagcuggaggaggugaaggagggccccgagggcggccugcagggcgaggcccuggaggagggccugaaggaggagggccugcccgaggagggcagcgugcacggccaggagcugagcgaggccagcagccccgacggcaagggcagccaggaggacgaccccgugcaggaggaggaggccggcagagccagcgccagcgccgagcccugccccgccgagggcaccgaggagcccaccgagccccccagccaccugagcgagaccgaccccagcgccagcgagagacagagcggcagccagcuggagcccggccuggagaagccccccggcgccaccaugaugggccaggagcacacccaggcccagcccacccagggcgccgccgagagaagcagcagcguggccugcagcgccgcccuggacugcgaccccaucugggugagcgugcugcugaagaagaccgagaaggccuuccuggcccaccuggccagcgccguggccgagcugagagccagauggggccugcaggacaacgaccugcuggaccagauggccgccgagcugcagcaggacguggcccagagacugcaggacagcaccaagagagagcugcagaagcugcagggcagagccggcagaauggugcuggagccccccagagaggcccugaccggcgagcugcugcugcagacccagcagagaagacacagacugagaggccugagaaaccugagcgccuucagcgagagaacccugggccugggcccccugagcuucacccuggaggacgagcccgcccugagcaccgcccugggcagccagcugggcgaggaggccgagggcgaggaguucugccccugcgaggccugcgugagaaagaaggugagccccaugagccccaaggccaccaugggcgccaccagaggccccaucaaggaggccuucgaccugcagcagauccugcagagaaagagaggcgagcacaccgacggcgaggccgccgagguggcccccggcaagacccacaccgaccccaccagcaccagaaccgugcagggcgccgagggcggccugggccccggccugagccagggccccggcguggacgagggcgaggacggcgagggcagccagagacugaacagagacaaggaccccaagcugggcgaggccgagggcgacgccauggcccaggagagagagggcaagacccacaacagcgagaccagcgccggcagcgagcugggcgaggccgagcaggagggcgagggcaucagcgagagaggcgagaccggcggccagggcagcggccacgaggacaaccugcagggcgaggccgccgccggcggcgaccaggaccccggccagagcgacggcgccgagggcaucgaggcccccgaggccgagggcgaggcccagcccgagagcgagggcguggaggcccccgaggccgagggcgacgcccaggaggccgagggcgaggcccagcccgagagcgaggacguggaggcccccgaggccgagggcgaggcccagcccgagagcgaggacguggagacccccgaggccgagugggaggugcagcccgagagcgagggcgccgaggcccccgaggccgagaaggaggcccagcccgagaccgagagcguggaggcccuggagaccgagggcgaggacgagcccgagagcgagggcgccgaggcccaggaggccgaggaggccgcccaggaggccgagggccagacccagcccgagagcgaggugaucgagagccaggaggccgaggaggaggcccagcccgagagcgaggacguggaggcccuggagguggagguggagacccaggaggccgagggcgaggcccagcccgagagcgaggacguggaggcccccgaggccgagggcgagaugcaggaggccgaggaggaggcccagcccgagagcgacggcguggaggcccagcccaagagcgagggcgaggaggcccaggagguggagggcgagacccagaagaccgagggcgacgcccagcccgagagcgacggcguggaggcccccgaggccgaggaggaggcccaggaggccgagggcgaggugcaggaggccgagggcgaggcccaccccgagagcgaggacguggacgcccaggaggccgagggcgaggcccagcccgagagcgagggcguggaggcccccgaggccgagggcgaggcccagaaggccgagggcaucgaggcccccgagaccgagggcgaggcccagcccgagagcgagggcaucgaggcccccgaggccgagggcgaggcccagcccgagagcgagggcguggaggcccaggacgccgagggcgaggcccagcccgagagcgagggcaucgaggcccaggaggccgaggaggaggcccagcccgagcuggagggcguggaggcccccgaggccgagggcgaggcccagcccgagagcgagggcaucgaggcccccgaggccgagggcgaggcccagcccgagcuggagggcguggaggcccccgaggccgaggaggaggcccagcccgagcccgagggcguggagacccccgaggccgagggcgaggcccagcccgagagcgagggcgagacccagggcgagaagaagggcagcccccaggugagccugggcgacggccagagcgaggaggccagcgagagcagcagccccgugcccgaggacagacccacccccccccccagccccggcggcgacaccccccaccagagacccggcagccagaccggccccagcagcagcagagccagcagcuggggcaacugcuggcagaaggacagcgagaacgaccacgugcugggcgacaccagaagccccgacgccaagagcaccggcaccccccacgccgagagaaaggccaccagaauguaccccgagagcagcaccagcgagcaggaggaggccccccugggcagcagaacccccgagcagggcgccagcgagggcuacgaccugcaggaggaccaggcccugggcagccuggcccccaccgaggccgugggcagagccgacggcuucggccaggacgaccuggacuucuaa

SEQ ID NO: 22784 - RNA, 1053 nt, Artificial Sequence
  RP2__Homo_sapiens__NP_008846
augggcugcuucuucagcaagagaagaaaggccgacaaggagagcagacccgagaacgaggaggagagacccaagcaguacagcugggaccagagagagaagguggaccccaaggacuacauguucagcggccugaaggacgagaccgugggcagacugcccggcaccguggccggccagcaguuccugauccaggacugcgagaacugcaacaucuacaucuucgaccacagcgccaccgugaccaucgacgacugcaccaacugcaucaucuuccugggccccgugaagggcagcguguucuucagaaacugcagagacugcaagugcacccuggccugccagcaguucagagugagagacugcagaaagcuggagguguuccugugcugcgccacccagcccaucaucgagagcagcagcaacaucaaguucggcugcuuccagugguacuaccccgagcuggccuuccaguucaaggacgccggccugagcaucuucaacaacaccuggagcaacauccacgacuucacccccgugagcggcgagcugaacuggagccugcugcccgaggacgccguggugcaggacuacgugcccauccccaccaccgaggagcugaaggccgugagagugagcaccgaggccaacagaagcaucgugcccaucagcagaggccagagacagaagagcagcgacgagagcugccugguggugcuguucgccggcgacuacaccaucgccaacgccagaaagcugaucgacgagauggugggcaagggcuucuuccuggugcagaccaaggaggugagcaugaaggccgaggacgcccagagaguguucagagagaaggcccccgacuuccugccccugcugaacaagggccccgugaucgcccuggaguucaacggcgacggcgccguggaggugugccagcugaucgugaacgagaucuucaacggcaccaagauguucgugagcgagagcaaggagaccgccagcggcgacguggacagcuucuacaacuucgccgacauccagaugggcaucuaa

SEQ ID NO: 22785 - RNA, 666 nt, Artificial Sequence
  RP9__Homo_sapiens__NP_976033
augagcagcagacccggcagagaggacgugggcgccgccggcgccagaagacccagagagccccccgagcaggagcugcagagaagaagagagcagaagagaagaagacacgacgcccagcagcugcagcagcugaagcaccuggagagcuucuacgagaagcccccccccggccugaucaaggaggacgagaccaagcccgaggacugcauccccgacgugcccggcaacgagcacgccagagaguuccuggcccacgcccccaccaagggccuguggaugccccugggcaaggaggugaaggugaugcagugcuggagaugcaagagauacggccacagaaccggcgacaaggagugccccuucuucaucaagggcaaccagaagcuggagcaguucagaguggcccacgaggaccccauguacgacaucaucagagacaacaagagacacgagaaggacgugagaauccagcagcugaagcagcugcuggaggacagcaccagcgacgaggacagaagcagcagcagcagcagcgagggcaaggagaagcacaagaagaagaagaagaaggagaagcacaagaagagaaagaaggagaagaagaagaagaagaagagaaagcacaagagcagcaagagcaacgagggcagcgacagcgaguaa

SEQ ID NO: 22786 - RNA, 1851 nt, Artificial Sequence
  RPA1__Homo_sapiens__NP_002936
auggugggccagcugagcgagggcgccaucgccgccaucaugcagaagggcgacaccaacaucaagcccauccugcaggugaucaacaucagacccaucaccaccggcaacagcccccccagauacagacugcugaugagcgacggccugaacacccugagcagcuucaugcuggccacccagcugaacccccugguggaggaggagcagcugagcagcaacugcgugugccagauccacagauucaucgugaacacccugaaggacggcagaagaguggugauccugauggagcuggaggugcugaagagcgccgaggccgugggcgugaagaucggcaaccccgugcccuacaacgagggccugggccagccccagguggccccccccgcccccgccgccagccccgccgccagcagcagaccccagccccagaacggcagcagcggcaugggcagcaccgugagcaaggccuacggcgccagcaagaccuucggcaaggccgccggccccagccugagccacaccagcggcggcacccagagcaagguggugcccaucgccagccugacccccuaccagagcaaguggaccaucugcgccagagugaccaacaagagccagaucagaaccuggagcaacagcagaggcgagggcaagcuguucagccuggagcugguggacgagagcggcgagaucagagccaccgccuucaacgagcagguggacaaguucuucccccugaucgaggugaacaagguguacuacuucagcaagggcacccugaagaucgccaacaagcaguucaccgccgugaagaacgacuacgagaugaccuucaacaacgagaccagcgugaugcccugcgaggacgaccaccaccugcccaccgugcaguucgacuucaccggcaucgacgaccuggagaacaagagcaaggacagccugguggacaucaucggcaucugcaagagcuacgaggacgccaccaagaucaccgugagaagcaacaacagagagguggccaagagaaacaucuaccugauggacaccagcggcaagguggugaccgccacccuguggggcgaggacgccgacaaguucgacggcagcagacagcccgugcuggccaucaagggcgccagagugagcgacuucggcggcagaagccugagcgugcugagcagcagcaccaucaucgccaaccccgacauccccgaggccuacaagcugagaggcugguucgacgccgagggccaggcccuggacggcgugagcaucagcgaccugaagagcggcggcgugggcggcagcaacaccaacuggaagacccuguacgaggugaagagcgagaaccugggccagggcgacaagcccgacuacuucagcagcguggccaccgugguguaccugagaaaggagaacugcauguaccaggccugccccacccaggacugcaacaagaaggugaucgaccagcagaacggccuguacagaugcgagaagugcgacaccgaguuccccaacuucaaguacagaaugauccugagcgugaacaucgccgacuuccaggagaaccagugggugaccugcuuccaggagagcgccgaggccauccugggccagaacgccgccuaccugggcgagcugaaggacaagaacgagcaggccuucgaggagguguuccagaacgccaacuucagaagcuucaucuucagagugagagugaagguggagaccuacaacgacgagagcagaaucaaggccaccgugauggacgugaagcccguggacuacagagaguacggcagaagacuggugaugagcaucagaagaagcgcccugauguaa

SEQ ID NO: 22787 - RNA, 837 nt, Artificial Sequence
  RPA2__Homo_sapiens__NP_001284487
augggcagaggcgacagaaacaagagaagcaucagaggcuucgagagcuacggcagcagcagcuacggcggcgccggcggcuacacccagagccccggcggcuucggcagccccgcccccagccaggccgagaagaagagcagagccagagcccagcacaucgugcccugcaccaucagccagcugcugagcgccacccugguggacgagguguucagaaucggcaacguggagaucagccaggugaccaucgugggcaucaucagacacgccgagaaggcccccaccaacaucguguacaagaucgacgacaugaccgccgcccccauggacgugagacaguggguggacaccgacgacaccagcagcgagaacaccguggugccccccgagaccuacgugaagguggccggccaccugagaagcuuccagaacaagaagagccugguggccuucaagaucaugccccuggaggacaugaacgaguucaccacccacauccuggaggugaucaacgcccacauggugcugagcaaggccaacagccagcccagcgccggcagagcccccaucagcaaccccggcaugagcgaggccggcaacuucggcggcaacagcuucaugcccgccaacggccugaccguggcccagaaccaggugcugaaccugaucaaggccugccccagacccgagggccugaacuuccaggaccugaagaaccagcugaagcacaugagcgugagcagcaucaagcaggccguggacuuccugagcaacgagggccacaucuacagcaccguggacgacgaccacuucaagagcaccgacgccgaguaa

SEQ ID NO: 22788 - RNA, 366 nt, Artificial Sequence
  RPA3__Homo_sapiens__NP_002938
augguggacaugauggaccugcccagaagcagaaucaacgccggcaugcuggcccaguucaucgacaagcccgugugcuucgugggcagacuggagaagauccaccccaccggcaagauguucauccugagcgacggcgagggcaagaacggcaccaucgagcugauggagccccuggacgaggagaucagcggcaucguggagguggugggcagagugaccgccaaggccaccauccugugcaccagcuacgugcaguucaaggaggacagccaccccuucgaccugggccuguacaacgaggccgugaagaucauccacgacuucccccaguucuacccccugggcaucgugcagcacgacuaa

SEQ ID NO: 22789 - RNA, 786 nt, Artificial Sequence
  RPA4__Homo_sapiens__NP_037479
augagcaagagcggcuucggcagcuacggcagcaucagcgccgccgacggcgccagcggcggcagcgaccagcugugcgagagagacgccacccccgccaucaagacccagagacccaaggugagaauccaggacguggugcccugcaacgugaaccagcugcugagcagcaccguguucgaccccguguucaaggugagaggcaucaucgugagccaggugagcaucgugggcgugaucagaggcgccgagaaggccagcaaccacaucugcuacaagaucgacgacaugaccgccaagcccaucgaggccagacagugguucggcagagagaaggugaagcaggugaccccccugagcgugggcguguacgugaagguguucggcauccugaagugccccaccggcaccaagagccuggaggugcugaagauccacgugcuggaggacaugaacgaguucaccgugcacauccuggagaccgugaacgcccacaugaugcuggacaaggccagaagagacaccaccguggagagcgugcccgugagccccagcgaggugaacgacgccggcgacaacgacgagagccacagaaacuucauccaggacgaggugcugagacugauccacgagugcccccaccaggagggcaagagcauccacgagcugagagcccagcugugcgaccugagcgugaaggccaucaaggaggccaucgacuaccugaccguggagggccacaucuaccccaccguggacagagagcacuucaagagcgccgacuaa

SEQ ID NO: 22790 - RNA, 660 nt, Artificial Sequence
  RPAIN__Homo_sapiens__NP_001028174
auggccgagagccugagaagccccagaagaagccuguacaagcuggugggcagcccccccuggaaggaggccuucagacagagaugccuggagagaaugagaaacagcagagacagacugcugaacagauacagacaggccggcagcagcggccccggcaacagccagaacagcuuccuggugcaggaggugauggaggaggaguggaacgcccugcagagcguggagaacugccccgaggaccuggcccagcuggaggagcugaucgacauggccgugcuggaggagauccagcaggagcugaucaaccaggagcagagcaucaucagcgaguacgagaagagccugcaguucgacgagaagugccugagcaucaugcuggccgagugggaggccaacccccugaucugccccgugugcaccaaguacaaccugagaaucaccagcggcgugguggugugccagugcggccugagcauccccagccacagcagcgagcugaccgagcagaagcugagagccugccuggagggcagcaucaacgagcacagcgcccacugcccccacacccccgaguucagcgugaccggcggcaccgaggagaagagcagccugcugaugagcugccuggccugcgacaccugggccgugauccuguaa

SEQ ID NO: 22791 - RNA, 4182 nt, Artificial Sequence
  RPAP1__Homo_sapiens__NP_056355
augcugagcagacccaagcccggcgagagcgagguggaccugcugcacuuccagagccaguuccuggccgccggcgccgcccccgccgugcagcuggugaagaagggcaacagaggcggcggcgacgccaacagcgacagacccccccugcaggaccacagagacguggugaugcuggacaaccugcccgaccugccccccgcccuggugcccagcccccccaagagagccagacccagccccggccacugccugcccgaggacgaggaccccgaggagagacugagaagacacgaccagcacaucaccgccgugcugaccaagaucaucgagagagacaccagcagcguggccgugaaccugcccgugcccagcggcguggccuuccccgccguguuccugagaagcagagacacccagggcaagagcgccaccagcggcaagagaagcaucuucgcccaggagaucgccgccagaagaaucgccgaggccaagggccccagcgugggcgagguggugcccaacgugggcccccccgagggcgccgugaccugcgagacccccacccccagaaaccagggcugccagcugcccggcagcagccacagcuuccagggccccaaccuggugaccggcaagggccugagagaccaggaggccgagcaggaggcccagaccauccacgaggagaacaucgccagacugcaggccauggcccccgaggagauccugcaggagcagcagagacugcuggcccagcuggaccccagccugguggccuuccugagaagccacagccacacccaggagcagaccggcgagaccgccagcgaggagcagagacccggcggccccagcgccaacgugaccaaggaggagccccugaugagcgccuucgccagcgagcccagaaagagagacaagcuggagcccgaggcccccgcccuggcccugcccgugaccccccagaaggaguggcugcacauggacaccguggagcuggagaagcugcacuggacccaggaccugccccccgugagaagacagcagacccaggagagaaugcaggccagauucagccugcagggcgagcugcuggcccccgacguggaccugcccacccaccugggccugcaccaccacggcgaggaggccgagagagccggcuacagccugcaggagcuguuccaccugaccagaagccaggugagccagcagagagcccuggcccugcacgugcuggcccaggugaucagcagagcccaggccggcgaguucggcgacagacuggccggcagcgugcugagccugcugcuggacgccggcuuccuguuccugcugagauucagccuggacgacagaguggacggcgugaucgccaccgccaucagagcccugagagcccugcugguggcccccggcgacgaggagcugcuggacagcaccuucagcugguaccacggcgcccugaccuucccccugaugcccagccaggaggacaaggaggacgaggacgaggacgaggagugccccgccggcaaggccaagagaaagagccccgaggaggagagcagacccccccccgaccuggccagacacgacgugaucaagggccugcuggccaccagccugcugcccagacugagauacgugcuggaggugaccuaccccggccccgccguggugcuggacauccuggccgugcugaucagacuggccagacacagccuggagagcgccaccagagugcuggagugccccagacugaucgagaccaucgugagagaguuccugcccaccagcuggagccccgugggcgccggccccacccccagccuguacaaggugcccugcgccaccgccaugaagcugcugagagugcuggccagcgccggcagaaacaucgccgccagacugcugagcagcuucgaccugagaagcagacugugcagaaucaucgccgaggccccccaggagcuggcccugccccccgaggaggccgagaugcugagcaccgaggcccugagacugugggccguggccgccagcuacggccagggcggcuaccuguacagagagcuguaccccgugcugaugagagcccugcagguggugcccagagagcugagcacccaccccccccagccccugagcaugcagagaaucgccagccugcugacccugcugacccagcugacccuggccgccggcagcacccccgccgagaccaucagcgacagcgccgaggccagccugagcgccacccccagccuggugaccuggacccaggugagcggccugcagccccugguggagcccugccugagacagacccugaagcugcugagcagacccgagauguggagagccgugggccccgugcccguggccugccugcuguuccugggcgccuacuaccaggccuggagccagcagcccagcagcugccccgaggacuggcugcaggacaugcagagacugagcgaggagcugcugcugccccugcugagccagcccacccugggcagccugugggacagccugagacacugcagccugcugugcaacccccugagcugcgugcccgcccuggaggccccccccagccuggugagccugggcugcagcggcggcugccccagacugagccuggccggcagcgccagccccuuccccuuccugaccgcccugcugagccugcugaacacccuggcccagauccacaagggccugugcggccagcuggccgccauccuggccgcccccggccugcagaacuacuuccugcagugcguggcccccggcgccgccccccaccugacccccuucagcgccugggcccugagacacgaguaccaccugcaguaccuggcccuggcccuggcccagaaggccgccgcccugcagccccugcccgccacccacgccgcccuguaccacggcauggcccuggcccugcugagcagacugcugcccggcagcgaguaccugacccacgagcugcugcugagcugcguguucagacuggaguuccugcccgagagaaccagcggcggccccgaggccgccgacuucagcgaccagcugagccugggcagcagcagagugcccagaugcggccagggcacccugcuggcccaggccugccaggaccugcccagcaucagaaacugcuaccugacccacugcagccccgccagagccagccugcuggccagccaggcccugcacagaggcgagcugcagagagugcccacccugcugcugcccaugcccaccgagccccugcugcccaccgacuggcccuuccugccccugaucagacuguaccacagagccagcgacacccccagcggccugagccccaccgacaccaugggcaccgccaugagagugcugcagugggugcuggugcuggagagcuggagaccccaggcccugugggccgugccccccgccgccagacuggccagacugaugugcguguuccugguggacagcgagcuguucagagagagccccgugcagcaccugguggccgcccugcuggcccagcugugccagccccaggugcugcccaaccugaaccuggacugcagacugcccggccugaccagcuuccccgaccuguacgccaacuuccuggaccacuucgaggccgugagcuucggcgaccaccuguucggcgcccuggugcugcugccccugcagagaagauucagcgugacccugagacuggcccuguucggcgagcacgugggcgcccugagagcccugagccugccccugacccagcugcccgugagccuggagugcuacaccgugccccccgaggacaaccuggcccugcugcagcuguacuucagaacccuggugaccggcgcccugagacccagauggugccccgugcuguacgccguggccguggcccacgugaacagcuucaucuucagccaggacccccagagcagcgacgaggugaaggccgccagaagaagcaugcugcagaagaccuggcugcuggccgacgagggccugagacagcaccugcugcacuacaagcugcccaacagcacccugcccgagggcuucgagcuguacagccagcugcccccccugagacagcacuaccugcagagacugaccagcaccgugcugcagaacggcgugagcgagaccuaa

SEQ ID NO: 22792 - RNA, 600 nt, Artificial Sequence
  RPE__Homo_sapiens__NP_001265214
auggccagcggcugcaagaucggccccagcauccugaacagcgaccuggccaaccugggcgccgagugccugagaaugcuggacagcggcgccgacuaccugcaccuggacgugauggacggccacuucgugcccaacaucaccuucggccaccccgugguggagagccugagaaagcagcugggccaggaccccuucuucgacaugcacaugauggugagcaagcccgagcagugggugaagcccauggccguggccggcgccaaccaguacaccuuccaccuggaggccaccgagaaccccggcgcccugaucaaggacaucagagagaacggcaugaaggugggccuggccaucaagcccggcaccagcguggaguaccuggcccccugggccaaccagaucgacauggcccuggugaugaccguggagcccggcuucggcggccagaaguucauggaggacaugaugcccaaggccggcgccaacaugaucgugagcggcagcgccaucaugagaagcgaggaccccagaagcgugaucaaccugcugagaaacgugugcagcgaggccgcccagaagagaagccuggacagauaa

SEQ ID NO: 22793 - RNA, 2448 nt, Artificial Sequence
  RPGR__Homo_sapiens__NP_000319
augagagagcccgaggagcugaugcccgacagcggcgccguguucaccuucggcaagagcaaguucgccgagaacaaccccggcaaguucugguucaagaacgacgugcccgugcaccugagcugcggcgacgagcacagcgccguggugaccggcaacaacaagcuguacauguucggcagcaacaacuggggccagcugggccugggcagcaagagcgccaucagcaagcccaccugcgugaaggcccugaagcccgagaaggugaagcuggccgccugcggcagaaaccacacccuggugagcaccgagggcggcaacguguacgccaccggcggcaacaacgagggccagcugggccugggcgacaccgaggagagaaacaccuuccacgugaucagcuucuucaccagcgagcacaagaucaagcagcugagcgccggcagcaacaccagcgccgcccugaccgaggacggcagacuguucauguggggcgacaacagcgagggccagaucggccugaagaacgugagcaacgugugcgugccccagcaggugaccaucggcaagcccgugagcuggaucagcugcggcuacuaccacagcgccuucgugaccaccgacggcgagcuguacguguucggcgagcccgagaacggcaagcugggccugcccaaccagcugcugggcaaccacagaaccccccagcuggugagcgagauccccgagaaggugauccagguggccugcggcggcgagcacaccguggugcugaccgagaacgccguguacaccuucggccugggccaguucggccagcugggccugggcaccuuccuguucgagaccagcgagcccaaggugaucgagaacaucagagaccagaccaucagcuacaucagcugcggcgagaaccacaccgcccugaucaccgacaucggccugauguacaccuucggcgacggcagacacggcaagcugggccugggccuggagaacuucaccaaccacuucauccccacccugugcagcaacuuccugagauucaucgugaagcugguggccugcggcggcugccacauggugguguucgccgccccccacagaggcguggccaaggagaucgaguucgacgagaucaacgacaccugccugagcguggccaccuuccugcccuacagcagccugaccagcggcaacgugcugcagagaacccugagcgccagaaugagaagaagagagagagagagaagccccgacagcuucagcaugagaagaacccugccccccaucgagggcacccugggccugagcgccugcuuccugcccaacagcguguuccccagaugcagcgagagaaaccugcaggagagcgugcugagcgagcaggaccugaugcagcccgaggagcccgacuaccugcuggacgagaugaccaaggaggccgagaucgacaacagcagcaccguggagagccugggcgagaccaccgacauccugaacaugacccacaucaugagccugaacagcaacgagaagagccugaagcugagccccgugcagaagcagaagaagcagcagaccaucggcgagcugacccaggacaccgcccugaccgagaacgacgacagcgacgaguacgaggagaugagcgagaugaaggagggcaaggccugcaagcagcacgugagccagggcaucuucaugacccagcccgccaccaccaucgaggccuucagcgacgaggagguggagauccccgaggagaaggagggcgccgaggacagcaagggcaacggcaucgaggagcaggagguggaggccaacgaggagaacgugaaggugcacggcggcagaaaggagaagaccgagauccugagcgacgaccugaccgacaaggccgaggaccacgaguucagcaagaccgaggagcugaagcuggaggacguggacgaggagaucaacgccgagaacguggagagcaagaagaagaccgugggcgacgacgagagcgugcccaccggcuaccacagcaagaccgagggcgccgagagaaccaacgacgacagcagcgccgagaccaucgagaagaaggagaaggccaaccuggaggagagagccaucugcgaguacaacgagaaccccaagggcuacaugcuggacgacgccgacagcagcagccuggagauccuggagaacagcgagaccacccccagcaaggacaugaagaagaccaagaagaucuuccuguucaagagagugcccagcaucaaccagaagaucgugaagaacaacaacgagccccugcccgagaucaagagcaucggcgaccagaucauccugaagagcgacaacaaggacgccgaccagaaccacaugagccagaaccaccagaacaucccccccaccaacaccgagagaagaagcaagagcugcaccauccuguaa

SEQ ID NO: 22794 - RNA, 3861 nt, Artificial Sequence
  RPGRIP1__Homo_sapiens__NP_065099
augagccaccugguggaccccaccagcggcgaccugcccgugagagacaucgacgccaucccccuggugcugcccgccagcaagggcaagaacaugaagacccagcccccccugagcagaaugaacagagaggagcuggaggacagcuucuucagacugagagaggaccacaugcuggugaaggagcugagcuggaagcagcaggacgagaucaagagacugagaaccacccugcugagacugaccgccgccggcagagaccugagaguggccgaggaggccgccccccugagcgagaccgccagaagaggccagaaggccggcuggagacagagacugagcaugcaccagagaccccagaugcacagacugcagggccacuuccacugcgugggccccgccagccccagaagagcccagcccagagugcaggugggccacagacagcugcacaccgccggcgcccccgugcccgagaagcccaagagaggccccagagacagacugagcuacaccgccccccccagcuucaaggagcacgccaccaacgagaacagaggcgagguggccagcaagcccagcgagcuggugagcggcagcaacagcaucaucagcuucagcagcgugaucagcauggccaagcccaucggccugugcaugcccaacagcgcccacaucauggccagcaacaccaugcagguggaggagccccccaagagccccgagaagauguggcccaaggacgagaacuucgagcagagaagcagccuggagugcgcccagaaggccgccgagcugagagccagcaucaaggagaagguggagcugaucagacugaagaagcugcugcacgagagaaacgccagccuggugaugaccaaggcccagcugaccgaggugcaggaggccuacgagacccugcugcagaagaaccagggcauccugagcgccgcccacgaggcccugcugaagcaggugaacgagcugagagccgagcugaaggaggagagcaagaaggccgugagccugaagagccagcuggaggacgugagcauccugcagaugacccugaaggaguuccaggagagaguggaggaccuggagaaggagagaaagcugcugaacgacaacuacgacaagcugcuggagagcaugcuggacagcagcgacagcagcagccagccccacuggagcaacgagcugaucgccgagcagcugcagcagcaggugagccagcugcaggaccagcuggacgccgagcuggaggacaagagaaaggugcugcuggagcugagcagagagaaggcccagaacgaggaccugaagcuggaggugaccaacauccugcagaagcacaagcaggagguggagcugcugcagaacgccgccaccaucagccagccccccgacagacagagcgagcccgccacccaccccgccgugcugcaggagaacacccagaucgagcccagcgagcccaagaaccaggaggagaagaagcugagccaggugcugaacgagcugcaggugagccacgccgagaccacccuggagcuggagaagaccagagacaugcugauccugcagagaaagaucaacgugugcuaccaggaggagcuggaggccaugaugaccaaggccgacaacgacaacagagaccacaaggagaagcuggagagacugaccagacugcuggaccugaagaacaacagaaucaagcagcuggagggcauccugagaagccacgaccugcccaccagcgagcagcugaaggacguggccuacggcaccagaccccugagccugugccuggagacccugcccgcccacggcgacgaggacaagguggacaucagccugcugcaccagggcgagaaccuguucgagcugcacauccaccaggccuuccugaccagcgccgcccuggcccaggccggcgacacccagcccaccaccuucugcaccuacagcuucuacgacuucgagacccacugcaccccccugagcgugggcccccagccccuguacgacuucaccagccaguacgugauggagaccgacagccuguuccugcacuaccugcaggaggccagcgccagacuggacauccaccaggccauggccagcgagcacagcacccuggccgccggcuggaucugcuucgacagagugcuggagaccguggagaaggugcacggccuggccacccugaucggcgccggcggcgaggaguucggcgugcuggaguacuggaugagacugagauuccccaucaagcccagccugcaggccugcaacaagagaaagaaggcccagguguaccugagcaccgacgugcugggcggcagaaaggcccaggaggaggaguucagaagcgagagcugggagccccagaacgagcuguggaucgagaucaccaagugcugcggccugagaagcagauggcugggcacccagcccagccccuacgccguguacagauucuucaccuucagcgaccacgacaccgccaucauccccgccagcaacaaccccuacuucagagaccaggccagauuccccgugcuggugaccagcgaccuggaccacuaccugagaagagaggcccugagcauccacguguucgacgacgaggaccuggagcccggcagcuaccugggcagagccagagugccccugcugccccuggccaagaacgagagcaucaagggcgacuucaaccugaccgaccccgccgagaagcccaacggcagcauccaggugcagcuggacuggaaguuccccuacaucccccccgagagcuuccugaagcccgaggcccagaccaagggcaaggacaccaaggacagcagcaagaucagcagcgaggaggagaaggccagcuuccccagccaggaccagauggccagccccgaggugcccaucgaggccggccaguacagaagcaagagaaagcccccccacggcggcgagagaaaggagaaggagcaccagguggugagcuacagcagaagaaagcacggcaagagaaucggcgugcagggcaagaacagaauggaguaccugagccugaacauccugaacggcaacacccccgagcaggugaacuacaccgaguggaaguucagcgagaccaacagcuucaucggcgacggcuucaagaaccagcacgaggaggaggagaugacccugagccacagcgcccugaagcagaaggagccccugcaccccgugaacgacaaggagagcagcgagcagggcagcgaggugagcgaggcccagaccaccgacagcgacgacgugaucgugccccccaugagccagaaguaccccaaggccgacagcgagaagaugugcaucgagaucgugagccuggccuucuaccccgaggccgaggugaugagcgacgagaacaucaagcagguguacguggaguacaaguucuacgaccugccccugagcgagaccgagacccccgugagccugagaaagcccagagccggcgaggagauccacuuccacuucagcaaggugaucgaccuggacccccaggagcagcagggcagaagaagauuccuguucgacaugcugaacggccaggaccccgaccagggccaccugaaguucaccguggugagcgacccccuggacgaggagaagaaggagugcgaggaggugggcuacgccuaccugcagcuguggcagauccuggagagcggcagagacauccuggagcaggagcuggacaucgugagccccgaggaccuggccacccccaucggcagacugaaggugagccugcaggccgccgccgugcugcacgccaucuacaaggagaugaccgaggaccuguucagcuaa

SEQ ID NO: 22795 - RNA, 3708 nt, Artificial Sequence
  RPGRIP1L__Homo_sapiens__NP_001121369
augagcggccccaccgacgagaccgccggcgaccugcccgugaaggacaccggccugaaccuguucggcaugggcggccugcaggagaccagcaccaccagaaccaugaagagcagacaggccgugagcagagugagcagagaggagcuggaggacagauuccugagacugcacgacgagaacauccugcugaagcagcacgccagaaagcaggaggacaagaucaagagaauggccaccaagcugaucagacuggugaacgacaagaagagauacgagagagugggcggcggccccaagagacugggcagagacguggagauggaggagaugaucgagcagcugcaggagaaggugcacgagcuggagaagcagaacgagacccugaagaacagacugaucagcgccaagcagcagcugcagacccagggcuacagacagacccccuacaacaacgugcagagcagaaucaacaccggcagaagaaaggccaacgagaacgccggccugcaggagugccccagaaagggcaucaaguuccaggacgccgacguggccgagaccccccaccccauguucaccaaguacggcaacagccugcuggaggaggccagaggcgagaucagaaaccuggagaacgugauccagagccagagaggccagaucgaggagcuggagcaccuggccgagauccugaagacccagcugagaagaaaggagaacgagaucgagcugagccugcugcagcugagagagcagcaggccaccgaccagagaagcaacaucagagacaacguggagaugaucaagcugcacaagcagcugguggagaagagcaacgcccugagcgccauggagggcaaguucauccagcugcaggagaagcagagaacccugagaaucagccacgacgcccugauggccaacggcgacgagcugaacaugcagcugaaggagcagagacugaagugcugcagccuggagaagcagcugcacagcaugaaguucagcgagagaagaaucgaggagcugcaggacagaaucaacgaccuggagaaggagagagagcugcugaaggagaacuacgacaagcuguacgacagcgccuucagcgccgcccacgaggagcaguggaagcugaaggagcagcagcugaaggugcagaucgcccagcuggagaccgcccugaagagcgaccugaccgacaagaccgagauccuggacagacugaagaccgagagagaccagaacgagaagcuggugcaggagaacagagagcugcagcugcaguaccuggagcagaagcagcagcuggacgagcugaagaagagaaucaagcuguacaaccaggagaacgacaucaacgccgacgagcugagcgaggcccugcugcugaucaaggcccagaaggagcagaagaacggcgaccugagcuuccuggugaagguggacagcgagaucaacaaggaccuggagagaagcaugagagagcugcaggccacccacgccgagaccgugcaggagcuggagaagaccagaaacaugcugaucaugcagcacaagaucaacaaggacuaccagauggagguggaggccgugaccagaaagauggagaaccugcagcaggacuacgagcugaagguggagcaguacgugcaccugcuggacaucagagccgccagaauccacaagcuggaggcccagcugaaggacaucgccuacggcaccaagcaguacaaguucaagcccgagaucaugcccgacgacagcguggacgaguucgacgagaccauccaccuggagagaggcgagaaccuguucgagauccacaucaacaaggugaccuucagcagcgaggugcugcaggccagcggcgacaaggagcccgugaccuucugcaccuacgccuucuacgacuucgagcugcagaccacccccguggugagaggccugcaccccgaguacaacuucaccagccaguaccuggugcacgugaacgaccuguuccugcaguacauccagaagaacaccaucacccuggaggugcaccaggccuacagcaccgaguacgagaccaucgccgccugccagcugaaguuccacgagauccuggagaagagcggcagaaucuucugcaccgccagccugaucggcaccaagggcgacauccccaacuucggcaccguggaguacugguucagacugagagugcccauggaccaggccaucagacuguacagagagagagccaaggcccugggcuacaucaccagcaacuucaagggccccgagcacaugcagagccugagccagcaggcccccaagaccgcccagcugagcagcaccgacagcaccgacggcaaccugaacgagcugcacaucaccaucagaugcugcaaccaccugcagagcagagccagccaccugcagccccaccccuacgugguguacaaguucuucgacuucgccgaccacgacaccgccaucauccccagcagcaacgacccccaguucgacgaccacauguacuuccccgugcccaugaacauggaccuggacagauaccugaagagcgagagccugagcuucuacguguucgacgacagcgacacccaggagaacaucuacaucggcaaggugaacgugccccugaucagccuggcccacgacagaugcaucagcggcaucuucgagcugaccgaccaccagaagcaccccgccggcaccauccacgugauccugaaguggaaguucgccuaccugccccccagcggcagcaucaccaccgaggaccugggcaacuucaucagaagcgaggagcccgagguggugcagagacugccccccgccagcagcgugagcacccuggugcuggcccccagacccaagcccagacagagacugacccccguggacaagaaggugagcuucguggacaucaugccccaccagagcgacgugagccaggagggcagcguggacgaggugaaggagaacaccgagaagaugcagcagggcaaggacgacgugagccugcugagcgagggccagcuggccgagcagagccuggccagcagcgaggacgagaccgagaucaccgaggaccuggagcccgagguggaggaggacaugagcgccagcgacagcgacgacugcaucauccccggccccaucagcaagaacaucaagcagcccagcgagaagaucagaaucgagaucaucgcccugagccugaacgacagccaggugaccauggacgacaccauccagagacuguucguggagugcagauucuacagccugcccgccgaggagacccccgugagccugcccaagcccaagagcggccaguggguguacuacaacuacagcaacgugaucuacguggacaaggagaacaacaaggccaagagagacauccugaaggccauccugcagaagcaggagaugcccaacagaagccugagauucaccguggugagcgacccccccgaggacgagcaggaccuggagugcgaggacaucggcguggcccacguggaccuggccgacauguuccaggagggcagagaccugaucgagcagaacaucgacguguucgacgccagagccgacggcgagggcaucggcaagcugagagugaccguggaggcccugcacgcccugcagagcguguacaagcaguacagagacgaccuggaggccuaa

SEQ ID NO: 22796 - RNA, 2085 nt, Artificial Sequence
  RPH3A__Homo_sapiens__NP_001137326
augaccgacaccguguucagcaacagcagcaacagauggauguaccccagcgacagaccccugcagagcaacgacaaggagcagcugcaggccggcuggagcgugcaccccggcggccagcccgacagacagagaaagcaggaggagcugaccgacgaggagaaggagaucaucaacagagugaucgccagagccgagaagauggaggagauggagcaggagagaaucggcagacugguggacagacuggagaacaugagaaagaacguggccggcgacggcgugaacagaugcauccugugcggcgagcagcugggcaugcugggcagcgccugcguggugugcgaggacugcaagaagaacgugugcaccaagugcggcguggagaccaacaacagacugcacagcguguggcugugcaagaucugcaucgagcagagagagguguggaagagaagcggcgccugguucuucaagggcuuccccaagcaggugcugccccagcccaugcccaucaagaagaccaagccccagcagcccgugagcgagcccgccgcccccgagcagcccgcccccgagcccaagcaccccgccagagcccccgccagaggcgacagcgaggacagaagaggccccggccagaagaccggccccgaccccgccagcgcccccggcagaggcaacuacggcccccccgugagaagagccagcgaggccagaaugagcagcagcagcagagacagcgagagcugggaccacagcggcggcgccggcgacagcagcagaagccccgccggccugagaagagccaacagcgugcaggccagcagacccgcccccggcagcgugcagagccccgcccccccccagcccggccagcccggcacccccggcggcagcagacccggccccggccccgccggcagauuccccgaccagaagcccgagguggcccccagcgaccccggcaccaccgccccccccagagaggagagaaccggcggcgugggcggcuaccccgccgugggcgccagagaggacagaaugagccaccccagcggccccuacagccaggccagcgccgccgccccccagcccgccgccgccagacagccccccccccccgaggaggaggaggaggaggccaacagcuacgacagcgacgaggccaccacccugggcgcccuggaguucagccugcuguacgaccaggacaacagcagccugcagugcaccaucaucaaggccaagggccugaagcccauggacagcaacggccuggccgaccccuacgugaagcugcaccugcugcccggcgccagcaagagcaacaagcugagaaccaagacccugagaaacaccagaaaccccaucuggaacgagacccugguguaccacggcaucaccgacgaggacaugcagagaaagacccugagaaucagcgugugcgacgaggacaaguucggccacaacgaguucaucggcgagaccagauucagccugaagaagcugaagcccaaccagagaaagaacuucaacaucugccuggagagagugauccccaugaagagagccggcaccaccggcagcgccagaggcauggcccuguacgaggaggagcagguggagagagugggcgacaucgaggagagaggcaagauccuggugagccugauguacagcacccagcagggcggccugaucgugggcaucaucagaugcgugcaccuggccgccauggacgccaacggcuacagcgaccccuucgugaagcuguggcugaagcccgacaugggcaagaaggccaagcacaagacccagaucaagaagaagacccugaaccccgaguucaacgaggaguucuucuacgacaucaagcacagcgaccuggccaagaagagccuggacaucagcgugugggacuacgacaucggcaagagcaacgacuacaucggcggcugccagcugggcaucagcgccaagggcgagagacugaagcacugguacgagugccugaagaacaaggacaagaagaucgagagauggcaccagcugcagaacgagaaccacgugagcagcgacuaa

SEQ ID NO: 22797 - RNA, 948 nt, Artificial Sequence
  RPH3AL__Homo_sapiens__XP_011545302
auggccgacaccaucuucggcagcggcaacgaccagugggugugccccaacgacagacagcuggcccugagagccaagcugcagaccggcuggagcgugcacaccuaccagaccgagaagcagagaagaaagcagcaccugagccccgccgagguggaggccauccugcaggugauccagagagccgagagacuggacgugcuggagcagcagagaaucggcagacugguggagagacuggagaccaugagaagaaacgugaugggcaacggccugagccagugccugcugugcggcgaggugcugggcuuccugggcagcagcagcguguucugcaaggacugcagaaagaaggugugcaccaagugcggcaucgaggccagccccggccagaagagaccccuguggcugugcaagaucugcagcgagcagagagagguguggaagagaagcggcgccugguucuacaagggccugcccaaguacauccugccccugaagacccccggcagagccgacgacccccacuucagaccccugcccaccgagcccgccgagagagagcccagaagcagcgagaccagcagaaucuacaccugggccagaggcagaguggugagcagcgacagcgacagcgacagcgaccugagcagcagcagccuggaggacagacugcccagcaccggcgugagagacagaaagggcgacaagcccuggaaggagagcggcggcagcguggaggcccccagaaugggcuucacccacccccccggccaccugagcggcugccagagcagccuggccagcggcgagaccggcaccggcagcgccgacccccccggcggccccagacccggccugaccagaagagcccccgugaaggacacccccggcagagcccccgccgccgacgccgcccccgccggccccagcagcugccugggcuaa

SEQ ID NO: 22798 - RNA, 936 nt, Artificial Sequence
  RPIA__Homo_sapiens__NP_653164
augcagagacccggccccuucagcacccuguacggcagagugcuggccccccugcccggcagagccggcggcgccgccagcggcggcggcggcaacagcugggaccugcccggcagccacgugagacugcccggcagagcccagagcggcaccagaggcggcgccggcaacaccagcaccagcugcggcgacagcaacagcaucugccccgcccccagcaccaugagcaaggccgaggaggccaagaagcuggccggcagagccgccguggagaaccacgugagaaacaaccaggugcugggcaucggcagcggcagcaccaucgugcacgccgugcagagaaucgccgagagagugaagcaggagaaccugaaccuggugugcauccccaccagcuuccaggccagacagcugauccugcaguacggccugacccugagcgaccuggacagacaccccgagaucgaccuggccaucgacggcgccgacgagguggacgccgaccugaaccugaucaagggcggcggcggcugccugacccaggagaagaucguggccggcuacgccagcagauucaucgugaucgccgacuucagaaaggacagcaagaaccugggcgaccaguggcacaagggcauccccaucgaggugauccccauggccuacgugcccgugagcagagccgugagccagaaguucggcggcgugguggagcugagaauggccgugaacaaggccggccccguggugaccgacaacggcaacuucauccuggacuggaaguucgacagagugcacaaguggagcgaggugaacaccgccaucaagaugauccccggcgugguggacaccggccuguucaucaacauggccgagagaguguacuucggcaugcaggacggcagcgugaacaugagagagaagcccuucugcuaa

SEQ ID NO: 22799 - RNA, 654 nt, Artificial Sequence
  RPL10A__Homo_sapiens__NP_009035
augagcagcaaggugagcagagacacccuguacgaggccgugagagaggugcugcacggcaaccagagaaagagaagaaaguuccuggagaccguggagcugcagaucagccugaagaacuacgacccccagaaggacaagagauucagcggcaccgugagacugaagagcacccccagacccaaguucagcgugugcgugcugggcgaccagcagcacugcgacgaggccaaggccguggacaucccccacauggacaucgaggcccugaagaagcugaacaagaacaagaagcuggugaagaagcuggccaagaaguacgacgccuuccuggccagcgagagccugaucaagcagauccccagaauccugggccccggccugaacaaggccggcaaguuccccagccugcugacccacaacgagaacaugguggccaagguggacgaggugaagagcaccaucaaguuccagaugaagaaggugcugugccuggccguggccgugggccacgugaagaugaccgacgacgagcugguguacaacauccaccuggccgugaacuuccuggugagccugcugaagaagaacuggcagaacgugagagcccuguacaucaagagcaccaugggcaagccccagagacuguacuaa

SEQ ID NO: 22800 - RNA, 651 nt, Artificial Sequence
  RPL10__Homo_sapiens__NP_001243506
augggcagaagacccgccagaugcuacagauacugcaagaacaagcccuaccccaagagcagauucugcagaggcgugcccgacgccaagaucagaaucuucgaccugggcagaaagaaggccaagguggacgaguucccccugugcggccacauggugagcgacgaguacgagcagcugagcagcgaggcccuggaggccgccagaaucugcgccaacaaguacauggugaagagcugcggcaaggacggcuuccacaucagagugagacugcaccccuuccacgugaucagaaucaacaagaugcugagcugcgccggcgccgacagaagcaccagccagagaagcggcgccagccccagcagcaugcugaugaaccugaagaccugguggcugaagagcggcagcagccagauggccgugggcagcagcaccagccccgugguggcccuguggaccagcggcggccccugcacccacgagggcuuccagugcgccgccccccugcugauccugaccaacaaguucuacuuccugagcaccuacguguucgugagcaccuuccugaccggcaaggagcugccccugggcaccuucggcagccugcccuuccacuucagaaacagacugaccacccagcccugcagcuaa

SEQ ID NO: 22801 - RNA, 645 nt, Artificial Sequence
  RPL10L__Homo_sapiens__NP_542784
augggcagaagacccgccagaugcuacagauacugcaagaacaagcccuaccccaagagcagauucugcagaggcgugcccgacgccaagaucagaaucuucgaccugggcagaaagaaggccaagguggacgaguucccccugggcggccacauggugagcgacgaguacgagcagcugagcagcgaggcccuggaggccgccagaaucugcgccaacaaguacauggugaagagcugcggcagagacggcuuccacaugagagugagacugcaccccuuccacgugaucagaaucaacaagaugcugagcugcgccggcgccgacagacugcagaccggcaugagaggcgccuucggcaagccccagggcaccguggccagagugcacaucggccaggugaucaugagcaucagaaccaagcugcagaacgaggagcacgugaucgaggcccugagaagagccaaguucaaguuccccggcagacagaagauccacaucagcaagaaguggggcuucaccaaguucaacgccgacgaguucgaggacaugguggccaagaagugccugauccccgacggcugcggcgugaaguacgugcccagccacggcccccuggacaaguggagagugcugcacagcuaa

SEQ ID NO: 22802 - RNA, 498 nt, Artificial Sequence
  RPL12__Homo_sapiens__NP_000967
augccccccaaguucgaccccaacgagaucaaggugguguaccugagaugcaccggcggcgaggugggcgccaccagcgcccuggcccccaagaucggcccccugggccugagccccaagaaggugggcgacgacaucgccaaggccaccggcgacuggaagggccugagaaucaccgugaagcugaccauccagaacagacaggcccagaucgagguggugcccagcgccagcgcccugaucaucaaggcccugaaggagccccccagagacagaaagaagcagaagaacaucaagcacagcggcaacaucaccuucgacgagaucgugaacaucgccagacagaugagacacagaagccuggccagagagcugagcggcaccaucaaggagauccugggcaccgcccagagcgugggcugcaacguggacggcagacacccccacgacaucaucgacgacaucaacagcggcgccguggagugccccgccagcuaa

SEQ ID NO: 22803 - RNA, 495 nt, Artificial Sequence
  RPL13__Homo_sapiens__NP_001230060
auggcccccagcagaaacggcauggugcugaagccccacuuccacaaggacuggcagagaagaguggccaccugguucaaccagcccgccagaaagaucagaagaagaaaggccagacaggccaaggccagaagaaucgcccccagacccgccagcggccccaucagacccaucgugagaugccccaccgugagauaccacaccaaggugagagccggcagaggcuucagccuggaggagcugagaguggccggcauccacaagaagggcgacagcagcgccgaggagcugaagcuggccacccagcugaccggccccgugaugcccgugagaaacguguacaagaaggagaaggccagagugaucaccgaggaggagaagaacuucaaggccuucgccagccugagaauggccagagccaacgccagacuguucggcaucagagccaagagagccaaggaggccgccgagcaggacguggagaagaagaaguaa

SEQ ID NO: 22804 - RNA, 648 nt, Artificial Sequence
  RPL14__Homo_sapiens__NP_001030168
augguguucagaagauucguggaggugggcagaguggccuacgugagcuucggcccccacgccggcaagcugguggccaucguggacgugaucgaccagaacagagcccugguggacggccccugcacccaggugagaagacaggccaugcccuucaagugcaugcagcugaccgacuucauccugaaguucccccacagcgcccaccagaaguacgugagacaggccuggcagaaggccgacaucaacaccaagugggccgccaccagaugggccaagaagaucgaggccagagagagaaaggccaagaugaccgacuucgacagauucaaggugaugaaggccaagaagaugagaaacagaaucaucaagaacgaggugaagaagcugcagaaggccgcccugcugaaggccagccccaagaaggcccccggcaccaagggcaccgccgccgccgccgccgccgccgccgccgccaaggugcccgccaagaagaucaccgccgccagcaagaaggcccccgcccagaaggugcccgcccagaaggccaccggccagaaggccgcccccgcccccaaggcccagaagggccagaaggcccccgcccagaaggcccccgcccccaaggccagcggcaagaaggccuaa

SEQ ID NO: 22805 - RNA, 438 nt, Artificial Sequence
  RPL15__Homo_sapiens__NP_001240313
augggcgccuacaaguacauccaggagcuguggagaaagaagcagagcgacgugaugagauuccugcugagagugagaugcuggcaguacagacagcugagcgcccugcacagagcccccagacccaccagacccgacaaggccagaagacugggcuacaaggccaagcagggcuacgugaucuacagaaucagagugagaagaggcggcagaaagagacccgugcccaagggcgccaccuacggcaagcccgugcaccacggcgugaaccagcugaaguucgccagaagccugcagagcguggccgaggagagagccggcagacacugcggcgcccugagagugcugaacagcuacuggauggagagccacagccacagcggcggcagcgccgugggccagagcagacugaccgccaccagcgugagcagaguguaa

SEQ ID NO: 22806 - RNA, 687 nt, Artificial Sequence
  RPL17-C18orf32__Homo_sapiens__NP_001186284
auggugagauacagccuggaccccgagaaccccaccaagagcugcaagagcagaggcagcaaccugagagugcacuucaagaacaccagagagaccgcccaggccaucaagggcaugcacaucagaaaggccaccaaguaccugaaggacgugacccugcagaagcagugcgugcccuucagaagauacaacggcggcgugggcagaugcgcccaggccaagcaguggggcuggacccagggcagauggcccaagaagagcgccgaguuccugcugcacaugcugaagaacgccgagagcaacgccgagcugaagggccuggacguggacagccuggugaucgagcacauccaggugaacaaggcccccaagaugagaagaagaaccuacagagcccacggcagaaucaaccccuacaugagcagccccugccacaucgagaugauccugaccgagaaggagcagaucgugcccaagcccgaggaggagguggcccagaagaagaagcugagaagcagcagccugggcaaguggugcgccuuccuggugagcagcuuccaguucugcagcggcagcaccaagaacagcuggagccacaucuacacccugugguucccccccagccuggugguguacggccugagaaagcaguacaagaaccccaugauccagaccaaggccaaguaa

SEQ ID NO: 22807 - RNA, 555 nt, Artificial Sequence
  RPL17__Homo_sapiens__NP_001030178
auggugagauacagccuggaccccgagaaccccaccaagagcugcaagagcagaggcagcaaccugagagugcacuucaagaacaccagagagaccgcccaggccaucaagggcaugcacaucagaaaggccaccaaguaccugaaggacgugacccugcagaagcagugcgugcccuucagaagauacaacggcggcgugggcagaugcgcccaggccaagcaguggggcuggacccagggcagauggcccaagaagagcgccgaguuccugcugcacaugcugaagaacgccgagagcaacgccgagcugaagggccuggacguggacagccuggugaucgagcacauccaggugaacaaggcccccaagaugagaagaagaaccuacagagcccacggcagaaucaaccccuacaugagcagccccugccacaucgagaugauccugaccgagaaggagcagaucgugcccaagcccgaggaggagguggcccagaagaagaagaucagccagaagaagcugaagaagcagaagcugauggccagagaguaa

SEQ ID NO: 22808 - RNA, 567 nt, Artificial Sequence
  RPL18__Homo_sapiens__NP_000970
augggcguggacaucagacacaacaaggacagaaaggugagaagaaaggagcccaagagccaggacaucuaccugagacugcuggugaagcuguacagauuccuggccagaagaaccaacagcaccuucaaccagguggugcugaagagacuguucaugagcagaaccaacagacccccccugagccugagcagaaugaucagaaagaugaagcugcccggcagagagaacaagaccgccgugguggugggcaccaucaccgacgacgugagagugcaggaggugcccaagcugaaggugugcgcccugagagugaccagcagagccagaagcagaauccugagagccggcggcaagauccugaccuucgaccagcuggcccuggacagccccaagggcugcggcaccgugcugcugagcggccccagaaagggcagagagguguacagacacuucggcaaggcccccggcaccccccacagccacaccaagcccuacgugagaagcaagggcagaaaguucgagagagccagaggcagaagagccagcagaggcuacaagaacuaa

SEQ ID NO: 22809 - RNA, 591 nt, Artificial Sequence
  RPL19__Homo_sapiens__NP_000972
augagcaugcugagacugcagaagagacuggccagcagcgugcugagaugcggcaagaagaagguguggcuggaccccaacgagaccaacgagaucgccaacgccaacagcagacagcagaucagaaagcugaucaaggacggccugaucaucagaaagcccgugaccgugcacagcagagccagaugcagaaagaacacccuggccagaagaaagggcagacacaugggcaucggcaagagaaagggcaccgccaacgccagaaugcccgagaaggugaccuggaugagaagaaugagaauccugagaagacugcugagaagauacagagagagcaagaagaucgacagacacauguaccacagccuguaccugaaggugaagggcaacguguucaagaacaagagaauccugauggagcacauccacaagcugaaggccgacaaggccagaaagaagcugcuggccgaccaggccgaggccagaagaagcaagaccaaggaggccagaaagagaagagaggagagacugcaggccaagaaggaggagaucaucaagacccugagcaaggaggaggagaccaagaaguaa

SEQ ID NO: 22810 - RNA, 483 nt, Artificial Sequence
  RPL21__Homo_sapiens__NP_000973
augaccaacaccaagggcaagagaagaggcaccagauacauguucagcagacccuucagaaagcacggcguggugccccuggccaccuacaugagaaucuacaagaagggcgacaucguggacaucaagggcaugggcaccgugcagaagggcaugccccacaagugcuaccacggcaagaccggcagaguguacaacgugacccagcacgccgugggcaucguggugaacaagcaggugaagggcaagauccuggccaagagaaucaacgugagaaucgagcacaucaagcacagcaagagcagagacagcuuccugaagagagugaaggagaacgaccagaagaagaaggaggccaaggagaagggcaccugggugcagcugaagagacagcccgccccccccagagaggcccacuucgugagaaccaacggcaaggagcccgagcugcuggagcccauccccuacgaguucauggccuaa

SEQ ID NO: 22811 - RNA, 471 nt, Artificial Sequence
  RPL23A__Homo_sapiens__NP_000975
auggcccccaaggccaagaaggaggcccccgccccccccaaggccgaggccaaggccaaggcccugaaggccaagaaggccgugcugaagggcgugcacagccacaagaagaagaagaucagaaccagccccaccuucagaagacccaagacccugagacugagaagacagcccaaguaccccagaaagagcgcccccagaagaaacaagcuggaccacuacgccaucaucaaguucccccugaccaccgagagcgccaugaagaagaucgaggacaacaacacccugguguucaucguggacgugaaggccaacaagcaccagaucaagcaggccgugaagaagcuguacgacaucgacguggccaaggugaacacccugaucagacccgacggcgagaagaaggccuacgugagacuggcccccgacuacgacgcccuggacguggccaacaagaucggcaucaucuaa

SEQ ID NO: 22812 - RNA, 423 nt, Artificial Sequence
  RPL23__Homo_sapiens__NP_000969
augagcaagagaggcagaggcggcagcagcggcgccaaguucagaaucagccugggccugcccgugggcgccgugaucaacugcgccgacaacaccggcgccaagaaccuguacaucaucagcgugaagggcaucaagggcagacugaacagacugcccgccgccggcgugggcgacauggugauggccaccgugaagaagggcaagcccgagcugagaaagaaggugcaccccgccguggugaucagacagagaaagagcuacagaagaaaggacggcguguuccuguacuucgaggacaacgccggcgugaucgugaacaacaagggcgagaugaagggcagcgccaucaccggccccguggccaaggagugcgccgaccuguggcccagaaucgccagcaacgccggcagcaucgccuaa

SEQ ID NO: 22813 - RNA, 474 nt, Artificial Sequence
  RPL24__Homo_sapiens__NP_000977
augaagguggagcugugcagcuucagcggcuacaagaucuaccccggccacggcagaagauacgccagaaccgacggcaagguguuccaguuccugaacgccaagugcgagagcgccuuccugagcaagagaaaccccagacagaucaacuggaccgugcuguacagaagaaagcacaagaagggccagagcgaggagauccagaagaagagaaccagaagagccgugaaguuccagagagccaucaccggcgccagccuggccgacaucauggccaagagaaaccagaagcccgaggugagaaaggcccagagagagcaggccaucagagccgccaaggaggccaagaaggccaagcaggccagcaagaagaccgccauggccgccgccaaggcccccaccaaggccgcccccaagcagaagaucgugaagcccgugaaggugagcgcccccagagugggcggcaagagauaa

SEQ ID NO: 22814 - RNA, 447 nt, Artificial Sequence
  RPL27A__Homo_sapiens__NP_000981
augcccagcagacugagaaagaccagaaagcugagaggccacgugagccacggccacggcagaaucggcaagcacagaaagcaccccggcggcagaggcaacgccggcggccugcaccaccacagaaucaacuucgacaaguaccaccccggcuacuucggcaaggugggcaugaagcacuaccaccugaagagaaaccagagcuucugccccaccgugaaccuggacaagcuguggacccuggugagcgagcagaccagagugaacgccgccaagaacaagaccggcgccgcccccaucaucgacguggugagaagcggcuacuacaaggugcugggcaagggcaagcugcccaagcagcccgugaucgugaaggccaaguucuucagcagaagagccgaggagaagaucaagagcgugggcggcgccugcgugcugguggccuaa

SEQ ID NO: 22815 - RNA, 480 nt, Artificial Sequence
  RPL29__Homo_sapiens__NP_000983
auggccaagagcaagaaccacaccacccacaaccagagcagaaaguggcacagaaacggcaucaagaagcccagaagccagagauacgagagccugaagggcguggaccccaaguuccugagaaacaugagauucgccaagaagcacaacaagaagggccugaagaagaugcaggccaacaacgccaaggccaugagcgccagagccgaggccaucaaggcccuggugaagcccaaggaggugaagcccaagauccccaagggcgugagcagaaagcuggacagacuggccuacaucgcccaccccaagcugggcaagagagccagagccagaaucgccaagggccugagacugugcagacccaaggccaaggccaaggccaaggccaaggaccagaccaaggcccaggccgccgcccccgccagcgugcccgcccaggcccccaagagaacccaggcccccaccaaggccagcgaguaa

SEQ ID NO: 22816 - RNA, 348 nt, Artificial Sequence
  RPL30__Homo_sapiens__NP_000980
augguggccgccaagaagaccaagaagagccuggagagcaucaacagcagacugcagcuggugaugaagagcggcaaguacgugcugggcuacaagcagacccugaagaugaucagacagggcaaggccaagcuggugauccuggccaacaacugccccgcccugagaaagagcgagaucgaguacuacgccaugcuggccaagaccggcgugcaccacuacagcggcaacaacaucgagcugggcaccgccugcggcaaguacuacagagugugcacccuggccaucaucgaccccggcgacagcgacaucaucagaagcaugcccgagcagaccggcgagaaguaa

SEQ ID NO: 22817 - RNA, 378 nt, Artificial Sequence
  RPL31__Homo_sapiens__NP_000984
auggcccccgccaagaagggcggcgagaagaagaagggcagaagcgccaucaacgagguggugaccagagaguacaccaucaacauccacaagagaauccacggcgugggcuucaagaagagagcccccagagcccugaaggagaucagaaaguucgccaugaaggagaugggcacccccgacgugagaaucgacaccagacugaacaaggccgugugggccaagggcaucagaaacgugcccuacagaaucagagugagacugagcagaaagagaaacgaggacgaggacagccccaacaagcuguacacccuggugaccuacgugcccgugaccaccuucaagaaccugcagaccgugaacguggacgagaacuaa

SEQ ID NO: 22818 - RNA, 354 nt, Artificial Sequence
  RPL34__Homo_sapiens__NP_001306164
auggugcagagacugaccuacagaagaagacugagcuacaacaccgccagcaacaagaccagacugagcagaacccccggcaacagaaucguguaccuguacaccaagaaggugggcaaggcccccaagagcgccugcggcgugugccccggcagacugagaggcgugagagccgugagacccaaggugcugaugagacugagcaagaccaagaagcacgugagcagagccuacggcggcagcaugugcgccaagugcgugagagacagaaucaagagagccuuccugaucgaggagcagaagaucguggugaaggugcugaaggcccaggcccagagccagaaggccaaguaa

SEQ ID NO: 22819 - RNA, 372 nt, Artificial Sequence
  RPL35__Homo_sapiens__NP_009140
auggccaagaucaaggccagagaccugagaggcaagaagaaggaggagcugcugaagcagcuggacgaccugaagguggagcugagccagcugagaguggccaaggugaccggcggcgccgccagcaagcugagcaagaucagaguggugagaaagagcaucgccagagugcugaccgugaucaaccagacccagaaggagaaccugagaaaguucuacaagggcaagaaguacaagccccuggaccugagacccaagaagaccagagccaugagaagaagacugaacaagcacgaggagaaccugaagaccaagaagcagcagagaaaggagagacuguacccccugagaaaguacgccgugaaggccuaa

SEQ ID NO: 22820 - RNA, 429 nt, Artificial Sequence
  RPL36A__Homo_sapiens__NP_066357
augaucgcccccaccgacagccacgaggaggugagaagcggcaccagcuacauccugcccuucgccagcagauuccugagcuucagagccgacagcgcccacgccagcauggugaacgugcccaagaccagaagaaccuucugcaagaagugcggcaagcaccagccccacaaggugacccaguacaagaagggcaaggacagccuguacgcccagggcaagagaagauacgacagaaagcagagcggcuacggcggccagaccaagcccaucuucagaaagaaggccaagaccaccaagaagaucgugcugagacuggagugcguggagcccaacugcagaagcaagagaaugcuggccaucaagagaugcaagcacuucgagcugggcggcgacaagaagagaaagggccaggugauccaguucuaa

SEQ ID NO: 22821 - RNA, 321 nt, Artificial Sequence
  RPL36AL__Homo_sapiens__NP_000992
auggugaacgugcccaagaccagaagaaccuucugcaagaagugcggcaagcaccagccccacaaggugacccaguacaagaagggcaaggacagccuguacgcccagggcagaagaagauacgacagaaagcagagcggcuacggcggccagaccaagcccaucuucagaaagaaggccaagaccaccaagaagaucgugcugagacuggagugcguggagcccaacugcagaagcaagagaaugcuggccaucaagagaugcaagcacuucgagcugggcggcgacaagaagagaaagggccaggugauccaguucuaa

SEQ ID NO: 22822 - RNA, 279 nt, Artificial Sequence
  RPL37A__Homo_sapiens__NP_000989
auggccaagagaaccaagaaggugggcaucgugggcaaguacggcaccagauacggcgccagccugagaaagauggugaagaagaucgagaucagccagcacgccaaguacaccugcagcuucugcggcaagaccaagaugaagagaagagccgugggcaucuggcacugcggcagcugcaugaagaccguggccggcggcgccuggaccuacaacaccaccagcgccgugaccgugaagagcgccaucagaagacugaaggagcugaaggaccaguaa

SEQ ID NO: 22823 - RNA, 213 nt, Artificial Sequence
  RPL38__Homo_sapiens__NP_000990
augcccagaaagaucgaggagaucaaggacuuccugcugaccgccagaagaaaggacgccaagagcgugaagaucaagaagaacaaggacaacgugaaguucaaggugagaugcagcagauaccuguacacccuggugaucaccgacaaggagaaggccgagaagcugaagcagagccugccccccggccuggccgugaaggagcugaaguaa

SEQ ID NO: 22824 - RNA, 156 nt, Artificial Sequence
  RPL39__Homo_sapiens__NP_000991
augagcagccacaagaccuucagaaucaagagauuccuggccaagaagcagaagcagaacagacccaucccccaguggaucagaaugaagaccggcaacaagaucagauacaacagcaagagaagacacuggagaagaaccaagcugggccuguaa

SEQ ID NO: 22825 - RNA, 156 nt, Artificial Sequence
  RPL39L__Homo_sapiens__NP_443201
augagcagccacaagaccuucaccaucaagagauuccuggccaagaagcagaagcagaacagacccaucccccaguggauccagaugaagcccggcagcaagaucagauacaacagcaagagaagacacuggagaagaaccaagcugggccuguaa

SEQ ID NO: 22826 - RNA, 1212 nt, Artificial Sequence
  RPL3__Homo_sapiens__NP_000958
augagccacagaaaguucagcgcccccagacacggcagccugggcuuccugcccagaaagagaagcagcagacacagaggcaaggugaagagcuuccccaaggacgaccccagcaagcccgugcaccugaccgccuuccugggcuacaaggccggcaugacccacaucgugagagagguggacagacccggcagcaaggugaacaagaaggaggugguggaggccgugaccaucguggagaccccccccauggugguggugggcaucgugggcuacguggagacccccagaggccugagaaccuucaagaccguguucgccgagcacaucagcgacgagugcaagagaagauucuacaagaacuggcacaagagcaagaagaaggccuucaccaaguacugcaagaaguggcaggacgaggacggcaagaagcagcuggagaaggacuucagcagcaugaagaaguacugccaggugaucagagugaucgcccacacccagaugagacugcugccccugagacagaagaaggcccaccugauggagauccaggugaacggcggcaccguggccgagaagcuggacugggccagagagagacuggagcagcaggugcccgugaaccagguguucggccaggacgagaugaucgacgugaucggcgugaccaagggcaagggcuacaagggcgugaccagcagauggcacaccaagaagcugcccagaaagacccacagaggccugagaaagguggccugcaucggcgccuggcaccccgccagaguggccuucagcguggccagagccggccagaagggcuaccaccacagaaccgagaucaacaagaagaucuacaagaucggccagggcuaccugaucaaggacggcaagcugaucaagaacaacgccagcaccgacuacgaccugagcgacaagagcaucaacccccugggcggcuucgugcacuacggcgaggugaccaacgacuucgugaugcugaagggcugcguggugggcaccaagaagagagugcugacccugagaaagagccugcuggugcagaccaagagaagagcccuggagaagaucgaccugaaguucaucgacaccaccagcaaguucggccacggcagauuccagaccauggaggagaagaaggccuucaugggcccccugaagaaggacagaaucgccaaggaggagggcgccuaa

SEQ ID NO: 22827 - RNA, 78 nt, Artificial Sequence
  RPL41__Homo_sapiens__NP_066927
augagagccaaguggagaaagaagagaaugagaagacugaagagaaagagaagaaagaugagacagagaagcaaguaa

SEQ ID NO: 22828 - RNA, 1284 nt, Artificial Sequence
  RPL4__Homo_sapiens__NP_000959
auggccugcgccagaccccugaucagcguguacagcgagaagggcgagagcagcggcaagaacgugacccugcccgccguguucaaggcccccaucagacccgacaucgugaacuucgugcacaccaaccugagaaagaacaacagacagcccuacgccgugagcgagcuggccggccaccagaccagcgccgagagcuggggcaccggcagagccguggccagaauccccagagugagaggcggcggcacccacagaagcggccagggcgccuucggcaacaugugcagaggcggcagaauguucgcccccaccaagaccuggagaagauggcacagaagagugaacaccacccagaagagauacgccaucugcagcgcccuggccgccagcgcccugcccgcccuggugaugagcaagggccacagaaucgaggaggugcccgagcugccccuggugguggaggacaagguggagggcuacaagaagaccaaggaggccgugcugcugcugaagaagcugaaggccuggaacgacaucaagaagguguacgccagccagagaaugagagccggcaagggcaagaugagaaacagaagaagaauccagagaagaggccccugcaucaucuacaacgaggacaacggcaucaucaaggccuucagaaacauccccggcaucacccugcugaacgugagcaagcugaacauccugaagcuggcccccggcggccacgugggcagauucugcaucuggaccgagagcgccuucagaaagcuggacgagcuguacggcaccuggagaaaggccgccagccugaagagcaacuacaaccugcccaugcacaagaugaucaacaccgaccugagcagaauccugaagagccccgagauccagagagcccugagagcccccagaaagaagauccacagaagagugcugaagaagaacccccugaagaaccugagaaucaugcugaagcugaaccccuacgccaagaccaugagaagaaacaccauccugagacaggccagaaaccacaagcugagaguggacaaggccgccgccgccgccgccgcccugcaggccaagagcgacgagaaggccgccguggccggcaagaagcccguggugggcaagaagggcaagaaggccgccgugggcgugaagaagcagaagaagccccuggugggcaagaaggccgccgccaccaagaagcccgcccccgagaagaagcccgccgagaagaagcccaccaccgaggagaagaagcccgccgccuaa

SEQ ID NO: 22829 - RNA, 867 nt, Artificial Sequence
  RPL6__Homo_sapiens__NP_001307069
auggccggcgagaagguggagaagcccgacaccaaggagaagaagcccgaggccaagaagguggacgccggcggcaaggugaagaagggcaaccugaaggccaagaagcccaagaagggcaagccccacugcagcagaaaccccgugcuggugagaggcaucggcagauacagcagaagcgccauguacagcagaaaggccauguacaagagaaaguacagcgccgccaagagcaagguggagaagaagaagaaggagaaggugcuggccaccgugaccaagcccgugggcggcgacaagaacggcggcaccagaguggugaagcugagaaagaugcccagauacuaccccaccgaggacgugcccagaaagcugcugagccacggcaagaagcccuucagccagcacgugagaaagcugagagccagcaucacccccggcaccauccugaucauccugaccggcagacacagaggcaagagagugguguuccugaagcagcuggccagcggccugcugcuggugaccggcccccuggugcugaacagagugccccugagaagaacccaccagaaguucgugaucgccaccagcaccaagaucgacaucagcaacgugaagauccccaagcaccugaccgacgccuacuucaagaagaagaagcugagaaagcccagacaccaggagggcgagaucuucgacaccgagaaggagaaguacgagaucaccgagcagagaaagaucgaccagaaggccguggacagccagauccugcccaagaucaaggccaucccccagcugcagggcuaccugagaagcguguucgcccugaccaacggcaucuacccccacaagcugguguucuaa

SEQ ID NO: 22830 - RNA, 801 nt, Artificial Sequence
  RPL7A__Homo_sapiens__NP_000963
augcccaagggcaagaaggccaagggcaagaagguggcccccgcccccgccguggugaagaagcaggaggccaagaagguggugaacccccuguucgagaagagacccaagaacuucggcaucggccaggacauccagcccaagagagaccugaccagauucgugaaguggcccagauacaucagacugcagagacagagagccauccuguacaagagacugaaggugccccccgccaucaaccaguucacccaggcccuggacagacagaccgccacccagcugcugaagcuggcccacaaguacagacccgagaccaagcaggagaagaagcagagacugcuggccagagccgagaagaaggccgccggcaagggcgacgugcccaccaagagaccccccgugcugagagccggcgugaacaccgugaccacccugguggagaacaagaaggcccagcugguggugaucgcccacgacguggaccccaucgagcuggugguguuccugcccgcccugugcagaaagaugggcgugcccuacugcaucaucaagggcaaggccagacugggcagacuggugcacagaaagaccugcaccaccguggccuucacccaggugaacagcgaggacaagggcgcccuggccaagcugguggaggccaucagaaccaacuacaacgacagauacgacgagaucagaagacacuggggcggcaacgugcugggccccaagagcguggccagaaucgccaagcuggagaaggccaaggccaaggagcuggccaccaagcugggcuaa

SEQ ID NO: 22831 - RNA, 747 nt, Artificial Sequence
  RPL7__Homo_sapiens__NP_000962
auggagggcguggaggagaagaagaaggaggugcccgccgugcccgagacccugaagaagaagagaagaaacuucgccgagcugaagaucaagagacugagaaagaaguucgcccagaagaugcugagaaaggccagaagaaagcugaucuacgagaaggccaagcacuaccacaaggaguacagacagauguacagaaccgagaucagaauggccagaauggccagaaaggccggcaacuucuacgugcccgccgagcccaagcuggccuucgugaucagaaucagaggcaucaacggcgugagccccaaggugagaaaggugcugcagcugcugagacugagacagaucuucaacggcaccuucgugaagcugaacaaggccagcaucaacaugcugagaaucguggagcccuacaucgccuggggcuaccccaaccugaagagcgugaacgagcugaucuacaagagaggcuacggcaagaucaacaagaagagaaucgcccugaccgacaacgcccugaucgccagaagccugggcaaguacggcaucaucugcauggaggaccugauccacgagaucuacaccgugggcaagagauucaaggaggccaacaacuuccuguggcccuucaagcugagcagccccagaggcggcaugaagaagaagaccacccacuucguggagggcggcgacgccggcaacagagaggaccagaucaacagacugaucagaagaaugaacuaa

SEQ ID NO: 22832 - RNA, 954 nt, Artificial Sequence
  RPLP0__Homo_sapiens__NP_000993
augcccagagaggacagagccaccuggaagagcaacuacuuccugaagaucauccagcugcuggacgacuaccccaagugcuucaucgugggcgccgacaacgugggcagcaagcagaugcagcagaucagaaugagccugagaggcaaggccguggugcugaugggcaagaacaccaugaugagaaaggccaucagaggccaccuggagaacaaccccgcccuggagaagcugcugccccacaucagaggcaacgugggcuucguguucaccaaggaggaccugaccgagaucagagacaugcugcuggccaacaaggugcccgccgccgccagagccggcgccaucgcccccugcgaggugaccgugcccgcccagaacaccggccugggccccgagaagaccagcuucuuccaggcccugggcaucaccaccaagaucagcagaggcaccaucgagauccugagcgacgugcagcugaucaagaccggcgacaaggugggcgccagcgaggccacccugcugaacaugcugaacaucagccccuucagcuucggccuggugauccagcagguguucgacaacggcagcaucuacaaccccgaggugcuggacaucaccgaggagacccugcacagcagauuccuggagggcgugagaaacguggccagcgugugccugcagaucggcuaccccaccguggccagcgugccccacagcaucaucaacggcuacaagagagugcuggcccugagcguggagaccgacuacaccuucccccuggccgagaaggugaaggccuuccuggccgaccccagcgccuucguggccgccgcccccguggccgccgccaccaccgccgcccccgccgccgccgccgcccccgccaagguggaggccaaggaggagagcgaggagagcgacgaggacaugggcuucggccuguucgacuaa

SEQ ID NO: 22833 - RNA, 345 nt, Artificial Sequence
  RPLP1__Homo_sapiens__NP_000994
auggccagcgugagcgagcuggccugcaucuacagcgcccugauccugcacgacgacgaggugaccgugaccgaggacaagaucaacgcccugaucaaggccgccggcgugaacguggagcccuucuggcccggccuguucgccaaggcccuggccaacgugaacaucggcagccugaucugcaacgugggcgccggcggccccgcccccgccgccggcgccgcccccgccggcggccccgcccccagcaccgccgccgcccccgccgaggagaagaagguggaggccaagaaggaggagagcgaggagagcgacgacgacaugggcuucggccuguucgacuaa

SEQ ID NO: 22834 - RNA, 1824 nt, Artificial Sequence
  RPN1__Homo_sapiens__NP_002941
auggaggcccccgccgccggccuguuccugcugcugcugcugggcaccugggcccccgcccccggcagcgccagcagcgaggcccccccccugaucaacgaggacgugaagagaaccguggaccugagcagccaccuggccaaggugaccgccgagguggugcuggcccaccugggcggcggcagcaccagcagagccaccagcuuccugcuggcccuggagcccgagcuggaggccagacuggcccaccugggcgugcaggugaagggcgaggacgaggaggagaacaaccuggaggugagagagaccaagaucaagggcaagagcggcagauucuucaccgugaagcugcccguggcccuggaccccggcgccaagaucagcgugaucguggagaccguguacacccacgugcugcaccccuaccccacccagaucacccagagcgagaagcaguucgugguguucgagggcaaccacuacuucuacagccccuaccccaccaagacccagaccaugagagugaagcuggccagcagaaacguggagagcuacaccaagcugggcaaccccaccagaagcgaggaccugcuggacuacggccccuucagagacgugcccgccuacagccaggacaccuucaaggugcacuacgagaacaacagccccuuccugaccaucaccagcaugaccagagugaucgaggugagccacuggggcaacaucgccguggaggagaacguggaccugaagcacaccggcgccgugcugaagggccccuucagcagauacgacuaccagagacagcccgacagcggcaucagcagcaucagaagcuucaagaccauccugcccgccgccgcccaggacguguacuacagagacgagaucggcaacgugagcaccagccaccugcugauccuggacgacagcguggagauggagaucagacccagauucccccuguucggcggcuggaagacccacuacaucgugggcuacaaccugcccagcuacgaguaccuguacaaccugggcgaccaguacgcccugaagaugagauucguggaccacguguucgacgagcaggugaucgacagccugaccgugaagaucauccugcccgagggcgccaagaacaucgagaucgacagccccuacgagaucagcagagcccccgacgagcugcacuacaccuaccuggacaccuucggcagacccgugaucguggccuacaagaagaaccugguggagcagcacauccaggacaucguggugcacuacaccuucaacaaggugcugaugcugcaggagccccugcuggugguggccgccuucuacauccuguucuucaccgugaucaucuacgugagacuggacuucagcaucaccaaggaccccgccgccgaggccagaaugaagguggccugcaucaccgagcaggugcugacccuggugaacaagagaaucggccuguacagacacuucgacgagaccgugaacagauacaagcagagcagagacaucagcacccugaacagcggcaagaagagccuggagaccgagcacaaggcccugaccagcgagaucgcccugcugcagagcagacugaagaccgagggcagcgaccugugcgacagagugagcgagaugcagaagcuggacgcccaggugaaggagcuggugcugaagagcgccguggaggccgagagacugguggccggcaagcugaagaaggacaccuacaucgagaacgagaagcugaucagcggcaagagacaggagcuggugaccaagaucgaccacauccuggacgcccuguaa

SEQ ID NO: 22835 - RNA, 1848 nt, Artificial Sequence
  RPN2__Homo_sapiens__NP_001129243
auggccccccccggcagcagcaccguguuccugcuggcccugaccaucaucgccagcaccugggcccugacccccacccacuaccugaccaagcacgacguggagagacugaaggccagccuggacagacccuucaccaaccuggagagcgccuucuacagcaucgugggccugagcagccugggcgcccaggugcccgacgccaagaucagcaucagcaacgagaccaaggaccugcugcuggccgccgugagcgaggacagcagcgugacccagaucuaccacgccguggccgcccugagcggcuucggccugccccuggccagccaggaggcccugagcgcccugaccgccagacugagcaaggaggagaccgugcuggccaccgugcaggcccugcagaccgccagccaccugagccagcaggccgaccugagaagcaucguggaggagaucgaggaccugguggccagacuggacgagcugggcggcguguaccugcaguucgaggagggccuggagaccaccgcccuguucguggccgccaccuacaagcugauggaccacgugggcaccgagcccagcaucaaggaggaccaggugauccagcugaugaacgccaucuucagcaagaagaacuucgagagccugagcgaggccuucagcguggccagcgccgccgccgugcugagccacaacagauaccacgugcccguggugguggugcccgagggcagcgccagcgacacccacgagcaggccauccugagacugcaggugaccaacgugcugagccagccccugacccaggccaccgugaagcuggagcacgccaagagcguggccagcagagccaccgugcugcagaagaccagcuucacccccgugggcgacguguucgagcugaacuucaugaacgugaaguucagcagcggcuacuacgacuuccugguggagguggagggcgacaacagauacaucgccaacaccguggagcugagagugaagaucagcaccgaggugggcaucaccaacguggaccugagcaccguggacaaggaccagagcaucgcccccaagaccaccagagugaccuaccccgccaaggccaagggcaccuucaucgccgacagccaccagaacuucgcccuguucuuccagcugguggacgugaacaccggcgccgagcugaccccccaccagaccuucgugagacugcacaaccagaagaccggccaggaggugguguucguggccgagcccgacaacaagaacguguacaaguucgagcuggacaccagcgagagaaagaucgaguucgacagcgccagcggcaccuacacccuguaccugaucaucggcgacgccacccugaagaaccccauccuguggaacguggccgacguggugaucaaguuccccgaggaggaggcccccagcaccgugcugagccagaaccuguucacccccaagcaggagauccagcaccuguucagagagcccgagaagagaccccccaccguggugagcaacaccuucaccgcccugauccugagcccccugcugcugcuguucgcccuguggaucagaaucggcgccaacgugagcaacuucaccuucgcccccagcaccaucaucuuccaccugggccacgccgccaugcugggccugauguacguguacuggacccagcugaacauguuccagacccugaaguaccuggccauccugggcagcgugaccuuccuggccggcaacagaaugcuggcccagcaggccgugaagagaaucgccgccgagcagagcagcagacuggccaaguacagaacccugagaaccgcccacuaa

SEQ ID NO: 22836 - RNA, 375 nt, Artificial Sequence
  RPP14__Homo_sapiens__NP_001092253
augcccgcccccgccgccaccuacgagagagugguguacaagaaccccagcgaguaccacuacaugaaggugugccuggaguuccaggacugcggcgugggccugaacgccgcccaguucaagcagcugcugaucagcgccgugaaggaccuguucggcgagguggacgccgcccugccccuggacauccugaccuacgaggagaagacccugagcgccauccugagaaucugcagcagcggccuggugaagcuguggagcagccugacccugcugggcagcuacaagggcaagaagugcgccuucagagugauccaggugagccccuuccugcuggcccugagcggcaacagcagagagcuggugcuggacuaa

SEQ ID NO: 22837 - RNA, 489 nt, Artificial Sequence
  RPP21__Homo_sapiens__NP_001186049
auggccggccccgugaaggacagagaggccuuccagagacugaacuuccuguaccaggccgcccacugcgugcuggcccaggaccccgagaaccaggcccuggccagauucuacugcuacaccgagagaaccaucgccaagagacuggugcugagaagaccccugagcagcagcgcccccagagaccccagcgugaagagaacccugugcagaggcugcagcagccugcuggugcccggccugaccugcacccagagacagagaagaugcagaggccagagauggaccgugcagaccugccugaccugccagagaagccagagauuccugaacgaccccggccaccugcuguggggcgacagacccgaggcccagcugggcagccaggccgacagcaagccccugcagccccugcccaacaccgcccacagcaucagcgacagacugcccgaggagaagaugcagacccagggcagcagcaaccaguaa

SEQ ID NO: 22838 - RNA, 600 nt, Artificial Sequence
  RPP25__Homo_sapiens__NP_060263
auggagaacuucagaaaggugagaagcgaggaggcccccgccggcugcggcgccgagggcggcggccccggcagcggccccuucgccgaccuggcccccggcgccgugcacaugagagugaaggagggcagcaagaucagaaaccugauggccuucgccaccgccagcauggcccagcccgccaccagagccaucguguucagcggcugcggcagagccaccaccaagaccgugaccugcgccgagauccugaagagaagacuggccggccugcaccaggugaccagacugagauacagaagcgugagagagguguggcagagccugccccccggccccacccagggccagacccccggcgagcccgccgccagccugagcgugcugaagaacgugcccggccuggccauccugcugagcaaggacgcccuggaccccagacagcccggcuaccagccccccaacccccaccccggccccagcagcccccccgccgcccccgccagcaagagaagccugggcgagcccgccgccggcgagggcagcgccaagagaagccagcccgagcccggcguggccgacgaggaccagaccgccuaa

SEQ ID NO: 22839 - RNA, 852 nt, Artificial Sequence
  RPP38__Homo_sapiens__NP_001252530
auggccgccgccccccaggcccccggcagaggcagccugagaaagaccagaccccugguggugaagaccagccugaacaaccccuacaucaucagauggagcgcccuggagagcgaggacaugcacuucauccugcagacccuggaggacagacugaaggccaucggccugcagaagaucgaggacaagaagaagaagaacaagacccccuuccugaagaaggagagcagagagaagugcagcaucgccguggacaucagcgagaaccugaaggagaagaagaccgacgccaagcagcaggugagcggcuggacccccgcccacgugagaaagcagcuggccaucggcgugaacgaggugaccagagcccuggagagaagagagcugcugcuggugcuggugugcaagagcgugaagcccgccaugaucaccagccaccugauccagcugagccugagcagaagcgugcccgccugccaggugcccagacugagcgagagaaucgcccccgugaucggccugaagugcgugcuggcccuggccuucaagaagaacaccaccgacuucguggacgaggugagagccaucauccccagagugcccagccugagcgugcccuggcugcaggacagaaucgaggacagcggcgagaaccuggagaccgagccccuggagagccaggacagagagcugcuggacaccagcuucgaggaccugagcaagcccaagagaaagcuggccgacggcagacaggccagcgugacccugcagccccugaagaucaagaagcugauccccaaccccaacaagaucagaaagccccccaagagcaagaaggccacccccaaguaa

SEQ ID NO: 22840 - RNA, 1092 nt, Artificial Sequence
  RPP40__Homo_sapiens__NP_006629
auggccacccugagaagacugagagaggcccccagacaccugcuggugugcgagaagagcaacuucggcaaccacaagagcagacacagacaccuggugcagacccacuacuacaacuacagagugagcuuccugauccccgagugcggcauccugagcgaggagcugaagaaccuggugaugaacaccggccccuacuacuucgugaagaaccugccccugcacgagcugaucacccccgaguucaucagcaccuucaucaagaagggcagcugcuacgcccugaccuacaacacccacaucgacgaggacaacaccguggcccugcugcccaacggcaagcugauccugagccuggacaaggacaccuacgaggagaccggccugcagggccaccccagccaguucagcggcagaaagaucaugaaguucaucgugagcaucgaccugauggagcugagccugaaccuggacagcaagaaguacgagagaaucagcuggagcuucaaggagaagaagccccugaaguucgacuuccugcuggccuggcacaagaccggcagcgaggagagcaccaugaugagcuacuucagcaaguaccagauccaggagcaccagcccaagguggcccugagcacccugagagaccugcagugccccgugcugcagagcagcgagcuggagggcacccccgaggugagcugcagagcccuggagcuguucgacuggcugggcgccguguucagcaacguggaccugaacaacgagcccaacaacuucaucagcaccuacugcugccccgagcccagcaccgugguggccaaggccuaccugugcaccaucaccggcuucauccugcccgagaagaucugccugcugcuggagcaccugugccacuacuucgacgagcccaagcuggcccccugggugacccugagcgugcagggcuucgccgacagccccgugagcugggagaagaacgagcacggcuucagaaagggcggcgagcaccuguacaacuucgugaucuucaacaaccaggacuacuggcugcagauggccgugggcgccaacgaccacugcccccccuaa

SEQ ID NO: 22841 - RNA, 831 nt, Artificial Sequence
  RPRD1A__Homo_sapiens__NP_001290340
augagaaacagcaacuggagauucugccagaccggcaucuacagcaagcccaacagaaagcugaccuuccuguaccuggccaacgacgugauccagaacagcaagagaaagggccccgaguucaccaaggacuucgcccccgugaucguggaggccuucaagcacgugagcagcgagaccgacgagagcugcaagaagcaccugggcagagugcugagcaucugggaggagagaagcguguacgagaacgacgugcuggagcagcugaagcaggcccuguacggcgacaagaagcccagaaagagaaccuacgagcagaucaagguggacgagaacgagaacugcagcagccugggcagccccagcgagcccccccagacccuggaccuggugagagcccugcaggaccuggagaacgccgccagcggcgacgccgccgugcaccagagaaucgccagccugcccguggaggugcaggaggugagccugcuggacaagaucaccgacaaggagagcggcgagagacugagcaagaugguggaggacgccugcaugcugcuggccgacuacaacggcagacuggccgccgagaucgacgacagaaagcagcugaccagaaugcuggccgacuuccugagaugccagaaggaggcccuggccgagaaggagcacaagcuggaggaguacaagagaaagcuggccagagugagccuggugagaaaggagcugagaagcagaauccagagccugcccgaccugagcagacugcccaacgugaccggcagccacaugcaccugcccuucgccggcgacaucuacagcgaggacuaa

SEQ ID NO: 22842 - RNA, 981 nt, Artificial Sequence
  RPRD1B__Homo_sapiens__NP_067038
augagcagcuucagcgagagcgcccuggagaagaagcugagcgagcugagcaacagccagcagagcgugcagacccugagccuguggcugauccaccacagaaagcacgccggccccaucgugagcguguggcacagagagcugagaaaggccaagagcaacagaaagcugaccuuccuguaccuggccaacgacgugauccagaacagcaagagaaagggccccgaguucaccagagaguucgagagcgugcugguggacgccuucagccacguggccagagaggccgacgagggcugcaagaagccccuggagagacugcugaacaucuggcaggagagaagcguguacggcggcgaguucauccagcagcugaagcugagcauggaggacagcaagagccccccccccaaggccaccgaggagaagaagagccugaagagaaccuuccagcagauccaggaggaggaggacgacgacuaccccggcagcuacagcccccaggaccccagcgccggcccccugcugaccgaggagcugaucaaggcccugcaggaccuggagaacgccgccagcggcgacgccaccgugagacagaagaucgccagccugccccaggaggugcaggacgugagccugcuggagaagaucaccgacaaggaggccgccgagagacugagcaagaccguggacgaggccugccugcugcuggccgaguacaacggcagacuggccgccgagcuggaggacagaagacagcuggccagaaugcugguggaguacacccagaaccagaaggacgugcugagcgagaaggagaagaagcuggaggaguacaagcagaagcuggccagagugacccaggugagaaaggagcugaagagccacauccagagccugcccgaccugagccugcugcccaacgugaccggcggccuggccccccugcccagcgccggcgaccuguucagcaccgacuaa

SEQ ID NO: 22843 - RNA, 2805 nt, Artificial Sequence
  RPRD2__Homo_sapiens__NP_001284602
auggccgccggcggcggcggcggcagcagcaaggccagcagcagcagcgccagcagcgccggcgcccuggagagcagccuggacagaaaguuccagagcgugaccaacaccauggagagcauccagggccugagcagcuggugcaucgagaacaagaagcaccacagcaccaucguguaccacuggaugaaguggcugagaagaagcgccuacccccacagacugaaccuguucuaccuggccaacgacgugauccagaacugcaagagaaagaacgccaucaucuucagagagagcuucgccgacgugcugcccgaggccgccgcccuggugaaggaccccagcgugagcaagagcguggagagaaucuucaagaucugggaggacagaaacguguaccccgaggagaugaucguggcccugagagaggcccugaccagcaccaaccccaaggccgcccugaagagcaagaucguggccgaguucagaagccaggcccugaucgaggagcugcugcuguacaagagaagcgaggaccagaucgagcugaaggagaagcagcugagcaccaugagaguggacgugugcagcaccgagacccugaagugccugaaggacaagaccggcggcaagaaguucagcaaggaguucgaggaggccagcagcaagcuggaggaguucgugaacggccuggacaagcaggugaagaacggccccagccugaccgaggcccuggagaacgccggcaucuucuacgaggcccaguacaaggaggugaaggugguggccaacgccuacaagaccuucgccaacagagugaacaaccugaagaagaagcuggaccagcugaagagcacccugcccgaccccgaggagagccccgugcccagccccagcauggacgcccccagccccaccggcagcgagagccccuuccagggcaugggcggcgaggagagccagagccccaccauggagagcgagaagagcgccacccccgagcccgugaccgacaacagagacguggaggacauggagcugagcgacguggaggacgacggcagcaagaucaucguggaggacagaaaggagaagcccgccgagaagagcgccgugagcaccagcgugcccaccaagcccaccgagaacaucagcaaggccagcagcugcacccccgugcccgugaccaugaccgccacccccccccugcccaagcccgugaacaccagccugagccccagccccgcccuggcccugcccaaccuggccaacguggaccuggccaagaucagcagcauccugagcagccugaccagcgugaugaagaacaccggcgugagccccgccagcagacccagccccggcacccccaccagccccagcaaccugaccagcggccugaagacccccgcccccgccaccaccaccagccacaacccccuggccaacauccugagcaagguggagaucacccccgagagcauccugagcgcccugagcaagacccagacccagagcgcccccgcccugcagggccugagcagccugcugcagagcgugaccggcaaccccgugcccgccagcgaggccgccagccagagcaccagcgccagccccgccaacaccaccgugagcaccaucaagggcagaaaccugcccagcagcgcccagcccuucauccccaagagcuucaacuacagccccaacagcagcaccagcgaggugagcagcaccagcgccagcaaggccagcaucggccagagccccggccugcccagcaccaccuucaagcugcccagcaacagccugggcuucaccgccacccacaacaccagccccgccgccccccccaccgaggugaccaucugccagagcagcgaggugagcaagcccaagcuggagagcgagagcaccagccccagccuggagaugaagauccacaacuuccugaagggcaaccccggcuucagcggccugaaccugaacauccccauccugagcagccugggcagcagcgcccccagcgagagccaccccagcgacuuccagagaggccccaccagcaccagcaucgacaacaucgacggcacccccgugagagacgagagaagcggcacccccacccaggacgagaugauggacaagcccaccagcagcagcguggacaccaugagccugcugagcaagaucaucagccccggcagcagcacccccagcagcaccagaagccccccccccggcagagacgagagcuaccccagagagcugagcaacagcgugagcaccuacagacccuucggccugggcagcgagagccccuacaagcagcccagcgacggcauggagagacccagcagccugauggacagcagccaggagaaguucuaccccgacaccagcuuccaggaggacgaggacuacagagacuucgaguacagcggccccccccccagcgccaugaugaaccuggagaagaagcccgccaagagcauccugaagagcagcaagcugagcgacaccaccgaguaccagcccauccugagcagcuacagccacagagcccaggaguucggcgugaagagcgccuucccccccagcgugagagcccugcuggacagcagcgagaacugcgacagacugagcagcagccccggccuguucggcgccuucagcgugagaggcaacgagcccggcagcgacagaagccccagccccaagcaccccugcagaagccacggcagccccacccacgugagaagaggcgagagccccggccugcaccacuuccaccacguggacgacuaa

SEQ ID NO: 22844 - RNA, 330 nt, Artificial Sequence
  RPRM__Homo_sapiens__NP_062819
augaaccccgcccugggcaaccagaccgacguggccggccuguuccuggccaacagcagcgaggcccuggagagagccgugagaugcugcacccaggccagcguggugaccgacgacggcuucgccgagggcggccccgacgagagaagccuguacaucaugagaguggugcagaucgccgugaugugcgugcugagccugaccgugguguucggcaucuucuuccugggcugcaaccugcugaucaagagcgagggcaugaucaacuuccuggugaaggacagaagacccagcaaggagguggaggccgugguggugggccccuacuaa

SEQ ID NO: 22845 - RNA, 498 nt, Artificial Sequence
  RPS10__Homo_sapiens__NP_001191020
augcugaugcccaagaagaacagaaucgccaucuacgagcugcuguucaaggagggcgugaugguggccaagaaggacgugcacaugcccaagcaccccgagcuggccgacaagaacgugcccaaccugcacgugaugaaggccaugcagagccugaagagcagaggcuacgugaaggagcaguucgccuggagacacuucuacugguaccugaccaacgagggcauccaguaccugagagacuaccugcaccugccccccgagaucgugcccgccacccugagaagaagcagacccgagaccggcagacccagacccaagggccuggagggcgagagacccgccagacugaccagaggcgaggccgacagagacaccuacagaagaagcgccgugccccccggcgccgacaagaaggccgaggccggcgccggcagcgccaccgaguuccaguucagaggcggcuucggcagaggcagaggccagcccccccaguaa

SEQ ID NO: 22846 - RNA, 456 nt, Artificial Sequence
  RPS14__Homo_sapiens__NP_001020242
auggcccccagaaagggcaaggagaagaaggaggagcaggugaucagccugggcccccagguggccgagggcgagaacguguucggcgugugccacaucuucgccagcuucaacgacaccuucgugcacgugaccgaccugagcggcaaggagaccaucugcagagugaccggcggcaugaaggugaaggccgacagagacgagagcagccccuacgccgccaugcuggccgcccaggacguggcccagagaugcaaggagcugggcaucaccgcccugcacaucaagcugagagccaccggcggcaacagaaccaagacccccggccccggcgcccagagcgcccugagagcccuggccagaagcggcaugaagaucggcagaaucgaggacgugacccccauccccagcgacagcaccagaagaaagggcggcagaagaggcagaagacuguaa

SEQ ID NO: 22847 - RNA, 393 nt, Artificial Sequence
  RPS15A__Homo_sapiens__NP_001025180
auggugagaaugaacgugcuggccgacgcccugaagagcaucaacaacgccgagaagagaggcaagagacaggugcugaucagacccugcagcaaggugaucgugagauuccugaccgugaugaugaagcacggcuacaucggcgaguucgagaucaucgacgaccacagagccggcaagaucguggugaaccugaccggcagacugaacaagugcggcgugaucagccccagauucgacgugcagcugaaggaccuggagaaguggcagaacaaccugcugcccagcagacaguucggcuucaucgugcugaccaccagcgccggcaucauggaccacgaggaggccagaagaaagcacaccggcggcaagauccugggcuucuucuucuaa

SEQ ID NO: 22848 - RNA, 459 nt, Artificial Sequence
  RPS16__Homo_sapiens__XP_005259194
augcccagcaagggcccccugcagagcgugcagguguucggcagaaagaagaccgccaccgccguggcccacugcaagagaggcaacggccugaucaaggugaacggcagaccccuggagaugaucgagcccagaacccugcaguacaagcugcuggagcccgugcugcugcugggcaaggagagauucgccggcguggacaucagagugagagugaagggcggcggccacguggcccagaucuacggcgagagccaggagcugggcgccuggagaagauggcugugggagggcggccugcacagcgcccccgugcccuucaacugcgugagcuucagccagcugagcgugagccccagccccaagcccugguggcccaucaccagaaacauguggaugagacugcccagaagaagaagcaagaccagcagcagcagcaugaccggccccugcugguaa

SEQ ID NO: 22849 - RNA, 459 nt, Artificial Sequence
  RPS18__Homo_sapiens__NP_072045
augagccuggugauccccgagaaguuccagcacauccugagagugcugaacaccaacaucgacggcagaagaaagaucgccuucgccaucaccgccaucaagggcgugggcagaagauacgcccacguggugcugagaaaggccgacaucgaccugaccaagagagccggcgagcugaccgaggacgagguggagagagugaucaccaucaugcagaaccccagacaguacaagauccccgacugguuccugaacagacagaaggacgugaaggacggcaaguacagccaggugcuggccaacggccuggacaacaagcugagagaggaccuggagagacugaagaagaucagagcccacagaggccugagacacuucuggggccugagagugagaggccagcacaccaagaccaccggcagaagaggcagaaccgugggcgugagcaagaagaaguaa

SEQ ID NO: 22850 - RNA, 411 nt, Artificial Sequence
  RPS19BP1__Homo_sapiens__NP_919307
augagcgccgcccugcugagaagaggccuggagcugcuggccgccagcgaggcccccagagacccccccggccaggccaagcccagaggcgcccccgugaagagacccagaaagaccaaggccauccaggcccagaagcugagaaacagcgccaagggcaaggugcccaagagcgcccuggacgaguacagaaagagagagugcagagaccaccugagagugaaccugaaguuccugaccagaaccagaagcaccguggccgagagcgugagccagcagauccugagacagaacagaggcagaaaggccugcgacagacccguggccaagaccaagaagaagaaggccgagggcaccguguucaccgaggaggacuuccagaaguuccagcaggaguacuucggcagcuaa

SEQ ID NO: 22851 - RNA, 429 nt, Artificial Sequence
  RPS20__Homo_sapiens__NP_001139699
auggccuucaaggacaccggcaagacccccguggagcccgagguggccauccacagaaucagaaucacccugaccagcagaaacgugaagagccuggagaaggugugcgccgaccugaucagaggcgccaaggagaagaaccugaaggugaagggccccgugagaaugcccaccaagacccugagaaucaccaccagaaagacccccugcggcgagggcagcaagaccugggacagauuccagaugagaauccacaagagacugaucgaccugcacagccccagcgagaucgugaagcagaucaccagcaucagcaucgagcccggcguggagcugaucgagagcaccgacgccgagcccauggacaccgagggccagcaguacacccugagaagcguguucgagagccccggcaccugccccuucuaa

SEQ ID NO: 22852 - RNA, 396 nt, Artificial Sequence
  RPS24__Homo_sapiens__NP_001135754
augaacgacaccgugaccaucagaaccagaaaguucaugaccaacagacugcugcagagaaagcagauggugaucgacgugcugcaccccggcaaggccaccgugcccaagaccgagaucagagagaagcuggccaagauguacaagaccacccccgacgugaucuucguguucggcuucagaacccacuucggcggcggcaagaccaccggcuucggcaugaucuacgacagccuggacuacgccaagaagaacgagcccaagcacagacuggccagacacggccuguacgagaagaagaagaccagcagaaagcagagaaaggagagaaagaacagaaugaagaaggugagaggcaccgccaaggccaacgugggcgccggcaagaagaaguaa

SEQ ID NO: 22853 - RNA, 471 nt, Artificial Sequence
  RPS27A__Homo_sapiens__NP_001170884
augcagaucuucgugaagacccugaccggcaagaccaucacccuggagguggagcccagcgacaccaucgagaacgugaaggccaagauccaggacaaggagggcaucccccccgaccagcagagacugaucuucgccggcaagcagcuggaggacggcagaacccugagcgacuacaacauccagaaggagagcacccugcaccuggugcugagacugagaggcggcgccaagaagagaaagaagaagagcuacaccacccccaagaagaacaagcacaagagaaagaaggugaagcuggccgugcugaaguacuacaagguggacgagaacggcaagaucagcagacugagaagagagugccccagcgacgagugcggcgccggcguguucauggccagccacuucgacagacacuacugcggcaagugcugccugaccuacugcuucaacaagcccgaggacaaguaa

SEQ ID NO: 22854 - RNA, 255 nt, Artificial Sequence
  RPS27__Homo_sapiens__NP_001021
augccccuggccaaggaccugcugcaccccagccccgaggaggagaagagaaagcacaagaagaagagacuggugcagagccccaacagcuacuucauggacgugaagugccccggcugcuacaagaucaccaccguguucagccacgcccagaccguggugcugugcgugggcugcagcaccgugcugugccagcccaccggcggcaaggccagacugaccgagggcugcagcuucagaagaaagcagcacuaa

SEQ ID NO: 22855 - RNA, 255 nt, Artificial Sequence
  RPS27L__Homo_sapiens__NP_057004
augccccuggccagagaccugcugcaccccagccuggaggaggagaagaagaagcacaagaagaagagacuggugcagagccccaacagcuacuucauggacgugaagugccccggcugcuacaagaucaccaccguguucagccacgcccagaccguggugcugugcgugggcugcagcaccgugcugugccagcccaccggcggcaaggccagacugaccgagggcugcagcuucagaagaaagcagcacuaa

SEQ ID NO: 22856 - RNA, 171 nt, Artificial Sequence
  RPS29__Homo_sapiens__NP_001023
augggccaccagcagcuguacuggagccaccccagaaaguucggccagggcagcagaagcugcagagugugcagcaacagacacggccugaucagaaaguacggccugaacaugugcagacagugcuucagacaguacgccaaggacaucggcuucaucaagcuggacuaa

SEQ ID NO: 22857 - RNA, 882 nt, Artificial Sequence
  RPS2__Homo_sapiens__NP_002943
auggccgacgacgccggcgccgccggcggccccggcggccccggcggccccggcaugggcaacagaggcggcuucagaggcggcuucggcagcggcaucagaggcagaggcagaggcagaggcagaggcagaggcagaggcagaggcgccagaggcggcaaggccgaggacaaggaguggaugcccgugaccaagcugggcagacuggugaaggacaugaagaucaagagccuggaggagaucuaccuguucagccugcccaucaaggagagcgagaucaucgacuucuuccugggcgccagccugaaggacgaggugcugaagaucaugcccgugcagaagcagaccagagccggccagagaaccagauucaaggccuucguggccaucggcgacuacaacggccacgugggccugggcgugaagugcagcaaggagguggccaccgccaucagaggcgccaucauccuggccaagcugagcaucgugcccgugagaagaggcuacuggggcaacaagaucggcaagccccacaccgugcccugcaaggugaccggcagaugcggcagcgugcuggugagacugauccccgcccccagaggcaccggcaucgugagcgcccccgugcccaagaagcugcugaugauggccggcaucgacgacugcuacaccagcgccagaggcugcaccgccacccugggcaacuucgccaaggccaccuucgacgccaucagcaagaccuacagcuaccugacccccgaccuguggaaggagaccguguucaccaagagccccuaccaggaguucaccgaccaccuggugaagacccacaccagagugagcgugcagagaacccaggcccccgccguggccaccaccuaa

SEQ ID NO: 22858 - RNA, 795 nt, Artificial Sequence
  RPS3A__Homo_sapiens__NP_000997
auggccgugggcaagaacaagagacugaccaagggcggcaagaagggcgccaagaagaaggugguggaccccuucagcaagaaggacugguacgacgugaaggcccccgccauguucaacaucagaaacaucggcaagacccuggugaccagaacccagggcaccaagaucgccagcgacggccugaagggcagaguguucgaggugagccuggccgaccugcagaacgacgagguggccuucagaaaguucaagcugaucaccgaggacgugcagggcaagaacugccugaccaacuuccacggcauggaccugaccagagacaagaugugcagcauggugaagaaguggcagaccaugaucgaggcccacguggacgugaagaccaccgacggcuaccugcugagacuguucugcgugggcuucaccaagaagagaaacaaccagaucagaaagaccagcuacgcccagcaccagcaggugagacagaucagaaagaagaugauggagaucaugaccagagaggugcagaccaacgaccugaaggagguggugaacaagcugauccccgacagcaucggcaaggacaucgagaaggccugccagagcaucuacccccugcacgacguguucgugagaaaggugaagaugcugaagaagcccaaguucgagcugggcaagcugauggagcugcacggcgagggcagcagcagcggcaaggccaccggcgacgagaccggcgccaagguggagagagccgacggcuacgagccccccgugcaggagagcguguaa

SEQ ID NO: 22859 - RNA, 732 nt, Artificial Sequence
  RPS3__Homo_sapiens__NP_000996
auggccgugcagaucagcaagaagagaaaguucguggccgacggcaucuucaaggccgagcugaacgaguuccugaccagagagcuggccgaggacggcuacagcggcguggaggugagagugacccccaccagaaccgagaucaucauccuggccaccagaacccagaacgugcugggcgagaagggcagaagaaucagagagcugaccgccguggugcagaagagauucggcuuccccgagggcagcguggagcuguacgccgagaagguggccaccagaggccugugcgccaucgcccaggccgagagccugagauacaagcugcugggcggccuggccgugagaagagccugcuacggcgugcugagauucaucauggagagcggcgccaagggcugcgaggugguggugagcggcaagcugagaggccagagagccaagagcaugaaguucguggacggccugaugauccacagcggcgaccccgugaacuacuacguggacaccgccgugagacacgugcugcugagacagggcgugcugggcaucaaggugaagaucaugcugcccugggaccccaccggcaagaucggccccaagaagccccugcccgaccacgugagcaucguggagcccaaggacgagauccugcccaccacccccaucagcgagcagaagggcggcaagcccgagccccccgccaugccccagcccgugcccaccgccuaa

SEQ ID NO: 22860 - RNA, 792 nt, Artificial Sequence
  RPS4X__Homo_sapiens__NP_000998
auggccagaggccccaagaagcaccugaagagaguggccgcccccaagcacuggaugcuggacaagcugaccggcguguucgcccccagacccagcaccggcccccacaagcugagagagugccugccccugaucaucuuccugagaaacagacugaaguacgcccugaccggcgacgaggugaagaagaucugcaugcagagauucaucaagaucgacggcaaggugagaaccgacaucaccuaccccgccggcuucauggacgugaucagcaucgacaagaccggcgagaacuucagacugaucuacgacaccaagggcagauucgccgugcacagaaucacccccgaggaggccaaguacaagcugugcaaggugagaaagaucuucgugggcaccaagggcaucccccaccuggugacccacgacgccagaaccaucagauaccccgacccccugaucaaggugaacgacaccauccagaucgaccuggagaccggcaagaucaccgacuucaucaaguucgacaccggcaaccugugcauggugaccggcggcgccaaccugggcagaaucggcgugaucaccaacagagagagacaccccggcagcuucgacguggugcacgugaaggacgccaacggcaacagcuucgccaccagacugagcaacaucuucgugaucggcaagggcaacaagcccuggaucagccugcccagaggcaagggcaucagacugaccaucgccgaggagagagacaagagacuggccgccaagcagagcagcggcuaa

SEQ ID NO: 22861 - RNA, 792 nt, Artificial Sequence
  RPS4Y1__Homo_sapiens__NP_000999
auggccagaggccccaagaagcaccugaagagaguggccgcccccaagcacuggaugcuggacaagcugaccggcguguucgcccccagacccagcaccggcccccacaagcugagagagugccugccccugaucguguuccugagaaacagacugaaguacgcccugaccggcgacgaggugaagaagaucugcaugcagagauucaucaagaucgacggcaaggugagaguggacgugaccuaccccgccggcuucauggacgugaucagcaucgagaagaccggcgagcacuucagacugguguacgacaccaagggcagauucgccgugcacagaaucaccguggaggaggccaaguacaagcugugcaaggugagaaagaucaccgugggcgugaagggcaucccccaccuggugacccacgacgccagaaccaucagauaccccgaccccgugaucaaggugaacgacaccgugcagaucgaccugggcaccggcaagaucaucaacuucaucaaguucgacaccggcaaccugugcauggugaucggcggcgccaaccugggcagagugggcgugaucaccaacagagagagacaccccggcagcuucgacguggugcacgugaaggacgccaacggcaacagcuucgccaccagacugagcaacaucuucgugaucggcaacggcaacaagcccuggaucagccugcccagaggcaagggcaucagacugaccguggccgaggagagagacaagagacuggccaccaagcagagcagcggcuaa

SEQ ID NO: 22862 - RNA, 2226 nt, Artificial Sequence
  RPS6KA2__Homo_sapiens__NP_001006933
augcccaucgcccagcugcuggagcuguggaagaagaucgagguggagcccauggagaucgagaccaccgaggaggaccugaaccuggacguggagcccgccaccgaggacaccgccgaggaggaggagggcguggugaaggagaucgacaucagccaccacgugaaggagggcuucgagaaggccgaccccagccaguucgagcugcugaaggugcugggccagggcagcuacggcaagguguuccuggugagaaaggugaagggcagcgacgccggccagcuguacgccaugaaggugcugaagaaggccacccugaaggugagagacagagugagaagcaagauggagagagacauccuggccgaggugaaccaccccuucaucgugaagcugcacuacgccuuccagaccgagggcaagcuguaccugauccuggacuuccugagaggcggcgaccuguucaccagacugagcaaggaggugauguucaccgaggaggacgugaaguucuaccuggccgagcuggcccuggcccuggaccaccugcacagccugggcaucaucuacagagaccugaagcccgagaacauccugcuggacgaggagggccacaucaagaucaccgacuucggccugagcaaggaggccaucgaccacgacaagagagccuacagcuucugcggcaccaucgaguacauggcccccgagguggugaacagaagaggccacacccagagcgccgacugguggagcuucggcgugcugauguucgagaugcugaccggcagccugcccuuccagggcaaggacagaaaggagaccauggcccugauccugaaggccaagcugggcaugccccaguuccugagcggcgaggcccagagccugcugagagcccuguucaagagaaaccccugcaacagacugggcgccggcaucgacggcguggaggagaucaagagacaccccuucuucgugaccaucgacuggaacacccuguacagaaaggagaucaagccccccuucaagcccgccgugggcagacccgaggacaccuuccacuucgaccccgaguucaccgccagaacccccaccgacagccccggcgugccccccagcgccaacgcccaccaccuguucagaggcuucagcuucguggccagcagccugauccaggagcccagccagcaggaccugcacaaggugcccgugcaccccaucgugcagcagcugcacggcaacaacauccacuucaccgacggcuacgagaucaaggaggacaucggcgugggcagcuacagcgugugcaagagaugcgugcacaaggccaccgacaccgaguacgccgugaagaucaucgacaagagcaagagagaccccagcgaggagaucgagauccugcugagauacggccagcaccccaacaucaucacccugaaggacguguacgacgacggcaaguucguguaccuggugauggagcugaugagaggcggcgagcugcuggacagaauccugagacagagauacuucagcgagagagaggccagcgacgugcugugcaccaucaccaagaccauggacuaccugcacagccagggcguggugcacagagaccugaagcccagcaacauccuguacagagacgagagcggcagccccgagagcaucagagugugcgacuucggcuucgccaagcagcugagagccggcaacggccugcugaugacccccugcuacaccgccaacuucguggcccccgaggugcugaagagacagggcuacgacgccgccugcgacaucuggagccugggcauccugcuguacaccaugcuggccggcuucacccccuucgccaacggccccgacgacacccccgaggagauccuggccagaaucggcagcggcaaguacgcccugagcggcggcaacugggacagcaucagcgacgccgccaaggacguggugagcaagaugcugcacguggacccccaccagagacugaccgccaugcaggugcugaagcaccccuggguggugaacagagaguaccugagccccaaccagcugagcagacaggacgugcaccuggugaagggcgccauggccgccaccuacuucgcccugaacagaaccccccaggcccccagacuggagcccgugcugagcagcaaccuggcccagagaagaggcaugaagagacugaccagcaccagacuguaa

SEQ ID NO: 22863 - RNA, 2223 nt, Artificial Sequence
  RPS6KA3__Homo_sapiens__NP_004577
augccccuggcccagcuggccgaccccuggcagaagauggccguggagagccccagcgacagcgccgagaacggccagcagaucauggacgagcccaugggcgaggaggagaucaacccccagaccgaggaggugagcaucaaggagaucgccaucacccaccacgugaaggagggccacgagaaggccgaccccagccaguucgagcugcugaaggugcugggccagggcagcuucggcaagguguuccuggugaagaagaucagcggcagcgacgccagacagcuguacgccaugaaggugcugaagaaggccacccugaaggugagagacagagugagaaccaagauggagagagacauccugguggaggugaaccaccccuucaucgugaagcugcacuacgccuuccagaccgagggcaagcuguaccugauccuggacuuccugagaggcggcgaccuguucaccagacugagcaaggaggugauguucaccgaggaggacgugaaguucuaccuggccgagcuggcccuggcccuggaccaccugcacagccugggcaucaucuacagagaccugaagcccgagaacauccugcuggacgaggagggccacaucaagcugaccgacuucggccugagcaaggagagcaucgaccacgagaagaaggccuacagcuucugcggcaccguggaguacauggcccccgagguggugaacagaagaggccacacccagagcgccgacugguggagcuucggcgugcugauguucgagaugcugaccggcacccugcccuuccagggcaaggacagaaaggagaccaugaccaugauccugaaggccaagcugggcaugccccaguuccugagccccgaggcccagagccugcugagaaugcuguucaagagaaaccccgccaacagacugggcgccggccccgacggcguggaggagaucaagagacacagcuucuucagcaccaucgacuggaacaagcuguacagaagagagauccacccccccuucaagcccgccaccggcagacccgaggacaccuucuacuucgaccccgaguucaccgccaagacccccaaggacagccccggcaucccccccagcgccaacgcccaccagcuguucagaggcuucagcuucguggccaucaccagcgacgacgagagccaggccaugcagaccgugggcgugcacagcaucgugcagcagcugcacagaaacagcauccaguucaccgacggcuacgaggugaaggaggacaucggcgugggcagcuacagcgugugcaagagaugcauccacaaggccaccaacauggaguucgccgugaagaucaucgacaagagcaagagagaccccaccgaggagaucgagauccugcugagauacggccagcaccccaacaucaucacccugaaggacguguacgacgacggcaaguacguguacguggugaccgagcugaugaagggcggcgagcugcuggacaagauccugagacagaaguucuucagcgagagagaggccagcgccgugcuguucaccaucaccaagaccguggaguaccugcacgcccagggcguggugcacagagaccugaagcccagcaacauccuguacguggacgagagcggcaaccccgagagcaucagaaucugcgacuucggcuucgccaagcagcugagagccgagaacggccugcugaugacccccugcuacaccgccaacuucguggcccccgaggugcugaagagacagggcuacgacgccgccugcgacaucuggagccugggcgugcugcuguacaccaugcugaccggcuacacccccuucgccaacggccccgacgacacccccgaggagauccuggccagaaucggcagcggcaaguucagccugagcggcggcuacuggaacagcgugagcgacaccgccaaggaccuggugagcaagaugcugcacguggacccccaccagagacugaccgccgcccuggugcugagacaccccuggaucgugcacugggaccagcugccccaguaccagcugaacagacaggacgccccccaccuggugaagggcgccauggccgccaccuacagcgcccugaacagaaaccagagccccgugcuggagcccgugggcagaagcacccuggcccagagaagaggcaucaagaagaucaccagcaccgcccuguaa

SEQ ID NO: 22864 - RNA, 2301 nt, Artificial Sequence
  RPS6KA4__Homo_sapiens__NP_001006945
augggcgacgaggacgacgacgagagcugcgccguggagcugagaaucaccgaggccaaccugaccggccacgaggagaaggugagcguggagaacuucgagcugcugaaggugcugggcaccggcgccuacggcaagguguuccuggugagaaaggccggcggccacgacgccggcaagcuguacgccaugaaggugcugagaaaggccgcccuggugcagagagccaagacccaggagcacaccagaaccgagagaagcgugcuggagcuggugagacaggcccccuuccuggugacccugcacuacgccuuccagaccgacgccaagcugcaccugauccuggacuacgugagcggcggcgagauguucacccaccuguaccagagacaguacuucaaggaggccgaggugagaguguacggcggcgagaucgugcuggcccuggagcaccugcacaagcugggcaucaucuacagagaccugaagcuggagaacgugcugcuggacagcgagggccacaucgugcugaccgacuucggccugagcaaggaguuccugaccgaggagaaggagagaaccuucagcuucugcggcaccaucgaguacauggcccccgagaucaucagaagcaagaccggccacggcaaggccguggacugguggagccugggcauccugcuguucgagcugcugaccggcgccagccccuucacccuggagggcgagagaaacacccaggccgaggugagcagaagaauccugaagugcagcccccccuucccccccagaaucggccccguggcccaggaccugcugcagagacugcugugcaaggaccccaagaagagacugggcgccggcccccagggcgcccaggaggugagaaaccaccccuucuuccagggccuggacuggguggcccuggccgccagaaagauccccgcccccuucagaccccagaucagaagcgagcuggacgugggcaacuucgccgaggaguucaccagacuggagcccguguacagcccccccggcagccccccccccggcgaccccagaaucuuccagggcuacagcuucguggcccccagcauccuguucgaccacaacaacgccgugaugaccgacggccuggaggcccccggcgccggcgacagacccggcagagccgccguggccagaagcgccaugaugcagcaguacgagcuggaccugagagagcccgcccugggccagggcagcuucagcgugugcagaagaugcagacagagacagagcggccaggaguucgccgugaagauccugagcagaagacuggaggccaacacccagagagagguggccgcccugagacugugccagagccaccccaacguggugaaccugcacgaggugcaccacgaccagcugcacaccuaccuggugcuggagcugcugagaggcggcgagcugcuggagcacaucagaaagaagagacacuucagcgagagcgaggccagccagauccugagaagccuggugagcgccgugagcuucaugcacgaggaggccggcguggugcacagagaccugaagcccgagaacauccuguacgccgacgacacccccggcgcccccgugaagaucaucgacuucggcuucgccagacugagaccccagagccccggcgugcccaugcagacccccugcuucacccugcaguacgccgcccccgagcugcuggcccagcagggcuacgacgagagcugcgaccuguggagccugggcgugauccuguacaugaugcugagcggccaggugcccuuccagggcgccagcggccagggcggccagagccaggccgccgagaucaugugcaagaucagagagggcagauucagccuggacggcgaggccuggcagggcgugagcgaggaggccaaggagcuggugagaggccugcugaccguggaccccgccaagagacugaagcuggagggccugagaggcagcagcuggcugcaggacggcagcgccagaagcagccccccccugagaacccccgacgugcuggagagcagcggccccgccgugagaagcggccugaacgccaccuucauggccuucaacagaggcaagagagagggcuucuuccugaagagcguggagaacgccccccuggccaagagaagaaagcagaagcugagaagcgccaccgccagcagaagaggcagccccgcccccgccaaccccggcagagcccccguggccagcaagggcgcccccagaagagccaacggcccccugccccccagcuaa

SEQ ID NO: 22865 - RNA, 2409 nt, Artificial Sequence
  RPS6KA5__Homo_sapiens__NP_004746
auggaggaggagggcggcagcagcggcggcgccgccggcaccagcgccgacggcggcgacggcggcgagcagcugcugaccgugaagcacgagcugagaaccgccaaccugaccggccacgccgagaaggugggcaucgagaacuucgagcugcugaaggugcugggcaccggcgccuacggcaagguguuccuggugagaaagaucagcggccacgacaccggcaagcuguacgccaugaaggugcugaagaaggccaccaucgugcagaaggccaagaccaccgagcacaccagaaccgagagacaggugcuggagcacaucagacagagccccuuccuggugacccugcacuacgccuuccagaccgagaccaagcugcaccugauccuggacuacaucaacggcggcgagcuguucacccaccugagccagagagagagauucaccgagcacgaggugcagaucuacgugggcgagaucgugcuggcccuggagcaccugcacaagcugggcaucaucuacagagacaucaagcuggagaacauccugcuggacagcaacggccacguggugcugaccgacuucggccugagcaaggaguucguggccgacgagaccgagagagccuacagcuucugcggcaccaucgaguacauggcccccgacaucgugagaggcggcgacagcggccacgacaaggccguggacugguggagccugggcgugcugauguacgagcugcugaccggcgccagccccuucaccguggacggcgagaagaacagccaggccgagaucagcagaagaauccugaagagcgagccccccuacccccaggagaugagcgcccuggccaaggaccugauccagagacugcugaugaaggaccccaagaagagacugggcugcggccccagagacgccgacgagaucaaggagcaccuguucuuccagaagaucaacugggacgaccuggccgccaagaaggugcccgcccccuucaagcccgugaucagagacgagcuggacgugagcaacuucgccgaggaguucaccgagauggaccccaccuacagccccgccgcccugccccagagcagcgagaagcuguuccagggcuacagcuucguggcccccagcauccuguucaagagaaacgccgccgugaucgacccccugcaguuccacaugggcguggagagacccggcgugaccaacguggccagaagcgccaugaugaaggacagccccuucuaccagcacuacgaccuggaccugaaggacaagccccugggcgagggcagcuucagcaucugcagaaagugcgugcacaagaagagcaaccaggccuucgccgugaagaucaucagcaagagaauggaggccaacacccagaaggagaucaccgcccugaagcugugcgagggccaccccaacaucgugaagcugcacgagguguuccacgaccagcugcacaccuuccuggugauggagcugcugaacggcggcgagcuguucgagagaaucaagaagaagaagcacuucagcgagaccgaggccagcuacaucaugagaaagcuggugagcgccgugagccacaugcacgacgugggcguggugcacagagaccugaagcccgagaaccugcuguucaccgacgagaacgacaaccuggagaucaagaucaucgacuucggcuucgccagacugaagccccccgacaaccagccccugaagacccccugcuucacccugcacuacgccgcccccgagcugcugaaccagaacggcuacgacgagagcugcgaccuguggagccugggcgugauccuguacaccaugcugagcggccaggugcccuuccagagccacgacagaagccugaccugcaccagcgccguggagaucaugaagaagaucaagaagggcgacuucagcuucgagggcgaggccuggaagaacgugagccaggaggccaaggaccugauccagggccugcugaccguggaccccaacaagagacugaagaugagcggccugagauacaacgaguggcugcaggacggcagccagcugagcagcaacccccugaugacccccgacauccugggcagcagcggcgccgccgugcacaccugcgugaaggccaccuuccacgccuucaacaaguacaagagagagggcuucugccugcagaacguggacaaggccccccuggccaagagaagaaagaugaagaagaccagcaccagcaccgagaccagaagcagcagcagcgagagcagccacagcagcagcagccacagccacggcaagaccacccccaccaagacccugcagcccagcaaccccgccgacagcaacaaccccgagacccuguuccaguucagcgacagcguggccuaa

SEQ ID NO: 22866 - RNA, 2238 nt, Artificial Sequence
  RPS6KA6__Homo_sapiens__NP_055311
augcugcccuucgccccccaggacgagcccugggacagagagauggagguguucagcggcggcggcgccagcagcggcgaggugaacggccugaagaugguggacgagcccauggaggagggcgaggccgacagcugccacgacgagggcguggugaaggagauccccaucacccaccacgugaaggagggcuacgagaaggccgaccccgcccaguucgagcugcugaaggugcugggccagggcagcuucggcaagguguuccuggugagaaagaagaccggccccgacgccggccagcuguacgccaugaaggugcugaagaaggccagccugaaggugagagacagagugagaaccaagauggagagagacauccugguggaggugaaccaccccuucaucgugaagcugcacuacgccuuccagaccgagggcaagcuguaccugauccuggacuuccugagaggcggcgacguguucaccagacugagcaaggaggugcuguucaccgaggaggacgugaaguucuaccuggccgagcuggcccuggcccuggaccaccugcaccagcugggcaucguguacagagaccugaagcccgagaacauccugcuggacgagaucggccacaucaagcugaccgacuucggccugagcaaggagagcguggaccaggagaagaaggccuacagcuucugcggcaccguggaguacauggcccccgagguggugaacagaagaggccacagccagagcgccgacugguggagcuacggcgugcugauguucgagaugcugaccggcacccugcccuuccagggcaaggacagaaacgagaccaugaacaugauccugaaggccaagcugggcaugccccaguuccugagcgccgaggcccagagccugcugagaaugcuguucaagagaaaccccgccaacagacugggcagcgagggcguggaggagaucaagagacaccuguucuucgccaacaucgacugggacaagcuguacaagagagaggugcagccccccuucaagcccgccagcggcaagcccgacgacaccuucugcuucgaccccgaguucaccgccaagacccccaaggacagccccggccugcccgccagcgccaacgcccaccagcuguucaagggcuucagcuucguggccaccagcaucgccgaggaguacaagaucacccccaucaccagcgccaacgugcugcccaucgugcagaucaacggcaacgccgcccaguucggcgagguguacgagcugaaggaggacaucggcgugggcagcuacagcgugugcaagagaugcauccacgccaccaccaacauggaguucgccgugaagaucaucgacaagagcaagagagaccccagcgaggagaucgagauccugaugagauacggccagcaccccaacaucaucacccugaaggacguguucgacgacggcagauacguguaccuggugaccgaccugaugaagggcggcgagcugcuggacagaauccugaagcagaagugcuucagcgagagagaggccagcgacauccuguacgugaucagcaagaccguggacuaccugcacugccagggcguggugcacagagaccugaagcccagcaacauccuguacauggacgagagcgccagcgccgacagcaucagaaucugcgacuucggcuucgccaagcagcugagaggcgagaacggccugcugcugacccccugcuacaccgccaacuucguggcccccgaggugcugaugcagcagggcuacgacgccgccugcgacaucuggagccugggcgugcuguucuacaccaugcuggccggcuacacccccuucgccaacggccccaacgacacccccgaggagauccugcugagaaucggcaacggcaaguucagccugagcggcggcaacugggacaacaucagcgacggcgccaaggaccugcugagccacaugcugcacauggacccccaccagagauacaccgccgagcagauccugaagcacagcuggaucacccacagagaccagcugcccaacgaccagcccaagagaaacgacgugagccacguggugaagggcgccaugguggccaccuacagcgcccugacccacaagaccuuccagcccgugcuggagcccguggccgccagcagccuggcccagagaagaagcaugaagaagagaaccagcaccggccuguaa

SEQ ID NO: 22867 - RNA, 1509 nt, Artificial Sequence
  RPS6KB1__Homo_sapiens__NP_001258971
augagaagaagaagaagaagagacggcuucuaccccgcccccgacuucagagacagagaggccgaggacauggccggcguguucgacaucgaccuggaccagcccgaggacgccggcagcgaggacgagcuggaggagggcggccagcugaacgagagcauggaccacggcggcgugggccccuacgagcugggcauggagcacugcgagaaguucgagaucagcgagaccagcgugaacagaggccccgagaagaucagacccgagugcuucgagcugcugagagugcugggcaagggcggcuacggcaaggccaugaucgugagaaacgccaaggacaccgcccacaccaaggccgagagaaacauccuggaggaggugaagcaccccuucaucguggaccugaucuacgccuuccagaccggcggcaagcuguaccugauccuggaguaccugagcggcggcgagcuguucaugcagcuggagagagagggcaucuucauggaggacaccgccugcuucuaccuggccgagaucagcauggcccugggccaccugcaccagaagggcaucaucuacagagaccugaagcccgagaacaucaugcugaaccaccagggccacgugaagcugaccgacuucggccugugcaaggagagcauccacgacggcaccgugacccacaccuucugcggcaccaucgaguacauggcccccgagauccugaugagaagcggccacaacagagccguggacugguggagccugggcgcccugauguacgacaugcugaccggcgccccccccuucaccggcgagaacagaaagaagaccaucgacaagauccugaagugcaagcugaaccugccccccuaccugacccaggaggccagagaccugcugaagaagcugcugaagagaaacgccgccagcagacugggcgccggccccggcgacgccggcgaggugcaggcccaccccuucuucagacacaucaacugggaggagcugcuggccagaaagguggagccccccuucaagccccugcugcagagcgaggaggacgugagccaguucgacagcaaguucaccagacagacccccguggacagccccgacgacagcacccugagcgagagcgccaaccagguguuccugggcuucaccuacguggcccccagcgugcuggagagcgugaaggagaaguucagcuucgagcccaagaucagaagccccagaagauucaucggcagccccagaacccccgugagccccgugaaguucagccccggcgacuucuggggcagaggcgccagcgccagcaccgccaacccccagacccccguggaguaccccauggagaccagcggcaucgagcagauggacgugaccaugagcggcgaggccagcgccccccugcccaucagacagcccaacagcggccccuacaagaagcaggccuuccccaugaucagcaagagacccgagcaccugagaaugaaccuguaa

SEQ ID NO: 22868 - RNA, 1449 nt, Artificial Sequence
  RPS6KB2__Homo_sapiens__NP_003943
auggccgccguguucgaccuggaccuggagaccgaggagggcagcgagggcgagggcgagcccgagcugagccccgccgacgccugcccccuggccgagcugagagccgccggccuggagcccgugggccacuacgaggagguggagcugaccgagaccagcgugaacgugggccccgagagaaucggcccccacugcuucgagcugcugagagugcugggcaagggcggcuacggcaagguguuccaggugagaaaggugcagggcaccaaccugggcaagaucuacgccaugaaggugcugagaaaggccaagaucgugagaaacgccaaggacaccgcccacaccagagccgagagaaacauccuggagagcgugaagcaccccuucaucguggagcuggccuacgccuuccagaccggcggcaagcuguaccugauccuggagugccugagcggcggcgagcuguucacccaccuggagagagagggcaucuuccuggaggacaccgccugcuucuaccuggccgagaucacccuggcccugggccaccugcacagccagggcaucaucuacagagaccugaagcccgagaacaucaugcugagcagccagggccacaucaagcugaccgacuucggccugugcaaggagagcauccacgagggcgccgugacccacaccuucugcggcaccaucgaguacauggcccccgagauccuggugagaagcggccacaacagagccguggacugguggagccugggcgcccugauguacgacaugcugaccggcagcccccccuucaccgccgagaacagaaagaagaccauggacaagaucaucagaggcaagcuggcccugccccccuaccugacccccgacgccagagaccuggugaagaaguuccugaagagaaaccccagccagagaaucggcggcggccccggcgacgccgccgacgugcagagacaccccuucuucagacacaugaacugggacgaccugcuggccuggagaguggacccccccuucagacccugccugcagagcgaggaggacgugagccaguucgacaccagauucaccagacagacccccguggacagccccgacgacaccgcccugagcgagagcgccaaccaggccuuccugggcuucaccuacguggcccccagcgugcuggacagcaucaaggagggcuucagcuuccagcccaagcugagaagccccagaagacugaacagcagccccagagcccccgugagcccccugaaguucagccccuucgagggcuucagacccagccccagccugcccgagcccaccgagcugccccugcccccccugcugcccccccccccccccagcaccaccgccccccugcccaucagaccccccagcggcaccaagaagagcaagagaggcagaggcagacccggcagauaa

SEQ ID NO: 22869 - RNA, 585 nt, Artificial Sequence
  RPS9__Homo_sapiens__XP_006726028
augcccguggccagaagcugggugugcagaaagaccuacgugacccccagaagacccuucgagaagagcagacuggaccaggagcugaagcugaucggcgaguacggccugagaaacaagagagagguguggagagugaaguucacccuggccaagaucagaaaggccgccagagagcugcugacccuggacgagaaggaccccagaagacuguucgagggcaacgcccugcugagaagacuggugagaaucggcgugcuggacgagggcaagaugaagcuggacuacauccugggccugaagaucgaggacuuccuggagagaagacugcagacccagguguucaagcugggccuggccaagagcauccaccacgccagagugcugaucagacagagacacaucagagugagaaagcagguggugaacauccccagcuucaucgugagacuggacagccagaagcacaucgacuucagccugagaagccccuacggcggcggcagacccggcagagugaagagaaagaacgccaagaagggccagggcggcgccggcgccggcgacgacgaggaggaggacuaa

SEQ ID NO: 22870 - RNA, 888 nt, Artificial Sequence
  RPSA__Homo_sapiens__NP_002286
augagcggcgcccuggacgugcugcagaugaaggaggaggacgugcugaaguuccuggccgccggcacccaccugggcggcaccaaccuggacuuccagauggagcaguacaucuacaagagaaagagcgacggcaucuacaucaucaaccugaagagaaccugggagaagcugcugcuggccgccagagccaucguggccaucgagaaccccgccgacgugagcgugaucagcagcagaaacaccggccagagagccgugcugaaguucgccgccgccaccggcgccacccccaucgccggcagauucacccccggcaccuucaccaaccagauccaggccgccuucagagagcccagacugcugguggugaccgaccccagagccgaccaccagccccugaccgaggccagcuacgugaaccugcccaccaucgcccugugcaacaccgacagcccccugagauacguggacaucgccauccccugcaacaacaagggcgcccacagcgugggccugaugugguggaugcuggccagagaggugcugagaaugagaggcaccaucagcagagagcaccccugggaggugaugcccgaccuguacuucuacagagaccccgaggagaucgagaaggaggagcaggccgccgccgagaaggccgugaccaaggaggaguuccagggcgaguggaccgcccccgcccccgaguucaccgccacccagcccgagguggccgacuggagcgagggcgugcaggugcccagcgugcccauccagcaguuccccaccgaggacuggagcgcccagcccgccaccgaggacuggagcgccgcccccaccgcccaggccaccgagugggugggcgccaccaccgacuggagcuaa

SEQ ID NO: 22871 - RNA, 3534 nt, Artificial Sequence
  RPTOR__Homo_sapiens__NP_001156506
auggagagcgagaugcugcagagcccccugcugggccugggcgaggaggacgaggccgaccugaccgacuggaaccugccccuggccuucaugaagaagagacacugcgagaagaucgagggcagcaagagccuggcccagagcuggagaaugaaggacagaaugaagaccgugagcguggcccuggugcugugccugaacgugggcguggacccccccgacguggugaagaccacccccugcgccagacuggagugcuggaucgacccccugagcaugggcccccagaaggcccuggagaccaucggcgccaaccugcagaagcaguacgagaacuggcagcccagagccagauacaagcagagccuggaccccaccguggacgaggugaagaagcugugcaccagccugagaagaaacgccaaggaggagagagugcuguuccacuacaacggccacggcgugcccagacccaccgugaacggcgagguguggguguucaacaagaacuacacccaguacaucccccugagcaucuacgaccugcagaccuggaugggcagccccagcaucuucguguacgacugcagcaacgccggccugaucgugaagagcuucaagcaguucgcccugcagagagagcaggagcuggagguggccgccaucaaccccaaccacccccuggcccagaugccccugccccccagcaugaagaacugcauccagcuggccgccugcgaggccaccgagcugcugcccaugauccccgaccugcccgccgaccuguucaccagcugccugaccacccccaucaagaucgcccugagaugguucugcaugcagaagugcgugagccuggugcccggcgugacccuggaccugaucgagaagauccccggcagacugaacgacagaagaaccccccugggcgagcugaacuggaucuucaccgccaucaccgacaccaucgccuggaacgugcugcccagagaccuguuccagaagcuguucagacaggaccugcugguggccagccuguucagaaacuuccugcuggccgagagaaucaugagaagcuacaacugcacccccgugagcagccccagacugccccccaccuacaugcacgccauguggcaggccugggaccuggccguggacaucugccugagccagcugcccaccaucaucgaggagggcaccgccuucagacacagccccuucuucgccgagcagcugaccgccuuccagguguggcugaccaugggcguggagaacagaaacccccccgagcagcugcccaucgugcugcaggugcugcugagccaggugcacagacugagagcccuggaccugcugggcagauuccuggaccugggccccugggccgugagccuggcccugagcgugggcaucuuccccuacgugcugaagcugcugcagagcagcgccagagagcugagaccccugcugguguucaucugggccaagauccuggccguggacagcgagcuggugguggcccugagccaccugguggugcaguacgagagcaacuucugcaccguggcccugcaguucaucgaggaggagaagaacuacgcccugcccagccccgccaccaccgagggcggcagccugacccccgugagagacagccccugcacccccagacugagaagcgugagcagcuacggcaacaucagagccguggccaccgccagaagccugaacaagagccugcagaaccugagccugaccgaggagagcggcggcgccguggccuucagccccggcaaccugagcaccagcagcagcgccagcagcacccugggcagccccgagaacgaggagcacauccugagcuucgagaccaucgacaagaugagaagagccagcagcuacagcagccugaacagccugaucggcgugagcuucaacagcguguacacccagaucuggagagugcugcugcaccuggccgccgaccccuaccccgaggugagcgacguggccaugaaggugcugaacagcaucgccuacaaggccaccgugaacgccagaccccagagagugcuggacaccagcagccugacccagagcgcccccgccagccccaccaacaagggcgugcacauccaccaggccggcggcagcccccccgccagcagcaccagcagcagcagccugaccaacgacguggccaagcagcccgugagcagagaccugcccagcggcagacccggcaccaccggccccgccggcgcccaguacaccccccacagccaccaguuccccagaaccagaaagauguucgacaagggccccgagcagaccgccgacgacgccgacgacgccgccggccacaagagcuucaucagcgccaccgugcagaccggcuucugcgacuggagcgccagauacuucgcccagcccgugaugaagauccccgaggagcacgaccuggagagccagaucagaaaggagagagaguggagauuccugagaaacagcagagugagaagacaggcccagcaggugauccagaagggcaucaccagacuggacgaccagaucuuccugaacagaaaccccggcgugcccagcguggugaaguuccaccccuucacccccugcaucgccguggccgacaaggacagcaucugcuucugggacugggagaagggcgagaagcuggacuacuuccacaacggcaaccccagauacaccagagugaccgccauggaguaccugaacggccaggacugcagccugcugcugaccgccaccgacgacggcgccaucagaguguggaagaacuucgccgaccuggagaagaaccccgagauggugaccgccuggcagggccugagcgacaugcugcccaccaccagaggcgccggcauggugguggacugggagcaggagaccggccugcugaugagcagcggcgacgugagaaucgugagaaucugggacaccgacagagagaugaaggugcaggacauccccaccggcgccgacagcugcgugaccagccugagcugcgacagccacagaagccugaucguggccggccugggcgacggcagcaucagaguguacgacagaagaauggcccugagcgagugcagagugaugaccuacagagagcacaccgccuggguggugaaggccagccugcagaagagacccgacggccacaucgugagcgugagcgugaacggcgacgugagaaucuucgaccccagaaugcccgagagcgugaacgugcugcagaucgugaagggccugaccgcccuggacauccacccccaggccgaccugaucgccugcggcagcgugaaccaguucaccgccaucuacaacagcagcggcgagcugaucaacaacaucaaguacuacgacggcuucaugggccagagagugggcgccaucagcugccuggccuuccacccccacuggccccaccuggccgugggcagcaacgacuacuacaucagcguguacagcguggagaagagagugagauaa

SEQ ID NO: 22872 - RNA, 996 nt, Artificial Sequence
  RQCD1__Homo_sapiens__NP_001258563
augcacagccuggccaccgccgcccccgugcccaccacccuggcccagguggacagagagaagaucuaccaguggaucaacgagcugagcagccccgagaccagagagaacgcccugcuggagcugagcaagaagagagagagcgugcccgaccuggcccccaugcuguggcacagcuucggcaccaucgccgcccugcugcaggagaucgugaacaucuaccccagcaucaacccccccacccugaccgcccaccagagcaacagagugugcaacgcccuggcccugcugcagugcguggccagccaccccgagaccagaagcgccuuccuggccgcccacaucccccuguuccuguaccccuuccugcacaccgugagcaagaccagacccuucgaguaccugagacugaccagccugggcgugaucguggagaccggcuuccaccacgugggccaggccgaccuggagcugcccaccagcagcgaccugcccgccagcgccagccagagcgccggcaucaccggcgcccuggugaagaccgacgagcaggaggugaucaacuuccugcugaccaccgagaucaucccccugugccugagaaucauggagagcggcagcgagcugagcaagaccguggccaccuucauccugcagaagauccugcuggacgacaccggccuggccuacaucugccagaccuacgagagauucagccacguggccaugauccugggcaagauggugcugcagcugagcaaggagcccagcgccagacugcugaagcacguggugagaugcuaccugagacugagcgacaaccccagagccagagaggcccugagacagugccugcccgaccagcugaaggacaccaccuucgcccaggugcugaaggacgacaccaccaccaagagauggcuggcccagcuggugaagaaccugcaggagggccaggugaccgaccccagaggcaucccccugcccccccaguaa

SEQ ID NO: 22873 - RNA, 927 nt, Artificial Sequence
  RRAD__Homo_sapiens__NP_001122322
augacccugaacggcggcggcagcggcgccggcggcagcagaggcggcggccaggagagagagagaagaagaggcagcacccccuggggccccgcccccccccugcacagaagaagcaugcccguggacgagagagaccugcaggccgcccugacccccggcgcccugaccgccgccgccgccggcaccggcacccagggccccagacuggacuggcccgaggacagcgaggacagccugagcagcggcggcagcgacagcgacgagagcguguacaaggugcugcugcugggcgcccccggcgugggcaagagcgcccuggccagaaucuucggcggcguggaggacggccccgaggccgaggccgccggccacaccuacgacagaagcaucgugguggacggcgaggaggccagccugaugguguacgacaucugggagcaggacggcggcagauggcugcccggccacugcauggccaugggcgacgccuacgugaucguguacagcgugaccgacaagggcagcuucgagaaggccagcgagcugagagugcagcugagaagagccagacagaccgacgacgugcccaucauccuggugggcaacaagagcgaccuggugagaagcagagaggugagcguggacgagggcagagccugcgccgugguguucgacugcaaguucaucgagaccagcgccgcccugcaccacaacgugcaggcccuguucgagggcguggugagacagaucagacugagaagagacagcaaggaggccaacgccagaagacaggccggcaccagaagaagagagagccugggcaagaaggccaagagauuccugggcagaaucguggccagaaacagcagaaagauggccuucagagccaagagcaagagcugccacgaccugagcgugcuguaa

SEQ ID NO: 22874 - RNA, 942 nt, Artificial Sequence
  RRAGA__Homo_sapiens__NP_006561
augcccaacaccgccaugaagaagaaggugcugcugaugggcaagagcggcagcggcaagaccagcaugagaagcaucaucuucgccaacuacaucgccagagacaccagaagacugggcgccaccaucgacguggagcacagccacgugagauuccugggcaaccuggugcugaaccugugggacugcggcggccaggacaccuucauggagaacuacuucaccagccagagagacaacaucuucagaaacguggaggugcugaucuacguguucgacguggagagcagagagcuggagaaggacaugcacuacuaccagagcugccuggaggccauccugcagaacagccccgacgccaagaucuucugccuggugcacaagauggaccuggugcaggaggaccagagagaccugaucuucaaggagagagaggaggaccugagaagacugagcagaccccuggagugcgccugcuucagaaccagcaucugggacgagacccuguacaaggccuggagcagcaucguguaccagcugauccccaacgugcagcagcuggagaugaaccugagaaacuucgcccagaucaucgaggccgacgaggugcugcuguucgagagagccaccuuccuggugaucagccacuaccagugcaaggagcagagagacgugcacagauucgagaagaucagcaacaucaucaagcaguucaagcugagcugcagcaagcuggccgccagcuuccagagcauggaggugagaaacagcaacuucgccgccuucaucgacaucuucaccagcaacaccuacgugaugguggugaugagcgaccccagcauccccagcgccgccacccugaucaacaucagaaacgccagaaagcacuucgagaagcuggagagaguggacggccccaagcacagccugcugaugagauaa

SEQ ID NO: 22875 - RNA, 384 nt, Artificial Sequence
  RRAS2__Homo_sapiens__NP_001096139
augagagagcaguacaugagaaccggcgagggcuuccugcugguguucagcgugaccgacagaggcagcuucgaggagaucuacaaguuccagagacagauccugagagugaaggacagagacgaguuccccaugauccugaucggcaacaaggccgaccuggaccaccagagacaggugacccaggaggagggccagcagcuggccagacagcugaaggugaccuacauggaggccagcgccaagaucagaaugaacguggaccaggccuuccacgagcuggugagagugaucagaaaguuccaggagcaggagugcccccccagccccgagcccaccagaaaggagaaggacaagaagggcugccacugcgugaucuucuaa

SEQ ID NO: 22876 - RNA, 657 nt, Artificial Sequence
  RRAS__Homo_sapiens__NP_006261
augagcagcggcgccgccagcggcaccggcagaggcagacccagaggcggcggccccggccccggcgaccccccccccagcgagacccacaagcuggugguggugggcggcggcggcgugggcaagagcgcccugaccauccaguucauccagagcuacuucgugagcgacuacgaccccaccaucgaggacagcuacaccaagaucugcagcguggacggcauccccgccagacuggacauccuggacaccgccggccaggaggaguucggcgccaugagagagcaguacaugagagccggccacggcuuccugcugguguucgccaucaacgacagacagagcuucaacgaggugggcaagcuguucacccagauccugagagugaaggacagagacgacuuccccguggugcuggugggcaacaaggccgaccuggagagccagagacaggugcccagaagcgaggccagcgccuucggcgccagccaccacguggccuacuucgaggccagcgccaagcugagacugaacguggacgaggccuucgagcagcuggugagagccgugagaaaguaccaggagcaggagcugccccccagcccccccagcgcccccagaaagaagggcggcggcugccccugcgugcugcuguaa

SEQ ID NO: 22877 - RNA, 2934 nt, Artificial Sequence
  RRBP1__Homo_sapiens__NP_001036041
auggacaucuacgacacccagacccugggcguggugguguucggcggcuucaugguggugagcgccaucggcaucuuccuggugagcaccuucagcaugaaggagaccagcuacgaggaggcccuggccaaccagagaaaggagauggccaagacccaccaccagaagguggagaagaagaagaaggagaagaccguggagaagaagggcaagaccaagaagaaggaggagaagcccaacggcaagauccccgaccacgaccccgcccccaacgugaccgugcugcugagagagcccgugagagcccccgccguggccguggcccccacccccgugcagccccccaucaucguggcccccguggccaccgugcccgccaugccccaggagaagcuggccagcagccccaaggacaagaagaagaaggagaagaagguggccaagguggagcccgccgugagcagcguggugaacagcauccaggugcugaccagcaaggccgccauccuggagaccgcccccaaggagggcagaaacaccgacguggcccagagccccgaggcccccaagcaggaggcccccgccaagaagaagagcggcagcaagaagaagggcccccccgacgccgacggcccccuguaccugcccuacaagacccuggugagcaccgugggcagcaugguguucaacgagggcgaggcccagagacugaucgagauccugagcgagaaggccggcaucauccaggacaccuggcacaaggccacccagaagggcgaccccguggccauccugaagagacagcuggaggagaaggagaagcugcuggccaccgagcaggaggacgccgccguggccaagagcaagcugagagagcugaacaaggagauggccgccgagaaggccaaggccgccgccggcgaggccaaggugaagaagcagcugguggccagagagcaggagaucaccgccgugcaggccagaaugcaggccagcuacagagagcacgugaaggaggugcagcagcugcagggcaagaucagaacccugcaggagcagcuggagaacggccccaacacccagcuggccagacugcagcaggagaacagcauccugagagacgcccugaaccaggccaccagccagguggagagcaagcagaacgccgagcuggccaagcugagacaggagcugagcaaggugagcaaggagcugguggagaagagcgaggccgugagacaggacgagcagcagagaaaggcccuggaggccaaggccgccgccuucgagaagcaggugcugcagcugcaggccagccacagagagagcgaggaggcccugcagaagagacuggacgaggugagcagagagcugugccacacccagagcagccacgccagccugagagccgacgccgagaaggcccaggagcagcagcagcagauggccgagcugcacagcaagcugcagagcagcgaggccgaggugagaagcaagugcgaggagcugagcggccugcacggccagcugcaggaggccagagccgagaacagccagcugaccgagagaaucagaagcaucgaggcccugcuggaggccggccaggccagagacgcccaggacgugcaggccagccaggccgaggccgaccagcagcagaccagacugaaggagcuggagagccaggugagcggccuggagaaggaggccaucgagcugagagaggccguggagcagcagaaggugaagaacaacgaccugagagagaagaacuggaaggccauggaggcccuggccaccgccgagcaggccugcaaggagaagcugcacagccugacccaggccaaggaggagagcgagaagcagcugugccugaucgaggcccagaccauggaggcccugcuggcccugcugcccgagcugagcgugcuggcccagcagaacuacaccgaguggcugcaggaccugaaggagaagggccccacccugcugaagcacccccccgcccccgccgagcccagcagcgaccuggccagcaagcugagagaggccgaggagacccagagcacccugcaggccgagugcgaccaguacagaagcauccuggccgagaccgagggcaugcugagagaccugcagaagagcguggaggaggaggagcagguguggagagccaaggugggcgccgccgaggaggagcugcagaagagcagagugaccgugaagcaccuggaggagaucguggagaagcugaagggcgagcuggagagcagcgaccaggugagagagcacaccagccaccuggaggccgagcuggagaagcacauggccgccgccagcgccgagugccagaacuacgccaaggagguggccggccugagacagcugcugcuggagagccagagccagcuggacgccgccaagagcgaggcccagaagcagagcgacgagcuggcccuggugagacagcagcugagcgagaugaagagccacguggaggacggcgacaucgccggcgcccccgccagcagccccgaggccccccccgccgagcaggaccccgugcagcugaagacccagcuggaguggaccgaggccauccuggaggacgagcagacccagagacagaagcugaccgccgaguucgaggaggcccagaccagcgccugcagacugcaggaggagcuggagaagcugagaaccgccggcccccuggagagcagcgagaccgaggaggccagccagcugaaggagagacuggagaaggagaagaagcugaccagcgaccugggcagagccgccaccagacugcaggagcugcugaagaccacccaggagcagcuggccagagagaaggacaccgugaagaagcugcaggagcagcuggagaaggccgaggacggcagcagcagcaaggagggcaccagcguguaa

SEQ ID NO: 22878 - RNA, 4431 nt, Artificial Sequence
  RREB1__Homo_sapiens__NP_001003700
augaccagcagcagccccgccggccuggagggcagcgaccugagcagcaucaacaccaugaugagcgccgugaugagcgugggcaaggugaccgagaacggcggcagcccccagggcaucaagagccccagcaagccccccggccccaacagaaucggcagaagaaaccaggagaccaaggaggagaagagcagcuacaacugcccccugugcgagaagaucugcaccacccagcaccagcugaccaugcacaucagacagcacaacaccgacaccggcggcgccgaccacagcugcagcaucugcggcaagagccugagcagcgccagcagccuggacagacacaugcuggugcacagcggcgagagacccuacaagugcaccgugugcggccagagcuucaccaccaacggcaacaugcacagacacaugaagauccacgagaaggaccccaacagcgccaccgccaccgccccccccagcccccugaagagaagaagacugagcagcaagagaaagcugagccacgacgccgagagcgagagagaggaccccgcccccgccaagaagaugguggaggacggccagagcggcgaccuggagaagaaggccgacgagguguuccacugccccgugugcuucaaggaguucgugugcaaguacggccuggagacccacauggagacccacagcgacaacccccugagaugcgacaucugcugcgugaccuucagaacccacagaggccugcugagacacaacgcccuggugcacaagcagcugcccagagacgccaugggcagacccuucauccagaacaaccccagcauccccgccggcuuccacgaccugggcuucaccgacuucagcugcagaaaguuccccagaaucagccaggccuggugcgagaccaaccugagaagaugcaucagcgagcagcacagauucgugugcgacaccugcgacaaggccuuccccaugcugugcagccuggcccugcacaagcagacccacguggccgccgaccagggccaggagaagccccaggccaccccccugcccggcgacgcccuggaccagaagggcuuccuggcccugcugggccugcagcacaccaaggacgugagacccgcccccgccgaggagccccugcccgacgacaaccaggccauccagcugcagacccugaagugccagcugccccaggaccccggcugcaccaaccugcugagccugagccccuucgaggccgccagccugggcggcagccugaccgugcugcccgccaccaaggacagcaucaagcaccugagccugcagcccuuccagaagggcuucaucauccagcccgacagcagcaucguggugaagcccaucagcggcgagagcgccaucgagcuggccgacauccagcagauccugaagauggccgccagcgcccccccccagaucagccugccccccuucagcaaggcccccgccgccccccugcaggccaucuucaagcacaugcccccccugaagcccaagccccuggugacccccagaaccgugguggccaccagcaccccccccccccugaucaacgcccagcaggccagccccggcugcaucagccccagccugcccccccccccccugaagcugcugaagggcagcguggaggccgccagcaacgcccaccugcugcagagcaagagcggcacccagccccacgccgccaccagacugagccugcagcagcccagagccgagcugcccggccagcccgagaugaagacccagcuggagcaggacagcaucaucgaggcccugcugccccugagcauggaggccaagaucaagcaggagaucaccgagggcgagcugaaggccuucaugaccgcccccggcggcaagaagacccccgccaugagaaaggugcuguaccccugcagauucugcaaccagguguucgccuucagcggcgugcugagagcccacgugagaagccaccugggcaucagccccuaccagugcaacaucugcgacuacaucgccgccgacaaggccgcccugaucagacaccugagaacccacagcggcgagagacccuacaucugcaagaucugccacuaccccuucaccgugaaggccaacugcgagagacaccugagaaagaagcaccugaaggccaccagaaaggacaucgagaagaacaucgaguacgugagcagcagcgccgccgagcugguggacgccuucugcgcccccgacaccgugugcagacugugcggcgaggaccugaagcacuacagagcccugagaauccacaugagaacccacugcggcagaggccugggcggcggccacaagggcagaaagcccuucgagugcaaggagugcagcgccgccuucgccgccaagagaaacugcauccaccacauccugaagcagcaccugcacgugcccgagcaggacaucgagagcuacgugcuggccgccgacggccugggccccgccgaggcccccgccgccgaggccagcggcagaggcgaggacagcggcugcgccgcccugggcgacugcaagccccugaccgccuuccuggagccccagaacggcuuccugcacagaggccccacccagcccccccccccccacgugagcaucaagcuggagcccgccagcagcuucgccguggacuucaacgagccccuggacuucagccagaagggccuggcccuggugcaggugaagcaggagaacaucagcuuccugagccccagcagccuggugcccuacgacugcagcauggagcccaucgaccugagcauccccaagaacuucagaaagggcgacaaggaccuggccacccccagcgaggccaagaagcccgaggaggaggccggcagcagcgagcagcccagccccugccccgcccccggccccagccugcccgugacccugggccccagcggcauccuggagagccccauggcccccgcccccgccgccacccccgagccccccgcccagccccugcagggccccgugcagcuggccgugcccaucuacagcagcgcccuggugagcagccccccccuggugggcagcagcgcccugcugagcggcaccgcccugcugagaccccugagacccaagcccccccugcugcugcccaagccccccgugaccgaggagcugcccccccuggccagcaucgcccagaucaucagcagcgugagcagcgcccccacccugcugaagaccaagguggccgaccccggccccgccagcaccggcagcaacaccaccgccagcgacagccugggcggcagcgugcccaaggccgccaccaccgccacccccgccgccaccaccagccccaaggagagcagcgagccccccgcccccgccagcagccccgaggccgccagccccaccgagcagggccccgccggcaccagcaagaagagaggcagaaagagaggcaugagaagcagacccagagccaacagcggcggcguggaccuggacagcagcggcgaguucgccagcaucgagaagaugcuggccaccaccgacaccaacaaguucagccccuuccugcagaccgccgaggacaacacccaggacgagguggccggcgcccccgccgaccaccacggccccagcgacgaggagcagggcagcccccccgaggacaagcugcugagagccaagagaaacagcuacaccaacugccugcagaagaucaccugcccccacugccccagaguguuccccugggccagcagccugcagagacacaugcugacccacaccggccagaagcccuuccccugccagaagugcgacgccuucuucagcaccaagagcaacugcgagagacaccagcugagaaagcacggcgugaccaccugcagccugagaagaaacggccugaucccccagagcaaggagagcgacgugggcagccacgacagcaccggcgagagacccuacaagugccagaccugcgagagaaccuucacccugaagcacagccuggugagacaccagagaauccaccagaaggccagacacgccaagcaccacggcaaggacagcgacaaggaggagagaggcgaggaggacagcgagaacgagagcacccacagcggcaacaacgccgugagcgagaacgaggccgagcuggcccccaacgccagcaaccacauggccgugaccagaagcagaaaggagggccuggccagcgccaccaaggacugcagccacagagaggagaaggugaccgccggcuggcccagcgagcccggccagggcgaccugaaccccgagagccccgccgcccugggccaggaccugcuggagcccagaagcaagagacccgcccaccccauccuggccaccgccgacggcgccagccagcuggugggcauggaguaa

SEQ ID NO: 22879 - RNA, 1014 nt, Artificial Sequence
  RRH__Homo_sapiens__NP_006574
augcugagaaacaaccugggcaacagcagcgacagcaagaacgaggacggcagcguguucagccagaccgagcacaacaucguggccaccuaccugaucauggccggcaugaucagcaucaucagcaacaucaucgugcugggcaucuucaucaaguacaaggagcugagaacccccaccaacgccaucaucaucaaccuggccgugaccgacaucggcgugagcagcaucggcuaccccaugagcgccgccagcgaccuguacggcagcuggaaguucggcuacgccggcugccagguguacgccggccugaacaucuucuucggcauggccagcaucggccugcugaccgugguggccguggacagauaccugaccaucugccugcccgacgugggcagaagaaugaccaccaacaccuacaucggccugauccugggcgccuggaucaacggccuguucugggcccugaugcccaucaucggcugggccagcuacgcccccgaccccaccggcgccaccugcaccaucaacuggagaaagaacgacagaagcuucgugagcuacaccaugaccgugaucgccaucaacuucaucgugccccugaccgugauguucuacugcuacuaccacgugacccugagcaucaagcaccacaccaccagcgacugcaccgagagccugaacagagacuggagcgaccagaucgacgugaccaagaugagcgugaucaugaucugcauguuccugguggccuggagccccuacagcaucgugugccugugggccagcuucggcgaccccaagaagauccccccccccauggccaucaucgccccccuguucgccaagagcagcaccuucuacaaccccugcaucuacgugguggccaacaagaaguucagaagagccaugcuggccauguucaagugccagacccaccagaccaugcccgugaccagcauccugcccauggacgugagccagaacccccuggccagcggcagaaucuaa

SEQ ID NO: 22880 - RNA, 2379 nt, Artificial Sequence
  RRM1__Homo_sapiens__NP_001024
augcacgugaucaagagagacggcagacaggagagagugauguucgacaagaucaccagcagaauccagaagcugugcuacggccugaacauggacuucguggaccccgcccagaucaccaugaaggugauccagggccuguacagcggcgugaccaccguggagcuggacacccuggccgccgagaccgccgccacccugaccaccaagcaccccgacuacgccauccuggccgccagaaucgccgugagcaaccugcacaaggagaccaagaagguguucagcgacgugauggaggaccuguacaacuacaucaacccccacaacggcaagcacagccccaugguggccaagagcacccuggacaucgugcuggccaacaaggacagacugaacagcgccaucaucuacgacagagacuucagcuacaacuacuucggcuucaagacccuggagagaagcuaccugcugaagaucaacggcaagguggccgagagaccccagcacaugcugaugagagugagcgugggcauccacaaggaggacaucgacgccgccaucgagaccuacaaccugcugagcgagagaugguucacccacgccagccccacccuguucaacgccggcaccaacagaccccagcugagcagcugcuuccugcugagcaugaaggacgacagcaucgagggcaucuacgacacccugaagcagugcgcccugaucagcaagagcgccggcggcaucggcguggccgugagcugcaucagagccaccggcagcuacaucgccggcaccaacggcaacagcaacggccuggugcccaugcugagaguguacaacaacaccgccagauacguggaccagggcggcaacaagagacccggcgccuucgccaucuaccuggagcccuggcaccuggacaucuucgaguuccuggaccugaagaagaacaccggcaaggaggagcagagagccagagaccuguucuucgcccuguggauccccgaccuguucaugaagagaguggagaccaaccaggacuggagccugaugugccccaacgagugccccggccuggacgagguguggggcgaggaguucgagaagcuguacgccagcuacgagaagcagggcagagugagaaagguggugaaggcccagcagcugugguacgccaucaucgagagccagaccgagaccggcacccccuacaugcuguacaaggacagcugcaacagaaagagcaaccagcagaaccugggcaccaucaagugcagcaaccugugcaccgagaucguggaguacaccagcaaggacgagguggccgugugcaaccuggccagccuggcccugaacauguacgugaccagcgagcacaccuacgacuucaagaagcuggccgaggugaccaaggugguggugagaaaccugaacaagaucaucgacaucaacuacuaccccgugcccgaggccugccugagcaacaagagacacagacccaucggcaucggcgugcagggccuggccgacgccuucauccugaugagauaccccuucgagagcgccgaggcccagcugcugaacaagcagaucuucgagaccaucuacuacggcgcccuggaggccagcugcgaccuggccaaggagcagggccccuacgagaccuacgagggcagccccgugagcaagggcauccugcaguacgacauguggaacgugacccccaccgaccugugggacuggaaggugcugaaggagaagaucgccaaguacggcaucagaaacagccugcugaucgcccccaugcccaccgccagcaccgcccagauccugggcaacaacgagagcaucgagcccuacaccagcaacaucuacaccagaagagugcugagcggcgaguuccagaucgugaacccccaccugcugaaggaccugaccgagagaggccuguggcacgaggagaugaagaaccagaucaucgccugcaacggcagcauccagagcauccccgagauccccgacgaccugaagcagcuguacaagaccgugugggagaucagccagaagaccgugcugaagauggccgccgagagaggcgccuucaucgaccagagccagagccugaacauccacaucgccgagcccaacuacggcaagcugaccagcaugcacuucuacggcuggaagcagggccugaagaccggcauguacuaccugagaaccagacccgccgccaaccccauccaguucacccugaacaaggagaagcugaaggacaaggagaaggugagcaaggaggaggaggagaaggagagaaacaccgccgccauggugugcagccuggagaacagagacgagugccugaugugcggcagcuaa

SEQ ID NO: 22881 - RNA, 1272 nt, Artificial Sequence
  RRM2B__Homo_sapiens__NP_001165948
augcugcugcugagacugcccccccacagaagccacgccagcccccuggacugcaagcugcaggacagaugcagaaagugcuacagccccagaagcggccaggccugcccccccgcccuggccgccgccuggcugagaagaugcgagagaagaggcggcagacccagaggcggcagaagaaaggagcugacccugggccugagacccgccagaugcagcgcccccggccccgccaaggacgacgccuggagaccccaggccggcagaagcagcagcgacaccaacgagagcgagaucaagagcaacgaggagccccugcugagaaagagcagcagaagauucgugaucuuccccauccaguaccccgacaucuggaagauguacaagcaggcccaggccagcuucuggaccgccgaggagguggaccugagcaaggaccugccccacuggaacaagcugaaggccgacgagaaguacuucaucagccacauccuggccuucuucgccgccagcgacggcaucgugaacgagaaccugguggagagauucagccaggaggugcaggugcccgaggccagaugcuucuacggcuuccagauccugaucgagaacgugcacagcgagauguacagccugcugaucgacaccuacaucagagaccccaagaagagagaguuccuguucaacgccaucgagaccaugcccuacgugaagaagaaggccgacugggcccugagauggaucgccgacagaaagagcaccuucggcgagagagugguggccuucgccgccguggagggcguguucuucagcggcagcuucgccgccaucuucuggcugaagaagagaggccugaugcccggccugaccuucagcaacgagcugaucagcagagacgagggccugcacugcgacuucgccugccugauguuccaguaccuggugaacaagcccagcgaggagagagugagagagaucaucguggacgccgugaagaucgagcaggaguuccugaccgaggcccugcccgugggccugaucggcaugaacugcauccugaugaagcaguacaucgaguucguggccgacagacugcugguggagcugggcuucagcaagguguuccaggccgagaaccccuucgacuucauggagaacaucagccuggagggcaagaccaacuucuucgagaagagagugagcgaguaccagagauucgccgugauggccgagaccaccgacaacguguucacccuggacgccgacuucuaa

SEQ ID NO: 22882 - RNA, 1170 nt, Artificial Sequence
  RRM2__Homo_sapiens__NP_001025
augcugagccugagagugccccuggcccccaucaccgacccccagcagcugcagcugagcccccugaagggccugagccugguggacaaggagaacaccccccccgcccugagcggcaccagagugcuggccagcaagaccgccagaagaaucuuccaggagcccaccgagcccaagaccaaggccgccgcccccggcguggaggacgagccccugcugagagagaaccccagaagauucgugaucuuccccaucgaguaccacgacaucuggcagauguacaagaaggccgaggccagcuucuggaccgccgaggagguggaccugagcaaggacauccagcacugggagagccugaagcccgaggagagauacuucaucagccacgugcuggccuucuucgccgccagcgacggcaucgugaacgagaaccugguggagagauucagccaggaggugcagaucaccgaggccagaugcuucuacggcuuccagaucgccauggagaacauccacagcgagauguacagccugcugaucgacaccuacaucaaggaccccaaggagagagaguuccuguucaacgccaucgagaccaugcccugcgugaagaagaaggccgacugggcccugagauggaucggcgacaaggaggccaccuacggcgagagagugguggccuucgccgccguggagggcaucuucuucagcggcagcuucgccagcaucuucuggcugaagaagagaggccugaugcccggccugaccuucagcaacgagcugaucagcagagacgagggccugcacugcgacuucgccugccugauguucaagcaccuggugcacaagcccagcgaggagagagugagagagaucaucaucaacgccgugagaaucgagcaggaguuccugaccgaggcccugcccgugaagcugaucggcaugaacugcacccugaugaagcaguacaucgaguucguggccgacagacugaugcuggagcugggcuucagcaagguguucagaguggagaaccccuucgacuucauggagaacaucagccuggagggcaagaccaacuucuucgagaagagagugggcgaguaccagagaaugggcgugaugagcagccccaccgagaacagcuucacccuggacgccgacuucuaa

SEQ ID NO: 22883 - RNA, 1866 nt, Artificial Sequence
  RRN3__Homo_sapiens__NP_001287993
auggccgccccccugcugcacaccagacugcccggcgacgccgccgccagcagcagcgccgugaagaagcugggcgccagcagaaccggcaucagcaacaugagagcccuggagaacgacuucuucaacagcccccccagaaagaccgugagauucggcggcaccgugaccgaggugcugcugaaguacaagaagggcgagaccaacgacuucgagcugcugaagaaccagcugcuggaccccgacaucaagagacugcccuggcugaacagaagccagaccgugguggaggaguaccuggccuuccugggcaaccuggugagcgcccagaccguguuccugagacccugccugagcaugaucgccagccacuucgugccccccagagugaucaucaaggagggcgacguggacgugagcgacagcgacgacgaggacgacaaccugcccgccaacuucgacaccugccacagagcccugcagaucaucgccagauacgugcccagcacccccugguuccugaugcccauccugguggagaaguuccccuucgugagaaagagcgagagaacccuggagugcuacgugcacaaccugcugagaaucagcguguacuuccccacccugagacacgagauccuggagcugaucaucgagaagcugcugaagcuggacgugaacgccagcagacagggcaucgaggacgccgaggagaccgccacccagaccugcggcggcaccgacagcaccgagggccuguucaacauggacgaggacgaggagaccgagcacgagaccaaggccggccccgagagacuggaccagauggugcaccccguggccgagagacuggacauccugaugagccuggugcugagcuacaugaaggacgugugcuacguggacggcaagguggacaacggcaagaccaaggaccuguacagagaccugaucaacaucuucgacaagcugcugcugcccacccacgccagcugccacgugcaguucuucauguucuaccugugcagcuucaagcugggcuucgccgaggccuuccuggagcaccuguggaagaagcugcaggaccccagcaaccccgccaucaucagacaggccgccggcaacuacaucggcagcuuccuggccagagccaaguucaucccccugaucaccgugaagagcugccuggaccugcuggugaacuggcugcacaucuaccugaacaaccaggacagcggcaccaaggccuucugcgacguggcccugcacggccccuucuacagcgccugccaggccguguucuacaccuucguguucagacacaagcagcugcugagcggcaaccugaaggagggccugcaguaccugcagagccugaacuucgagagaaucgugaugagccagcugaacccccugaagaucugccugcccagcguggugaacuucuucgccgccaucaccaacaaguaccagcugguguucugcuacaccaucaucgagagaaacaacagacagaugcugcccgugaucagaagcaccgccggcggcgacagcgugcagaucugcaccaacccccuggacaccuucuuccccuucgaccccugcgugcugaagagaagcaagaaguucaucgaccccaucuaccaggugugggaggacaugagcgccgaggagcugcaggaguucaagaagcccaugaagaaggacaucguggaggacgaggacgacgacuuccugaagggcgaggugccccagaacgacaccgugaucggcaucacccccagcagcuucgacacccacuucagaagccccagcagcagcgugggcagcccccccgugcuguacaugcagcccagcccccuguaa

SEQ ID NO: 22884 - RNA, 834 nt, Artificial Sequence
  RRNAD1__Homo_sapiens__NP_001136032
augcccggcaucagcgccagaggccugagccacgagggcagaaagcagcuggccgugaaccugaccagagugcuggcccuguacagaagcauccuggacgccuacaucaucgaguucuucaccgacaaccugugggacacccugcccugcagcuggcaggaggcccuggacggccugaagcccccccagcuggccaccaugcugcugggcaugcccggcgagggcgagguggugagauacagaagcguguggccccugacccugcuggcccugaagagcaccgccugcgcccuggccuucaccagaaugcccggcuuccagacccccagcgaguuccuggagaaccccagccagagcagcagacugaccgcccccuucagaaagcacgugagacccaagaagcagcacgagaucagaagacugggcgagcuggugaagaagcugagcgacuucaccggcugcacccaggugguggacgugggcagcggccagggccaccugagcagauucauggcccugggccugggccugauggugaagagcaucgagggcgaccagagacugguggagagagcccagagacuggaccaggagcugcugcaggcccuggagaaggaggagaagagaaacccccagaucugcgccgccggcgccaccgccagcggcgccagaagccccgccgccaccgagagcggcugccccagcggccccagaggccccggcgagcccugcggcggccugcugcagcccggcagcaccgccugccccaccggcggcgacgccuacagcaccggccccgccgccgugcccagcggcaccggcuuccccugcuaa

SEQ ID NO: 22885 - RNA, 2277 nt, Artificial Sequence
  RRP1B__Homo_sapiens__NP_055871
auggcccccgccaugcagcccgccgagauccaguucgcccagagacuggccagcagcgagaagggcaucagagacagagccgugaagaagcugagacaguacaucagcgugaagacccagagagagaccggcggcuucagccaggaggagcugcugaagaucuggaagggccuguucuacugcaugugggugcaggacgagccccugcugcaggaggagcuggccaacaccaucgcccagcuggugcacgccgugaacaacagcgccgcccagcaccuguucauccagaccuucuggcagaccaugaacagagaguggaagggcaucgacagacugagacuggacaaguacuacaugcugaucagacuggugcugagacagagcuucgaggugcugaagagaaacggcugggaggagagcagaaucaagguguuccuggacgugcugaugaaggaggugcugugccccgagagccagagccccaacggcgugagauuccacuucaucgacaucuaccuggacgagcugagcaaggugggcggcaaggagcugcuggccgaccagaaccugaaguucaucgaccccuucugcaagaucgccgccaagaccaaggaccacacccuggugcagaccaucgccagaggcguguucgaggccaucguggaccagagccccuucgugcccgaggagaccauggaggagcagaagaccaaggugggcgacggcgaccugagcgccgaggagauccccgagaacgaggugagccugagaagagccgugagcaagaagaagaccgcccugggcaagaaccacagcagaaaggacggccugagcgacgagagaggcagagacgacugcggcaccuucgaggacaccggcccccugcugcaguucgacuacaaggccguggccgacagacugcuggagaugaccagcagaaagaacaccccccacuucaacagaaagagacugagcaagcugaucaagaaguuccaggaccugagcgagggcagcagcaucagccagcugagcuucgccgaggacaucagcgccgacgaggacgaccagauccugagccagggcaagcacaagaagaagggcaacaagcugcuggagaagaccaaccuggagaaggagaagggcagcagaguguucugcguggaggaggaggacagcgagagcagccugcagaagagaagaagaaagaagaagaagaagcaccaccugcagcccgagaaccccggccccggcggcgccgcccccagccuggagcagaacagaggcagagagcccgaggccagcggccugaaggcccugaaggccagaguggccgagcccggcgccgaggccaccagcagcaccggcgaggagagcggcagcgagcacccccccgccgugcccaugcacaacaagagaaagagacccagaaagaagagccccagagcccacagagagaugcuggagagcgccgugcugccccccgaggacaugagccagagcggccccagcggcagccacccccagggccccagaggcagccccaccggcggcgcccagcugcugaagagaaagagaaagcugggcguggugcccgugaacggcagcggccugagcacccccgccuggcccccccugcagcaggagggcccccccaccggccccgccgagggcgccaacagccacaccacccugccccagagaagaagacugcagaagaagaaggccggccccggcagccuggagcugugcggccugcccagccagaagaccgccagccugaagaagagaaagaagaugagagugaugagcaaccugguggagcacaacggcgugcuggagagcgaggccggccagccccaggcccugggcagcagcggcaccugcagcagccugaagaagcagaagcugagagccgagagcgacuucgugaaguucgacacccccuuccugcccaagccccuguucuucagaagagccaagagcagcaccgccacccacccccccggccccgccgugcagcugaacaagacccccagcagcagcaagaaggugaccuucggccugaacagaaacaugaccgccgaguucaagaagaccgacaagagcauccuggugagccccaccggccccagcagaguggccuucgaccccgagcagaagccccugcacggcgugcugaagacccccaccagcagccccgccagcagcccccugguggccaagaagccccugaccaccacccccagaagaagacccagagccauggacuucuucuaa

SEQ ID NO: 22886 - RNA, 1386 nt, Artificial Sequence
  RRP1__Homo_sapiens__NP_003674
auggugagcagagugcagcugccccccgagauccagcuggcccagagacuggccggcaacgagcaggugaccagagacagagccgugagaaagcugagaaaguacaucguggccagaacccagagagccgccggcggcuucacccacgacgagcugcugaagguguggaagggccuguucuacugcauguggaugcaggacaagccccugcugcaggaggagcugggcagaaccaucagccagcuggugcacgccuuccagaccaccgaggcccagcaccuguuccugcaggccuucuggcagaccaugaacagagaguggaccggcaucgacagacugagacuggacaaguucuacaugcugaugagaauggugcugaacgagagccugaaggugcugaagaugcagggcugggaggagagacagaucgaggagcugcuggagcugcugaugaccgagauccugcaccccagcagccaggcccccaacggcgugaagagccacuucaucgagaucuuccuggaggagcugaccaaggugggcgccgaggagcugaccgccgaccagaaccugaaguucaucgaccccuucugcagaaucgccgccagaaccaaggacagccuggugcugaacaacaucaccagaggcaucuucgagaccaucguggagcaggccccccuggccaucgaggaccugcugaacgagcuggacacccaggacgaggagguggccagcgacagcgacgagagcagcgagggcggcgagagaggcgacgcccugagccagaagagaagcgagaagccccccgccggcagcaucugcagagccgagcccgaggccggcgaggagcaggccggcgacgacagagacagcggcggccccgugcugcaguucgacuacgaggccguggccaacagacuguucgagauggccagcagacagagcacccccagccagaacagaaagagacuguacaaggugaucagaaagcugcaggaccuggccggcggcaucuuccccgaggacgagauccccgagaaggccugcagaagacugcuggagggcagaagacagaagaagaccaagaagcagaagagacugcugagacugcagcaggagagaggcaagggcgagaaggagccccccagccccggcauggagagaaagagaagcagaagaagaggcgugggcgccgaccccgaggccagagccgaggccggcgagcagcccggcaccgccgagagagcccugcugagagaccagcccagaggcagaggccagagaggcgccagacagagaagaagaacccccagaccccugaccagcgccagagccaaggccgccaacgugcaggagcccgagaagaagaagaagagaagagaguaa

SEQ ID NO: 22887 - RNA, 1428 nt, Artificial Sequence
  RRP9__Homo_sapiens__NP_004695
augagcgccaccgccgccgccagaaagagaggcaagcccgccagcggcgccggcgccggcgccggcgccggcaagagaagaagaaaggccgacagcgccggcgacagaggcaagagcaagggcggcggcaagaugaacgaggagaucagcagcgacagcgagagcgagagccuggcccccagaaagcccgaggaggaggaggaggaggagcuggaggagaccgcccaggagaagaagcugagacuggccaagcuguaccuggagcagcugagacagcaggaggaggagaaggccgaggccagagccuucgaggaggaccagguggccggcagacugaaggaggacgugcuggagcagagaggcagacugcagaagcugguggccaaggagauccaggcccccgccagcgccgacaucagagugcugagaggccaccagcugagcaucaccugccugguggugacccccgacgacagcgccaucuucagcgccgccaaggacugcagcaucaucaaguggagcguggagagcggcagaaagcugcacgugauccccagagccaagaagggcgccgagggcaagccccccggccacagcagccacgugcugugcauggccaucagcagcgacggcaaguaccuggccagcggcgacagaagcaagcugauccugaucugggaggcccagagcugccagcaccuguacaccuucaccggccacagagacgccgugagcggccuggccuucagaagaggcacccaccagcuguacagcaccagccacgacagaagcgugaagguguggaacguggccgagaacagcuacguggagacccuguucggccaccaggacgccguggccgcccuggacgcccugagcagagagugcugcgugaccgccggcggcagagacggcaccgugagaguguggaagauccccgaggagagccagcugguguucuacggccaccagggcagcaucgacugcauccaccugaucaacgaggagcacauggugagcggcgccgacgacggcagcguggcccuguggggccugagcaagaagagaccccuggcccugcagagagaggcccacggccugagaggcgagcccggccuggagcagcccuucuggaucagcagcguggccgcccugcugaacaccgaccugguggccaccggcagccacagcagcugcgugagacuguggcagugcggcgagggcuucagacagcuggaccugcugugcgacaucccccuggugggcuucaucaacagccugaaguucagcagcagcggcgacuuccugguggccggcgugggccaggagcacagacugggcagaugguggagaaucaaggaggccagaaacagcgugugcaucaucccccugagaagagugcccgugccccccgccgccggcagcuaa

SEQ ID NO: 22888 - RNA, 1098 nt, Artificial Sequence
  RRS1__Homo_sapiens__NP_055984
auggagggccagagcguggaggagcugcuggccaaggccgagcaggacgaggccgagaagcugcagagaaucaccgugcacaaggagcuggagcugcaguucgaccugggcaaccugcuggccagcgacagaaacccccccaccggccugagaugcgccggccccacccccgaggccgagcugcaggcccuggccagagacaacacccagcugcugaucaaccagcuguggcagcugcccaccgagagaguggaggaggccaucguggccagacugcccgagcccaccaccagacugcccagagagaagccccugcccagacccagaccccugaccagauggcagcaguucgccagacugaagggcaucagacccaagaagaagaccaaccuggugugggacgaggugagcggccaguggagaagaagauggggcuaccagagagccagagacgacaccaaggaguggcugaucgaggugcccggcaacgccgacccccuggaggaccaguucgccaagagaauccaggccaagaaggagagaguggccaagaacgagcugaacagacugagaaaccuggccagagcccacaagaugcagcugcccagcgccgccggccugcaccccaccggccaccagagcaaggaggagcugggcagagccaugcagguggccaaggugagcaccgccagcgugggcagauuccaggagagacugcccaaggagaaggugcccagaggcagcggcaagaagagaaaguuccagccccuguucggcgacuucgccgccgagaagaagaaccagcuggagcugcugagagugaugaacagcaagaagccccagcuggacgugaccagagccaccaacaagcagaugagagaggaggaccaggaggaggccgccaagagaagaaagaugagccagaagggcaagagaaagggcggcagacagggccccggcggcaagagaaagggcggcccccccagccagggcggcaagagaaagggcggccugggcggcaagaugaacagcggcccccccggccugggcggcaagagaaagggcggccagagacccggcggcaagagaagaaaguaa

SEQ ID NO: 22889 - RNA, 675 nt, Artificial Sequence
  RS1__Homo_sapiens__NP_000321
augagcagaaagaucgagggcuuccugcugcugcugcuguucggcuacgaggccacccugggccugagcagcaccgaggacgagggcgaggaccccugguaccagaaggccugcaagugcgacugccagggcggccccaacgcccuguggagcgccggcgccaccagccuggacugcauccccgagugccccuaccacaagccccugggcuucgagagcggcgaggugacccccgaccagaucaccugcagcaaccccgagcaguacgugggcugguacagcagcuggaccgccaacaaggccagacugaacagccagggcuucggcugcgccuggcugagcaaguuccaggacagcagccaguggcugcagaucgaccugaaggagaucaaggugaucagcggcauccugacccagggcagaugcgacaucgacgaguggaugaccaaguacagcgugcaguacagaaccgacgagagacugaacuggaucuacuacaaggaccagaccggcaacaacagaguguucuacggcaacagcgacagaaccagcaccgugcagaaccugcugagaccccccaucaucagcagauucaucagacugaucccccugggcuggcacgugagaaucgccaucagaauggagcugcuggagugcgugagcaagugcgccuaa

SEQ ID NO: 22890 - RNA, 1086 nt, Artificial Sequence
  RSAD2__Homo_sapiens__XP_011508716
augugggugcugacccccgccgccuucgccggcaagcugcugagcguguucagacagccccugagcagccuguggagaagccuggugccccuguucugcuggcugagagccaccuucuggcugcuggccaccaagagaagaaagcagcagcuggugcugagaggccccgacgagaccaaggaggaggaggaggaccccccccugcccaccacccccaccagcgugaacuaccacuucaccagacagugcaacuacaagugcggcuucugcuuccacaccgccaagaccagcuucgugcugccccuggaggaggccaagagaggccugcugcugcugaaggaggccggcauggagaagaucaacuucagcggcggcgagcccuuccugcaggacagaggcgaguaccugggcaagcuggugagauucugcaagguggagcugagacugcccagcgugagcaucgugagcaacggcagccugaucagagagagaugguuccagaacuacggcgaguaccuggacauccuggccaucagcugcgacagcuucgacgaggaggugaacgugcugaucggcagaggccagggcaagaagaaccacguggagaaccugcagaagcugagaagauggugcagagacuacagaguggccuucaagaucaacagcgugaucaacagauucaacguggaggaggacaugaccgagcagaucaaggcccugaaccccgugagauggaagguguuccagugccugcugaucgagggcgagaacugcggcgaggacgcccugagagaggccgagagauucgugaucggcgacgaggaguucgagagauuccuggagagacacaaggaggugagcugccuggugcccgagagcaaccagaagaugaaggacagcuaccugauccuggacgaguacaugagauuccugaacugcagaaagggcagaaaggaccccagcaagagcauccuggacgugggcguggaggaggccaucaaguucagcggcuucgacgagaagauguuccugaagagaggcggcaaguacaucuggagcaaggccgaccugaagcuggacugguaa

SEQ ID NO: 22891 - RNA, 4326 nt, Artificial Sequence
  RSF1__Homo_sapiens__NP_057662
auggccaccgccgccgccgccgccgccgugauggccccccccggcugccccggcagcugccccaacuucgccguggugugcagcuuccuggagagauacggcccccugcuggaccugcccgagcugcccuuccccgagcuggagagagugcugcaggcccccccccccgacgugggcaacggcgaggugcccaaggagcugguggagcugcaccugaagcugaugagaaagaucggcaagagcgugaccgccgacagaugggagaaguaccugaucaagaucugccaggaguucaacagcaccugggccugggagauggagaagaagggcuaccuggagaugagcguggagugcaagcuggcccugcugaaguaccugugcgagugccaguucgacgacaaccugaaguucaagaacaucaucaacgaggaggacgccgacaccaugagacugcagcccaucggcagagacaaggacggccugauguacugguaccagcuggaccaggaccacaacgugagaauguacaucgaggagcaggacgaccaggacggcagcagcuggaagugcaucgugagaaacagaaacgagcuggccgagacccuggcccugcugaaggcccagaucgaccccgugcugcugaagaacagcagccagcaggacaacagcagcagagagagccccagccuggaggacgaggagaccaagaaggaggaggagacccccaagcaggaggagcagaaggagagcgagaagaugaagagcgaggagcagcccauggaccuggagaacagaagcaccgccaacgugcuggaggagaccaccgugaagaaggagaaggaggacgagaaggagcuggugaagcugcccgugaucgugaagcuggagaagccccugcccgagaacgaggagaagaagaucaucaaggaggagagcgacagcuucaaggagaacgugaagcccaucaagguggaggugaaggagugcagagccgaccccaaggacaccaagagcagcauggagaagcccguggcccaggagcccgagagaaucgaguucggcggcaacaucaagagcagccacgagaucaccgagaagagcaccgaggagaccgagaagcugaagaacgaccagcaggccaagaucccccugaagaagagagagaucaagcugagcgacgacuucgacagccccgugaagggcccccugugcaagagcgugacccccaccaaggaguuccugaaggacgagaucaagcaggaggaggagaccugcaagagaaucagcaccaucaccgcccugggccacgagggcaagcagcuggugaacggcgaggugagcgacgagagaguggcccccaacuucaagaccgagcccaucgagaccaaguucuacgagaccaaggaggagagcuacagccccagcaaggacagaaacaucaucaccgagggcaacggcaccgagagccugaacagcgugaucaccagcaugaagaccggcgagcuggagaaggagaccgccccccugagaaaggacgccgacagcagcaucagcgugcuggagauccacagccagaaggcccagaucgaggagcccgacccccccgagauggagaccagccuggacagcagcgagauggccaaggaccugagcagcaagaccgcccugagcagcaccgagagcugcaccaugaagggcgaggagaagagccccaagaccaagaaggacaagagaccccccauccuggagugccuggagaagcuggagaagagcaagaagaccuuccuggacaaggacgcccagagacugagccccauccccgaggaggugcccaagagcacccuggagagcgagaagcccggcagccccgaggccgccgagaccagcccccccagcaacaucaucgaccacugcgagaagcuggccagcgagaaggaggugguggagugccagagcaccagcaccgugggcggccagagcgugaagaagguggaccuggagacccugaaggaggacagcgaguucaccaagguggagauggacaaccuggacaacgcccagaccagcggcaucgaggagcccagcgagaccaagggcagcaugcagaagagcaaguucaaguacaagcuggugcccgaggaggagaccaccgccagcgagaacaccgagaucaccagcgagagacagaaggagggcaucaagcugaccaucagaaucagcagcagaaagaagaagcccgacagcccccccaaggugcuggagcccgagaacaagcaggagaagaccgagaaggaggaggagaagaccaacgugggcagaacccugagaagaagccccagaaucagcagacccaccgccaagguggccgagaucagagaccagaaggccgacaagaagagaggcgagggcgaggacgagguggaggaggagagcaccgcccugcagaagaccgacaagaaggagauccugaagaagagcgagaaggacaccaacagcaaggugagcaaggugaagcccaagggcaaggugagauggaccggcagcagaaccagaggcagauggaaguacagcagcaacgacgagagcgagggcagcggcagcgagaagagcagcgccgccagcgaggaggaggaggagaaggagagcgaggaggccauccuggccgacgacgacgagcccugcaagaagugcggccugcccaaccaccccgagcugauccugcugugcgacagcugcgacagcggcuaccacaccgccugccugagacccccccugaugaucauccccgacggcgagugguucugcccccccugccagcacaagcugcugugcgagaagcuggaggagcagcugcaggaccuggacguggcccugaagaagaaggagagagccgagagaagaaaggagagacugguguacgugggcaucagcaucgagaacaucauccccccccaggagcccgacuucagcgaggaccaggaggagaagaagaaggacagcaagaagagcaaggccaaccugcuggagagaagaagcaccagaaccagaaagugcaucagcuacagauucgacgaguucgacgaggccaucgacgaggccaucgaggacgacaucaaggaggccgacggcggcggcgugggcagaggcaaggacaucagcaccaucaccggccacagaggcaaggacaucagcaccauccuggacgaggagagaaaggagaacaagagaccccagagagccgccgccgccagaagaaagaagagaagaagacugaacgaccuggacagcgacagcaaccuggacgaggaggagagcgaggacgaguucaagaucagcgacggcagccaggacgaguucguggugagcgacgagaaccccgacgagagcgaggaggacccccccagcaacgacgacagcgacaccgacuucugcagcagaagacugagaagacaccccagcagacccaugagacagagcagaagacugagaagaaagacccccaagaagaaguacagcgacgacgacgaggaggaggagagcgaggagaacagcagagacagcgagagcgacuucagcgacgacuucagcgacgacuucguggagaccagaagaagaagaagcagaagaaaccagaagagacagaucaacuacaaggaggacagcgagagcgacggcagccagaagagccugagaagaggcaaggagaucagaagagugcacaagagaagacugagcagcagcgagagcgaggagagcuaccugagcaagaacagcgaggacgacgagcuggccaaggagagcaagagaagcgugagaaagagaggcagaagcaccgacgaguacagcgaggccgacgaggaggaggaggaggaggagggcaagcccagcagaaagagacugcacagaaucgagaccgacgaggaggagagcugcgacaacgcccacggcgacgccaaccagcccgccagagacagccagcccagagugcugcccagcgagcaggagagcaccaagaagcccuacagaaucgagagcgacgaggaggaggacuucgagaacgugggcaaggugggcagcccccuggacuacagccugguggaccugcccagcaccaacggccagagccccggcaaggccaucgagaaccugaucggcaagcccaccgagaagagccagacccccaaggacaacagcaccgccagcgccagccuggccagcaacggcaccagcggcggccaggaggccggcgcccccgaggaggaggaggacgagcugcugagagugaccgaccugguggacuacgugugcaacagcgagcagcuguaa

SEQ ID NO: 22892 - RNA, 1473 nt, Artificial Sequence
  RSL1D1__Homo_sapiens__NP_056474
auggaggacagcgccagcgccagccugagcagcgccgccgccaccggcaccagcaccagcacccccgccgcccccaccgccagaaagcagcuggacaaggagcaggugagaaaggccguggacgcccugcugacccacugcaagagcagaaagaacaacuacggccugcugcugaacgagaacgagagccuguuccugaugguggugcuguggaagauccccagcaaggagcugagagugagacugacccugccccacagcaucagaagcgacagcgaggacaucugccuguucaccaaggacgagcccaacagcacccccgagaagaccgagcaguucuacagaaagcugcugaacaagcacggcaucaagaccgugagccagaucaucagccugcagacccugaagaaggaguacaagagcuacgaggccaagcugagacugcugagcagcuucgacuucuuccugaccgacgccagaaucagaagacugcugcccagccugaucggcagacacuucuaccagagaaagaaggugcccgugagcgugaaccugcugagcaagaaccugagcagagagaucaacgacugcaucggcggcaccgugcugaacaucagcaagagcggcagcugcagcgccaucagaaucggccacgugggcaugcagaucgagcacaucaucgagaacaucguggccgugaccaagggccugagcgagaagcugcccgagaagugggagagcgugaagcugcuguucgugaagaccgagaagagcgccgcccugcccaucuucagcagcuucgugagcaacugggacgaggccaccaagagaagccugcugaacaagaagaagaaggaggccagaagaaagagaagagagagaaacuucgagaagcagaaggagagaaagaagaagagacagcaggccagaaagaccgccagcgugcugagcaaggacgacguggcccccgagagcggcgacaccaccgugaagaagcccgagagcaagaaggagcagacccccgagcacggcaagaagaagagaggcagaggcaaggcccaggugaaggccaccaacgagagcgaggacgagaucccccagcuggugcccaucggcaagaagacccccgccaacgagaagguggagauccagaagcacgccaccggcaagaagagccccgccaagagccccaaccccagcacccccagaggcaagaagagaaaggcccugcccgccagcgagacccccaaggccgccgagagcgagacccccggcaagagccccgagaagaagcccaagaucaaggaggaggccgugaaggagaagagccccagccugggcaagaaggacgccagacagacccccaagaagcccgaggccaaguucuucaccacccccagcaagagcgugagaaaggccagccacacccccaagaaguggcccaagaagcccaaggugccccagagcaccuaa

SEQ ID NO: 22893 - RNA, 492 nt, Artificial Sequence
  RSL24D1__Homo_sapiens__NP_057388
augagaaucgagaagugcuacuucugcagcggccccaucuaccccggccacggcaugauguucgugagaaacgacugcaagguguucagauucugcaagagcaagugccacaagaacuucaagaagaagagaaaccccagaaaggugagauggaccaaggccuucagaaaggccgccggcaaggagcugaccguggacaacagcuucgaguucgagaagagaagaaacgagcccaucaaguaccagagagagcuguggaacaagaccaucgacgccaugaagagaguggaggagaucaagcagaagagacaggccaaguucaucaugaacagacugaagaagaacaaggagcugcagaaggugcaggacaucaaggaggugaagcagaacauccaccugaucagagccccccuggccggcaagggcaagcagcuggaggagaagauggugcagcagcugcaggaggacguggacauggaggacgcccccuaa

SEQ ID NO: 22894 - RNA, 930 nt, Artificial Sequence
  RSPH1__Homo_sapiens__NP_543136
augagcgaccugggcagcgaggagcuggaggaggagggcgagaacgacaucggcgaguacgagggcggcagaaacgaggccggcgagagacacggcagaggcagagccagacugcccaacggcgacaccuacgagggcagcuacgaguucggcaagagacacggccagggcaucuacaaguucaagaacggcgccagauacaucggcgaguacgugagaaacaagaagcacggccagggcaccuucaucuaccccgacggcagcagauacgagggcgagugggccaacgaccugagacacggccacggcguguacuacuacaucaacaacgacaccuacaccggcgagugguucgcccaccagagacacggccagggcaccuaccuguacgccgagaccggcagcaaguacgugggcaccugggugaacggccagcaggagggcaccgccgagcugauccaccugaaccacagauaccagggcaaguuccugaacaagaaccccgugggccccggcaaguacguguucgacgugggcugcgagcagcacggcgaguacagacugaccgacauggagagaggcgaggaggaggaggaggaggagcuggugaccguggugcccaaguggaaggccacccagaucaccgagcuggcccuguggacccccacccugcccaagaagcccaccagcaccgacggccccggccaggacgcccccggcgccgagagcgccggcgagcccggcgaggaggcccaggcccugcuggagggcuucgagggcgagauggacaugagacccggcgacgaggacgccgacgugcugagagaggagagcagagaguacgaccaggaggaguucagauacgacauggacgagggcaacaucaacagcgaggaggaggagaccagacagagcgaccugcaggacuaa

SEQ ID NO: 22895 - RNA, 2151 nt, Artificial Sequence
  RSPH4A__Homo_sapiens__NP_001010892
auggaggacagcaccagccccaagcaggagaaggagaaccaggaggagcugggcgagaccagaagacccugggagggcaagaccgccgccagcccccaguacagcgagcccgagagcagcgagccccuggaggccaagcagggccccgagaccggcagacagagcagaagcagcagacccuggagcccccagagcagagccaagaccccccugggcggccccgccggccccgagaccagcagccccgcccccgugagccccagagagcccagcagcagccccagcccccuggcccccgccagacaggaccuggccgcccccccccagagcgacagaaccaccagcgugauccccgaggccggcacccccuaccccgacccccuggagcagagcagcgacaagagagagagcaccccccaccacaccagccagagcgagggcaacaccuuccagcagagccagcagcccaagccccaccugugcggcagaagagacgugagcuacaacaacgccaagcagaaggagcugagauucgacguguuccaggaggaggacagcaacagcgacuacgaccugcagcagcccgcccccggcggcagcgagguggcccccagcaugcuggagaucaccauccagaacgccaaggccuaccugcugaagaccagcagcaacagcggcuucaaccuguacgaccaccugagcaacaugcugaccaagauccugaacgagagacccgagaacgccguggacaucuucgagaacaucagccaggacgugaagauggcccacuucagcaagaaguucgacgcccugcagaacgagaacgagcugcugcccaccuacgagaucgccgagaagcagaaggcccuguuccugcagggccaccuggagggcguggaccaggagcuggaggacgagaucgccgagaacgcccugcccaacgugauggagagcgccuucuacuucgagcaggccggcgugggccugggcaccgacgagaccuacagaaucuuccuggcccugaagcagcugaccgacacccaccccauccagagaugcagauucuggggcaagauccugggccuggagaugaacuacaucguggccgagguggaguucagagagggcgaggacgaggaggagguggaggaggaggacguggccgaggagagagacaacggcgagagcgaggcccacgaggacgaggaggacgagcugcccaagagcuucuacaaggccccccaggccauccccaaggaggagagcagaaccggcgccaacaaguacguguacuucgugugcaacgagcccggcagacccugggugaagcugccccccgugauccccgcccagaucgugaucgccagaaagaucaagaaguucuucaccggcagacuggacgcccccaucaucagcuacccccccuuccccggcaacgagagcaacuaccugagagcccagaucgccagaaucagcgccggcacccacgugagcccccugggcuucuaccaguucggcgaggaggagggcgaggaggaggaggaggccgagggcggcagaaacagcuucgaggagaaccccgacuucgagggcauccaggugaucgaccugguggagagccugagcaacugggugcaccacgugcagcacauccugagccagggcagaugcaacugguucaacagcauccagaagaacgaggaggaggaggaggaggaggacgaggagaaggacgacagcgacuacaucgagcaggaggugggccugccccugcugacccccaucagcgaggaccuggagauccagaacaucccccccuggaccaccagacugagcagcaaccugaucccccaguacgccaucgccgugcugcagagcaaccuguggcccggcgccuacgccuucagcaacggcaagaaguucgagaacuucuacaucggcuggggccacaaguacagccccgacaacuacaccccccccgugcccccccccguguaccaggaguaccccagcggccccgagaucaccgagauggacgaccccagcguggaggaggagcaggccuucagagccgcccaggaggccgugcugcuggccgccgagaacgaggagagcgaggaggacgaggacgaggaggacgacuacgacuaa

SEQ ID NO: 22896 - RNA, 921 nt, Artificial Sequence
  RSPH9__Homo_sapiens__NP_001180270
auggacgccgacagccugcugcugagccuggagcuggccagcggcagcggccagggccugagccccgacagaagagccagccugcugaccagccugaugcuggugaagagagacuacagauacgacagagugcuguucuggggcagaauccugggccugguggccgacuacuacaucgcccagggccugagcgaggaccagcuggcccccagaaagacccuguacagccugaacugcaccgaguggagccugcugccccccgccaccgaggagaugguggcccagagcagcguggugaagggcagauucaugggcgaccccagcuacgaguacgagcacaccgagcugcagaaggugaacgagggcgagaagguguucgaggaggagaucgugaucgacaaggccguggccaucauccccagaggcgcccuguucaagacccccuucggccccacccacgugaacagaaccuucgagggccugagccugagcgaggccaagaagcugagcagcuacuuccacuucagagagcccguggagcugaagaacaagacccugcuggagaaggccgaccuggaccccagccuggacuucauggacagccuggagcacgacauccccaagggcagcgaggccguggugcagggcgacuucaccuggcugcugagcagaugcggcuucggcuggcccugcagcugggacagcugcagcgugagcaugagagugcuggagcaccccgacggcgagggccagugccccggcggcgccgcccagcccgcccuggccggcccccaccugcugcccugcagcccccaccaggagcuguggcugagacugagaggccacuggagagaggagcacggccuggcccugcacgccaucgagugggagcccgccuggauguuccugaacagaguguaa

SEQ ID NO: 22897 - RNA, 540 nt, Artificial Sequence
  RSPO2__Homo_sapiens__NP_001269792
augcaguucagacuguucagcuucgcccugaucauccugaacugcauggacuacagccacugccagggcaacagauggagaagaagcaagagaggcugcagaaucgagaacugcgacagcugcuucagcaaggacuucugcaccaagugcaaggugggcuucuaccugcacagaggcagaugcuucgacgagugccccgacggcuucgccccccuggaggagaccauggagugcgugggcugcgaggugggccacuggagcgaguggggcaccugcagcagaaacaacagaaccugcggcuucaaguggggccuggagaccagaaccagacagaucgugaagaagcccgugaaggacaccauccugugccccaccaucgccgagagcagaagaugcaagaugaccaugagacacugccccggcggcaagagaacccccaaggccaaggagaagagaaacaagaagaagaagagaaagcugaucgagagagcccaggagcagcacagcguguuccuggccaccgacagagccaaccaguaa

SEQ ID NO: 22898 - RNA, 819 nt, Artificial Sequence
  RSPO3__Homo_sapiens__NP_116173
augcaccugagacugaucagcuggcuguucaucauccugaacuucauggaguacaucggcagccagaacgccagcagaggcagaagacagagaagaaugcaccccaacgugagccagggcugccagggcggcugcgccaccugcagcgacuacaacggcugccugagcugcaagcccagacuguucuucgcccuggagagaaucggcaugaagcagaucggcgugugccugagcagcugccccagcggcuacuacggcaccagauaccccgacaucaacaagugcaccaagugcaaggccgacugcgacaccugcuucaacaagaacuucugcaccaagugcaagagcggcuucuaccugcaccugggcaagugccuggacaacugccccgagggccuggaggccaacaaccacaccauggagugcgugagcaucgugcacugcgaggugagcgaguggaaccccuggagccccugcaccaagaagggcaagaccugcggcuucaagagaggcaccgagaccagagugagagagaucauccagcaccccagcgccaagggcaaccugugcccccccaccaacgagaccagaaagugcaccgugcagagaaagaagugccagaagggcgagagaggcaagaagggcagagagagaaagagaaagaagcccaacaagggcgagagcaaggaggccauccccgacagcaagagccuggagagcagcaaggagauccccgagcagagagagaacaagcagcagcagaagaagagaaaggugcaggacaagcagaagagcgugagcgugagcaccgugcacuaa

SEQ ID NO: 22899 - RNA, 705 nt, Artificial Sequence
  RSPO4__Homo_sapiens__NP_001025042
augagagccccccugugccugcugcugcugguggcccacgccguggacaugcuggcccugaacagaagaaagaagcaggugggcaccggccugggcggcaacugcaccggcugcaucaucugcagcgaggagaacggcugcagcaccugccagcagagacuguuccuguucaucagaagagagggcaucagacaguacggcaagugccugcacgacugcccccccggcuacuucggcaucagaggccaggaggugaacagaugcaagaagugcggcgccaccugcgagagcugcuucagccaggacuucugcaucagaugcaagagacaguucuaccuguacaagggcaagugccugcccaccugcccccccggcacccuggcccaccagaacaccagagagugccagggcgagugcgagcugggccccuggggcggcuggagccccugcacccacaacggcaagaccugcggcagcgccuggggccuggagagcagagugagagaggccggcagagccggccacgaggaggccgccaccugccaggugcugagcgagagcagaaagugccccauccagagacccugccccggcgagagaagccccggccagaagaagggcagaaaggacagaagacccagaaaggacagaaagcuggacagaagacuggacgugagacccagacagcccggccugcagcccuaa

SEQ ID NO: 22900 - RNA, 831 nt, Artificial Sequence
  RSRC1__Homo_sapiens__NP_001258763
augggcagaagaagcagcgacaccgaggaggagagcagaagcaagagaaagaagaagcacagaagaagaagcagcagcagcagcagcagcgacagcagaaccuacagcagaaagaagggcggcagaaagagcagaagcaagagcagaagcuggagcagagaccugcagcccagaagccacagcuacgacagaagaagaagacacagaagcagcagcagcagcagcuacggcagcagaagaaagagaagcagaagcagaagcagaggcagaggcaagagcuacagagugcagagaagcagaagcaagagcagaaccagaagagagagcggcaacaucaaggccggccuggagcaccugccccccgccgagcaggccaaggccagacugcagcuggugcuggaggccgccgccaaggccgacgaggcccugaaggccaaggagagaaacgaggaggaggccaagagaagaaaggaggaggaccaggccacccugguggagcaggugaagagagugaaggagaucgaggccaucgagagcgacagcuucgugcagcagaccuucagaagcagcaaggaggugaagaagagcguggagcccagcgaggugaagcaggccaccagcaccagcggccccgccagcgccguggccgacccccccagcaccgagaaggagaucgaccccaccagcauccccaccgccaucaaguaccaggacgacaacagccuggcccaccccaaccuguucaucgagaaggccgacgccgaggagaagugguucaagagacugaucgcccugagacaggagagacugaugggcagccccguggccuaa

SEQ ID NO: 22901 - RNA, 1305 nt, Artificial Sequence
  RSRC2__Homo_sapiens__NP_075388
auggccgccagcgacaccgagagagacggccuggcccccgagaagaccagccccgacagagacaagaagaaggagcagagcgaggugagcgugagccccagagccagcaagcaccacuacagcagaagcagaagcagaagcagagagagaaagagaaagagcgacaacgagggcagaaagcacagaagcagaagcagaagcaaggagggcagaagacacgagagcaaggacaagagcagcaagaagcacaagagcgaggagcacaacgacaaggagcacagcagcgacaagggcagagagagacugaacagcagcgagaacggcgaggacagacacaagagaaaggagagaaagagcagcagaggcagaagccacagcagaagcagaagcagagagagaagacacagaagcagaagcagagagagaaagaagagcagaagcagaagcagagagagaaagaagagcagaagcagaagcagagagagaaagaagagcagaagcagaagcagagagagaaagagaagaaucagaagcagaagcagaagcagaagcagacacagacacagaaccagaagcagaagcagaaccagaagcagaagcagagacagaaagaagagaaucgagaagcccagaagauucagcagaagccugagcagaacccccagccccccccccuucagaggcagaaacaccgccauggacgcccaggaggcccuggccagaagacuggagagagccaagaagcugcaggagcagagagagaaggagaugguggagaagcagaagcagcaggagaucgccgccgccgccgccaccggcggcagcgugcugaacguggccgcccugcuggccagcggcacccaggugaccccccagaucgccauggccgcccagauggccgcccugcaggccaaggcccuggccgagaccggcaucgccgugcccagcuacuacaaccccgccgccgugaaccccaugaaguucgccgagcaggagaagaagagaaagaugcuguggcagggcaagaaggagggcgacaagagccagagcgccgagaucugggagaagcugaacuucggcaacaaggaccagaacgugaaguucagaaagcugaugggcaucaagagcgaggacgaggccggcugcagcagcguggacgaggagagcuacaagacccugaagcagcaggaggagguguucagaaaccuggacgcccaguacgagauggccagaagccagacccacacccagagaggcaugggccugggcuucaccagcagcaugagaggcauggacgccguguaa

SEQ ID NO: 22902 - RNA, 681 nt, Artificial Sequence
  RSRP1__Homo_sapiens__XP_011540100
augagcaacuacgugaacgacauguggcccggcagcccccaggagaaggacagccccagcaccagcagaagcggcggcagcagcagacugagcagcagaagcagaagcagaagcuucagcagaagcagcagaagccacagcagagugagcagcagauucagcagcagaagcagaagaagcaagagcagaagcagaagcagaagaagacaccagagaaaguacagaagauacagcagaagcuacagcagaagcagaagcagaagcagaagcagaagauacagagagagaagauacggcuucaccagaagauacuacagaagccccagcagauacagaagcagaagcagaagcagaagcagaagcagaggcagaagcuacugcggcagagccuacgccaucgccagaggccagagauacuacggcuucggcagaaccguguaccccgaggagcacagcagauggagagacagaagcagaaccagaagcagaagcagaacccccuucagacugagcgagaaggacagaauggagcugcuggagaucgccaagaccaacgccgccaaggcccugggcaccaccaacaucgaccugcccgccagccugagaaccgugcccagcgccaaggagaccagcagaggcaucggcgugagcagcaacggcgccaagcccgagauguucuaa

SEQ ID NO: 22903 - RNA, 834 nt, Artificial Sequence
  RSU1__Homo_sapiens__NP_036557
augagcaagagccugaagaagcugguggaggagagcagagagaagaaccagcccgagguggacaugagcgacagaggcaucagcaacaugcuggacgugaacggccuguucacccugagccacaucacccagcuggugcugagccacaacaagcugaccauggugccccccaacaucgccgagcugaagaaccuggaggugcugaacuucuucaacaaccagaucgaggagcugcccacccagaucagcagccugcagaagcugaagcaccugaaccugggcaugaacagacugaacacccugcccagaggcuucggcagccugcccgcccuggaggugcuggaccugaccuacaacaaccugagcgagaacagccugcccggcaacuucuucuaccugaccacccugagagcccuguaccugagcgacaacgacuucgagauccugccccccgacaucggcaagcugaccaagcugcagauccugagccugagagacaacgaccugaucagccugcccaaggagaucggcgagcugacccagcugaaggagcugcacauccagggcaacagacugaccgugcugccccccgagcugggcaaccuggaccugaccggccagaagcagguguucaaggccgagaacaaccccugggugacccccaucgccgaccaguuccagcugggcgugagccacguguucgaguacaucagaagcgagaccuacaaguaccuguacggcagacacaugcaggccaaccccgagccccccaagaagaacaacgacaagagcaagaagaucagcagaaagccccuggccgccaagaacagauaa

SEQ ID NO: 22904 - RNA, 1518 nt, Artificial Sequence
  RTCB__Homo_sapiens__NP_055121
augagcagaagcuacaacgacgagcugcaguuccuggagaagaucaacaagaacugcuggagaaucaagaagggcuucgugcccaacaugcagguggagggcguguucuacgugaacgacgcccuggagaagcugauguucgaggagcugagaaacgccugcagaggcggcggcgugggcggcuuccugcccgccaugaagcagaucggcaacguggccgcccugcccggcaucgugcacagaagcaucggccugcccgacgugcacagcggcuacggcuucgccaucggcaacauggccgccuucgacaugaacgaccccgaggccguggugagccccggcggcgugggcuucgacaucaacugcggcgugagacugcugagaaccaaccuggacgagagcgacgugcagcccgugaaggagcagcuggcccaggccauguucgaccacauccccgugggcgugggcagcaagggcgugauccccaugaacgccaaggaccuggaggaggcccuggagaugggcguggacuggagccugagagagggcuacgccugggccgaggacaaggagcacugcgaggaguacggcagaaugcugcaggccgaccccaacaaggugagcgccagagccaagaagagaggccugccccagcugggcacccugggcgccggcaaccacuacgccgagauccaggugguggacgagaucuucaacgaguacgccgccaagaagaugggcaucgaccacaagggccaggugugcgugaugauccacagcggcagcagaggccugggccaccagguggccaccgacgcccugguggccauggagaaggccaugaagagagacaagaucaucgugaacgacagacagcuggccugcgccagaaucgccagccccgagggccaggacuaccugaagggcauggccgccgccggcaacuacgccugggugaacagaagcagcaugaccuuccugaccagacaggccuucgccaagguguucaacaccacccccgacgaccuggaccugcacgugaucuacgacgugagccacaacaucgccaagguggagcagcacgugguggacggcaaggagagaacccugcuggugcacagaaagggcagcaccagagccuuccccccccaccacccccugaucgccguggacuaccagcugaccggccagcccgugcugaucggcggcaccaugggcaccugcagcuacgugcugaccggcaccgagcagggcaugaccgagaccuucggcaccaccugccacggcgccggcagagcccugagcagagccaagagcagaagaaaccuggacuuccaggacgugcuggacaagcuggccgacaugggcaucgccaucagaguggccagccccaagcuggugauggaggaggcccccgagagcuacaagaacgugaccgacguggugaacaccugccacgacgccggcaucagcaagaaggccaucaagcugagacccaucgccgugaucaagggcuaa

SEQ ID NO: 22905 - RNA, 3903 nt, Artificial Sequence
  RTEL1__Homo_sapiens__NP_001269938
augcccaagaucgugcugaacggcgugaccguggacuuccccuuccagcccuacaagugccagcaggaguacaugaccaaggugcuggagugccugcagcagaaggugaacggcauccuggagagccccaccggcaccggcaagacccugugccugcugugcaccacccuggccuggagagagcaccugagagacggcaucagcgccagaaagaucgccgagagagcccagggcgagcuguuccccgacagagcccugagcagcuggggcaacgccgccgccgccgccggcgaccccaucgccugcuacaccgacauccccaagaucaucuacgccagcagaacccacagccagcugacccaggugaucaacgagcugagaaacaccagcuacagacccaaggugugcgugcugggcagcagagagcagcugugcauccaccccgaggugaagaagcaggagagcaaccaccugcagauccaccugugcagaaagaagguggccagcagaagcugccacuucuacaacaacguggaggagaagagccuggagcaggagcuggccagccccauccuggacaucgaggaccuggugaagagcggcagcaagcacagagugugccccuacuaccugagcagaaaccugaagcagcaggccgacaucaucuucaugcccuacaacuaccugcuggacgccaagagcagaagagcccacaacaucgaccugaagggcaccguggugaucuucgacgaggcccacaacguggagaagaugugcgaggagagcgccagcuucgaccugaccccccacgaccuggccagcggccuggacgugaucgaccaggugcuggaggagcagaccaaggccgcccagcagggcgagccccaccccgaguucagcgccgacagccccagccccggccugaacauggagcuggaggacaucgccaagcugaagaugauccugcugagacuggagggcgccaucgacgccguggagcugcccggcgacgacagcggcgugaccaagcccggcagcuacaucuucgagcuguucgccgaggcccagaucaccuuccagaccaagggcugcauccuggacagccuggaccagaucauccagcaccuggccggcagagccggcguguucaccaacaccgccggccugcagaagcuggccgacaucauccagaucguguucagcguggaccccagcgagggcagccccggcagccccgccggccugggcgcccugcagagcuacaaggugcacauccaccccgacgccggccacagaagaaccgcccagagaagcgacgccuggagcaccaccgccgccagaaagagaggcaaggugcugagcuacuggugcuucagccccggccacagcaugcacgagcuggugagacagggcgugagaagccugauccugaccagcggcacccuggcccccgugagcagcuucgcccuggagaugcagauccccuuccccgugugccuggagaacccccacaucaucgacaagcaccagaucugggugggcguggugcccagaggccccgacggcgcccagcugagcagcgccuucgacagaagauucagcgaggagugccugagcagccugggcaaggcccugggcaacaucgccagaguggugcccuacggccugcugaucuucuuccccagcuaccccgugauggagaagagccuggaguucuggagagccagagaccuggccagaaagauggaggcccugaagccccuguucguggagcccagaagcaagggcagcuucagcgagaccaucagcgccuacuacgccagaguggccgcccccggcagcaccggcgccaccuuccuggccgugugcagaggcaaggccagcgagggccuggacuucagcgacaccaacggcagaggcgugaucgugaccggccugcccuacccccccagaauggaccccagaguggugcugaagaugcaguuccuggacgagaugaagggccagggcggcgccggcggccaguuccugagcggccaggagugguacagacagcaggccagcagagccgugaaccaggccaucggcagagugaucagacacagacaggacuacggcgccguguuccugugcgaccacagauucgccuucgccgacgccagagcccagcugcccagcugggugagaccccacgugagaguguacgacaacuucggccacgugaucagagacguggcccaguucuucagaguggccgagagaaccaugcccgcccccgcccccagagccaccgcccccagcgugagaggcgaggacgccgugagcgaggccaagagccccggccccuucuucagcaccagaaaggccaagagccuggaccugcacgugcccagccugaagcagagaagcagcggcagccccgccgccggcgaccccgagagcagccugugcguggaguacgagcaggagcccgugcccgccagacagagacccagaggccugcuggccgcccuggagcacagcgagcagagagccggcagccccggcgaggagcaggcccacagcugcagcacccugagccugcugagcgagaagagacccgccgaggagcccagaggcggcagaaagaagaucagacuggugagccaccccgaggagcccguggccggcgcccagaccgacagagccaagcuguucaugguggccgugaagcaggagcugagccaggccaacuucgccaccuucacccaggcccugcaggacuacaagggcagcgacgacuucgccgcccuggccgccugccugggcccccuguucgccgaggaccccaagaagcacaaccugcugcagggcuucuaccaguucgugagaccccaccacaagcagcaguucgaggaggugugcauccagcugaccggcagaggcugcggcuacagacccgagcacagcauccccagaagacagagagcccagcccgugcuggaccccaccggcagaaccgcccccgaccccaagcugaccgugagcaccgccgccgcccagcagcuggacccccaggagcaccugaaccagggcagaccccaccugagccccagacccccccccaccggcgaccccggcagccagccccaguggggcagcggcgugcccagagccggcaagcagggccagcacgccgugagcgccuaccuggccgacgccagaagagcccugggcagcgccggcugcagccagcugcuggccgcccugaccgccuacaagcaggacgacgaccuggacaaggugcuggccgugcuggccgcccugaccaccgccaagcccgaggacuucccccugcugcacagauucagcauguucgugagaccccaccacaagcagagauucagccagaccugcaccgaccugaccggcagacccuaccccggcauggagccccccggcccccaggaggagagacuggccgugccccccgugcugacccacagagccccccagcccggccccagcagaagcgagaagaccggcaagacccagagcaagaucagcagcuuccugagacagagacccgccggcaccgugggcgccggcggcgaggacgccggccccagccagagcagcggccccccccacggccccgccgccagcgaguggggcgagccccacggcagagacaucgccggccagcaggccaccggcgcccccggcggcccccugagcgccggcugcgugugccagggcugcggcgccgaggacguggugcccuuccagugccccgccugcgacuuccagagaugccaggccugcuggcagagacaccugcaggccagcagaaugugccccgccugccacaccgccagcagaaagcagagcgugaugcagguguucuggcccgagccccaguaa

SEQ ID NO: 22906 - RNA, 492 nt, Artificial Sequence
  RTKN2__Homo_sapiens__NP_001269870
auggagggccccagccugagaggccccgcccugagacuggccggccugcccacccagcaggacugcaacauccaggagaagaucgaccuggagaucagaaugagagagggcaucuggaagcugcugagccugagcacccagaaggaccaggugcugcacgccgugaagaaccugauggugugcaacgccagacugauggccuacaccagcgagcugcagaagcuggaggagcagaucgccaaccagaccggcagaugcgacgugaaguucgagagcaaggagagaaccgccugcaagggcaagaucgccaucagcgacaucagaaucccccugauguggaaggacagcgaccacuucagcaacaaggagagaagcagaagauacgccaucuucugccuguucaagaugggcgccaacguguucgacaccgacguggugaacguggacaagaccaucaccgacaucugcuucgagaacgugaccauccuguaa

SEQ ID NO: 22907 - RNA, 1692 nt, Artificial Sequence
  RTKN__Homo_sapiens__NP_001015055
auguucagcagaaaccacagaagcagagugaccguggccagaggcagcgcccuggagauggaguucaagagaggcagauucagacugagccuguucagcgaccugcccgaggacaccgagcugcagagaaagcuggaccacgagaucagaaugagagagggcgccugcaagcugcuggccgccugcagccagagagagcaggcccuggaggccaccaagagccugcuggugugcaacagcagaauccugagcuacaugggcgagcugcagagaagaaaggaggcccaggugcugggcaagaccagcagaagacccagcgacagcggcccccccgccgagagaagccccugcagaggcagagugugcaucagcgaccugagaaucccccugauguggaaggacaccgaguacuucaagaacaagggcgaccugcacagaugggccguguuccugcugcugcagcugggcgagcacauccaggacaccgagaugauccugguggacagaacccugaccgacaucagcuuccagagcaacgugcuguucgccgaggccggccccgacuucgagcugagacuggagcuguacggcgccugcguggaggaggagggcgcccugaccggcggccccaagagacuggccaccaagcugagcagcagccugggcagaagcagcggcagaagagugagagccagccuggacagcgccggcggcagcggcagcagccccauccugcugcccacccccguggugggcggccccagauaccaccugcuggcccacaccacccugacccuggccgccgugcaggacggcuucagaacccacgaccugacccuggccagccacgaggagaaccccgccuggcugccccuguacggcagcgugugcugcagacuggccgcccagccccugugcaugacccagcccaccgccagcggcacccugagagugcagcaggccggcgagaugcagaacugggcccaggugcacggcgugcugaagggcaccaaccuguucugcuacagacagcccgaggacgccgacaccggcgaggagccccugcugaccaucgccgugaacaaggagaccagagugagagccggcgagcuggaccaggcccugggcagacccuucacccugagcaucagcaaccaguacggcgacgacgaggugacccacacccugcagaccgagagcagagaggcccugcagagcuggauggaggcccuguggcagcuguucuucgacaugagccaguggaagcagugcugcgacgagaucaugaagaucgagacccccgcccccagaaagcccccccaggcccuggccaagcagggcagccuguaccacgagauggccaucgagccccuggacgacaucgccgccgugaccgacauccugacccagagagagggcgccagacuggagacccccccccccuggcuggccauguucaccgaccagcccgcccugcccaaccccugcagccccgccagcguggcccccgcccccgacuggacccacccccugcccuggggcagacccagaaccuucagccuggacgccgugccccccgaccacagccccagagccagaagcguggccccccugcccccccagagaagccccagaaccagaggccugugcagcaagggccagcccagaaccuggcugcagagccccguguaa

SEQ ID NO: 22908 - RNA, 4077 nt, Artificial Sequence
  RTL1__Homo_sapiens__NP_001128360
augaucgagcccagcgaggacagcuucgagaccaugauggagcacaagaaccccagcagcaagcagauggagagcagcgagggcagcagcaacaccaccgaggccaccagcggcagcggcgugagaggcgaggccggccccgccagcggccccgcccaggagaagaaggagccccccagcggcccccugcaggagauggaggagcugcccaccgaccugcugcaggacauggaggagcccagcagcggccccagaaaggagaucgaggacccccccaacgaccugcugcaggaccuggaggagagcugcaacggcagccaccaggccagaggcgacccccugagcggcgccagcgacagaaugaaggaggccagcgugaaccccagcggcgccagagaggagcaggaggcccacaccgaccugaaggagagcggcagagaggagaccccccaggagcagaaccagaccgagcacagcaccgccgagcugauggccauggugagaagcaucaucagccuguacuucagaaugcaggaccugaaggagcagcagagaguggccgaggagauccugaucaagggcaucaacgccggccagcugcccgcccccaagcacuucagcggcgacagaagagaguuccacgaguucaucgugcugugccagcugacccugcagagcuaccccagaauguucuacaacgacagacugagagugggcuacgugaucaaccaccugagcggccuggcccuggagugggccaaggcccugcugcaggagaacagcccccugaucggcgacuuccccgccuuccuggaggccaugagcgagguguucgaguacagacaggcccugagaguggccgaggaggccauguucaccaucagacagggcggcagaagcgccaccgaguacaucgacgaguuccagagccuggugcccauccugggcuggcccgacgaggugcugcaggcccaccugugccagggccugaacgaggagaucagacacuaccuguucagagugccccagcccgacagccuggacagccugaucgugcugauccugcagaucgaggagaagcuggccgagagaagagccaugcugagacugccccccgaggccagacccagaaaccugaccuggaucgacagccccgcccccgagagauggauggugagcagcuggcugcccagcgaggugcaccccgacaucaacagagcccaccuguuccugcugcugauggugagagugaaccccuaccacagcguggccgugcaggcccugguggacagcggcgccgacggcaacuucauggacgagaaguucgcccaggagcacuacguggagcuguacgagaagcccuacccccagcccgugcagagcguggacggcagccugaucggcaacgagcccguguggcuguacaccgagccccuggugugcauccaccagaaccaccaggagagcaucgaguucgacaucgugcccagccccaacuucagcguggugcugggcaucagauggcugagagugcacgcccccgagguggacuggaucaagggcagaugcaccuuccacagccccuacugccugaagaacugcuucagaccccccccccccugcaucgcccuggagagacacggcaugagccugcugcccggccugccccaccccuacagcgaccuggccgacguguucaaccccaaggaggccgacgacgagaccagcgaccagcccagcagcgacggcagcgacgaccugagcgagagcgagcccagcgagcugcagcaggccggcgacagcgaccacagcgagaccuucuacgagugccccagcaccgcccccugggagcccgugggcgccagaaugcaggagagagccagacugcaggaggaguacugggaccugcaggacaugcugaccaacagacaggacuacauccagaugauccccgagcuguucgaccagcugcacggcgccgagugguucaccaagcuggagcugagaggcaccaucguggaggagagcgugaacggccacagaaccgaggacguguggaaggccgccuucggccuggagcuggaggagaugaagagcuaccagcccuucgcccugagccccgaccccaucaucccccagaacgugauccacuucauccugaaggacaugcugggcuucuucgugcugagcuacggccaggaggugcugaucuacagcaugagccaggaggagcaccugcaccacgugagacaggugcuggugagauucagacaccacaacguguacugcagccuggacaagagccaguuccacagacagaccguggaguuccugggcuucguggugacccccaagggcgugaagcugaacaagaacgugaugaccaucaucaccggcuaccccacccccggcagcaagcugagccugagaaacuucaucgaguucguguuccccuacagacacuucguggagagauucagcaucaucgccgagccccuggugagacagcugcugagcagcuaccaguucuacuggggcguggaggagcaggaggccuucgagugccugaagagagccuucagaaaggccccccugcugcaccaccccaagccccagaaccccuucuaccuggagaccggcgugaccggcaccgcccugcacgccagccugauccagaucgacgaccagaccggcaagagagccugcugcgccuucuacagcagaaacaucagccccaucgagguggaguacagccaggccgagaugaagauccugcccaucagagccgccuucaugguguggugcagauaccuggagaacaccgaggagcccaucaugauccugcugaacaccgaggaccuggccagccugaacaacgacagacugaccgugcugcugcccggccacuggguguucuucuucagccacuucaacuucgacgugauggagcugcccgagcaggacggcggcagagcccugccccccgugagaaaccugagauggagaagagccuuccagagaaacaccgccgccagacagacccugcugcuggccagcagaggcuuccccagagaccccagcaccgagagcggcgaggaggagaacgaggagcaggacgagcugaacgagcagauccugagacaggagcugcuggccaugauccccaucgaccagauccugaacagcuuccuggcccacuucagcauggcccagaucagagccgugauccugcacuucuucagaggccugcuguacuggaagaacacccuggcccuggccgccauccuggugcugcugagagugagacagugccugagccugagacccgcccccgccaugagaguggccagaccccagccccagagaagccugagacugauccuggacagcagccugaucgccggcagcagcaucaccaccgccaucacccagcugcugacccagaugcccgcccuggugggcgccaacaccauccccgcccaggagcuggccgagcuguuccugggccccggcagauggcagagaaacgcccugcacagccaggcccacagaggccugcaguucacccccggcuucuggcugacccugugcgaguucuucggcgugagagugaccccccaggagggccaccugcccgcccugagacagaacagauaccuggagcugcacguggugggcgacgaggacguggugcugagagaggcccugcaggacgaccugcagagauacagacagugcggccugcacgacggccugcaggacaccagccaggacaagcaggacaacgacgugcaggaggccccccccagccacaccgccgccacccacccccccagacccagacaccugauggacccccaggugcuggaguuccugggcagcagacugcugcacauccacagcgccgacggccagcugcaccugcugagcagagagcaggccgccagagcccugagccaguuccugacccugaucuacagaagagcccugcccauccccgccugggagagccagcccagagagcaggccagacuggaggagcugcccgacgaggacgaggacgccaaccuggacuaa

SEQ ID NO: 22909 - RNA, 2331 nt, Artificial Sequence
  RTN1__Homo_sapiens__NP_066959
auggccgcccccggcgacccccaggacgagcugcugccccuggccggccccggcagccaguggcugagacacagaggcgagggcgagaacgaggccgugacccccaagggcgccacccccgccccccaggccggcgagcccagccccggccugggcgccagagccagagaggccgccagcagagaggccggcagcggccccgccagacagagccccguggccauggagaccgccagcaccggcguggccggcgugagcagcgccauggaccacaccuucagcaccaccagcaaggacggcgagggcagcugcuacaccagccugaucagcgacaucugcuaccccccccaggaggacagcaccuacuucaccggcauccugcagaaggagaacggccacgugaccaucagcgagagccccgaggagcugggcacccccggccccagccugcccgacgugcccggcaucgagagcagaggccuguucagcagcgacagcggcaucgagaugacccccgccgagagcaccgaggugaacaagauccuggccgacccccuggaccagaugaaggccgaggccuacaaguacaucgacaucaccagacccgaggaggugaagcaccaggagcagcaccaccccgagcuggaggacaaggaccuggacuucaagaacaaggacaccgacaucagcaucaagcccgagggcgugagagagcccgacaagcccgcccccguggagggcaagaucaucaaggaccaccugcuggaggagagcaccuucgcccccuacaucgacgaccugagcgaggagcagagaagagccccccagaucaccacccccgugaagaucacccugaccgagaucgagcccagcguggagaccaccacccaggagaagacccccgagaagcaggacaucugccugaagcccagccccgacaccgugcccaccgugaccgugagcgagcccgaggacgacagccccggcagcaucaccccccccagcagcggcaccgagcccagcgccgccgagagccagggcaagggcagcaucagcgaggacgagcugaucaccgccaucaaggaggccaagggccugagcuacgagaccgccgagaaccccagacccgugggccagcuggccgacagacccgaggugaaggccagaagcggcccccccaccauccccagcccccuggaccacgaggccagcagcgccgagagcggcgacagcgagaucgagcuggugagcgaggaccccauggccgccgaggacgcccugcccagcggcuacgugagcuucggccacgugggcggccccccccccagccccgccagccccagcauccaguacagcauccugagagaggagagagaggccgagcuggacagcgagcugaucaucgagagcugcgacgccagcagcgccagcgaggagagccccaagagagagcaggacagcccccccaugaagcccagcgcccuggacgccaucagagaggagaccggcgugagagccgaggagagagcccccagcagaagaggccuggccgagcccggcagcuuccuggacuaccccagcaccgagccccagcccggccccgagcugccccccggcgacggcgcccuggagcccgagacccccaugcugcccagaaagcccgaggaggacagcagcagcaaccagagccccgccgccaccaagggccccggcccccugggccccggcgccccccccccccugcuguuccugaacaagcagaaggccaucgaccugcuguacuggagagacaucaagcagaccggcaucguguucggcagcuuccugcugcugcuguucagccugacccaguucagcguggugagcgugguggccuaccuggcccuggccgcccugagcgccaccaucagcuucagaaucuacaagagcgugcugcaggccgugcagaagaccgacgagggccaccccuucaaggccuaccuggagcuggagaucacccugagccaggagcagauccagaaguacaccgacugccugcaguucuacgugaacagcacccugaaggagcugagaagacuguuccuggugcaggaccugguggacagccugaaguucgccgugcugauguggcugcugaccuacgugggcgcccuguucaacggccugacccugcugcugauggccguggugagcauguucacccugcccgugguguacgugaagcaccaggcccagaucgaccaguaccugggccuggugagaacccacaucaacgccgugguggccaagauccaggccaagauccccggcgccaagagacacgccgaguaa

SEQ ID NO: 22910 - RNA, 1638 nt, Artificial Sequence
  RTN2__Homo_sapiens__NP_005610
augggccaggugcugcccguguucgcccacugcaaggaggcccccagcaccgccagcagcacccccgacagcaccgagggcggcaacgacgacagcgacuucagagagcugcacaccgccagagaguucagcgaggaggacgaggaggagaccaccagccaggacuggggcacccccagagagcugaccuucagcuacaucgccuucgacggcguggugggcagcggcggcagaagagacagcaccgccagaagacccagaccccagggcagaagcgugagcgagcccagagaccagcacccccagcccagccugggcgacagccuggagagcauccccagccugagccagagccccgagcccggcagaagaggcgaccccgacaccgccccccccagcgagagaccccuggaggaccugagacugagacuggaccaccugggcuggguggccagaggcaccggcagcggcgaggacagcagcaccagcagcagcaccccccuggaggacgaggagccccaggagcccaacagacuggagaccggcgaggccggcgaggagcuggaccugagacugagacuggcccagcccagcagccccgaggugcugaccccccagcugagccccggcagcggcaccccccaggccggcacccccagccccagcagaagcagagacagcaacagcggccccgaggagccccugcuggaggaggaggagaagcaguggggcccccuggagagagagcccgugagaggccagugccuggacagcaccgaccagcuggaguucaccguggagcccagacugcugggcaccgccauggaguggcugaagaccagccugcugcuggccguguacaagaccgugcccauccuggagcugagccccccccuguggaccgccaucggcugggugcagagaggccccaccccccccacccccgugcugagagugcugcugaagugggccaagagccccagaagcagcggcgugcccagccugagccugggcgccgacaugggcagcaagguggccgaccugcuguacuggaaggacaccagaaccagcggcgugguguucaccggccugauggugagccugcugugccugcugcacuucagcaucgugagcguggccgcccaccuggcccugcugcugcugugcggcaccaucagccugagaguguacagaaaggugcugcaggccgugcacagaggcgacggcgccaaccccuuccaggccuaccuggacguggaccugacccugaccagagagcagaccgagagacugagccaccagaucaccagcagaguggugagcgccgccacccagcugagacacuucuuccugguggaggaccugguggacagccugaagcuggcccugcuguucuacauccugaccuucgugggcgccaucuucaacggccugacccugcugauccugggcgugaucggccuguucaccaucccccugcuguacagacagcaccaggcccagaucgaccaguacgugggccuggugaccaaccagcugagccacaucaaggccaagaucagagccaagauccccggcaccggcgcccuggccagcgccgccgccgccgugagcggcagcaaggccaaggccgaguaa

SEQ ID NO: 22911 - RNA, 3099 nt, Artificial Sequence
  RTN3__Homo_sapiens__NP_001252518
auggccgagcccagcgccgccacccagagccacagcaucagcagcagcagcuucggcgccgagcccagcgcccccggcggcggcggcagccccggcgccugccccgcccugggcaccaagagcugcagcagcagcugcgccgacagcuucgugagcagcagcagcagccagcccgugagccuguucagcaccagccaggagggccugagcagccugugcagcgacgagcccagcagcgagaucaugaccagcagcuuccugagcagcagcgagauccacaacaccggccugaccauccugcacggcgagaagagccacgugcugggcagccagcccauccuggccaaggagggcaaggaccaccuggaccugcuggacaugaagaagauggagaagccccagggcaccagcaacaacgugagcgacagcagcgugagccuggccgccggcgugcacugcgacagacccagcauccccgccagcuuccccgagcaccccgccuuccugagcaagaagaucggccagguggaggagcagaucgacaaggagaccaagaaccccaacggcgugagcagcagagaggccaagaccgcccuggacgccgacgacagauucacccugcugaccgcccagaagccccccaccgaguacagcaagguggagggcaucuacaccuacagccugagccccagcaaggugagcggcgacgacgugaucgagaaggacagccccgagagccccuucgaggugaucaucgacaaggccgccuucgacaaggaguucaaggacagcuacaaggagagcaccgacgacuucggcagcuggagcgugcacaccgacaaggagagcagcgaggacaucagcgagaccaacgacaagcuguucccccugagaaacaaggaggccggcagauaccccaugagcgcccugcugagcagacaguucagccacaccaacgccgcccuggaggaggugagcagaugcgugaacgacaugcacaacuucaccaacgagauccugaccugggaccuggugccccaggugaagcagcagaccgacaagagcagcgacugcaucaccaagaccaccggccuggacaugagcgaguacaacagcgagauccccguggugaaccugaagaccagcacccaccagaagacccccgugugcagcaucgacggcagcacccccaucaccaagagcaccggcgacugggccgaggccagccugcagcaggagaacgccaucaccggcaagcccgugcccgacagccugaacagcaccaaggaguucagcaucaagggcgugcagggcaacaugcagaagcaggacgacacccuggccgagcugcccggcagcccccccgagaagugcgacagccugggcagcggcguggccaccgugaagguggugcugcccgacgaccaccugaaggacgagauggacuggcagagcagcgcccugggcgagaucaccgaggccgacagcagcggcgagagcgacgacaccgugaucgaggacaucaccgccgacaccagcuucgagaacaacaagauccaggccgagaagcccgugagcauccccagcgccguggugaagaccggcgagagagagaucaaggagauccccagcugcgagagagaggagaagaccagcaagaacuucgaggagcuggugagcgacagcgagcugcaccaggaccagcccgacauccugggcagaagccccgccagcgaggccgccugcagcaaggugcccgacaccaacgugagccuggaggacgugagcgagguggcccccgagaagcccaucaccaccgagaaccccaagcugcccagcaccgugagccccaacguguucaacgagaccgaguucagccugaacgugaccaccagcgccuaccuggagagccugcacggcaagaacgugaagcacaucgacgacagcagccccgaggaccugaucgccgccuucaccgagaccagagacaagggcaucguggacagcgagagaaacgccuucaaggccaucagcgagaagaugaccgacuucaagaccaccccccccguggaggugcugcacgagaacgagagcggcggcagcgagaucaaggacaucggcagcaaguacagcgagcagagcaaggagaccaacggcagcgagccccugggcguguuccccacccagggcacccccguggccagccuggaccuggagcaggagcagcugaccaucaaggcccugaaggagcugggcgagagacagguggagaagagcaccagcgcccagagagacgccgagcugcccagcgaggaggugcugaagcagaccuucaccuucgcccccgagagcuggccccagagaagcuacgacauccuggagagaaacgugaagaacggcagcgaccugggcaucagccagaagcccaucaccaucagagagaccaccagaguggacgccgugagcagccugagcaagaccgagcuggugaagaagcacgugcuggccagacugcugaccgacuucagcgugcacgaccugaucuucuggagagacgugaagaagaccggcuucguguucggcaccacccugaucaugcugcugagccuggccgccuucagcgugaucagcguggugagcuaccugauccuggcccugcugagcgugaccaucagcuucagaaucuacaagagcgugauccaggccgugcagaagagcgaggagggccaccccuucaaggccuaccuggacguggacaucacccugagcagcgaggccuuccacaacuacaugaacgccgccauggugcacaucaacagagcccugaagcugaucaucagacuguuccugguggaggaccugguggacagccugaagcuggccguguucauguggcugaugaccuacgugggcgccguguucaacggcaucacccugcugauccuggccgagcugcugaucuucagcgugcccaucguguacgagaaguacaagacccagaucgaccacuacgugggcaucgccagagaccagaccaagagcaucguggagaagauccaggccaagcugcccggcaucgccaagaagaaggccgaguaa

SEQ ID NO: 22912 - RNA, 600 nt, Artificial Sequence
  RTN4__Homo_sapiens__NP_008939
auggacggccagaagaagaacuggaaggacaaggugguggaccugcuguacuggagagacaucaagaagaccggcgugguguucggcgccagccuguuccugcugcugagccugaccguguucagcaucgugagcgugaccgccuacaucgcccuggcccugcugagcgugaccaucagcuucagaaucuacaagggcgugauccaggccauccagaagagcgacgagggccaccccuucagagccuaccuggagagcgagguggccaucagcgaggagcuggugcagaaguacagcaacagcgcccugggccacgugaacugcaccaucaaggagcugagaagacuguuccugguggacgaccugguggacagccugaaguucgccgugcugauguggguguucaccuacgugggcgcccuguucaacggccugacccugcugauccuggcccugaucagccuguucagcgugcccgugaucuacgagagacaccaggcccagaucgaccacuaccugggccuggccaacaagaacgugaaggacgccauggccaagauccaggccaagauccccggccugaagagaaaggccgaguaa

SEQ ID NO: 22913 - RNA, 1191 nt, Artificial Sequence
  RTN4IP1__Homo_sapiens__NP_116119
auggaguuccugaagaccugcgugcugagaagaaacgccugcaccgccgugugcuucuggagaagcaagguggugcagaagcccagcgugagaagaaucagcaccaccagccccagaagcaccgugaugcccgccugggugaucgacaaguacggcaagaacgaggugcugagauucacccagaacaugaugaugcccaucauccacuaccccaacgaggugaucgugaaggugcacgccgccagcgugaaccccaucgacgugaacaugagaagcggcuacggcgccaccgcccugaacaugaagagagacccccugcacgugaagaucaagggcgaggaguucccccugacccugggcagagacgugagcggcguggugauggagugcggccuggacgugaaguacuucaagcccggcgacgaggugugggccgccgugccccccuggaagcagggcacccugagcgaguucgugguggugagcggcaacgaggugagccacaagcccaagagccugacccacacccaggccgccagccugcccuacguggcccugaccgccuggagcgccaucaacaaggugggcggccugaacgacaagaacugcaccggcaagagagugcugauccugggcgccagcggcggcgugggcaccuucgccauccaggugaugaaggccugggacgcccacgugaccgccgugugcagccaggacgccagcgagcuggugagaaagcugggcgccgacgacgugaucgacuacaagagcggcagcguggaggagcagcugaagagccugaagcccuucgacuucauccuggacaacgugggcggcagcaccgagaccugggcccccgacuuccugaagaaguggagcggcgccaccuacgugacccuggugacccccuuccugcugaacauggacagacugggcaucgccgacggcaugcugcagaccggcgugaccgugggcagcaaggcccugaagcacuucuggaagggcgugcacuacagaugggccuucuucauggccagcggccccugccuggacgacaucgccgagcugguggacgccggcaagaucagacccgugaucgagcagaccuuccccuucagcaaggugcccgaggccuuccugaagguggagagaggccacgccagaggcaagaccgugaucaacgugguguaa

SEQ ID NO: 22914 - RNA, 1422 nt, Artificial Sequence
  RTN4R__Homo_sapiens__NP_075380
augaagagagccagcgccggcggcagcagacugcuggccugggugcuguggcugcaggccuggcagguggccgcccccugccccggcgccugcgugugcuacaacgagcccaaggugaccaccagcugcccccagcagggccugcaggccgugcccgugggcauccccgccgccagccagagaaucuuccugcacggcaacagaaucagccacgugcccgccgccagcuucagagccugcagaaaccugaccauccuguggcugcacagcaacgugcuggccagaaucgacgccgccgccuucaccggccuggcccugcuggagcagcuggaccugagcgacaacgcccagcugagaagcguggaccccgccaccuuccacggccugggcagacugcacacccugcaccuggacagaugcggccugcaggagcugggccccggccuguucagaggccuggccgcccugcaguaccuguaccugcaggacaacgcccugcaggcccugcccgacgacaccuucagagaccugggcaaccugacccaccuguuccugcacggcaacagaaucagcagcgugcccgagagagccuucagaggccugcacagccuggacagacugcugcugcaccagaacagaguggcccacgugcacccccacgccuucagagaccugggcagacugaugacccuguaccuguucgccaacaaccugagcgcccugcccaccgaggcccuggccccccugagagcccugcaguaccugagacugaacgacaaccccugggugugcgacugcagagccagaccccugugggccuggcugcagaaguucagaggcagcagcagcgaggugcccugcagccugccccagagacuggccggcagagaccugaagagacuggccgccaacgaccugcagggcugcgccguggccaccggccccuaccaccccaucuggaccggcagagccaccgacgaggagccccugggccugcccaagugcugccagcccgacgccgccgacaaggccagcgugcuggagcccggcagacccgccagcgccggcaacgcccugaagggcagagugccccccggcgacagcccccccggcaacggcagcggccccagacacaucaacgacagccccuucggcacccugcccggcagcgccgagcccccccugaccgccgugagacccgagggcagcgagccccccggcuuccccaccagcggccccagaagaagacccggcugcagcagaaagaacagaaccagaagccacugcagacugggccaggccggcagcggcggcggcggcaccggcgacagcgagggcagcggcgcccugcccagccugaccugcagccugaccccccugggccuggcccuggugcuguggaccgugcugggccccugcuaa

SEQ ID NO: 22915 - RNA, 699 nt, Artificial Sequence
  RTP3__Homo_sapiens__NP_113628
auggccggcgacaccgagguguggaagcagauguuccaggagcugaugagagaggugaagcccuggcacagauggacccugagacccgacaagggccugcugcccaacgugcugaagcccggcuggaugcaguaccagcaguggaccuucgccagauuccagugcagcagcugcagcagaaacugggccagcgcccaggugcuggugcuguuccacaugaacuggagcgaggagaagagcagaggccaggugaagaugagaguguucacccagagaugcaagaagugcccccagccccuguucgaggaccccgaguucacccaggagaacaucagcagaauccugaagaaccugguguucagaauccugaagaagugcuacagaggcagauuccagcugaucgaggaggugcccaugaucaaggacaucagccuggagggcccccacaacagcgacaacugcgaggccugccugcagggcuucugcgccggccccauccaggugaccagccugccccccagccagacccccagagugcacagcaucuacaagguggaggagguggugaagcccugggccagcggcgagaacguguacagcuacgccugccagaaccacaucugcagaaaccugagcaucuucugcugcugcgugauccugaucgugaucguggugaucguggugaagaccgccaucuaa

SEQ ID NO: 22916 - RNA, 741 nt, Artificial Sequence
  RTP4__Homo_sapiens__NP_071430
auggugguggacuucuggaccugggagcagaccuuccaggagcugauccaggaggccaagcccagagccaccuggacccugaagcuggacggcaaccugcagcuggacugccuggcccagggcuggaagcaguaccagcagagagccuucggcugguucagaugcagcagcugccagagaagcugggccagcgcccaggugcagauccugugccacaccuacugggagcacuggaccagccagggccaggugagaaugagacuguucggccagagaugccagaagugcagcuggagccaguacgagaugcccgaguucagcagcgacagcaccaugagaauccugagcaaccuggugcagcacauccugaagaaguacuacggcaacggcaccagaaagagccccgagaugcccgugauccuggaggugagccuggagggcagccacgacaccgccaacugcgaggccugcacccugggcaucugcggccagggccugaagagcugcaugaccaagcccagcaagagccugcugccccaccugaagaccggcaacagcagccccggcaucggcgccguguaccuggccaaccaggccaagaaccagagcgccgaggccaaggaggccaagggcagcggcuacgagaagcugggccccagcagagaccccgacccccugaacaucugcguguucauccugcugcugguguucaucguggugaagugcuucaccagcgaguaa

SEQ ID NO: 22917 - RNA, 6681 nt, Artificial Sequence
  RTTN__Homo_sapiens__NP_775901
auggugcuggccggccugaucagaaagcugggccaccagcuggccgagaucagagagagagcccugaagagcauccugugcaagaucgagcacaaccugaucugcuacgccgaccugauccaggagagacagcuguuccugcaccugcuggagugguucaacuuccccagcgugcccaugaaggaggaggugcugaaccugcugagcagacuggugaaguacccccccgccgugcagcaccugguggacgugggcgccguggaguuccugagcaagcugagaagcaacguggagcccaaccugcaggccgagaucgacggcauccuggacggccuguuccugcugcccagcgaggugcccgcccugagcagcgccagcuaccagaccaaccagaccgagcugagcaagaaccccgagauccugaccggcuacuucccccaggacaagagcaacuuccagcagauggaggugccccccagacccguggugaaccagaccgugaagugccugaaguucagcaccuuccccuggcugccccugaccaccaccgacagacacgugcugagcagcaacgagagcagccugagaagcagcaaccacacccugaucuggaacaccugcgagcugcugaaggacgugaucaugcaggacuuccccgccgagaucuuccugcagagacccaagaucgugcagagccugcugagccugcugaagcuggccuucggcgacggcaagcacagacuggcccugcagagcgugagcugccugcagcagcugugcauguaccugagaaacagacugaacuuccacagagaccccggcuucuucagcaacaagcacgacaccgugagccagaacagcagccugagcuacugccacgaggccagaggcacccaccacagccagaaccccagccccggcagcagcagccccagacccagcguggugggcagaaccggccagagacccagaggcgacggccaggacugggacgccgccagcagcagcggcagcagcagccacgcccacgugaacagcagaaucagcgugcacagcccccuggacaugggccacaucgaccugcccgagcuggagaccgaggacacccuggagcugcaguuccagcagcugagccugccccaguucugcgugagcauccuggagagcgccgugccccugcugagaaccggcagcagacaggugaucaucagagugcuggagcugcugaccgaggacaugacccugaucggcgaggccaucagcaccgacaucugggacgacagcagccuguucggcaucgacaugaaggagaagcugcugcuggugcugggcgcccugggcgagaccaugugcuaccacaagagcagcaucagccuggagcagcccgaggugaugcuggugcaccacagaauggccuucaucagcaucagccuguucgccgugagacugcugcagacccugcugcccguggagaaggccagcgaguuccugagcgagcccaugagcaccgcccuguuccugcugagccuggacaugcccaucagccuggaguaccccaacauccacgaggccgugguggccuaccuggagcagcugaacagcgagaacuacagcaucuacaagagaaccgccgaggccguguacagcaucgagugcaccugcaacuuccugagcgacaucggcaaggagggcgagaagaaccugcuggagcugguggagcuggccgaccaggcccugagaagcuucagcuaccaccagcacuucccccugaucaaggagaucaucagcaucugcagcaagaucuggaagagcgcccaggccagcccccugcugcagggcgagagccagaaggugcugcugcacaugcugagccacccccugcccagagugaaggccgagaccuaccacugcugccuggagaucaccaaggagugccugggcgugcacaacgugaccaagcccgugagcagccugugcaacggcauccacuuccugcugcaccccaaggugcuguacgagaucagcguguucggcauccaggagcccgagagcgaggugaacaccgccgccaaggccauccugcuguaccugcugcagggcagacugaugaugaccgcccugaccuggaacaaguucaucgagagccugugccccgugauccccauccugcagggcuacgccgacaccgaggacccccugggcaacugcauccugcugcugagcaaggccagcagcgacaccgaggagaugcugcccugcaccaccagacugaagagcaugcugagacugcugcuggugaagaagcccagcgugagaagccuggcccugaagcugcuggccuuccaccugaccagcgaggagggcgccgacaccaagagaccccugaucgacgccagagugcugagcagagugaccgaccuguucaucggcaagaagcccaucgagcugagacuggacgacagaagagagcuggugaucaagcuggagaccguggagaagguguacgagaucuucaccagcgacgacguggaccuggugcugagaaagagcgccgccgagcagcuggccgugaucaugcaggacaucaagaugcacgccguggugaagaagcugugccugaucgacaagaucaucgaguaccugaacgagugcgugagccaggacggcaaggugguggagugccuggugcagcccugccugacccugcugagaaaggugcugugcggcgaccccgugaugagagugagccugagccagcagagcagccugcugaccgugcuguucagagugagccugaucuuccacgaggacugcagcguggugaccgaggugggcgcccuguucugccugcugcuguucgacgaggugagcagaauggacauguggagcgugaaccccagcaacaagcccagccugcccagcguguucagccugcccgugagcguguucagaagauaccaccugcccgugcacgugaucggccaccacgccgugagccccuacagcaucgugcugccccugagcgccgacugccuggcccugaagcccgugagcgacaugcugagaaucgccuggaaccugagcugguaccacggcagcgacaaccugcugaagcagaugaacagcgagaccaagacccaggagauccuggacgcccugaagcugagcaccgaggacauccugacccugaagaucacccacauggccagcggccugcaggacugccugcacagcaucgugcaggccgccacccacagagaggugagagccgccgugaccagaaugagcuucuaccugcugaacgacagacugagccugaagggcugccccggccccugcggcgugacccugaagagccuggccuggcacaccgcccugaacagauuccugcaggugcugcccgccugcaccgaggacgagaagcugcugaucgacaucauccacuuccugaacaagcugaucaaggagcagagaaagaacagcagccuggagcugcugaacuggauccuggagcugcugcugagacacagcgccaacccccugcuggaccugcuggugcugaccgagagccaggccagagaggagaccgacgacaucagaaccgccgugagacagcagcugcagaaggagcugaucgcccuguucgacacccugcugcugaacuucauggaggugaccgacagaaagugcagcgagcugcuguacguguuccagacccagcuggcccugaagcugcugcagugccugaaggugaccgacgccccccacuucuacggccugcccagccuggagagaacccugagaggcauggccaaccugaccgccuuccccggcuggagcagccacagcccccugaccaagccccuggacaucugcgugaaguaccugagcggccugcuggaggugaucaccagcuucuacguggagagaggcggcaacgccaugagcuucaugggcaagggcgugaccaagagcaccauccugugccugcugcaccugagccacgagaugauggcccaggccggcagccuggaguggaugagccugugguuccugccccugggcagccacagcgaggagcacauccccacccagcagggccuggccuggcugaucccccuguggguggacagagaccccgaggugagauucaccagccugggccugggcagcgcccugaccacccuggagaccggcugcguggcccuggccaacagcugccagaacaucagcggcggccuguggggcaccguggugaacauccugcuggaccagagcgagugcagcauggugagaagagaggccgccuucauccugcagaaccugcuggugauccccaugcccaccgagaucaucaaggacuacaccuggcagggccccugcgugcacgacgaggacagcggccugagccugaucggcaagcccgcccugcaggcccugcuguaccacugccacuucuacgagcaccugaaccagauggugaagcacugcuaccugggcagaugcauguucgaccugaacuucagcgccuucgacagaaacagcgagagcaacgaccugaacggccuggacgacagcuucaaguucuggagagcccccagcagaaccagccaggacagagaccccagcagccugagcaccagcgagaccaccguggcccccagccugggcagcaccgaguuccagccccuggugcagagcaccacccugcugcccgaggccagccacgaccaguucguggcccagggccaccaggagagcaccagccccagacccccccacgacagcagccugagcgccccccugcccaagcugugcguguucgugacccccagccugcugagcgccaugugcagccugcuggacaaccugcugaccaucgcccccagagacaccgccaaggccuucagacaggcccaccugaucgagcugcugugcagcaucgccgacgccacccugauccagaccugcgugcaggagcugagagcccugcugcccagcagcccccccgccgagcacacccaggcccaggugagcuuccugcuggaguaccugagcagccugagcagacugcugcagagcugccugcugguggagcccgaccuggugauccaggacgagcuggugaagccccugaucaccaacaucaucggcauccugaccaucugcaccaaggacgugcuggacaaggagcugaucagcgccuucuaccacaccuggacccaccuguucaaccugcuggccaugcugcugagaaaggccggcgccaucacccugcccuucgugaccguggcccuggccaagcacuggaccgccgccaucgacauguucugcaccugcgccggccugagcgccaccugccccgcccuguacaccgccagccugcaguuccugagcgugcugcugaccgaggaggccaagggccaccugcaggccaagagcaagacccaccugugcugcagccccaccguggccagccugcuggacgacagccaggagaaccagaagagccuggagcagcugagcgacgugauccugcagugcuacgagggcaagagcagcaaggacauccugaagagaguggccgccaacgcccugaugagccugcuggccgugagcagaagagcccagaagcacgcccugaaggccaaccugaucgacaacugcauggagcagaugaagcacaucaacgcccagcugaaccuggacagccugagacccggcaaggccgcccugaagaagaaggaggacggcgugaucaaggagcugagcaucgccaugcagcugcugagaaacugccuguaccagaacgaggagugcaaggaggccgcccuggaggcccaccuggugcccgugcugcacagccuguggcccuggauccugauggacgacagccugaugcagaucagccugcagcugcugugcguguacaccgccaacuuccccaacggcugcagcagccugugcuggagcagcugcggccagcaccccgugcaggccacccacagaggcgccgugagcaacagccugaugcugugcauccugaagcuggccagccagaugccccuggagaacaccaccgugcagcagaugguguucaugcugcugagcaaccuggcccugagccacgacugcaagggcgugauccagaagagcaacuuccugcagaacuuccugagccuggcccugcccaagggcggcaacaagcaccugagcaaccugaccauccuguggcugaagcugcugcugaacaucagcagcggcgaggacggccagcagaugauccugagacuggacggcugccuggaccugcugaccgagaugagcaaguacaagcacaagagcagcccccugcugccccugcugaucuuccacaacgugugcuucagccccgccaacaagcccaagauccuggccaacgagaaggugaucaccgugcuggccgccugccuggagagcgagaaccagaacgcccagagaaucggcgccgccgcccugugggcccugaucuacaacuaccagaaggccaagaccgcccugaagagccccagcgugaagagaagaguggacgaggccuacagccuggccaagaagaccuuccccaacagcgaggccaacccccugaacgccuacuaccugaagugccuggagaaccuggugcagcugcugaacagcagcuaa

SEQ ID NO: 22918 - RNA, 1803 nt, Artificial Sequence
  RUFY1__Homo_sapiens__NP_001035542
augauggaggagagagccaaccugaugcacaugaugaagcugagcaucaaggugcugcugcagagcgcccugagccugggcagaagccuggacgccgaccacgccccccugcagcaguucuucguggugauggagcacugccugaagcacggccugaaggugaagaagagcuucaucggccagaacaagagcuucuucggcccccuggagcugguggagaagcugugccccgaggccagcgacaucgccaccagcgugagaaaccugcccgagcugaagaccgccgugggcagaggcagagccuggcuguaccuggcccugaugcagaagaagcuggccgacuaccugaaggugcugaucgacaacaagcaccugcugagcgaguucuacgagcccgaggcccugaugauggaggaggagggcauggugaucgugggccugcuggugggccugaacgugcuggacgccaaccugugccugaagggcgaggaccuggacagccaggugggcgugaucgacuucagccuguaccugaaggacgugcaggaccuggacggcggcaaggagcacgagagaaucaccgacgugcuggaccagaagaacuacguggaggagcugaacagacaccugagcugcaccgugggcgaccugcagaccaagaucgacggccuggagaagaccaacagcaagcugcaggaggagcugagcgccgccaccgacagaaucugcagccugcaggaggagcagcagcagcugagagagcagaacgagcugaucagagagagaagcgagaagagcguggagaucaccaagcaggacaccaagguggagcuggagaccuacaagcagaccagacagggccuggacgagauguacagcgacguguggaagcagcugaaggaggagaagaaggugagacuggagcuggagaaggagcuggagcugcagaucggcaugaagaccgagauggagaucgccaugaagcugcuggagaaggacacccacgagaagcaggacacccugguggcccugagacagcagcuggaggaggugaaggccaucaaccugcagauguuccacaaggcccagaacgccgagagcagccugcagcagaagaacgaggccaucaccagcuucgagggcaagaccaaccaggugaugagcagcaugaagcagauggaggagagacugcagcacagcgagagagccagacagggcgccgaggagagaagccacaagcugcagcaggagcugggcggcagaaucggcgcccugcagcugcagcugagccagcugcacgagcagugcagcagccuggagaaggagcugaagagcgagaaggagcagagacaggcccugcagagagagcugcagcacgagaaggacaccagcagccugcugagaauggagcugcagcagguggagggccugaagaaggagcugagagagcugcaggacgagaaggccgagcugcagaagaucugcgaggagcaggagcaggcccugcaggagaugggccugcaccugagccagagcaagcugaagauggaggacaucaaggaggugaaccaggcccugaagggccacgccuggcugaaggacgacgaggccacccacugcagacagugcgagaaggaguucagcaucagcagaagaaagcaccacugcagaaacugcggccacaucuucugcaacaccugcagcagcaacgagcuggcccugcccagcuaccccaagcccgugagagugugcgacagcugccacacccugcugcugcagagaugcagcagcaccgccagcuaa

SEQ ID NO: 22919 - RNA, 1863 nt, Artificial Sequence
  RUFY3__Homo_sapiens__NP_001032519
augagcgcccugaccccccccaccgacaugcccacccccaccaccgacaagaucacccaggccgccauggagaccaucuaccugugcaaguucagagugagcauggacggcgaguggcugugccugagagagcuggacgacaucagccugacccccgaccccgagcccacccacgaggaccccaacuaccugauggccaacgagagaaugaaccugaugaacauggccaagcugagcaucaagggccugaucgagagcgcccugaaccugggcagaacccuggacagcgacuacgccccccugcagcaguucuucguggugauggagcacugccugaagcacggccugaaggccaagaagaccuuccugggccagaacaagagcuucuggggcccccuggagcugguggagaagcuggugcccgaggccgccgagaucaccgccagcgugaaggaccugcccggccugaagacccccgugggcagaggcagagccuggcugagacuggcccugaugcagaagaagcugagcgaguacaugaaggcccugaucaacaagaaggagcugcugagcgaguucuacgagcccaacgcccugaugauggaggaggagggcgccaucaucgccggccugcuggugggccugaacgugaucgacgccaacuucugcaugaagggcgaggaccuggacagccaggugggcgugaucgacuucagcauguaccugaaggacggcaacagcagcaagggcaccgagggcgacggccagaucaccgccauccuggaccagaagaacuacguggaggagcugaacagacaccugaacgccaccgugaacaaccugcaggccaagguggacgcccuggagaagagcaacaccaagcugaccgaggagcuggccguggccaacaacagaaucaucacccugcaggaggagauggagagagugaaggaggagagcagcuacauccuggagagcaacagaaagggccccaagcaggacagaaccgccgagggccaggcccugagcgaggccagaaagcaccugaaggaggagacccagcugagacuggacguggagaaggagcuggagaugcagaucagcaugagacaggagauggagcuggccaugaagaugcuggagaaggacgugugcgagaagcaggacgcccuggugagccugagacagcagcuggacgaccugagagcccugaagcacgagcuggccuucaagcugcagagcagcgaccugggcgugaagcagaagagcgagcugaacagcagacuggaggagaagaccaaccagauggccgccaccaucaagcagcuggagcagagacugagacaggccgagagaagcagacagagcgccgagcuggacaacagacuguucaagcaggacuucggcgacaagaucaacagccugcagcuggagguggaggagcugaccagacagagaaaccagcuggagcuggagcugaagcaggagaaggagagaagacugcagaacgacagaagcauccccggcagaggcagccagaagagcgagagcaagauggacggcaagcacaagaugcaggaggagaacgugaagcugaagaagccccuggaggagagccacagacugcagccccaccccauggacgagcaggaccagcugcugcugagcgagaagccccagcugugccagcugugccaggaggacggcagccugaccaagaacgugugcaagaacugcagcggcaccuucugcgacgccugcagcaccaacgagcugccccugcccagcagcaucaagcuggagagagugugcaaccccugccacaagcaccugaugaagcaguacagcaccagccccagcuaa

SEQ ID NO: 22920 - RNA, 1371 nt, Artificial Sequence
  RUNDC3B__Homo_sapiens__NP_001127877
auggccagcagaagccugggcggccugagcggcaucagaggcggcggcggcggcggcggcaagaagagccugagcgccagaaacgccgccguggagagaagaaaccugaucaccgugugcagauucagcgugaagacccugaucgacagaagcugcuucgagaccaucgacgacagcagccccgaguucaacaacuucgccgccauccuggagcagauccugagccacagacugaagggccaggugaccugguucggcuacgagagccccagaagcuucugggacuacaucagaguggccugcagaaaggugagccagaacugcaucugcagcaucgagaacauggagaacgugagcagcagcagagccaagggcagagccuggaucagaguggcccugauggagaagcaccugagcgaguacaucagcaccgcccugagagacuucaagaccaccagaagauucuacgaggacggcgccaucgugcugggcgaggaggccaacaugcuggccggcaugcugcugggccugaacgccaucgacuucagcuucugccugaagggcgagggccuggacggcagcuuccccgccgugaucgacuacacccccuaccugaaguacauccagagcagcgacagcaucagcagcgacgaggaggagcugagaacccugggcagcagcggcagcgagagcagcacccccgagaacgugggcccccccuuccugauggacgagaacagcugguucaacaagugcaagagagugaagcagaaguaccagcugacccuggagcagaagggcuaccuggaggagcugcugagacugagagagaaccagcugagcgagagcgugagccagaacaagauccugcugcagagaaucgaggacagcgaccuggcccacaagcuggagaaggagcagcuggaguacaucaucguggagcugcaggaccagcugaccgugcugaagaacaacgaccugagaagcagacaggagcugaccgcccaccugaccaaccaguggcccagccccggcgcccuggacgugaacgccguggcccuggacacccugcuguacagaaagcacaacaagcagugguacgagaagagcuaccagagccuggaccagcugagcgccgaggugagccugagccagaccagccuggaccccggccagagccaggagggcgacggcaagcaggacacccugaacgugaugagcgagggcaaggaggacacccccagccugcugggccugugcggcagccugaccagcguggccagcuacaagagccugaccagccugaagagcaacgacuaccuggccagccccaccaccgagaugaccagccccggccugacccccagcuaa

SEQ ID NO: 22921 - RNA, 1362 nt, Artificial Sequence
  RUNX1__Homo_sapiens__NP_001001890
augagaauccccguggacgccagcaccagcagaagauucaccccccccagcaccgcccugagccccggcaagaugagcgaggcccugccccugggcgcccccgacgccggcgccgcccuggccggcaagcugagaagcggcgacagaagcaugguggaggugcuggccgaccaccccggcgagcuggugagaaccgacagccccaacuuccugugcagcgugcugcccacccacuggagaugcaacaagacccugcccaucgccuucaaggugguggcccugggcgacgugcccgacggcacccuggugaccgugauggccggcaacgacgagaacuacagcgccgagcugagaaacgccaccgccgccaugaagaaccagguggccagauucaacgaccugagauucgugggcagaagcggcagaggcaagagcuucacccugaccaucaccguguucaccaaccccccccagguggccaccuaccacagagccaucaagaucaccguggacggccccagagagcccagaagacacagacagaagcuggacgaccagaccaagcccggcagccugagcuucagcgagagacugagcgagcuggagcagcugagaagaaccgccaugagagugagcccccaccaccccgcccccacccccaaccccagagccagccugaaccacagcaccgccuucaacccccagccccagagccagaugcaggacaccagacagauccagcccagcccccccuggagcuacgaccagagcuaccaguaccugggcagcaucgccagccccagcgugcaccccgccacccccaucagccccggcagagccagcggcaugaccacccugagcgccgagcugagcagcagacugagcaccgcccccgaccugaccgccuucagcgaccccagacaguuccccgcccugcccagcaucagcgaccccagaaugcacuaccccggcgccuucaccuacagccccacccccgugaccagcggcaucggcaucggcaugagcgccaugggcagcgccaccagauaccacaccuaccugcccccccccuaccccggcagcagccaggcccagggcggccccuuccaggccagcagccccagcuaccaccuguacuacggcgccagcgccggcagcuaccaguucagcauggugggcggcgagagaagcccccccagaauccugccccccugcaccaacgccagcaccggcagcgcccugcugaaccccagccugcccaaccagagcgacgugguggaggccgagggcagccacagcaacagccccaccaacauggcccccagcgccagacuggaggaggccguguggagacccuacuaa

SEQ ID NO: 22922 - RNA, 1815 nt, Artificial Sequence
  RUNX1T1__Homo_sapiens__NP_001185560
augaucagcgugaagagaaacaccuggagagcccugagccuggugaucggcgacugcagaaagaagggcaacuucgaguacugccaggacagaaccgagaagcacagcaccaugcccgacagccccguggacgugaagacccagagcagacugaccccccccaccaugccccccccccccaccacccagggcgcccccagaaccagcagcuucacccccaccacccugaccaacggcaccagccacagccccaccgcccugaacggcgcccccagcccccccaacggcuucagcaacggccccagcagcagcagcagcagcagccuggccaaccagcagcugccccccgccugcggcgccagacagcugagcaagcugaagagauuccugaccacccugcagcaguucggcaacgacaucagccccgagaucggcgagagagugagaacccuggugcugggccuggugaacagcacccugaccaucgaggaguuccacagcaagcugcaggaggccaccaacuucccccugagacccuucgugauccccuuccugaaggccaaccugccccugcugcagagagagcugcugcacugcgccagacuggccaagcagaaccccgcccaguaccuggcccagcacgagcagcugcugcuggacgccagcaccaccagccccguggacagcagcgagcugcugcuggacgugaacgagaacggcaagagaagaacccccgacagaaccaaggagaacggcuucgacagagagccccugcacagcgagcaccccagcaagagacccugcaccaucagccccggccagagauacagccccaacaacggccugagcuaccagcccaacggccugccccaccccacccccccccccccccagcacuacagacuggacgacauggccaucgcccaccacuacagagacagcuacagacaccccagccacagagaccugagagacagaaacagacccaugggccugcacggcaccagacaggaggagaugaucgaccacagacugaccgacagagagugggccgaggaguggaagcaccuggaccaccugcugaacugcaucauggacaugguggagaagaccagaagaagccugaccgugcugagaagaugccaggaggccgacagagaggagcugaacuacuggaucagaagauacagcgacgccgaggaccugaagaagggcggcggcagcagcagcagccacagcagacagcagagccccgugaaccccgaccccguggcccuggacgcccacagagaguuccugcacagacccgccagcggcuacgugcccgaggagaucuggaagaaggccgaggaggccgugaacgaggugaagagacaggccaugaccgagcugcagaaggccgugagcgaggccgagagaaaggcccacgacaugaucaccaccgagagagccaagauggagagaaccguggccgaggccaagagacaggccgccgaggacgcccuggccgugaucaaccagcaggaggacagcagcgagagcugcuggaacugcggcagaaaggccagcgagaccugcagcggcugcaacaccgccagauacugcggcagcuucugccagcacaaggacugggagaagcaccaccacaucugcggccagacccugcaggcccagcagcagggcgacacccccgccgugagcagcagcgugacccccaacagcggcgccggcagccccauggacaccccccccgccgccacccccagaagcaccacccccggcacccccagcaccaucgagaccacccccagauaa

SEQ ID NO: 22923 - RNA, 1500 nt, Artificial Sequence
  RUNX2__Homo_sapiens__NP_001015051
auggccagcaacagccuguucagcaccgugacccccugccagcagaacuucuucugggaccccagcaccagcagaagauucagcccccccagcagcagccugcagcccggcaagaugagcgacgugagccccgugguggccgcccagcagcagcagcagcagcagcagcagcagcagcagcagcagcagcagcagcagcagcagcagcagcaggaggccgccgccgccgccgccgccgccgccgccgccgccgccgccgccgccgccgugcccagacugagacccccccacgacaacagaaccaugguggagaucaucgccgaccaccccgccgagcuggugagaaccgacagccccaacuuccugugcagcgugcugcccagccacuggagaugcaacaagacccugcccguggccuucaaggugguggcccugggcgaggugcccgacggcaccguggugaccgugauggccggcaacgacgagaacuacagcgccgagcugagaaacgccagcgccgugaugaagaaccagguggccagauucaacgaccugagauucgugggcagaagcggcagaggcaagagcuucacccugaccaucaccguguucaccaaccccccccagguggccaccuaccacagagccaucaaggugaccguggacggccccagagagcccagaagacacagacagaagcuggacgacagcaagcccagccuguucagcgacagacugagcgaccugggcagaaucccccaccccagcaugagagugggcgugcccccccagaaccccagacccagccugaacagcgcccccagccccuucaacccccagggccagagccagaucaccgaccccagacaggcccagagcagcccccccuggagcuacgaccagagcuaccccagcuaccugagccagaugaccagccccagcauccacagcaccaccccccugagcagcaccagaggcaccggccugcccgccaucaccgacgugcccagaagaaucagcggcgccagcgagcugggccccuucagcgaccccagacaguuccccagcaucagcagccugaccgagagcagauucagcaaccccagaaugcacuaccccgccaccuucaccuacaccccccccgugaccagcggcaugagccugggcaugagcgccaccacccacuaccacaccuaccugcccccccccuaccccggcagcagccagagccagagcggccccuuccagaccagcagcacccccuaccuguacuacggcaccagcagcggcagcuaccaguuccccauggugcccggcggcgacagaagccccagcagaaugcugccccccugcaccaccaccagcaacggcagcacccugcugaaccccaaccugcccaaccagaacgacggcguggacgccgacggcagccacagcagcagccccaccgugcugaacagcagcggcagaauggacgagagcguguggagacccuacuaa

SEQ ID NO: 22924 - RNA, 1131 nt, Artificial Sequence
  RUNX3__Homo_sapiens__XP_011540653
auggccagcaacagcaucuucgacagcuuccccaccuacagccccaccuucaucagagaccccagcaccagcagaagauucaccccccccagccccgccuuccccugcggcggcggcggcggcaagaugggcgagaacagcggcgcccugagcgcccaggccgccgugggccccggcggcagagccagacccgaggugagaagcaugguggacgugcuggccgaccacgccggcgagcuggugagaaccgacagccccaacuuccugugcagcgugcugcccagccacuggagaugcaacaagacccugcccguggccuucaaggugguggcccugggcgacgugcccgacggcaccguggugaccgugauggccggcaacgacgagaacuacagcgccgagcugagaaacgccagcgccgugaugaagaaccagguggccagauucaacgaccugagauucgugggcagaagcggcagaggcaagagcuucacccugaccaucaccguguucaccaaccccacccagguggccaccuaccacagagccaucaaggugaccguggacggccccagagagcccagaagaaccagcgagcugaaccccuucagcgaccccagacaguucgacagaagcuuccccacccugcccacccugaccgagagcagauuccccgaccccagaaugcacuaccccggcgccaugagcgccgccuuccccuacagcgccacccccagcggcaccagcaucagcagccugagcguggccggcaugcccgccaccagcagauuccaccacaccuaccugcccccccccuaccccggcgccccccagaaccagagcggccccuuccaggccaaccccagccccuaccaccuguacuacggcaccagcagcggcagcuaccaguucagcaugguggccggcagcagcagcggcggcgacagaagccccaccagaaugcuggccagcugcaccagcagcgccgccagcguggccgccggcaaccugaugaaccccagccugggcggccagagcgacggcguggaggccgacggcagccacagcaacagccccaccgcccugagcacccccggcagaauggacgaggccguguggagacccuacuaa

SEQ ID NO: 22925 - RNA, 1371 nt, Artificial Sequence
  RUVBL1__Homo_sapiens__NP_003698
augaagaucgaggaggugaagagcaccaccaagacccagagaaucgccagccacagccacgugaagggccugggccuggacgagagcggccuggccaagcaggccgccagcggccuggugggccaggagaacgccagagaggccugcggcgugaucguggagcugaucaagagcaagaagauggccggcagagccgugcugcuggccggcccccccggcaccggcaagaccgcccuggcccuggccaucgcccaggagcugggcagcaaggugcccuucugccccauggugggcagcgagguguacagcaccgagaucaagaagaccgaggugcugauggagaacuucagaagagccaucggccugagaaucaaggagaccaaggagguguacgagggcgaggugaccgagcugacccccugcgagaccgagaaccccaugggcggcuacggcaagaccaucagccacgugaucaucggccugaagaccgccaagggcaccaagcagcugaagcuggaccccagcaucuucgagagccugcagaaggagagaguggaggccggcgacgugaucuacaucgaggccaacagcggcgccgugaagagacagggcagaugcgacaccuacgccaccgaguucgaccuggaggccgaggaguacgugccccugcccaagggcgacgugcacaagaagaaggagaucauccaggacgugacccugcacgaccuggacguggccaacgccagaccccagggcggccaggacauccugagcaugaugggccagcugaugaagcccaagaagaccgagaucaccgacaagcugagaggcgagaucaacaagguggugaacaaguacaucgaccagggcaucgccgagcuggugcccggcgugcuguucguggacgaggugcacaugcuggacaucgagugcuucaccuaccugcacagagcccuggagagcagcaucgcccccaucgugaucuucgccagcaacagaggcaacugcgugaucagaggcaccgaggacaucaccagcccccacggcaucccccuggaccugcuggacagagugaugaucaucagaaccaugcuguacaccccccaggagaugaagcagaucaucaagaucagagcccagaccgagggcaucaacaucagcgaggaggcccugaaccaccugggcgagaucggcaccaagaccacccugagauacagcgugcagcugcugacccccgccaaccugcuggccaagaucaacggcaaggacagcaucgagaaggagcacguggaggagaucagcgagcuguucuacgacgccaagagcagcgccaagauccuggccgaccagcaggacaaguacaugaaguaa

SEQ ID NO: 22926 - RNA, 1392 nt, Artificial Sequence
  RUVBL2__Homo_sapiens__NP_006657
auggccaccgugaccgccaccaccaaggugcccgagaucagagacgugaccagaaucgagagaaucggcgcccacagccacaucagaggccugggccuggacgacgcccuggagcccagacaggccagccagggcauggugggccagcuggccgccagaagagccgccggcguggugcuggagaugaucagagagggcaagaucgccggcagagccgugcugaucgccggccagcccggcaccggcaagaccgccaucgccaugggcauggcccaggcccugggccccgacacccccuucaccgccaucgccggcagcgagaucuucagccuggagaugagcaagaccgaggcccugacccaggccuucagaagaagcaucggcgugagaaucaaggaggagaccgagaucaucgagggcgaggugguggagauccagaucgacagacccgccaccggcaccggcagcaaggugggcaagcugacccugaagaccaccgagauggagaccaucuacgaccugggcaccaagaugaucgagagccugaccaaggacaaggugcaggccggcgacgugaucaccaucgacaaggccaccggcaagaucagcaagcugggcagaagcuucaccagagccagagacuacgacgccaugggcagccagaccaaguucgugcagugccccgacggcgagcugcagaagagaaaggagguggugcacaccgugagccugcacgagaucgacgugaucaacagcagaacccagggcuuccuggcccuguucagcggcgacaccggcgagaucaagagcgaggugagagagcagaucaacgccaagguggccgaguggagagaggagggcaaggccgagaucauccccggcgugcuguucaucgacgaggugcacaugcuggacaucgagagcuucagcuuccugaacagagcccuggagagcgacauggcccccgugcugaucauggccaccaacagaggcaucaccagaaucagaggcaccagcuaccagagcccccacggcauccccaucgaccugcuggacagacugcugaucgugagcaccacccccuacagcgagaaggacaccaagcagauccugagaaucagaugcgaggaggaggacguggagaugagcgaggacgccuacaccgugcugaccagaaucggccuggagaccagccugagauacgccauccagcugaucaccgccgccagccuggugugcagaaagagaaagggcaccgaggugcagguggacgacaucaagagaguguacagccuguuccuggacgagagcagaagcacccaguacaugaaggaguaccaggacgccuuccuguucaacgagcugaagggcgagaccauggacaccagcuaa

SEQ ID NO: 22927 - RNA, 2130 nt, Artificial Sequence
  RXFP1__Homo_sapiens__NP_001240658
augaccagcggcagcguguucuucuacauccugaucuucggcaaguacuucagccacggcggcggccaggacgugaagugcagccugggcuacuuccccugcggcaacaucaccaagugccugccccagcugcugcacugcaacggcguggacgacugcggcaaccaggccgacgaggacaacugcggcgacaacaacggcuggagccugcaguucgacaaguacuucgccagcuacuacaagaugaccagccaguaccccuucgaggccgagacccccgagugccuggugggcagcgugcccgugcagugccugugccagggccuggagcuggacugcgacgagaccaaccugagagccgugcccagcgugagcagcaacgugaccgccaugagccugcaguggaaccugaucagaaagcugccccccgacugcuucaagaacuaccacgaccugcagaagcuguaccugcagaacaacaagaucaccagcaucagcaucuacgccuucagaggccugaacagccugaccaagcuguaccugagccacaacagaaucaccuuccugaagcccggcguguucgaggaccugcacagacuggaguggcugaucaucgaggacaaccaccugagcagaaucagcccccccaccuucuacggccugaacagccugauccugcuggugcugaugaacaacgugcugaccagacugcccgacaagccccugugccagcacaugcccagacugcacuggcuggaccuggagggcaaccacauccacaaccugagaaaccugaccuucaucagcugcagcaaccugaccgugcuggugaugagaaagaacaagaucaaccaccugaacgagaacaccuucgccccccugcagaagcuggacgaguucagccuggagggcaucgagaucagcaacauccagcagagaauguucagaccccugaugaaccugagccacaucuacuucaagaaguuccaguacugcggcuacgccccccacgugagaagcugcaagcccaacaccgacggcaucagcagccuggagaaccugcuggccagcaucauccagagaguguucguguggguggugagcgccgugaccugcuucggcaacaucuucgugaucugcaugagacccuacaucagaagcgagaacaagcuguacgccaugagcaucaucagccugugcugcgccgacugccugaugggcaucuaccuguucgugaucggcggcuucgaccugaaguucagaggcgaguacaacaagcacgcccagcuguggauggagagcacccacugccagcuggugggcagccuggccauccugagcaccgaggugagcgugcugcugcugaccuuccugacccuggagaaguacaucugcaucguguaccccuucagaugcgugagacccggcaagugcagaaccaucaccgugcugauccugaucuggaucaccggcuucaucguggccuucaucccccugagcaacaaggaguucuucaagaacuacuacggcaccaacggcgugugcuucccccugcacagcgaggacaccgagagcaucggcgcccagaucuacagcguggccaucuuccugggcaucaaccuggccgccuucaucaucaucguguucagcuacggcagcauguucuacagcgugcaccagagcgccaucaccgccaccgagaucagaaaccaggugaagaaggagaugauccuggccaagagauucuucuucaucguguucaccgacgcccugugcuggauccccaucuucguggugaaguuccugagccugcugcagguggagauccccggcaccaucaccagcuggguggugaucuucauccugcccaucaacagcgcccugaaccccauccuguacacccugaccaccagacccuucaaggagaugauccacagauucugguacaacuacagacagagaaagagcauggacagcaagggccagaagaccuacgcccccagcuucaucuggguggagauguggccccugcaggagaugccccccgagcugaugaagcccgaccuguucaccuaccccugcgagaugagccugaucagccagagcaccagacugaacagcuacagcuaa

SEQ ID NO: 22928 - RNA, 2193 nt, Artificial Sequence
  RXFP2__Homo_sapiens__NP_001159530
augaucguguuccugguguucaagcaccuguucagccugagacugaucaccauguucuuccugcugcacuucaucgugcugaucaacgugaaggacuucgcccugacccagggcagcaugaucacccccagcugccagaagggcuacuuccccugcggcaaccugaccaagugccugcccagagccuuccacugcgacggcaaggacgacugcggcaacggcgccgacgaggagaacugcggcgacaccagcggcugggccaccaucuucggcaccgugcacggcaacgccaacagcguggcccugacccaggagugcuuccugaagcaguacccccagugcugcgacugcaaggagaccgagcuggagugcgugaacggcgaccugaagagcgugcccaugaucagcaacaacgugacccugcugagccugaagaagaacaagauccacagccugcccgacaagguguucaucaaguacaccaagcugaagaagaucuuccugcagcacaacugcaucagacacaucagcagaaaggccuucuucggccugugcaaccugcagauccuguaccugaaccacaacugcaucaccacccugagacccggcaucuucaaggaccugcaccagcugaccuggcugauccuggacgacaaccccaucaccagaaucagccagagacuguucaccggccugaacagccuguucuuccugagcauggugaacaacuaccuggaggcccugcccaagcagaugugcgcccagaugccccagcugaacuggguggaccuggagggcaacagaaucaaguaccugaccaacagcaccuuccugagcugcgacagccugaccgugcuggaccugagcagcaacaccaucaccgagcugagcccccaccuguucaaggaccugaagcugcugcagaagcugaaccugagcagcaacccccugauguaccugcacaagaaccaguucgagagccugaagcagcugcagagccuggaccuggagagaaucgagauccccaacaucaacaccagaauguuccagcccaugaagaaccugagccacaucuacuucaagaacuucagauacugcagcuacgccccccacgugagaaucugcaugccccugaccgacggcaucagcagcuucgaggaccugcuggccaacaacauccugagaaucuucgugugggugaucgccuucaucaccugcuucggcaaccuguucgugaucggcaugagaagcuucaucaaggccgagaacaccacccacgccaugagcaucaagauccugugcugcgccgacugccugaugggcguguaccuguucuucgugggcaucuucgacaucaaguacagaggccaguaccagaaguacgcccugcuguggauggagagcgugcagugcagacugaugggcuuccuggccaugcugagcaccgaggugagcgugcugcugcugaccuaccugacccuggagaaguuccuggugaucguguuccccuucagcaacaucagacccggcaagagacagaccagcgugauccugaucugcaucuggauggccggcuuccugaucgccgugauccccuucuggaacaaggacuacuucggcaacuucuacggcaagaacggcgugugcuucccccuguacuacgaccagaccgaggacaucggcagcaagggcuacagccugggcaucuuccugggcgugaaccugcuggccuuccugaucaucguguucagcuacaucaccauguucugcagcauccagaagaccgcccugcagaccaccgaggugagaaacugcuucggcagagagguggccguggccaacagauucuucuucaucguguucagcgacgccaucugcuggauccccguguucguggugaagauccugagccuguucagaguggagauccccgacaccaugaccagcuggaucgugaucuucuuccugcccgugaacagcgcccugaaccccauccuguacacccugaccaccaacuucuucaaggacaagcugaagcagcugcugcacaagcaccagagaaagagcaucuucaagaucaagaagaagagccugagcaccagcaucguguggaucgaggacagcagcagccugaagcugggcgugcugaacaagaucacccugggcgacagcaucaugaagcccgugagcuaa

SEQ ID NO: 22929 - RNA, 1410 nt, Artificial Sequence
  RXFP3__Homo_sapiens__NP_057652
augcagauggccgacgccgccaccaucgccaccaugaacaaggccgccggcggcgacaagcuggccgagcuguucagccuggugcccgaccugcuggaggccgccaacaccagcggcaacgccagccugcagcugcccgaccuguggugggagcugggccuggagcugcccgacggcgccccccccggccacccccccggcagcggcggcgccgagagcgccgacaccgaggccagagugagaauccugaucagcgugguguacuggguggugugcgcccugggccuggccggcaaccugcuggugcuguaccugaugaagagcaugcagggcuggagaaagagcagcaucaaccuguucgugaccaaccuggcccugaccgacuuccaguucgugcugacccugcccuucugggccguggagaacgcccuggacuucaaguggcccuucggcaaggccaugugcaagaucgugagcauggugaccagcaugaacauguacgccagcguguucuuccugaccgccaugagcgugaccagauaccacagcguggccagcgcccugaagagccacagaaccagaggccacggcagaggcgacugcugcggcagaagccugggcgacagcugcugcuucagcgccaaggcccugugcguguggaucugggcccuggccgcccuggccagccugcccagcgccaucuucagcaccaccgugaaggugaugggcgaggagcugugccuggugagauuccccgacaagcugcugggcagagacagacaguucuggcugggccuguaccacagccagaaggugcugcugggcuucgugcugccccugggcaucaucauccugugcuaccugcugcuggugagauucaucgccgacagaagagccgccggcaccaagggcggcgccgccguggccggcggcagacccaccggcgccagcgccagaagacugagcaaggugaccaagagcgugaccaucguggugcugagcuucuuccugugcuggcugcccaaccaggcccugaccaccuggagcauccugaucaaguucaacgccgugcccuucagccaggaguacuuccugugccagguguacgccuuccccgugagcgugugccuggcccacagcaacagcugccugaaccccgugcuguacugccuggugagaagagaguucagaaaggcccugaagagccugcuguggagaaucgccagccccagcaucaccagcaugagacccuucaccgccaccaccaagcccgagcacgaggaccagggccugcaggcccccgcccccccccacgccgccgccgagcccgaccugcuguacuacccccccggcguggugguguacagcggcggcagauacgaccugcugcccagcagcagcgccuacuaa

SEQ ID NO: 22930 - RNA, 1308 nt, Artificial Sequence
  RXRA__Homo_sapiens__NP_001278849
auggccgcccccagccugcaccccagccugggccccggcaucggcagccccggccagcugcacagccccaucagcacccugagcagccccaucaacggcaugggcccccccuucagcgugaucagcagccccaugggcccccacagcaugagcgugcccaccacccccacccugggcuucagcaccggcagcccccagcugagcagccccaugaaccccgugagcagcagcgaggacaucaagcccccccugggccugaacggcgugcugaaggugcccgcccaccccagcggcaacauggccagcuucaccaagcacaucugcgccaucugcggcgacagaagcagcggcaagcacuacggcguguacagcugcgagggcugcaagggcuucuucaagagaaccgugagaaaggaccugaccuacaccugcagagacaacaaggacugccugaucgacaagagacagagaaacagaugccaguacugcagauaccagaagugccuggccaugggcaugaagagagaggccgugcaggaggagagacagagaggcaaggacagaaacgagaacgagguggagagcaccagcagcgccaacgaggacaugcccguggagagaauccuggaggccgagcuggccguggagcccaagaccgagaccuacguggaggccaacaugggccugaaccccagcagccccaacgaccccgugaccaacaucugccaggccgccgacaagcagcuguucacccugguggagugggccaagagaaucccccacuucagcgagcugccccuggacgaccaggugauccugcugagagccggcuggaacgagcugcugaucgccagcuucagccacagaagcaucgccgugaaggacggcauccugcuggccaccggccugcacgugcacagaaacagcgcccacagcgccggcgugggcgccaucuucgacagagugcugaccgagcuggugagcaagaugagagacaugcagauggacaagaccgagcugggcugccugagagccaucgugcuguucaaccccgacagcaagggccugagcaaccccgccgagguggaggcccugagagagaagguguacgccagccuggaggccuacugcaagcacaaguaccccgagcagcccggcagauucgccaagcugcugcugagacugcccgcccugagaagcaucggccugaagugccuggagcaccuguucuucuucaagcugaucggcgacacccccaucgacaccuuccugauggagaugcuggaggccccccaccagaugaccuaa

SEQ ID NO: 22931 - RNA, 1614 nt, Artificial Sequence
  RXRB__Homo_sapiens__NP_001257330
augagcugggccgccagaccccccuuccugccccagagacacgccgccggccagugcggccccgugggcgugagaaaggagaugcacugcggcguggccagcagauggagaagaagaagacccuggcuggaccccgccgccgccgccgccgccgccguggccggcggcgagcagcagacccccgagcccgagcccggcgaggccggcagagacggcaugggcgacagcggcagagacagcagaagccccgacagcagcagccccaacccccugccccagggcgugcccccccccagcccccccggccccccccugccccccagcaccgcccccagccugggcggcagcggcgcccccccccccccccccaugcccccccccccccugggcagccccuuccccgugaucagcagcagcaugggcagccccggccugcccccccccgccccccccggcuucagcggccccgugagcagcccccagaucaacagcaccgugagccugcccggcggcggcagcggcccccccgaggacgugaagccccccgugcugggcgugagaggccugcacugcccccccccccccggcggccccggcgccggcaagagacugugcgccaucugcggcgacagaagcagcggcaagcacuacggcguguacagcugcgagggcugcaagggcuucuucaagagaaccaucagaaaggaccugaccuacagcugcagagacaacaaggacugcaccguggacaagagacagagaaacagaugccaguacugcagauaccagaagugccuggccaccggcaugaagagagaggccgugcaggaggagagacagagaggcaaggacaaggacggcgacggcgagggcgccggcggcgcccccgaggagaugcccguggacagaauccuggaggccgagcuggccguggagcagaagagcgaccagggcguggagggccccggcggcaccggcggcagcggcagcagccccaacgaccccgugaccaacaucugccaggccgccgacaagcagcuguucacccugguggagugggccaagagaaucccccacuucagcagccugccccuggacgaccaggugauccugcugagagccggcuggaacgagcugcugaucgccagcuucagccacagaagcaucgacgugagagacggcauccugcuggccaccggccugcacgugcacagaaacagcgcccacagcgccggcgugggcgccaucuucgacagaagccugagcagagugcugaccgagcuggugagcaagaugagagacaugagaauggacaagaccgagcugggcugccugagagccaucauccuguucaaccccgacgccaagggccugagcaaccccagcgagguggaggugcugagagagaagguguacgccagccuggagaccuacugcaagcagaaguaccccgagcagcagggcagauucgccaagcugcugcugagacugcccgcccugagaagcaucggccugaagugccuggagcaccuguucuucuucaagcugaucggcgacacccccaucgacaccuuccugauggagaugcuggaggccccccaccagcuggccuaa

SEQ ID NO: 22932 - RNA, 1392 nt, Artificial Sequence
  RXRG__Homo_sapiens__NP_008848
auguacggcaacuacagccacuucaugaaguuccccgccggcuacggcggcagccccggccacaccggcagcaccagcaugagccccagcgccgcccugagcaccggcaagcccauggacagccaccccagcuacaccgacacccccgugagcgcccccagaacccugagcgccgugggcaccccccugaacgcccugggcagccccuacagagugaucaccagcgccaugggcccccccagcggcgcccuggccgccccccccggcaucaaccugguggccccccccagcagccagcugaacguggugaacagcgugagcagcagcgaggacaucaagccccugcccggccugcccggcaucggcaacaugaacuaccccagcaccagccccggcagccuggugaagcacaucugcgccaucugcggcgacagaagcagcggcaagcacuacggcguguacagcugcgagggcugcaagggcuucuucaagagaaccaucagaaaggaccugaucuacaccugcagagacaacaaggacugccugaucgacaagagacagagaaacagaugccaguacugcagauaccagaagugccuggugaugggcaugaagagagaggccgugcaggaggagagacagagaagcagagagagagccgagagcgaggccgagugcgccaccagcggccacgaggacaugcccguggagagaauccuggaggccgagcuggccguggagcccaagaccgagagcuacggcgacaugaacauggagaacagcaccaacgaccccgugaccaacaucugccacgccgccgacaagcagcuguucacccugguggagugggccaagagaaucccccacuucagcgaccugacccuggaggaccaggugauccugcugagagccggcuggaacgagcugcugaucgccagcuucagccacagaagcgugagcgugcaggacggcauccugcuggccaccggccugcacgugcacagaagcagcgcccacagcgccggcgugggcagcaucuucgacagagugcugaccgagcuggugagcaagaugaaggacaugcagauggacaagagcgagcugggcugccugagagccaucgugcuguucaaccccgacgccaagggccugagcaaccccagcgagguggagacccugagagagaagguguacgccacccuggaggccuacaccaagcagaaguaccccgagcagcccggcagauucgccaagcugcugcugagacugcccgcccugagaagcaucggccugaagugccuggagcaccuguucuucuucaagcugaucggcgacacccccaucgacaccuuccugauggagaugcuggagaccccccugcagaucaccuaa

SEQ ID NO: 22933 - RNA, 687 nt, Artificial Sequence
  RYBP__Homo_sapiens__NP_036366
augaccaugggcgacaagaagagccccaccagacccaagagacaggccaagcccgccgccgacgagggcuucugggacugcagcgugugcaccuucagaaacagcgccgaggccuucaagugcagcaucugcgacgugagaaagggcaccagcaccagaaagcccagaaucaacagccagcugguggcccagcagguggcccagcaguacgccaccccccccccccccaagaaggagaagaaggagaagguggagaagcaggacaaggagaagcccgagaaggacaaggagaucagccccagcgugaccaagaagaacaccaacaagaagaccaagcccaagagcgacauccugaaggacccccccagcgaggccaacagcauccagagcgccaacgccaccaccaagaccagcgagaccaaccacaccagcagacccagacugaagaacguggacagaagcaccgcccagcagcuggccgugaccgugggcaacgugaccgugaucaucaccgacuucaaggagaagaccagaagcagcagcaccagcagcagcaccgugaccagcagcgccggcagcgagcagcagaaccagagcagcagcggcagcgagagcaccgacaagggcagcagcagaagcagcacccccaagggcgacaugagcgccgugaacgacgagagcuucuaa

SEQ ID NO: 22934 - RNA, 1833 nt, Artificial Sequence
  RYK__Homo_sapiens__NP_001005861
augagaggcgccgccagacugggcagacccggcagaagcugccugcccggcgccagaggccugagagccccccccccccccccccugcugcugcugcuggcccugcugccccugcugcccgcccccggcgccgccgccgcccccgcccccagaccccccgagcugcagagcgccagcgccggccccagcgugagccuguaccugagcgaggacgaggugagaagacugaucggccuggacgccgagcuguacuacgugagaaacgaccugaucagccacuacgcccugagcuucagccugcuggugcccagcgagaccaacuuccugcacuucaccuggcacgccaagagcaagguggaguacaagcugggcuuccagguggacaacgugcuggccauggacaugccccaggugaacaucagcgugcagggcgaggugcccagaacccugagcguguucagaguggagcugagcugcaccggcaagguggacagcgaggugaugauccugaugcagcugaaccugaccgugaacagcagcaagaacuucaccgugcugaacuucaagagaagaaagaugugcuacaagaagcuggaggaggugaagaccagcgcccuggacaagaacaccagcagaaccaucuacgaccccgugcacgccgcccccaccaccagcaccagaguguucuacaucagcgugggcgugugcugcgccgugaucuuccugguggccaucauccuggccgugcugcaccugcacagcaugaagagaaucgagcuggacgacagcaucagcgccagcagcagcagccagggccugagccagcccagcacccagaccacccaguaccugagagccgacacccccaacaacgccacccccaucaccagcagccugggcuaccccacccugagaaucgagaagaacgaccugagaagcgugacccugcuggaggccaagggcaaggugaaggacaucgccaucagcagagagagaaucacccugaaggacgugcugcaggagggcaccuucggcagaaucuuccacggcauccugaucgacgagaaggaccccaacaaggagaagcaggccuucgugaagaccgugaaggaccaggccagcgagauccaggugaccaugaugcugaccgagagcugcaagcugagaggccugcaccacagaaaccugcugcccaucacccacgugugcaucgaggagggcgagaagcccauggugauccugcccuacaugaacuggggcaaccugaagcuguuccugagacagugcaagcugguggaggccaacaacccccaggccaucagccagcaggaccuggugcacauggccauccagaucgccugcggcaugagcuaccuggccagaagagaggugauccacaaggaccuggccgccagaaacugcgugaucgacgacacccugcaggugaagaucaccgacaacgcccugagcagagaccuguuccccauggacuaccacugccugggcgacaacgagaacagacccgugagauggauggcccuggagagccuggugaacaacgaguucagcagcgccagcgacgugugggccuucggcgugacccugugggagcugaugacccugggccagacccccuacguggacaucgaccccuucgagauggccgccuaccugaaggacggcuacagaaucgcccagcccaucaacugccccgacgagcuguucgccgugauggccugcugcugggcccuggaccccgaggagagacccaaguuccagcagcuggugcagugccugaccgaguuccacgccgcccugggcgccuacguguaa

SEQ ID NO: 22935 - RNA, 15117 nt, Artificial Sequence
  RYR1__Homo_sapiens__NP_000531
augggcgacgccgagggcgaggacgaggugcaguuccugagaaccgacgacgagguggugcugcagugcagcgccaccgugcugaaggagcagcugaagcugugccuggccgccgagggcuucggcaacagacugugcuuccuggagcccaccagcaacgcccagaacgugccccccgaccuggccaucugcugcuucgugcuggagcagagccugagcgugagagcccugcaggagaugcuggccaacaccguggaggccggcguggagagcagccagggcggcggccacagaacccugcuguacggccacgccauccugcugagacacgcccacagcagaauguaccugagcugccugaccaccagcagaagcaugaccgacaagcuggccuucgacgugggccugcaggaggacgccaccggcgaggccugcugguggaccaugcaccccgccagcaagcagagaagcgagggcgagaaggugagagugggcgacgacaucauccuggugagcgugagcagcgagagauaccugcaccugagcaccgccagcggcgagcugcagguggacgccagcuucaugcagacccuguggaacaugaaccccaucugcagcagaugcgaggagggcuucgugaccggcggccacgugcugagacuguuccacggccacauggacgagugccugaccaucagccccgccgacagcgacgaccagagaagacugguguacuacgagggcggcgccgugugcacccacgccagaagccuguggagacuggagccccugagaaucagcuggagcggcagccaccugagauggggccagccccugagagugagacacgugaccaccggccaguaccuggcccugaccgaggaccagggccugguggugguggacgccagcaaggcccacaccaaggccaccagcuucugcuucagaaucagcaaggagaagcuggacguggcccccaagagagacguggagggcaugggcccccccgagaucaaguacggcgagagccugugcuucgugcagcacguggccagcggccuguggcugaccuacgccgcccccgaccccaaggcccugagacugggcgugcugaagaagaaggccaugcugcaccaggagggccacauggacgacgcccugagccugaccagaugccagcaggaggagagccaggccgccagaaugauccacagcaccaacggccuguacaaccaguucaucaagagccuggacagcuucagcggcaagcccagaggcagcggcccccccgccggcaccgcccugcccaucgagggcgugauccugagccugcaggaccugaucaucuacuucgagccccccagcgaggaccugcagcacgaggagaagcagagcaagcugagaagccugagaaacagacagagccuguuccaggaggagggcaugcugagcauggugcugaacugcaucgacagacugaacguguacaccaccgccgcccacuucgccgaguucgccggcgaggaggccgccgagagcuggaaggagaucgugaaccugcuguacgagcugcuggccagccugaucagaggcaacagaagcaacugcgcccuguucagcaccaaccuggacuggcuggugagcaagcuggacagacuggaggccagcagcggcauccuggaggugcuguacugcgugcugaucgagagccccgaggugcugaacaucauccaggagaaccacaucaagagcaucaucagccugcuggacaagcacggcagaaaccacaaggugcuggacgugcugugcagccugugcgugugcaacggcguggccgugagaagcaaccaggaccugaucaccgagaaccugcugcccggcagagagcugcugcugcagaccaaccugaucaacuacgugaccagcaucagacccaacaucuucgugggcagagccgagggcaccacccaguacagcaagugguacuucgaggugaugguggacgaggugacccccuuccugaccgcccaggccacccaccugagagugggcugggcccugaccgagggcuacacccccuaccccggcgccggcgagggcuggggcggcaacggcgugggcgacgaccuguacagcuacggcuucgacggccugcaccuguggaccggccacguggccagacccgugaccagccccggccagcaccugcuggcccccgaggacgugaucagcugcugccuggaccugagcgugcccagcaucagcuucagaaucaacggcugccccgugcagggcguguucgagagcuucaaccuggacggccuguucuuccccguggugagcuucagcgccggcgugaaggugagauuccugcugggcggcagacacggcgaguucaaguuccugcccccccccggcuacgcccccugccacgaggccgugcugcccagagagagacugcaccuggagcccaucaaggaguacagaagagagggccccagaggcccccaccuggugggccccagcagaugccugagccacaccgacuucgugcccugccccguggacaccgugcagaucgugcugcccccccaccuggagagaaucagagagaagcuggccgagaacauccacgagcugugggcccugaccagaaucgagcagggcuggaccuacggccccgugagagacgacaacaagagacugcaccccugccugguggacuuccacagccugcccgagcccgagagaaacuacaaccugcagaugagcggcgagacccugaagacccugcuggcccugggcugccacgugggcauggccgacgagaaggccgaggacaaccugaagaagaccaagcugcccaagaccuacaugaugagcaacggcuacaagcccgccccccuggaccugagccacgugagacugacccccgcccagaccacccugguggacagacuggccgagaacggccacaacgugugggccagagacagagugggccagggcuggagcuacagcgccgugcaggacauccccgccagaagaaaccccagacuggugcccuacagacugcuggacgaggccaccaagagaagcaacagagacagccugugccaggccgugagaacccugcugggcuacggcuacaacaucgagccccccgaccaggagcccagccagguggagaaccagagcagaugcgacagagugagaaucuucagagccgagaagagcuacaccgugcagagcggcagaugguacuucgaguucgaggccgugaccaccggcgagaugagagugggcugggccagacccgagcugagacccgacguggagcugggcgccgacgagcuggccuacguguucaacggccacagaggccagagauggcaccugggcagcgagcccuucggcagacccuggcagcccggcgacguggugggcugcaugaucgaccugaccgagaacaccaucaucuucacccugaacggcgaggugcugaugagcgacagcggcagcgagaccgccuucagagagaucgagaucggcgacggcuuccugcccgugugcagccugggccccggccaggugggccaccugaaccugggccaggacgugagcagccugagauucuucgccaucugcggccugcaggagggcuucgagcccuucgccaucaacaugcagagacccgugaccaccugguucagcaagggccugccccaguucgagcccgugccccuggagcacccccacuacgaggugagcagaguggacggcaccguggacaccccccccugccugagacugacccacagaaccuggggcagccagaacagccugguggagaugcuguuccugagacugagccugcccgugcaguuccaccagcacuucagaugcaccgccggcgccaccccccuggccccccccggccugcagccccccgccgaggacgaggccagagccgccgagcccgaccccgacuacgagaaccugagaagaagcgccggcggcuggagcgaggccgagaacggcaaggagggcaccgccaaggagggcgcccccggcggcaccccccaggccggcggcgaggcccagcccgccagagccgagaacgagaaggacgccaccaccgagaagaacaagaagagaggcuuccuguucaaggccaagaagguggccaugaugacccagccccccgccacccccacccugcccagacugccccacgacguggugcccgccgacaacagagacgaccccgagaucauccugaacaccaccaccuacuacuacagcgugagaguguucgccggccaggagcccagcugcgugugggccggcugggugacccccgacuaccaccagcacgacaugagcuucgaccugagcaaggugagaguggugaccgugaccaugggcgacgagcagggcaacgugcacagcagccugaagugcagcaacugcuacaugguguggggcggcgacuucgugagccccggccagcagggcagaaucagccacaccgaccuggugaucggcugccugguggaccuggccaccggccugaugaccuucaccgccaacggcaaggagagcaacaccuucuuccagguggagcccaacaccaagcuguuccccgccguguucgugcugcccacccaccagaacgugauccaguucgagcugggcaagcagaagaacaucaugccccugagcgccgccauguuccagagcgagagaaagaaccccgccccccagugcccccccagacuggagaugcagaugcugaugcccgugagcuggagcagaaugcccaaccacuuccugcagguggagaccagaagagccggcgagagacugggcugggccgugcagugccaggagccccugaccaugauggcccugcacauccccgaggagaacagaugcauggacauccuggagcugagcgagagacuggaccugcagagauuccacagccacacccugagacuguacagagccgugugcgcccugggcaacaacagaguggcccacgcccugugcagccacguggaccaggcccagcugcugcacgcccuggaggacgcccaccugcccggcccccugagagccggcuacuacgaccugcugaucagcauccaccuggagagcgccugcagaagcagaagaagcaugcugagcgaguacaucgugccccugacccccgagaccagagccaucacccuguucccccccggcagaagcaccgagaacggccaccccagacacggccugcccggcgugggcgugaccaccagccugagacccccccaccacuucagcccccccugcuucguggccgcccugcccgccgccggcgccgccgaggcccccgccagacugagccccgccaucccccuggaggcccugagagacaaggcccugagaaugcugggcgaggccgugagagacggcggccagcacgccagagaccccgugggcggcagcguggaguuccaguucgugcccgugcugaagcuggugagcacccugcuggugaugggcaucuucggcgacgaggacgugaagcagauccugaagaugaucgagcccgagguguucaccgaggaggaggaggaggaggacgaggaggaggagggcgaggaggaggacgaggaggagaaggaggaggacgaggaggagaccgcccaggagaaggaggacgaggagaaggaggaggaggaggccgccgagggcgagaaggaggagggccuggaggagggccugcugcagaugaagcugcccgagagcgugaagcugcagaugugccaccugcuggaguacuucugcgaccaggagcugcagcacagaguggagagccuggccgccuucgccgagagauacguggacaagcugcaggccaaccagagaagcagauacggccugcugaucaaggccuucagcaugaccgccgccgagaccgccagaagaaccagagaguucagaagccccccccaggagcagaucaacaugcugcugcaguucaaggacggcaccgacgaggaggacugcccccugcccgaggagaucagacaggaccugcuggacuuccaccaggaccugcuggcccacugcggcauccagcuggacggcgaggaggaggagcccgaggaggagaccacccugggcagcagacugaugagccugcuggagaaggugagacuggugaagaagaaggaggagaagcccgaggaggagagaagcgccgaggagagcaagcccagaagccugcaggagcuggugagccacaugguggugagaugggcccaggaggacuucgugcagagccccgagcuggugagagccauguucagccugcugcacagacaguacgacggccugggcgagcugcugagagcccugcccagagccuacaccaucagccccagcagcguggaggacaccaugagccugcuggagugccugggccagaucagaagccugcugaucgugcagaugggcccccaggaggagaaccugaugauccagagcaucggcaacaucaugaacaacaagguguucuaccagcaccccaaccugaugagagcccugggcaugcacgagaccgugauggaggugauggugaacgugcugggcggcggcgagagcaaggagaucagauuccccaagauggugaccagcugcugcagauuccugugcuacuucugcagaaucagcagacagaaccagagaagcauguucgaccaccugagcuaccugcuggagaacagcggcaucggccugggcaugcagggcagcaccccccuggacguggccgccgccagcgugaucgacaacaacgagcuggcccuggcccugcaggagcaggaccuggagaagguggugagcuaccuggccggcugcggccugcagagcugccccaugcugguggccaagggcuaccccgacaucggcuggaaccccugcggcggcgagagauaccuggacuuccugagauucgccguguucgugaacggcgagagcguggaggagaacgccaacgugguggugagacugcugaucagaaagcccgagugcuucggccccgcccugagaggcgagggcggcagcggccugcuggccgccaucgaggaggccaucagaaucagcgaggaccccgccagagacggccccggcaucagaagagacagaagaagagagcacuucggcgaggagccccccgaggagaacagagugcaccugggccacgccaucaugagcuucuacgccgcccugaucgaccugcugggcagaugcgcccccgagaugcaccugauccaggccggcaagggcgaggcccugagaaucagagccauccugagaagccuggugccccuggaggaccuggugggcaucaucagccugccccugcagauccccacccugggcaaggacggcgcccuggugcagcccaagaugagcgccagcuucgugcccgaccacaaggccagcauggugcuguuccuggacagaguguacggcaucgagaaccaggacuuccugcugcacgugcuggacgugggcuuccugcccgacaugagagccgccgccagccuggacaccgccaccuucagcaccaccgagauggcccuggcccugaacagauaccugugccuggccgugcugccccugaucaccaagugcgccccccuguucgccggcaccgagcacagagccaucaugguggacagcaugcugcacaccguguacagacugagcagaggcagaagccugaccaaggcccagagagacgugaucgaggacugccugaugagccugugcagauacaucagacccagcaugcugcagcaccugcugagaagacugguguucgacgugcccauccugaacgaguucgccaagaugccccugaagcugcugaccaaccacuacgagagaugcuggaaguacuacugccugcccaccggcugggccaacuucggcgugaccagcgaggaggagcugcaccugaccagaaagcuguucuggggcaucuucgacagccuggcccacaagaaguacgaccccgagcuguacagaauggccaugcccugccugugcgccaucgccggcgcccugccccccgacuacguggacgccagcuacagcagcaaggccgagaagaaggccaccguggacgccgagggcaacuucgaccccagacccguggagacccugaacgugaucauccccgagaagcuggacagcuucaucaacaaguucgccgaguacacccacgagaagugggccuucgacaagauccagaacaacuggagcuacggcgagaacaucgacgaggagcugaagacccaccccaugcugagacccuacaagaccuucagcgagaaggacaaggagaucuacagauggcccaucaaggagagccugaaggccaugaucgccugggaguggaccaucgagaaggccagagagggcgaggaggagaagaccgagaagaagaagaccagaaagaucagccagagcgcccagaccuacgaccccagagagggcuacaacccccagccccccgaccugagcgccgugacccugagcagagagcugcaggccauggccgagcagcuggccgagaacuaccacaacaccuggggcagaaagaagaagcaggagcuggaggccaagggcggcggcacccacccccugcuggugcccuacgacacccugaccgccaaggagaaggccagagacagagagaaggcccaggagcugcugaaguuccugcagaugaacggcuacgccgugaccagaggccugaaggacauggagcuggacagcagcagcaucgagaagagauucgccuucggcuuccugcagcagcugcugagauggauggacaucagccaggaguucaucgcccaccuggaggccguggugagcagcggcagaguggagaagagcccccacgagcaggagaucaaguucuucgccaagauccugcugccccugaucaaccaguacuucaccaaccacugccuguacuuccugagcacccccgccaaggugcugggcagcggcggccacgccagcaacaaggagaaggagaugaucaccagccuguucugcaagcuggccgcccuggugagacacagagugagccuguucggcaccgacgcccccgccguggugaacugccugcacauccuggccagaagccuggacgccagaaccgugaugaagagcggccccgagaucgugaaggccggccugagaagcuucuucgagagcgccagcgaggacaucgagaagaugguggagaaccugagacugggcaaggugagccaggccagaacccaggugaagggcgugggccagaaccugaccuacaccaccguggcccugcugcccgugcugaccacccuguuccagcacaucgcccagcaccaguucggcgacgacgugauccuggacgacgugcaggugagcugcuacagaacccugugcagcaucuacagccugggcaccaccaagaacaccuacguggagaagcugagacccgcccugggcgagugccuggccagacuggccgccgccaugcccguggccuuccuggagccccagcugaacgaguacaacgccugcagcguguacaccaccaagagccccagagagagagccauccugggccugcccaacagcguggaggagaugugccccgacauccccgugcuggagagacugauggccgacaucggcggccuggccgagagcggcgccagauacaccgagaugccccacgugaucgagaucacccugcccaugcugugcagcuaccugcccagauggugggagagaggccccgaggccccccccagcgcccugcccgccggcgcccccccccccugcaccgccgugaccagcgaccaccugaacagccugcugggcaacauccugagaaucaucgugaacaaccugggcaucgacgaggccagcuggaugaagagacuggccguguucgcccagcccaucgugagcagagccagacccgagcugcugcagagccacuucauccccaccaucggcagacugagaaagagagccggcaagguggugagcgaggaggagcagcugagacuggaggccaaggccgaggcccaggagggcgagcugcuggugagagacgaguucagcgugcugugcagagaccuguacgcccuguacccccugcugaucagauacguggacaacaacagagcccaguggcugaccgagcccaaccccagcgccgaggagcuguucagaauggugggcgagaucuucaucuacuggagcaagagccacaacuucaagagagaggagcagaacuucguggugcagaacgagaucaacaacaugagcuuccugaccgccgacaacaagagcaagauggccaaggccggcgacauccagagcggcggcagcgaccaggagagaaccaagaagaagagaagaggcgacagauacagcgugcagaccagccugaucguggccacccugaagaagaugcugcccaucggccugaacaugugcgcccccaccgaccaggaccugaucacccuggccaagaccagauacgcccugaaggacaccgacgaggaggugagagaguuccugcacaacaaccugcaccugcagggcaagguggagggcagccccagccugagauggcagauggcccuguacagaggcgugcccggcagagaggaggacgccgacgaccccgagaagaucgugagaagagugcaggaggugagcgccgugcuguacuaccuggaccagaccgagcaccccuacaagagcaagaaggccguguggcacaagcugcugagcaagcagagaagaagagccgugguggccugcuucagaaugaccccccuguacaaccugcccacccacagagccugcaacauguuccuggagagcuacaaggccgccuggauccugaccgaggaccacagcuucgaggacagaaugaucgacgaccugagcaaggccggcgagcaggaggaggaggaggaggagguggaggagaagaagcccgacccccugcaccagcuggugcugcacuucagcagaaccgcccugaccgagaagagcaagcuggacgaggacuaccuguacauggccuacgccgacaucauggccaagagcugccaccuggaggagggcggcgagaacggcgaggccgaggaggagguggaggugagcuucgaggagaagcagauggagaagcagagacugcuguaccagcaggccagacugcacaccagaggcgccgccgagauggugcugcagaugaucagcgccugcaagggcgagaccggcgccauggugagcagcacccugaagcugggcaucagcauccugaacggcggcaacgccgaggugcagcagaagaugcuggacuaccugaaggacaagaaggaggugggcuucuuccagagcauccaggcccugaugcagaccugcagcgugcuggaccugaacgccuucgagagacagaacaaggccgagggccugggcauggugaacgaggacggcaccgugaucaacagacagaacggcgagaaggugauggccgacgacgaguucacccaggaccuguucagauuccugcagcugcugugcgagggccacaacaacgacuuccagaacuaccugagaacccagaccggcaacaccaccaccaucaacaucaucaucugcaccguggacuaccugcugagacugcaggagagcaucagcgacuucuacugguacuacagcggcaaggacgugaucgaggagcagggcaagagaaacuucagcaaggccaugagcguggccaagcagguguucaacagccugaccgaguacauccagggccccugcaccggcaaccagcagagccuggcccacagcagacugugggacgccguggugggcuuccugcacguguucgcccacaugaugaugaagcuggcccaggacagcagccagaucgagcugcugaaggagcugcuggaccugcagaaggacaugguggugaugcugcugagccugcuggagggcaacguggugaacggcaugaucgccagacagaugguggacaugcugguggagagcagcagcaacguggagaugauccugaaguucuucgacauguuccugaagcugaaggacaucgugggcagcgaggccuuccaggacuacgugaccgaccccagaggccugaucagcaagaaggacuuccagaaggccauggacagccagaagcaguucagcggccccgagauccaguuccugcugagcugcagcgaggccgacgagaacgagaugaucaacugcgaggaguucgccaacagauuccaggagcccgccagagacaucggcuucaacguggccgugcugcugaccaaccugagcgagcacgugccccacgaccccagacugcacaacuuccuggagcuggccgagagcauccuggaguacuucagacccuaccugggcagaaucgagaucaugggcgccagcagaagaaucgagagaaucuacuucgagaucagcgagaccaacagagcccagugggagaugccccaggugaaggagagcaagagacaguucaucuucgacguggugaacgagggcggcgaggccgagaagauggagcuguucgugagcuucugcgaggacaccaucuucgagaugcagaucgccgcccagaucagcgagcccgagggcgagcccgagaccgacgaggacgagggcgccggcgccgccgaggccggcgccgagggcgccgaggagggcgccgccggccuggagggcaccgccgccaccgccgccgccggcgccaccgccagagugguggccgccgccggcagagcccugagaggccugagcuacagaagccugagaagaagagugagaagacugagaagacugaccgccagagaggccgccaccgccguggccgcccugcugugggccgccgugaccagagccggcgccgccggcgccggcgccgccgccggcgcccugggccugcuguggggcagccuguucggcggcggccugguggagggcgccaagaaggugaccgugaccgagcugcuggccggcaugcccgaccccaccagcgacgaggugcacggcgagcagcccgccggccccggcggcgacgccgacggcgagggcgccagcgagggcgccggcgacgccgccgagggcgccggcgacgaggaggaggccgugcacgaggccggccccggcggcgccgacggcgccguggccgugaccgacggcggccccuucagacccgagggcgccggcggccugggcgacaugggcgacaccacccccgccgagccccccacccccgagggcagccccauccugaagagaaagcugggcguggacggcguggaggaggagcugccccccgagcccgagcccgagcccgagcccgagcuggagcccgagaaggccgacgccgagaacggcgagaaggaggaggugcccgagcccacccccgagccccccaagaagcaggccccccccagccccccccccaagaaggaggaggccggcggcgaguucuggggcgagcuggaggugcagagagugaaguuccugaacuaccugagcagaaacuucuacacccugagauuccuggcccuguuccuggccuucgccaucaacuucauccugcuguucuacaaggugagcgacagcccccccggcgaggacgacauggagggcagcgccgccggcgacgugagcggcgccggcagcggcggcagcagcggcuggggccugggcgccggcgaggaggccgagggcgacgaggacgagaacaugguguacuacuuccuggaggagagcaccggcuacauggagcccgcccugagaugccugagccugcugcacacccugguggccuuccugugcaucaucggcuacaacugccugaaggugccccuggugaucuucaagagagagaaggagcuggccagaaagcuggaguucgacggccuguacaucaccgagcagcccgaggacgacgacgugaagggccagugggacagacuggugcugaacacccccagcuuccccagcaacuacugggacaaguucgugaagagaaaggugcuggacaagcacggcgacaucuacggcagagagagaaucgccgagcugcugggcauggaccuggccacccuggagaucaccgcccacaacgagagaaagcccaaccccccccccggccugcugaccuggcugaugagcaucgacgugaaguaccagaucuggaaguucggcgugaucuucaccgacaacagcuuccuguaccugggcugguacauggugaugagccugcugggccacuacaacaacuucuucuucgccgcccaccugcuggacaucgccaugggcgugaagacccugagaaccauccugagcagcgugacccacaacggcaagcagcuggugaugaccgugggccugcuggccguggugguguaccuguacaccgugguggccuucaacuucuucagaaaguucuacaacaagagcgaggacgaggacgagcccgacaugaagugcgacgacaugaugaccugcuaccuguuccacauguacgugggcgugagagccggcggcggcaucggcgacgagaucgaggaccccgccggcgacgaguacgagcuguacagagugguguucgacaucaccuucuucuucuucgugaucgugauccugcuggccaucauccagggccugaucaucgacgccuucggcgagcugagagaccagcaggagcaggugaaggaggacauggagaccaagugcuucaucugcggcaucggcagcgacuacuucgacaccaccccccacggcuucgagacccacacccuggaggagcacaaccuggccaacuacauguucuuccugauguaccugaucaacaaggacgagaccgagcacaccggccaggagagcuacguguggaagauguaccaggagagaugcugggacuucuuccccgccggcgacugcuucagaaagcaguacgaggaccagcugagcuaa

SEQ ID NO: 22936 - RNA, 14958 nt, Artificial Sequence
  RYR2__Homo_sapiens__XP_006711865
auggccgacggcggcgagggcgaggacgagauccaguuccugagaaccgacgacgagguggugcugcagugcaccgccaccauccacaaggagcagcagaagcugugccuggccgccgagggcuucggcaacagacugugcuuccuggagagcaccagcaacagcaagaacgugccccccgaccugagcaucugcaccuucgugcuggagcagagccugagcgugagagcccugcaggagaugcuggccaacaccguggagaagagcgagggccagguggacguggagaaguggaaguucaugaugaagaccgcccagggcggcggccacagaacccugcuguacggccacgccauccugcugagacacagcuacagcggcauguaccugugcugccugagcaccagcagaagcagcaccgacaagcuggccuucgacgugggccugcaggaggacaccaccggcgaggccugcugguggaccauccaccccgccagcaagcagagaagcgagggcgagaaggugagagugggcgacgaccugauccuggugagcgugagcagcgagagauaccugcaccugagcuacggcaacggcagccugcacguggacgccgccuuccagcagacccuguggagcguggcccccaucagcagcggcagcgaggccgcccagggcuaccugaucggcggcgacgugcugagacugcugcacggccacauggacgagugccugaccgugcccagcggcgagcacggcgaggagcagagaagaaccgugcacuacgagggcggcgccgugagcgugcacgccagaagccuguggagacuggagacccugagaguggccuggagcggcagccacaucagauggggccagcccuucagacugagacacgugaccaccggcaaguaccugagccugauggaggacaagaaccugcugcugauggacaaggagaaggccgacgugaagagcaccgccuucaccuucagaagcagcaaggagaagcuggacgugggcgugagaaaggagguggacggcaugggcaccagcgagaucaaguacggcgacagcgugugcuacauccagcacguggacaccggccuguggcugaccuaccagagcguggacgugaagagcgugagaaugggcagcauccagagaaaggccaucaugcaccacgagggccacauggacgacggcaucagccugagcagaagccagcacgaggagagcagaaccgccagagugaucagaagcaccguguuccuguucaacagauucaucagaggccuggacgcccugagcaagaaggccaaggccagcaccguggaccugcccaucgagagcgugagccugagccugcaggaccugaucggcuacuuccacccccccgacgagcaccuggagcacgaggacaagcagaacagacugagagcccugaagaacagacagaaccuguuccaggaggagggcaugaucaaccuggugcuggagugcaucgacagacugcacguguacagcagcgccgcccacuucgccgacguggccggcagagaggccggcgagagcuggaagagcauccugaacagccuguacgagcugcuggccgcccugaucagaggcaacagaaagaacugcgcccaguucagcggcagccuggacuggcugaucagcagacuggagagacuggaggccagcagcggcauccuggaggugcugcacugcgugcugguggagagccccgaggcccugaacaucaucaaggagggccacaucaagagcaucaucagccugcuggacaagcacggcagaaaccacaaggugcuggacgugcugugcagccugugcgugugccacggcguggccgugagaagcaaccagcaccugaucugcgacaaccugcugcccggcagagaccugcugcugcagaccagacuggugaaccacgugagcagcaugagacccaacaucuuccugggcgugagcgagggcagcgcccaguacaagaagugguacuacgagcugaugguggaccacaccgagcccuucgugaccgccgaggccacccaccugagagugggcugggccagcaccgagggcuacagccccuaccccggcggcggcgaggaguggggcggcaacggcgugggcgacgaccuguucagcuacggcuucgacggccugcaccuguggagcggcugcaucgccagaaccgugagcagccccaaccagcaccugcugagaaccgacgacgugaucagcugcugccuggaccugagcgcccccagcaucagcuucagaaucaacggccagcccgugcagggcauguucgagaacuucaacaucgacggccuguucuuccccguggugagcuucagcgccggcaucaaggugagauuccugcugggcggcagacacggcgaguucaaguuccugcccccccccggcuacgcccccugcuacgaggccgugcugcccaaggagaagcugaagguggagcacagcagagaguacaagcaggagagaaccuacaccagagaccugcugggccccaccgugagccugacccaggccgccuucacccccauccccguggacaccagccagaucgugcugcccccccaccuggagagaaucagagagaagcuggccgagaacauccacgagcugugggugaugaacaagaucgagcugggcuggcaguacggccccgugagagacgacaacaagagacagcaccccugccugguggaguucagcaagcugcccgagcaggagagaaacuacaaccugcagaugagccuggagacccugaagacccugcuggcccugggcugccacgugggcaucagcgacgagcacgccgaggacaaggugaagaagaugaagcugcccaagaacuaccagcugaccagcggcuacaagcccgcccccauggaccugagcuucaucaagcugacccccagccaggaggccaugguggacaagcuggccgagaacgcccacaacgugugggccagagacagaaucagacagggcuggaccuacggcauccagcaggacgugaagaacagaagaaaccccagacuggugcccuacacccugcuggacgacagaaccaagaagagcaacaaggacagccugagagaggccgugagaacccugcugggcuacggcuacaaccuggaggcccccgaccaggaccacgccgccagagccgaggugugcagcggcaccggcgagagauucagaaucuucagagccgagaagaccuacgccgugaaggccggcagaugguacuucgaguucgagaccgugaccgccggcgacaugagagugggcuggagcagacccggcugccagcccgaccaggagcugggcagcgacgagagagccuucgccuucgacggcuucaaggcccagagauggcaccagggcaacgagcacuacggcagaagcuggcaggccggcgacguggugggcugcaugguggacaugaacgagcacaccaugauguucacccugaacggcgagauccugcuggacgacagcggcagcgagcuggccuucaaggacuucgacgugggcgacggcuucauccccgugugcagccugggcguggcccaggugggcagaaugaacuucggcaaggacgugagcacccugaaguacuucaccaucugcggccugcaggagggcuacgagcccuucgccgugaacaccaacagagacaucaccauguggcugagcaagagacugccccaguuccugcaggugcccagcaaccacgagcacaucgaggugaccagaaucgacggcaccaucgacagcagccccugccugaaggugacccagaagagcuucggcagccagaacagcaacaccgacaucauguucuacagacugagcaugcccaucgagugcgccgagguguucagcaagaccguggccggcggccugcccggcgccggccuguucggccccaagaacgaccuggaggacuacgacgccgacagcgacuucgaggugcugaugaagaccgcccacggccaccuggugcccgacagaguggacaaggacaaggaggccaccaagcccgaguucaacaaccacaaggacuacgcccaggagaagcccagcagacugaagcagagauuccugcugagaagaaccaagcccgacuacagcaccagccacagcgccagacugaccgaggacgugcuggccgacgacagagacgacuacgacuuccugaugcagaccagcaccuacuacuacagcgugagaaucuuccccggccaggagcccgccaacgugugggugggcuggaucaccagcgacuuccaccaguacgacaccggcuucgaccuggacagagugagaaccgugaccgugacccugggcgacgagaagggcaaggugcacgagagcuucgccaucgacagccugugcggcuucggcaucaagagaagcaacugcuacauggugugcgccggcgagagcaugagccccggccagggcagaaacaacaacggccuggagaucggcugcgugguggacgccgccagcggccugcugaccuucaucgccaacggcaaggagcugagcaccuacuaccagguggagcccagcaccaagcuguuccccgccguguucgcccaggccaccagccccaacguguuccaguucgagcugggcagaaucaagaacgugaugccccugagcgccggccuguucaagagcgagcacaagaaccccgugccccagugcccccccagacugcacgugcaguuccugagccacgugcuguggagcagaaugcccaaccaguuccugaagguggacgugagcagaaucagcgagagacagggcuggcuggugcagugccuggacccccugcaguucaugagccugcacauccccgaggagaacagaagcguggacauccuggagcugaccgagcaggaggagcugcugaaguuccacuaccacacccugagacuguacagcgccgugugcgcccugggcaaccacagaguggcccacgcccugugcagccacguggacgagccccagcugcuguacgccaucgagaacaaguacaugcccggccugcugagagccggcuacuacgaccugcugaucgacauccaccugagcagcuacgccaccgccagacugaugaugaacaacgaguacaucgugcccaugaccgaggagaccaagagcaucacccuguuccccgacgagaacaagaagcacggccugcccggcaucggccugagcaccagccugagacccagaaugcaguucagcagccccagcuucgugagcaucagcaacgagugcuaccaguacagccccgaguucccccuggacauccugaagagcaagaccauccagaugcugaccgaggccgugaaggagggcagccugcacgccagagaccccgugggcggcaccaccgaguuccuguucgugccccugaucaagcuguucuacacccugcugaucaugggcaucuuccacaacgaggaccugaagcacauccugcagcugaucgagcccagcguguucaaggaggccgccacccccgaggaggagagcgacacccuggagaaggagcugagcguggacgacgccaagcugcagggcgccggcgaggaggaggccaagggcggcaagagacccaaggagggccugcugcagaugaagcugcccgagcccgugaagcugcagaugugccugcugcugcaguaccugugcgacugccaggugagacacagaaucgaggccaucguggccuucagcgacgacuucguggccaagcugcaggacaaccagagauucagauacaacgaggugaugcaggcccugaacaugagcgccgcccugaccgccagaaagaccaaggaguucagaagccccccccaggagcagaucaacaugcugcugaacuucaaggacgacaagagcgagugccccugccccgaggagaucagagaccagcugcuggacuuccacgaggaccugaugacccacugcggcaucgagcuggacgaggacggcagccuggacggcaacagcgaccugaccaucagaggcagacugcugagccugguggagaaggugaccuaccugaagaagaagcaggccgagaagcccguggagagcgacagcaagaagagcagcacccugcagcagcugaucagcgagaccauggugagaugggcccaggagagcgugaucgaggaccccgagcuggugagagccauguucgugcugcugcacagacaguacgacggcaucggcggccuggugagagcccugcccaagaccuacaccaucaacggcgugagcguggaggacaccaucaaccugcuggccagccugggccagaucagaagccugcugagcgugagaaugggcaaggaggaggagaagcugaugaucagaggccugggcgacaucaugaacaacaagguguucuaccagcaccccaaccugaugagagcccugggcaugcacgagaccgugauggaggugauggugaacgugcugggcggcggcgagagcaaggagaucaccuuccccaagaugguggccaacugcugcagauuccugugcuacuucugcagaaucagcagacagaaccagaaggccauguucgaccaccugagcuaccugcuggagaacagcagcgugggccuggccagccccgccaugagaggcagcaccccccuggacguggccgccgccagcgugauggacaacaacgagcuggcccuggcccugagagagcccgaccuggagaagguggugagauaccuggccggcugcggccugcagagcugccagaugcuggugagcaagggcuaccccgacaucggcuggaaccccguggagggcgagagauaccuggacuuccugagauucgccguguucugcaacggcgagagcguggaggagaacgccaacgugguggugagacugcugaucagaagacccgagugcuucggccccgcccugagaggcgagggcggcaacggccugcuggccgccauggaggaggccaucaagaucgccgaggaccccagcagagacggccccagccccaacagcggcagcagcaagacccuggacaccgaggaggaggaggacgacaccauccacaugggcaacgccaucaugaccuucuacagcgcccugaucgaccugcugggcagaugcgcccccgagaugcaccugauccacgccggcaagggcgaggccaucagaaucagaagcauccugagaagccugaucccccugggcgaccuggugggcgugaucagcaucgccuuccagaugcccaccaucgccaaggacggcaacgugguggagcccgacaugagcgccggcuucugccccgaccacaaggccgccauggugcuguuccuggacagaguguacggcaucgaggugcaggacuuccugcugcaccugcuggaggugggcuuccugcccgaccugagagccgccgccagccuggacaccgccgcccugagcgccaccgacauggcccuggcccugaacagauaccugugcaccgccgugcugccccugcugaccagaugcgccccccuguucgccggcaccgagcaccacgccagccugaucgacagccugcugcacaccguguacagacugagcaagggcugcagccugaccaaggcccagagagacagcaucgaggugugccugcugagcaucugcggccagcugagacccagcaugaugcagcaccugcugagaagacugguguucgacgugccccugcugaacgagcacgccaagaugccccugaagcugcugaccaaccacuacgagagaugcuggaaguacuacugccugcccggcggcuggggcaacuucggcgccgccagcgaggaggagcugcaccugagcagaaagcuguucuggggcaucuucgacgcccugagccagaagaaguacgagcaggagcuguucaagcuggcccugcccugccugagcgccguggccggcgcccugccccccgacuacauggagagcaacuacgugagcaugauggagaagcagagcagcauggacagcgagggcaacuucaacccccagcccguggacaccagcaacaucaccauccccgagaagcuggaguacuucaucaacaaguacgccgagcacagccacgacaaguggagcauggacaagcuggccaacggcuggaucuacggcgagaucuacagcgacagcagcaaggugcagccccugaugaagcccuacaagcugcugagcgagaaggagaaggagaucuacagauggcccaucaaggagagccugaagaccaugcuggccuggggcuggagaaucgagagaaccagagagggcgacagcauggcccuguacaacagaaccagaagaaucagccagaccagccaggugagcguggacgccgcccacggcuacagccccagagccaucgacaugagcaacgugacccugagcagagaccugcacgccauggccgagaugauggccgagaacuaccacaacaucugggccaagaagaagaagauggagcuggagagcaagggcggcggcaaccacccccugcuggugcccuacgacacccugaccgccaaggagaaggccaaggacagagagaaggcccaggacauccugaaguuccugcagaucaacggcuacgccgugagcagaggcuucaaggaccuggagcuggacacccccagcaucgagaagagauucgccuacagcuuccugcagcagcugaucagauacguggacgaggcccaccaguacauccuggaguucgacggcggcagcagaggcaagggcgagcacuuccccuacgagcaggagaucaaguucuucgccaagguggugcugccccugaucgaccaguacuucaagaaccacagacuguacuuccugagcgccgccagcagaccccugugcagcggcggccacgccagcaacaaggagaaggagauggugaccagccuguucugcaagcugggcgugcuggugagacacagaaucagccuguucggcaacgacgccaccagcaucgugaacugccugcacauccugggccagacccuggacgccagaaccgugaugaagaccggccuggagagcgugaagagcgcccugagagccuuccuggacaacgccgccgaggaccuggagaagaccauggagaaccugaagcagggccaguucacccacaccagaaaccagcccaagggcgugacccagaucaucaacuacaccaccguggcccugcugcccaugcugagcagccuguucgagcacaucggccagcaccaguucggcgaggaccugauccuggaggacgugcaggugagcugcuacagaauccugaccagccuguacgcccugggcaccagcaagagcaucuacguggagagacagagaagcgcccugggcgagugccuggccgccuucgccggcgccuuccccguggccuuccuggagacccaccuggacaagcacaacaucuacagcaucuacaacaccaagagcagcagagagagagccgcccugagccugcccaccaacguggaggacgugugccccaacauccccagccuggagaagcugauggaggagaucguggagcuggccgagagcggcaucagauacacccagaugccccacgugauggaggugauccugcccaugcugugcagcuacaugagcagauggugggagcacggccccgagaacaaccccgagagagccgagaugugcugcaccgcccugaacagcgagcacaugaacacccugcugggcaacauccugaagaucaucuacaacaaccugggcaucgacgagggcgccuggaugaagagacuggccguguucagccagcccaucaucaacaaggugaagccccagcugcugaagacccacuuccugccccugauggagaagcugaagaagaaggccgccaccguggugagcgaggaggaccaccugaaggccgaggccagaggcgacaugagcgaggccgagcugcugauccuggacgaguucaccacccuggccagagaccuguacgccuucuacccccugcugaucagauucguggacuacaacagagccaaguggcugaaggagcccaaccccgaggccgaggagcuguucagaaugguggccgagguguucaucuacuggagcaagagccacaacuucaagagagaggagcagaacuucguggugcagaacgagaucaacaacaugagcuuccugaucaccgacaccaagagcaagaugagcaaggccgccgugagcgaccaggagagaaagaagaugaagagaaagggcgacagauacagcaugcagaccagccugaucguggccgcccugaagagacugcugcccaucggccugaacaucugcgcccccggcgaccaggagcugaucgcccuggccaagaacagauucagccugaaggacaccgaggacgaggugagagacaucaucagaagcaacauccaccugcagggcaagcuggaggaccccgccaucagauggcagauggcccuguacaaggaccugcccaacagaaccgacgacaccagcgaccccgagaagaccguggagagagugcuggacaucgccaacgugcuguuccaccuggagcagaagagcaagagagugggcagaagacacuacugccugguggagcacccccagagaagcaagaaggccguguggcacaagcugcugagcaagcagagaaagagagccgugguggccugcuucagaauggccccccuguacaaccugcccagacacagagccgugaaccuguuccugcagggcuacgagaagagcuggaucgagaccgaggagcacuacuucgaggacaagcugaucgaggaccuggccaagcccggcgccgagccccccgaggaggacgagggcaccaagagaguggacccccugcaccagcugauccugcuguucagcagaaccgcccugaccgagaagugcaagcuggaggaggacuuccuguacauggccuacgccgacaucauggccaagagcugccacgacgaggaggacgacgacggcgaggaggaggugaagagcuucgaggugaccggcagccagagaagcaaggagaaggagauggagaagcagaagcugcuguaccagcaggccagacugcacgacagaggcgccgccgagauggugcugcagaccaucagcgccagcaagggcgagaccggccccaugguggccgccacccugaagcugggcaucgccauccugaacggcggcaacagcaccgugcagcagaagaugcuggacuaccugaaggagaagaaggacgugggcuucuuccagagccuggccggccugaugcagagcugcagcgugcuggaccugaacgccuucgagagacagaacaaggccgagggccugggcauggugaccgaggagggcagcggcgagaaggugcugcaggacgacgaguucaccugcgaccuguucagauuccugcagcugcugugcgagggccacaacagcgacuuccagaacuaccugagaacccagaccggcaacaacaccaccgugaacaucaucaucagcaccguggacuaccugcugagagugcaggagagcaucagcgacuucuacugguacuacagcggcaaggacgugaucgacgagcagggccagagaaacuucagcaaggccauccagguggccaagcagguguucaacacccugaccgaguacauccagggccccugcaccggcaaccagcagagccuggcccacagcagacugugggacgccguggugggcuuccugcacguguucgcccacaugcagaugaagcugagccaggacagcagccagaucgagcugcugaaggagcugauggaccugcagaaggacaugguggugaugcugcugagcaugcuggagggcaacguggugaacggcaccaucggcaagcagaugguggacaugcugguggagagcagcaacaacguggagaugauccugaaguucuucgacauguuccugaagcugaaggaccugaccagcagcgacaccuucaaggaguacgaccccgacggcaagggcgugaucagcaagagagacuuccacaaggccauggagagccacaagcacuacacccagagcgagaccgaguuccugcugagcugcgccgagaccgacgagaacgagacccuggacuacgaggaguucgugaagagauuccacgagcccgccaaggacaucggcuucaacguggccgugcugcugaccaaccugagcgagcacaugcccaacgacaccagacugcagaccuuccuggagcuggccgagagcgugcugaacuacuuccagcccuuccugggcagaaucgagaucaugggcagcgccaagagaaucgagagaguguacuucgagaucagcgagagcagcagaacccagugggagaagccccaggugaaggagagcaagagacaguucaucuucgacguggugaacgagggcggcgagaaggagaagauggagcuguucgugaacuucugcgaggacaccaucuucgagaugcagcuggccgcccagaucagcgagagcgaccugaacgagagaagcgccaacaaggaggagagcgagaaggagagacccgaggagcagggccccagaauggccuucuucagcauccugaccgugagaagcgcccuguucgcccugagauacaacauccugacccugaugagaaugcugagccugaagagccugaagaagcagaugaagaaggugaagaagaugaccgugaaggacauggugaccgccuucuucagcagcuacuggagcaucuucaugacccugcugcacuucguggccagcguguucagaggcuucuucagaaucaucugcagccugcugcugggcggcagccugguggagggcgccaagaagaucaagguggccgagcugcuggccaacaugcccgaccccacccaggacgaggugagaggcgacggcgaggagggcgagagaaagccccuggaggccgcccugcccagcgaggaccugaccgaccugaaggagcugaccgaggagagcgaccugcugagcgacaucuucggccuggaccugaagagagagggcggccaguacaagcugaucccccacaaccccaacgccggccugagcgaccugaugagcaaccccgugcccaugcccgaggugcaggagaaguuccaggagcagaaggccaaggaggaggagaaggaggagaaggaggagaccaagagcgagcccgagaaggccgagggcgaggacggcgagaaggaggagaaggccaaggaggacaagggcaagcagaagcugagacagcugcacacccacagauacggcgagcccgaggugcccgagagcgccuucuggaagaagaucaucgccuaccagcagaagcugcugaacuacuucgccagaaacuucuacaacaugagaaugcuggcccuguucguggccuucgccaucaacuucauccugcuguucuacaaggugagcaccagcagcgugguggagggcaaggagcugcccaccagaagcagcagcgagaacgccaaggugaccagccuggacagcagcagccacagaaucaucgccgugcacuacgugcuggaggagagcagcggcuacauggagcccacccugagaauccuggccauccugcacaccgugaucagcuucuucugcaucaucggcuacuacugccugaaggugccccuggugaucuucaagagagagaaggagguggccagaaagcuggaguucgacggccuguacaucaccgagcagcccagcgaggacgacaucaagggccagugggacagacuggugaucaacacccagagcuuccccaacaacuacugggacaaguucgugaagagaaaggugauggacaaguacggcgaguucuacggcagagacagaaucagcgagcugcugggcauggacaaggccgcccuggacuucagcgacgccagagagaagaagaagcccaagaaggacagcagccugagcgccgugcugaacagcaucgacgugaaguaccagauguggaagcugggcgugguguucaccgacaacagcuuccuguaccuggccugguacaugaccaugagcgugcugggccacuacaacaacuucuucuucgccgcccaccugcuggacaucgccaugggcuucaagacccugagaaccauccugagcagcgugacccacaacggcaagcagcuggugcugaccgugggccugcuggccguggugguguaccuguacaccgugguggccuucaacuucuucagaaaguucuacaacaagagcgaggacggcgacacccccgacaugaagugcgacgacaugcugaccugcuacauguuccacauguacgugggcgugagagccggcggcggcaucggcgacgagaucgaggaccccgccggcgacgaguacgagaucuacagaaucaucuucgacaucaccuucuucuucuucgugaucgugauccugcuggccaucauccagggccugaucaucgacgccuucggcgagcugagagaccagcaggagcaggugaaggaggacauggagaccaagugcuucaucugcggcaucggcaacgacuacuucgacaccgugccccacggcuucgagacccacacccugcaggagcacaaccuggccaacuaccuguucuuccugauguaccugaucaacaaggacgagaccgagcacaccggccaggagagcuacguguggaagauguaccaggagagaugcugggaguucuuccccgccggcgacugcuucagaaagcaguacgaggaccagcugaacuaa

SEQ ID NO: 22937 - RNA, 14613 nt, Artificial Sequence
  RYR3__Homo_sapiens__NP_001027
auggccgagggcggcgagggcggcgaggacgagauccaguuccugagaaccgaggacgagguggugcugcagugcaucgccaccauccacaaggagcagagaaaguucugccuggccgccgagggccugggcaacagacugugcuuccuggagcccaccagcgaggccaaguacaucccccccgaccugugcgugugcaacuucgugcuggagcagagccugagcgugagagcccugcaggagaugcuggccaacaccggcgagaacggcggcgagggcgccgcccagggcggcggccacagaacccugcuguacggccacgccgugcugcugagacacagcuucagcggcauguaccugaccugccugaccaccagcagaagccagaccgacaagcuggccuucgacgugggccugagagagcacgccaccggcgaggccugcugguggaccauccaccccgccagcaagcagagaagcgagggcgagaaggugagaaucggcgacgaccugauccuggugagcgugagcagcgagagauaccugcaccugagcgugagcaacggcaacauccagguggacgccagcuucaugcagacccuguggaacgugcaccccaccugcagcggcagcagcaucgaggagggcuaccugcugggcggccacguggugagacuguuccacggccacgacgagugccugaccauccccagcaccgaccagaacgacagccagcacagaagaaucuucuacgaggccggcggcgccggcaccagagccagaagccuguggagaguggagccccugagaaucagcuggagcggcagcaacaucagauggggccaggccuucagacugagacaccugaccaccggccacuaccuggcccugaccgaggaccagggccugauccugcaggacagagccaagagcgacaccaagagcaccgccuucagcuucagagccagcaaggagcugaaggagaagcuggacagcagccacaagagagacaucgagggcaugggcgugcccgagaucaaguacggcgacagcgugugcuucgugcagcacaucgccagcggccugugggugaccuacaaggcccaggacgccaagaccagcagacugggcccccugaagagaaaggugauccugcaccaggagggccacauggacgacggccugacccugcagagaugccagagagaggagagccaggccgccagaaucaucagaaacaccaccgcccuguucagccaguucgugagcggcaacaacagaaccgccgcccccaucacccugcccaucgaggaggugcugcagacccugcaggaccugaucgccuacuuccagccccccgaggaggagaugagacacgaggacaagcagaacaagcugagaagccugaagaacagacagaaccuguucaaggaggagggcaugcuggcccuggugcugaacugcaucgacagacugaacguguacaacagcguggcccacuucgccggcaucgccagagaggagagcggcauggccuggaaggagauccugaaccugcuguacaagcugcuggccgcccugaucagaggcaacagaaacaacugcgcccaguucagcaacaaccuggacuggcugaucagcaagcuggacagacuggagagcagcagcggcauccuggaggugcugcacugcauccugaccgagagccccgaggcccugaaccugaucgccgagggccacaucaagagcaucaucagccugcuggacaagcacggcagaaaccacaaggugcuggacauccugugcagccugugccugugcaacggcguggccgugagagccaaccagaaccugaucugcgacaaccugcugcccagaagaaaccugcugcugcagaccagacugaucaacgacgugaccagcaucagacccaacaucuuccugggcguggccgagggcagcgcccaguacaagaagugguacuucgagcugaucaucgaccagguggaccccuuccugaccgccgagcccacccaccugagagugggcugggccagcagcagcggcuacgcccccuaccccggcggcggcgagggcuggggcggcaacggcgugggcgacgaccuguacagcuacggcuucgacggccugcaccuguggagcggcagaauccccagagccguggccagcaucaaccagcaccugcugagaagcgacgacguggugagcugcugccuggaccugggcgugcccagcaucagcuucagaaucaacggccagcccgugcagggcauguucgagaacuucaacaccgacggccuguucuuccccgugaugagcuucagcgccggcgugaaggugagauuccugaugggcggcagacacggcgaguucaaguuccugccccccagcggcuacgcccccugcuacgaggcccugcugcccaaggagaagaugagacuggagcccgugaaggaguacaagagagacgccgacggcaucagagaccugcugggcaccacccaguuccugagccaggccagcuucauccccugccccguggacaccagccaggugauccugcccccccaccuggagaagaucagagacagacuggccgagaacauccacgagcuguggggcaugaacaagaucgagcugggcuggaccuucggcaagaucagagacgacaacaagagacagcaccccugccugguggaguucagcaagcugcccgagaccgagaagaacuacaaccugcagaugagcaccgagacccugaagacccugcuggcccugggcugccacaucgcccacgugaaccccgccgccgaggaggaccugaagaaggugaagcugcccaagaacuacaugaugagcaacggcuacaagcccgccccccuggaccugagcgacgugaagcugcugcccccccaggagauccugguggacaagcuggccgagaacgcccacaacgugugggccaaggacagaaucaagcagggcuggaccuacggcauccagcaggaccugaagaacaagagaaaccccagacuggugcccuacgcccugcuggacgagagaaccaagaagagcaacagagacagccugagagaggccgugagaaccuucgugggcuacggcuacaacaucgagcccagcgaccaggagcuggccgacagcgccguggagaaggugagcaucgacaagaucagauucuucagaguggagagaagcuacgccgugagaagcggcaagugguacuucgaguucgagguggugaccggcggcgacaugagagugggcugggccagacccggcugcagacccgacguggagcugggcgccgacgaccaggccuucguguucgagggcaacagaggccagagauggcaccagggcagcggcuacuucggcagaaccuggcagcccggcgacguggugggcugcaugaucaaccuggacgacgccagcaugaucuucacccugaacggcgagcugcugaucaccaacaagggcagcgagcuggccuucgccgacuacgagaucgagaacggcuucgugcccaucugcugccugggccugagccagaucggcagaaugaaccugggcaccgacgccagcaccuucaaguucuacaccaugugcggccugcaggagggcuucgagcccuucgccgugaacaugaacagagacguggccaugugguucagcaagagacugcccaccuucgugaacgugcccaaggaccacccccacaucgaggugaugagaaucgacggcaccauggacagcccccccugccugaaggugacccacaagaccuucggcacccagaacagcaacgccgacaugaucuacugcagacugagcaugcccguggagugccacagcagcuucagccacagccccugccuggacagcgaggccuuccagaagagaaagcagaugcaggagauccugagccacaccaccacccagugcuacuacgccaucagaaucuucgccggccaggaccccagcugcgugugggugggcugggugacccccgacuaccaccuguacagcgagaaguucgaccugaacaagaacugcaccgugaccgugacccugggcgacgagagaggcagagugcacgagagcgugaagagaagcaacugcuacaugguguggggcggcgacaucguggccagcagccagagaagcaacagaagcaacguggaccuggagaucggcugccugguggaccuggccaugggcaugcugagcuucagcgccaacggcaaggagcugggcaccugcuaccagguggagcccaacaccaagguguuccccgccguguuccugcagcccaccagcaccagccuguuccaguucgagcugggcaagcugaagaacgccaugccccugagcgccgccaucuucagaagcgaggagaagaaccccgugccccagugcccccccagacuggacgugcagaccauccagcccgugcuguggagcagaaugcccaacagcuuccugaagguggagaccgagagagugagcgagagacacggcuggguggugcagugccuggagccccugcagaugauggcccugcacauccccgaggagaacagaugcguggacauccuggagcugugcgagcaggaggaccugaugagauuccacuaccacacccugagacuguacagcgccgugugcgcccugggcaacagcagaguggccuacgcccugugcagccacguggaccugagccagcuguucuacgccaucgacaacaaguaccugcccggccugcugagaagcggcuucuacgaccugcugaucagcauccaccuggccagcgccaaggagagaaagcugaugaugaagaacgaguacaucauccccaucaccagcaccaccagaaacaucagacuguuccccgacgagagcaagagacacggccugcccggcgugggccugagaaccugccugaagcccggcuucagauucagcacccccugcuucguggugaccggcgaggaccaccagaagcagagccccgagaucccccuggagagccugagaaccaaggcccugagcaugcugaccgaggccgugcagugcagcggcgcccacaucagagaccccgugggcggcagcguggaguuccaguucgugcccgugcugaagcugaucggcacccugcuggugaugggcguguucgacgacgacgacgugagacagauccugcugcugaucgaccccagcguguucggcgagcacagcgccggcaccgaggagggcgccgagaaggaggaggugacccagguggaggagaaggccguggaggccggcgagaaggccggcaaggaggcccccgugaagggccugcugcagaccagacugcccgagagcgugaagcugcagaugugcgagcugcugagcuaccugugcgacugcgagcugcagcacagaguggaggccaucguggccuucggcgacaucuacgugagcaagcugcaggccaaccagaaguucagauacaacgagcugaugcaggcccugaacaugagcgccgcccugaccgccagaaagaccaaggaguucagaagccccccccaggagcagaucaacaugcugcugaacuuccagcugggcgagaacugccccugccccgaggagaucagagaggagcuguacgacuuccacgaggaccugcugcugcacugcggcgugccccuggaggaggaggaggaggaggaggaggacaccagcuggaccggcaagcugugcgcccugguguacaagaucaagggcccccccaagcccgagaaggagcagcccaccgaggaggaggagagaugccccaccacccugaaggagcugaucagccagaccaugaucugcugggcccaggaggaccagauccaggacagcgagcuggugagaaugauguucaaccugcugagaagacaguacgacagcaucggcgagcugcugcaggcccugagaaagaccuacaccaucagccacaccagcgugagcgacaccaucaaccugcuggccgcccugggccagaucagaagccugcugagcgugagaaugggcaaggaggaggagcugcugaugaucaacggccugggcgacaucaugaacaacaagguguucuaccagcaccccaaccugaugagagugcugggcaugcacgagaccgugauggaggugauggugaacgugcugggcaccgagaagagccagaucgccuuccccaagaugguggccagcugcugcagauuccugugcuacuucugcagaaucagcagacagaaccagaaggccauguucgagcaccugagcuaccugcuggagaacagcagcgugggccuggccagccccagcaugagaggcagcaccccccuggacguggccgccagcagcgugauggacaacaacgagcuggcccugagccuggaggagcccgaccuggagaagguggugaccuaccuggccggcugcggccugcagagcugccccaugcugcuggccaagggcuaccccgacgugggcuggaaccccaucgagggcgagagauaccugagcuuccugagauucgccguguucgugaacagcgagagcguggaggagaacgccagcgugguggugaagcugcugaucagaagacccgagugcuucggccccgcccugagaggcgagggcggcaacggccugcuggccgccaugcagggcgccaucaagaucagcgagaaccccgcccuggaccugcccagccagggcuacaagagagaggugagcaccggcgacgacgaggaggaggaggagaucgugcacaugggcaacgccaucaugagcuucuacagcgcccugaucgaccugcugggcagaugcgcccccgagaugcaccugauccagaccggcaagggcgaggccaucagaaucagaagcauccugagaagccuggugcccaccgaggaccuggugggcaucaucagcaucccccugaagcugcccagccugaacaaggacggcagcgugagcgagcccgacauggccgccaacuucugccccgaccacaaggcccccauggugcuguuccuggacagaguguacggcaucaaggaccagaccuuccugcugcaccugcuggaggugggcuuccugcccgaccugagagccagcgccagccuggacaccgugagccugagcaccaccgaggccgcccuggcccugaacagauacaucugcagcgccgugcugccccugcugaccagaugcgccccccuguucgccggcaccgagcacugcaccagccugaucgacagcacccugcagaccaucuacagacugagcaagggcagaagccugaccaaggcccagagagacaccaucgaggagugccugcuggccaucugcaaccaccugagacccagcaugcugcagcagcugcugagaagacugguguucgacgugccccagcugaacgaguacugcaagaugccccugaagcugcugaccaaccacuacgagcagugcuggaaguacuacugccugcccagcggcuggggcagcuacggccuggccguggaggaggagcugcaccugaccgagaagcuguucuggggcaucuucgacagccugagccacaagaaguacgaccccgaccuguucagaauggcccugcccugccugagcgccaucgccggcgcccugccccccgacuaccuggacaccagaaucaccgccacccuggagaagcagaucagcguggacgccgacggcaacuucgaccccaagcccaucaacaccaugaacuucagccugcccgagaagcuggaguacaucgugaccaaguacgccgagcacagccacgacaagugggccugcgacaagagccagagcggcuggaaguacggcaucagccuggacgagaacgugaagacccacccccugaucagacccuucaagacccugaccgagaaggagaaggagaucuacagauggcccgccagagagagccugaagaccaugcuggccgugggcuggaccguggagagaaccaaggagggcgaggcccuggugcagcagagagagaacgagaagcugagaagcgugagccaggccaaccagggcaacagcuacagccccgccccccuggaccugagcaacguggugcugagcagagagcugcagggcaugguggaggugguggccgagaacuaccacaacaucugggccaagaagaagaagcuggagcuggagagcaagggcggcggcagccacccccugcuggugcccuacgacacccugaccgccaaggagaaguucaaggacagagagaaggcccaggaccuguucaaguuccugcaggugaacggcaucaucgugagcagaggcaugaaggacauggagcuggacgccagcagcauggagaagagauucgccuacaaguuccugaagaagauccugaaguacguggacagcgcccaggaguucaucgcccaccuggaggccaucgugagcagcggcaagaccgagaagagccccagagaccaggagaucaaguucuucgccaaggugcugcugccccugguggaccaguacuucaccagccacugccuguacuuccugagcagcccccugaagccccugagcagcagcggcuacgccagccacaaggagaaggagaugguggccggccuguucugcaagcuggccgcccuggugagacacagaaucagccuguucggcagcgacagcaccaccauggugagcugccugcacauccuggcccagacccuggacaccagaaccgugaugaagagcggcagcgagcuggugaaggccggccugagagccuucuucgagaacgccgccgaggaccuggagaagaccagcgagaaccugaagcugggcaaguucacccacagcagaacccagaucaagggcgugagccagaacaucaacuacaccaccguggcccugcugcccauccugaccagcaucuucgagcacgugacccagcaccaguucggcauggaccugcugcugggcgacgugcagaucagcugcuaccacauccugugcagccuguacagccugggcaccggcaagaacaucuacguggagagacagagacccgcccugggcgagugccuggccagccuggccgccgccauccccguggccuuccuggagcccacccugaacagauacaacccccugagcguguucaacaccaagacccccagagagagaagcauccugggcaugcccgacaccguggaggacaugugccccgacaucccccagcuggagggccugaugaaggagaucaacgaccuggccgagagcggcgccagauacaccgagaugccccacgugaucgaggugauccugcccaugcugugcaacuaccugagcuacuggugggagagaggccccgagaaccugccccccagcaccggccccugcugcaccaaggugaccagcgagcaccugagccugauccugggcaacauccugaagaucaucaacaacaaccugggcaucgacgaggccagcuggaugaagagaaucgccguguacgcccagcccaucaucagcaaggccagacccgaccugcugagaagccacuucauccccacccuggagaagcugaagaagaaggccgugaagaccgugcaggaggaggagcagcugaaggccgacggcaagggcgacacccaggaggccgagcugcugauccuggacgaguucgccgugcugugcagagaccuguacgccuucuaccccaugcugaucagauacguggacaacaacagaagcaacuggcugaagagccccgacgccgacagcgaccagcuguucagaaugguggccgagguguucauccuguggugcaagagccacaacuucaagagagaggagcagaacuucgugauccagaacgagaucaacaaccuggccuuccugaccggcgacagcaagagcaagaugagcaaggccaugcaggugaagagcggcggccaggaccaggagagaaagaagaccaagagaagaggcgaccuguacagcauccagaccagccugaucguggccgcccugaagaagaugcugcccaucggccugaacaugugcacccccggcgaccaggagcugaucagccuggccaagagcagauacagccacagagacaccgacgaggaggugagagagcaccugagaaacaaccugcaccugcaggagaagagcgacgaccccgccgugaaguggcagcugaaccuguacaaggacgugcugaagagcgaggagcccuucaaccccgagaagaccguggagagagugcagagaaucagcgccgccguguuccaccuggagcagguggagcagccccugagaagcaagaaggccguguggcacaagcugcugagcaagcagagaaagagagccgugguggccugcuucagaauggccccccuguacaaccugcccagacacagaagcaucaaccuguuccugcacggcuaccagagauucuggaucgagaccgaggaguacagcuucgaggagaagcuggugcaggaccuggccaagagccccaagguggaggaggaggaggaggaggagaccgagaagcagcccgacccccugcaccagaucauccuguacuucagcagaaacgcccugaccgagagaagcaagcuggaggacgacccccuguacaccagcuacagcagcaugauggccaagagcugccagagcggcgaggacgaggaggaggacgaggacaaggagaagaccuucgaggagaaggagauggagaagcagaagacccuguaccagcaggccagacugcacgagagaggcgccgccgagauggugcugcagaugaucagcgccagcaagggcgagaugagccccauggugguggagacccugaagcugggcaucgccauccugaacggcggcaacgccggcgugcagcagaagaugcuggacuaccugaaggagaagaaggacgccggcuucuuccagagccugagcggccugaugcagagcugcagcgugcuggaccugaacgccuucgagagacagaacaaggccgagggccugggcauggugaccgaggagggcacccugaucgugagagagagaggcgagaaggugcugcagaacgacgaguucaccagagaccuguucagauuccugcagcugcugugcgagggccacaacagcgacuuccagaacuuccugagaacccagaugggcaacaccaccaccgugaacgugaucaucagcaccguggacuaccugcugagacugcaggagagcaucagcgacuucuacugguacuacagcggcaaggacaucaucgacgagagcggccagcacaacuucagcaaggcccuggccgugaccaagcagaucuucaacagccugaccgaguacauccagggccccugcaucggcaaccagcagagccuggcccacagcagacugugggacgccguggugggcuuccugcacguguucgccaacaugcagaugaagcugagccaggacagcagccagaucgagcugcugaaggagcugcuggaccugcugcaggacaugguggugaugcugcugagccugcuggagggcaacguggugaacggcaccaucggcaagcagaugguggacacccugguggagagcagcaccaacguggagaugauccugaaguucuucgacauguuccugaagcugaaggaccugaccagcagcgacaccuucaaggaguacgaccccgacggcaagggcaucaucagcaagaaggaguuccagaaggccauggagggccagaagcaguacacccagagcgagaucgacuuccugcugagcugcgccgaggccgacgagaacgacauguucaacuacguggacuucguggacagauuccacgagcccgccaaggacaucggcuucaacguggccgugcugcugaccaaccugagcgagcacaugcccaacgacagcagacugaagugccugcuggaccccgccgagagcgugcugaacuacuucgagcccuaccugggcagaaucgagaucaugggcggcgccaagaagaucgagagaguguacuucgagaucagcgagagcagcagaacccagugggagaagccccaggugaaggagagcaagagacaguucaucuucgacguggugaacgagggcggcgagcaggagaagauggagcuguucgugaacuucugcgaggacaccaucuucgagaugcagcuggccagccagaucagcgagagcgacagcgccgacagacccgaggaggaggaggaggacgaggacagcagcuacgugcuggagaucgccggcgaggaggaggaggacggcagccuggagcccgccagcgccuucgccauggccugcgccagcgugaagagaaacgugaccgacuuccugaagagagccacccugaagaaccugagaaagcaguacagaaacgugaagaagaugaccgccaaggagcuggugaaggugcuguucagcuucuucuggaugcuguucgugggccuguuccagcugcuguucaccauccugggcggcaucuuccagauccuguggagcaccguguucggcggcggccugguggagggcgccaagaacaucagagugaccaagauccugggcgacaugcccgaccccacccaguucggcauccacgacgacaccauggaggccgagagagccgaggugauggagcccggcaucaccaccgagcuggugcacuucaucaagggcgagaagggcgacaccgacaucaugagcgaccuguucggccugcaccccaagaaggagggcagccugaagcacggccccgaggugggccugggcgaccugagcgagaucaucggcaaggacgagccccccacccuggagagcaccgugcagaagaagagaaaggcccaggccgccgagaugaaggccgccaacgaggccgagggcaagguggagagcgagaaggccgacauggaggacggcgagaaggaggacaaggacaaggaggaggagcaggccgaguaccuguggaccgaggugaccaagaagaagaagagaagaugcggccagaagguggagaagcccgaggccuucaccgccaacuucuucaagggccuggagaucuaccagaccaagcugcugcacuaccuggccagaaacuucuacaaccugagauuccuggcccuguucguggccuucgccaucaacuucauccugcuguucuacaaggugaccgaggagccccuggaggaggagaccgaggacguggccaaccuguggaacagcuucaacgacgaggaggaggaggaggccaugguguucuucgugcugcaggagagcaccggcuacauggcccccacccugagagcccuggccaucauccacaccaucaucagccuggugugcguggugggcuacuacugccugaaggugccccuggugguguucaagagagagaaggagaucgccagaaagcuggaguucgacggccuguacaucaccgagcagcccagcgaggacgacaucaagggccagugggacagacuggugaucaacacccccagcuuccccaacaacuacugggacaaguucgugaagagaaaggugaucaacaaguacggcgaccuguacggcgccgagagaaucgccgagcugcugggccuggacaagaacgcccuggacuucagccccguggaggagaccaaggccgaggccgccagccuggugagcuggcugagcagcaucgacaugaaguaccacaucuggaagcugggcgugguguucaccgacaacagcuuccuguaccuggccugguacaccaccaugagcgugcugggccacuacaacaacuucuucuucgccgcccaccugcuggacaucgccaugggcuucaagacccugagaaccauccugagcagcgugacccacaacggcaagcagcuggugcugaccgugggccugcuggccguggugguguaccuguacaccgugguggccuucaacuucuucagaaaguucuacaacaagagcgaggacgacgacgagcccgacaugaagugcgacgacaugaugaccugcuaccuguuccacauguacgugggcgugagagccggcggcggcaucggcgacgagaucgaggaccccgccggcgaccccuacgagauguacagaaucguguucgacaucaccuucuucuucuucgugaucgugauccugcuggccaucauccagggccugaucaucgacgccuucggcgagcugagagaccagcaggagcaggugagagaggacauggagaccaagugcuucaucugcggcaucggcaacgacuacuucgacaccaccccccacggcuucgagacccacacccugcaggagcacaaccuggccaacuaccuguucuuccugauguaccugaucaacaaggacgagaccgagcacaccggccaggagagcuacguguggaagauguaccaggagagaugcugggacuucuuccccgccggcgacugcuucagaaagcaguacgaggaccagcugggcuaa

SEQ ID NO: 22938 - RNA, 294 nt, Artificial Sequence
  S100A10__Homo_sapiens__NP_002957
augcccagccagauggagcacgccauggagaccaugauguucaccuuccacaaguucgccggcgacaagggcuaccugaccaaggaggaccugagagugcugauggagaaggaguuccccggcuuccuggagaaccagaaggacccccuggccguggacaagaucaugaaggaccuggaccagugcagagacggcaaggugggcuuccagagcuucuucagccugaucgccggccugaccaucgccugcaacgacuacuucguggugcacaugaagcagaagggcaagaaguaa

SEQ ID NO: 22939 - RNA, 318 nt, Artificial Sequence
  S100A11__Homo_sapiens__NP_005611
auggccaagaucagcagccccaccgagaccgagagaugcaucgagagccugaucgccguguuccagaaguacgccggcaaggacggcuacaacuacacccugagcaagaccgaguuccugagcuucaugaacaccgagcuggccgccuucaccaagaaccagaaggaccccggcgugcuggacagaaugaugaagaagcuggacaccaacagcgacggccagcuggacuucagcgaguuccugaaccugaucggcggccuggccauggccugccacgacagcuuccugaaggccgugcccagccagaagagaaccuaa

SEQ ID NO: 22940 - RNA, 279 nt, Artificial Sequence
  S100A12__Homo_sapiens__NP_005612
augaccaagcuggaggagcaccuggagggcaucgugaacaucuuccaccaguacagcgugagaaagggccacuucgacacccugagcaagggcgagcugaagcagcugcugaccaaggagcuggccaacaccaucaagaacaucaaggacaaggccgugaucgacgagaucuuccagggccuggacgccaaccaggacgagcagguggacuuccaggaguucaucagccugguggccaucgcccugaaggccgcccacuaccacacccacaaggaguaa

SEQ ID NO: 22941 - RNA, 297 nt, Artificial Sequence
  S100A13__Homo_sapiens__XP_011508166
auggccgccgagccccugaccgagcuggaggagagcaucgagaccguggugaccaccuucuucaccuucgccagacaggagggcagaaaggacagccugagcgugaacgaguucaaggagcuggugacccagcagcugccccaccugcugaaggacgugggcagccuggacgagaagaugaagagccuggacgugaaccaggacagcgagcugaaguucaacgaguacuggagacugaucggcgagcuggccaaggagaucagaaagaagaaggaccugaagaucagaaagaaguaa

SEQ ID NO: 22942 - RNA, 315 nt, Artificial Sequence
  S100A14__Homo_sapiens__XP_005245419
augggccagugcagaagcgccaacgccgaggacgcccaggaguucagcgacguggagagagccaucgagacccugaucaagaacuuccaccaguacagcguggagggcggcaaggagacccugacccccagcgagcugagagaccuggugacccagcagcugccccaccugaugcccagcaacugcggccuggaggagaagaucgccaaccugggcagcugcaacgacagcaagcuggaguucagaagcuucugggagcugaucggcgaggccgccaagagcgugaagcuggagagacccgugagaggccacuaa

SEQ ID NO: 22943 - RNA, 312 nt, Artificial Sequence
  S100A16__Homo_sapiens__NP_525127
augagcgacugcuacaccgagcuggagaaggccgugaucgugcugguggagaacuucuacaaguacgugagcaaguacagccuggugaagaacaagaucagcaagagcagcuucagagagaugcugcagaaggagcugaaccacaugcugagcgacaccggcaacagaaaggccgccgacaagcugauccagaaccuggacgccaaccacgacggcagaaucagcuucgacgaguacuggacccugaucggcggcaucaccggccccaucgccaagcugauccacgagcaggagcagcagagcagcagcuaa

SEQ ID NO: 22944 - RNA, 285 nt, Artificial Sequence
  S100A1__Homo_sapiens__NP_006262
augggcagcgagcuggagaccgccauggagacccugaucaacguguuccacgcccacagcggcaaggagggcgacaaguacaagcugagcaagaaggagcugaaggagcugcugcagaccgagcugagcggcuuccuggacgcccagaaggacguggacgccguggacaaggugaugaaggagcuggacgagaacggcgacggcgagguggacuuccaggaguacguggugcugguggccgcccugaccguggccugcaacaacuucuucugggagaacagcuaa

SEQ ID NO: 22945 - RNA, 294 nt, Artificial Sequence
  S100A2__Homo_sapiens__NP_005969
augugcagcagccuggagcaggcccuggccgugcuggugaccaccuuccacaaguacagcugccaggagggcgacaaguucaagcugagcaagggcgagaugaaggagcugcugcacaaggagcugcccagcuucgugggcgagaagguggacgaggagggccugaagaagcugaugggcagccuggacgagaacagcgaccagcagguggacuuccaggaguacgccguguuccuggcccugaucaccgugaugugcaacgacuucuuccagggcugccccgacagacccuaa

SEQ ID NO: 22946 - RNA, 306 nt, Artificial Sequence
  S100A3__Homo_sapiens__NP_002951
auggccagaccccuggagcaggccguggccgccaucgugugcaccuuccaggaguacgccggcagaugcggcgacaaguacaagcugugccaggccgagcugaaggagcugcugcagaaggagcuggccaccuggacccccaccgaguucagagagugcgacuacaacaaguucaugagcgugcuggacaccaacaaggacugcgagguggacuucguggaguacgugagaagccuggccugccugugccuguacugccacgaguacuucaaggacugccccagcgagccccccugcagccaguaa

SEQ ID NO: 22947 - RNA, 306 nt, Artificial Sequence
  S100A4__Homo_sapiens__NP_002952
auggccugcccccuggagaaggcccuggacgugauggugagcaccuuccacaaguacagcggcaaggagggcgacaaguucaagcugaacaagagcgagcugaaggagcugcugaccagagagcugcccagcuuccugggcaagagaaccgacgaggccgccuuccagaagcugaugagcaaccuggacagcaacagagacaacgagguggacuuccaggaguacugcguguuccugagcugcaucgccaugaugugcaacgaguucuucgagggcuuccccgacaagcagcccagaaagaaguaa

SEQ ID NO: 22948 - RNA, 279 nt, Artificial Sequence
  S100A5__Homo_sapiens__NP_002953
auggagaccccccuggagaaggcccugaccaccauggugaccaccuuccacaaguacagcggcagagagggcagcaagcugacccugagcagaaaggagcugaaggagcugaucaagaaggagcugugccugggcgagaugaaggagagcagcaucgacgaccugaugaagagccuggacaagaacagcgaccaggagaucgacuucaaggaguacagcguguuccugaccaugcugugcauggccuacaacgacuucuuccuggaggacaacaaguaa

SEQ ID NO: 22949 - RNA, 273 nt, Artificial Sequence
  S100A6__Homo_sapiens__NP_055439
auggccugcccccuggaccaggccaucggccugcugguggccaucuuccacaaguacagcggcagagagggcgacaagcacacccugagcaagaaggagcugaaggagcugauccagaaggagcugaccaucggcagcaagcugcaggacgccgagaucgccagacugauggaggaccuggacagaaacaaggaccaggaggugaacuuccaggaguacgugaccuuccugggcgcccuggcccugaucuacaacgaggcccugaagggcuaa

SEQ ID NO: 22950 - RNA, 306 nt, Artificial Sequence
  S100A7A__Homo_sapiens__NP_789793
augagcaacacccaggccgagagaagcaucaucggcaugaucgacauguuccacaaguacaccggcagagacggcaagaucgagaagcccagccugcugaccaugaugaaggagaacuuccccaacuuccugagcgccugcgacaagaagggcauccacuaccuggccaccguguucgagaagaaggacaagaacgaggacaagaagaucgacuucagcgaguuccugagccugcugggcgacaucgccgccgacuaccacaagcagagccacggcgccgcccccugcagcggcggcagccaguaa

SEQ ID NO: 22951 - RNA, 306 nt, Artificial Sequence
  S100A7__Homo_sapiens__NP_002954
augagcaacacccaggccgagagaagcaucaucggcaugaucgacauguuccacaaguacaccagaagagacgacaagaucgagaagcccagccugcugaccaugaugaaggagaacuuccccaacuuccugagcgccugcgacaagaagggcaccaacuaccuggccgacguguucgagaagaaggacaagaacgaggacaagaagaucgacuucagcgaguuccugagccugcugggcgacaucgccaccgacuaccacaagcagagccacggcgccgcccccugcagcggcggcagccaguaa

SEQ ID NO: 22952 - RNA, 282 nt, Artificial Sequence
  S100A8__Homo_sapiens__NP_002955
augcugaccgagcuggagaaggcccugaacagcaucaucgacguguaccacaaguacagccugaucaagggcaacuuccacgccguguacagagacgaccugaagaagcugcuggagaccgagugcccccaguacaucagaaagaagggcgccgacgugugguucaaggagcuggacaucaacaccgacggcgccgugaacuuccaggaguuccugauccuggugaucaagaugggcguggccgcccacaagaagagccacgaggagagccacaaggaguaa

SEQ ID NO: 22953 - RNA, 345 nt, Artificial Sequence
  S100A9__Homo_sapiens__NP_002956
augaccugcaagaugagccagcuggagagaaacaucgagaccaucaucaacaccuuccaccaguacagcgugaagcugggccaccccgacacccugaaccagggcgaguucaaggagcuggugagaaaggaccugcagaacuuccugaagaaggagaacaagaacgagaaggugaucgagcacaucauggaggaccuggacaccaacgccgacaagcagcugagcuucgaggaguucaucaugcugauggccagacugaccugggccagccacgagaagaugcacgagggcgacgagggccccggccaccaccacaagcccggccugggcgagggcacccccuaa

SEQ ID NO: 22954 - RNA, 279 nt, Artificial Sequence
  S100B__Homo_sapiens__NP_006263
augagcgagcuggagaaggccaugguggcccugaucgacguguuccaccaguacagcggcagagagggcgacaagcacaagcugaagaagagcgagcugaaggagcugaucaacaacgagcugagccacuuccuggaggagaucaaggagcaggaggugguggacaaggugauggagacccuggacaacgacggcgacggcgagugcgacuuccaggaguucauggccuucguggccauggugaccaccgccugccacgaguucuucgagcacgaguaa

SEQ ID NO: 22955 - RNA, 288 nt, Artificial Sequence
  S100P__Homo_sapiens__NP_005971
augaccgagcuggagaccgccaugggcaugaucaucgacguguucagcagauacagcggcagcgagggcagcacccagacccugaccaagggcgagcugaaggugcugauggagaaggagcugcccggcuuccugcagagcggcaaggacaaggacgccguggacaagcugcugaaggaccuggacgccaacggcgacgcccagguggacuucagcgaguucaucguguucguggccgccaucaccagcgccugccacaaguacuucgagaaggccggccugaaguaa

SEQ ID NO: 22956 - RNA, 300 nt, Artificial Sequence
  S100Z__Homo_sapiens__NP_570128
augcccacccagcuggagauggccauggacaccaugaucagaaucuuccacagauacagcggcaaggagagaaagagauucaagcugagcaagggcgagcugaagcugcugcugcagagagagcugaccgaguuccugagcugccagaaggagacccagcugguggacaagaucgugcaggaccuggacgccaacaaggacaacgagguggacuucaacgaguucguggugaugguggccgcccugaccguggccugcaacgacuacuucguggagcagcugaagaagaagggcaaguaa

SEQ ID NO: 22957 - RNA, 1062 nt, Artificial Sequence
  S1PR2__Homo_sapiens__NP_004221
augggcagccuguacagcgaguaccugaaccccaacaaggugcaggagcacuacaacuacaccaaggagacccuggagacccaggagaccaccagcagacagguggccagcgccuucaucgugauccugugcugcgccaucgugguggagaaccugcuggugcugaucgccguggccagaaacagcaaguuccacagcgccauguaccuguuccugggcaaccuggccgccagcgaccugcuggccggcguggccuucguggccaacacccugcugagcggcagcgugacccugagacugacccccgugcagugguucgccagagagggcagcgccuucaucacccugagcgccagcguguucagccugcuggccaucgccaucgagagacacguggccaucgccaaggugaagcuguacggcagcgacaagagcugcagaaugcugcugcugaucggcgccagcuggcugaucagccuggugcugggcggccugcccauccugggcuggaacugccugggccaccuggaggccugcagcaccgugcugccccuguacgccaagcacuacgugcugugcguggugaccaucuucagcaucauccugcuggccaucguggcccuguacgugagaaucuacugcguggugagaagcagccacgccgacauggccgccccccagacccuggcccugcugaagaccgugaccaucgugcugggcguguucaucgugugcuggcugcccgccuucagcauccugcugcuggacuacgccugccccgugcacagcugccccauccuguacaaggcccacuacuucuucgccgugagcacccugaacagccugcugaaccccgugaucuacaccuggagaagcagagaccugagaagagaggugcugagaccccugcagugcuggagacccggcgugggcgugcagggcagaagaagaggcggcacccccggccaccaccugcugccccugagaagcagcagcagccuggagagaggcaugcacaugcccaccagccccaccuuccuggagggcaacaccgugguguaa

SEQ ID NO: 22958 - RNA, 1137 nt, Artificial Sequence
  S1PR3__Homo_sapiens__NP_005217
auggccaccgcccugccccccagacugcagcccgugagaggcaacgagacccugagagagcacuaccaguacgugggcaagcuggccggcagacugaaggaggccagcgagggcagcacccugaccaccgugcuguuccuggugaucugcagcuucaucgugcuggagaaccugauggugcugaucgccaucuggaagaacaacaaguuccacaacagaauguacuucuucaucggcaaccuggcccugugcgaccugcuggccggcaucgccuacaaggugaacauccugaugagcggcaagaagaccuucagccugagccccaccgugugguuccugagagagggcagcauguucguggcccugggcgccagcaccugcagccugcuggccaucgccaucgagagacaccugaccaugaucaagaugagacccuacgacgccaacaagagacacagaguguuccugcugaucggcaugugcuggcugaucgccuucacccugggcgcccugcccauccugggcuggaacugccugcacaaccugcccgacugcagcaccauccugccccuguacagcaagaaguacaucgccuucugcaucagcaucuucaccgccauccuggugaccaucgugauccuguacgccagaaucuacuuccuggugaagagcagcagcagaaagguggccaaccacaacaacagcgagagaagcauggcccugcugagaaccguggugaucguggugagcguguucaucgccugcuggagcccccuguucauccuguuccugaucgacguggccugcagagugcaggccugccccauccuguucaaggcccagugguucaucgugcuggccgugcugaacagcgccaugaaccccgugaucuacacccuggccagcaaggagaugagaagagccuucuucagacuggugugcaacugccuggugagaggcagaggcgccagagccagccccauccagcccgcccuggaccccagcagaagcaagagcagcagcagcaacaacagcagccacagccccaaggugaaggaggaccugccccacaccgcccccagcagcugcaucauggacaagaacgccgcccugcagaacggcaucuucugcaacuaa

SEQ ID NO: 22959 - RNA, 1155 nt, Artificial Sequence
  S1PR4__Homo_sapiens__NP_003766
augaacgccaccggcacccccguggcccccgagagcugccagcagcuggccgccggcggccacagcagacugaucgugcugcacuacaaccacagcggcagacuggccggcagaggcggccccgaggacggcggccugggcgcccugagaggccugagcguggccgccagcugccugguggugcuggagaaccugcuggugcuggccgccaucaccagccacaugagaagcagaagauggguguacuacugccuggugaacaucacccugagcgaccugcugaccggcgccgccuaccuggccaacgugcugcugagcggcgccagaaccuucagacuggcccccgcccagugguuccugagagagggccugcuguucaccgcccuggccgccagcaccuucagccugcuguucaccgccggcgagagauucgccaccauggugagacccguggccgagagcggcgccaccaagaccagcagaguguacggcuucaucggccugugcuggcugcuggccgcccugcugggcaugcugccccugcugggcuggaacugccugugcgccuucgacagaugcagcagccugcugccccuguacagcaagagauacauccuguucugccuggugaucuucgccggcgugcuggccaccaucaugggccuguacggcgccaucuucagacuggugcaggccagcggccagaaggcccccagacccgccgccagaagaaaggccagaagacugcugaagaccgugcugaugauccugcuggccuuccuggugugcuggggcccccuguucggccugcugcuggccgacguguucggcagcaaccugugggcccaggaguaccugagaggcauggacuggauccuggcccuggccgugcugaacagcgccgugaaccccaucaucuacagcuucagaagcagagaggugugcagagccgugcugagcuuccugugcugcggcugccugagacugggcaugagaggccccggcgacugccuggccagagccguggaggcccacagcggcgccagcaccaccgacagcagccugagacccagagacagcuucagaggcagcagaagccugagcuucagaaugagagagccccugagcagcaucagcagcgugagaagcaucuaa

SEQ ID NO: 22960 - RNA, 1197 nt, Artificial Sequence
  S1PR5__Homo_sapiens__NP_001159687
auggagagcggccugcugagacccgcccccgugagcgaggugaucgugcugcacuacaacuacaccggcaagcugagaggcgccagauaccagcccggcgccggccugagagccgacgccguggugugccuggccgugugcgccuucaucgugcuggagaaccuggccgugcugcuggugcugggcagacaccccagauuccacgcccccauguuccugcugcugggcagccugacccugagcgaccugcuggccggcgccgccuacgccgccaacauccugcugagcggcccccugacccugaagcugagccccgcccugugguucgccagagagggcggcguguucguggcccugaccgccagcgugcugagccugcuggccaucgcccuggagagaagccugaccauggccagaagaggccccgcccccgugagcagcagaggcagaacccuggccauggccgccgccgccuggggcgugagccugcugcugggccugcugcccgcccugggcuggaacugccugggcagacuggacgccugcagcaccgugcugccccuguacgccaaggccuacgugcuguucugcgugcuggccuucgugggcauccuggccgccaucugcgcccuguacgccagaaucuacugccaggugagagccaacgccagaagacugcccgccagacccggcaccgccggcaccaccagcaccagagccagaagaaagcccagaagccuggcccugcugagaacccugagcguggugcugcuggccuucguggccugcuggggcccccuguuccugcugcugcugcuggacguggccugccccgccagaaccugccccgugcugcugcaggccgaccccuuccugggccuggccauggccaacagccugcugaaccccaucaucuacacccugaccaacagagaccugagacacgcccugcugagacuggugugcugcggcagacacagcugcggcagagaccccagcggcagccagcagagcgccagcgccgccgaggccagcggcggccugagaagaugccugccccccggccuggacggcagcuucagcggcagcgagagaagcagcccccagagagacggccuggacaccagcggcagcaccggcagccccggcgcccccaccgccgccagaacccuggugagcgagcccgccgccgacuaa

SEQ ID NO: 22961 - RNA, 369 nt, Artificial Sequence
  SAA1__Homo_sapiens__NP_001171477
augaagcugcugaccggccugguguucugcagccuggugcugggcgugagcagcagaagcuucuucagcuuccugggcgaggccuucgacggcgccagagacauguggagagccuacagcgacaugagagaggccaacuacaucggcagcgacaaguacuuccacgccagaggcaacuacgacgccgccaagagaggccccggcggcgccugggccgccgaggugaucagcgacgccagagagaacauccagagauucuucggccacggcgccgaggacagccuggccgaccaggccgccaacgaguggggcagaagcggcaaggaccccaaccacuucagacccgccggccugcccgagaaguacuaa

SEQ ID NO: 22962 - RNA, 252 nt, Artificial Sequence
  SAA2__Homo_sapiens__NP_001120852
augaagcugcugaccggccugguguucugcagccuggugcugagcgugagcagcagaagcuucuucagcuuccugggcgaggccuucgacggcgccagagacauguggagagccuacagcgacaugagagaggccaacuacaucggcagcgacaaguacuuccacgccagaggcaacuacgacgccgccaagagaggccccggcggcgccugggccgccgaggugaucagccuguucagcgccgagcuguaa

SEQ ID NO: 22963 - RNA, 393 nt, Artificial Sequence
  SAA4__Homo_sapiens__NP_006503
augagacuguucaccggcaucguguucugcagccuggugaugggcgugaccagcgagagcuggagaagcuucuucaaggaggcccugcagggcgugggcgacaugggcagagccuacugggacaucaugaucagcaaccaccagaacagcaacagauaccuguacgccagaggcaacuacgacgccgcccagagaggccccggcggcgugugggccgccaagcugaucagcagaagcagaguguaccugcagggccugaucgacugcuaccuguucggcaacagcagcaccgugcuggaggacagcaagagcaacgagaaggccgaggaguggggcagaagcggcaaggaccccgacagauucagacccgacggccugcccaagaaguacuaa

SEQ ID NO: 22964 - RNA, 1425 nt, Artificial Sequence
  SAAL1__Homo_sapiens__NP_612430
auggacagaaaccccagcccccccccccccggcagagacaaggaggaggaggaggagguggccggcggcgacugcaucggcagcaccguguacagcaagcacuggcuguucggcgugcugagcggccugauccagaucgugagccccgagaacaccaagagcagcagcgacgacgaggagcagcugaccgagcuggacgaggagauggagaacgagaucugcagagugugggacaugagcauggacgaggacguggcccuguuccugcaggaguucaacgcccccgacaucuucaugggcgugcuggccaagagcaagugccccagacugagagagaucugcgugggcauccugggcaacauggccugcuuccaggagaucugcgugagcaucagcagcgacaagaaccugggccaggugcugcugcacugccuguacgacagcgacccccccacccugcuggagaccagcagacugcugcugaccugccugagccaggccgagguggccagcguguggguggagagaauccaggagcaccccgccaucuacgacagcaucugcuucaucaugagcagcagcaccaacguggaccugcuggugaaggugggcgaggugguggacaagcuguucgaccuggacgagaagcugaugcuggagugggugagaaacggcgccgcccagccccuggaccagccccaggaggagagcgaggagcagcccguguucagacuggugcccugcauccuggaggccgccaagcaggugagaagcgagaaccccgaguggcuggacguguacaugcacauccugcagcugcugaccaccguggacgacggcauccaggccaucgugcacugccccgacaccggcaaggacaucuggaaccugcuguucgaccuggugugccacgaguucugccagagcgacgacccccccaucauccugcaggagcagaagaccgugcuggccagcguguucagcgugcugagcgccaucuacgccagccagaccgagcaggaguaccugaagaucgagaagguggaccugccccugaucgacagccugaucagagugcugcagaacauggagcagugccagaagaagcccgagaacagcgccgagagcaacaccgaggagaccaagagaaccgaccugacccaggacgacuuccaccugaagauccugaaggacauccugugcgaguuccugagcaacaucuuccaggcccugaccaaggagaccguggcccagggcgugaaggagggccagcugagcaagcagaagugcagcagcgccuuccagaaccugcugcccuucuacagccccgugguggaggacuucaucaagauccugagagagguggacaaggcccuggccgacgaccuggagaagaacuuccccagccugaaggugcagaccuaa

SEQ ID NO: 22965 - RNA, 1077 nt, Artificial Sequence
  SAC3D1__Homo_sapiens__NP_037431
augcccggcugcgagcugcccgugggcaccugccccgacaugugccccgccgccgagagagcccagagagagagagagcacagacugcacagacuggagguggugcccggcugcagacaggacccccccagagccgacccccagagagccgugaaggaguacagcagacccgccgccggcaagcccagacccccccccagccagcugagaccccccagcgugcugcuggccaccgugagauaccuggccggcgagguggccgagagcgccgacaucgccagagccgagguggccagcuucguggccgacagacugagagccgugcugcuggaccuggcccugcagggcgccggcgacgccgaggccgccguggugcuggaggccgcccuggccacccugcugaccgugguggccagacugggccccgacgccgccagaggccccgccgaccccgugcugcugcaggcccaggugcaggagggcuucggcagccugagaagaugcuacgccagaggcgccggcccccaccccagacagcccgccuuccagggccuguuccugcuguacaaccugggcagcguggaggcccugcacgaggugcugcagcugcccgccgcccugagagccugccccccccugagaaaggcccuggccguggacgccgccuucagagagggcaacgccgccagacuguucagacugcugcagacccugcccuaccugcccagcugcgccgugcagugccacgugggccacgccagaagagaggcccuggccagauucgccagagccuucagcacccccaagggccagacccugccccugggcuucauggugaaccugcuggcccuggacggccugagagaggccagagaccugugccaggcccacggccugccccuggacggcgaggagagagugguguuccugagaggcagauacguggaggagggccugccccccgccagcaccugcaaggugcugguggagagcaagcugagaggcagaacccuggaggagguggugauggccgaggaggaggacgagggcaccgacagacccggcagccccgccuaa

SEQ ID NO: 22966 - RNA, 1764 nt, Artificial Sequence
  SACM1L__Homo_sapiens__NP_054735
auggccaccgccgccuacgagcagcugaagcugcacaucacccccgagaaguucuacguggaggccugcgacgacggcgccgacgacgugcugaccaucgacagagugagcaccgaggugacccuggccgugaagaaggacgugccccccagcgccgugaccagacccaucuucggcauccugggcaccauccaccugguggccggcaacuaccugaucgugaucaccaagaagaucaaggugggcgaguucuucagccacgugguguggaaggccaccgacuucgacgugcugagcuacaagaagaccaugcugcaccugaccgacauccagcugcaggacaacaagaccuuccuggccaugcugaaccacgugcugaacguggacggcuucuacuucagcaccaccuacgaccugacccacacccugcagagacugagcaacaccagccccgaguuccaggagaugagccugcuggagagagccgaccagagauucguguggaacggccaccugcugagagagcugagcgcccagcccgaggugcacagauucgcccugcccgugcugcacggcuucaucaccaugcacagcugcagcaucaacggcaaguacuucgacuggauccugaucagcagaagaagcugcuucagagccggcgugagauacuacgugagaggcaucgacagcgagggccacgccgccaacuucguggagaccgagcagaucgugcacuacaacggcagcaaggccagcuucgugcagaccagaggcagcauccccguguucuggagccagagacccaaccugaaguacaagccccugccccagaucagcaagguggccaaccacauggacggcuuccagagacacuucgacagccaggugaucaucuacggcaagcaggugaucaucaaccugaucaaccagaagggcagcgagaagccccuggagcagaccuucgccaccauggugagcagccugggcagcggcaugaugagauacaucgccuucgacuuccacaaggagugcaagaacaugagaugggacagacugagcauccugcuggaccagguggccgagaugcaggacgagcugagcuacuuccugguggacagcgccggccaggugguggccaaccaggagggcguguucagaagcaacugcauggacugccuggacagaaccaacgugauccagagccugcuggccagaagaagccugcaggcccagcugcagagacugggcgugcugcacgugggccagaagcuggaggagcaggacgaguucgagaagaucuacaagaacgccugggccgacaacgccaacgccugcgccaagcaguacgccggcaccggcgcccugaagaccgacuucaccagaaccggcaagagaacccaccugggccugaucauggacggcuggaacagcaugaucagauacuacaagaacaacuucagcgacggcuucagacaggacagcaucgaccuguuccugggcaacuacagcguggacgagcuggagagccacagcccccugagcgugcccagagacuggaaguuccuggcccugcccaucaucauggugguggccuucagcaugugcaucaucugccugcugauggccggcgacaccuggaccgagacccuggccuacgugcuguucuggggcguggccagcaucggcaccuucuucaucauccuguacaacggcaaggacuucguggacgcccccagacuggugcagaaggagaagaucgacuaa

SEQ ID NO: 22967 - RNA, 13299 nt, Artificial Sequence
  SACS__Homo_sapiens__NP_001264984
auggcccccuaccagggccccgcccuguacguguacaacaacgccguguucacccccgaggacuggcacggcauccaggagaucgccagaagcagaaagaaggacgacccccugaaggugggcagauucggcaucggcuucaacagcguguaccacaucaccgacgugcccugcaucuucagcggcgaccagaucggcaugcuggacccccaccagacccuguucggcccccacgagagcggccagugcuggaaccugaaggacgacagcaaggagaucagcgagcugagcgaccaguucgcccccuucgugggcaucuucggcagcaccaaggagaccuucaucaacggcaacuuccccggcaccuucuucagauucccccugagacugcagcccagccagcugagcagcaaccuguacaacaagcagaaggugcuggagcuguucgagagcuucagagccgacgccgacaccgugcugcuguuccugaagagcgugcaggacgugagccuguacgugagagaggccgacggcaccgagaagcugguguucagagugaccagcagcgagagcaaggcccugaagcacgagagacccaacagcaucaagauccugggcaccgccaucagcaacuacugcaagaagacccccagcaacaacaucaccugcgugaccuaccacgugaacaucgugcuggaggaggagagcaccaaggacgcccagaagaccagcuggcuggugugcaacagcgugggcggcagaggcaucagcagcaagcuggacagccuggccgacgagcugaaguucgugcccaucaucggcaucgccaugccccugagcagcagagacgacgaggccaagggcgccaccagcgacuucagcggcaaggccuucugcuuccugccccugccccccggcgaggagagcagcaccggccugcccgugcacaucagcggcuucuucggccugaccgacaacagaagaagcaucaaguggagagagcuggaccaguggagagaccccgccgcccuguggaacgaguuccuggugaugaacguggugcccaaggccuacgccacccugauccuggacagcaucaagagacuggagauggagaagagcagcgacuucccccugagcguggacgugaucuacaagcuguggcccgaggccagcaaggugaaggugcacuggcagcccgugcuggagccccuguucagcgagcugcugcagaacgccgugaucuacagcaucagcugcgacugggugagacuggagcagguguacuucagcgagcuggacgagaaccuggaguacaccaagaccgugcugaacuaccugcagagcagcggcaagcagaucgccaaggugcccggcaacguggacgccgccgugcagcugaccgccgccagcggcaccacccccgugagaaaggugacccccgccugggugagacaggugcugagaaagugcgcccaccugggcugcgccgaggagaagcugcaccugcuggaguucgugcugagcgaccaggccuacagcgagcugcugggccuggagcugcugccccugcagaacggcaacuucgugcccuucagcagcagcgugagcgaccaggacgugaucuacaucaccagcgccgaguaccccagaagccuguuccccagccuggagggcagauucauccuggacaaccugaagccccaccugguggccgcccugaaggaggccgcccagaccagaggcagacccugcacccagcugcagcugcugaaccccgagagauucgccagacugaucaaggaggugaugaacaccuucuggcccggcagagagcugaucgugcagugguaccccuucgacgagaacagaaaccaccccagcgugagcuggcugaagaugguguggaagaaccuguacauccacuucagcgaggaccugacccuguucgacgagaugccccugauccccagaaccauccuggaggagggccagaccugcguggagcugaucagacugagaauccccagccuggugauccuggacgacgagagcgaggcccagcugcccgaguuccuggccgacaucgugcagaagcugggcggcuucgugcugaagaagcuggacgccagcauccagcacccccugaucaagaaguacauccacagcccccugcccagcgccgugcugcagaucauggagaagaugccccugcagaagcugugcaaccagaucaccagccugcugcccacccacaaggacgcccugagaaaguuccuggccagccugaccgacagcagcgagaaggagaagagaaucauccaggagcuggccaucuucaagagaaucaaccacagcagcgaccagggcaucagcagcuacaccaagcugaagggcugcaaggugcugcaccacaccgccaagcugcccgccgaccugagacugagcaucagcgugaucgacagcagcgacgaggccaccaucagacuggccaacaugcugaagaucgagcagcugaagaccaccagcugccugaagcuggugcugaaggacaucgagaacgccuucuacagccacgaggaggugacccagcugaugcugugggugcuggagaaccugagcagccugaagaacgagaaccccaacgugcuggaguggcugaccccccugaaguucauccagaucagccaggagcagauggugagcgccggcgagcuguucgaccccgacaucgaggugcugaaggaccuguucugcaacgaggagggcaccuacuucccccccagcguguucaccagccccgacauccugcacagccugagacagaucggccugaagaacgaggccagccugaaggagaaggacguggugcagguggccaagaagaucgaggcccugcaggugggcgccugccccgaccaggacgugcugcugaagaaggccaagacccugcugcuggugcugaacaagaaccacacccugcugcagagcagcgagggcaagaugacccugaagaagaucaagugggugcccgccugcaaggagagaccccccaacuaccccggcagccugguguggaagggcgaccugugcaaccugugcgccccccccgacaugugcgacgugggccacgccauccugaucggcagcagccugccccugguggagagcauccacgugaaccuggagaaggcccugggcaucuucaccaagcccagccugagcgccgugcugaagcacuucaagaucgugguggacugguacagcagcaagaccuucagcgacgaggacuacuaccaguuccagcacauccugcuggagaucuacggcuucaugcacgaccaccugaacgagggcaaggacagcuucagagcccugaaguuccccuggguguggaccggcaagaaguucugcccccuggcccaggccgugaucaagcccauccacgaccuggaccugcagcccuaccugcacaacgugcccaagaccauggccaaguuccaccagcuguucaaggugugcggcagcaucgaggagcugaccagcgaccacaucagcauggugauccagaagaucuaccugaagagcgaccaggaccugagcgagcaggagagcaagcagaaccugcaccugaugcugaacaucaucagauggcuguacagcaaccagauccccgccagccccaacacccccgugcccauccaccacagcaagaaccccagcaagcugaucaugaagcccauccacgagugcugcuacugcgacaucaagguggacgaccugaacgaccugcuggaggacagcguggagcccaucauccuggugcacgaggacauccccaugaagaccgccgaguggcugaaggugcccugccugagcaccagacugaucaaccccgagaacaugggcuucgagcagagcggccagagagagccccugaccgugagaaucaagaacauccuggaggaguaccccagcgugagcgacaucuucaaggagcugcugcagaacgccgacgacgccaacgccaccgagugcagcuuccugaucgacaugagaagaaacauggacaucagagagaaccugcuggaccccggcauggccgccugccacggccccgcccuguggagcuucaacaacagccaguucagcgacagcgacuucgugaacaucaccagacugggcgagagccugaagagaggcgagguggacaaggugggcaaguucggccugggcuucaacagcguguaccacaucaccgacauccccaucaucaugagcagagaguucaugaucauguucgaccccaacaucaaccacaucagcaagcacaucaaggacaagagcaaccccggcaucaagaucaacuggagcaagcagcagaagagacugagaaaguuccccaaccaguucaagcccuucaucgacguguucggcugccagcugccccugaccguggaggcccccuacagcuacaacggcacccuguucagacugagcuucagaacccagcaggaggccaaggugagcgaggugagcagcaccugcuacaacaccgccgacaucuacagccugguggacgaguucagccugugcggccacagacugaucaucuucacccagagcgugaagagcauguaccugaaguaccugaagaucgaggagaccaaccccagccuggcccaggacaccgugaucaucaagaagaagagcugcagcagcaaggcccugaacacccccgugcugagcgugcugaaggaggccgccaagcugaugaagaccugcagcagcagcaacaagaagcugcccagcgacgagcccaagagcagcugcauccugcagaucaccguggaggaguuccaccacguguucagaagaaucgccgaccugcagagcccccuguucagaggccccgacgacgaccccgccgcccuguucgagauggccaagagcggccagagcaagaagcccagcgacgagcugagccagaagaccguggagugcaccaccuggcugcugugcaccugcauggacaccggcgaggcccugaaguucagccugagcgagagcggcagaagacugggccuggugcccugcggcgccgugggcgugcagcugagcgagauccaggaccagaaguggaccgugaagccccacaucggcgagguguucugcuaccugccccugagaaucaagaccggccugcccgugcacaucaacggcugcuucgccgugaccagcaacagaaaggagaucuggaagaccgacaccaagggcagauggaacaccaccuucaugagacacgugaucgugaaggccuaccugcaggugcugagcgugcugagagaccuggccaccagcggcgagcugauggacuacaccuacuacgccguguggcccgaccccgaccuggugcacgacgacuucagcgugaucugccagggcuucuacgaggacaucgcccacggcaagggcaaggagcugaccaagguguucagcgacggcagcaccugggugagcaugaagaacgugagauuccuggacgacagcauccugaagagaagagacgugggcagcgccgccuucaagaucuuccugaaguaccugaagaagaccggcagcaagaaccugugcgccguggagcugcccagcagcgugaagcugggcuucgaggaggccggcugcaagcagauccugcuggagaacaccuucagcgagaagcaguucuucagcgagguguucuuccccaacauccaggagaucgaggccgagcugagagacccccugaugaucuucgugcugaacgagaagguggacgaguucagcggcgugcugagagugacccccugcauccccugcagccuggagggccacccccuggugcugcccagcagacugauccaccccgagggcagaguggccaagcuguucgacaucaaggacggcagauuccccuacggcagcacccaggacuaccugaaccccaucauccugaucaagcuggugcagcugggcauggccaaggacgacauccugugggacgacaugcuggagagagccgugagcguggccgagaucaacaagagcgaccacguggccgccugccugagaagcagcauccugcugagccugaucgacgagaagcugaagaucagagaccccagagccaaggacuucgccgccaaguaccagaccaucagauuccugcccuuccugaccaagcccgccggcuucagccuggacuggaagggcaacagcuucaagcccgagaccauguucgccgccaccgaccuguacaccgccgagcaccaggacaucgugugccugcugcagcccauccugaacgagaacagccacagcuucagaggcugcggcagcgugagccuggccgugaaggaguuccugggccugcugaagaagcccaccguggaccuggugaucaaccagcugaaggagguggccaagagcguggacgacggcaucacccuguaccaggagaacaucaccaacgccugcuacaaguaccugcacgaggcccugaugcagaacgagaucaccaagaugagcaucaucgacaagcugaagcccuucagcuucauccugguggagaacgccuacguggacagcgagaaggugagcuuccaccugaacuucgaggccgcccccuaccuguaccagcugcccaacaaguacaagaacaacuucagagagcuguucgagaccgugggcgugagacagagcugcaccguggaggacuucgcccuggugcuggagagcaucgaccaggagagaggcaccaagcagaucaccgaggagaacuuccagcugugcagaagaaucaucagcgagggcaucuggagccugaucagagagaagaagcaggaguucugcgagaagaacuacggcaagauccugcugcccgacaccaaccugaugcugcugcccgccaagagccugugcuacaacgacugccccuggaucaaggugaaggacaccaccgugaaguacugccacgccgacauccccagagagguggccgugaagcugggcgccgugcccaagagacacaaggcccuggagagauacgccagcaacgugugcuucaccacccugggcaccgaguucggccagaaggagaagcugaccagcagaaucaagagcauccugaacgccuaccccagcgagaaggagaugcugaaggagcugcugcagaacgccgacgacgccaaggccaccgagaucugcuucguguucgaccccagacagcaccccguggacagaaucuucgacgacaagugggccccccugcagggccccgcccugugcguguacaacaaccagcccuucaccgaggacgacgugagaggcauccagaaccugggcaagggcaccaaggagggcaaccccuacaagaccggccaguacggcaucggcuucaacagcguguaccacaucaccgacugccccagcuucaucagcggcaacgacauccugugcaucuucgacccccacgccagauacgcccccggcgccaccagcaucagccccggcagaauguucagagaccuggacgccgacuucagaacccaguucagcgacgugcuggaccuguaccugggcacccacuucaagcuggacaacugcaccauguucagauucccccugagaaacgccgagauggccaaggugagcgagaucagcagcgugcccgccagcgacagaauggugcagaaccugcuggacaagcugagaagcgacggcgccgagcugcugauguuccugaaccacauggagaagaucagcaucugcgagaucgacaagagcaccggcgcccugaacgugcuguacagcgugaagggcaagaucaccgacggcgacagacugaagagaaagcaguuccacgccagcgugaucgacagcgugaccaagaagagacagcugaaggacauccccgugcagcagaucaccuacaccauggacaccgaggacagcgagggcaaccugaccaccuggcugaucugcaacagaagcggcuucagcagcauggagaaggugagcaagagcgugaucagcgcccacaagaaccaggacaucacccuguuccccagaggcggcguggccgccugcaucacccacaacuacaagaagccccacagagccuucugcuuccugccccugagccuggagaccggccugcccuuccacgugaacggccacuucgcccuggacagcgccagaagaaaccuguggagagacgacaacggcgugggcgugagaagcgacuggaacaacagccugaugaccgcccugaucgcccccgccuacguggagcugcugauccagcugaagaagagauacuuccccggcagcgaccccacccugagcgugcugcagaacacccccauccacguggugaaggacacccugaagaaguuccugagcuucuuccccgugaacagacuggaccugcagcccgaccuguacugccuggugaaggcccuguacaacugcauccacgaggacaugaagagacugcugcccguggugagagcccccaacaucgacggcagcgaccugcacagcgccgugaucaucaccuggaucaacaugagcaccagcaacaagaccagacccuucuucgacaaccugcugcaggacgagcugcagcaccugaagaacgccgacuacaacaucaccaccagaaagaccguggccgagaacguguacagacugaagcaccugcugcuggagaucggcuucaaccugguguacaacugcgacgagaccgccaaccuguaccacugccugaucgacgccgacauccccgugagcuacgugacccccgccgacaucagaagcuuccugaugaccuucagcagccccgacaccaacugccacaucggcaagcugcccugcagacugcagcagaccaaccugaagcuguuccacagccugaagcugcugguggacuacugcuucaaggacgccgaggagaacgagaucgagguggagggccugccccugcugaucacccuggacagcgugcugcagaccuucgacgccaagagacccaaguuccugaccaccuaccacgagcugauccccagcagaaaggaccuguucaugaacacccuguaccugaaguacagcaacauccugcugaacugcaagguggccaagguguucgacaucagcagcuucgccgaccugcugagcagcgugcugcccagagaguacaagaccaagagcugcaccaaguggaaggacaacuucgccagcgagagcuggcugaagaacgccuggcacuucaucagcgagagcgugagcgugaaggaggaccaggaggagaccaagcccaccuucgacaucgugguggacacccugaaggacugggcccugcugcccggcaccaaguucaccgugagcgccaaccagcugguggugcccgagggcgacgugcugcugccccugagccugaugcacaucgccguguuccccaacgcccagagcgacaagguguuccacgcccugaugaaggccggcugcauccagcuggcccugaacaagaucugcagcaaggacagcgccuucgugccccugcugagcugccacaccgccaacaucgagagccccaccagcauccugaaggcccugcacuacauggugcagaccagcaccuucagagccgagaagcugguggagaacgacuucgaggcccugcugauguacuucaacugcaaccugaaccaccugaugagccaggacgacaucaagauccugaagagccugcccugcuacaagagcaucagcggcagauacgugagcaucggcaaguucggcaccugcuacgugcugaccaagagcauccccagcgccgagguggagaaguggacccagagcagcagcagcgccuuccuggaggagaagauccaccugaaggagcuguacgaggugaucggcugcgugcccguggacgaccuggagguguaccugaagcaccugcugcccaagaucgagaaccugagcuacgacgccaagcuggagcaccugaucuaccugaagaacagacugagcagcgccgaggagcugagcgagaucaaggagcagcuguucgagaagcuggagagccugcugaucauccacgacgccaacagcagacugaagcaggccaagcacuucuacgacagaaccgugagaguguucgaggugaugcugcccgagaagcuguucauccccaacgacuucuucaagaagcuggagcagcugaucaagcccaagaaccacgugaccuucaugaccagcuggguggaguuccugagaaacaucggccugaaguacauccugagccagcagcagcugcugcaguucgccaaggagaucagcgugagagccaacaccgagaacuggagcaaggagacccugcagaacaccguggacauccugcugcaccacaucuuccaggagagaauggaccugcugagcggcaacuuccugaaggagcugagccugauccccuuccugugccccgagagagcccccgccgaguucaucagauuccacccccaguaccaggaggugaacggcacccugccccugaucaaguucaacggcgcccaggugaaccccaaguucaagcagugcgacgugcugcagcugcuguggaccagcugccccauccugcccgagaaggccaccccccugagcaucaaggagcaggagggcagcgaccugggcccccaggagcagcuggagcaggugcugaacaugcugaacgugaaccuggaccccccccuggacaaggugaucaacaacugcagaaacaucugcaacaucaccacccuggacgaggagauggugaagaccagagccaaggugcugagaagcaucuacgaguuccugagcgccgagaagagagaguucagauuccagcugagaggcguggccuucgugaugguggaggacggcuggaagcugcugaagcccgaggagguggugaucaaccuggaguacgagagcgacuucaagcccuaccuguacaagcugccccuggagcugggcaccuuccaccagcuguucaagcaccugggcaccgaggacaucaucagcaccaagcaguacguggaggugcugagcagaaucuucaagaacagcgagggcaagcagcuggaccccaacgagaugagaaccgugaagagaguggugagcggccuguucagaagccugcagaacgacagcgugaaggugagaagcgaccuggagaacgugagagaccuggcccuguaccugcccagccaggacggcagacuggugaagagcagcauccugguguucgacgacgccccccacuacaagagcagaauccagggcaacaucggcgugcagaugcugguggaccugagccagugcuaccugggcaaggaccacggcuuccacaccaagcugaucaugcuguucccccagaagcugagacccagacugcugagcagcauccuggaggagcagcuggacgaggagacccccaaggugugccaguucggcgcccugugcagccugcagggcagacugcagcugcugcugagcagcgagcaguucaucaccggccugaucagaaucaugaagcacgagaacgacaacgccuuccuggccaacgaggagaaggccaucagacugugcaaggcccugagagagggccugaaggugagcugcuucgagaagcugcagaccacccugagagugaagggcuucaaccccaucccccacagcagaagcgagaccuucgccuuccugaagagauucggcaacgccgugauccugcuguacauccagcacagcgacagcaaggacaucaacuuccugcuggcccuggccaugacccugaagagcgccaccgacaaccugaucagcgacaccagcuaccugaucgccaugcugggcugcaacgacaucuacagaaucggcgagaagcuggacagccugggcgugaaguacgacagcagcgagcccagcaagcuggagcugcccaugcccggcacccccauccccgccgagauccacuacacccugcugauggaccccaugaacguguucuaccccggcgaguacgugggcuaccugguggacgccgagggcggcgacaucuacggcagcuaccagcccaccuacaccuacgccaucaucgugcaggagguggagagagaggacgccgacaacagcagcuuccugggcaagaucuaccagaucgacaucggcuacagcgaguacaagaucgugagcagccuggaccuguacaaguucagcagacccgaggagagcagccagagcagagacagcgcccccagcacccccaccagccccaccgaguuccugacccccggccugagaagcauccccccccuguucagcggcagagagagccacaagaccagcagcaagcaccagagccccaagaagcugaaggugaacagccugcccgagauccugaaggaggugaccagcgugguggagcaggccuggaagcugcccgagagcgagagaaagaagaucaucagaagacuguaccugaaguggcaccccgacaagaaccccgagaaccacgacaucgccaacgagguguucaagcaccugcagaacgagaucaacagacuggagaagcaggccuuccuggaccagaacgccgacagagccagcagaagaaccuucagcaccagcgccagcagauuccagagcgacaaguacagcuuccagagauucuacaccagcuggaaccaggaggccaccagccacaagagcgagagacagcagcagaacaaggagaagugcccccccagcgccggccagaccuacagccagagauucuucgugccccccaccuucaagagcgugggcaaccccguggaggccagaagauggcugagacaggccagagccaacuucagcgccgccagaaacgaccugcacaagaacgccaacgagugggugugcuucaagugcuaccugagcaccaagcuggcccugaucgccgccgacuacgccgugagaggcaagagcgacaaggacgugaagcccaccgcccuggcccagaagaucgaggaguacagccagcagcuggagggccugaccaacgacgugcacacccuggaggccuacggcguggacagccugaagaccagauaccccgaccugcugcccuucccccagauccccaacgacagauucaccagcgagguggccaugagagugauggagugcaccgccugcaucaucaucaagcuggagaacuucaugcagcagaagguguaa

SEQ ID NO: 22968 - RNA, 900 nt, Artificial Sequence
  SAE1__Homo_sapiens__NP_001139185
augguggagaaggaggaggccggcggcggcaucagcgaggaggaggccgcccaguacgacagacagaucagacuguggggccuggaggcccagaagagacugagagccagcagagugcugcuggugggccugaagggccugggcgccgagaucgccaagaaccugauccuggccggcgugaagggccugaccaugcuggaccacgagcaggugacccccgaggaccccggcgcccaguuccugaucagaaccggcagcgugggcagaaacagagccgaggccagccuggagagagcccagaaccugaaccccaugguggacgugaagguggacaccgaggacaucgagaagaagcccgagagcuucuucacccaguucgacgccgugugccugaccugcugcagcagagacgugaucgugaagguggaccagaucugccacaagaacagcaucaaguucuucaccggcgacguguucggcuaccacggcuacaccuucgccaaccugggcgagcacgaguucguggaggagaagaccaagguggccaaggugagccagggcguggaggacggccccgacaccaagagagccaagcuggacagcagcgagaccaccauggugaagaagaaggugguguucugccccgugaaggaggcccuggagguggacuggagcagcgagaaggccaaggccgcccugaagagaaccaccagcgacuacuuccugcugcagggccccgugagcgccggccccagcagccagcagcugcugcugcugagauggcacgagggcgagugggacugcggcgugcccuggccccaggugaacagcagauucggcagccccagagacgccaacugcagcaugcccaccugcauccccugcccccugcccagcuaa

SEQ ID NO: 22969 - RNA, 2862 nt, Artificial Sequence
  SAFB2__Homo_sapiens__NP_055464
auggccgagacccugcccggcagcggcgacagcggccccggcaccgccagccugggccccggcguggccgagaccggcaccagaagacugagcgagcugagagugaucgaccugagagccgagcugaagaagagaaaccuggacaccggcggcaacaagagcgugcugauggagagacugaagaaggccgugaaggaggagggccaggaccccgacgagaucggcaucgagcuggaggccaccagcaagaagagcgccaagagaugcgugaagggccugaagauggaggaggagggcaccgaggacaacggccuggaggacgacagcagagacggccaggaggacauggaggccagccuggagaaccugcagaacaugggcaugauggacaugagcgugcuggacgagaccgagguggccaacagcagcgcccccgacuucggcgaggacggcaccgacggccugcuggacagcuucugcgacagcaaggaguacguggccgcccagcugagacagcugcccgcccagccccccgagcacgccguggacggcgagggcuucaagaacacccuggagaccagcagccugaacuucaaggugacccccgacaucgaggagagccugcuggagcccgagaacgagaagauccuggacauccugggcgagaccugcaagagcgagcccgugaaggaggagagcagcgagcuggagcagcccuucgcccaggacaccagcagcgugggccccgacagaaagcuggccgaggaggaggaccuguucgacagcgcccaccccgaggagggcgaccuggaccuggccagcgagagcaccgcccacgcccagagcagcaaggccgacagccugcuggccguggugaagagagagcccgccgagcagcccggcgacggcgagagaaccgacugcgagcccgugggccuggagcccgccguggagcagagcagcgccgccagcgagcuggccgaggccagcagcgaggagcuggccgaggcccccaccgaggcccccagccccgaggccagagacagcaaggaggacggcagaaaguucgacuucgacgccugcaacgaggugccccccgcccccaaggagagcagcaccagcgagggcgccgaccagaagaugagcagcuucaaggaggagaaggacaucaagcccaucaucaaggacgagaagggcagagugggcagcggcagcggcagaaaccugugggugagcggccugagcagcaccaccagagccaccgaccugaagaaccuguucagcaaguacggcaagguggugggcgccaagguggugaccaacgccagaagccccggcgccagaugcuacggcuucgugaccaugagcaccagcgacgaggccaccaagugcaucagccaccugcacagaaccgagcugcacggcagaaugaucagcguggagaaggccaagaacgagcccgccggcaagaagcugagcgacagaaaggagugcgaggugaagaaggagaagcugagcagcguggacagacaccacagcguggagaucaagaucgagaagaccgugaucaagaaggaggagaagaucgagaagaaggaggagaagaagcccgaggacaucaagaaggaggagaaggaccaggacgagcugaagcccggccccaccaacagaagcagagugaccaagagcggcagcagaggcauggagagaaccguggugauggacaagagcaagggcgagcccgugaucagcgugaagaccaccagcagaagcaaggagagaagcagcaagagccaggacagaaagagcgagagcaaggagaagagagacauccugagcuucgacaagaucaaggagcagagagagagagagagacagagacagagagagagagagaucagagagaccgagagaagaagagagagagagcagagagagagagagcagagacuggaggccuuccacgagagaaaggagaaggccagacugcagagagagagacugcagcuggagugccagagacagagacuggagagagagagaauggagagagagagacuggagagagagagaaugagaguggagagagagagaagaaaggagcaggagagaauccacagagagagagaggagcugagaagacagcaggagcagcugagauacgagcaggagagaagacccggcagaagacccuacgaccuggacagaagagacgacgccuacuggcccgagggcaagagaguggccauggaggacagauacagagccgacuuccccagacccgaccacagauuccacgacuucgaccacagagacagaggccaguaccaggaccacgccaucgacagaagagagggcagcagacccaugaugggcgaccacagagacggccagcacuacggcgacgacagacacggccacggcggcccccccgagagacacggcagagacagcagagacggcuggggcggcuacggcagcgacaagagacugagcgagggcagaggccugccccccccccccagaggcggcagagacuggggcgagcacaaccagagacuggaggagcaccaggccagagccuggcagggcgccauggacgccggcgccgccagcagagagcacgccagauggcagggcggcgagagaggccugagcggccccagcggccccggccacauggccagcagaggcggcguggccggcagaggcggcuucgcccagggcggccacagccagggccacguggugcccggcggcggccuggagggcggcggcguggccagccaggacagaggcagcagagugccccacccccacccccaccccccccccuacccccacuucaccagaagauacuaa

SEQ ID NO: 22970 - RNA, 2754 nt, Artificial Sequence
  SAFB__Homo_sapiens__NP_001188267
auggccgagacccugagcggccugggcgacagcggcgccgccggcgccgccgcccugagcagcgccagcagcgagaccggcaccagaagacugagcgaccugagagugaucgaccugagagccgagcugagaaagagaaacguggacagcagcggcaacaagagcgugcugauggagagacugaagaaggccaucgaggacgagggcggcaaccccgacgagaucgagaucaccagcgagggcaacaagaagaccagcaagagaagcagcaagggcagaaagcccgaggaggagggcguggaggacaacggccuggaggagaacagcggcgacggccaggaggacguggagaccagccuggagaaccugcaggacaucgacaucauggacaucagcgugcuggacgaggccgagaucgacaacggcagcguggccgacugcguggaggacgacgacgccgacaaccugcaggagagccugagcgacagcagagagcugguggagggcgagaugaaggagcugcccgagcagcugcaggagcacgccaucgaggacaaggagaccaucaacaaccuggacaccagcagcagcgacuucaccauccugcaggagaucgaggagcccagccuggagcccgagaacgagaagauccuggacauccugggcgagaccugcaagagcgagcccgugaaggaggagagcagcgagcuggagcagcccuucgcccaggacaccagcagcgugggccccgacagaaagcuggccgaggaggaggaccuguucgacagcgcccaccccgaggagggcgaccuggaccuggccagcgagagcaccgcccacgcccagagcagcaaggccgacagccugcuggccguggugaagagagagcccgccgagcagcccggcgacggcgagagaaccgacugcgagcccgugggccuggagcccgccguggagcagagcagcgccgccagcgagcuggccgaggccagcagcgaggagcuggccgaggcccccaccgaggcccccagccccgaggccagagacagcaaggaggacggcagaaaguucgacuucgacgccugcaacgaggugccccccgcccccaaggagagcagcaccagcgagggcgccgaccagaagaugagcagccccgaggacgacagcgacaccaagagacugagcaaggaggagaagggcagaagcagcugcggcagaaacuucugggugagcggccugagcagcaccaccagagccaccgaccugaagaaccuguucagcaaguacggcaagguggugggcgccaagguggugaccaacgccagaagccccggcgccagaugcuacggcuucgugaccaugagcaccgccgaggaggccaccaagugcaucaaccaccugcacaagaccgagcugcacggcaagaugaucagcguggagaaggccaagaacgagcccgugggcaagaagaccagcgacaagagagacagcgacggcaagaaggagaagagcagcaacagcgacagaagcaccaaccugaagagagacgacaagugcgacagaaaggacgacgccaagaagggcgacgacggcagcggcgagaagagcaaggaccaggacgaccagaagcccggccccagcgagagaagcagagccaccaagagcggcagcagaggcaccgagagaaccguggugauggacaagagcaagggcgugcccgugaucagcgugaagaccagcggcagcaaggagagagccagcaagagccaggacagaaagagcgccagcagagagaagagaagcguggugagcuucgacaaggugaaggagcccagaaagagcagagacagcgagagccacagcagagugagagagagaagcgagagagagcagagaaugcaggcccagugggagagagaggagagagagagacuggagaucgccagagagagacuggccuuccagagacagagacuggagagagagagaauggagagagagagacuggagagagagagaaugcacguggagcacgagagaagaagagagcaggagagaauccacagagagagagaggagcugagaagacagcaggagcugagauacgagcaggagagaagacccgccgugagaagacccuacgaccuggacagaagagacgacgccuacuggcccgaggccaagagagccgcccuggacgagagauaccacagcgacuucaacagacaggacagauuccacgacuucgaccacagagacagaggcagauaccccgaccacagcguggacagaagagagggcagcagaagcaugaugggcgagagagagggccagcacuaccccgagagacacggcggccccgagagacacggcagagacagcagagacggcuggggcggcuacggcagcgacaagagaaugagcgagggcagaggccugccccccccccccagaggcagaagagacuggggcgaccacggcagaagagaggacgacagaagcuggcagggcaccgccgacggcggcaugauggacagagaccacaagagauggcagggcggcgagagaagcaugagcggccacagcggccccggccacaugaugaacagaggcggcaugagcggcagaggcagcuucgcccccggcggcgccagcagaggccaccccaucccccacggcggcaugcagggcggcuucggcggccagagcagaggcagcagacccagcgacgccagauucaccagaagauacuaa

SEQ ID NO: 22971 - RNA, 2715 nt, Artificial Sequence
  SAGE1__Homo_sapiens__NP_061136
augcaggccagcccccugcagaccagccagcccaccccccccgaggagcugcacgccgccgccuacguguucaccaacgacggccagcagaugagaagcgacgaggugaaccugguggccaccggccaccagagcaagaagaagcacagcagaaagagcaagagacacagcagcagcaagagaagaaagagcaugagcagcuggcuggacaagcaggaggacgccgccgugacccacagcaucugcgaggagagaaucaacaacggccagcccguggccgacaacgugcugagcaccgccccccccuggcccgacgccaccaucgcccacaacaucagagaggagagaauggagaacggccagagcagaaccgacaaggugcugagcaccgcccccccccagcuggugcacauggccgccgccggcauccccagcaugagcaccagagaccugcacagcaccgugacccacaacaucagagaggagagaauggagaacggccagccccagcccgacaacgugcugagcaccggccccaccggccugaucaacauggccgccacccccauccccgccaugagcgccagagaccuguacgccaccgugacccacaacgugugcgagcagaagauggagaacgugcagcccgcccccgacaacgugcugcugacccugagacccagaagaaucaacaugaccgacaccggcaucagccccaugagcaccagagaccccuacgccaccaucaccuacaacgugcccgaggagaagauggagaagggccagccccagcccgacaacauccugagcaccgccagcaccggccugaucaacguggccggcgccggcacccccgccaucagcaccaacggccuguacagcaccgugccccacaacgugugcgaggagaagauggagaacgaccagccccagcccaacaacgugcugagcaccgugcagcccgugaucaucuaccugaccgccaccggcauccccggcaugaacaccagagaccaguacgccaccaucacccacaacgugugcgaggagagaguggugaacaaccagccccugcccagcaacgcccugagcaccgugcugcccggccuggccuaccuggccaccgccgacaugcccgccaugagcaccagagaccagcacgccaccaucauccacaaccugagagaggagaagaaggacaacagccagcccacccccgacaacgugcugagcgccgugacccccgagcugaucaaccuggccggcgccggcaucccccccaugagcaccagagaccaguacgccaccgugaaccaccacgugcacgaggccagaauggagaacggccagagaaagcaggacaacgugcugagcaacgugcugagcggccugaucaacauggccggcgccagcauccccgccaugagcagcagagaccuguacgccaccaucacccacagcgugagagaggagaagauggagagcggcaagccccagaccgacaaggugaucagcaacgacgccccccagcugggccacauggccgccggcggcauccccagcaugagcaccaaggaccuguacgccaccgugacccagaacgugcacgaggagagaauggagaacaaccagccccagcccagcuacgaccugagcaccgugcugcccggccugaccuaccugaccguggccggcauccccgccaugagcaccagagaccaguacgccaccgugacccacaacgugcacgaggagaagaucaagaacggccaggccgccagcgacaacguguucagcaccgugccccccgccuucaucaacauggccgccaccggcgugagcagcaugagcaccagagaccaguacgccgccgugacccacaacaucagagaggagaagaucaacaacagccagcccgcccccggcaacauccugagcaccgccccccccuggcugagacacauggccgccgccggcaucagcagcaccaucaccagagaccuguacgugaccgccacccacagcgugcacgaggagaagaugaccaacggccagcaggcccccgacaacagccugagcaccgugccccccggcugcaucaaccugagcggcgccggcaucagcugcagaagcaccagagaccuguacgccaccgugauccacgacauccaggaggaggagauggagaacgaccagaccccccccgacggcuuccugagcaacagcgacagccccgagcugaucaacaugaccggccacugcaugccccccaacgcccuggacagcuucagccacgacuucaccagccugagcaaggacgagcugcuguacaagcccgacagcaacgaguucgccgugggcaccaagaacuacagcgugagcgccggcgacccccccgugaccgugaugagccugguggagaccgugcccaacaccccccagaucagccccgccauggccaagaagaucaacgacgacaucaaguaccagcugaugaaggaggugagaagauucggccagaacuacgagagaaucuucauccugcuggaggaggugcagggcagcaugaaggugaagagacaguucguggaguucaccaucaaggaggccgccagauucaagaagguggugcugauccagcagcuggagaaggcccugaaggagaucgacagccacugccaccugagaaaggugaagcacaugagaaagagauaa

SEQ ID NO: 22972 - RNA, 1218 nt, Artificial Sequence
  SAG__Homo_sapiens__NP_000532
auggccgccagcggcaagaccagcaagagcgagcccaaccacgugaucuucaagaagaucagcagagacaagagcgugaccaucuaccugggcaacagagacuacaucgaccacgugagccaggugcagcccguggacggcguggugcugguggaccccgaccuggugaagggcaagaagguguacgugacccugaccugcgccuucagauacggccaggaggacaucgacgugaucggccugaccuucagaagagaccuguacuucagcagagugcagguguacccccccgugggcgccgccagcacccccaccaagcugcaggagagccugcugaagaagcugggcagcaacaccuaccccuuccugcugaccuuccccgacuaccugcccugcagcgugaugcugcagcccgccccccaggacagcggcaagagcugcggcguggacuucgaggugaaggccuucgccaccgacagcaccgacgccgaggaggacaagauccccaagaagagcagcgugagacugcugaucagaaaggugcagcacgccccccuggagaugggcccccagcccagagccgaggccgccuggcaguucuucaugagcgacaagccccugcaccuggccgugagccugaacaaggagaucuacuuccacggcgagcccauccccgugaccgugaccgugaccaacaacaccgagaagaccgugaagaagaucaaggccuucguggagcagguggccaacguggugcuguacagcagcgacuacuacgugaagcccguggccauggaggaggcccaggagaaggugccccccaacagcacccugaccaagacccugacccugcugccccugcuggccaacaacagagagagaagaggcaucgcccuggacggcaagaucaagcacgaggacaccaaccuggccagcagcaccaucaucaaggagggcaucgacagaaccgugcugggcauccuggugagcuaccagaucaaggugaagcugaccgugagcggcuuccugggcgagcugaccagcagcgagguggccaccgaggugcccuucagacugaugcacccccagcccgaggaccccgccaaggagagcuaccaggacgccaaccugguguucgaggaguucgccagacacaaccugaaggacgccggcgaggccgaggagggcaagagagacaagaacgacguggacgaguaa

SEQ ID NO: 22973 - RNA, 3684 nt, Artificial Sequence
  SALL1__Homo_sapiens__NP_001121364
augaacgacaccgugaacaagaccgaccagguggacugcagcgaccugagcgagcacaacggccuggacagagaggagagcauggagguggaggcccccguggccaacaagagcggcagcggcaccagcagcggcagccacagcagcaccgcccccagcagcagcagcagcagcagcagcagcagcggcggcggcggcagcagcagcaccggcaccagcgccaucaccaccagccugccccagcugggcgaccugaccacccugggcaacuucagcgugaucaacagcaacgugaucaucgagaaccugcagagcaccaagguggccguggcccaguucagccaggaggccagaugcggcggcgccagcggcggcaagcuggccgugcccgcccugauggagcagcugcuggcccugcagcagcagcagauccaccagcugcagcugaucgagcagaucagacaccagauccugcugcuggccagccagaacgccgaccugcccaccagcagcagccccagccagggcacccugagaaccagcgccaacccccugagcacccugagcagccaccugagccagcagcuggccgccgccgccggccuggcccagagccuggccagccagagcgccagcaucagcggcgugaagcagcugccccccauccagcugccccagagcagcagcggcaacaccaucauccccagcaacagcggcagcagccccaacaugaacauccuggccgccgccgugaccacccccagcagcgagaagguggccagcagcgccggcgccagccacgugagcaaccccgccgugagcagcagcagcagccccgccuucgccaucagcagccugcugagccccgccagcaacccccugcugccccagcaggccagcgccaacagcguguuccccagcccccugcccaacaucggcaccaccgccgaggaccugaacagccugagcgcccuggcccagcagagaaagagcaagccccccaacgugaccgccuucgaggccaagagcaccagcgacgaggccuucuucaagcacaagugcagauucugcgccaagguguucggcagcgacagcgcccugcagauccaccugagaagccacaccggcgagagacccuucaagugcaacaucugcggcaacagauucagcaccaagggcaaccugaaggugcacuuccagagacacaaggagaaguacccccacauccagaugaaccccuaccccgugcccgagcaccuggacaacauccccaccagcaccggcauccccuacggcaugagcaucccccccgagaagcccgugaccagcuggcuggacaccaagcccgugcugcccacccugaccaccagcgugggccugccccugccccccacccugcccagccugauccccuucaucaagaccgaggagcccgcccccauccccaucagccacagcgccaccagcccccccggcagcgugaagagcgacagcggcggccccgagagcgccaccagaaaccugggcggccugcccgaggaggccgagggcagcacccugccccccagcggcggcaagagcgaggagagcggcauggugaccaacagcgugcccaccgccagcagcagcgugcugagcagccccgccgccgacugcggccccgccggcagcgccaccaccuucaccaacccccugcugccccugaugagcgagcaguucaaggccaaguuccccuucggcggccugcuggacagcgcccaggccagcgagaccagcaagcugcagcagcugguggagaacaucgacaagaaggccaccgaccccaacgagugcaucaucugccacagagugcugagcugccagagcgcccugaagaugcacuacagaacccacaccggcgagagacccuucaagugcaagaucugcggcagagccuucaccaccaagggcaaccugaagacccacuacagcgugcacagagccaugcccccccugagagugcagcacagcugccccaucugccagaagaaguucaccaacgccguggugcugcagcagcacaucagaaugcacaugggcggccagauccccaacacccccgugcccgacagcuacagcgagagcauggagagcgacaccggcagcuucgacgagaagaacuucgacgaccuggacaacuucagcgacgagaacauggaggacugccccgagggcagcauccccgacacccccaagagcgccgacgccagccaggacagccugagcagcagcccccugccccuggagaugagcagcaucgccgcccuggagaaccagaugaagaugaucaacgccggccuggccgagcagcugcaggccagccugaagagcguggagaacggcagcaucgagggcgacgugcugaccaacgacagcagcagcgugggcggcgacauggagagccagagcgccggcagccccgccaucagcgagagcaccagcagcaugcaggcccugagccccagcaacagcacccaggaguuccacaagagccccagcaucgaggagaagccccagagagccgugcccagcgaguucgccaacggccugagccccacccccgugaacggcggcgcccuggaccugaccagcagccacgccgagaagaucaucaaggaggacagccugggcauccuguuccccuucagagacagaggcaaguucaagaacaccgccugcgacaucugcggcaagaccuucgccugccagagcgcccuggacauccacuacagaagccacaccaaggagagacccuucaucugcaccgugugcaacagaggcuucagcaccaagggcaaccugaagcagcacaugcugacccaccagaugagagaccugcccagccagcuguucgagcccagcagcaaccugggccccaaccagaacagcgccgugauccccgccaacagccugagcagccugaucaagaccgaggugaacggcuucgugcacgugagcccccaggacagcaaggacacccccaccagccacgugcccagcggcccccugagcagcagcgccaccagccccgugcugcugcccgcccugcccagaagaacccccaagcagcacuacugcaacaccugcggcaagaccuucagcagcagcagcgcccugcagauccacgagagaacccacaccggcgagaagcccuucgccugcaccaucugcggcagagccuucaccaccaagggcaaccugaaggugcacaugggcacccacauguggaacagcacccccgccagaagaggcagaagacugagcguggacggccccaugaccuuccugggcggcaaccccgugaaguuccccgagauguuccagaaggaccuggccgccagaagcggcagcggcgaccccagcagcuucuggaaccaguacgccgccgcccugagcaacggccuggccaugaaggccaacgagaucagcgugauccagaacggcggcaucccccccauccccggcagccugggcagcggcaacagcagccccgugagcggccugaccggcaaccuggagagacugcagaacagcgagcccaacgccccccuggccggccuggagaagauggccagcagcgagaacggcaccaacuucagauucaccagauucguggaggacagcaaggagaucgugaccagcuaa

SEQ ID NO: 22974 - RNA, 3024 nt, Artificial Sequence
  SALL2__Homo_sapiens__NP_005398
augagcagaagaaagcagagaaagccccagcagcugaucagcgacugcgagggccccagcgccagcgagaacggcgacgccagcgaggaggaccacccccaggugugcgccaagugcugcgcccaguucaccgaccccaccgaguuccuggcccaccagaacgccugcagcaccgacccccccgugauggugaucaucggcggccaggagaaccccaacaacagcagcgccagcagcgagcccagacccgagggccacaacaacccccaggugauggacaccgagcacagcaacccccccgacagcggcagcagcgugcccaccgaccccaccuggggccccgagagaagaggcgaggagagcagcggccacuuccugguggccgccaccggcaccgccgccggcggcggcggcggccugauccuggccagccccaagcugggcgccaccccccugccccccgagagcacccccgcccccccccccccccccccccccccccccccccccggcgugggcagcggccaccugaacaucccccugauccuggaggagcugagagugcugcagcagagacagauccaccagaugcagaugaccgagcagaucugcagacaggugcugcugcugggcagccugggccagaccgugggcgcccccgccagccccagcgagcugcccggcaccggcaccgccagcagcaccaagccccugcugccccuguucagccccaucaagcccgugcagaccagcaagacccuggccagcagcagcagcagcagcagcagcagcagcggcgccgagacccccaagcaggccuucuuccaccuguaccacccccugggcagccagcaccccuucagcgccggcggcgugggcagaagccacaagcccacccccgcccccagccccgcccugcccggcagcaccgaccagcugaucgccagcccccaccuggccuuccccagcaccaccggccugcuggccgcccagugccugggcgccgccagaggccuggaggccaccgccagccccggccugcugaagcccaagaacggcagcggcgagcugagcuacggcgaggugaugggcccccuggagaagcccggcggcagacacaagugcagauucugcgccaagguguucggcagcgacagcgcccugcagauccaccugagaagccacaccggcgagagacccuacaagugcaacgugugcggcaacagauucaccaccagaggcaaccugaaggugcacuuccacagacacagagagaaguacccccacgugcagaugaacccccaccccgugcccgagcaccuggacuacgugaucaccagcagcggccugcccuacggcaugagcgugccccccgagaaggccgaggaggaggccgccacccccggcggcggcguggagagaaagccccugguggccagcaccaccgcccugagcgccaccgagagccugacccugcugagcaccagcgccggcaccgccaccgcccccggccugcccgccuucaacaaguucgugcugaugaaggccguggagcccaagaacaaggccgacgagaacaccccccccggcagcgagggcagcgccaucagcggcguggccgagagcagcaccgccaccagaaugcagcugagcaagcuggugaccagccugcccagcugggcccugcugaccaaccacuucaagagcaccggcagcuuccccuuccccuacgugcuggagccccugggcgccagccccagcgagaccagcaagcugcagcagcugguggagaagaucgacagacagggcgccguggccgugaccagcgccgccagcggcgcccccaccaccagcgcccccgcccccagcagcagcgccagcagcggccccaaccagugcgugaucugccugagagugcugagcugccccagagcccugagacugcacuacggccagcacggcggcgagagacccuucaagugcaaggugugcggcagagccuucagcaccagaggcaaccugagagcccacuucgugggccacaaggccagccccgccgccagagcccagaacagcugccccaucugccagaagaaguucaccaacgccgugacccugcagcagcacgugagaaugcaccugggcggccagauccccaacggcggcaccgcccugcccgagggcggcggcgccgcccaggagaacggcagcgagcagagcaccgugagcggcgccagaagcuucccccagcagcagagccagcagcccagccccgaggaggagcugagcgaggaggaggaggaggaggacgaggaggaggaggaggacgugaccgacgaggacagccuggccggcagaggcagcgagagcggcggcgagaaggccaucagcgugagaggcgacagcgaggaggccagcggcgccgaggaggaggugggcaccguggccgccgccgccaccgccggcaaggagauggacagcaacgagaagaccacccagcagagcagccugccccccccccccccccccgacagccuggaccagccccagcccauggagcagggcagcagcggcgugcugggcggcaaggaggagggcggcaagcccgagagaagcagcagccccgccagcgcccugacccccgagggcgaggccaccagcgugacccugguggaggagcugagccugcaggaggccaugagaaaggagcccggcgagagcagcagcagaaaggccugcgaggugugcggccaggccuuccccagccaggccgcccuggaggagcaccagaagacccaccccaaggagggcccccuguucaccugcguguucugcagacagggcuuccuggagagagccacccugaagaagcacaugcugcuggcccaccaccaggugcagcccuucgccccccacggcccccagaacaucgccgcccugagccuggugcccggcugcagccccagcaucaccagcaccggccugagccccuuccccagaaaggacgaccccaccauccccuaa

SEQ ID NO: 22975 - RNA, 3903 nt, Artificial Sequence
  SALL3__Homo_sapiens__NP_741996
augagcagaagaaagcaggccaagccccagcaccugaagagcgacgaggagcugcugccccccgacggcgcccccgagcacgccgcccccggcgagggcgccgaggacgccgacagcggccccgagagcagaagcggcggcgaggagaccagcgugugcgagaagugcugcgccgaguucuucaagugggccgacuuccuggagcaccagagaagcugcaccaagcugccccccgugcugaucgugcacgaggacgcccccgcccccccccccgaggacuuccccgagcccagccccgccagcagccccagcgagagagccgagagcgaggccgccgaggaggccggcgccgagggcgccgagggcgaggccagacccguggagaaggaggccgagcccauggacgccgagcccgccggcgacaccagagcccccagacccccccccgccgcccccgccccccccacccccgccuacggcgcccccagcaccaacgugacccuggaggcccugcugagcaccaagguggccguggcccaguucagccagggcgccagagccgccggcggcagcggcgccggcggcggcguggccgccgccgccgugccccugauccuggagcagcugauggcccugcagcagcagcagauccaccagcugcagcugaucgagcagaucagaagccagguggcccugaugcagagacccccccccagacccagccugagccccgccgccgcccccagcgcccccggccccgcccccagccagcugcccggccuggccgcccugccccugagcgccggcgcccccgccgccgccaucgccggcagcggccccgccgcccccgccgccuucgagggcgcccagccccugagcagacccgagagcggcgccagcacccccggcggccccgccgagcccagcgcccccgccgcccccagcgccgcccccgcccccgccgcccccgcccccgcccccgccccccagagcgccgccagcagccagccccagagcgccagcaccccccccgcccuggcccccggcagccugcugggcgccgcccccggccugcccagcccccugcugccccagaccagcgccagcggcgugaucuuccccaacccccuggugagcaucgccgccaccgccaacgcccuggacccccugagcgcccugaugaagcacagaaagggcaagccccccaacgugagcguguucgagcccaaggccagcgccgaggaccccuucuucaagcacaagugcagauucugcgccaagguguucggcagcgacagcgcccugcagauccaccugagaagccacaccggcgagagacccuucaagugcaacaucugcggcaacagauucagcaccaagggcaaccugaaggugcacuuccagagacacaaggagaaguacccccacauccagaugaaccccuaccccgugcccgaguaccuggacaacgugcccaccugcagcggcauccccuacggcaugagccugccccccgagaagcccgugaccaccuggcuggacagcaagcccgugcugcccaccgugcccaccagcgugggccugcagcugccccccaccgugcccggcgcccacggcuacgccgacagccccagcgccacccccgccagcagaagcccccagagacccagccccgccagcagcgagugcgccagccugagccccggccugaaccacguggagagcggcgugagcgccaccgccgagagcccccagagccugcugggcggccccccccugaccaaggccgagcccgugagccugcccugcaccaacgccagagccggcgacgcccccgugggcgcccaggccagcgccgcccccaccagcguggacggcgcccccaccagccugggcagccccggccugcccgccgugagcgagcaguucaaggcccaguuccccuucggcggccugcuggacagcaugcagaccagcgagaccagcaagcugcagcagcugguggagaacaucgacaagaagaugaccgaccccaaccagugcgugaucugccacagagugcugagcugccagagcgcccugaagaugcacuacagaacccacaccggcgagagacccuucaagugcaagaucugcggcagagccuucaccaccaagggcaaccugaagacccacuucggcgugcacagagccaagcccccccugagagugcagcacagcugccccaucugccagaagaaguucaccaacgccguggugcugcagcagcacaucagaaugcacaugggcggccagauccccaacaccccccugcccgagggcuuccaggacgccauggacagcgagcuggccuacgacgacaagaacgccgagacccugagcagcuacgacgacgacauggacgagaacagcauggaggacgacgccgagcugaaggacgccgccaccgaccccgccaagccccugcugagcuacgccggcagcugcccccccagcccccccagcgugaucagcagcaucgccgcccuggagaaccagaugaagaugaucgacagcgugaugagcugccagcagcugaccggccugaagagcguggagaacggcagcggcgagagcgacagacugagcaacgacagcagcagcgccgugggcgaccuggagagcagaagcgccggcagccccgcccugagcgagagcagcagcagccaggcccugagccccgcccccagcaacggcgagagcuucagaagcaagagccccggccugggcgcccccgaggagccccaggagaucccccugaagaccgagagacccgacagccccgccgccgcccccggcagcggcggcgcccccggcagagccggcaucaaggaggaggcccccuucagccugcuguuccugagcagagagagaggcaagugccccagcaccgugugcggcgugugcggcaagcccuucgccugcaagagcgcccuggagauccacuacagaagccacaccaaggagagacccuucgugugcgcccugugcagaagaggcugcagcaccaugggcaaccugaagcagcaccugcugacccacagacugaaggagcugcccagccagcuguucgaccccaacuucgcccugggccccagccagagcacccccagccugaucagcagcgccgcccccaccaugaucaagauggaggugaacggccacggcaaggccauggcccugggcgagggccccccccugcccgccggcgugcaggugcccgccggcccccagaccgugaugggccccggccuggcccccaugcuggcccccccccccagaagaacccccaagcagcacaacugccagagcugcggcaagaccuucagcagcgccagcgcccugcagauccacgagagaacccacaccggcgagaagcccuucggcugcaccaucugcggcagagccuucaccaccaagggcaaccugaaggugcacaugggcacccacauguggaacaacgcccccgccagaagaggcagaagacugagcguggagaaccccauggcccugcugggcggcgacgcccugaaguucagcgagauguuccagaaggaccuggccgccagagccaugaacguggaccccagcuucuggaaccaguacgccgccgccaucaccaacggccuggccaugaagaacaacgagaucagcgugauccagaacggcggcaucccccagcugcccgugagccugggcggcagcgcccugcccccccugggcagcauggccagcggcauggacaaggccagaaccggcagcagcccccccaucgugagccuggacaaggccagcagcgagaccgccgccagcagacccuucaccagauucaucgaggacaacaaggagaucggcaucaacuaa

SEQ ID NO: 22976 - RNA, 3162 nt, Artificial Sequence
  SALL4__Homo_sapiens__NP_065169
augagcagaagaaagcaggccaagccccagcacaucaacagcgaggaggaccagggcgagcagcagccccagcagcagacccccgaguucgccgacgccgcccccgccgcccccgccgccggcgagcugggcgcccccgugaaccaccccggcaacgacgagguggccagcgaggacgaggccaccgugaagagacugagaagagaggagacccacgugugcgagaagugcugcgccgaguucuucagcaucagcgaguuccuggagcacaagaagaacugcaccaagaacccccccgugcugaucaugaacgacagcgagggccccgugcccagcgaggacuucagcggcgccgugcugagccaccagcccaccagccccggcagcaaggacugccacagagagaacggcggcagcagcgaggacaugaaggagaagcccgacgccgagagcgugguguaccugaagaccgagaccgcccugccccccaccccccaggacaucagcuaccuggccaagggcaagguggccaacaccaacgugacccugcaggcccugagaggcaccaagguggccgugaaccagagaagcgccgacgcccugcccgcccccgugcccggcgccaacagcauccccugggugcuggagcagauccugugccugcagcagcagcagcugcagcagauccagcugaccgagcagaucagaauccaggugaacaugugggccagccacgcccugcacagcagcggcgccggcgccgacacccugaagacccugggcagccacaugagccagcaggugagcgccgccguggcccugcugagccagaaggccggcagccagggccugagccuggacgcccugaagcaggccaagcugccccacgccaacauccccagcgccaccagcagccugagccccggccuggcccccuucacccugaagcccgacggcaccagagugcugcccaacgugaugagcagacugcccagcgcccugcugccccaggcccccggcagcgugcuguuccagagccccuucagcaccguggcccuggacaccagcaagaagggcaagggcaagccccccaacaucagcgccguggacgugaagcccaaggacgaggccgcccuguacaagcacaagugcaaguacugcagcaagguguucggcaccgacagcagccugcagauccaccugagaagccacaccggcgagagacccuucgugugcagcgugugcggccacagauucaccaccaagggcaaccugaaggugcacuuccacagacacccccaggugaaggccaacccccagcuguucgccgaguuccaggacaagguggccgccggcaacggcauccccuacgcccugagcgugcccgaccccaucgacgagcccagccugagccuggacagcaagcccgugcuggugaccaccagcgugggccugccccagaaccugagcagcggcaccaaccccaaggaccugaccggcggcagccugcccggcgaccugcagcccggccccagccccgagagcgagggcggccccacccugcccggcgugggccccaacuacaacagccccagagccggcggcuuccagggcagcggcacccccgagcccggcagcgagacccugaagcugcagcagcugguggagaacaucgacaaggccaccaccgaccccaacgagugccugaucugccacagagugcugagcugccagagcagccugaagaugcacuacagaacccacaccggcgagagacccuuccagugcaagaucugcggcagagccuucagcaccaagggcaaccugaagacccaccugggcgugcacagaaccaacaccagcaucaagacccagcacagcugccccaucugccagaagaaguucaccaacgccgugaugcugcagcagcacaucagaaugcacaugggcggccagauccccaacaccccccugcccgagaaccccugcgacuucaccggcagcgagcccaugaccgugggcgagaacggcagcaccggcgccaucugccacgacgacgugaucgagagcaucgacguggaggaggugagcagccaggaggcccccagcagcagcagcaaggugcccaccccccugcccagcauccacagcgccagccccacccugggcuucgccaugauggccagccuggacgcccccggcaaggugggccccgcccccuucaaccugcagagacagggcagcagagagaacggcagcguggagagcgacggccugaccaacgacagcagcagccugaugggcgaccaggaguaccagagcagaagccccgacauccuggagaccaccagcuuccaggcccugagccccgccaacagccaggccgagagcaucaagagcaagagccccgacgccggcagcaaggccgagagcagcgagaacagcagaaccgagauggagggcagaagcagccugcccagcaccuucaucagagccccccccaccuacgugaagguggaggugcccggcaccuucgugggccccagcacccugagccccggcaugaccccccugcuggccgcccagcccagaagacaggccaagcagcacggcugcaccagaugcggcaagaacuucagcagcgccagcgcccugcagauccacgagagaacccacaccggcgagaagcccuucgugugcaacaucugcggcagagccuucaccaccaagggcaaccugaaggugcacuacaugacccacggcgccaacaacaacagcgccagaagaggcagaaagcuggccaucgagaacaccauggcccugcugggcaccgacggcaagagagugagcgagaucuuccccaaggagauccuggcccccagcgugaacguggaccccgugguguggaaccaguacaccagcaugcugaacggcggccuggccgugaagaccaacgagaucagcgugauccagagcggcggcgugcccacccugcccgugagccugggcgccaccagcguggugaacaacgccaccgugagcaagauggacggcagccagagcggcaucagcgccgacguggagaagcccagcgccaccgacggcgugcccaagcaccaguucccccacuuccuggaggagaacaagaucgccgugagcuaa

SEQ ID NO: 22977 - RNA, 1338 nt, Artificial Sequence
  SAMD14__Homo_sapiens__NP_777580
auggccagcagcaagcugagagagcccguggacgagguguucgaccuggaccuggccgugcccgagaccgccagacuggacagcagccugcacaaggccagagcccagcugcuggccaagggcagaagacacagacccagcagaagcagacugagagacagcgccagcagcgccgaggacggcgagggcagcgacggccccggcggcaaggugaccgacggcugcggcagcccccugcacagacugagaagcccccugcacagcggccccggcagccccgccggcggcagcuucugccuggacccccccggccugagaagaagccuggacgaggacgagcccccccccagcccccugaccagauacagaccccugcacaacgccgccagccacgagggccuggccgccgccagcugcagcccccccagaagcgcccccagcagcgacagcagccccagcuucgugagaagacaccccagagccgagccccacagcgaggacgacagcagagacgccagcccccccgagcccgccagccccaccaucggccuggacaagaagaccagaagaaaguuccuggaccugggcgugacccugagaagagccagcaccggcaagagcagaaaggagaagggcagcaacagacugagcaugggcagcagagagagcguggagggcagcggcagaagcggcggcagccccuuccugcccuucagcugguucaccgacagcggcaagggcagcgccagcagcggcagcaccaccagccccaccugcagccccaagcacgagggcuucagccccaagaagagcgccagccaggcccagcugcuggcccacgcccaggaggcccugagcaacagcuggugccuggugcaggacuucggcagcacccagaucggcauggagagcacccugagcgacgacagcaccccccccagcagcagccccaagauccccagcggccccuggcaggaggccaagugcagcuaccccuaccacacccugagccagagcagcgacgaguuccuggacgagccccugccccccgugcaccacuggaccagccagcaggugggccaguggcugcagagccugaaccuggagcaguacgccgccgaguucgccgccagacagguggacggcccccagcugcugcagcuggacggcagcaagcugaagagccugggccugagcaacagccacgacagagcccuggugaagagaaagcugaaggagauggccgccgccgccgagaaggagagaaaggcccaggagaaggccgccagacagagagagaagcugagaagaagagagcaggaggccaagaagagcuaa

SEQ ID NO: 22978 - RNA, 1617 nt, Artificial Sequence
  SAMD1__Homo_sapiens__NP_612361
auggccggcccccccgcccugcccccccccgagaccgccgccgccgccaccaccgccgccgccgccagcagcagcgccgccagcccccacuaccaggaguggauccuggacaccaucgacagccugagaagcagaaaggccagacccgaccuggagagaaucugcagaauggugagaagaagacacggccccgagcccgagagaaccagagccgagcuggagaagcugauccagcagagagccgugcugagagugagcuacaagggcagcaucagcuacagaaacgccgccagagugcagccccccagaagaggcgccaccccccccgccccccccagagcccccagaggcgcccccgccgccgccgccgccgccgcccccccccccacccccgcccccccccccccccccgcccccguggccgccgccgcccccgccagagcccccagagccgccgccgccgccgccaccgccccccccagccccggccccgcccagcccggccccagagcccagagagccgccccccuggccgcccccccccccgcccccgccgccccccccgccguggccccccccgccggccccagaagagcccccccccccgccguggccgccagagagcccccccugcccccccccccccagccccccgcccccccccagcagcagcagcccccccccccccagccccagcccccccccgagggcggcgccgugagagccggcggcgccgccagacccgugagccugagagagguggugagauaccugggcggcagcggcggcgccggcggcagacugaccagaggcagagugcagggccugcuggaggaggaggccgccgccagaggcagacuggagagaaccagacugggcgcccuggcccugcccagaggcgacagacccggcagagccccccccgccgccagcgccagacccagcagaagcaagagaggcggcgaggagagagugcuggagaaggaggaggaggaggacgacgacgaggacgaggacgaggaggacgacgugagcgagggcagcgaggugcccgagagcgacagacccgccggcgcccagcaccaccagcugaacggcgagagaggcccccagagcgccaaggagagagugaaggaguggacccccugcggcccccaccagggccaggacgagggcagaggccccgcccccggcagcggcaccagacagguguucagcauggccgccaugaacaaggagggcggcaccgccagcguggccaccggccccgacagccccagccccgugccccugccccccggcaagcccgcccugcccggcgccgacggcacccccuucggcugcccccccggcagaaaggagaagcccagcgaccccguggaguggaccgugauggacgugguggaguacuucaccgaggccggcuuccccgagcaggccaccgccuuccaggagcaggagaucgacggcaagagccugcugcugaugcagagaaccgacgugcugaccggccugagcaucagacugggccccgcccugaagaucuacgagcaccacaucaaggugcugcagcagggccacuucgaggacgacgaccccgacggcuuccugggcuaa

SEQ ID NO: 22979 - RNA, 1893 nt, Artificial Sequence
  SAMD4A__Homo_sapiens__NP_001155048
augauguucagagaccaggugggcgugcuggccggcugguucaagggcuggaacgagugcgagcagaccguggcccugcugagccugcugaagagagugagccagacccaggccagauuccugcagcugugccuggagcacagccuggccgacugcgccgagcugcacgugcuggagagagaggccaacagccccggcaucaucaaccaguggcagcaggagagcaaggacaaggugaucagccugcugcugacccaccugccccugcugaagcccggcaaccuggacgccaagguggaguacaugaagcugcugcccaagauccuggcccacagcaucgagcacaaccagcacaucgaggagagcagacagcugcugagcuacgcccugauccaccccgccaccagccuggaggacagaagcgcccuggccauguggcugaaccaccuggaggacagaaccagcaccagcuucggcggccagaacagaggcagaagcgacagcguggacuacggccagacccacuacuaccaccagagacagaacagcgacgacaagcugaacggcuggcagaacagcagagacagcggcaucugcaucaacgccagcaacuggcaggacaagagcaugggcugcgagaacggccacgugccccuguacagcagcagcagcgugcccaccaccaucaacaccaucggcaccagcaccagcaccaacgugcccgccuggcugaagagccugagacugcacaaguacgccgcccuguucagccagaugaccuacgaggagaugauggcccugaccgagugccagcuggaggcccagaacgugaccaagggcgccagacacaagaucgugaucagcauccagaagcugaaggagagacagaaccugcugaagagccuggagagagacaucaucgagggcggcagccugagaaucccccugcaggagcugcaccagaugauccugacccccaucaaggccuacagcagccccagcaccacccccgaggccagaagaagagagccccaggcccccagacagcccagccugaugggccccgagagccagagccccgacugcaaggacggcgccgccgccaccggcgccaccgccacccccagcgccggcgccagcggcggccugcagccccaccagcugagcagcugcgacggcgagcuggccguggccccccugcccgagggcgaccugcccggccaguucaccagagugaugggcaaggugugcacccagcugcuggugagcagacccgacgaggagaacaucagcagcuaccugcagcugaucgacaagugccugauccacgaggccuucaccgagacccagaagaagagacugcugagcuggaagcagcaggugcagaagcuguucagaagcuuccccagaaagacccugcuggacaucagcggcuacagacagcagagaaacagaggcuucggccagagcaacagccugcccaccgccggcagcgugggcggcggcaugggcagaagaaaccccagacaguaccagauccccagcagaaacgugcccagcgccagacugggccugcugggcaccagcggcuucgugagcagcaaccagagaaacaccaccgccacccccaccaucaugaagcagggcagacagaaccugugguucgccaaccccggcggcagcaacagcaugcccagcagaacccacagcagcgugcagagaaccagaagccugcccgugcacaccagcccccagaacaugcugauguuccagcagcccgaguuccagcugcccgugaccgagcccgacaucaacaacagacuggagagccugugccugagcaugaccgagcacgcccugggcgacggcguggacagaaccagcaccaucuaa

SEQ ID NO: 22980 - RNA, 522 nt, Artificial Sequence
  SAMD5__Homo_sapiens__NP_001025231
augugcaccaacaucguguacgaguggcugaaggcccugcagcugccccaguacgccgagagcuucguggacaacggcuacgacgaccuggaggugugcaagcagaucggcgaccccgaccuggacgccaucggcgugcuggcccccgcccacagaagaagaauccuggaggccgugagaagacugagagagcaggacgccaacgccgccggccuguacuucacccuggagccccagcccgccccccccggcccccccgccgacgccgugcccaccggcagaagaggcgagcccugcggcggccccgcccagggcaccagaggcgacagcagaggccacaccaccgcccccagaagcagagagcuggugagcuaccccaagcugaagcugaagaucaugaucagagacaagcuggugagagacggcauccaccugagcaagccccccuacagcagaaaggugcccauggccggcauccuggaguaccugaugaacuggcccaagagcagccagagcagauaa

SEQ ID NO: 22981 - RNA, 4770 nt, Artificial Sequence
  SAMD9__Homo_sapiens__NP_060124
auggccaagcagcugaaccugcccgagaacaccgacgacuggaccaaggaggacgugaaccaguggcuggagagccacaagaucgaccagaagcacagagagauccugaccgagcaggacgugaacggcgccgugcugaaguggcugaagaaggagcaccugguggacaugggcaucacccacggccccgccauccagaucgaggagcuguucaaggagcugagaaagaccgccaucgaggacagcauccagaccagcaagaugggcaagcccagcaagaacgcccccaaggaccagaccgugagccagaaggagagaagagagaccagcaagcagaagcagaagggcaaggagaaccccgacauggccaaccccagcgccaugagcaccaccgccaagggcagcaagagccugaagguggagcugaucgaggacaagaucgacuacaccaaggagagacagcccagcaucgaccugaccugcgugagcuaccccuucgacgaguucagcaaccccuacagauacaagcuggacuucagccugcagcccgagaccggccccggcaaccugaucgaccccauccacgaguucaaggccuucaccaacaccgccaccgccaccgaggaggacgugaagaugaaguucagcaacgagguguucagauucgccagcgccugcaugaacagcagaaccaacggcaccauccacuucggcgugaaggacaagccccacggcaagaucgugggcaucaaggugaccaacgacaccaaggaggcccugaucaaccacuucaaccugaugaucaacaaguacuucgaggaccaccaggugcagcaggccaagaagugcaucagagagcccagauucguggaggugcugcugcccaacagcacccugagcgacagauucgugaucgagguggacaucaucccccaguucagcgagugccaguacgacuacuuccagaucaagaugcagaacuacaacaacaagaucugggagcagagcaagaaguucagccuguucgugagagacggcaccagcagcaaggacaucaccaagaacaagguggacuucagagccuucaaggccgacuucaagacccuggccgagagcagaaaggccgccgaggagaaguucagagccaagaccaacaagaaggagagagagggccccaagcuggugaagcugcugaccggcaaccaggaccugcuggacaacagcuacuacgagcaguacauccuggugaccaacaagugccaccccgaccagaccaagcaccuggacuuccugaaggagaucaagugguucgccgugcuggaguucgaccccgagagcaacaucaacggcguggugaaggccuacaaggagagcagaguggccaaccugcacuuccccagcguguacguggagcagaagaccacccccaacgagaccaucagcacccugaaccuguaccaccagcccagcuggaucuucugcaacggcagacuggaccuggacagcgagaaguacaagcccuucgaccccagcagcuggcagagagagagagccagcgacgugagaaagcugaucagcuuccugacccacgaggacaucaugcccagaggcaaguuccuggugguguuccugcugcugagcagcguggacgaccccagagacccccugaucgagaccuucugcgccuucuaccaggaccugaagggcauggagaacauccugugcaucugcgugcacccccacaucuuccagggcuggaaggaccugcuggaggccagacugaucaagcaccaggacgagaucagcagccagugcaucagcgcccugagccuggaggagaucaacggcaccauccugaagcugaagagcgugacccagagcagcaagagacugcugcccagcaucggccugagcaccgugcugcugaagaaggaggaggacaucaugaccgcccuggagaucaucugcgagaacgagugcgagggcacccugcuggagaaggacaagaacaaguuccuggaguucaaggccagcaaggaggaggacuucuacagaggcggcaaggugagcugguggaacuucuacuucagcagcgagagcuacagcagccccuucgugaagagagacaaguacgagagacuggaggccaugauccagaacugcgccgacagcagcaagcccaccagcaccaagaucauccaccuguaccaccaccccggcugcggcggcaccacccuggccaugcacauccugugggagcugagaaagaaguucagaugcgccgugcugaagaacaagaccguggacuucagcgagaucggcgagcaggugaccagccugaucaccuacggcgccaugaacagacaggaguacgugcccgugcugcugcugguggacgacuucgaggagcaggacaacguguaccugcugcaguacagcauccagaccgccaucgccaagaaguacaucagauacgagaagccccuggugaucauccugaacugcaugagaagccagaaccccgagaagagcgccagaauccccgacagcaucgccgugauccagcagcugagccccaaggagcagagagccuucgagcugaagcugaaggagaucaaggagcagcacaagaacuucgaggacuucuacagcuucaugaucaugaagaccaacuucaacaaggaguacaucgagaacguggugagaaacauccugaagggccagaacaucuucaccaaggaggccaagcuguucagcuuccuggcccugcugaacagcuacgugcccgacaccaccaucagccugagccagugcgagaaguuccugggcaucggcaacaagaaggccuucuggggcaccgagaaguucgaggacaagaugggcaccuacagcaccauccugaucaagaccgaggugaucgagugcggcaacuacugcggcgugagaaucauccacagccugaucgccgaguucagccuggaggagcugaagaagagcuaccaccugaacaagagccagaucaugcuggacaugcugaccgagaaccuguucuucgacaccggcaugggcaagagcaaguuccugcaggacaugcacacccugcugcugaccagacacagagacgagcacgagggcgagaccggcaacugguucagccccuucaucgaggcccugcacaaggacgagggcaacgaggccguggaggccgugcugcuggagagcauccacagauucaaccccaacgccuucaucugccaggcccuggccagacacuucuacaucaagaagaaggacuucggcaacgcccugaacugggccaagcaggccaagaucaucgagcccgacaacagcuacaucagcgacacccugggccagguguacaagagcaagaucagaugguggaucgaggagaacggcggcaacggcaacaucagcguggacgaccugaucgcccugcuggaccuggccgagcacgccagcagcgccuucaaggagagccagcagcagagcgaggacagagaguacgaggugaaggagagacuguaccccaagagcaagagaagauacgacaccuacaacaucgccggcuaccagggcgagaucgaggugggccuguacaccauccagauccugcagcugauccccuucuucgacaacaagaacgagcugagcaagagauacauggugaacuucgugagcggcagcagcgacauccccggcgaccccaacaacgaguacaagcuggcccugaagaacuacauccccuaccugaccaagcugaaguucagccugaagaagagcuucgacuucuucgacgaguacuucgugcugcugaagcccagaaacaacaucaagcagaacgaggaggccaagaccagaagaaagguggccggcuacuucaagaaguacguggacaucuucugccugcuggaggagagccagaacaacaccggccugggcagcaaguucagcgagccccugcagguggagagaugcagaagaaaccugguggcccugaaggccgacaaguucagcggccugcuggaguaccugaucaagagccaggaggacgccaucagcaccaugaagugcaucgugaacgaguacaccuuccugcuggagcagugcaccgugaagauccagagcaaggagaagcugaacuucauccuggccaacaucauccugagcugcauccagcccaccagcagacuggugaagcccguggagaagcugaaggaccagcugagagaggugcugcagcccaucggccugaccuaccaguucagcgagcccuacuuccuggccagccugcuguucuggcccgagaaccagcagcuggaccagcacagcgagcagaugaaggaguacgcccaggcccugaagaacagcuucaagggccaguacaagcacaugcacagaaccaagcagcccaucgccuacuucuuccugggcaagggcaagagacuggagagacuggugcacaagggcaagaucgaccagugcuucaagaagacccccgacaucaacagccuguggcagagcggcgacguguggaaggaggagaaggugcaggagcugcugcugagacugcagggcagagccgagaacaacugccuguacaucgaguacggcaucaacgagaagaucaccauccccaucacccccgccuuccugggccagcugagaagcggcagaagcaucgagaaggugagcuucuaccugggcuucagcaucggcggcccccuggccuacgacaucgagaucguguaa

SEQ ID NO: 22982 - RNA, 4755 nt, Artificial Sequence
  SAMD9L__Homo_sapiens__NP_001290426
augagcaagcaggugagccugcccgagaugaucaaggacuggaccaaggagcacgugaagaagugggugaacgaggaccugaagaucaacgagcaguacggccagauccugcugagcgaggaggugaccggccuggugcugcaggagcugaccgagaaggaccugguggagaugggccugcccuggggccccgcccugcugaucaagagaagcuacaacaagcugaacagcaagagccccgagagcgacaaccacgaccccggccagcuggacaacagcaagcccagcaagaccgagcaccagaagaaccccaagcacaccaagaaggaggaggagaacagcaugagcagcaacaucgacuacgaccccagagagaucagagacaucaagcaggaggagagcauccugaugaaggagaacgugcuggacgagguggccaacgccaagcacaagaagaagggcaagcugaagcccgagcagcugaccugcaugcccuaccccuucgaccaguuccacgacagccacagauacaucgagcacuacacccugcagcccgagaccggcgcccugaaccugaucgaccccauccacgaguucaaggcccugaccaacaccgagaccgccaccgagguggacaucaagaugaaguucagcaacgagguguucagauucgccagcgccugcaugaacagcagaaccaacggcaccauccacuucggcgugaaggacaagccccacggcgagaucgugggcgugaagaucaccagcaaggccgccuucaucgaccacuucaacgugaugaucaagaaguacuucgaggagagcgagaucaacgaggccaagaagugcaucagagagcccagauucguggaggugcugcugcagaacaacacccccagcgacagauucgugaucgagguggacaccauccccaagcacagcaucugcaacgacaaguacuucuacauccagaugcagaucugcaaggacaagaucuggaagcagaaccagaaccugagccuguucgugagagagggcgccagcagcagagacauccuggccaacagcaagcagagagacguggacuucaaggccuuccugcagaaccugaagagccugguggccagcagaaaggaggccgaggaggaguacggcaugaaggccaugaagaaggagagcgagggccugaagcuggugaagcugcugaucggcaacagagacagccuggacaacagcuacuacgacugguacauccuggugaccaacaagugccaccccaaccagaucaagcaccuggacuuccugaaggagaucaagugguucgccgugcuggaguucgaccccgagagcaugaucaacggcguggugaaggccuacaaggagagcagaguggccaaccugcacuuccccaaccaguacgaggacaagaccaccaacaugugggagaagaucagcacccugaaccuguaccagcagcccagcuggaucuucugcaacggcagaagcgaccugaagagcgagaccuacaagccccuggagccccaccuguggcagagagagagagccagcgaggugagaaagcugauccuguuccugaccgacgagaacaucaugaccagaggcaaguuccuggugguguuccugcugcugagcagcguggagagccccggcgacccccugaucgagaccuucugggccuucuaccaggcccugaagggcauggagaacaugcugugcaucagcgugaacagccacaucuaccagagauggaaggaccugcugcagaccagaaugaagauggaggacgagcugaccaaccacagcaucagcacccugaacaucgagcuggugaacagcaccauccugaagcugaagagcgugaccagaagcagcagaagauuccugcccgccagaggcagcagcagcgugauccuggagaagaagaaggaggacgugcugaccgcccuggagauccugugcgagaacgagugcaccgagaccgacaucgagaaggacaagagcaaguuccuggaguucaagaagagcaaggaggagcacuucuacagaggcggcaaggugagcugguggaacuucuacuucagcagcgagaacuacagcagcgacuucgugaagagagacagcuacgagaagcugaaggaccugauccacugcugggccgagagccccaagcccaucuucgccaagaucaucaaccuguaccaccaccccggcugcggcggcaccacccuggccaugcacgugcugugggaccugaagaagaacuucagaugcgccgugcugaagaacaagaccaccgacuucgccgagaucgccgagcaggugaucaaccuggugaccuacagagccaagagccaccaggacuacauccccgugcugcugcugguggacgacuucgaggagcaggagaacguguacuuccugcagaacgccauccacagcgugcuggccgagaaggaccugagauacgagaagacccuggugaucauccugaacugcaugagaagcagaaaccccgacgagagcgccaagcuggccgacagcaucgcccugaacuaccagcugagcagcaaggagcagagagccuucggcgccaagcugaaggagaucgagaagcagcacaagaacugcgagaacuucuacagcuucaugaucaugaagagcaacuucgacgagaccuacaucgagaacguggugagaaacauccugaagggccaggacguggacagcaaggaggcccagcugaucagcuuccuggcccugcugagcagcuacgugaccgacagcaccaucagcgugagccagugcgagaucuuccugggcaucaucuacaccagcacccccugggagcccgagagccuggaggacaagaugggcaccuacagcacccugcugaucaagaccgagguggccgaguacggcagauacaccggcgugagaaucauccacccccugaucgcccuguacugccugaaggagcuggagagaagcuaccaccuggacaagugccagaucgcccugaacauccuggaggagaaccuguucuacgacagcggcaucggcagagacaaguuccagcacgacgugcagacccugcugcugaccagacagagaaagguguacggcgacgagaccgacacccuguucagcccccugauggaggcccugcagaacaaggacaucgagaaggugcugagcgccggcagcagaagauucccccagaacgccuucaucugccaggcccuggccagacacuucuacaucaaggagaaggacuucaacaccgcccuggacugggccagacaggccaagaugaaggcccccaagaacagcuacaucagcgacacccugggccagguguacaagagcgagaucaagugguggcuggacggcaacaagaacugcagaagcaucaccgugaacgaccugacccaccugcuggaggccgccgagaaggccagcagagccuucaaggagagccagagacagaccgacagcaagaacuacgagaccgagaacuggagcccccagaagagccagagaagauacgacauguacaacaccgccugcuuccugggcgagaucgaggugggccuguacaccauccagauccugcagcugacccccuucuuccacaaggagaacgagcugagcaagaagcacauggugcaguuccugagcggcaaguggaccaucccccccgaccccagaaacgagugcuaccuggcccugagcaaguucaccagccaccugaagaaccugcagagcgaccugaagagaugcuucgacuucuucaucgacuacauggugcugcugaagaugagauacacccagaaggagaucgccgagaucaugcugagcaagaaggugagcagaugcuucagaaaguacaccgagcuguucugccaccuggaccccugccugcugcagagcaaggagagccagcugcugcaggaggagaacugcagaaagaagcuggaggcccugagagccgacagauucgccggccugcuggaguaccugaaccccaacuacaaggacgccaccaccauggagagcaucgugaacgaguacgccuuccugcugcagcagaacagcaagaagcccaugaccaacgagaagcagaacagcauccuggccaacaucauccugagcugccugaagcccaacagcaagcugauccagccccugaccacccugaagaagcagcugagagaggugcugcaguucgugggccugagccaccaguaccccggccccuacuuccuggccugccugcuguucuggcccgagaaccaggagcuggaccaggacagcaagcugaucgagaaguacgugagcagccugaacagaagcuucagaggccaguacaagagaaugugcagaagcaagcaggccagcacccuguucuaccugggcaagagaaagggccugaacagcaucgugcacaaggccaagaucgagcaguacuucgacaaggcccagaacaccaacagccuguggcacagcggcgacguguggaagaagaacgaggugaaggaccugcugagaagacugaccggccaggccgagggcaagcugaucagcguggaguacggcaccgaggagaagaucaagauccccgugaucagcguguacagcggcccccugagaagcggcagaaacaucgagagagugagcuucuaccugggcuucagcaucgagggcccccuggccuacgacaucgaggugaucuaa

SEQ ID NO: 22983 - RNA, 1881 nt, Artificial Sequence
  SAMHD1__Homo_sapiens__NP_056289
augcagagagccgacagcgagcagcccagcaagagacccagaugcgacgacagccccagaacccccagcaacacccccagcgccgaggccgacuggagccccggccuggagcugcaccccgacuacaagaccuggggccccgagcaggugugcagcuuccugagaagaggcggcuucgaggagcccgugcugcugaagaacaucagagagaacgagaucaccggcgcccugcugcccugccuggacgagagcagauucgagaaccugggcgugagcagccugggcgagagaaagaagcugcugagcuacauccagagacuggugcagauccacguggacaccaugaaggugaucaacgaccccauccacggccacaucgagcugcacccccugcuggugagaaucaucgacaccccccaguuccagagacugagauacaucaagcagcugggcggcggcuacuacguguuccccggcgccagccacaacagauucgagcacagccugggcgugggcuaccuggccggcugccuggugcacgcccugggcgagaagcagcccgagcugcagaucagcgagagagacgugcugugcgugcagaucgccggccugugccacgaccugggccacggccccuucagccacauguucgacggcagauucaucccccuggccagacccgaggugaaguggacccacgagcagggcagcgugaugauguucgagcaccugaucaacagcaacggcaucaagcccgugauggagcaguacggccugauccccgaggaggacaucugcuucaucaaggagcagaucgugggcccccuggagagccccguggaggacagccuguggcccuacaagggcagacccgagaacaagagcuuccuguacgagaucgugagcaacaagagaaacggcaucgacguggacaagugggacuacuucgccagagacugccaccaccugggcauccagaacaacuucgacuacaagagauucaucaaguucgccagagugugcgagguggacaacgagcugagaaucugcgccagagacaaggaggugggcaaccuguacgacauguuccacaccagaaacagccugcacagaagagccuaccagcacaaggugggcaacaucaucgacaccaugaucaccgacgccuuccugaaggccgacgacuacaucgagaucaccggcgccggcggcaagaaguacagaaucagcaccgccaucgacgacauggaggccuacaccaagcugaccgacaacaucuuccuggagauccuguacagcaccgaccccaagcugaaggacgccagagagauccugaagcagaucgaguacagaaaccuguucaaguacgugggcgagacccagcccaccggccagaucaagaucaagagagaggacuacgagagccugcccaaggagguggccagcgccaagcccaaggugcugcuggacgugaagcugaaggccgaggacuucaucguggacgugaucaacauggacuacggcaugcaggagaagaaccccaucgaccacgugagcuucuacugcaagaccgcccccaacagagccaucagaaucaccaagaaccaggugagccagcugcugcccgagaaguucgccgagcagcugaucagaguguacugcaagaagguggacagaaagagccuguacgccgccagacaguacuucgugcaguggugcgccgacagaaacuucaccaagccccaggacggcgacgugaucgccccccugaucaccccccagaagaaggaguggaacgacagcaccagcgugcagaaccccaccagacugagagaggccagcaagagcagagugcagcuguucaaggacgaccccauguaa

SEQ ID NO: 22984 - RNA, 1410 nt, Artificial Sequence
  SAMM50__Homo_sapiens__NP_056195
augggcaccgugcacgccagaagccuggagccccugcccagcagcggccccgacuucggcggccugggcgaggaggccgaguucguggagguggagcccgaggccaagcaggagauccuggagaacaaggacgugguggugcagcacgugcacuucgacggccugggcagaaccaaggacgacaucaucaucugcgagaucggcgacguguucaaggccaagaaccugaucgaggugaugagaaagagccacgaggccagagagaagcugcugagacugggcaucuucagacagguggacgugcugaucgacaccugccagggcgacgacgcccugcccaacggccuggacgugaccuucgaggugaccgagcugagaagacugaccggcagcuacaacaccauggugggcaacaacgagggcagcauggugcugggccugaagcugcccaaccugcugggcagagccgagaaggugaccuuccaguucagcuacggcaccaaggagaccagcuacggccugagcuucuucaagcccagacccggcaacuucgagagaaacuucagcgugaaccuguacaaggugaccggccaguuccccuggagcagccugagagagaccgacagaggcaugagcgccgaguacagcuuccccaucuggaagaccagccacaccgugaagugggagggcguguggagagagcugggcugccugagcagaaccgccagcuucgccgugagaaaggagagcggccacagccugaagagcagccugagccacgccauggugaucgacagcagaaacagcagcauccugcccagaagaggcgcccugcugaaggugaaccaggagcuggccggcuacaccggcggcgacgugagcuucaucaaggaggacuucgagcugcagcugaacaagcagcugaucuucgacagcguguucagcgccagcuucuggggcggcaugcuggugcccaucggcgacaagcccagcagcaucgccgacagauucuaccugggcggccccaccagcaucagaggcuucagcaugcacagcaucggcccccagagcgagggcgacuaccugggcggcgaggccuacugggccggcggccugcaccuguacaccccccugcccuucagacccggccagggcggcuucggcgagcuguucagaacccacuucuuccugaacgccggcaaccugugcaaccugaacuacggcgagggccccaaggcccacaucagaaagcuggccgagugcaucagauggagcuacggcgccggcaucgugcugagacugggcaacaucgccagacuggagcugaacuacugcgugcccaugggcgugcagaccggcgacagaaucugcgacggcgugcaguucggcgccggcaucagauuccuguaa

SEQ ID NO: 22985 - RNA, 1326 nt, Artificial Sequence
  SAMSN1__Homo_sapiens__NP_001243299
auggagaucagacuggacacccugagcgccagccugggcagaagcagcacccugaacaacugcaaccuggaggacaagcuggccugguacgagggcgaggccuacauguggcaccacuggaagcccuuccccgagaacccccuguggaccugccuggacuuccagaucgcccaggugggccccugggaccacugcagcagcugcaucagacacaccagacugaagagcagcugcagcgacauggaccugcugcacagcuggagaagcagcagcuucggcaacuucgacagauucagaaacaacagccugagcaagcccgacgacagcaccgaggcccacgagggcgaccccaccaacggcagcggcgagcagagcaagaccagcaacaacggcggcggccugggcaagaagaugagagccaucagcuggaccaugaagaagaaggugggcaagaaguacaucaaggcccugagcgaggagaaggacgaggaggacggcgagaacgcccaccccuacagaaacagcgaccccgugaucggcacccacaccgagaaggugagccugaaggccagcgacagcauggacagccuguacagcggccagagcagcagcagcggcaucaccagcugcagcgacggcaccagcaacagagacagcuucagacuggacgacgacggccccuacagcggccccuucugcggcagagccagagugcacaccgacuucacccccagccccuacgacaccgacagccugaagaucaagaagggcgacaucaucgacaucaucugcaagacccccaugggcauguggaccggcaugcugaacaacaaggugggcaacuucaaguucaucuacguggacgugaucagcgaggaggaggccgcccccaagaagaucaaggccaacagaagaagcaacagcaagaagagcaagacccugcaggaguuccuggagagaauccaccugcaggaguacaccagcacccugcugcugaacggcuacgagacccuggaggaccugaaggacaucaaggagagccaccugaucgagcugaacaucgagaaccccgacgacagaagaagacugcugagcgccgccgagaacuuccuggaggaggagaucauccaggagcaggagaacgagcccgagccccugagccugagcagcgacaucagccugaacaagagccagcuggacgacugccccagagacagcggcugcuacaucagcagcggcaacagcgacaacggcaaggaggaccuggagagcgagaaccugagcgacauggugcacaagaucaucaucaccgagcccagcgacuaa

SEQ ID NO: 22986 - RNA, 879 nt, Artificial Sequence
  SAP30BP__Homo_sapiens__NP_001288768
auggccggcaagaagaacgugcugagcagccuggccguguacgccgaggacagcgagcccgagagcgacggcgaggccggcaucgaggccgugggcagcgccgccgaggagaagggcggccuggugagcgacgccuacggcgaggacgacuucagcagacugggcggcgacgaggacggcuacgaggaggaggaggacgagaacagcagacagagcgacaacaccgaggccgagaagagagacccccaggagcugguggccagcuucagcgagagagugagaaacaugagccccgacgagaucaagaucccccccgagccccccggcagaugcagcaaccaccugcaggacaagauccagaagcuguacgagagaaagaucaaggagggcauggacaugaacuacaucauccagagaaagaaggaguucagaaaccccagcaucuacgagaagcugauccaguucugcgccaucgacgagcugggcaccaacuaccccaaggacauguucgacccccacggcuggagcgaggacagcuacuacgaggcccuggccaaggcccagaagaucgagauggacaagcuggagaaggccaagaaggagagaaccaagaucgaguucgugaccggcaccaagaagggcaccaccaccaacgccaccagcaccaccaccaccaccgccagcaccgccguggccgacgcccagaagagaaagagcaagugggacagcgccauccccgugaccaccaucgcccagcccaccauccugaccaccaccgccacccugcccgccguggugaccgugaccaccagcgccagcggcagcaagaccaccgugaucagcgccgugggcaccaucgugaagaaggccaagcaguaa

SEQ ID NO: 22987 - RNA, 429 nt, Artificial Sequence
  SAP30L__Homo_sapiens__NP_001124534
augaacggcuucagcaccgaggaggacagcagagagggcccccccgccgcccccgccgccgccgcccccggcuacggccagagcugcugccugaucgaggacggcgagagaugcgugagacccgccggcaacgccagcuucagcaagagagugcagaagagcaucagccagaagaagcugaagcuggacaucgacaagagcguggaccuguuccagcugcaggugaacacccugagaagauacaagagacacuacaagcugcagaccagacccggcuucaacaaggcccagcuggccgagaccgugagcagacacuucagaaacauccccgugaacgagaaggagacccuggccuacuucaucuacauggugaagagcaacaagagcagacuggaccagaagagcgagggcggcaagcagcuggaguaa

SEQ ID NO: 22988 - RNA, 537 nt, Artificial Sequence
  SAPCD1__Homo_sapiens__NP_001034740
augggcagccagggcagcggcggcgugccccuggugcaggcccccuacaccgugcugcugcugccccugggcaccagcagacaggaccccggcgcccagagcuucuuccuguggcugagaagaaugcaggcccuggagagagagcaggacgcccuguggcagggccuggagcugcugcagcacggccaggccugguucgaggaccaccugagagaggcccagagacagcagcugcaccugggcgcccugggcgagaacuuccugaccgaccugcacagcgagcccggcagacccccccuggcccagauccagaaggugaacaucugccugcagaaccugauccacgagaaguucagccccagcccccugaacaaggccagcagcugcaccacccaggacagcaaggagagaagaagagagcagaaccuguggcagcagcaggagcugagcagacagcagaagggcgugacccagcccaaggaggagauggcccagagaggcugcaccaagggccccagaggccccaccagaguguaa

SEQ ID NO: 22989 - RNA, 1185 nt, Artificial Sequence
  SAPCD2__Homo_sapiens__NP_848543
auggccggcgccgccauggccgagagaggcagagugcccccccccgcccccgcccccagcaccgagggccugcccagagccuuccugcagagccugagaacccuguucgacauccuggacgacagaagaagaggcugcgugcaccugagagagaucgagagcagauggcagggcaccgacgccagagagcugcccagaggcgugcuggagggccugagacagguggcccccgccagcggcuaccugaccuucgagagauucguggccggccugagaaccagccugcugagcgccgacggcggccccagagaccccaccagagcccccgccagacccggcgaccagccccccccccccccccagagacugguguucgcccccgccgacgagcccagaaccgugcuggagagaaagccccugccccugggcgugagagccccccuggccggccccagcgccgccgccagaagccccgagcagcugugcgcccccgccgaggccgcccccugccccgccgagcccgagagaagccagagcgccgcccuggagcccagcagcagcgccgacgccggcgccguggccugcagagcccuggaggccgacagcggcgacgccagaagagcccccagagccagaggcgagagaagaagacacaccaucgccagcggcguggacugcggccugcugaagcagaugaaggagcuggagcaggagaaggaggugcugcugcagggccuggagaugauggccagaggcagagacugguaccagcagcagcugcagagagugcaggagagacagagaagacugggccagagcagagccagcgccgacuucggcgccgccggcagccccagaccccugggcagacugcugcccaaggugcaggagguggccagaugccugggcgagcugcuggccgccgccugcgccagcagagcccugccccccagcagcagcggcccccccugccccgcccugaccagcaccagcccccccguguggcagcagcagaccauccugaugcugaaggagcagaacagacugcugacccaggaggugaccgagaagagcgagagaaucacccagcuggagcaggagaagagcgcccugaucaagcagcuguucgaggccagagcccugagccagcaggacggcggcccccuggacagcaccuucaucuaa

SEQ ID NO: 22990 - RNA, 597 nt, Artificial Sequence
  SAR1A__Homo_sapiens__NP_001136120
augagcuucaucuucgaguggaucuacaacggcuucagcagcgugcugcaguuccugggccuguacaagaagagcggcaagcugguguuccugggccuggacaacgccggcaagaccacccugcugcacaugcugaaggacgacagacugggccagcacgugcccacccugcaccccaccagcgaggagcugaccaucgccggcaugaccuucaccaccuucgaccugggcggccacgagcaggccagaagaguguggaagaacuaccugcccgccaucaacggcaucguguuccugguggacugcgccgaccacagcagacugguggagagcaagguggagcugaacgcccugaugaccgacgagaccaucagcaacgugcccauccugauccugggcaacaagaucgacagaaccgacgccaucagcgaggagaagcugagagagaucuucggccuguacggccagaccaccggcaagggcaacgugacccugaaggagcugaacgccagacccauggagguguucaugugcagcgugcugaagagacagggcuacggcgagggcuucagauggcugagccaguacaucgacuaa

SEQ ID NO: 22991 - RNA, 597 nt, Artificial Sequence
  SAR1B__Homo_sapiens__NP_001028675
augagcuucaucuucgacuggaucuacagcggcuucagcagcgugcugcaguuccugggccuguacaagaagaccggcaagcugguguuccugggccuggacaacgccggcaagaccacccugcugcacaugcugaaggacgacagacugggccagcacgugcccacccugcaccccaccagcgaggagcugaccaucgccggcaugaccuucaccaccuucgaccugggcggccacgugcaggccagaagaguguggaagaacuaccugcccgccaucaacggcaucguguuccugguggacugcgccgaccacgagagacugcuggagagcaaggaggagcuggacagccugaugaccgacgagaccaucgccaacgugcccauccugauccugggcaacaagaucgacagacccgaggccaucagcgaggagagacugagagagauguucggccuguacggccagaccaccggcaagggcagcaucagccugaaggagcugaacgccagaccccuggagguguucaugugcagcgugcugaagagacagggcuacggcgagggcuucagauggauggcccaguacaucgacuaa

SEQ ID NO: 22992 - RNA, 2757 nt, Artificial Sequence
  SARDH__Homo_sapiens__NP_001128179
auggccagccugagcagagcccugagaguggccgccgcccaccccagacagagccccaccagaggcaugggccccugcaaccugagcagcgccgccggccccaccgccgagaagagcgugcccuaccagagaacccugaaggagggccagggcaccagcgugguggcccagggccccagcagaccccugcccagcaccgccaacgugguggugaucggcggcggcagccugggcugccagacccuguaccaccuggccaagcugggcaugagcggcgccgugcugcuggagagagagagacugaccagcggcaccaccuggcacaccgccggccugcuguggcagcugagacccagcgacguggagguggagcugcuggcccacaccagaagaguggugagcagagagcuggaggaggagaccggccugcacaccggcuggauccagaacggcggccuguucaucgccagcaacagacagagacuggacgaguacaagagacugaugagccugggcaaggccuacggcguggagagccacgugcugagccccgccgagaccaagacccuguacccccugaugaacguggacgaccuguacggcacccuguacgugccccacgacggcaccauggaccccgccggcaccugcaccacccuggccagagccgccagcgccagaggcgcccaggugaucgagaacugccccgugaccggcaucagaguguggaccgacgacuucggcgugagaagaguggccggcguggagacccagcacggcagcauccagacccccugcguggugaacugcgccggcgugugggccagcgccgugggcagaauggccggcgugaaggugccccugguggccaugcaccacgccuacguggugaccgagagaaucgagggcauccagaacaugcccaacgugagagaccacgacgccagcguguaccugagacugcagggcgacgcccugagcgugggcggcuacgaggccaaccccaucuucugggaggaggugagcgacaaguucgccuucggccuguucgaccuggacugggagguguucacccagcacaucgagggcgccaucaacagagugcccgugcuggagaagaccggcaucaagagcaccgugugcggccccgagagcuucacccccgaccacaagccccugaugggcgaggcccccgagcugagaggcuucuuccugggcugcggcuucaacagcgccggcaugaugcugggcggcggcugcggccaggagcuggcccacuggaucauccacggcagacccgagaaggacaugcacggcuacgacaucagaagauuccaccacagccugaccgaccaccccagauggaucagagagagaagccacgagagcuacgccaagaacuacagcgugguguucccccacgacgagccccuggccggcagaaacaugagaagagacccccugcacgaggagcugcugggccagggcugcguguuccaggagagacacggcugggagagacccggcugguuccaccccagaggccccgcccccgugcuggaguacgacuacuacggcgccuacggcagcagagcccacgaggacuacgccuacagaagacugcuggccgacgaguacaccuucgccuuccccccccaccacgacaccaucaagaaggagugccuggccugcagaggcgccgccgccguguucgacaugagcuacuucggcaaguucuaccuggugggccuggacgccagaaaggccgccgacuggcuguucagcgccgacgugagcagaccccccggcagcaccguguacaccugcaugcugaaccacagaggcggcaccgagagcgaccugaccgugagcagacuggcccccagccaccaggccagcccccuggcccccgccuucgagggcgacggcuacuaccuggccaugggcggcgccguggcccagcacaacuggagccacaucaccaccgugcugcaggaccagaagagccagugccagcugaucgacagcagcgaggaccugggcaugaucagcauccagggccccgccagcagagccauccugcaggaggugcuggacgccgaccugagcaacgaggccuuccccuucagcacccacaagcugcugagagccgccggccaccuggugagagccaugagacugagcuucgugggcgagcugggcugggagcugcacauccccaaggccagcugcgugcccguguacagagccgugauggccgccggcgccaagcacggccugaucaacgccggcuacagagccaucgacagccugagcaucgagaagggcuacagacacuggcacgccgaccugagacccgacgacagcccccuggaggccggccuggccuucaccugcaagcugaagagccccgugcccuuccugggcagagaggcccuggagcagcagagagccgccggccugagaagaagacuggugugcuucaccauggaggacaaggugcccauguucggccuggaggccaucuggagaaacggccagguggugggccacgugagaagagccgacuucggcuucgccaucgacaagaccaucgccuacggcuacauccacgaccccagcggcggccccgugagccuggacuucgugaagagcggcgacuacgcccuggagagaaugggcgugaccuacggcgcccaggcccaccugaagagccccuucgaccccaacaacaagagagugaagggcaucuacuaa

SEQ ID NO: 22993 - RNA, 2175 nt, Artificial Sequence
  SARM1__Homo_sapiens__NP_055892
auggugcugacccugcugcugagcgccuacaagcugugcagauucuucgccaugagcggccccagacccggcgccgagagacuggccgugcccggccccgacggcggcggcggcaccggccccuggugggccgccggcggcagaggccccagagaggugagccccggcgccggcaccgaggugcaggacgcccuggagagagcccugcccgagcugcagcaggcccugagcgcccugaagcaggccggcggcgccagagccgugggcgccggccuggccgagguguuccagcugguggaggaggccuggcugcugcccgccgugggcagagagguggcccagggccugugcgacgccaucagacuggacggcggccuggaccugcugcugagacugcugcaggcccccgagcuggagaccagagugcaggccgccagacugcuggagcagauccugguggccgagaacagagacagaguggccagaaucggccugggcgugauccugaaccuggccaaggagagagagcccguggagcuggccagaagcguggccggcauccuggagcacauguucaagcacagcgaggagaccugccagagacugguggccgccggcggccuggacgccgugcuguacuggugcagaagaaccgaccccgcccugcugagacacugcgcccuggcccugggcaacugcgcccugcacggcggccaggccgugcagagaagaaugguggagaagagagccgccgaguggcuguucccccuggccuucagcaaggaggacgagcugcugagacugcacgccugccuggccguggccgugcuggccaccaacaaggagguggagagagagguggagagaagcggcacccuggcccugguggagccccugguggccagccuggaccccggcagauucgccagaugccugguggacgccagcgacaccagccagggcagaggccccgacgaccugcagagacuggugccccugcuggacagcaacagacuggaggcccagugcaucggcgccuucuaccugugcgccgaggccgccaucaagagccugcagggcaagaccaagguguucagcgacaucggcgccauccagagccugaagagacuggugagcuacagcaccaacggcaccaagagcgcccuggccaagagagcccugagacugcugggcgaggaggugcccagacccauccugcccagcgugcccagcuggaaggaggccgaggugcagaccuggcugcagcagaucggcuucagcaaguacugcgagagcuucagagagcagcagguggacggcgaccugcugcugagacugaccgaggaggagcugcagaccgaccugggcaugaagagcggcaucaccagaaagagauucuucagagagcugaccgagcugaagaccuucgccaacuacagcaccugcgacagaagcaaccuggccgacuggcugggcagccuggaccccagauucagacaguacaccuacggccuggugagcugcggccuggacagaagccugcugcacagagugagcgagcagcagcugcuggaggacugcggcauccaccugggcgugcacagagccagaauccugaccgccgccagagagaugcugcacagcccccugcccugcaccggcggcaagcccagcggcgacacccccgacguguucaucagcuacagaagaaacagcggcagccagcuggccagccugcugaaggugcaccugcagcugcacggcuucagcguguucaucgacguggagaagcuggaggccggcaaguucgaggacaagcugauccagagcgugaugggcgccagaaacuucgugcuggugcugagccccggcgcccuggacaagugcaugcaggaccacgacugcaaggacugggugcacaaggagaucgugaccgcccugagcugcggcaagaacaucgugcccaucaucgacggcuucgaguggcccgagccccaggugcugcccgaggacaugcaggccgugcugaccuucaacggcaucaaguggagccacgaguaccaggaggccaccaucgagaagaucaucagauuccugcagggcagaagcagcagagacagcagcgccggcagcgacaccagccuggagggcgccgcccccaugggccccaccuaa

SEQ ID NO: 22994 - RNA, 633 nt, Artificial Sequence
  SARNP__Homo_sapiens__NP_149073
auggccaccgagaccguggagcugcacaagcugaagcuggccgagcugaagcaggagugccuggccagaggccuggagaccaagggcaucaagcaggaccugauccacagacugcaggccuaccuggaggagcacgccgaggaggaggccaacgaggaggacgugcugggcgacgagaccgaggaggaggagaccaagcccaucgagcugcccgugaaggaggaggagccccccgagaagaccguggacguggccgccgagaagaagguggugaagaucaccagcgagaucccccagaccgagagaaugcagaagagagccgagagauucaacgugcccgugagccuggagagcaagaaggccgccagagccgccagauucggcaucagcagcgugcccaccaagggccugagcagcgacaacaagcccauggugaaccuggacaagcugaaggagagagcccagagauucggccugaacgugagcagcaucagcagaaagagcgaggacgacgagaagcugaagaagagaaaggagagauucggcaucgugaccagcagcgccggcaccggcaccaccgaggacaccgaggccaagaagagaaagagagccgagagauucggcaucgccuaa

SEQ ID NO: 22995 - RNA, 1563 nt, Artificial Sequence
  SARS2__Homo_sapiens__NP_001139373
auggccgccagcauggccagaagacuguggccccugcugaccagaagaggcuucagacccagaggcggcugcaucagcaacgacagccccagaagaagcuucaccaccgagaagagaaacagaaaccugcuguacgaguacgccagagagggcuacagcgcccugccccagcuggacaucgagagauucugcgccugccccgaggaggccgcccacgcccuggagcugagaaagggcgagcugagaagcgccgaccugcccgccaucaucagcaccuggcaggagcugagacagcugcaggagcagaucagaagccuggaggaggagaaggccgccgugaccgaggccgugagagcccugcuggccaaccaggacagcggcgaggugcagcaggugagacuggaccccggcgccggcagcaucuucggccccaccuuccugcccuuccccggccagcugagccugcugguggaggcccagcuggaggagcaguucuaccugcaggcccugaagcugcccaaccagacccaccccgacgugcccgugggcgacgagagccaggccagagugcugcacauggugggcgacaagcccguguucagcuuccagcccagaggccaccuggagaucggcgagaagcuggacaucaucagacagaagagacugagccacgugagcggccacagaagcuacuaccugagaggcgccggcgcccugcugcagcacggccuggugaacuucaccuucaacaagcugcugagaagaggcuucacccccaugaccgugcccgaccugcugagaggcgccguguucgagggcugcggcaugacccccaacgccaaccccagccagaucuacaacaucgaccccgccagauucaaggaccugaaccuggccggcaccgccgaggugggccuggccggcuacuucauggaccacaccguggccuucagagaccugcccgugagaauggugugcagcagcaccugcuacagagccgagaccaacaccggccaggagcccagaggccuguacagagugcaccacuucaccaagguggagauguucggcgugaccggccccggccuggagcagagcagccagcugcuggaggaguuccugagccugcagauggagauccugaccgagcugggccugcacuucagagugcuggacaugcccacccaggagcugggccugcccgccuacagaaaguucgacaucgaggccuggaugcccggcagaggcagauucggcgaggugaccagcgccagcaacugcaccgacuuccagagcagaagacugcacaucauguuccagaccgaggccggcgagcugcaguucgcccacaccgugaacgccaccgccugcgccgugcccagacugcugaucgcccugcuggagagcaaccagcagaaggacggcagcgugcuggugccccccgcccugcagagcuaccugggcaccgacagaaucaccgcccccacccacgugccccugcaguacaucggccccaaccagcccagaaagcccggccugcccggccagcccgccgugagcuaa
